United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 56

SEQ ID NO: 2530978 - RNA, 22 nt, Human
cccuucugacccaugcugcccu

SEQ ID NO: 2530979 - RNA, 21 nt, Human
cccuucugacccaugcugccc

SEQ ID NO: 2530980 - RNA, 16 nt, Human
ccgccaugcuccuggc

SEQ ID NO: 2530981 - RNA, 21 nt, Human
ccgccauucucaagcccugca

SEQ ID NO: 2530982 - RNA, 14 nt, Human
ccgccauugccacc

SEQ ID NO: 2530983 - RNA, 15 nt, Human
ccgccauggcuucca

SEQ ID NO: 2530984 - RNA, 21 nt, Human
ccgccagggcccacacccccu

SEQ ID NO: 2530985 - RNA, 20 nt, Human
ccgccauucucaagcccugc

SEQ ID NO: 2530986 - RNA, 20 nt, Human
ccgcccaggcuuagucacug

SEQ ID NO: 2530987 - RNA, 15 nt, Human
ccgccauugccacca

SEQ ID NO: 2530988 - RNA, 16 nt, Human
ccgccauugccaccag

SEQ ID NO: 2530989 - RNA, 19 nt, Human
ccgccauugccaccaggag

SEQ ID NO: 2530990 - RNA, 13 nt, Human
ccgcccccagucc

SEQ ID NO: 2530991 - RNA, 13 nt, Human
ccgccccacauuc

SEQ ID NO: 2530992 - RNA, 15 nt, Human
ccgccccagccucug

SEQ ID NO: 2530993 - RNA, 19 nt, Human
ccgcccccaguccccaccc

SEQ ID NO: 2530994 - RNA, 12 nt, Human
ccgcccccuccu

SEQ ID NO: 2530995 - RNA, 14 nt, Human
ccgccccagccucu

SEQ ID NO: 2530996 - RNA, 11 nt, Human
ccgcccccugc

SEQ ID NO: 2530997 - RNA, 17 nt, Human
ccgcccccugcccuccc

SEQ ID NO: 2530998 - RNA, 16 nt, Human
ccgcccccugcccucc

SEQ ID NO: 2530999 - RNA, 16 nt, Human
cccuucugucccucac

SEQ ID NO: 2531000 - RNA, 17 nt, Human
cccuucugucccucaca

SEQ ID NO: 2531001 - RNA, 22 nt, Human
cccuucugggcaucuguucugg

SEQ ID NO: 2531002 - RNA, 21 nt, Human
cccuucugggcaucuguucug

SEQ ID NO: 2531003 - RNA, 20 nt, Human
cccuucugggcaucuguucu

SEQ ID NO: 2531004 - RNA, 13 nt, Human
cccuucugcuacu

SEQ ID NO: 2531005 - RNA, 14 nt, Human
cccuucugcucagc

SEQ ID NO: 2531006 - RNA, 23 nt, Human
cccuucugcucagcucugggcca

SEQ ID NO: 2531007 - RNA, 17 nt, Human
cccuucuuuccacagaa

SEQ ID NO: 2531008 - RNA, 20 nt, Human
ccgaauagcugggacuacag

SEQ ID NO: 2531009 - RNA, 18 nt, Human
ccgacaaccgaugcucca

SEQ ID NO: 2531010 - RNA, 20 nt, Human
ccgacaaccgaugcuccagc

SEQ ID NO: 2531011 - RNA, 20 nt, Human
ccgaaugugcagguuuguua

SEQ ID NO: 2531012 - RNA, 15 nt, Human
ccgacaaccgaugcu

SEQ ID NO: 2531013 - RNA, 13 nt, Human
ccgaccagagccc

SEQ ID NO: 2531014 - RNA, 18 nt, Human
ccgaauccccucccuguc

SEQ ID NO: 2531015 - RNA, 16 nt, Human
ccgaauccccucccug

SEQ ID NO: 2531016 - RNA, 21 nt, Human
cccuucuuggugcuuacacau

SEQ ID NO: 2531017 - RNA, 13 nt, Human
ccgaaugugcagg

SEQ ID NO: 2531018 - RNA, 19 nt, Human
ccgaauccccucccuguca

SEQ ID NO: 2531019 - RNA, 23 nt, Human
ccgaaucucuuuuugcuuucgaa

SEQ ID NO: 2531020 - RNA, 16 nt, Human
ccgacccuugccgucu

SEQ ID NO: 2531021 - RNA, 19 nt, Human
ccgaccgaggcuggagcug

SEQ ID NO: 2531022 - RNA, 12 nt, Human
ccgaccucagcc

SEQ ID NO: 2531023 - RNA, 13 nt, Human
ccgaccucagccu

SEQ ID NO: 2531024 - RNA, 17 nt, Human
ccgccaaggcuggggga

SEQ ID NO: 2531025 - RNA, 14 nt, Human
ccgaccucagccuu

SEQ ID NO: 2531026 - RNA, 15 nt, Human
ccgaccucagccuuc

SEQ ID NO: 2531027 - RNA, 21 nt, Human
ccgaccgaggcuggagcuggc

SEQ ID NO: 2531028 - RNA, 13 nt, Human
ccgaccucguccu

SEQ ID NO: 2531029 - RNA, 19 nt, Human
ccgaccucguccucccccu

SEQ ID NO: 2531030 - RNA, 15 nt, Human
ccgccagccuccucu

SEQ ID NO: 2531031 - RNA, 14 nt, Human
ccgccagccuccuc

SEQ ID NO: 2531032 - RNA, 13 nt, Human
ccgccagccuccu

SEQ ID NO: 2531033 - RNA, 12 nt, Human
ccgccagccucc

SEQ ID NO: 2531034 - RNA, 11 nt, Human
ccgccagccuc

SEQ ID NO: 2531035 - RNA, 19 nt, Human
ccgccagauggggccucug

SEQ ID NO: 2531036 - RNA, 16 nt, Human
ccgccagauggggccu

SEQ ID NO: 2531037 - RNA, 23 nt, Human
ccgccagccuccucuggacggca

SEQ ID NO: 2531038 - RNA, 18 nt, Human
ccgccagccuccucugga

SEQ ID NO: 2531039 - RNA, 12 nt, Human
ccgccaggcgag

SEQ ID NO: 2531040 - RNA, 12 nt, Human
ccgccagggccc

SEQ ID NO: 2531041 - RNA, 16 nt, Human
ccgccacuccugaacc

SEQ ID NO: 2531042 - RNA, 23 nt, Human
ccgccaccuaucucgugggagag

SEQ ID NO: 2531043 - RNA, 17 nt, Human
ccgccaccuaucucgug

SEQ ID NO: 2531044 - RNA, 23 nt, Human
ccgccacauggcuuccuccugcg

SEQ ID NO: 2531045 - RNA, 16 nt, Human
ccgccagacuguuaga

SEQ ID NO: 2531046 - RNA, 23 nt, Human
ccgccaagguagccaucccauga

SEQ ID NO: 2531047 - RNA, 15 nt, Human
ccgcauucccugagu

SEQ ID NO: 2531048 - RNA, 23 nt, Human
ccgcauucccugagucaccagga

SEQ ID NO: 2531049 - RNA, 21 nt, Human
ccgccaaaagcugcucaggga

SEQ ID NO: 2531050 - RNA, 20 nt, Human
ccccucuggucgcuccugcc

SEQ ID NO: 2531051 - RNA, 19 nt, Human
ccccucuggucgcuccugc

SEQ ID NO: 2531052 - RNA, 23 nt, Human
ccccucuggucgcuccugcccac

SEQ ID NO: 2531053 - RNA, 12 nt, Human
ccccucugucca

SEQ ID NO: 2531054 - RNA, 12 nt, Human
ccccucuggucg

SEQ ID NO: 2531055 - RNA, 18 nt, Human
ccccucuggcuccagcug

SEQ ID NO: 2531056 - RNA, 19 nt, Human
ccccucuggcuccagcugg

SEQ ID NO: 2531057 - RNA, 19 nt, Human
cccgggagcugcugcccug

SEQ ID NO: 2531058 - RNA, 17 nt, Human
cccuauugguaaagaau

SEQ ID NO: 2531059 - RNA, 18 nt, Human
cccuauuagagaagagau

SEQ ID NO: 2531060 - RNA, 23 nt, Human
cccgggaggcagagguugcagug

SEQ ID NO: 2531061 - RNA, 22 nt, Human
cccgggaagggggcugggacau

SEQ ID NO: 2531062 - RNA, 18 nt, Human
cccgggacgcagcaggag

SEQ ID NO: 2531063 - RNA, 23 nt, Human
cccgggacgcagggguugcagug

SEQ ID NO: 2531064 - RNA, 17 nt, Human
cccggcucccaccgagg

SEQ ID NO: 2531065 - RNA, 17 nt, Human
cccggccaccugcggug

SEQ ID NO: 2531066 - RNA, 21 nt, Human
cccggcugcagaggccagagg

SEQ ID NO: 2531067 - RNA, 16 nt, Human
cccggcugcagaggcc

SEQ ID NO: 2531068 - RNA, 22 nt, Human
cccggcucgagcaguccugccu

SEQ ID NO: 2531069 - RNA, 16 nt, Human
cccggcuccaggcucc

SEQ ID NO: 2531070 - RNA, 15 nt, Human
cccggcuccaggcuc

SEQ ID NO: 2531071 - RNA, 14 nt, Human
cccggcuccaggcu

SEQ ID NO: 2531072 - RNA, 13 nt, Human
cccggcuccaggc

SEQ ID NO: 2531073 - RNA, 14 nt, Human
cccggccaccugcg

SEQ ID NO: 2531074 - RNA, 13 nt, Human
cccggccaccugc

SEQ ID NO: 2531075 - RNA, 12 nt, Human
cccggcuccagg

SEQ ID NO: 2531076 - RNA, 11 nt, Human
cccggcuccag

SEQ ID NO: 2531077 - RNA, 23 nt, Human
ccccuugcccuugcccugaccuc

SEQ ID NO: 2531078 - RNA, 21 nt, Human
ccccuugcccuugcccugacc

SEQ ID NO: 2531079 - RNA, 19 nt, Human
ccccuugcccuugcccuga

SEQ ID NO: 2531080 - RNA, 18 nt, Human
ccccuugcccuugcccug

SEQ ID NO: 2531081 - RNA, 17 nt, Human
ccccuugcccuugcccu

SEQ ID NO: 2531082 - RNA, 23 nt, Human
ccccuugcccagggcucagccug

SEQ ID NO: 2531083 - RNA, 17 nt, Human
ccccuugcccagggcuc

SEQ ID NO: 2531084 - RNA, 20 nt, Human
ccccuugcccagggcucagc

SEQ ID NO: 2531085 - RNA, 21 nt, Human
ccccuugcccagggcucagcc

SEQ ID NO: 2531086 - RNA, 14 nt, Human
ccccucuguccagg

SEQ ID NO: 2531087 - RNA, 22 nt, Human
ccccucuguccaggcacugaga

SEQ ID NO: 2531088 - RNA, 12 nt, Human
ccccucugucuu

SEQ ID NO: 2531089 - RNA, 15 nt, Human
ccccucuugccccaa

SEQ ID NO: 2531090 - RNA, 14 nt, Human
ccccucuugcccca

SEQ ID NO: 2531091 - RNA, 13 nt, Human
ccccucuugcccc

SEQ ID NO: 2531092 - RNA, 12 nt, Human
ccccucuugccc

SEQ ID NO: 2531093 - RNA, 24 nt, Human
ccccuuucagaugucuucugccug

SEQ ID NO: 2531094 - RNA, 22 nt, Human
ccccuuuccuggacacucagac

SEQ ID NO: 2531095 - RNA, 10 nt, Human
ccccuuuccu

SEQ ID NO: 2531096 - RNA, 23 nt, Human
ccccuuuccuggacacucagacc

SEQ ID NO: 2531097 - RNA, 13 nt, Human
ccccuugggcggc

SEQ ID NO: 2531098 - RNA, 24 nt, Human
ccccuugcccuugcccugaccucc

SEQ ID NO: 2531099 - RNA, 22 nt, Human
ccccuugcucuccccugcccug

SEQ ID NO: 2531100 - RNA, 18 nt, Human
ccccuuguccuuucccuu

SEQ ID NO: 2531101 - RNA, 15 nt, Human
ccccuuguccuuucc

SEQ ID NO: 2531102 - RNA, 15 nt, Human
ccccuugggcggcug

SEQ ID NO: 2531103 - RNA, 21 nt, Human
cccggccaccucugcggaccc

SEQ ID NO: 2531104 - RNA, 20 nt, Human
cccggccaccucugcggacc

SEQ ID NO: 2531105 - RNA, 15 nt, Human
cccggccaccucugc

SEQ ID NO: 2531106 - RNA, 14 nt, Human
cccggccaccucug

SEQ ID NO: 2531107 - RNA, 13 nt, Human
cccggccaccucu

SEQ ID NO: 2531108 - RNA, 12 nt, Human
cccggccaccuc

SEQ ID NO: 2531109 - RNA, 17 nt, Human
cccggcaugggaaagcc

SEQ ID NO: 2531110 - RNA, 23 nt, Human
cccgaauacaaacaccuggacuu

SEQ ID NO: 2531111 - RNA, 20 nt, Human
cccgaauacaaacaccugga

SEQ ID NO: 2531112 - RNA, 14 nt, Human
cccgaauacaaaca

SEQ ID NO: 2531113 - RNA, 14 nt, Human
cccgaauagcuggg

SEQ ID NO: 2531114 - RNA, 16 nt, Human
ccccuuugugcugugg

SEQ ID NO: 2531115 - RNA, 15 nt, Human
ccccuuugugcugug

SEQ ID NO: 2531116 - RNA, 13 nt, Human
ccccuuugugcug

SEQ ID NO: 2531117 - RNA, 12 nt, Human
ccccuuugugcu

SEQ ID NO: 2531118 - RNA, 20 nt, Human
ccccuuugggcccagggaca

SEQ ID NO: 2531119 - RNA, 18 nt, Human
ccccuuugggcccaggga

SEQ ID NO: 2531120 - RNA, 17 nt, Human
ccccuuugggcccaggg

SEQ ID NO: 2531121 - RNA, 16 nt, Human
ccccuuugggcccagg

SEQ ID NO: 2531122 - RNA, 13 nt, Human
ccccuuugggccc

SEQ ID NO: 2531123 - RNA, 20 nt, Human
ccccuuugaugauuaauuca

SEQ ID NO: 2531124 - RNA, 22 nt, Human
ccccuuuucagcuucugcuggg

SEQ ID NO: 2531125 - RNA, 19 nt, Human
ccccuuuucagcuucugcu

SEQ ID NO: 2531126 - RNA, 17 nt, Human
ccccuuuucagcuucug

SEQ ID NO: 2531127 - RNA, 16 nt, Human
ccccuuuucagcuucu

SEQ ID NO: 2531128 - RNA, 16 nt, Human
ccccuuuucugcauuu

SEQ ID NO: 2531129 - RNA, 14 nt, Human
ccccuuuucugcau

SEQ ID NO: 2531130 - RNA, 20 nt, Human
ccccuuuucuuuucuacccu

SEQ ID NO: 2531131 - RNA, 19 nt, Human
ccccuuuucuuuucuaccc

SEQ ID NO: 2531132 - RNA, 17 nt, Human
ccccuuuucuuuucuac

SEQ ID NO: 2531133 - RNA, 15 nt, Human
ccccuuuucuuuucu

SEQ ID NO: 2531134 - RNA, 18 nt, Human
ccccuuuuuacuccccuu

SEQ ID NO: 2531135 - RNA, 19 nt, Human
ccccuuuuuacuccccuug

SEQ ID NO: 2531136 - RNA, 23 nt, Human
ccccuuuucuuuucuacccuagc

SEQ ID NO: 2531137 - RNA, 23 nt, Human
ccccgaggccuucucugaaggac

SEQ ID NO: 2531138 - RNA, 23 nt, Human
ccccgcucugcaugcggcccagc

SEQ ID NO: 2531139 - RNA, 21 nt, Human
ccccgcucugcaugcggccca

SEQ ID NO: 2531140 - RNA, 14 nt, Human
ccccgcucugcaug

SEQ ID NO: 2531141 - RNA, 17 nt, Human
ccccgaggacccagacc

SEQ ID NO: 2531142 - RNA, 13 nt, Human
ccccgcucugcau

SEQ ID NO: 2531143 - RNA, 13 nt, Human
ccccgagcugggg

SEQ ID NO: 2531144 - RNA, 21 nt, Human
cccccaacacugugcccuggu

SEQ ID NO: 2531145 - RNA, 20 nt, Human
cccccaacacugugcccugg

SEQ ID NO: 2531146 - RNA, 12 nt, Human
ccccgagcuggg

SEQ ID NO: 2531147 - RNA, 14 nt, Human
ccccggaguucagu

SEQ ID NO: 2531148 - RNA, 14 nt, Human
ccccggcagacgcc

SEQ ID NO: 2531149 - RNA, 22 nt, Human
ccccgcucugcaugcggcccag

SEQ ID NO: 2531150 - RNA, 14 nt, Human
ccccgcuucugccu

SEQ ID NO: 2531151 - RNA, 15 nt, Human
ccccgcuuguccagc

SEQ ID NO: 2531152 - RNA, 17 nt, Human
ccccgcuuguccagcgc

SEQ ID NO: 2531153 - RNA, 18 nt, Human
ccccgcuuguccagcgcc

SEQ ID NO: 2531154 - RNA, 19 nt, Human
ccccgcuuguccagcgccu

SEQ ID NO: 2531155 - RNA, 15 nt, Human
ccccggccaccucug

SEQ ID NO: 2531156 - RNA, 14 nt, Human
ccccggccaccucu

SEQ ID NO: 2531157 - RNA, 13 nt, Human
ccccggccaccuc

SEQ ID NO: 2531158 - RNA, 12 nt, Human
ccccggccaccu

SEQ ID NO: 2531159 - RNA, 17 nt, Human
ccccggccaccucugcg

SEQ ID NO: 2531160 - RNA, 16 nt, Human
ccccggccaccucugc

SEQ ID NO: 2531161 - RNA, 15 nt, Human
cccauugucccucug

SEQ ID NO: 2531162 - RNA, 18 nt, Human
cccauugucccucugccc

SEQ ID NO: 2531163 - RNA, 14 nt, Human
cccauugucccucu

SEQ ID NO: 2531164 - RNA, 22 nt, Human
cccauuguggucacaggaagua

SEQ ID NO: 2531165 - RNA, 23 nt, Human
cccauuguggucacaggaaguag

SEQ ID NO: 2531166 - RNA, 22 nt, Human
ccccaaaacucuccucugcugc

SEQ ID NO: 2531167 - RNA, 23 nt, Human
ccccaaaacucuccucugcugcu

SEQ ID NO: 2531168 - RNA, 21 nt, Human
ccccaaaacucuccucugcug

SEQ ID NO: 2531169 - RNA, 19 nt, Human
cccauuguggcuccuaucu

SEQ ID NO: 2531170 - RNA, 20 nt, Human
cccauugucccucugcccca

SEQ ID NO: 2531171 - RNA, 15 nt, Human
cccauuguggcuccu

SEQ ID NO: 2531172 - RNA, 21 nt, Human
ccccagacuccaccaagccug

SEQ ID NO: 2531173 - RNA, 20 nt, Human
ccccagacuccaccaagccu

SEQ ID NO: 2531174 - RNA, 19 nt, Human
ccccaaaccugcaagggcu

SEQ ID NO: 2531175 - RNA, 22 nt, Human
ccccaaacaccuuccagcuccu

SEQ ID NO: 2531176 - RNA, 18 nt, Human
ccccaaacaccuuccagc

SEQ ID NO: 2531177 - RNA, 19 nt, Human
ccccaaacgggcugcccug

SEQ ID NO: 2531178 - RNA, 23 nt, Human
ccccgacccuugccgucuaccug

SEQ ID NO: 2531179 - RNA, 15 nt, Human
ccccauuuucugugg

SEQ ID NO: 2531180 - RNA, 16 nt, Human
cccccaacacugugcc

SEQ ID NO: 2531181 - RNA, 20 nt, Human
ccccauuucuauuuauuuac

SEQ ID NO: 2531182 - RNA, 17 nt, Human
ccccauuucuauuuauu

SEQ ID NO: 2531183 - RNA, 22 nt, Human
cccccaaauggaaaugggcaga

SEQ ID NO: 2531184 - RNA, 19 nt, Human
ccccauuucccaucugcac

SEQ ID NO: 2531185 - RNA, 18 nt, Human
ccccauuucccaucugca

SEQ ID NO: 2531186 - RNA, 17 nt, Human
ccccauuucccaucugc

SEQ ID NO: 2531187 - RNA, 16 nt, Human
ccccauuucccaucug

SEQ ID NO: 2531188 - RNA, 22 nt, Human
ccccauuucccaucugcacccc

SEQ ID NO: 2531189 - RNA, 20 nt, Human
ccccauuucccaucugcacc

SEQ ID NO: 2531190 - RNA, 13 nt, Human
ccccauuucuauu

SEQ ID NO: 2531191 - RNA, 18 nt, Human
ccccaucugcccaggacg

SEQ ID NO: 2531192 - RNA, 17 nt, Human
ccccaucugcccaggac

SEQ ID NO: 2531193 - RNA, 14 nt, Human
ccccaucugcccag

SEQ ID NO: 2531194 - RNA, 21 nt, Human
ccccauuuauccaccuccauc

SEQ ID NO: 2531195 - RNA, 17 nt, Human
ccccauuuauccaccuc

SEQ ID NO: 2531196 - RNA, 18 nt, Human
ccccauuuagguuucuga

SEQ ID NO: 2531197 - RNA, 13 nt, Human
ccccaucugccca

SEQ ID NO: 2531198 - RNA, 19 nt, Human
ccccaucucucccuccccu

SEQ ID NO: 2531199 - RNA, 12 nt, Human
ccccaucucucc

SEQ ID NO: 2531200 - RNA, 16 nt, Human
ccccaucucucccucc

SEQ ID NO: 2531201 - RNA, 21 nt, Human
ccccaucucaugccccuggcu

SEQ ID NO: 2531202 - RNA, 23 nt, Human
ccccaucucaugccccuggcugg

SEQ ID NO: 2531203 - RNA, 14 nt, Human
ccccaucucuacua

SEQ ID NO: 2531204 - RNA, 19 nt, Human
ccccagcacccgggcucag

SEQ ID NO: 2531205 - RNA, 15 nt, Human
ccccagcacccgggc

SEQ ID NO: 2531206 - RNA, 13 nt, Human
ccccagcacccgg

SEQ ID NO: 2531207 - RNA, 18 nt, Human
ccccagaggccucucucu

SEQ ID NO: 2531208 - RNA, 22 nt, Human
ccccagcaagugagagcugggu

SEQ ID NO: 2531209 - RNA, 17 nt, Human
ccccauccuggcccauc

SEQ ID NO: 2531210 - RNA, 16 nt, Human
ccccauccuggcccau

SEQ ID NO: 2531211 - RNA, 15 nt, Human
ccccauccuggccca

SEQ ID NO: 2531212 - RNA, 14 nt, Human
ccccauccuggccc

SEQ ID NO: 2531213 - RNA, 13 nt, Human
ccccauccuggcc

SEQ ID NO: 2531214 - RNA, 15 nt, Human
ccccagcacugagga

SEQ ID NO: 2531215 - RNA, 13 nt, Human
ccccagcacugag

SEQ ID NO: 2531216 - RNA, 12 nt, Human
ccccagcacuga

SEQ ID NO: 2531217 - RNA, 11 nt, Human
ccccagcacua

SEQ ID NO: 2531218 - RNA, 19 nt, Human
ccccagcacuaaagcagug

SEQ ID NO: 2531219 - RNA, 21 nt, Human
ccccagcaagugagagcuggg

SEQ ID NO: 2531220 - RNA, 12 nt, Human
ccccagagcugu

SEQ ID NO: 2531221 - RNA, 21 nt, Human
ccccagagcuguuuauggccu

SEQ ID NO: 2531222 - RNA, 22 nt, Human
ccccagagcuguuuauggccuc

SEQ ID NO: 2531223 - RNA, 23 nt, Human
ccccagagcuguuuauggccuca

SEQ ID NO: 2531224 - RNA, 11 nt, Human
ccccagagcug

SEQ ID NO: 2531225 - RNA, 13 nt, Human
ccccagagcacug

SEQ ID NO: 2531226 - RNA, 10 nt, Human
ccccagagac

SEQ ID NO: 2531227 - RNA, 21 nt, Human
ccccagagacucagagggagg

SEQ ID NO: 2531228 - RNA, 15 nt, Human
cccacuucccugggc

SEQ ID NO: 2531229 - RNA, 22 nt, Human
cccacccaagggccuggccuga

SEQ ID NO: 2531230 - RNA, 21 nt, Human
cccacccaagggccuggccug

SEQ ID NO: 2531231 - RNA, 20 nt, Human
cccacccaagggccuggccu

SEQ ID NO: 2531232 - RNA, 15 nt, Human
cccacccccacccaa

SEQ ID NO: 2531233 - RNA, 12 nt, Human
cccacccccacc

SEQ ID NO: 2531234 - RNA, 18 nt, Human
cccacccaagggccuggc

SEQ ID NO: 2531235 - RNA, 17 nt, Human
cccacccccacccaagg

SEQ ID NO: 2531236 - RNA, 18 nt, Human
cccacccccacccccacc

SEQ ID NO: 2531237 - RNA, 22 nt, Human
cccacccacaauccuauucucg

SEQ ID NO: 2531238 - RNA, 13 nt, Human
cccacccccagcu

SEQ ID NO: 2531239 - RNA, 12 nt, Human
cccacccccauc

SEQ ID NO: 2531240 - RNA, 18 nt, Human
cccacccugaaagcccug

SEQ ID NO: 2531241 - RNA, 15 nt, Human
cccacccuccugucu

SEQ ID NO: 2531242 - RNA, 14 nt, Human
cccacccuccuguc

SEQ ID NO: 2531243 - RNA, 13 nt, Human
cccacccuccugu

SEQ ID NO: 2531244 - RNA, 16 nt, Human
cccacccucccuggag

SEQ ID NO: 2531245 - RNA, 19 nt, Human
cccacccuccugucuuccc

SEQ ID NO: 2531246 - RNA, 12 nt, Human
cccacccccuca

SEQ ID NO: 2531247 - RNA, 15 nt, Human
cccacccccaccccc

SEQ ID NO: 2531248 - RNA, 13 nt, Human
cccaccccccuca

SEQ ID NO: 2531249 - RNA, 18 nt, Human
cccacccucccuggagug

SEQ ID NO: 2531250 - RNA, 15 nt, Human
cccacccucccugga

SEQ ID NO: 2531251 - RNA, 14 nt, Human
cccaccccccucau

SEQ ID NO: 2531252 - RNA, 18 nt, Human
cccacucagcuccgugaa

SEQ ID NO: 2531253 - RNA, 16 nt, Human
cccacucaagccaagc

SEQ ID NO: 2531254 - RNA, 17 nt, Human
cccacucaagccaagca

SEQ ID NO: 2531255 - RNA, 19 nt, Human
cccacucaagccaagcagc

SEQ ID NO: 2531256 - RNA, 20 nt, Human
cccacucaagccaagcagcc

SEQ ID NO: 2531257 - RNA, 23 nt, Human
cccacucaagccaagcagccaag

SEQ ID NO: 2531258 - RNA, 20 nt, Human
cccacguucucacacccacc

SEQ ID NO: 2531259 - RNA, 17 nt, Human
cccacguucucacaccc

SEQ ID NO: 2531260 - RNA, 16 nt, Human
cccacguucucacacc

SEQ ID NO: 2531261 - RNA, 18 nt, Human
cccacuagacccacugga

SEQ ID NO: 2531262 - RNA, 21 nt, Human
cccacguucucacacccaccg

SEQ ID NO: 2531263 - RNA, 18 nt, Human
cccacugcacccccuccu

SEQ ID NO: 2531264 - RNA, 17 nt, Human
cccacuccccaccuuca

SEQ ID NO: 2531265 - RNA, 22 nt, Human
cccacugcacccccuccugcug

SEQ ID NO: 2531266 - RNA, 21 nt, Human
cccacugcacccccuccugcu

SEQ ID NO: 2531267 - RNA, 20 nt, Human
cccacugcacccccuccugc

SEQ ID NO: 2531268 - RNA, 19 nt, Human
cccacugcacccccuccug

SEQ ID NO: 2531269 - RNA, 23 nt, Human
cccacugcacccccuccugcugc

SEQ ID NO: 2531270 - RNA, 15 nt, Human
cccacugcaggcccc

SEQ ID NO: 2531271 - RNA, 23 nt, Human
cccacugcaggccccgcuugucc

SEQ ID NO: 2531272 - RNA, 12 nt, Human
cccacugcccac

SEQ ID NO: 2531273 - RNA, 17 nt, Human
cccacugccauaaaaca

SEQ ID NO: 2531274 - RNA, 19 nt, Human
cccacugcaggccccgcuu

SEQ ID NO: 2531275 - RNA, 22 nt, Human
cccacugcccacccccucaagc

SEQ ID NO: 2531276 - RNA, 19 nt, Human
cccacugcccacccccuca

SEQ ID NO: 2531277 - RNA, 17 nt, Human
cccacugcccacccccu

SEQ ID NO: 2531278 - RNA, 16 nt, Human
cccacugcccaccccc

SEQ ID NO: 2531279 - RNA, 15 nt, Human
cccacugccucaggu

SEQ ID NO: 2531280 - RNA, 18 nt, Human
cccacugccuacugcauc

SEQ ID NO: 2531281 - RNA, 16 nt, Human
cccacugccucagguu

SEQ ID NO: 2531282 - RNA, 13 nt, Human
cccacugccugcc

SEQ ID NO: 2531283 - RNA, 12 nt, Human
cccacuuccugu

SEQ ID NO: 2531284 - RNA, 24 nt, Human
cccacuucccugacacugcggggc

SEQ ID NO: 2531285 - RNA, 20 nt, Human
cccacuucccugacacugcg

SEQ ID NO: 2531286 - RNA, 19 nt, Human
cccacuucccugacacugc

SEQ ID NO: 2531287 - RNA, 17 nt, Human
cccacuucccugacacu

SEQ ID NO: 2531288 - RNA, 16 nt, Human
cccacuucccugacac

SEQ ID NO: 2531289 - RNA, 12 nt, Human
cccacuucccug

SEQ ID NO: 2531290 - RNA, 23 nt, Human
cccacuuccccuccuaccccucc

SEQ ID NO: 2531291 - RNA, 19 nt, Human
cccacuuccccuccuaccc

SEQ ID NO: 2531292 - RNA, 17 nt, Human
cccacuuccccuccuac

SEQ ID NO: 2531293 - RNA, 15 nt, Human
cccacuuccccuccu

SEQ ID NO: 2531294 - RNA, 14 nt, Human
cccacuuccccucc

SEQ ID NO: 2531295 - RNA, 23 nt, Human
cccacuguccugggcgcccugga

SEQ ID NO: 2531296 - RNA, 22 nt, Human
cccacuguccugggcgcccugg

SEQ ID NO: 2531297 - RNA, 18 nt, Human
cccacuguccugggcgcc

SEQ ID NO: 2531298 - RNA, 13 nt, Human
cccacugcucccc

SEQ ID NO: 2531299 - RNA, 16 nt, Human
cccacugccugcccac

SEQ ID NO: 2531300 - RNA, 13 nt, Human
cccacugcucugg

SEQ ID NO: 2531301 - RNA, 12 nt, Human
cccacugcucug

SEQ ID NO: 2531302 - RNA, 19 nt, Human
cccacugcuuuuggucugu

SEQ ID NO: 2531303 - RNA, 17 nt, Human
cccacuguccugggcgc

SEQ ID NO: 2531304 - RNA, 14 nt, Human
cccacugccuuuga

SEQ ID NO: 2531305 - RNA, 14 nt, Human
cccacugccugccc

SEQ ID NO: 2531306 - RNA, 15 nt, Human
cccacugccugccca

SEQ ID NO: 2531307 - RNA, 17 nt, Human
cccagcugacauggaaa

SEQ ID NO: 2531308 - RNA, 13 nt, Human
cccagcugcaccu

SEQ ID NO: 2531309 - RNA, 18 nt, Human
cccagcugcaccugccag

SEQ ID NO: 2531310 - RNA, 21 nt, Human
cccagcugcaccugccagccu

SEQ ID NO: 2531311 - RNA, 22 nt, Human
cccagcugcaccugccagccug

SEQ ID NO: 2531312 - RNA, 22 nt, Human
cccagcuuaaaggggcuagagu

SEQ ID NO: 2531313 - RNA, 22 nt, Human
cccagcucuggugagucuuggc

SEQ ID NO: 2531314 - RNA, 20 nt, Human
cccagcucuggugagucuug

SEQ ID NO: 2531315 - RNA, 15 nt, Human
cccagcucuggugag

SEQ ID NO: 2531316 - RNA, 13 nt, Human
cccagcucuggug

SEQ ID NO: 2531317 - RNA, 22 nt, Human
cccagccagauggacuccagcc

SEQ ID NO: 2531318 - RNA, 22 nt, Human
cccagccagaguuccugcggag

SEQ ID NO: 2531319 - RNA, 21 nt, Human
cccagcugacaguccucucca

SEQ ID NO: 2531320 - RNA, 19 nt, Human
cccagcugacaguccucuc

SEQ ID NO: 2531321 - RNA, 17 nt, Human
cccagcugacaguccuc

SEQ ID NO: 2531322 - RNA, 20 nt, Human
cccagcucuucuccccaggu

SEQ ID NO: 2531323 - RNA, 15 nt, Human
cccagcugacaugga

SEQ ID NO: 2531324 - RNA, 22 nt, Human
cccagcugacaguccucuccac

SEQ ID NO: 2531325 - RNA, 12 nt, Human
cccagcugcacc

SEQ ID NO: 2531326 - RNA, 23 nt, Human
cccagcucugguccauagagagc

SEQ ID NO: 2531327 - RNA, 18 nt, Human
cccagccagaguuccugc

SEQ ID NO: 2531328 - RNA, 17 nt, Human
cccagccagaguuccug

SEQ ID NO: 2531329 - RNA, 22 nt, Human
cccagccaccccgggcucucug

SEQ ID NO: 2531330 - RNA, 14 nt, Human
cccagccaccccgg

SEQ ID NO: 2531331 - RNA, 19 nt, Human
cccagccaccccgggcucu

SEQ ID NO: 2531332 - RNA, 13 nt, Human
cccauccucugua

SEQ ID NO: 2531333 - RNA, 22 nt, Human
cccauccuccccuucccugcaa

SEQ ID NO: 2531334 - RNA, 14 nt, Human
cccauccuccccuu

SEQ ID NO: 2531335 - RNA, 15 nt, Human
cccauccuccccuuc

SEQ ID NO: 2531336 - RNA, 16 nt, Human
cccauccuccccuucc

SEQ ID NO: 2531337 - RNA, 18 nt, Human
cccauccuccccuucccu

SEQ ID NO: 2531338 - RNA, 23 nt, Human
cccauccuacccucgggcccacc

SEQ ID NO: 2531339 - RNA, 18 nt, Human
cccauccuacccucgggc

SEQ ID NO: 2531340 - RNA, 22 nt, Human
cccauccuaucagccugucucu

SEQ ID NO: 2531341 - RNA, 14 nt, Human
cccauccuccagca

SEQ ID NO: 2531342 - RNA, 15 nt, Human
cccauccuccagcag

SEQ ID NO: 2531343 - RNA, 16 nt, Human
cccauccuccagcagg

SEQ ID NO: 2531344 - RNA, 18 nt, Human
cccauccuccagcaggga

SEQ ID NO: 2531345 - RNA, 17 nt, Human
cccauccuccagcuucu

SEQ ID NO: 2531346 - RNA, 16 nt, Human
cccauccuccagcuuc

SEQ ID NO: 2531347 - RNA, 15 nt, Human
cccauccuccagcuu

SEQ ID NO: 2531348 - RNA, 14 nt, Human
cccauccuccagcu

SEQ ID NO: 2531349 - RNA, 19 nt, Human
cccauccuccagcuucugg

SEQ ID NO: 2531350 - RNA, 12 nt, Human
cccauccucccc

SEQ ID NO: 2531351 - RNA, 13 nt, Human
cccauccuccccu

SEQ ID NO: 2531352 - RNA, 17 nt, Human
cccaggcuggcgugcag

SEQ ID NO: 2531353 - RNA, 20 nt, Human
cccaggcuggccagccccac

SEQ ID NO: 2531354 - RNA, 19 nt, Human
cccaggcuggccagcccca

SEQ ID NO: 2531355 - RNA, 17 nt, Human
cccaggcuggccagccc

SEQ ID NO: 2531356 - RNA, 16 nt, Human
cccaggcuggccagcc

SEQ ID NO: 2531357 - RNA, 23 nt, Human
cccaggcuggccagccccacagc

SEQ ID NO: 2531358 - RNA, 22 nt, Human
cccaggcuggccagccccacag

SEQ ID NO: 2531359 - RNA, 21 nt, Human
cccagggccagggcccugcag

SEQ ID NO: 2531360 - RNA, 19 nt, Human
cccaggcuggagugcagug

SEQ ID NO: 2531361 - RNA, 15 nt, Human
cccaggcuggccagc

SEQ ID NO: 2531362 - RNA, 13 nt, Human
cccaggcuggcca

SEQ ID NO: 2531363 - RNA, 20 nt, Human
cccaggcuggagugcaaugg

SEQ ID NO: 2531364 - RNA, 13 nt, Human
cccaggcuggcgu

SEQ ID NO: 2531365 - RNA, 22 nt, Human
cccagcuuugcccaacaccagc

SEQ ID NO: 2531366 - RNA, 20 nt, Human
cccaggcuggagugcaauga

SEQ ID NO: 2531367 - RNA, 16 nt, Human
cccaggaaaggcccag

SEQ ID NO: 2531368 - RNA, 18 nt, Human
cccagcuuugcccaacac

SEQ ID NO: 2531369 - RNA, 13 nt, Human
cccagcuuugccc

SEQ ID NO: 2531370 - RNA, 23 nt, Human
cccagcuugggcccagcugggcu

SEQ ID NO: 2531371 - RNA, 22 nt, Human
cccagcuugggcccagcugggc

SEQ ID NO: 2531372 - RNA, 20 nt, Human
cccagcuugggcccagcugg

SEQ ID NO: 2531373 - RNA, 19 nt, Human
cccagcuugggcccagcug

SEQ ID NO: 2531374 - RNA, 15 nt, Human
cccagcuugaaaccu

SEQ ID NO: 2531375 - RNA, 23 nt, Human
cccagcugcaccugccagccugg

SEQ ID NO: 2531376 - RNA, 16 nt, Human
cccagggcccagagcc

SEQ ID NO: 2531377 - RNA, 17 nt, Human
cccagggcccagagccc

SEQ ID NO: 2531378 - RNA, 19 nt, Human
cccagggcccagagcccag

SEQ ID NO: 2531379 - RNA, 20 nt, Human
cccagggcccagagcccagc

SEQ ID NO: 2531380 - RNA, 14 nt, Human
cccagggcccagag

SEQ ID NO: 2531381 - RNA, 15 nt, Human
cccagggcccagagc

SEQ ID NO: 2531382 - RNA, 13 nt, Human
cccagggcccaga

SEQ ID NO: 2531383 - RNA, 22 nt, Human
cccagggccagggcccugcaga

SEQ ID NO: 2531384 - RNA, 15 nt, Human
cccagggccugagcc

SEQ ID NO: 2531385 - RNA, 19 nt, Human
cccagggccugagccuggc

SEQ ID NO: 2531386 - RNA, 13 nt, Human
cccagggccugag

SEQ ID NO: 2531387 - RNA, 22 nt, Human
cccagggcccagagcccagcuc

SEQ ID NO: 2531388 - RNA, 14 nt, Human
cccagggccugcag

SEQ ID NO: 2531389 - RNA, 16 nt, Human
cccagggccugcagga

SEQ ID NO: 2531390 - RNA, 19 nt, Human
cccagggccugcaggaccu

SEQ ID NO: 2531391 - RNA, 20 nt, Human
cccagggccagggcccugca

SEQ ID NO: 2531392 - RNA, 16 nt, Human
cccauagcuuccauga

SEQ ID NO: 2531393 - RNA, 14 nt, Human
cccauauccugccu

SEQ ID NO: 2531394 - RNA, 13 nt, Human
cccauagcuucca

SEQ ID NO: 2531395 - RNA, 19 nt, Human
cccauagugaccggcugcu

SEQ ID NO: 2531396 - RNA, 20 nt, Human
cccauauuuguacaccaaua

SEQ ID NO: 2531397 - RNA, 17 nt, Human
cccauccuacccucggg

SEQ ID NO: 2531398 - RNA, 16 nt, Human
cccauauuucaucgug

SEQ ID NO: 2531399 - RNA, 13 nt, Human
cccauauuucauc

SEQ ID NO: 2531400 - RNA, 20 nt, Human
ccaguuggguggaugccugg

SEQ ID NO: 2531401 - RNA, 19 nt, Human
ccaguuggguggaugccug

SEQ ID NO: 2531402 - RNA, 21 nt, Human
ccaguucaguaccuggaggag

SEQ ID NO: 2531403 - RNA, 20 nt, Human
ccaguucaguaccuggagga

SEQ ID NO: 2531404 - RNA, 19 nt, Human
ccaguucaguaccuggagg

SEQ ID NO: 2531405 - RNA, 17 nt, Human
ccaguucaguaccugga

SEQ ID NO: 2531406 - RNA, 18 nt, Human
ccaguucauugcacuuug

SEQ ID NO: 2531407 - RNA, 17 nt, Human
ccaguucauugcacuuu

SEQ ID NO: 2531408 - RNA, 17 nt, Human
ccaguuggguggaugcc

SEQ ID NO: 2531409 - RNA, 15 nt, Human
ccaguucagcuuggg

SEQ ID NO: 2531410 - RNA, 20 nt, Human
ccaguuauuuuccgcccuca

SEQ ID NO: 2531411 - RNA, 19 nt, Human
ccaguucaaucucccgcug

SEQ ID NO: 2531412 - RNA, 17 nt, Human
ccaguuaugugaaugau

SEQ ID NO: 2531413 - RNA, 13 nt, Human
ccaguucacccug

SEQ ID NO: 2531414 - RNA, 14 nt, Human
ccaguucaggaguc

SEQ ID NO: 2531415 - RNA, 18 nt, Human
ccaguucaggagucccaa

SEQ ID NO: 2531416 - RNA, 21 nt, Human
ccaguucaggagucccaagga

SEQ ID NO: 2531417 - RNA, 20 nt, Human
ccaucccugaaggccccgcc

SEQ ID NO: 2531418 - RNA, 17 nt, Human
ccaucccugaaggcccc

SEQ ID NO: 2531419 - RNA, 15 nt, Human
ccaucccugaaggcc

SEQ ID NO: 2531420 - RNA, 14 nt, Human
ccaucccugaaggc

SEQ ID NO: 2531421 - RNA, 15 nt, Human
ccaugacccaggcug

SEQ ID NO: 2531422 - RNA, 14 nt, Human
ccaugacccaggcu

SEQ ID NO: 2531423 - RNA, 20 nt, Human
ccaugacccaccccugugcu

SEQ ID NO: 2531424 - RNA, 19 nt, Human
ccaugacccaccccugugc

SEQ ID NO: 2531425 - RNA, 17 nt, Human
ccaugacccaggcuggg

SEQ ID NO: 2531426 - RNA, 16 nt, Human
ccaugacccaggcugg

SEQ ID NO: 2531427 - RNA, 18 nt, Human
ccaugacccaggcugggc

SEQ ID NO: 2531428 - RNA, 18 nt, Human
ccaugacccaccccugug

SEQ ID NO: 2531429 - RNA, 17 nt, Human
ccaugacccaccccugu

SEQ ID NO: 2531430 - RNA, 16 nt, Human
ccaugacccaccccug

SEQ ID NO: 2531431 - RNA, 15 nt, Human
ccaugacccaccccu

SEQ ID NO: 2531432 - RNA, 12 nt, Human
ccaugacccacc

SEQ ID NO: 2531433 - RNA, 14 nt, Human
ccaugaccauacug

SEQ ID NO: 2531434 - RNA, 23 nt, Human
ccaucccaggacaccacacccag

SEQ ID NO: 2531435 - RNA, 22 nt, Human
ccaucccaggacaccacaccca

SEQ ID NO: 2531436 - RNA, 21 nt, Human
ccaucccaggacaccacaccc

SEQ ID NO: 2531437 - RNA, 14 nt, Human
ccaucccaggacac

SEQ ID NO: 2531438 - RNA, 17 nt, Human
ccaugaaucaaagacau

SEQ ID NO: 2531439 - RNA, 16 nt, Human
ccaugaaucaaagaca

SEQ ID NO: 2531440 - RNA, 24 nt, Human
ccaucccaggacaccacacccagc

SEQ ID NO: 2531441 - RNA, 19 nt, Human
ccaugaaucgcuucucuuu

SEQ ID NO: 2531442 - RNA, 18 nt, Human
ccaugaaucgcuucucuu

SEQ ID NO: 2531443 - RNA, 17 nt, Human
ccaugaaucgcuucucu

SEQ ID NO: 2531444 - RNA, 15 nt, Human
ccaugaaucgcuucu

SEQ ID NO: 2531445 - RNA, 18 nt, Human
ccaugaauguaucaggaa

SEQ ID NO: 2531446 - RNA, 19 nt, Human
ccaugaauguaucaggaaa

SEQ ID NO: 2531447 - RNA, 15 nt, Human
ccaguuucugccucu

SEQ ID NO: 2531448 - RNA, 14 nt, Human
ccaguuucugccuc

SEQ ID NO: 2531449 - RNA, 12 nt, Human
ccaguuucugcc

SEQ ID NO: 2531450 - RNA, 14 nt, Human
ccaucccagcccca

SEQ ID NO: 2531451 - RNA, 15 nt, Human
ccaucccagccccaa

SEQ ID NO: 2531452 - RNA, 13 nt, Human
ccaucccagcccc

SEQ ID NO: 2531453 - RNA, 23 nt, Human
ccaucccagccuuggcaucuaga

SEQ ID NO: 2531454 - RNA, 15 nt, Human
ccaucccagccuugg

SEQ ID NO: 2531455 - RNA, 14 nt, Human
ccaucccagccuug

SEQ ID NO: 2531456 - RNA, 13 nt, Human
ccaguuugcagaa

SEQ ID NO: 2531457 - RNA, 17 nt, Human
ccaguuuaaccugaugc

SEQ ID NO: 2531458 - RNA, 19 nt, Human
ccaguuuaaucauugccug

SEQ ID NO: 2531459 - RNA, 18 nt, Human
ccaguuuaaccugaugca

SEQ ID NO: 2531460 - RNA, 21 nt, Human
ccaguuucagguguuuaguug

SEQ ID NO: 2531461 - RNA, 23 nt, Human
ccaguucaguaccuggaggagga

SEQ ID NO: 2531462 - RNA, 23 nt, Human
ccaguuggucccccuuccaugga

SEQ ID NO: 2531463 - RNA, 22 nt, Human
ccaguuccuuucaaugguuugc

SEQ ID NO: 2531464 - RNA, 21 nt, Human
ccaguuccuuucaaugguuug

SEQ ID NO: 2531465 - RNA, 20 nt, Human
ccaguugggagcacuggagu

SEQ ID NO: 2531466 - RNA, 18 nt, Human
ccaugucagcaaaaagca

SEQ ID NO: 2531467 - RNA, 22 nt, Human
ccauguauuuaucucuauuuaa

SEQ ID NO: 2531468 - RNA, 16 nt, Human
ccauguauuuaucucu

SEQ ID NO: 2531469 - RNA, 23 nt, Human
ccauguauuuaucucuauuuaau

SEQ ID NO: 2531470 - RNA, 18 nt, Human
ccauguaagguaucaguu

SEQ ID NO: 2531471 - RNA, 17 nt, Human
ccaugucagcaaaaagc

SEQ ID NO: 2531472 - RNA, 13 nt, Human
ccaugucacugug

SEQ ID NO: 2531473 - RNA, 22 nt, Human
ccaugucaccggauccugggug

SEQ ID NO: 2531474 - RNA, 23 nt, Human
ccaugucaccggauccugggugg

SEQ ID NO: 2531475 - RNA, 23 nt, Human
ccaugagccucagcauccuggca

SEQ ID NO: 2531476 - RNA, 21 nt, Human
ccaugagccucagcauccugg

SEQ ID NO: 2531477 - RNA, 17 nt, Human
ccaugagcuccagaccc

SEQ ID NO: 2531478 - RNA, 18 nt, Human
ccaugagcuccagacccc

SEQ ID NO: 2531479 - RNA, 19 nt, Human
ccaugagcuccagaccccc

SEQ ID NO: 2531480 - RNA, 23 nt, Human
ccaugagcuccagacccccagca

SEQ ID NO: 2531481 - RNA, 13 nt, Human
ccaugagcuccag

SEQ ID NO: 2531482 - RNA, 15 nt, Human
ccaugagcuccagac

SEQ ID NO: 2531483 - RNA, 16 nt, Human
ccaugagcuccagacc

SEQ ID NO: 2531484 - RNA, 16 nt, Human
ccauguaacagaaagg

SEQ ID NO: 2531485 - RNA, 15 nt, Human
ccauguaacagaaag

SEQ ID NO: 2531486 - RNA, 14 nt, Human
ccaugguugagaaa

SEQ ID NO: 2531487 - RNA, 18 nt, Human
ccauggugugaucgucug

SEQ ID NO: 2531488 - RNA, 19 nt, Human
ccauggugugaucgucuga

SEQ ID NO: 2531489 - RNA, 20 nt, Human
ccauggucggaaaacaugcu

SEQ ID NO: 2531490 - RNA, 22 nt, Human
ccauggugaauuaaucacuuuu

SEQ ID NO: 2531491 - RNA, 20 nt, Human
ccaugguacccccuucuggg

SEQ ID NO: 2531492 - RNA, 20 nt, Human
ccauggugaauuaaucacuu

SEQ ID NO: 2531493 - RNA, 22 nt, Human
ccaggcacacacugugcuuucu

SEQ ID NO: 2531494 - RNA, 16 nt, Human
ccaggcacacacugug

SEQ ID NO: 2531495 - RNA, 22 nt, Human
ccaggcacccuucuuuccucuu

SEQ ID NO: 2531496 - RNA, 21 nt, Human
ccaggcacccuucuuuccucu

SEQ ID NO: 2531497 - RNA, 14 nt, Human
ccaggcacccuucu

SEQ ID NO: 2531498 - RNA, 13 nt, Human
ccaggcacccuuc

SEQ ID NO: 2531499 - RNA, 18 nt, Human
ccaggcacgaacccaccu

SEQ ID NO: 2531500 - RNA, 19 nt, Human
ccaggcacgaacccaccug

SEQ ID NO: 2531501 - RNA, 20 nt, Human
ccaggcacgaacccaccugc

SEQ ID NO: 2531502 - RNA, 21 nt, Human
ccaggcacccccuggagagaa

SEQ ID NO: 2531503 - RNA, 19 nt, Human
ccaggcacccccuggagag

SEQ ID NO: 2531504 - RNA, 18 nt, Human
ccaggcacccccuggaga

SEQ ID NO: 2531505 - RNA, 17 nt, Human
ccaggcacccccuggag

SEQ ID NO: 2531506 - RNA, 16 nt, Human
ccaggcacccccugga

SEQ ID NO: 2531507 - RNA, 18 nt, Human
ccaggcacugcugcccag

SEQ ID NO: 2531508 - RNA, 16 nt, Human
ccaggcacugcugccc

SEQ ID NO: 2531509 - RNA, 21 nt, Human
ccaggcacgaacccaccugcu

SEQ ID NO: 2531510 - RNA, 22 nt, Human
ccaggcacgaacccaccugcug

SEQ ID NO: 2531511 - RNA, 23 nt, Human
ccaggcacgaacccaccugcuga

SEQ ID NO: 2531512 - RNA, 13 nt, Human
ccaggcagaucca

SEQ ID NO: 2531513 - RNA, 15 nt, Human
ccaggcagauccagg

SEQ ID NO: 2531514 - RNA, 16 nt, Human
ccaggcagauccagga

SEQ ID NO: 2531515 - RNA, 17 nt, Human
ccaggcagauccaggac

SEQ ID NO: 2531516 - RNA, 18 nt, Human
ccaggcagauccaggacu

SEQ ID NO: 2531517 - RNA, 19 nt, Human
ccaggcagauccaggacua

SEQ ID NO: 2531518 - RNA, 13 nt, Human
ccaggcagaucug

SEQ ID NO: 2531519 - RNA, 17 nt, Human
ccaggcagaucugugcc

SEQ ID NO: 2531520 - RNA, 18 nt, Human
ccaggcuggcgugcagug

SEQ ID NO: 2531521 - RNA, 17 nt, Human
ccaggcuggcgugcagu

SEQ ID NO: 2531522 - RNA, 22 nt, Human
ccagggcuggacugaggccuga

SEQ ID NO: 2531523 - RNA, 19 nt, Human
ccaggcuggcgugcagugg

SEQ ID NO: 2531524 - RNA, 16 nt, Human
ccaggcuggcgugcag

SEQ ID NO: 2531525 - RNA, 23 nt, Human
ccaggcuccuuccugucuuccug

SEQ ID NO: 2531526 - RNA, 15 nt, Human
ccaggcuccuuccug

SEQ ID NO: 2531527 - RNA, 22 nt, Human
ccaggcuccuuccugucuuccu

SEQ ID NO: 2531528 - RNA, 18 nt, Human
ccaggcagaucugugccc

SEQ ID NO: 2531529 - RNA, 14 nt, Human
ccaggcuccuuccu

SEQ ID NO: 2531530 - RNA, 21 nt, Human
ccaggcuccuuuagcgcccag

SEQ ID NO: 2531531 - RNA, 20 nt, Human
ccaggcuccuuuagcgccca

SEQ ID NO: 2531532 - RNA, 17 nt, Human
ccaggggugggacaccc

SEQ ID NO: 2531533 - RNA, 14 nt, Human
ccaggggugggaca

SEQ ID NO: 2531534 - RNA, 20 nt, Human
ccaggggugcccccuccucu

SEQ ID NO: 2531535 - RNA, 19 nt, Human
ccaggggugcccccuccuc

SEQ ID NO: 2531536 - RNA, 18 nt, Human
ccaggggugcccccuccu

SEQ ID NO: 2531537 - RNA, 19 nt, Human
ccaggggugggacacccug

SEQ ID NO: 2531538 - RNA, 16 nt, Human
ccaggguagcccgccu

SEQ ID NO: 2531539 - RNA, 14 nt, Human
ccaggguagcccgc

SEQ ID NO: 2531540 - RNA, 13 nt, Human
ccagggguuucuc

SEQ ID NO: 2531541 - RNA, 23 nt, Human
ccaggggugggacacccugugau

SEQ ID NO: 2531542 - RNA, 13 nt, Human
ccaggggugggac

SEQ ID NO: 2531543 - RNA, 20 nt, Human
ccaggggaaaaucagccugc

SEQ ID NO: 2531544 - RNA, 19 nt, Human
ccaggggaaaaucagccug

SEQ ID NO: 2531545 - RNA, 17 nt, Human
ccagggucccucugugu

SEQ ID NO: 2531546 - RNA, 16 nt, Human
ccagggucccucugug

SEQ ID NO: 2531547 - RNA, 18 nt, Human
ccagggucccucugugua

SEQ ID NO: 2531548 - RNA, 13 nt, Human
ccagggucccugg

SEQ ID NO: 2531549 - RNA, 22 nt, Human
ccaggguagcccgccugccagu

SEQ ID NO: 2531550 - RNA, 21 nt, Human
ccaggguagcccgccugccag

SEQ ID NO: 2531551 - RNA, 20 nt, Human
ccaggguagcccgccugcca

SEQ ID NO: 2531552 - RNA, 19 nt, Human
ccaggguagcccgccugcc

SEQ ID NO: 2531553 - RNA, 21 nt, Human
ccagggucacugaaggccugg

SEQ ID NO: 2531554 - RNA, 23 nt, Human
ccaggguagcccgccugccaguc

SEQ ID NO: 2531555 - RNA, 17 nt, Human
ccagggucacugaaggc

SEQ ID NO: 2531556 - RNA, 15 nt, Human
ccagaugcaccagcc

SEQ ID NO: 2531557 - RNA, 17 nt, Human
ccagaugcaccagcccu

SEQ ID NO: 2531558 - RNA, 18 nt, Human
ccagaugcaccagcccuu

SEQ ID NO: 2531559 - RNA, 20 nt, Human
ccagagggccugcaagggag

SEQ ID NO: 2531560 - RNA, 19 nt, Human
ccagagggccugcaaggga

SEQ ID NO: 2531561 - RNA, 18 nt, Human
ccagagggccugcaaggg

SEQ ID NO: 2531562 - RNA, 17 nt, Human
ccagagggccugcaagg

SEQ ID NO: 2531563 - RNA, 16 nt, Human
ccaccuuggcucaagu

SEQ ID NO: 2531564 - RNA, 15 nt, Human
ccagauccuggaaau

SEQ ID NO: 2531565 - RNA, 14 nt, Human
ccagauccucuugg

SEQ ID NO: 2531566 - RNA, 15 nt, Human
ccagauccucuuggu

SEQ ID NO: 2531567 - RNA, 14 nt, Human
ccagauccucacaa

SEQ ID NO: 2531568 - RNA, 17 nt, Human
ccagauccucacaacca

SEQ ID NO: 2531569 - RNA, 18 nt, Human
ccagaucccagaaggacc

SEQ ID NO: 2531570 - RNA, 21 nt, Human
ccagaguuccccaugcagaca

SEQ ID NO: 2531571 - RNA, 19 nt, Human
ccagaguuccccaugcaga

SEQ ID NO: 2531572 - RNA, 18 nt, Human
ccagaguuccccaugcag

SEQ ID NO: 2531573 - RNA, 13 nt, Human
ccagauccagccu

SEQ ID NO: 2531574 - RNA, 14 nt, Human
ccagauccagccug

SEQ ID NO: 2531575 - RNA, 15 nt, Human
ccagauccagccugg

SEQ ID NO: 2531576 - RNA, 16 nt, Human
ccagauccagccuggg

SEQ ID NO: 2531577 - RNA, 13 nt, Human
ccagaucccagaa

SEQ ID NO: 2531578 - RNA, 16 nt, Human
ccagaucccagaagga

SEQ ID NO: 2531579 - RNA, 17 nt, Human
ccagaucccagaaggac

SEQ ID NO: 2531580 - RNA, 16 nt, Human
ccagaguccuuuccaa

SEQ ID NO: 2531581 - RNA, 21 nt, Human
ccagaguccuuuccaaggcuu

SEQ ID NO: 2531582 - RNA, 13 nt, Human
ccagaguggccug

SEQ ID NO: 2531583 - RNA, 14 nt, Human
ccagaguggccugg

SEQ ID NO: 2531584 - RNA, 15 nt, Human
ccagaguggccuggc

SEQ ID NO: 2531585 - RNA, 16 nt, Human
ccagaguggccuggcc

SEQ ID NO: 2531586 - RNA, 17 nt, Human
ccagaguggccuggcca

SEQ ID NO: 2531587 - RNA, 18 nt, Human
ccagaguggccuggccag

SEQ ID NO: 2531588 - RNA, 19 nt, Human
ccagaguggccuggccagg

SEQ ID NO: 2531589 - RNA, 21 nt, Human
ccagaguggccuggccaggag

SEQ ID NO: 2531590 - RNA, 22 nt, Human
ccagaguggccuggccaggagc

SEQ ID NO: 2531591 - RNA, 12 nt, Human
ccagagugugaa

SEQ ID NO: 2531592 - RNA, 18 nt, Human
ccagagugugggaaggga

SEQ ID NO: 2531593 - RNA, 21 nt, Human
ccagagugugggaagggagag

SEQ ID NO: 2531594 - RNA, 23 nt, Human
ccagaguggccuggccaggagcu

SEQ ID NO: 2531595 - RNA, 21 nt, Human
ccagaguggggaugacaugca

SEQ ID NO: 2531596 - RNA, 15 nt, Human
ccagcagccagcucu

SEQ ID NO: 2531597 - RNA, 16 nt, Human
ccagcagccagcucuc

SEQ ID NO: 2531598 - RNA, 18 nt, Human
ccagcagccagcucucag

SEQ ID NO: 2531599 - RNA, 19 nt, Human
ccagcagccagcucucagc

SEQ ID NO: 2531600 - RNA, 20 nt, Human
ccagcagccagcucucagcc

SEQ ID NO: 2531601 - RNA, 15 nt, Human
ccagcaggcucucag

SEQ ID NO: 2531602 - RNA, 13 nt, Human
ccagcaggcucuc

SEQ ID NO: 2531603 - RNA, 24 nt, Human
ccagcagcggaaccgcccaggauc

SEQ ID NO: 2531604 - RNA, 19 nt, Human
ccagcagcgccuuucccaa

SEQ ID NO: 2531605 - RNA, 17 nt, Human
ccagcagcgccuuuccc

SEQ ID NO: 2531606 - RNA, 18 nt, Human
ccagcagcgccuuuccca

SEQ ID NO: 2531607 - RNA, 12 nt, Human
ccagcagcgccu

SEQ ID NO: 2531608 - RNA, 13 nt, Human
ccaggaagccagc

SEQ ID NO: 2531609 - RNA, 14 nt, Human
ccaggaacugggcc

SEQ ID NO: 2531610 - RNA, 12 nt, Human
ccaggaagccag

SEQ ID NO: 2531611 - RNA, 15 nt, Human
ccaggaaaggcucca

SEQ ID NO: 2531612 - RNA, 14 nt, Human
ccaggaaaggcucc

SEQ ID NO: 2531613 - RNA, 16 nt, Human
ccaggaaaggcuccag

SEQ ID NO: 2531614 - RNA, 21 nt, Human
ccagcuuaaaguaaccggaug

SEQ ID NO: 2531615 - RNA, 24 nt, Human
ccaggaaccacaccacaucuaagc

SEQ ID NO: 2531616 - RNA, 14 nt, Human
ccaggaaccuccuc

SEQ ID NO: 2531617 - RNA, 23 nt, Human
ccaggaaacucugcauucuagua

SEQ ID NO: 2531618 - RNA, 19 nt, Human
ccagcuuaaaggggcuaga

SEQ ID NO: 2531619 - RNA, 17 nt, Human
ccagcuguucagcuggu

SEQ ID NO: 2531620 - RNA, 22 nt, Human
ccagcucaauggacuggaaggg

SEQ ID NO: 2531621 - RNA, 22 nt, Human
ccagcuguucugucccuuggag

SEQ ID NO: 2531622 - RNA, 17 nt, Human
ccagcucaauggacugg

SEQ ID NO: 2531623 - RNA, 15 nt, Human
ccagcuacucaggag

SEQ ID NO: 2531624 - RNA, 17 nt, Human
ccagcuacucaggaggc

SEQ ID NO: 2531625 - RNA, 19 nt, Human
ccagcuacucaggaggcug

SEQ ID NO: 2531626 - RNA, 20 nt, Human
ccagcuacucaggaggcuga

SEQ ID NO: 2531627 - RNA, 22 nt, Human
ccagcucaccagccccagugcc

SEQ ID NO: 2531628 - RNA, 16 nt, Human
ccagcuguucagcugg

SEQ ID NO: 2531629 - RNA, 16 nt, Human
ccagcucaccagcccc

SEQ ID NO: 2531630 - RNA, 15 nt, Human
ccagcucaccagccc

SEQ ID NO: 2531631 - RNA, 12 nt, Human
ccagccccugga

SEQ ID NO: 2531632 - RNA, 11 nt, Human
ccagccccugg

SEQ ID NO: 2531633 - RNA, 15 nt, Human
ccagccccugcccca

SEQ ID NO: 2531634 - RNA, 23 nt, Human
ccagccccucuggucgcuccugc

SEQ ID NO: 2531635 - RNA, 22 nt, Human
ccagccccucuggucgcuccug

SEQ ID NO: 2531636 - RNA, 17 nt, Human
ccagccccucuggucgc

SEQ ID NO: 2531637 - RNA, 15 nt, Human
ccagccccucugguc

SEQ ID NO: 2531638 - RNA, 14 nt, Human
ccagccccucuggu

SEQ ID NO: 2531639 - RNA, 20 nt, Human
ccagcuacucaagaggcuga

SEQ ID NO: 2531640 - RNA, 17 nt, Human
ccagcuacaccuuucuc

SEQ ID NO: 2531641 - RNA, 14 nt, Human
ccagcuacucagaa

SEQ ID NO: 2531642 - RNA, 16 nt, Human
ccagcuacucagaagc

SEQ ID NO: 2531643 - RNA, 17 nt, Human
ccagcuacucagaagcc

SEQ ID NO: 2531644 - RNA, 20 nt, Human
ccagcuacucagaagccuga

SEQ ID NO: 2531645 - RNA, 21 nt, Human
ccagcuacucagaagccugag

SEQ ID NO: 2531646 - RNA, 23 nt, Human
ccagcuacucagaagccugaggc

SEQ ID NO: 2531647 - RNA, 13 nt, Human
ccagcuacucagg

SEQ ID NO: 2531648 - RNA, 14 nt, Human
ccagcuacucagga

SEQ ID NO: 2531649 - RNA, 22 nt, Human
ccagcuacccuuuuucuccagc

SEQ ID NO: 2531650 - RNA, 21 nt, Human
ccagcuacccuuuuucuccag

SEQ ID NO: 2531651 - RNA, 16 nt, Human
ccagcuacccuuuuuc

SEQ ID NO: 2531652 - RNA, 20 nt, Human
ccagcuacaccuuucuccuu

SEQ ID NO: 2531653 - RNA, 22 nt, Human
ccagccccugccccagcccaag

SEQ ID NO: 2531654 - RNA, 20 nt, Human
ccagccccugccccagccca

SEQ ID NO: 2531655 - RNA, 18 nt, Human
ccagccccugccccagcc

SEQ ID NO: 2531656 - RNA, 19 nt, Human
ccagcuacaccuuucuccu

SEQ ID NO: 2531657 - RNA, 18 nt, Human
ccagcuacaccuuucucc

SEQ ID NO: 2531658 - RNA, 20 nt, Human
ccuucugacccaugcugccc

SEQ ID NO: 2531659 - RNA, 17 nt, Human
ccuucugacccaugcug

SEQ ID NO: 2531660 - RNA, 16 nt, Human
ccuucugacccaugcu

SEQ ID NO: 2531661 - RNA, 12 nt, Human
ccuucugaccca

SEQ ID NO: 2531662 - RNA, 15 nt, Human
ccuggccugagcugg

SEQ ID NO: 2531663 - RNA, 14 nt, Human
ccuggccugagcug

SEQ ID NO: 2531664 - RNA, 20 nt, Human
ccuggccugagcugggauga

SEQ ID NO: 2531665 - RNA, 14 nt, Human
ccuggccucugugc

SEQ ID NO: 2531666 - RNA, 20 nt, Human
ccuucugaaaaaguauccug

SEQ ID NO: 2531667 - RNA, 22 nt, Human
ccuucugacccaugcugcccug

SEQ ID NO: 2531668 - RNA, 21 nt, Human
ccuucugacccaugcugcccu

SEQ ID NO: 2531669 - RNA, 23 nt, Human
ccuucugacccaugcugcccugu

SEQ ID NO: 2531670 - RNA, 18 nt, Human
ccuucugaggacauucca

SEQ ID NO: 2531671 - RNA, 21 nt, Human
ccuucugaggacauuccaaga

SEQ ID NO: 2531672 - RNA, 12 nt, Human
ccuucugcucag

SEQ ID NO: 2531673 - RNA, 16 nt, Human
ccuucugccugagcuu

SEQ ID NO: 2531674 - RNA, 13 nt, Human
ccuucugcuacug

SEQ ID NO: 2531675 - RNA, 17 nt, Human
ccuucugcucagcucug

SEQ ID NO: 2531676 - RNA, 20 nt, Human
ccuucugcuggauaaaauga

SEQ ID NO: 2531677 - RNA, 22 nt, Human
ccuucuggaauaaggagaauga

SEQ ID NO: 2531678 - RNA, 17 nt, Human
ccuucuggauucuuggc

SEQ ID NO: 2531679 - RNA, 21 nt, Human
ccuucugcuggauaaaaugag

SEQ ID NO: 2531680 - RNA, 17 nt, Human
ccuucuggccucccaca

SEQ ID NO: 2531681 - RNA, 17 nt, Human
ccuucuguaguuuuauc

SEQ ID NO: 2531682 - RNA, 19 nt, Human
ccuucugucccucacagca

SEQ ID NO: 2531683 - RNA, 18 nt, Human
ccuucugucccucacagc

SEQ ID NO: 2531684 - RNA, 16 nt, Human
ccuucuguaguuuuau

SEQ ID NO: 2531685 - RNA, 22 nt, Human
ccuucuguaaagguuuuuggaa

SEQ ID NO: 2531686 - RNA, 22 nt, Human
ccuucugggcaucuguucuggu

SEQ ID NO: 2531687 - RNA, 20 nt, Human
ccuucugggcaucuguucug

SEQ ID NO: 2531688 - RNA, 19 nt, Human
ccuucugggcaucuguucu

SEQ ID NO: 2531689 - RNA, 18 nt, Human
ccuucugggcaucuguuc

SEQ ID NO: 2531690 - RNA, 20 nt, Human
ccuucugggcagaccuugac

SEQ ID NO: 2531691 - RNA, 12 nt, Human
ccuucugggaaa

SEQ ID NO: 2531692 - RNA, 21 nt, Human
ccuucuggauucuuggcccgc

SEQ ID NO: 2531693 - RNA, 20 nt, Human
ccuucuggccucccacagac

SEQ ID NO: 2531694 - RNA, 19 nt, Human
ccuucuggauucuuggccc

SEQ ID NO: 2531695 - RNA, 18 nt, Human
ccuucuggauucuuggcc

SEQ ID NO: 2531696 - RNA, 18 nt, Human
ccuucuggccucccacag

SEQ ID NO: 2531697 - RNA, 15 nt, Human
ccuugcccaccccac

SEQ ID NO: 2531698 - RNA, 11 nt, Human
ccuugcccaga

SEQ ID NO: 2531699 - RNA, 12 nt, Human
ccuugcccagag

SEQ ID NO: 2531700 - RNA, 13 nt, Human
ccuugcccagaga

SEQ ID NO: 2531701 - RNA, 14 nt, Human
ccuugcccagagau

SEQ ID NO: 2531702 - RNA, 19 nt, Human
ccuugcccagagaugccuc

SEQ ID NO: 2531703 - RNA, 21 nt, Human
ccuugcccagagaugccucca

SEQ ID NO: 2531704 - RNA, 23 nt, Human
ccuugcccagagaugccuccacc

SEQ ID NO: 2531705 - RNA, 13 nt, Human
ccuugcccagggc

SEQ ID NO: 2531706 - RNA, 17 nt, Human
ccuugccgucuaccuga

SEQ ID NO: 2531707 - RNA, 15 nt, Human
ccuugcccagggcuc

SEQ ID NO: 2531708 - RNA, 16 nt, Human
ccuugcccagggcuca

SEQ ID NO: 2531709 - RNA, 17 nt, Human
ccuugcccagggcucag

SEQ ID NO: 2531710 - RNA, 18 nt, Human
ccuugcccagggcucagc

SEQ ID NO: 2531711 - RNA, 20 nt, Human
ccuugccgucuaccugaggg

SEQ ID NO: 2531712 - RNA, 16 nt, Human
ccuugccucaaugcca

SEQ ID NO: 2531713 - RNA, 15 nt, Human
ccuugccucaaugcc

SEQ ID NO: 2531714 - RNA, 20 nt, Human
ccuugcccagggcucagccu

SEQ ID NO: 2531715 - RNA, 22 nt, Human
ccuugccuccccauuucccauc

SEQ ID NO: 2531716 - RNA, 17 nt, Human
ccuugccuccccauuuc

SEQ ID NO: 2531717 - RNA, 14 nt, Human
ccuugccuccccau

SEQ ID NO: 2531718 - RNA, 12 nt, Human
ccuugccucccc

SEQ ID NO: 2531719 - RNA, 20 nt, Human
ccuugccucaaugccaguaa

SEQ ID NO: 2531720 - RNA, 19 nt, Human
ccuugccucaaugccagua

SEQ ID NO: 2531721 - RNA, 21 nt, Human
ccuugcuuguugggauuccug

SEQ ID NO: 2531722 - RNA, 23 nt, Human
ccuugccuccccauuucccaucu

SEQ ID NO: 2531723 - RNA, 12 nt, Human
ccuugccuccug

SEQ ID NO: 2531724 - RNA, 22 nt, Human
ccuugcuuggcugcuuggccuu

SEQ ID NO: 2531725 - RNA, 17 nt, Human
ccuuggacauccuccuc

SEQ ID NO: 2531726 - RNA, 16 nt, Human
ccuuggacauccuccu

SEQ ID NO: 2531727 - RNA, 19 nt, Human
ccuuuagccaaacccuugu

SEQ ID NO: 2531728 - RNA, 15 nt, Human
ccuuggaaguuucau

SEQ ID NO: 2531729 - RNA, 22 nt, Human
ccuuggaaguugcauggcauca

SEQ ID NO: 2531730 - RNA, 22 nt, Human
ccuuggaaaccugcccugccug

SEQ ID NO: 2531731 - RNA, 20 nt, Human
ccuuggaaaccugcccugcc

SEQ ID NO: 2531732 - RNA, 23 nt, Human
ccuuggaaaccugcccugccuga

SEQ ID NO: 2531733 - RNA, 17 nt, Human
ccuuggaaaccugcccu

SEQ ID NO: 2531734 - RNA, 19 nt, Human
ccuuggaaaccugcccugc

SEQ ID NO: 2531735 - RNA, 18 nt, Human
ccuuggaaaccugcccug

SEQ ID NO: 2531736 - RNA, 14 nt, Human
ccuugccuccugug

SEQ ID NO: 2531737 - RNA, 23 nt, Human
ccuuuccaccacagccagcaccu

SEQ ID NO: 2531738 - RNA, 13 nt, Human
ccuuuccagcaug

SEQ ID NO: 2531739 - RNA, 19 nt, Human
ccuuuccaccacagccagc

SEQ ID NO: 2531740 - RNA, 22 nt, Human
ccuuuagggcagcuugccccgg

SEQ ID NO: 2531741 - RNA, 20 nt, Human
ccuuuagggcagcuugcccc

SEQ ID NO: 2531742 - RNA, 15 nt, Human
ccuuuagggcagcuu

SEQ ID NO: 2531743 - RNA, 14 nt, Human
ccuuuagggcagcu

SEQ ID NO: 2531744 - RNA, 13 nt, Human
ccuuuagggcagc

SEQ ID NO: 2531745 - RNA, 20 nt, Human
ccuuuagcgcccaguugggu

SEQ ID NO: 2531746 - RNA, 14 nt, Human
ccuuuagcgcccag

SEQ ID NO: 2531747 - RNA, 12 nt, Human
ccuuuccccagc

SEQ ID NO: 2531748 - RNA, 19 nt, Human
ccuuucccaggugcuacac

SEQ ID NO: 2531749 - RNA, 11 nt, Human
ccuuuccauaa

SEQ ID NO: 2531750 - RNA, 16 nt, Human
ccuuuccccagcccag

SEQ ID NO: 2531751 - RNA, 15 nt, Human
ccuuuccccagccca

SEQ ID NO: 2531752 - RNA, 14 nt, Human
ccuuuccccagccc

SEQ ID NO: 2531753 - RNA, 13 nt, Human
ccuuuccccagcc

SEQ ID NO: 2531754 - RNA, 18 nt, Human
ccuuuccccagcccaggg

SEQ ID NO: 2531755 - RNA, 17 nt, Human
ccuuuccccagcccagg

SEQ ID NO: 2531756 - RNA, 23 nt, Human
ccuuuucuuuucuacccuagcca

SEQ ID NO: 2531757 - RNA, 21 nt, Human
ccuuuugaaauuaaccucuca

SEQ ID NO: 2531758 - RNA, 22 nt, Human
ccuuuucuuuucuacccuagcc

SEQ ID NO: 2531759 - RNA, 18 nt, Human
ccuuuucuuuucuacccu

SEQ ID NO: 2531760 - RNA, 20 nt, Human
ccuuuugcaccugcucucuu

SEQ ID NO: 2531761 - RNA, 20 nt, Human
ccuuuugcaccccucccauu

SEQ ID NO: 2531762 - RNA, 19 nt, Human
ccuuuugcaccccucccau

SEQ ID NO: 2531763 - RNA, 18 nt, Human
ccuuuugcaccccuccca

SEQ ID NO: 2531764 - RNA, 17 nt, Human
ccuuuugcaccccuccc

SEQ ID NO: 2531765 - RNA, 23 nt, Human
ccuuuugaaguaguuuguauaac

SEQ ID NO: 2531766 - RNA, 23 nt, Human
ccuuuugaacgcccccccccacc

SEQ ID NO: 2531767 - RNA, 22 nt, Human
ccuuuucugcauuuugcuauug

SEQ ID NO: 2531768 - RNA, 14 nt, Human
ccuuuucugcauuu

SEQ ID NO: 2531769 - RNA, 22 nt, Human
ccuuuucuagcccgaauacaaa

SEQ ID NO: 2531770 - RNA, 15 nt, Human
cgacagugagacucu

SEQ ID NO: 2531771 - RNA, 16 nt, Human
cgacagugagacucug

SEQ ID NO: 2531772 - RNA, 17 nt, Human
ccuuuuuuauacauaaa

SEQ ID NO: 2531773 - RNA, 18 nt, Human
ccuuuuuuauacauaaac

SEQ ID NO: 2531774 - RNA, 14 nt, Human
cgaccaccugccca

SEQ ID NO: 2531775 - RNA, 12 nt, Human
cgaccaccugcc

SEQ ID NO: 2531776 - RNA, 23 nt, Human
cgaccagacaccuugacagggca

SEQ ID NO: 2531777 - RNA, 12 nt, Human
ccuuuuugaagu

SEQ ID NO: 2531778 - RNA, 22 nt, Human
cgacauagcccaucccugccug

SEQ ID NO: 2531779 - RNA, 21 nt, Human
cgaccaccccugccuccaccc

SEQ ID NO: 2531780 - RNA, 16 nt, Human
cgaccaccccugccuc

SEQ ID NO: 2531781 - RNA, 15 nt, Human
cgaccaccccugccu

SEQ ID NO: 2531782 - RNA, 23 nt, Human
cgaccacagggucugcacucuaa

SEQ ID NO: 2531783 - RNA, 14 nt, Human
cgaccacagggucu

SEQ ID NO: 2531784 - RNA, 19 nt, Human
cgacauggacccggagcua

SEQ ID NO: 2531785 - RNA, 12 nt, Human
ccuuuuuuauac

SEQ ID NO: 2531786 - RNA, 21 nt, Human
ccuuuuucucccucuggauca

SEQ ID NO: 2531787 - RNA, 20 nt, Human
ccuuuuucuuuauaaacuuu

SEQ ID NO: 2531788 - RNA, 16 nt, Human
ccuuuuucuuuauaaa

SEQ ID NO: 2531789 - RNA, 18 nt, Human
ccuuuuucucccucugga

SEQ ID NO: 2531790 - RNA, 17 nt, Human
ccuuuuuccuugucccc

SEQ ID NO: 2531791 - RNA, 16 nt, Human
ccuuuuucuccagcug

SEQ ID NO: 2531792 - RNA, 14 nt, Human
ccuuuuuccuuguc

SEQ ID NO: 2531793 - RNA, 13 nt, Human
ccuuuuuccuugu

SEQ ID NO: 2531794 - RNA, 14 nt, Human
ccuuuuucuccagc

SEQ ID NO: 2531795 - RNA, 21 nt, Human
ccuuuuuccccaaagucuuaa

SEQ ID NO: 2531796 - RNA, 13 nt, Human
ccuuuuuccuucc

SEQ ID NO: 2531797 - RNA, 15 nt, Human
ccuuuugucugccuc

SEQ ID NO: 2531798 - RNA, 19 nt, Human
ccuuuuggcccccgagcug

SEQ ID NO: 2531799 - RNA, 20 nt, Human
ccuuuuggcccccgagcugg

SEQ ID NO: 2531800 - RNA, 21 nt, Human
ccuuuuggcccccgagcuggg

SEQ ID NO: 2531801 - RNA, 23 nt, Human
ccuuuuggcccccgagcuggggg

SEQ ID NO: 2531802 - RNA, 19 nt, Human
ccuuuuguaccauggugug

SEQ ID NO: 2531803 - RNA, 18 nt, Human
ccuuuugcuugaaaccaa

SEQ ID NO: 2531804 - RNA, 19 nt, Human
ccuuuugcggaugggaggg

SEQ ID NO: 2531805 - RNA, 12 nt, Human
ccuuuuggcacu

SEQ ID NO: 2531806 - RNA, 12 nt, Human
ccuuuuggcccc

SEQ ID NO: 2531807 - RNA, 17 nt, Human
ccuuuugcaccugcucu

SEQ ID NO: 2531808 - RNA, 14 nt, Human
ccuuuugcaucauu

SEQ ID NO: 2531809 - RNA, 18 nt, Human
cgaccugguuuuuaaaua

SEQ ID NO: 2531810 - RNA, 16 nt, Human
cgaccugccucggccu

SEQ ID NO: 2531811 - RNA, 23 nt, Human
cgaccugauuuacaguuucaaaa

SEQ ID NO: 2531812 - RNA, 18 nt, Human
cgaccugauuuacaguuu

SEQ ID NO: 2531813 - RNA, 16 nt, Human
cgaccccaucugccca

SEQ ID NO: 2531814 - RNA, 15 nt, Human
cgaccccaucugccc

SEQ ID NO: 2531815 - RNA, 14 nt, Human
cgaccccaucugcc

SEQ ID NO: 2531816 - RNA, 13 nt, Human
cgaccgcccccuc

SEQ ID NO: 2531817 - RNA, 20 nt, Human
cgaccgaggcuggagcuggc

SEQ ID NO: 2531818 - RNA, 23 nt, Human
cgaccaccccugccuccacccuc

SEQ ID NO: 2531819 - RNA, 15 nt, Human
cgaccagagccccac

SEQ ID NO: 2531820 - RNA, 12 nt, Human
cgaccucagccu

SEQ ID NO: 2531821 - RNA, 13 nt, Human
cgaccucagccuu

SEQ ID NO: 2531822 - RNA, 14 nt, Human
cgaccucagccuuc

SEQ ID NO: 2531823 - RNA, 15 nt, Human
cgaccucagccuucc

SEQ ID NO: 2531824 - RNA, 12 nt, Human
cgaccucggugg

SEQ ID NO: 2531825 - RNA, 14 nt, Human
cgaccucguccucc

SEQ ID NO: 2531826 - RNA, 16 nt, Human
cgaccucguccucccc

SEQ ID NO: 2531827 - RNA, 19 nt, Human
cgaccucguccucccccug

SEQ ID NO: 2531828 - RNA, 22 nt, Human
cgaccucguccucccccugcca

SEQ ID NO: 2531829 - RNA, 20 nt, Human
cgaccucuccaucuucagcu

SEQ ID NO: 2531830 - RNA, 23 nt, Human
cgaccucguccucccccugccag

SEQ ID NO: 2531831 - RNA, 21 nt, Human
cgccgugaguucucagggcuc

SEQ ID NO: 2531832 - RNA, 19 nt, Human
cgccgugaguucucagggc

SEQ ID NO: 2531833 - RNA, 18 nt, Human
cgccgugaguucucaggg

SEQ ID NO: 2531834 - RNA, 17 nt, Human
cgccgugaguucucagg

SEQ ID NO: 2531835 - RNA, 22 nt, Human
cgccggggacagaggccugccc

SEQ ID NO: 2531836 - RNA, 20 nt, Human
cgccggggacagaggccugc

SEQ ID NO: 2531837 - RNA, 15 nt, Human
cgccgucuccagggg

SEQ ID NO: 2531838 - RNA, 14 nt, Human
cgccuacaggagug

SEQ ID NO: 2531839 - RNA, 23 nt, Human
cgccgugaguucucagggcuccu

SEQ ID NO: 2531840 - RNA, 13 nt, Human
cgccguggcugcg

SEQ ID NO: 2531841 - RNA, 15 nt, Human
cgccucccacugggg

SEQ ID NO: 2531842 - RNA, 11 nt, Human
cgccucccagc

SEQ ID NO: 2531843 - RNA, 14 nt, Human
cgccucccagccug

SEQ ID NO: 2531844 - RNA, 19 nt, Human
cgccucccacuggggucca

SEQ ID NO: 2531845 - RNA, 16 nt, Human
cgccucccacuggggu

SEQ ID NO: 2531846 - RNA, 19 nt, Human
cgccggggacagaggccug

SEQ ID NO: 2531847 - RNA, 17 nt, Human
cgccggggacagaggcc

SEQ ID NO: 2531848 - RNA, 16 nt, Human
cgccggggacagaggc

SEQ ID NO: 2531849 - RNA, 18 nt, Human
cgccggcgggcgggccgg

SEQ ID NO: 2531850 - RNA, 22 nt, Human
cgccggcaaaacuuuggcacug

SEQ ID NO: 2531851 - RNA, 23 nt, Human
cgccggaguccacucccagugcu

SEQ ID NO: 2531852 - RNA, 18 nt, Human
cgccggaguccacuccca

SEQ ID NO: 2531853 - RNA, 17 nt, Human
cgccgcuuuucuccucu

SEQ ID NO: 2531854 - RNA, 18 nt, Human
cgccgccucgcccaccgc

SEQ ID NO: 2531855 - RNA, 20 nt, Human
cgccgccugguacucaagcc

SEQ ID NO: 2531856 - RNA, 22 nt, Human
cgccgccggaguccacucccag

SEQ ID NO: 2531857 - RNA, 23 nt, Human
cgccgcaaaccacacuggacucc

SEQ ID NO: 2531858 - RNA, 22 nt, Human
cgccgcaaaccacacuggacuc

SEQ ID NO: 2531859 - RNA, 21 nt, Human
cgccgcaaaccacacuggacu

SEQ ID NO: 2531860 - RNA, 16 nt, Human
cgccgccucgcccacc

SEQ ID NO: 2531861 - RNA, 13 nt, Human
cgccgccucgccc

SEQ ID NO: 2531862 - RNA, 12 nt, Human
cgccgccucuuu

SEQ ID NO: 2531863 - RNA, 15 nt, Human
cgccgccugguacuc

SEQ ID NO: 2531864 - RNA, 14 nt, Human
cgccgccugguacu

SEQ ID NO: 2531865 - RNA, 14 nt, Human
cgcaggcuggcccu

SEQ ID NO: 2531866 - RNA, 15 nt, Human
cgcaggcuggcccug

SEQ ID NO: 2531867 - RNA, 17 nt, Human
cgcaggcuggcccugcc

SEQ ID NO: 2531868 - RNA, 18 nt, Human
cgcaggcuggcccugccc

SEQ ID NO: 2531869 - RNA, 19 nt, Human
cgcaggcuggcccugcccu

SEQ ID NO: 2531870 - RNA, 20 nt, Human
cgcaggcuggcccugcccug

SEQ ID NO: 2531871 - RNA, 12 nt, Human
cgccaaggcugg

SEQ ID NO: 2531872 - RNA, 13 nt, Human
cgccaaggcuggg

SEQ ID NO: 2531873 - RNA, 16 nt, Human
cgccaaggcuggggga

SEQ ID NO: 2531874 - RNA, 19 nt, Human
cgccaagcaaccugggucc

SEQ ID NO: 2531875 - RNA, 19 nt, Human
cgccgagucugucucuguc

SEQ ID NO: 2531876 - RNA, 18 nt, Human
cgccgagucugucucugu

SEQ ID NO: 2531877 - RNA, 18 nt, Human
cgccgacuuuguaccccc

SEQ ID NO: 2531878 - RNA, 20 nt, Human
cgccgcaaaccacacuggac

SEQ ID NO: 2531879 - RNA, 19 nt, Human
cgccgcaaaccacacugga

SEQ ID NO: 2531880 - RNA, 16 nt, Human
cgaguagcugggacua

SEQ ID NO: 2531881 - RNA, 15 nt, Human
cgaguagcugggacu

SEQ ID NO: 2531882 - RNA, 14 nt, Human
cgaguagcugggac

SEQ ID NO: 2531883 - RNA, 13 nt, Human
cgaguagcuggga

SEQ ID NO: 2531884 - RNA, 18 nt, Human
cgaguuacagacaaagcg

SEQ ID NO: 2531885 - RNA, 17 nt, Human
cgaguuacagacaaagc

SEQ ID NO: 2531886 - RNA, 15 nt, Human
cgagugcucauuuca

SEQ ID NO: 2531887 - RNA, 19 nt, Human
cgagugugugcaugugugu

SEQ ID NO: 2531888 - RNA, 11 nt, Human
cgagugugugc

SEQ ID NO: 2531889 - RNA, 18 nt, Human
cgagugugugcaugugug

SEQ ID NO: 2531890 - RNA, 22 nt, Human
cgagugugaagcuuccuuggcu

SEQ ID NO: 2531891 - RNA, 22 nt, Human
cgccucugcaagggcagaacac

SEQ ID NO: 2531892 - RNA, 22 nt, Human
cgccucgcccaccgcaugcccc

SEQ ID NO: 2531893 - RNA, 19 nt, Human
cgccucgcccaccgcaugc

SEQ ID NO: 2531894 - RNA, 16 nt, Human
cgccucgcccaccgca

SEQ ID NO: 2531895 - RNA, 15 nt, Human
cgccucgcccaccgc

SEQ ID NO: 2531896 - RNA, 21 nt, Human
cgccucucccgucagggccca

SEQ ID NO: 2531897 - RNA, 15 nt, Human
cgccucucccgucag

SEQ ID NO: 2531898 - RNA, 13 nt, Human
cgccucucccguc

SEQ ID NO: 2531899 - RNA, 10 nt, Human
cgccuccccg

SEQ ID NO: 2531900 - RNA, 24 nt, Human
cgccuccccacggccgcuccaggg

SEQ ID NO: 2531901 - RNA, 16 nt, Human
cgccuccccugcccca

SEQ ID NO: 2531902 - RNA, 22 nt, Human
cgccgugaguucucagggcucc

SEQ ID NO: 2531903 - RNA, 15 nt, Human
cgccucccagccugg

SEQ ID NO: 2531904 - RNA, 13 nt, Human
cgccucgcccacc

SEQ ID NO: 2531905 - RNA, 14 nt, Human
cgccucgcccaccg

SEQ ID NO: 2531906 - RNA, 22 nt, Human
cgccuccccgaaacaggcuacu

SEQ ID NO: 2531907 - RNA, 17 nt, Human
cggagcaaacucugcug

SEQ ID NO: 2531908 - RNA, 16 nt, Human
cggagcaaacucugcu

SEQ ID NO: 2531909 - RNA, 19 nt, Human
cggagauuggacggccuga

SEQ ID NO: 2531910 - RNA, 22 nt, Human
cggagccccaggccucuguguc

SEQ ID NO: 2531911 - RNA, 14 nt, Human
cggagccccaggcc

SEQ ID NO: 2531912 - RNA, 12 nt, Human
cggagccccagg

SEQ ID NO: 2531913 - RNA, 18 nt, Human
cggagccacuccucugac

SEQ ID NO: 2531914 - RNA, 21 nt, Human
cggagccacuccucugacuca

SEQ ID NO: 2531915 - RNA, 13 nt, Human
cggagccacuccu

SEQ ID NO: 2531916 - RNA, 17 nt, Human
cggagccacuccucuga

SEQ ID NO: 2531917 - RNA, 11 nt, Human
cggagccacuc

SEQ ID NO: 2531918 - RNA, 12 nt, Human
cggcggcgccgg

SEQ ID NO: 2531919 - RNA, 20 nt, Human
cggcgcuugccacuagggcu

SEQ ID NO: 2531920 - RNA, 18 nt, Human
cggcucacugcagccuca

SEQ ID NO: 2531921 - RNA, 17 nt, Human
cggcucacugcauccuc

SEQ ID NO: 2531922 - RNA, 19 nt, Human
cggcucacugcagccucaa

SEQ ID NO: 2531923 - RNA, 15 nt, Human
cggcucccuggagcc

SEQ ID NO: 2531924 - RNA, 21 nt, Human
cggcucacugcauccuccgcc

SEQ ID NO: 2531925 - RNA, 13 nt, Human
cggcuccugcugc

SEQ ID NO: 2531926 - RNA, 19 nt, Human
cggcuccucggacucugcu

SEQ ID NO: 2531927 - RNA, 12 nt, Human
cggcuccugcug

SEQ ID NO: 2531928 - RNA, 16 nt, Human
cggcucggaggaagcc

SEQ ID NO: 2531929 - RNA, 20 nt, Human
cggcucggaggaagccccca

SEQ ID NO: 2531930 - RNA, 14 nt, Human
cggcuccugugcuu

SEQ ID NO: 2531931 - RNA, 20 nt, Human
cggcucgagcaguccugccu

SEQ ID NO: 2531932 - RNA, 23 nt, Human
cggcuccugcugcaccaacccag

SEQ ID NO: 2531933 - RNA, 17 nt, Human
cggcuccugcugcacca

SEQ ID NO: 2531934 - RNA, 15 nt, Human
cggcuccugcugcac

SEQ ID NO: 2531935 - RNA, 14 nt, Human
cggcuccugcugca

SEQ ID NO: 2531936 - RNA, 13 nt, Human
cggcuccugugcu

SEQ ID NO: 2531937 - RNA, 22 nt, Human
cggagguugggugggccggcuu

SEQ ID NO: 2531938 - RNA, 19 nt, Human
cggagucagugccaggucc

SEQ ID NO: 2531939 - RNA, 15 nt, Human
cggagucagugccag

SEQ ID NO: 2531940 - RNA, 18 nt, Human
cggaguaucugggaacug

SEQ ID NO: 2531941 - RNA, 16 nt, Human
cggagguguggagccg

SEQ ID NO: 2531942 - RNA, 13 nt, Human
cggagguugcagg

SEQ ID NO: 2531943 - RNA, 17 nt, Human
cggagcuaacacuggcc

SEQ ID NO: 2531944 - RNA, 18 nt, Human
cggagcuaacacuggccc

SEQ ID NO: 2531945 - RNA, 20 nt, Human
cggagccgggaaagaagagc

SEQ ID NO: 2531946 - RNA, 22 nt, Human
cggagccucauccgaggcaggg

SEQ ID NO: 2531947 - RNA, 20 nt, Human
cggagccucauccgaggcag

SEQ ID NO: 2531948 - RNA, 21 nt, Human
cggagccucauccgaggcagg

SEQ ID NO: 2531949 - RNA, 18 nt, Human
cggaggggccuggcagcc

SEQ ID NO: 2531950 - RNA, 16 nt, Human
cggaggggccuggcag

SEQ ID NO: 2531951 - RNA, 14 nt, Human
cggagucccaccuu

SEQ ID NO: 2531952 - RNA, 20 nt, Human
cggaguccacucccagugcu

SEQ ID NO: 2531953 - RNA, 16 nt, Human
cggaguccacucccag

SEQ ID NO: 2531954 - RNA, 13 nt, Human
cggcgccaccauc

SEQ ID NO: 2531955 - RNA, 17 nt, Human
cggcgccaccauccugc

SEQ ID NO: 2531956 - RNA, 15 nt, Human
cggcgccaccauccu

SEQ ID NO: 2531957 - RNA, 18 nt, Human
cggcgccccugccaccuc

SEQ ID NO: 2531958 - RNA, 18 nt, Human
cggcgcccucuguccuga

SEQ ID NO: 2531959 - RNA, 17 nt, Human
cggcgcccucuguccug

SEQ ID NO: 2531960 - RNA, 13 nt, Human
cggcgcgguggcu

SEQ ID NO: 2531961 - RNA, 20 nt, Human
cggcgcgguggcucacgccu

SEQ ID NO: 2531962 - RNA, 13 nt, Human
cggcggagcuggc

SEQ ID NO: 2531963 - RNA, 21 nt, Human
cggcggagcuggccccgccgc

SEQ ID NO: 2531964 - RNA, 19 nt, Human
cggcggagcuggccccgcc

SEQ ID NO: 2531965 - RNA, 14 nt, Human
cuaccugaggggcc

SEQ ID NO: 2531966 - RNA, 11 nt, Human
cuaccugaggg

SEQ ID NO: 2531967 - RNA, 19 nt, Human
cuaccugacacucccuugg

SEQ ID NO: 2531968 - RNA, 20 nt, Human
cuaccugacacucccuuggg

SEQ ID NO: 2531969 - RNA, 18 nt, Human
cuagcccaggagagagaa

SEQ ID NO: 2531970 - RNA, 17 nt, Human
cuagcccaggagagaga

SEQ ID NO: 2531971 - RNA, 16 nt, Human
cuagcccaggagagag

SEQ ID NO: 2531972 - RNA, 15 nt, Human
cuagcccaggagaga

SEQ ID NO: 2531973 - RNA, 21 nt, Human
cuagccaccaacucuugcagg

SEQ ID NO: 2531974 - RNA, 15 nt, Human
cuagccaccaacucu

SEQ ID NO: 2531975 - RNA, 22 nt, Human
cuagccaccaacucuugcaggu

SEQ ID NO: 2531976 - RNA, 14 nt, Human
cuagcccaggagag

SEQ ID NO: 2531977 - RNA, 23 nt, Human
cuagcccaggagagagaaagcca

SEQ ID NO: 2531978 - RNA, 22 nt, Human
cuagcccaggagagagaaagcc

SEQ ID NO: 2531979 - RNA, 20 nt, Human
cuagcccaggagagagaaag

SEQ ID NO: 2531980 - RNA, 19 nt, Human
cuagcccaggagagagaaa

SEQ ID NO: 2531981 - RNA, 19 nt, Human
cuagcccauggacuucaca

SEQ ID NO: 2531982 - RNA, 14 nt, Human
cuagcccauggacu

SEQ ID NO: 2531983 - RNA, 13 nt, Human
cuagccccugugg

SEQ ID NO: 2531984 - RNA, 23 nt, Human
cuagccaaaugguuuaacuucug

SEQ ID NO: 2531985 - RNA, 18 nt, Human
cuagccaccgccuccuac

SEQ ID NO: 2531986 - RNA, 17 nt, Human
cuagcauggcugccaau

SEQ ID NO: 2531987 - RNA, 15 nt, Human
cuagaagaugaauac

SEQ ID NO: 2531988 - RNA, 16 nt, Human
cuagaacacagaaagc

SEQ ID NO: 2531989 - RNA, 22 nt, Human
cuagcagugaugaaaaugaauc

SEQ ID NO: 2531990 - RNA, 20 nt, Human
cuagaagaugaauacaaaca

SEQ ID NO: 2531991 - RNA, 23 nt, Human
cuagcagcagggagggcuucugc

SEQ ID NO: 2531992 - RNA, 16 nt, Human
cuagaacucccuuuca

SEQ ID NO: 2531993 - RNA, 17 nt, Human
cuagaacucccuuucaa

SEQ ID NO: 2531994 - RNA, 18 nt, Human
cuagaacucccuuucaac

SEQ ID NO: 2531995 - RNA, 19 nt, Human
cuagaacucccuuucaaca

SEQ ID NO: 2531996 - RNA, 12 nt, Human
cuagcagcaggg

SEQ ID NO: 2531997 - RNA, 22 nt, Human
cuagcagcagggagggcuucug

SEQ ID NO: 2531998 - RNA, 21 nt, Human
cuagaacacaggcaaaauccu

SEQ ID NO: 2531999 - RNA, 22 nt, Human
cuagaacacaggcaaaauccuu

SEQ ID NO: 2532000 - RNA, 18 nt, Human
cuagaacucuccaucuua

SEQ ID NO: 2532001 - RNA, 19 nt, Human
cuagaaauuccccacccug

SEQ ID NO: 2532002 - RNA, 14 nt, Human
cuagaacacaggca

SEQ ID NO: 2532003 - RNA, 19 nt, Human
cuagaacacaggcaaaauc

SEQ ID NO: 2532004 - RNA, 13 nt, Human
cuagaaauuuuuc

SEQ ID NO: 2532005 - RNA, 23 nt, Human
cuagaaauuuuucagaugcuucu

SEQ ID NO: 2532006 - RNA, 16 nt, Human
cuagaaauugacacaa

SEQ ID NO: 2532007 - RNA, 20 nt, Human
cuagaaauugacacaagugg

SEQ ID NO: 2532008 - RNA, 23 nt, Human
cuagaaaugauccccagcuguuu

SEQ ID NO: 2532009 - RNA, 20 nt, Human
cuaguuccaccaucaagcca

SEQ ID NO: 2532010 - RNA, 18 nt, Human
cuaguuccaccaucaagc

SEQ ID NO: 2532011 - RNA, 17 nt, Human
cuagggccaagcccagc

SEQ ID NO: 2532012 - RNA, 18 nt, Human
cuagggccaagcccagca

SEQ ID NO: 2532013 - RNA, 15 nt, Human
cuagggccuggguuu

SEQ ID NO: 2532014 - RNA, 17 nt, Human
cuaggggagcagggggc

SEQ ID NO: 2532015 - RNA, 12 nt, Human
cuaggggagcag

SEQ ID NO: 2532016 - RNA, 19 nt, Human
cuaggggacacuucccucu

SEQ ID NO: 2532017 - RNA, 15 nt, Human
cuagggccacugaag

SEQ ID NO: 2532018 - RNA, 14 nt, Human
cuaguuccaccauc

SEQ ID NO: 2532019 - RNA, 21 nt, Human
cuagggaaaaaccagcgugug

SEQ ID NO: 2532020 - RNA, 13 nt, Human
cuagggaucccuc

SEQ ID NO: 2532021 - RNA, 17 nt, Human
cuagggaucccucaucu

SEQ ID NO: 2532022 - RNA, 22 nt, Human
cuaggcuggggaaguccucugg

SEQ ID NO: 2532023 - RNA, 13 nt, Human
cuaggcuggggaa

SEQ ID NO: 2532024 - RNA, 21 nt, Human
cuaggcuucagcauauuuaua

SEQ ID NO: 2532025 - RNA, 23 nt, Human
cuaggcuucagcauauuuauagc

SEQ ID NO: 2532026 - RNA, 16 nt, Human
cuagggccaagcccag

SEQ ID NO: 2532027 - RNA, 20 nt, Human
cuagggauucaggcugcuug

SEQ ID NO: 2532028 - RNA, 17 nt, Human
cuagggauucaggcugc

SEQ ID NO: 2532029 - RNA, 18 nt, Human
cuagggauucaggcugcu

SEQ ID NO: 2532030 - RNA, 23 nt, Human
cuagggaucccucaucugucccu

SEQ ID NO: 2532031 - RNA, 16 nt, Human
cuagggaguggucuuu

SEQ ID NO: 2532032 - RNA, 19 nt, Human
cuagggauguucuggcccu

SEQ ID NO: 2532033 - RNA, 15 nt, Human
cuagggauucaggcu

SEQ ID NO: 2532034 - RNA, 16 nt, Human
cuagggauucaggcug

SEQ ID NO: 2532035 - RNA, 21 nt, Human
cuagccccuguggagacuggg

SEQ ID NO: 2532036 - RNA, 20 nt, Human
cuagccccuguggagacugg

SEQ ID NO: 2532037 - RNA, 14 nt, Human
cuagccccugugga

SEQ ID NO: 2532038 - RNA, 22 nt, Human
cuagcccauggacuucacauaa

SEQ ID NO: 2532039 - RNA, 16 nt, Human
cuagcccgaauacaaa

SEQ ID NO: 2532040 - RNA, 13 nt, Human
cuagcccucucac

SEQ ID NO: 2532041 - RNA, 18 nt, Human
cuagcccucucacauuua

SEQ ID NO: 2532042 - RNA, 19 nt, Human
cuagcccucucacauuuau

SEQ ID NO: 2532043 - RNA, 13 nt, Human
cuagccgaccuca

SEQ ID NO: 2532044 - RNA, 14 nt, Human
cuagccgaccucag

SEQ ID NO: 2532045 - RNA, 15 nt, Human
cuagccgaccucagc

SEQ ID NO: 2532046 - RNA, 16 nt, Human
cuagccgaccucagcc

SEQ ID NO: 2532047 - RNA, 17 nt, Human
cuagccgaccucagccu

SEQ ID NO: 2532048 - RNA, 18 nt, Human
cuagccgaccucagccuu

SEQ ID NO: 2532049 - RNA, 19 nt, Human
cuagccgaccucagccuuc

SEQ ID NO: 2532050 - RNA, 20 nt, Human
cuagccgaccucagccuucc

SEQ ID NO: 2532051 - RNA, 19 nt, Human
cuagggaaaaaccagcgug

SEQ ID NO: 2532052 - RNA, 17 nt, Human
cuaggcuggagcccagg

SEQ ID NO: 2532053 - RNA, 15 nt, Human
cuaggcuggagccca

SEQ ID NO: 2532054 - RNA, 11 nt, Human
cuaggcugggg

SEQ ID NO: 2532055 - RNA, 20 nt, Human
cuaggcuggagcccagggag

SEQ ID NO: 2532056 - RNA, 21 nt, Human
cuaggcuuaauaccuggguga

SEQ ID NO: 2532057 - RNA, 13 nt, Human
cuagccucuccag

SEQ ID NO: 2532058 - RNA, 22 nt, Human
cuauaaccccagcucccuagga

SEQ ID NO: 2532059 - RNA, 16 nt, Human
cuaguucuguagaaau

SEQ ID NO: 2532060 - RNA, 23 nt, Human
cuaguucuguagaaaugguugua

SEQ ID NO: 2532061 - RNA, 17 nt, Human
cuaguucuguagaaaug

SEQ ID NO: 2532062 - RNA, 22 nt, Human
cuaguuccaccaucaagccacc

SEQ ID NO: 2532063 - RNA, 23 nt, Human
cuaguugaucagcuuauugucua

SEQ ID NO: 2532064 - RNA, 22 nt, Human
cuaguucuuuguucauagccca

SEQ ID NO: 2532065 - RNA, 23 nt, Human
cuauaaauuccucuuugcuuugc

SEQ ID NO: 2532066 - RNA, 19 nt, Human
cuauaaauuccucuuugcu

SEQ ID NO: 2532067 - RNA, 22 nt, Human
cuauaaauuccucuuugcuuug

SEQ ID NO: 2532068 - RNA, 18 nt, Human
cuauaaccccagcucccu

SEQ ID NO: 2532069 - RNA, 15 nt, Human
cuauaaauuccucuu

SEQ ID NO: 2532070 - RNA, 17 nt, Human
cuauaaauuccucuuug

SEQ ID NO: 2532071 - RNA, 18 nt, Human
cuauaaaugguguuuuuu

SEQ ID NO: 2532072 - RNA, 16 nt, Human
cuauaaaugguguuuu

SEQ ID NO: 2532073 - RNA, 23 nt, Human
cuauaaaugguguuuuuuuaaua

SEQ ID NO: 2532074 - RNA, 17 nt, Human
cuauaaaguaaagcuaa

SEQ ID NO: 2532075 - RNA, 14 nt, Human
cuaagucuuuccau

SEQ ID NO: 2532076 - RNA, 20 nt, Human
cuaagugaaauaagccagac

SEQ ID NO: 2532077 - RNA, 23 nt, Human
cuaagugaaauaagccagacauc

SEQ ID NO: 2532078 - RNA, 15 nt, Human
cuacaugaaacagaa

SEQ ID NO: 2532079 - RNA, 16 nt, Human
cuacaugaaacagaaa

SEQ ID NO: 2532080 - RNA, 18 nt, Human
cuacaugaaacagaaaca

SEQ ID NO: 2532081 - RNA, 13 nt, Human
cuacaugagaaca

SEQ ID NO: 2532082 - RNA, 15 nt, Human
cuacaugagguacug

SEQ ID NO: 2532083 - RNA, 14 nt, Human
cuacaugagaacaa

SEQ ID NO: 2532084 - RNA, 17 nt, Human
cuacaugagaacaaaca

SEQ ID NO: 2532085 - RNA, 15 nt, Human
cuaccuccucaggga

SEQ ID NO: 2532086 - RNA, 22 nt, Human
cuacauaaacugacuuuauccu

SEQ ID NO: 2532087 - RNA, 18 nt, Human
cuacauaaacugacuuua

SEQ ID NO: 2532088 - RNA, 17 nt, Human
cuacauaaacugacuuu

SEQ ID NO: 2532089 - RNA, 22 nt, Human
cuacauaaguaauucaagaaaa

SEQ ID NO: 2532090 - RNA, 15 nt, Human
cuacauaaacugacu

SEQ ID NO: 2532091 - RNA, 12 nt, Human
cuacauaaacug

SEQ ID NO: 2532092 - RNA, 23 nt, Human
cuacauaaguaauucaagaaaac

SEQ ID NO: 2532093 - RNA, 14 nt, Human
cuacaugaaacaga

SEQ ID NO: 2532094 - RNA, 20 nt, Human
cuacauaaacugacuuuauc

SEQ ID NO: 2532095 - RNA, 18 nt, Human
cuacauacaauuccaaac

SEQ ID NO: 2532096 - RNA, 18 nt, Human
cuacaguccucccaucuc

SEQ ID NO: 2532097 - RNA, 17 nt, Human
cuacaguccucccaucu

SEQ ID NO: 2532098 - RNA, 16 nt, Human
cuacaguccucccauc

SEQ ID NO: 2532099 - RNA, 15 nt, Human
cuacaguccucccau

SEQ ID NO: 2532100 - RNA, 17 nt, Human
cuacaguguacagucuu

SEQ ID NO: 2532101 - RNA, 16 nt, Human
cuacaguguacagucu

SEQ ID NO: 2532102 - RNA, 17 nt, Human
cuacaacuucagcagua

SEQ ID NO: 2532103 - RNA, 16 nt, Human
cuacaacuucagcagu

SEQ ID NO: 2532104 - RNA, 14 nt, Human
cuacaguguacagu

SEQ ID NO: 2532105 - RNA, 15 nt, Human
cuacaguguacaguc

SEQ ID NO: 2532106 - RNA, 13 nt, Human
cuacaguugaaaa

SEQ ID NO: 2532107 - RNA, 23 nt, Human
cuacaguuaggguugaguuacuu

SEQ ID NO: 2532108 - RNA, 20 nt, Human
cuacaguguacagucuugua

SEQ ID NO: 2532109 - RNA, 22 nt, Human
cuaagugauccucccaccucag

SEQ ID NO: 2532110 - RNA, 20 nt, Human
cuaagugauccucccaccuc

SEQ ID NO: 2532111 - RNA, 18 nt, Human
cuaagugaggaugaaaaa

SEQ ID NO: 2532112 - RNA, 13 nt, Human
cuaagugauauaa

SEQ ID NO: 2532113 - RNA, 16 nt, Human
cuaagucuuuccauug

SEQ ID NO: 2532114 - RNA, 14 nt, Human
cuaagugaaaaggu

SEQ ID NO: 2532115 - RNA, 16 nt, Human
cuaagugauauaaauc

SEQ ID NO: 2532116 - RNA, 14 nt, Human
cuaagugauauaaa

SEQ ID NO: 2532117 - RNA, 19 nt, Human
cuaauuggaagaaauuccu

SEQ ID NO: 2532118 - RNA, 22 nt, Human
cuaauuggaagaaauuccugua

SEQ ID NO: 2532119 - RNA, 21 nt, Human
cuaauuggaagaaauuccugu

SEQ ID NO: 2532120 - RNA, 22 nt, Human
cuaauuggcaugaaggugucau

SEQ ID NO: 2532121 - RNA, 12 nt, Human
cuaauuuaaaaa

SEQ ID NO: 2532122 - RNA, 22 nt, Human
cuaauuguauaacagguuauuu

SEQ ID NO: 2532123 - RNA, 20 nt, Human
cuaauuguauaacagguuau

SEQ ID NO: 2532124 - RNA, 19 nt, Human
cuaauuguauaacagguua

SEQ ID NO: 2532125 - RNA, 14 nt, Human
cuaauuuaaaaaau

SEQ ID NO: 2532126 - RNA, 18 nt, Human
cuaauuguauaacagguu

SEQ ID NO: 2532127 - RNA, 17 nt, Human
cuaauuguauaacaggu

SEQ ID NO: 2532128 - RNA, 16 nt, Human
cuaauuguauaacagg

SEQ ID NO: 2532129 - RNA, 15 nt, Human
cuaauuguauaacag

SEQ ID NO: 2532130 - RNA, 13 nt, Human
cuaauuguauaac

SEQ ID NO: 2532131 - RNA, 19 nt, Human
cuaauuggccucuuuaaga

SEQ ID NO: 2532132 - RNA, 16 nt, Human
cuacaacaagaguuua

SEQ ID NO: 2532133 - RNA, 18 nt, Human
cuacaaccaagcucucug

SEQ ID NO: 2532134 - RNA, 13 nt, Human
cuacaaccaagcu

SEQ ID NO: 2532135 - RNA, 14 nt, Human
cuacaacuucagca

SEQ ID NO: 2532136 - RNA, 20 nt, Human
cuacaaccaagcucucugca

SEQ ID NO: 2532137 - RNA, 14 nt, Human
cuacaacugagucc

SEQ ID NO: 2532138 - RNA, 18 nt, Human
cuacaaagaagacauguu

SEQ ID NO: 2532139 - RNA, 16 nt, Human
cuacaaagaagacaug

SEQ ID NO: 2532140 - RNA, 15 nt, Human
cuacaaagaagacau

SEQ ID NO: 2532141 - RNA, 14 nt, Human
cuacaaagaagaca

SEQ ID NO: 2532142 - RNA, 20 nt, Human
cuacaaagaagacauguuuu

SEQ ID NO: 2532143 - RNA, 19 nt, Human
cuacaaagaagacauguuu

SEQ ID NO: 2532144 - RNA, 10 nt, Human
cuacaaauca

SEQ ID NO: 2532145 - RNA, 20 nt, Human
cuaauuuuuguauuuuucgu

SEQ ID NO: 2532146 - RNA, 21 nt, Human
cuacaaacaaaauuucuauua

SEQ ID NO: 2532147 - RNA, 23 nt, Human
cuacaaaaaauuagaaauuggcu

SEQ ID NO: 2532148 - RNA, 14 nt, Human
cuaauuuuuguaau

SEQ ID NO: 2532149 - RNA, 20 nt, Human
cuaauuuuuguaauuuuagu

SEQ ID NO: 2532150 - RNA, 17 nt, Human
cuaauuuuuauucauaa

SEQ ID NO: 2532151 - RNA, 17 nt, Human
cuaauuuuuaagcaaaa

SEQ ID NO: 2532152 - RNA, 21 nt, Human
cguggugaucaauuaaaugua

SEQ ID NO: 2532153 - RNA, 14 nt, Human
cgugucuguauuua

SEQ ID NO: 2532154 - RNA, 15 nt, Human
cgugugauuuuucug

SEQ ID NO: 2532155 - RNA, 11 nt, Human
cgugugauuuu

SEQ ID NO: 2532156 - RNA, 22 nt, Human
cgugugagaagugaaugcuggg

SEQ ID NO: 2532157 - RNA, 22 nt, Human
cuaaacugcccccucugcccug

SEQ ID NO: 2532158 - RNA, 23 nt, Human
cgugugagaagugaaugcuggga

SEQ ID NO: 2532159 - RNA, 21 nt, Human
cgugugagaagugaaugcugg

SEQ ID NO: 2532160 - RNA, 22 nt, Human
cgugucuguauuuaugugugag

SEQ ID NO: 2532161 - RNA, 16 nt, Human
cuaaacuuccccaucu

SEQ ID NO: 2532162 - RNA, 20 nt, Human
cuaaacuuccccaucuucua

SEQ ID NO: 2532163 - RNA, 23 nt, Human
cuaaacugcccccucugcccugc

SEQ ID NO: 2532164 - RNA, 18 nt, Human
cgugugauuuuucuggag

SEQ ID NO: 2532165 - RNA, 18 nt, Human
cgugugcacacacaccac

SEQ ID NO: 2532166 - RNA, 18 nt, Human
cuaaagagcccuugccuc

SEQ ID NO: 2532167 - RNA, 17 nt, Human
cuaaagagcccuugccu

SEQ ID NO: 2532168 - RNA, 16 nt, Human
cuaaagagcccuugcc

SEQ ID NO: 2532169 - RNA, 15 nt, Human
cuaaagagcccuugc

SEQ ID NO: 2532170 - RNA, 14 nt, Human
cuaaacuuucacac

SEQ ID NO: 2532171 - RNA, 19 nt, Human
cuaaagagagaauguagau

SEQ ID NO: 2532172 - RNA, 13 nt, Human
cuaaacuuucaca

SEQ ID NO: 2532173 - RNA, 14 nt, Human
cgugagaccugccc

SEQ ID NO: 2532174 - RNA, 16 nt, Human
cgugagaccugccccu

SEQ ID NO: 2532175 - RNA, 23 nt, Human
cgugagccaccgugccuggccac

SEQ ID NO: 2532176 - RNA, 21 nt, Human
cgugagacgccaccauuccug

SEQ ID NO: 2532177 - RNA, 23 nt, Human
cgugagagugucuucacggcagg

SEQ ID NO: 2532178 - RNA, 13 nt, Human
cgugagaccugcc

SEQ ID NO: 2532179 - RNA, 20 nt, Human
cgugacugccccaacuccug

SEQ ID NO: 2532180 - RNA, 21 nt, Human
cgugacugccccaacuccugg

SEQ ID NO: 2532181 - RNA, 22 nt, Human
cgugacugccccaacuccugga

SEQ ID NO: 2532182 - RNA, 23 nt, Human
cgugacugccccaacuccuggaa

SEQ ID NO: 2532183 - RNA, 14 nt, Human
cgugacucacccaa

SEQ ID NO: 2532184 - RNA, 15 nt, Human
cgugacucacccaag

SEQ ID NO: 2532185 - RNA, 16 nt, Human
cgugacucacccaagc

SEQ ID NO: 2532186 - RNA, 17 nt, Human
cgugacucacccaagca

SEQ ID NO: 2532187 - RNA, 18 nt, Human
cgugacucacccaagcau

SEQ ID NO: 2532188 - RNA, 13 nt, Human
cgugacugcccca

SEQ ID NO: 2532189 - RNA, 16 nt, Human
cgugacugccccaacu

SEQ ID NO: 2532190 - RNA, 17 nt, Human
cgugacugccccaacuc

SEQ ID NO: 2532191 - RNA, 18 nt, Human
cguggggugugcugggag

SEQ ID NO: 2532192 - RNA, 17 nt, Human
cguggggugugcuggga

SEQ ID NO: 2532193 - RNA, 15 nt, Human
cguggggugugcugg

SEQ ID NO: 2532194 - RNA, 23 nt, Human
cgugagacgccaccauuccugga

SEQ ID NO: 2532195 - RNA, 18 nt, Human
cguggggcagcacagaga

SEQ ID NO: 2532196 - RNA, 14 nt, Human
cgugagccaccgcg

SEQ ID NO: 2532197 - RNA, 20 nt, Human
cguggggcagcacagagagg

SEQ ID NO: 2532198 - RNA, 23 nt, Human
cguggguguguguagccaagguc

SEQ ID NO: 2532199 - RNA, 20 nt, Human
cgugggucuguuuuccuuuc

SEQ ID NO: 2532200 - RNA, 19 nt, Human
cgugggucuguuuuccuuu

SEQ ID NO: 2532201 - RNA, 18 nt, Human
cgugggucuguuuuccuu

SEQ ID NO: 2532202 - RNA, 21 nt, Human
cgugguccccaacagcgacau

SEQ ID NO: 2532203 - RNA, 17 nt, Human
cguggucacugcuguca

SEQ ID NO: 2532204 - RNA, 16 nt, Human
cguggucacugcuguc

SEQ ID NO: 2532205 - RNA, 15 nt, Human
cguggucacugcugu

SEQ ID NO: 2532206 - RNA, 15 nt, Human
cguggucaagcacuc

SEQ ID NO: 2532207 - RNA, 22 nt, Human
cgugggucuucagggggccagg

SEQ ID NO: 2532208 - RNA, 20 nt, Human
cgugaccggacuuuucugca

SEQ ID NO: 2532209 - RNA, 23 nt, Human
cgugaccaacuagacauucuguc

SEQ ID NO: 2532210 - RNA, 17 nt, Human
cgugacagugccuggga

SEQ ID NO: 2532211 - RNA, 18 nt, Human
cgugacauccccacccuu

SEQ ID NO: 2532212 - RNA, 19 nt, Human
cgugacgcugaauaaaugu

SEQ ID NO: 2532213 - RNA, 16 nt, Human
cgugacgcugaauaaa

SEQ ID NO: 2532214 - RNA, 14 nt, Human
cgugacgcugaaua

SEQ ID NO: 2532215 - RNA, 20 nt, Human
cgugacgcugaauaaauguc

SEQ ID NO: 2532216 - RNA, 13 nt, Human
cgugacucaccca

SEQ ID NO: 2532217 - RNA, 18 nt, Human
cgugacagacuccugagg

SEQ ID NO: 2532218 - RNA, 16 nt, Human
cgugacagugccuggg

SEQ ID NO: 2532219 - RNA, 17 nt, Human
cgugacagacuccugag

SEQ ID NO: 2532220 - RNA, 18 nt, Human
cggcugagagccccagcu

SEQ ID NO: 2532221 - RNA, 17 nt, Human
cggcugagagccccagc

SEQ ID NO: 2532222 - RNA, 16 nt, Human
cggcugagagccccag

SEQ ID NO: 2532223 - RNA, 15 nt, Human
cggcugagagcccca

SEQ ID NO: 2532224 - RNA, 20 nt, Human
cggcugagagccccagcuga

SEQ ID NO: 2532225 - RNA, 19 nt, Human
cggcugagagccccagcug

SEQ ID NO: 2532226 - RNA, 14 nt, Human
cggcugagagcccc

SEQ ID NO: 2532227 - RNA, 11 nt, Human
cggcugagagc

SEQ ID NO: 2532228 - RNA, 23 nt, Human
cggcugaccaugcucaucugcug

SEQ ID NO: 2532229 - RNA, 22 nt, Human
cggcugaccaugcucaucugcu

SEQ ID NO: 2532230 - RNA, 16 nt, Human
cggcugaccaugcuca

SEQ ID NO: 2532231 - RNA, 15 nt, Human
cggcugaccaugcuc

SEQ ID NO: 2532232 - RNA, 14 nt, Human
cggcugaccaugcu

SEQ ID NO: 2532233 - RNA, 11 nt, Human
cggcugaccau

SEQ ID NO: 2532234 - RNA, 18 nt, Human
cggcucuuuccuugcuca

SEQ ID NO: 2532235 - RNA, 23 nt, Human
cggcucucuauagcaccagggcu

SEQ ID NO: 2532236 - RNA, 16 nt, Human
cggcucuuuccuugcu

SEQ ID NO: 2532237 - RNA, 18 nt, Human
cggcucuagguggggcgg

SEQ ID NO: 2532238 - RNA, 23 nt, Human
cggcuccugugcuuucccugaac

SEQ ID NO: 2532239 - RNA, 16 nt, Human
cuaagaaagaggagug

SEQ ID NO: 2532240 - RNA, 21 nt, Human
cuaagaaaagauuuuaaucaa

SEQ ID NO: 2532241 - RNA, 20 nt, Human
cuaagaaaagauuuuaauca

SEQ ID NO: 2532242 - RNA, 16 nt, Human
cuaacuucaccauauu

SEQ ID NO: 2532243 - RNA, 16 nt, Human
cuaacuuuccuucauu

SEQ ID NO: 2532244 - RNA, 22 nt, Human
cuaagaaaagauacgacuuuau

SEQ ID NO: 2532245 - RNA, 14 nt, Human
cuaagaaaagauuu

SEQ ID NO: 2532246 - RNA, 15 nt, Human
cuaagaaaagauuuu

SEQ ID NO: 2532247 - RNA, 23 nt, Human
cuaagaaaagauacgacuuuauu

SEQ ID NO: 2532248 - RNA, 15 nt, Human
cuaacuucaccauau

SEQ ID NO: 2532249 - RNA, 12 nt, Human
cuaaccugugac

SEQ ID NO: 2532250 - RNA, 17 nt, Human
cuaaccuggguucccuu

SEQ ID NO: 2532251 - RNA, 22 nt, Human
cuaaagagcccuugccucccca

SEQ ID NO: 2532252 - RNA, 21 nt, Human
cuaaagagcccuugccucccc

SEQ ID NO: 2532253 - RNA, 20 nt, Human
cuaaagagcccuugccuccc

SEQ ID NO: 2532254 - RNA, 19 nt, Human
cuaaagagcccuugccucc

SEQ ID NO: 2532255 - RNA, 23 nt, Human
cuaaagagcccuugccuccccau

SEQ ID NO: 2532256 - RNA, 18 nt, Human
cuaaagaggcugaaagag

SEQ ID NO: 2532257 - RNA, 18 nt, Human
cuaaagaguuuauuuuaa

SEQ ID NO: 2532258 - RNA, 19 nt, Human
cuaaagaguuuauuuuaag

SEQ ID NO: 2532259 - RNA, 15 nt, Human
cucagucucccuuuc

SEQ ID NO: 2532260 - RNA, 14 nt, Human
cucagucucccuuu

SEQ ID NO: 2532261 - RNA, 13 nt, Human
cucagucucugag

SEQ ID NO: 2532262 - RNA, 17 nt, Human
cucagucuggcccuucc

SEQ ID NO: 2532263 - RNA, 18 nt, Human
cucagucuggcccuuccu

SEQ ID NO: 2532264 - RNA, 12 nt, Human
cucaugaaccuc

SEQ ID NO: 2532265 - RNA, 21 nt, Human
cucaugaaccucaagcugcau

SEQ ID NO: 2532266 - RNA, 13 nt, Human
cucaugaaucugc

SEQ ID NO: 2532267 - RNA, 15 nt, Human
cucaucuuucuugau

SEQ ID NO: 2532268 - RNA, 13 nt, Human
cucaucuuucuug

SEQ ID NO: 2532269 - RNA, 12 nt, Human
cucaucuuucuu

SEQ ID NO: 2532270 - RNA, 17 nt, Human
cucaucuucuucaccau

SEQ ID NO: 2532271 - RNA, 18 nt, Human
cucaucuuagugccugag

SEQ ID NO: 2532272 - RNA, 22 nt, Human
cucaucuuucauuaaaggcuuc

SEQ ID NO: 2532273 - RNA, 14 nt, Human
cucagucucugagc

SEQ ID NO: 2532274 - RNA, 20 nt, Human
cucagucucugagcagugaa

SEQ ID NO: 2532275 - RNA, 13 nt, Human
cucagugccacua

SEQ ID NO: 2532276 - RNA, 18 nt, Human
cucaguggcuucaucugu

SEQ ID NO: 2532277 - RNA, 21 nt, Human
cucaguggcuucaucugucaa

SEQ ID NO: 2532278 - RNA, 22 nt, Human
cucaguggacuuuccacccccu

SEQ ID NO: 2532279 - RNA, 16 nt, Human
cucaguggacuuucca

SEQ ID NO: 2532280 - RNA, 19 nt, Human
cucaguggacuuuccaccc

SEQ ID NO: 2532281 - RNA, 20 nt, Human
cucaguggacuuuccacccc

SEQ ID NO: 2532282 - RNA, 17 nt, Human
cucaguguauuuguauu

SEQ ID NO: 2532283 - RNA, 16 nt, Human
cucaguguauuuguau

SEQ ID NO: 2532284 - RNA, 12 nt, Human
cucaguguauuu

SEQ ID NO: 2532285 - RNA, 14 nt, Human
cucagugucauuua

SEQ ID NO: 2532286 - RNA, 17 nt, Human
cucagugucauuuauga

SEQ ID NO: 2532287 - RNA, 18 nt, Human
cucagugucauuuaugaa

SEQ ID NO: 2532288 - RNA, 22 nt, Human
cucagugucauuuaugaaaaga

SEQ ID NO: 2532289 - RNA, 12 nt, Human
cucauguucuua

SEQ ID NO: 2532290 - RNA, 14 nt, Human
cucauguucuuaau

SEQ ID NO: 2532291 - RNA, 18 nt, Human
cucauguucuuaauucuu

SEQ ID NO: 2532292 - RNA, 19 nt, Human
cucauguucuuaauucuua

SEQ ID NO: 2532293 - RNA, 15 nt, Human
cucaugcugaaagcc

SEQ ID NO: 2532294 - RNA, 15 nt, Human
cucaugcuaauauaa

SEQ ID NO: 2532295 - RNA, 21 nt, Human
cucaugccuguaaucccagca

SEQ ID NO: 2532296 - RNA, 18 nt, Human
cucaugccucagccuccu

SEQ ID NO: 2532297 - RNA, 20 nt, Human
cucaugccucagccuccuga

SEQ ID NO: 2532298 - RNA, 13 nt, Human
cucaugcugaaag

SEQ ID NO: 2532299 - RNA, 12 nt, Human
cucaugcugaaa

SEQ ID NO: 2532300 - RNA, 14 nt, Human
cucaugcugaaagc

SEQ ID NO: 2532301 - RNA, 23 nt, Human
cuccaaccccccagcacugagga

SEQ ID NO: 2532302 - RNA, 22 nt, Human
cuccaaccccccagcacugagg

SEQ ID NO: 2532303 - RNA, 21 nt, Human
cuccaaccccccagcacugag

SEQ ID NO: 2532304 - RNA, 20 nt, Human
cuccaaccccccagcacuga

SEQ ID NO: 2532305 - RNA, 19 nt, Human
cuccaaccccccagcacug

SEQ ID NO: 2532306 - RNA, 18 nt, Human
cuccaaccccccagcacu

SEQ ID NO: 2532307 - RNA, 17 nt, Human
cuccaaccccccagcac

SEQ ID NO: 2532308 - RNA, 15 nt, Human
cuccaaccccccagc

SEQ ID NO: 2532309 - RNA, 23 nt, Human
cuccaacaccaagcacagcagcc

SEQ ID NO: 2532310 - RNA, 14 nt, Human
cuccaaccccccag

SEQ ID NO: 2532311 - RNA, 16 nt, Human
cuccaaagucucugga

SEQ ID NO: 2532312 - RNA, 21 nt, Human
cucauggagaagcagaaauac

SEQ ID NO: 2532313 - RNA, 20 nt, Human
cucauggagaagcagaaaua

SEQ ID NO: 2532314 - RNA, 15 nt, Human
cuccaaaggcccccu

SEQ ID NO: 2532315 - RNA, 15 nt, Human
cuccaacaccaagca

SEQ ID NO: 2532316 - RNA, 16 nt, Human
cuccaacaccaagcac

SEQ ID NO: 2532317 - RNA, 18 nt, Human
cuccaacaccaagcacag

SEQ ID NO: 2532318 - RNA, 22 nt, Human
cuccaacaccaagcacagcagc

SEQ ID NO: 2532319 - RNA, 12 nt, Human
cuccaaaugcug

SEQ ID NO: 2532320 - RNA, 15 nt, Human
cuccaaaugagaucu

SEQ ID NO: 2532321 - RNA, 21 nt, Human
cucaggccugggggcugggca

SEQ ID NO: 2532322 - RNA, 20 nt, Human
cucaggccugggggcugggc

SEQ ID NO: 2532323 - RNA, 14 nt, Human
cucaggccuggggg

SEQ ID NO: 2532324 - RNA, 13 nt, Human
cucaggccugggg

SEQ ID NO: 2532325 - RNA, 16 nt, Human
cucaggcccaaagccu

SEQ ID NO: 2532326 - RNA, 15 nt, Human
cucaggccaggugca

SEQ ID NO: 2532327 - RNA, 18 nt, Human
cucaggccaggugcagug

SEQ ID NO: 2532328 - RNA, 22 nt, Human
cucaggccagcugcuugggcuu

SEQ ID NO: 2532329 - RNA, 21 nt, Human
cucaggccagcugcuugggcu

SEQ ID NO: 2532330 - RNA, 20 nt, Human
cucaggccagcugcuugggc

SEQ ID NO: 2532331 - RNA, 14 nt, Human
cucaggccagcugc

SEQ ID NO: 2532332 - RNA, 13 nt, Human
cucagcggggaca

SEQ ID NO: 2532333 - RNA, 13 nt, Human
cucaggccaccug

SEQ ID NO: 2532334 - RNA, 16 nt, Human
cucaggccaccugccc

SEQ ID NO: 2532335 - RNA, 14 nt, Human
cucagcgaaugaau

SEQ ID NO: 2532336 - RNA, 22 nt, Human
cucagccuugccagagauccaa

SEQ ID NO: 2532337 - RNA, 11 nt, Human
cucagccuugg

SEQ ID NO: 2532338 - RNA, 15 nt, Human
cucagccuuggauaa

SEQ ID NO: 2532339 - RNA, 13 nt, Human
cucaggccagcug

SEQ ID NO: 2532340 - RNA, 18 nt, Human
cucaggccaccugccccc

SEQ ID NO: 2532341 - RNA, 19 nt, Human
cucaggccaccugcccccu

SEQ ID NO: 2532342 - RNA, 22 nt, Human
cucaggccaccugcccccuucu

SEQ ID NO: 2532343 - RNA, 23 nt, Human
cucaggccaccugcccccuucuc

SEQ ID NO: 2532344 - RNA, 18 nt, Human
cucagccuugccagagau

SEQ ID NO: 2532345 - RNA, 19 nt, Human
cucagccuugccagagauc

SEQ ID NO: 2532346 - RNA, 20 nt, Human
cucagccuugccagagaucc

SEQ ID NO: 2532347 - RNA, 21 nt, Human
cucagccuugccagagaucca

SEQ ID NO: 2532348 - RNA, 16 nt, Human
cucagccuugccagag

SEQ ID NO: 2532349 - RNA, 17 nt, Human
cucagccuugccagaga

SEQ ID NO: 2532350 - RNA, 15 nt, Human
cucagccuugccaga

SEQ ID NO: 2532351 - RNA, 23 nt, Human
cucagccuuccccuugcccaggg

SEQ ID NO: 2532352 - RNA, 15 nt, Human
cucagccuucagaca

SEQ ID NO: 2532353 - RNA, 15 nt, Human
cucagccuccugugu

SEQ ID NO: 2532354 - RNA, 16 nt, Human
cucagccugugcugcc

SEQ ID NO: 2532355 - RNA, 18 nt, Human
cucagccugugcugcccg

SEQ ID NO: 2532356 - RNA, 17 nt, Human
cucagccuucagacaga

SEQ ID NO: 2532357 - RNA, 16 nt, Human
cucagccuucagacag

SEQ ID NO: 2532358 - RNA, 19 nt, Human
cucagccuucagacagaga

SEQ ID NO: 2532359 - RNA, 22 nt, Human
cucagccuuccccuugcccagg

SEQ ID NO: 2532360 - RNA, 18 nt, Human
cucagccuccucaucugg

SEQ ID NO: 2532361 - RNA, 17 nt, Human
cucagccuccucaucug

SEQ ID NO: 2532362 - RNA, 12 nt, Human
cucagccuggug

SEQ ID NO: 2532363 - RNA, 16 nt, Human
cucagccuggugggcc

SEQ ID NO: 2532364 - RNA, 18 nt, Human
cucagccuggugggccuc

SEQ ID NO: 2532365 - RNA, 19 nt, Human
cucagccuggugggccucc

SEQ ID NO: 2532366 - RNA, 20 nt, Human
cucagccuggugggccuccu

SEQ ID NO: 2532367 - RNA, 13 nt, Human
cucagccugugcu

SEQ ID NO: 2532368 - RNA, 14 nt, Human
cucagccugugcug

SEQ ID NO: 2532369 - RNA, 12 nt, Human
cucagccuccug

SEQ ID NO: 2532370 - RNA, 13 nt, Human
cucagccuccuga

SEQ ID NO: 2532371 - RNA, 22 nt, Human
cucagccuccugaguagcugga

SEQ ID NO: 2532372 - RNA, 14 nt, Human
cucagccuccugag

SEQ ID NO: 2532373 - RNA, 16 nt, Human
cucagccucccaaagu

SEQ ID NO: 2532374 - RNA, 14 nt, Human
cucagccucccaaa

SEQ ID NO: 2532375 - RNA, 17 nt, Human
cuaucccggcugcccuu

SEQ ID NO: 2532376 - RNA, 21 nt, Human
cuaucccaauaggcagacugg

SEQ ID NO: 2532377 - RNA, 17 nt, Human
cuauccacccagcccau

SEQ ID NO: 2532378 - RNA, 21 nt, Human
cucagccucccaaagugcugg

SEQ ID NO: 2532379 - RNA, 23 nt, Human
cucagccucccgaauagcuggga

SEQ ID NO: 2532380 - RNA, 13 nt, Human
cucagccucccag

SEQ ID NO: 2532381 - RNA, 20 nt, Human
cucagccucccagagugcug

SEQ ID NO: 2532382 - RNA, 20 nt, Human
cucagccuccggaguagcug

SEQ ID NO: 2532383 - RNA, 13 nt, Human
cucagccucccga

SEQ ID NO: 2532384 - RNA, 22 nt, Human
cucagccucccaaagugcuggg

SEQ ID NO: 2532385 - RNA, 15 nt, Human
cuaucccggcugccc

SEQ ID NO: 2532386 - RNA, 16 nt, Human
cuaucccggcugcccu

SEQ ID NO: 2532387 - RNA, 13 nt, Human
cucagccucccaa

SEQ ID NO: 2532388 - RNA, 12 nt, Human
cuauccacccag

SEQ ID NO: 2532389 - RNA, 13 nt, Human
cuauccacccagc

SEQ ID NO: 2532390 - RNA, 14 nt, Human
cuauccacccagcc

SEQ ID NO: 2532391 - RNA, 15 nt, Human
cuauccacccagccc

SEQ ID NO: 2532392 - RNA, 16 nt, Human
cuauccacccagccca

SEQ ID NO: 2532393 - RNA, 19 nt, Human
cuauccacccagcccauuc

SEQ ID NO: 2532394 - RNA, 15 nt, Human
cuccgccucccgggu

SEQ ID NO: 2532395 - RNA, 15 nt, Human
cuccgccucugcugg

SEQ ID NO: 2532396 - RNA, 18 nt, Human
cuccgccuucacuccggu

SEQ ID NO: 2532397 - RNA, 19 nt, Human
cuccgccuucacuccggug

SEQ ID NO: 2532398 - RNA, 19 nt, Human
cuccgcuuucuacccagcg

SEQ ID NO: 2532399 - RNA, 21 nt, Human
cuccgccuucacuccggugug

SEQ ID NO: 2532400 - RNA, 14 nt, Human
cuccgcuggaggug

SEQ ID NO: 2532401 - RNA, 16 nt, Human
cuccgccucugcuggc

SEQ ID NO: 2532402 - RNA, 13 nt, Human
cucccccugccag

SEQ ID NO: 2532403 - RNA, 16 nt, Human
cucccccugccagugc

SEQ ID NO: 2532404 - RNA, 17 nt, Human
cucccccugccagugcc

SEQ ID NO: 2532405 - RNA, 18 nt, Human
cucccccugccagugccu

SEQ ID NO: 2532406 - RNA, 19 nt, Human
cucccccugccagugccuu

SEQ ID NO: 2532407 - RNA, 11 nt, Human
cucccccuggg

SEQ ID NO: 2532408 - RNA, 12 nt, Human
cucccccugggc

SEQ ID NO: 2532409 - RNA, 13 nt, Human
cucccccugggcu

SEQ ID NO: 2532410 - RNA, 18 nt, Human
cucccaccuagcagcacc

SEQ ID NO: 2532411 - RNA, 12 nt, Human
cucccaccucag

SEQ ID NO: 2532412 - RNA, 23 nt, Human
cucccacccgaugcugcuuuccc

SEQ ID NO: 2532413 - RNA, 21 nt, Human
cucccacccgaugcugcuuuc

SEQ ID NO: 2532414 - RNA, 20 nt, Human
cucccacccgaugcugcuuu

SEQ ID NO: 2532415 - RNA, 18 nt, Human
cucccacccgaugcugcu

SEQ ID NO: 2532416 - RNA, 19 nt, Human
cucccacccggcugcagag

SEQ ID NO: 2532417 - RNA, 17 nt, Human
cucccacccggcugcag

SEQ ID NO: 2532418 - RNA, 17 nt, Human
cucccacccgaugcugc

SEQ ID NO: 2532419 - RNA, 15 nt, Human
cucccacccgaugcu

SEQ ID NO: 2532420 - RNA, 15 nt, Human
cuccagucugcugcc

SEQ ID NO: 2532421 - RNA, 17 nt, Human
cuccagucugcugcccu

SEQ ID NO: 2532422 - RNA, 20 nt, Human
cuccagucugcugcccucca

SEQ ID NO: 2532423 - RNA, 21 nt, Human
cuccagucugcugcccuccau

SEQ ID NO: 2532424 - RNA, 21 nt, Human
cuccagugagacagcucugca

SEQ ID NO: 2532425 - RNA, 12 nt, Human
cuccagucugcu

SEQ ID NO: 2532426 - RNA, 14 nt, Human
cuccccuccccugc

SEQ ID NO: 2532427 - RNA, 13 nt, Human
cuccccuccccug

SEQ ID NO: 2532428 - RNA, 15 nt, Human
cuccccuccaaccug

SEQ ID NO: 2532429 - RNA, 14 nt, Human
cucccuccucaccu

SEQ ID NO: 2532430 - RNA, 15 nt, Human
cucccuccucaccuc

SEQ ID NO: 2532431 - RNA, 18 nt, Human
cuccccuccccugcugca

SEQ ID NO: 2532432 - RNA, 17 nt, Human
cuccccuccccugcugc

SEQ ID NO: 2532433 - RNA, 16 nt, Human
cuccccuccccugcug

SEQ ID NO: 2532434 - RNA, 15 nt, Human
cuccccuccccugcu

SEQ ID NO: 2532435 - RNA, 14 nt, Human
cuccccucccuccu

SEQ ID NO: 2532436 - RNA, 21 nt, Human
cucccuccgauccuuccuccc

SEQ ID NO: 2532437 - RNA, 16 nt, Human
cuccccgccuguuccc

SEQ ID NO: 2532438 - RNA, 15 nt, Human
cuccccgccuguucc

SEQ ID NO: 2532439 - RNA, 14 nt, Human
cuccccgccuguuc

SEQ ID NO: 2532440 - RNA, 14 nt, Human
cucccccuucuccc

SEQ ID NO: 2532441 - RNA, 13 nt, Human
cucccccuucucc

SEQ ID NO: 2532442 - RNA, 11 nt, Human
cucccccuucu

SEQ ID NO: 2532443 - RNA, 19 nt, Human
cucccccuguccccucagc

SEQ ID NO: 2532444 - RNA, 13 nt, Human
cucccccuguccc

SEQ ID NO: 2532445 - RNA, 12 nt, Human
cucccccugucc

SEQ ID NO: 2532446 - RNA, 23 nt, Human
cucccccugggcucugccccagc

SEQ ID NO: 2532447 - RNA, 19 nt, Human
cuccccucacagccucuga

SEQ ID NO: 2532448 - RNA, 17 nt, Human
cuccccgccuguucccc

SEQ ID NO: 2532449 - RNA, 18 nt, Human
cuccccgccuguuccccc

SEQ ID NO: 2532450 - RNA, 14 nt, Human
cuccccgcuucugc

SEQ ID NO: 2532451 - RNA, 20 nt, Human
cuccccucacagccucugac

SEQ ID NO: 2532452 - RNA, 13 nt, Human
cuccccucagagu

SEQ ID NO: 2532453 - RNA, 16 nt, Human
cuccccucagagugca

SEQ ID NO: 2532454 - RNA, 20 nt, Human
cucccugcaucugaccagca

SEQ ID NO: 2532455 - RNA, 15 nt, Human
cucccuccucugucc

SEQ ID NO: 2532456 - RNA, 12 nt, Human
cucccuccucug

SEQ ID NO: 2532457 - RNA, 17 nt, Human
cucccuccucaccucug

SEQ ID NO: 2532458 - RNA, 18 nt, Human
cucccuccucaccucugg

SEQ ID NO: 2532459 - RNA, 19 nt, Human
cucccuccucaccucugga

SEQ ID NO: 2532460 - RNA, 21 nt, Human
cucccuccucaccucuggacu

SEQ ID NO: 2532461 - RNA, 12 nt, Human
cucccugacccu

SEQ ID NO: 2532462 - RNA, 23 nt, Human
cucccugacccuguauauagccc

SEQ ID NO: 2532463 - RNA, 17 nt, Human
cucccugacccuguaua

SEQ ID NO: 2532464 - RNA, 16 nt, Human
cucccugacccuguau

SEQ ID NO: 2532465 - RNA, 14 nt, Human
cucccugacccugu

SEQ ID NO: 2532466 - RNA, 16 nt, Human
cuccagacccccagca

SEQ ID NO: 2532467 - RNA, 17 nt, Human
cuccagacacaugucca

SEQ ID NO: 2532468 - RNA, 20 nt, Human
cuccagaagccucuggcuag

SEQ ID NO: 2532469 - RNA, 21 nt, Human
cuccagaagccucuggcuaga

SEQ ID NO: 2532470 - RNA, 19 nt, Human
cuccagacacauguccaag

SEQ ID NO: 2532471 - RNA, 21 nt, Human
cuccagaaucuaaagccagug

SEQ ID NO: 2532472 - RNA, 17 nt, Human
cuccagacccaccacac

SEQ ID NO: 2532473 - RNA, 12 nt, Human
cuccagaccccc

SEQ ID NO: 2532474 - RNA, 16 nt, Human
cuccagacccccaccc

SEQ ID NO: 2532475 - RNA, 18 nt, Human
cuccagacccccaccccu

SEQ ID NO: 2532476 - RNA, 21 nt, Human
cuccagacccccaccccuucc

SEQ ID NO: 2532477 - RNA, 22 nt, Human
cuccagacccccaccccuuccc

SEQ ID NO: 2532478 - RNA, 14 nt, Human
cuccagacccccag

SEQ ID NO: 2532479 - RNA, 18 nt, Human
cuccagaauuucccaaag

SEQ ID NO: 2532480 - RNA, 15 nt, Human
cuccagaauuuccca

SEQ ID NO: 2532481 - RNA, 16 nt, Human
cuccagaagccucugg

SEQ ID NO: 2532482 - RNA, 17 nt, Human
cuccagaagccucuggc

SEQ ID NO: 2532483 - RNA, 18 nt, Human
cuccagaagccucuggcu

SEQ ID NO: 2532484 - RNA, 19 nt, Human
cuccagaagccucuggcua

SEQ ID NO: 2532485 - RNA, 14 nt, Human
cuccagaagccucu

SEQ ID NO: 2532486 - RNA, 15 nt, Human
cuccagaagccucug

SEQ ID NO: 2532487 - RNA, 23 nt, Human
cuccagaagauagcuucacccca

SEQ ID NO: 2532488 - RNA, 18 nt, Human
cuccaagaccuucuccuu

SEQ ID NO: 2532489 - RNA, 17 nt, Human
cuccaagaccuucuccu

SEQ ID NO: 2532490 - RNA, 16 nt, Human
cuccaagaccuucucc

SEQ ID NO: 2532491 - RNA, 22 nt, Human
cuccacuuucuagccagaggag

SEQ ID NO: 2532492 - RNA, 15 nt, Human
cuccacuuuguugga

SEQ ID NO: 2532493 - RNA, 15 nt, Human
cuccagaaacggcca

SEQ ID NO: 2532494 - RNA, 22 nt, Human
cuccagaaaugucuaaaugcug

SEQ ID NO: 2532495 - RNA, 19 nt, Human
cuccagaaccgcagaagcc

SEQ ID NO: 2532496 - RNA, 20 nt, Human
cuccagaaccgcagaagccu

SEQ ID NO: 2532497 - RNA, 14 nt, Human
cuccagaagauagc

SEQ ID NO: 2532498 - RNA, 15 nt, Human
cuccagaagauagcu

SEQ ID NO: 2532499 - RNA, 16 nt, Human
cuccagucaggaggca

SEQ ID NO: 2532500 - RNA, 15 nt, Human
cuccagucaggaggc

SEQ ID NO: 2532501 - RNA, 16 nt, Human
cuccaguccaaggaaa

SEQ ID NO: 2532502 - RNA, 18 nt, Human
cuccaggucucacgggca

SEQ ID NO: 2532503 - RNA, 20 nt, Human
cuccaguauucuugucaaaa

SEQ ID NO: 2532504 - RNA, 17 nt, Human
cuccaggucucacgggc

SEQ ID NO: 2532505 - RNA, 16 nt, Human
cuccaggucucacggg

SEQ ID NO: 2532506 - RNA, 22 nt, Human
cuccagguccucuacuuaauga

SEQ ID NO: 2532507 - RNA, 11 nt, Human
cuccaggugca

SEQ ID NO: 2532508 - RNA, 16 nt, Human
cuccagggugugugcu

SEQ ID NO: 2532509 - RNA, 23 nt, Human
cuccaggggcugcuuccuccugg

SEQ ID NO: 2532510 - RNA, 22 nt, Human
cuccaggggcugcuuccuccug

SEQ ID NO: 2532511 - RNA, 15 nt, Human
cuccagggguggcug

SEQ ID NO: 2532512 - RNA, 12 nt, Human
cucgggcccagc

SEQ ID NO: 2532513 - RNA, 21 nt, Human
cucgggcccaccuggccaccu

SEQ ID NO: 2532514 - RNA, 20 nt, Human
cucgggcccaccuggccacc

SEQ ID NO: 2532515 - RNA, 19 nt, Human
cucgggcccaccuggccac

SEQ ID NO: 2532516 - RNA, 18 nt, Human
cucgggcccaccuggcca

SEQ ID NO: 2532517 - RNA, 17 nt, Human
cucgggcccaccuggcc

SEQ ID NO: 2532518 - RNA, 16 nt, Human
cucgggcccaccuggc

SEQ ID NO: 2532519 - RNA, 14 nt, Human
cucgggcccaccug

SEQ ID NO: 2532520 - RNA, 13 nt, Human
cucgggcccaccu

SEQ ID NO: 2532521 - RNA, 19 nt, Human
cucgggaggcugagacagg

SEQ ID NO: 2532522 - RNA, 21 nt, Human
cucgggaggcugagacaggag

SEQ ID NO: 2532523 - RNA, 20 nt, Human
cucgggauuaguacacacuu

SEQ ID NO: 2532524 - RNA, 15 nt, Human
cucgggaggcugaga

SEQ ID NO: 2532525 - RNA, 20 nt, Human
cucgggacaccugcccugcc

SEQ ID NO: 2532526 - RNA, 15 nt, Human
cucgggacaccugcc

SEQ ID NO: 2532527 - RNA, 16 nt, Human
cucgggaaccucacuc

SEQ ID NO: 2532528 - RNA, 12 nt, Human
cucgggaaccuc

SEQ ID NO: 2532529 - RNA, 19 nt, Human
cucggcuuuucucagcugg

SEQ ID NO: 2532530 - RNA, 18 nt, Human
cucggcuuuucucagcug

SEQ ID NO: 2532531 - RNA, 19 nt, Human
cuccgugcuuccucaguua

SEQ ID NO: 2532532 - RNA, 16 nt, Human
cuccgugcuuccucag

SEQ ID NO: 2532533 - RNA, 22 nt, Human
cuccgugccuccaccaccacug

SEQ ID NO: 2532534 - RNA, 21 nt, Human
cuccgugccuccaccaccacu

SEQ ID NO: 2532535 - RNA, 16 nt, Human
cuccgugccuccacca

SEQ ID NO: 2532536 - RNA, 15 nt, Human
cuccgugccuccacc

SEQ ID NO: 2532537 - RNA, 14 nt, Human
cuccgugccuccac

SEQ ID NO: 2532538 - RNA, 13 nt, Human
cuccgugccucca

SEQ ID NO: 2532539 - RNA, 16 nt, Human
cuccguuagcuccugu

SEQ ID NO: 2532540 - RNA, 15 nt, Human
cuccguuagcuccug

SEQ ID NO: 2532541 - RNA, 13 nt, Human
cuccguggagcag

SEQ ID NO: 2532542 - RNA, 18 nt, Human
cuccguccaggagccugg

SEQ ID NO: 2532543 - RNA, 22 nt, Human
cuccguccagccgccauugcca

SEQ ID NO: 2532544 - RNA, 15 nt, Human
cuccguccagccgcc

SEQ ID NO: 2532545 - RNA, 19 nt, Human
cuccguccaggagccuggc

SEQ ID NO: 2532546 - RNA, 20 nt, Human
cuccguccaggagccugugc

SEQ ID NO: 2532547 - RNA, 22 nt, Human
cuccguccaggagccugugccu

SEQ ID NO: 2532548 - RNA, 22 nt, Human
cuccgucuuagaaguggaccag

SEQ ID NO: 2532549 - RNA, 16 nt, Human
cucucaauaugcuuac

SEQ ID NO: 2532550 - RNA, 15 nt, Human
cucucaauaugcuua

SEQ ID NO: 2532551 - RNA, 17 nt, Human
cucucaacccaggagca

SEQ ID NO: 2532552 - RNA, 14 nt, Human
cucucacuccuuga

SEQ ID NO: 2532553 - RNA, 12 nt, Human
cucucacuccuu

SEQ ID NO: 2532554 - RNA, 15 nt, Human
cucucacuccuugaa

SEQ ID NO: 2532555 - RNA, 12 nt, Human
cucucacugucu

SEQ ID NO: 2532556 - RNA, 19 nt, Human
cucucagauuguaccauug

SEQ ID NO: 2532557 - RNA, 19 nt, Human
cucucagaagggaggcugg

SEQ ID NO: 2532558 - RNA, 14 nt, Human
cucucagaagggag

SEQ ID NO: 2532559 - RNA, 17 nt, Human
cucucagaauucuucag

SEQ ID NO: 2532560 - RNA, 22 nt, Human
cucucagagcuacuugggccau

SEQ ID NO: 2532561 - RNA, 21 nt, Human
cucucagagcuacuugggcca

SEQ ID NO: 2532562 - RNA, 20 nt, Human
cucucagagcuacuugggcc

SEQ ID NO: 2532563 - RNA, 16 nt, Human
cucucagaagguauuc

SEQ ID NO: 2532564 - RNA, 20 nt, Human
cucucaaccaccuuucagau

SEQ ID NO: 2532565 - RNA, 22 nt, Human
cucucaaaucuuuuagucauua

SEQ ID NO: 2532566 - RNA, 15 nt, Human
cucuauuuaauauuu

SEQ ID NO: 2532567 - RNA, 14 nt, Human
cucuauuuaauauu

SEQ ID NO: 2532568 - RNA, 13 nt, Human
cucuauuuaauau

SEQ ID NO: 2532569 - RNA, 21 nt, Human
cucuauuguagcauuucuuga

SEQ ID NO: 2532570 - RNA, 17 nt, Human
cucuauuuaauauuuau

SEQ ID NO: 2532571 - RNA, 16 nt, Human
cucuauuuaauauuua

SEQ ID NO: 2532572 - RNA, 13 nt, Human
cucuauuuagcau

SEQ ID NO: 2532573 - RNA, 16 nt, Human
cucuauuuauguuugc

SEQ ID NO: 2532574 - RNA, 17 nt, Human
cucuauuuauguuugca

SEQ ID NO: 2532575 - RNA, 14 nt, Human
cucuauuuagcaug

SEQ ID NO: 2532576 - RNA, 20 nt, Human
cucuauuaagauuuccaagu

SEQ ID NO: 2532577 - RNA, 20 nt, Human
cucuauuguagcauuucuug

SEQ ID NO: 2532578 - RNA, 23 nt, Human
cucuauugauguacagucuguca

SEQ ID NO: 2532579 - RNA, 12 nt, Human
cucuauuuaaua

SEQ ID NO: 2532580 - RNA, 16 nt, Human
cucgggcccaggccau

SEQ ID NO: 2532581 - RNA, 14 nt, Human
cucgggcccaggcc

SEQ ID NO: 2532582 - RNA, 12 nt, Human
cucgggcccagg

SEQ ID NO: 2532583 - RNA, 18 nt, Human
cucgggcccagcccccac

SEQ ID NO: 2532584 - RNA, 16 nt, Human
cucgggcccagccccc

SEQ ID NO: 2532585 - RNA, 15 nt, Human
cucgggcccagcccc

SEQ ID NO: 2532586 - RNA, 14 nt, Human
cucgggcccagccc

SEQ ID NO: 2532587 - RNA, 13 nt, Human
cucgggcccagcc

SEQ ID NO: 2532588 - RNA, 23 nt, Human
cucgggcccaggccaucuuccag

SEQ ID NO: 2532589 - RNA, 20 nt, Human
cucuauguuuacaaauggac

SEQ ID NO: 2532590 - RNA, 18 nt, Human
cucuauuaagauuuccaa

SEQ ID NO: 2532591 - RNA, 15 nt, Human
cucuauguuuacaaa

SEQ ID NO: 2532592 - RNA, 17 nt, Human
cucugaagccucuggga

SEQ ID NO: 2532593 - RNA, 15 nt, Human
cucugaagccucugg

SEQ ID NO: 2532594 - RNA, 17 nt, Human
cucugaagcauguuuca

SEQ ID NO: 2532595 - RNA, 14 nt, Human
cucugaagcauguu

SEQ ID NO: 2532596 - RNA, 20 nt, Human
cucugaagcauguuucaugu

SEQ ID NO: 2532597 - RNA, 15 nt, Human
cucugaaggacauug

SEQ ID NO: 2532598 - RNA, 19 nt, Human
cucucuggccucccacccg

SEQ ID NO: 2532599 - RNA, 18 nt, Human
cucucuggccucccaccc

SEQ ID NO: 2532600 - RNA, 13 nt, Human
cucugaagagugg

SEQ ID NO: 2532601 - RNA, 21 nt, Human
cucugaagaguggguuucaca

SEQ ID NO: 2532602 - RNA, 11 nt, Human
cucugaagcau

SEQ ID NO: 2532603 - RNA, 20 nt, Human
cucucuggccucccacccga

SEQ ID NO: 2532604 - RNA, 18 nt, Human
cucugaagaugaucauuu

SEQ ID NO: 2532605 - RNA, 22 nt, Human
cucugaagaguggguuucacaa

SEQ ID NO: 2532606 - RNA, 23 nt, Human
cucugaagaguggguuucacaag

SEQ ID NO: 2532607 - RNA, 17 nt, Human
cucucuggccucccacc

SEQ ID NO: 2532608 - RNA, 16 nt, Human
cucucuggccucccac

SEQ ID NO: 2532609 - RNA, 15 nt, Human
cucucuggccuccca

SEQ ID NO: 2532610 - RNA, 14 nt, Human
cucucuggccuccc

SEQ ID NO: 2532611 - RNA, 13 nt, Human
cucucuggccucc

SEQ ID NO: 2532612 - RNA, 20 nt, Human
cucuccuccaagacacugug

SEQ ID NO: 2532613 - RNA, 12 nt, Human
cucucuggccuu

SEQ ID NO: 2532614 - RNA, 11 nt, Human
cucucuggccu

SEQ ID NO: 2532615 - RNA, 16 nt, Human
cucuccuccaagacac

SEQ ID NO: 2532616 - RNA, 23 nt, Human
cucuccucaucucuaacagcuca

SEQ ID NO: 2532617 - RNA, 12 nt, Human
cucuccucaucu

SEQ ID NO: 2532618 - RNA, 14 nt, Human
cucuccucaucucu

SEQ ID NO: 2532619 - RNA, 20 nt, Human
cucuccucauguucugcuuu

SEQ ID NO: 2532620 - RNA, 16 nt, Human
cucuccccagcccaga

SEQ ID NO: 2532621 - RNA, 17 nt, Human
cucuccccagcccagag

SEQ ID NO: 2532622 - RNA, 18 nt, Human
cucuccccagcccagaga

SEQ ID NO: 2532623 - RNA, 19 nt, Human
cucuccccagcccagagac

SEQ ID NO: 2532624 - RNA, 16 nt, Human
cucuccccagguccag

SEQ ID NO: 2532625 - RNA, 15 nt, Human
cucuccccaggucca

SEQ ID NO: 2532626 - RNA, 20 nt, Human
cucuccccagcccagagaca

SEQ ID NO: 2532627 - RNA, 22 nt, Human
cucucagccccugauccuguga

SEQ ID NO: 2532628 - RNA, 13 nt, Human
cucuccccagccc

SEQ ID NO: 2532629 - RNA, 15 nt, Human
cucuccccagcccag

SEQ ID NO: 2532630 - RNA, 21 nt, Human
cucucagccccugauccugug

SEQ ID NO: 2532631 - RNA, 11 nt, Human
cucucagccaa

SEQ ID NO: 2532632 - RNA, 23 nt, Human
cucucagccaacgaguaauuuau

SEQ ID NO: 2532633 - RNA, 20 nt, Human
cucuccccagguccagcucu

SEQ ID NO: 2532634 - RNA, 18 nt, Human
cucuccccagguccagcu

SEQ ID NO: 2532635 - RNA, 23 nt, Human
cucuccccagguccagcucugga

SEQ ID NO: 2532636 - RNA, 21 nt, Human
cucuccgaccagacaccuuga

SEQ ID NO: 2532637 - RNA, 15 nt, Human
cucuccggucucucu

SEQ ID NO: 2532638 - RNA, 21 nt, Human
cucuccuagagacagaagcag

SEQ ID NO: 2532639 - RNA, 14 nt, Human
cucuccuagagaca

SEQ ID NO: 2532640 - RNA, 16 nt, Human
cucugaagccucuggg

SEQ ID NO: 2532641 - RNA, 18 nt, Human
cucuguagggaacucugg

SEQ ID NO: 2532642 - RNA, 22 nt, Human
cucuguagggaacucugggguc

SEQ ID NO: 2532643 - RNA, 22 nt, Human
cucuguaucaggacccagagga

SEQ ID NO: 2532644 - RNA, 21 nt, Human
cucuguaaucucguuucaaaa

SEQ ID NO: 2532645 - RNA, 15 nt, Human
cucuuagaugcaguu

SEQ ID NO: 2532646 - RNA, 16 nt, Human
cucuuagaaaugaagg

SEQ ID NO: 2532647 - RNA, 15 nt, Human
cucugucaaugaaaa

SEQ ID NO: 2532648 - RNA, 21 nt, Human
cucuguacagagcccacgccc

SEQ ID NO: 2532649 - RNA, 17 nt, Human
cucuguacagagcccac

SEQ ID NO: 2532650 - RNA, 20 nt, Human
cucugguuuggggcgaggca

SEQ ID NO: 2532651 - RNA, 22 nt, Human
cucugguuuggggcgaggcaga

SEQ ID NO: 2532652 - RNA, 21 nt, Human
cucuguaaaugaaaaaaccca

SEQ ID NO: 2532653 - RNA, 18 nt, Human
cucuguaaucucguuuca

SEQ ID NO: 2532654 - RNA, 16 nt, Human
cucugguuuaauuaca

SEQ ID NO: 2532655 - RNA, 13 nt, Human
cucugguucuuug

SEQ ID NO: 2532656 - RNA, 22 nt, Human
cucugguccggacacuccuaga

SEQ ID NO: 2532657 - RNA, 15 nt, Human
cucugguccauagag

SEQ ID NO: 2532658 - RNA, 19 nt, Human
cucugcugacagacacagg

SEQ ID NO: 2532659 - RNA, 18 nt, Human
cucugcugacagacacag

SEQ ID NO: 2532660 - RNA, 17 nt, Human
cucugcugacagacaca

SEQ ID NO: 2532661 - RNA, 18 nt, Human
cucugguccauagagagc

SEQ ID NO: 2532662 - RNA, 16 nt, Human
cucugguccauagaga

SEQ ID NO: 2532663 - RNA, 19 nt, Human
cucugguccauagagagca

SEQ ID NO: 2532664 - RNA, 14 nt, Human
cucugguuccuccc

SEQ ID NO: 2532665 - RNA, 15 nt, Human
cucugguuaucuaau

SEQ ID NO: 2532666 - RNA, 18 nt, Human
cucugcagcaauaaagca

SEQ ID NO: 2532667 - RNA, 19 nt, Human
cucugcagcaauaaagcag

SEQ ID NO: 2532668 - RNA, 23 nt, Human
cucugcagcaauaaagcagcguu

SEQ ID NO: 2532669 - RNA, 14 nt, Human
cucugcagccagcc

SEQ ID NO: 2532670 - RNA, 23 nt, Human
cucugcacuacuccucugcagug

SEQ ID NO: 2532671 - RNA, 13 nt, Human
cucugcagccagc

SEQ ID NO: 2532672 - RNA, 18 nt, Human
cucugcuccaccacaucc

SEQ ID NO: 2532673 - RNA, 15 nt, Human
cucugcuccaccaca

SEQ ID NO: 2532674 - RNA, 16 nt, Human
cucugcuccaccacau

SEQ ID NO: 2532675 - RNA, 12 nt, Human
cucugcuccacc

SEQ ID NO: 2532676 - RNA, 13 nt, Human
cucugcuccacca

SEQ ID NO: 2532677 - RNA, 14 nt, Human
cucugcuccaccac

SEQ ID NO: 2532678 - RNA, 19 nt, Human
cucugcuacguuccuauug

SEQ ID NO: 2532679 - RNA, 22 nt, Human
cucugcgugucaccugugcuuc

SEQ ID NO: 2532680 - RNA, 16 nt, Human
cucugcacaugucuug

SEQ ID NO: 2532681 - RNA, 15 nt, Human
cucugcacaugucuu

SEQ ID NO: 2532682 - RNA, 22 nt, Human
cucugcacuacugacauguggg

SEQ ID NO: 2532683 - RNA, 20 nt, Human
cucugcacuacugacaugug

SEQ ID NO: 2532684 - RNA, 13 nt, Human
cucugcagcaaua

SEQ ID NO: 2532685 - RNA, 22 nt, Human
cucugcacuacuccucugcagu

SEQ ID NO: 2532686 - RNA, 20 nt, Human
cucugcacuacuccucugca

SEQ ID NO: 2532687 - RNA, 15 nt, Human
cucugcacuacuccu

SEQ ID NO: 2532688 - RNA, 13 nt, Human
cucugcacuacuc

SEQ ID NO: 2532689 - RNA, 18 nt, Human
cucugcacuacugacaug

SEQ ID NO: 2532690 - RNA, 16 nt, Human
cucugcacuacugaca

SEQ ID NO: 2532691 - RNA, 18 nt, Human
cucugcacaugucuugua

SEQ ID NO: 2532692 - RNA, 16 nt, Human
cucugcacccccauau

SEQ ID NO: 2532693 - RNA, 18 nt, Human
cucugcaccguacugugg

SEQ ID NO: 2532694 - RNA, 20 nt, Human
cucuuagaugcaguucugaa

SEQ ID NO: 2532695 - RNA, 21 nt, Human
cucuuagaugcaguucugaag

SEQ ID NO: 2532696 - RNA, 18 nt, Human
cucuuagacuucugcuuu

SEQ ID NO: 2532697 - RNA, 20 nt, Human
cucuugccacugccucuucc

SEQ ID NO: 2532698 - RNA, 19 nt, Human
cucuugccacugccucuuc

SEQ ID NO: 2532699 - RNA, 18 nt, Human
cucuugccacugccucuu

SEQ ID NO: 2532700 - RNA, 17 nt, Human
cucuugccacugccucu

SEQ ID NO: 2532701 - RNA, 23 nt, Human
cucuugccaaccuguaauaaaua

SEQ ID NO: 2532702 - RNA, 22 nt, Human
cucuugccaaccuguaauaaau

SEQ ID NO: 2532703 - RNA, 21 nt, Human
cucuugccaaccuguaauaaa

SEQ ID NO: 2532704 - RNA, 16 nt, Human
cucuugccacugccuc

SEQ ID NO: 2532705 - RNA, 18 nt, Human
cucuugcaggucucaacc

SEQ ID NO: 2532706 - RNA, 20 nt, Human
cucuuggaccucugcucuga

SEQ ID NO: 2532707 - RNA, 19 nt, Human
cucuuggaccucugcucug

SEQ ID NO: 2532708 - RNA, 14 nt, Human
cucuuggagccugc

SEQ ID NO: 2532709 - RNA, 18 nt, Human
cucuuggaccucugcucu

SEQ ID NO: 2532710 - RNA, 17 nt, Human
cucuuggaccucugcuc

SEQ ID NO: 2532711 - RNA, 12 nt, Human
cucuuggaccuc

SEQ ID NO: 2532712 - RNA, 17 nt, Human
cucuuggaaaaagugau

SEQ ID NO: 2532713 - RNA, 16 nt, Human
cucuuggaaaaaguga

SEQ ID NO: 2532714 - RNA, 14 nt, Human
cucuugcucuuucu

SEQ ID NO: 2532715 - RNA, 15 nt, Human
cucuugcucuuucua

SEQ ID NO: 2532716 - RNA, 13 nt, Human
cucuugcucuuuc

SEQ ID NO: 2532717 - RNA, 12 nt, Human
cucuugcucuuu

SEQ ID NO: 2532718 - RNA, 20 nt, Human
cucuugcucaaaaaucuguu

SEQ ID NO: 2532719 - RNA, 19 nt, Human
cucuugcucaaaaaucugu

SEQ ID NO: 2532720 - RNA, 12 nt, Human
cucuugcucaaa

SEQ ID NO: 2532721 - RNA, 22 nt, Human
cucuugcuaaucagugucucac

SEQ ID NO: 2532722 - RNA, 21 nt, Human
cucuugcuaaucagugucuca

SEQ ID NO: 2532723 - RNA, 14 nt, Human
cucuugcuaaucag

SEQ ID NO: 2532724 - RNA, 14 nt, Human
cucuugccuccugg

SEQ ID NO: 2532725 - RNA, 17 nt, Human
cucuugcggucccuucu

SEQ ID NO: 2532726 - RNA, 15 nt, Human
cugaaaaauuccuuu

SEQ ID NO: 2532727 - RNA, 17 nt, Human
cugaaaacacugugcac

SEQ ID NO: 2532728 - RNA, 15 nt, Human
cucuuggagccugca

SEQ ID NO: 2532729 - RNA, 14 nt, Human
cugaaaacaucugg

SEQ ID NO: 2532730 - RNA, 14 nt, Human
cugaaaacccagag

SEQ ID NO: 2532731 - RNA, 15 nt, Human
cugaaaacccagaga

SEQ ID NO: 2532732 - RNA, 19 nt, Human
cugaaaaccuaaguccuuu

SEQ ID NO: 2532733 - RNA, 17 nt, Human
cugaaaacccagagagg

SEQ ID NO: 2532734 - RNA, 17 nt, Human
cugaaaacggcccucuu

SEQ ID NO: 2532735 - RNA, 14 nt, Human
cugaaaaccucucc

SEQ ID NO: 2532736 - RNA, 15 nt, Human
cugaaaaccucuccu

SEQ ID NO: 2532737 - RNA, 17 nt, Human
cugaaaaccucuccuca

SEQ ID NO: 2532738 - RNA, 20 nt, Human
cugaaaaccucuccucaugu

SEQ ID NO: 2532739 - RNA, 17 nt, Human
cugaaggccccgcccag

SEQ ID NO: 2532740 - RNA, 14 nt, Human
cugaaggccccgcc

SEQ ID NO: 2532741 - RNA, 13 nt, Human
cugaaggccccgc

SEQ ID NO: 2532742 - RNA, 21 nt, Human
cugaaggacacuuccugccua

SEQ ID NO: 2532743 - RNA, 20 nt, Human
cugaaggacacuuccugccu

SEQ ID NO: 2532744 - RNA, 19 nt, Human
cugaaggacacuuccugcc

SEQ ID NO: 2532745 - RNA, 18 nt, Human
cugaaggacacuuccugc

SEQ ID NO: 2532746 - RNA, 21 nt, Human
cugaaggacauugcggacagc

SEQ ID NO: 2532747 - RNA, 20 nt, Human
cugaaggacauugcggacag

SEQ ID NO: 2532748 - RNA, 19 nt, Human
cugaaggacauugcggaca

SEQ ID NO: 2532749 - RNA, 16 nt, Human
cugaaaauguaugugu

SEQ ID NO: 2532750 - RNA, 16 nt, Human
cugaaaacggcccucu

SEQ ID NO: 2532751 - RNA, 18 nt, Human
cugaaaagacucaguguu

SEQ ID NO: 2532752 - RNA, 13 nt, Human
cugaaaaugugaa

SEQ ID NO: 2532753 - RNA, 12 nt, Human
cugaaaaugugc

SEQ ID NO: 2532754 - RNA, 13 nt, Human
cugaaaaugugcu

SEQ ID NO: 2532755 - RNA, 21 nt, Human
cugaaaaugugaauaaaauua

SEQ ID NO: 2532756 - RNA, 22 nt, Human
cugaaaauguuuuucugccagg

SEQ ID NO: 2532757 - RNA, 17 nt, Human
cugaaaauuaacacugc

SEQ ID NO: 2532758 - RNA, 16 nt, Human
cugaaaauuaacacug

SEQ ID NO: 2532759 - RNA, 16 nt, Human
cugaagcugccugcuu

SEQ ID NO: 2532760 - RNA, 15 nt, Human
cugaagcugccugcu

SEQ ID NO: 2532761 - RNA, 18 nt, Human
cugaagcugccugcuuuu

SEQ ID NO: 2532762 - RNA, 14 nt, Human
cugaagcugccugc

SEQ ID NO: 2532763 - RNA, 18 nt, Human
cugaaaauucgaaccagg

SEQ ID NO: 2532764 - RNA, 17 nt, Human
cugaaggacacuuccug

SEQ ID NO: 2532765 - RNA, 22 nt, Human
cugaaggaaaaacacaagcaaa

SEQ ID NO: 2532766 - RNA, 21 nt, Human
cugaaggaaaaacacaagcaa

SEQ ID NO: 2532767 - RNA, 18 nt, Human
cugaaggaaaaacacaag

SEQ ID NO: 2532768 - RNA, 22 nt, Human
cugaaggaauaaauugcuccuu

SEQ ID NO: 2532769 - RNA, 11 nt, Human
cugaaggaaaa

SEQ ID NO: 2532770 - RNA, 17 nt, Human
cugaaggaaaaacacaa

SEQ ID NO: 2532771 - RNA, 16 nt, Human
cugaaggaaaaacaca

SEQ ID NO: 2532772 - RNA, 14 nt, Human
cugaaggaaaaaca

SEQ ID NO: 2532773 - RNA, 14 nt, Human
cugacagacacagg

SEQ ID NO: 2532774 - RNA, 12 nt, Human
cugacagacaca

SEQ ID NO: 2532775 - RNA, 17 nt, Human
cugaagguaaaauugaa

SEQ ID NO: 2532776 - RNA, 15 nt, Human
cugacagacacaggc

SEQ ID NO: 2532777 - RNA, 21 nt, Human
cugaagggguucucacagugg

SEQ ID NO: 2532778 - RNA, 17 nt, Human
cugaagggguucucaca

SEQ ID NO: 2532779 - RNA, 15 nt, Human
cugaagguaaaauug

SEQ ID NO: 2532780 - RNA, 14 nt, Human
cugacagaaggacu

SEQ ID NO: 2532781 - RNA, 20 nt, Human
cugaaggggcgucuguuccc

SEQ ID NO: 2532782 - RNA, 23 nt, Human
cugaaggggccaugauggcaaca

SEQ ID NO: 2532783 - RNA, 15 nt, Human
cugaaggggccauga

SEQ ID NO: 2532784 - RNA, 19 nt, Human
cugaaggggccaugauggc

SEQ ID NO: 2532785 - RNA, 11 nt, Human
cugaagggagg

SEQ ID NO: 2532786 - RNA, 12 nt, Human
cugaagggaggu

SEQ ID NO: 2532787 - RNA, 21 nt, Human
cugaccugugagcccagcugg

SEQ ID NO: 2532788 - RNA, 16 nt, Human
cugaccuuccucgcag

SEQ ID NO: 2532789 - RNA, 21 nt, Human
cugaccuuccucgcagagagg

SEQ ID NO: 2532790 - RNA, 20 nt, Human
cugaccuuccucgcagagag

SEQ ID NO: 2532791 - RNA, 18 nt, Human
cugaccuuccucgcagag

SEQ ID NO: 2532792 - RNA, 17 nt, Human
cugaccuuccucgcaga

SEQ ID NO: 2532793 - RNA, 23 nt, Human
cugaccuuccucgcagagaggcc

SEQ ID NO: 2532794 - RNA, 22 nt, Human
cugaccuuccucgcagagaggc

SEQ ID NO: 2532795 - RNA, 20 nt, Human
cugaccuugaacuccugggc

SEQ ID NO: 2532796 - RNA, 23 nt, Human
cugaccugucaugccccccucaa

SEQ ID NO: 2532797 - RNA, 17 nt, Human
cugaccugugagcccag

SEQ ID NO: 2532798 - RNA, 18 nt, Human
cugaccugugagcccagc

SEQ ID NO: 2532799 - RNA, 20 nt, Human
cugaccugugagcccagcug

SEQ ID NO: 2532800 - RNA, 12 nt, Human
cugaccucuggu

SEQ ID NO: 2532801 - RNA, 21 nt, Human
cugaccucccucuaauuuauc

SEQ ID NO: 2532802 - RNA, 17 nt, Human
cugaccuaucacuucca

SEQ ID NO: 2532803 - RNA, 22 nt, Human
cugaccgugggcggggccuugc

SEQ ID NO: 2532804 - RNA, 13 nt, Human
cugaccuccacag

SEQ ID NO: 2532805 - RNA, 14 nt, Human
cugaccuccacagc

SEQ ID NO: 2532806 - RNA, 15 nt, Human
cugaccuccacagcu

SEQ ID NO: 2532807 - RNA, 23 nt, Human
cugacccuuacagccucugacuu

SEQ ID NO: 2532808 - RNA, 20 nt, Human
cugacccuuacagccucuga

SEQ ID NO: 2532809 - RNA, 17 nt, Human
cugacccugguucucuc

SEQ ID NO: 2532810 - RNA, 22 nt, Human
cugacccuuacagccucugacu

SEQ ID NO: 2532811 - RNA, 18 nt, Human
cugaccgaaacagcgcug

SEQ ID NO: 2532812 - RNA, 13 nt, Human
cugaccgugggcg

SEQ ID NO: 2532813 - RNA, 20 nt, Human
cugaccgaaacagcgcuggg

SEQ ID NO: 2532814 - RNA, 20 nt, Human
cugaccucccucuaauuuau

SEQ ID NO: 2532815 - RNA, 18 nt, Human
cugaccucccucuaauuu

SEQ ID NO: 2532816 - RNA, 23 nt, Human
cugaccucccagcccuauggaug

SEQ ID NO: 2532817 - RNA, 22 nt, Human
cugaccucccagcccuauggau

SEQ ID NO: 2532818 - RNA, 18 nt, Human
cugaccucccagcccuau

SEQ ID NO: 2532819 - RNA, 17 nt, Human
cugaccucccagcccua

SEQ ID NO: 2532820 - RNA, 16 nt, Human
cugaccucccagcccu

SEQ ID NO: 2532821 - RNA, 14 nt, Human
cugaccucccagcc

SEQ ID NO: 2532822 - RNA, 13 nt, Human
cugaccucccagc

SEQ ID NO: 2532823 - RNA, 12 nt, Human
cugaccucccag

SEQ ID NO: 2532824 - RNA, 11 nt, Human
cugaccuccca

SEQ ID NO: 2532825 - RNA, 16 nt, Human
cugaccuccacagcuu

SEQ ID NO: 2532826 - RNA, 20 nt, Human
cugacccaugcugcccugug

SEQ ID NO: 2532827 - RNA, 19 nt, Human
cugacccaugcugcccugu

SEQ ID NO: 2532828 - RNA, 17 nt, Human
cugacccaugcugcccu

SEQ ID NO: 2532829 - RNA, 18 nt, Human
cugacccaugcugcccug

SEQ ID NO: 2532830 - RNA, 23 nt, Human
cugacccugcuucaaauauuucc

SEQ ID NO: 2532831 - RNA, 12 nt, Human
cugacccuguau

SEQ ID NO: 2532832 - RNA, 13 nt, Human
cugacccugugga

SEQ ID NO: 2532833 - RNA, 22 nt, Human
cugacccuguauauagcccagc

SEQ ID NO: 2532834 - RNA, 21 nt, Human
cugacccuguauauagcccag

SEQ ID NO: 2532835 - RNA, 20 nt, Human
cugacccuguauauagccca

SEQ ID NO: 2532836 - RNA, 19 nt, Human
cugacccuguauauagccc

SEQ ID NO: 2532837 - RNA, 18 nt, Human
cugacccuguauauagcc

SEQ ID NO: 2532838 - RNA, 15 nt, Human
cugacccuguauaua

SEQ ID NO: 2532839 - RNA, 13 nt, Human
cugacccuguaua

SEQ ID NO: 2532840 - RNA, 20 nt, Human
aacuucauauaugaggacuu

SEQ ID NO: 2532841 - RNA, 21 nt, Human
aacuucaggauaauaaagugu

SEQ ID NO: 2532842 - RNA, 14 nt, Human
aacuguauauauuc

SEQ ID NO: 2532843 - RNA, 19 nt, Human
aacuguagaaaugaugaug

SEQ ID NO: 2532844 - RNA, 17 nt, Human
aacuucagcuguacuuc

SEQ ID NO: 2532845 - RNA, 13 nt, Human
aacuuccaauuua

SEQ ID NO: 2532846 - RNA, 12 nt, Human
aacuucauuuga

SEQ ID NO: 2532847 - RNA, 14 nt, Human
aacuucauuugaug

SEQ ID NO: 2532848 - RNA, 18 nt, Human
aacuuccagauccuggaa

SEQ ID NO: 2532849 - RNA, 18 nt, Human
aacuucccagugaauucu

SEQ ID NO: 2532850 - RNA, 20 nt, Human
aacuucaugucaacuucugg

SEQ ID NO: 2532851 - RNA, 19 nt, Human
aacuuccagguguuacugu

SEQ ID NO: 2532852 - RNA, 17 nt, Human
aacuuccccaucuucua

SEQ ID NO: 2532853 - RNA, 18 nt, Human
aacuuccccaucuucuaa

SEQ ID NO: 2532854 - RNA, 22 nt, Human
aacuuccagguguuacuguaau

SEQ ID NO: 2532855 - RNA, 23 nt, Human
aacuuccugcagguaaacaguuc

SEQ ID NO: 2532856 - RNA, 15 nt, Human
aacuuccugcaggua

SEQ ID NO: 2532857 - RNA, 23 nt, Human
aacuucccgucccauauccugcc

SEQ ID NO: 2532858 - RNA, 22 nt, Human
aacuucccgucccauauccugc

SEQ ID NO: 2532859 - RNA, 22 nt, Human
aacuucuccccugguagaaaga

SEQ ID NO: 2532860 - RNA, 14 nt, Human
aacuggguuccugc

SEQ ID NO: 2532861 - RNA, 15 nt, Human
aacuggguuccugca

SEQ ID NO: 2532862 - RNA, 13 nt, Human
aacugguauuuua

SEQ ID NO: 2532863 - RNA, 19 nt, Human
aacuggucaccaugaaacu

SEQ ID NO: 2532864 - RNA, 22 nt, Human
aacugguauuuuaucuuugauu

SEQ ID NO: 2532865 - RNA, 13 nt, Human
aacuguaaauaaa

SEQ ID NO: 2532866 - RNA, 21 nt, Human
aacugguuuguugcagccaaa

SEQ ID NO: 2532867 - RNA, 14 nt, Human
aacuguaugucaga

SEQ ID NO: 2532868 - RNA, 21 nt, Human
aacuucagcgguuuauauaag

SEQ ID NO: 2532869 - RNA, 14 nt, Human
aacuguagaaauga

SEQ ID NO: 2532870 - RNA, 15 nt, Human
aacuguagaaaugau

SEQ ID NO: 2532871 - RNA, 16 nt, Human
aacuguagaaaugaug

SEQ ID NO: 2532872 - RNA, 17 nt, Human
aacuguagaaaugauga

SEQ ID NO: 2532873 - RNA, 18 nt, Human
aacuguacuuuuaaggca

SEQ ID NO: 2532874 - RNA, 15 nt, Human
aacuguacuucacug

SEQ ID NO: 2532875 - RNA, 13 nt, Human
aacuguacuucac

SEQ ID NO: 2532876 - RNA, 16 nt, Human
gugaugagaggaaauc

SEQ ID NO: 2532877 - RNA, 22 nt, Human
gugaugacaacuggaauaguuu

SEQ ID NO: 2532878 - RNA, 14 nt, Human
gugaugaauacugu

SEQ ID NO: 2532879 - RNA, 22 nt, Human
gugaugaagaaaagugggccag

SEQ ID NO: 2532880 - RNA, 15 nt, Human
gugaugaggggaggg

SEQ ID NO: 2532881 - RNA, 22 nt, Human
gugaugaucagcuguuugucau

SEQ ID NO: 2532882 - RNA, 15 nt, Human
gugaugccacacaga

SEQ ID NO: 2532883 - RNA, 17 nt, Human
gugaugccacacagagu

SEQ ID NO: 2532884 - RNA, 23 nt, Human
gugaugccagguucuauuuggaa

SEQ ID NO: 2532885 - RNA, 18 nt, Human
gugaugccagguucuauu

SEQ ID NO: 2532886 - RNA, 15 nt, Human
gugaugccagguucu

SEQ ID NO: 2532887 - RNA, 19 nt, Human
gugaugccacacagagugg

SEQ ID NO: 2532888 - RNA, 15 nt, Human
aacuucuuauggaau

SEQ ID NO: 2532889 - RNA, 15 nt, Human
aacuucucuggaaag

SEQ ID NO: 2532890 - RNA, 14 nt, Human
aacuucucucagac

SEQ ID NO: 2532891 - RNA, 13 nt, Human
aacuucugccugu

SEQ ID NO: 2532892 - RNA, 16 nt, Human
aacuucuuauggaauu

SEQ ID NO: 2532893 - RNA, 17 nt, Human
aacuucuuauggaauug

SEQ ID NO: 2532894 - RNA, 19 nt, Human
aacuucuuauggaauugau

SEQ ID NO: 2532895 - RNA, 24 nt, Human
aacuucuuauggaauugauuugca

SEQ ID NO: 2532896 - RNA, 14 nt, Human
gugaugagaggaaa

SEQ ID NO: 2532897 - RNA, 19 nt, Human
aacuucuucagagcugaca

SEQ ID NO: 2532898 - RNA, 11 nt, Human
aacuucuucag

SEQ ID NO: 2532899 - RNA, 18 nt, Human
gugauggggcccugccuc

SEQ ID NO: 2532900 - RNA, 17 nt, Human
gugauggggcccugccu

SEQ ID NO: 2532901 - RNA, 16 nt, Human
gugauggggcccugcc

SEQ ID NO: 2532902 - RNA, 14 nt, Human
gugauggggcccug

SEQ ID NO: 2532903 - RNA, 17 nt, Human
gugaugggaaagcauug

SEQ ID NO: 2532904 - RNA, 16 nt, Human
gugaugcucaggcuug

SEQ ID NO: 2532905 - RNA, 13 nt, Human
gugaugcggcaga

SEQ ID NO: 2532906 - RNA, 15 nt, Human
gugaugcugggcugg

SEQ ID NO: 2532907 - RNA, 22 nt, Human
gugaugcgcaugucacggaggg

SEQ ID NO: 2532908 - RNA, 12 nt, Human
gugaugcggcag

SEQ ID NO: 2532909 - RNA, 22 nt, Human
gugaugcuaaagguuguauugc

SEQ ID NO: 2532910 - RNA, 13 nt, Human
gugaugccucccu

SEQ ID NO: 2532911 - RNA, 18 nt, Human
gugcacaucugugucuug

SEQ ID NO: 2532912 - RNA, 14 nt, Human
gugcacagugauuu

SEQ ID NO: 2532913 - RNA, 13 nt, Human
gugcacagugauu

SEQ ID NO: 2532914 - RNA, 22 nt, Human
gugcaugcugucccuuacguga

SEQ ID NO: 2532915 - RNA, 14 nt, Human
gugcaugguggcac

SEQ ID NO: 2532916 - RNA, 16 nt, Human
gugcauguaugucuug

SEQ ID NO: 2532917 - RNA, 13 nt, Human
gugcaugggugaa

SEQ ID NO: 2532918 - RNA, 18 nt, Human
gugcaugggugaagggag

SEQ ID NO: 2532919 - RNA, 21 nt, Human
gugcacacaccagagcccacc

SEQ ID NO: 2532920 - RNA, 22 nt, Human
gugcacagacgucccuccacgu

SEQ ID NO: 2532921 - RNA, 20 nt, Human
gugcacagacgucccuccac

SEQ ID NO: 2532922 - RNA, 20 nt, Human
gugcaauuuguuugugcuuc

SEQ ID NO: 2532923 - RNA, 17 nt, Human
gugcaauuuguuugugc

SEQ ID NO: 2532924 - RNA, 22 nt, Human
gugcaauuguaggggugugugu

SEQ ID NO: 2532925 - RNA, 23 nt, Human
gugcaauuuguuugugcuucuaa

SEQ ID NO: 2532926 - RNA, 21 nt, Human
gugcaauuuguuugugcuucu

SEQ ID NO: 2532927 - RNA, 18 nt, Human
gugcacaaaacccagacc

SEQ ID NO: 2532928 - RNA, 15 nt, Human
gugcacaaauauuua

SEQ ID NO: 2532929 - RNA, 21 nt, Human
gugcaaugucugagugaaccu

SEQ ID NO: 2532930 - RNA, 22 nt, Human
gugcaaugaccuuucaauagga

SEQ ID NO: 2532931 - RNA, 22 nt, Human
gugcaaguguaugcacgugugc

SEQ ID NO: 2532932 - RNA, 17 nt, Human
gugcaagugucugugug

SEQ ID NO: 2532933 - RNA, 20 nt, Human
gugcaagagacucuggccuc

SEQ ID NO: 2532934 - RNA, 19 nt, Human
gugcaagagacucuggccu

SEQ ID NO: 2532935 - RNA, 18 nt, Human
gugcaagagacucuggcc

SEQ ID NO: 2532936 - RNA, 22 nt, Human
gugcaacccaaggacugaggga

SEQ ID NO: 2532937 - RNA, 12 nt, Human
gugcaagagagg

SEQ ID NO: 2532938 - RNA, 20 nt, Human
gugcaaguaugugagugugu

SEQ ID NO: 2532939 - RNA, 22 nt, Human
gugcaagagacucuggccucca

SEQ ID NO: 2532940 - RNA, 15 nt, Human
gugcaagccccugcu

SEQ ID NO: 2532941 - RNA, 19 nt, Human
gugauggggcccugccucc

SEQ ID NO: 2532942 - RNA, 16 nt, Human
gugaugguuccccugu

SEQ ID NO: 2532943 - RNA, 14 nt, Human
gugaugguuccccu

SEQ ID NO: 2532944 - RNA, 23 nt, Human
gugcaaccucuuggccugaucag

SEQ ID NO: 2532945 - RNA, 23 nt, Human
gugcaacccuuaccccuuagccu

SEQ ID NO: 2532946 - RNA, 14 nt, Human
gugcaacccuuacc

SEQ ID NO: 2532947 - RNA, 13 nt, Human
gugcaacccaagg

SEQ ID NO: 2532948 - RNA, 24 nt, Human
gugcaacaggguauggacuaucug

SEQ ID NO: 2532949 - RNA, 15 nt, Human
gugcauuaucuagau

SEQ ID NO: 2532950 - RNA, 19 nt, Human
gugcauuaucuagauacug

SEQ ID NO: 2532951 - RNA, 19 nt, Human
gugcauguguguucaugca

SEQ ID NO: 2532952 - RNA, 23 nt, Human
gugcauguaugucuuggacacug

SEQ ID NO: 2532953 - RNA, 13 nt, Human
gugcaugugugug

SEQ ID NO: 2532954 - RNA, 14 nt, Human
gugcaugugugugc

SEQ ID NO: 2532955 - RNA, 15 nt, Human
gugcaugugugugcu

SEQ ID NO: 2532956 - RNA, 18 nt, Human
gugcaugugugugcucag

SEQ ID NO: 2532957 - RNA, 14 nt, Human
gugcauuacagaga

SEQ ID NO: 2532958 - RNA, 16 nt, Human
gugcauuacagagagg

SEQ ID NO: 2532959 - RNA, 23 nt, Human
gugcauuaucuagauacuguauc

SEQ ID NO: 2532960 - RNA, 21 nt, Human
gugccaauuucaaguuccaag

SEQ ID NO: 2532961 - RNA, 14 nt, Human
gugccaauuucaag

SEQ ID NO: 2532962 - RNA, 23 nt, Human
gugcauuacagagaggagaaaca

SEQ ID NO: 2532963 - RNA, 11 nt, Human
gugccacccug

SEQ ID NO: 2532964 - RNA, 14 nt, Human
gugccacccugggc

SEQ ID NO: 2532965 - RNA, 12 nt, Human
gugccacccugg

SEQ ID NO: 2532966 - RNA, 18 nt, Human
gugccacccaccagggcg

SEQ ID NO: 2532967 - RNA, 21 nt, Human
gugccacccugggcucugugg

SEQ ID NO: 2532968 - RNA, 20 nt, Human
gugccacccugggcucugug

SEQ ID NO: 2532969 - RNA, 16 nt, Human
gugccacccugggcuc

SEQ ID NO: 2532970 - RNA, 15 nt, Human
gugccacccugggcu

SEQ ID NO: 2532971 - RNA, 22 nt, Human
gugccacucaccgaagccacuu

SEQ ID NO: 2532972 - RNA, 22 nt, Human
gugccacccugggcucuguggg

SEQ ID NO: 2532973 - RNA, 17 nt, Human
gugccacugcccgagcu

SEQ ID NO: 2532974 - RNA, 18 nt, Human
gugccacugcccgagcug

SEQ ID NO: 2532975 - RNA, 20 nt, Human
gugccuggguggggcugcuc

SEQ ID NO: 2532976 - RNA, 21 nt, Human
gugccuggguggggcugcucc

SEQ ID NO: 2532977 - RNA, 12 nt, Human
gugccucugccu

SEQ ID NO: 2532978 - RNA, 18 nt, Human
gugccuggguggggcugc

SEQ ID NO: 2532979 - RNA, 20 nt, Human
gugccugucccacccccacc

SEQ ID NO: 2532980 - RNA, 15 nt, Human
gugccugucccaccc

SEQ ID NO: 2532981 - RNA, 21 nt, Human
gugccuguaugcaacaggcac

SEQ ID NO: 2532982 - RNA, 19 nt, Human
gugccuguaugcaacaggc

SEQ ID NO: 2532983 - RNA, 22 nt, Human
gugccuggguggggcugcuccu

SEQ ID NO: 2532984 - RNA, 23 nt, Human
gugccuggguggggcugcuccuc

SEQ ID NO: 2532985 - RNA, 22 nt, Human
gugccuguguccaugcgcucag

SEQ ID NO: 2532986 - RNA, 13 nt, Human
gugccugugucca

SEQ ID NO: 2532987 - RNA, 20 nt, Human
gugccugucuguuacacugg

SEQ ID NO: 2532988 - RNA, 15 nt, Human
gugccugugaggcag

SEQ ID NO: 2532989 - RNA, 16 nt, Human
gugccugugaggcagg

SEQ ID NO: 2532990 - RNA, 17 nt, Human
gugccugugaggcaggg

SEQ ID NO: 2532991 - RNA, 19 nt, Human
gugccacugcccgagcugg

SEQ ID NO: 2532992 - RNA, 20 nt, Human
gugccacugcccgagcuggu

SEQ ID NO: 2532993 - RNA, 21 nt, Human
gugccacugcccgagcuggug

SEQ ID NO: 2532994 - RNA, 22 nt, Human
gugccacugcccgagcuggugc

SEQ ID NO: 2532995 - RNA, 23 nt, Human
gugccacugcccgagcuggugca

SEQ ID NO: 2532996 - RNA, 23 nt, Human
gugccuccaccaccacuggccac

SEQ ID NO: 2532997 - RNA, 13 nt, Human
gugccuccaggug

SEQ ID NO: 2532998 - RNA, 15 nt, Human
gugccuccaggugug

SEQ ID NO: 2532999 - RNA, 21 nt, Human
gugccuccuuccaccucccuc

SEQ ID NO: 2533000 - RNA, 18 nt, Human
gugccuccuuccaccucc

SEQ ID NO: 2533001 - RNA, 22 nt, Human
gugccuccuuccaccucccucc

SEQ ID NO: 2533002 - RNA, 22 nt, Human
gugccucggcuuuucucagcug

SEQ ID NO: 2533003 - RNA, 13 nt, Human
gugccuccuucca

SEQ ID NO: 2533004 - RNA, 13 nt, Human
aacugggaccuuu

SEQ ID NO: 2533005 - RNA, 14 nt, Human
aacugggcugaaca

SEQ ID NO: 2533006 - RNA, 16 nt, Human
aacugggcugaacacu

SEQ ID NO: 2533007 - RNA, 17 nt, Human
aacugggacaggggaga

SEQ ID NO: 2533008 - RNA, 12 nt, Human
aacuggcugugu

SEQ ID NO: 2533009 - RNA, 23 nt, Human
aacuggccggucugcaagucaga

SEQ ID NO: 2533010 - RNA, 21 nt, Human
aacuggccggucugcaaguca

SEQ ID NO: 2533011 - RNA, 17 nt, Human
aacuggccggucugcaa

SEQ ID NO: 2533012 - RNA, 21 nt, Human
aacugggggagggugaaguga

SEQ ID NO: 2533013 - RNA, 22 nt, Human
aacugggggagggugaagugaa

SEQ ID NO: 2533014 - RNA, 21 nt, Human
aacuggguacuuguggacaca

SEQ ID NO: 2533015 - RNA, 16 nt, Human
aacuggguacuugugg

SEQ ID NO: 2533016 - RNA, 19 nt, Human
aacuggacugguucaaaug

SEQ ID NO: 2533017 - RNA, 15 nt, Human
aacuggauuaaacuu

SEQ ID NO: 2533018 - RNA, 19 nt, Human
aacuggacccuguugcuaa

SEQ ID NO: 2533019 - RNA, 18 nt, Human
aacuggacccuguugcua

SEQ ID NO: 2533020 - RNA, 17 nt, Human
aacuggacccuguugcu

SEQ ID NO: 2533021 - RNA, 14 nt, Human
aacuggacccuguu

SEQ ID NO: 2533022 - RNA, 21 nt, Human
aacuggacccuguugcuaagc

SEQ ID NO: 2533023 - RNA, 20 nt, Human
aacuggacccuguugcuaag

SEQ ID NO: 2533024 - RNA, 22 nt, Human
aacuggacccuguugcuaagcc

SEQ ID NO: 2533025 - RNA, 13 nt, Human
aacuggacucagg

SEQ ID NO: 2533026 - RNA, 15 nt, Human
aacuggacucaggau

SEQ ID NO: 2533027 - RNA, 11 nt, Human
aacuggcugca

SEQ ID NO: 2533028 - RNA, 16 nt, Human
aacuggauuaaacuua

SEQ ID NO: 2533029 - RNA, 17 nt, Human
aacuggcaguuuuccau

SEQ ID NO: 2533030 - RNA, 12 nt, Human
aacuggagcccc

SEQ ID NO: 2533031 - RNA, 21 nt, Human
aacuggacucaggaugcccag

SEQ ID NO: 2533032 - RNA, 22 nt, Human
aacuggacucaggaugcccagg

SEQ ID NO: 2533033 - RNA, 17 nt, Human
aacugcuuguuuccuag

SEQ ID NO: 2533034 - RNA, 15 nt, Human
aacugcuuucuuucg

SEQ ID NO: 2533035 - RNA, 21 nt, Human
aacugcuuucuuucguuuguu

SEQ ID NO: 2533036 - RNA, 17 nt, Human
aacuggaauaguuuuuu

SEQ ID NO: 2533037 - RNA, 20 nt, Human
aacuggaagcauguaggaga

SEQ ID NO: 2533038 - RNA, 23 nt, Human
aacugcugacuguuuucucuuga

SEQ ID NO: 2533039 - RNA, 20 nt, Human
aacugcugcuuuuugaggug

SEQ ID NO: 2533040 - RNA, 14 nt, Human
aacugcugcuuuuu

SEQ ID NO: 2533041 - RNA, 20 nt, Human
aacugcugacuguuuucucu

SEQ ID NO: 2533042 - RNA, 21 nt, Human
aacugcugacuguuuucucuu

SEQ ID NO: 2533043 - RNA, 16 nt, Human
aacugcguuaaaggcu

SEQ ID NO: 2533044 - RNA, 23 nt, Human
aacugcugaaaacuagcucguga

SEQ ID NO: 2533045 - RNA, 15 nt, Human
aacugcugacuguuu

SEQ ID NO: 2533046 - RNA, 20 nt, Human
aacugccuacuccaaaaugu

SEQ ID NO: 2533047 - RNA, 13 nt, Human
aacugcaggcccu

SEQ ID NO: 2533048 - RNA, 20 nt, Human
aacugccucgaaacacagaa

SEQ ID NO: 2533049 - RNA, 16 nt, Human
aacugccuuggcuuca

SEQ ID NO: 2533050 - RNA, 17 nt, Human
aacugccuuggcuucag

SEQ ID NO: 2533051 - RNA, 15 nt, Human
aacugccucuuuccu

SEQ ID NO: 2533052 - RNA, 17 nt, Human
aacugccuuaaaacuuu

SEQ ID NO: 2533053 - RNA, 19 nt, Human
aacugcacugucaagauga

SEQ ID NO: 2533054 - RNA, 19 nt, Human
aacugcagaccuguccucc

SEQ ID NO: 2533055 - RNA, 18 nt, Human
aacugcagaccuguccuc

SEQ ID NO: 2533056 - RNA, 17 nt, Human
aacugcagaccuguccu

SEQ ID NO: 2533057 - RNA, 22 nt, Human
aacucugacaacagacuucuga

SEQ ID NO: 2533058 - RNA, 23 nt, Human
aacucugacaacagacuucugaa

SEQ ID NO: 2533059 - RNA, 22 nt, Human
gugagucuuggcggcagcagcc

SEQ ID NO: 2533060 - RNA, 21 nt, Human
gugagucuuggcggcagcagc

SEQ ID NO: 2533061 - RNA, 20 nt, Human
gugagucuuggcggcagcag

SEQ ID NO: 2533062 - RNA, 19 nt, Human
gugagucuuggcggcagca

SEQ ID NO: 2533063 - RNA, 13 nt, Human
gugagugagccug

SEQ ID NO: 2533064 - RNA, 18 nt, Human
gugagugagccuggcucu

SEQ ID NO: 2533065 - RNA, 15 nt, Human
gugagugagccuggc

SEQ ID NO: 2533066 - RNA, 14 nt, Human
gugagugagccugg

SEQ ID NO: 2533067 - RNA, 20 nt, Human
aacucugacaacagacuucu

SEQ ID NO: 2533068 - RNA, 22 nt, Human
gugagucgaggacagggaggug

SEQ ID NO: 2533069 - RNA, 18 nt, Human
gugagucuuggcggcagc

SEQ ID NO: 2533070 - RNA, 17 nt, Human
gugagucuuggcggcag

SEQ ID NO: 2533071 - RNA, 16 nt, Human
gugagucuuggcggca

SEQ ID NO: 2533072 - RNA, 14 nt, Human
gugaggugcccagc

SEQ ID NO: 2533073 - RNA, 21 nt, Human
gugaggugcagagugcccaga

SEQ ID NO: 2533074 - RNA, 15 nt, Human
gugagucgaggacag

SEQ ID NO: 2533075 - RNA, 19 nt, Human
gugaggugcagagugccca

SEQ ID NO: 2533076 - RNA, 18 nt, Human
gugaggguuucugagcug

SEQ ID NO: 2533077 - RNA, 19 nt, Human
gugaggguuucugagcugc

SEQ ID NO: 2533078 - RNA, 18 nt, Human
gugagggucagagaggag

SEQ ID NO: 2533079 - RNA, 13 nt, Human
aacucuuaucuca

SEQ ID NO: 2533080 - RNA, 14 nt, Human
aacucuuaucucag

SEQ ID NO: 2533081 - RNA, 21 nt, Human
aacucuucaaucucuugcacu

SEQ ID NO: 2533082 - RNA, 22 nt, Human
aacucuguugcaagugcaauaa

SEQ ID NO: 2533083 - RNA, 17 nt, Human
aacucuuagaaaugaag

SEQ ID NO: 2533084 - RNA, 19 nt, Human
aacucuguugcaagugcaa

SEQ ID NO: 2533085 - RNA, 15 nt, Human
aacucuuaucucagu

SEQ ID NO: 2533086 - RNA, 18 nt, Human
aacucuucacaaaaucug

SEQ ID NO: 2533087 - RNA, 19 nt, Human
aacugaaaacaagccauga

SEQ ID NO: 2533088 - RNA, 20 nt, Human
aacugaaaagacucaguguu

SEQ ID NO: 2533089 - RNA, 12 nt, Human
aacugaaaaugu

SEQ ID NO: 2533090 - RNA, 19 nt, Human
aacugaaaaucuaauauua

SEQ ID NO: 2533091 - RNA, 12 nt, Human
aacugaaaagac

SEQ ID NO: 2533092 - RNA, 12 nt, Human
aacugaaaucau

SEQ ID NO: 2533093 - RNA, 13 nt, Human
aacugaaagugaa

SEQ ID NO: 2533094 - RNA, 20 nt, Human
gugagaugcuggagaagaga

SEQ ID NO: 2533095 - RNA, 19 nt, Human
gugagaugcuggagaagag

SEQ ID NO: 2533096 - RNA, 18 nt, Human
gugagaugcuggagaaga

SEQ ID NO: 2533097 - RNA, 17 nt, Human
gugagaugcuggagaag

SEQ ID NO: 2533098 - RNA, 15 nt, Human
gugagaugcuggaga

SEQ ID NO: 2533099 - RNA, 18 nt, Human
gugagaugcagcuggaaa

SEQ ID NO: 2533100 - RNA, 16 nt, Human
gugagaugcagcugga

SEQ ID NO: 2533101 - RNA, 15 nt, Human
gugagaugcagcugg

SEQ ID NO: 2533102 - RNA, 15 nt, Human
gugagauguaauugu

SEQ ID NO: 2533103 - RNA, 22 nt, Human
gugaggccagagacacaagccu

SEQ ID NO: 2533104 - RNA, 17 nt, Human
gugaggccagagacaca

SEQ ID NO: 2533105 - RNA, 16 nt, Human
gugagggucccaugug

SEQ ID NO: 2533106 - RNA, 15 nt, Human
gugagggucccaugu

SEQ ID NO: 2533107 - RNA, 17 nt, Human
gugagggagggcuguca

SEQ ID NO: 2533108 - RNA, 19 nt, Human
gugagggguaaaagcugau

SEQ ID NO: 2533109 - RNA, 22 nt, Human
gugagggcuugucauuaccaga

SEQ ID NO: 2533110 - RNA, 15 nt, Human
gugaggccagggcag

SEQ ID NO: 2533111 - RNA, 17 nt, Human
gugaggccagggcagag

SEQ ID NO: 2533112 - RNA, 14 nt, Human
gugaggccagggca

SEQ ID NO: 2533113 - RNA, 21 nt, Human
gugagcaagaagucaaaguaa

SEQ ID NO: 2533114 - RNA, 16 nt, Human
gugaggccuggccagg

SEQ ID NO: 2533115 - RNA, 14 nt, Human
gugaggccuggcca

SEQ ID NO: 2533116 - RNA, 13 nt, Human
gugaggccuggcc

SEQ ID NO: 2533117 - RNA, 11 nt, Human
gugaggccugg

SEQ ID NO: 2533118 - RNA, 13 nt, Human
gugaggccccugg

SEQ ID NO: 2533119 - RNA, 22 nt, Human
gugagaugcuggagaagagagg

SEQ ID NO: 2533120 - RNA, 15 nt, Human
gugaggcccagggag

SEQ ID NO: 2533121 - RNA, 17 nt, Human
gugaacuugggccacug

SEQ ID NO: 2533122 - RNA, 19 nt, Human
gugaacuugggccacugug

SEQ ID NO: 2533123 - RNA, 21 nt, Human
gugagaugcuagaacucccuu

SEQ ID NO: 2533124 - RNA, 14 nt, Human
gugaacuuuuugua

SEQ ID NO: 2533125 - RNA, 15 nt, Human
gugaacuuuauuaaa

SEQ ID NO: 2533126 - RNA, 20 nt, Human
gugaacuuggggaacaaggg

SEQ ID NO: 2533127 - RNA, 23 nt, Human
gugaacucagccaagcacagugg

SEQ ID NO: 2533128 - RNA, 22 nt, Human
gugaacucagccaagcacagug

SEQ ID NO: 2533129 - RNA, 21 nt, Human
gugaacucagccaagcacagu

SEQ ID NO: 2533130 - RNA, 19 nt, Human
gugaacucagccaagcaca

SEQ ID NO: 2533131 - RNA, 18 nt, Human
gugaacucagccaagcac

SEQ ID NO: 2533132 - RNA, 17 nt, Human
gugaacucagccaagca

SEQ ID NO: 2533133 - RNA, 16 nt, Human
gugaacucagccaagc

SEQ ID NO: 2533134 - RNA, 15 nt, Human
gugaacucagccaag

SEQ ID NO: 2533135 - RNA, 16 nt, Human
gugaacugacaggcag

SEQ ID NO: 2533136 - RNA, 13 nt, Human
gugaacugacagg

SEQ ID NO: 2533137 - RNA, 20 nt, Human
gugaacuggacccuguugcu

SEQ ID NO: 2533138 - RNA, 19 nt, Human
gugaacuggacccuguugc

SEQ ID NO: 2533139 - RNA, 22 nt, Human
gugaacuggacccuguugcuaa

SEQ ID NO: 2533140 - RNA, 21 nt, Human
gugaacuggacccuguugcua

SEQ ID NO: 2533141 - RNA, 23 nt, Human
gugaacuggacccuguugcuaag

SEQ ID NO: 2533142 - RNA, 21 nt, Human
gugaacugugaggguaaaggc

SEQ ID NO: 2533143 - RNA, 13 nt, Human
aaccccuguggag

SEQ ID NO: 2533144 - RNA, 16 nt, Human
aacccgaggcccgcau

SEQ ID NO: 2533145 - RNA, 15 nt, Human
aacccgaggcccgca

SEQ ID NO: 2533146 - RNA, 16 nt, Human
aacccgacagagggaa

SEQ ID NO: 2533147 - RNA, 11 nt, Human
aaccccuuucc

SEQ ID NO: 2533148 - RNA, 17 nt, Human
aacccgacagagggaag

SEQ ID NO: 2533149 - RNA, 16 nt, Human
aacccgggaggcagag

SEQ ID NO: 2533150 - RNA, 20 nt, Human
aaccucagccuggccagaca

SEQ ID NO: 2533151 - RNA, 13 nt, Human
aaccucagcucug

SEQ ID NO: 2533152 - RNA, 16 nt, Human
aaccucagccuggcca

SEQ ID NO: 2533153 - RNA, 23 nt, Human
aacccgagucauucguucugugg

SEQ ID NO: 2533154 - RNA, 20 nt, Human
aacccgacagagggaagaaa

SEQ ID NO: 2533155 - RNA, 16 nt, Human
aaccucauugacaaga

SEQ ID NO: 2533156 - RNA, 14 nt, Human
aaccucauucccca

SEQ ID NO: 2533157 - RNA, 21 nt, Human
aaccucauugacaagaacuga

SEQ ID NO: 2533158 - RNA, 21 nt, Human
aaccuccuguuagcuguuauu

SEQ ID NO: 2533159 - RNA, 19 nt, Human
aaccuccuuucucuucucu

SEQ ID NO: 2533160 - RNA, 18 nt, Human
aaccuccuuucucuucuc

SEQ ID NO: 2533161 - RNA, 17 nt, Human
aaccuccuuucucuucu

SEQ ID NO: 2533162 - RNA, 13 nt, Human
aaccuccuuucuc

SEQ ID NO: 2533163 - RNA, 16 nt, Human
aaccucaucuucuuca

SEQ ID NO: 2533164 - RNA, 13 nt, Human
aaccucaguguca

SEQ ID NO: 2533165 - RNA, 18 nt, Human
aaccucagugucauuuau

SEQ ID NO: 2533166 - RNA, 19 nt, Human
aaccucagugucauuuaug

SEQ ID NO: 2533167 - RNA, 21 nt, Human
aaccucagcucugggagagga

SEQ ID NO: 2533168 - RNA, 16 nt, Human
aaccucagcucuggga

SEQ ID NO: 2533169 - RNA, 15 nt, Human
aaccucagcucuggg

SEQ ID NO: 2533170 - RNA, 14 nt, Human
aaccucagcucugg

SEQ ID NO: 2533171 - RNA, 18 nt, Human
aaccucaggcuuccuugg

SEQ ID NO: 2533172 - RNA, 11 nt, Human
aaccugaaaaa

SEQ ID NO: 2533173 - RNA, 14 nt, Human
aaccucgcuggacu

SEQ ID NO: 2533174 - RNA, 19 nt, Human
aaccucgcuggacucucag

SEQ ID NO: 2533175 - RNA, 18 nt, Human
aaccugagccccaaaagg

SEQ ID NO: 2533176 - RNA, 19 nt, Human
aaccugaccccugcucagu

SEQ ID NO: 2533177 - RNA, 20 nt, Human
aaccugaccgugggcggggc

SEQ ID NO: 2533178 - RNA, 17 nt, Human
aaccugacguagcugca

SEQ ID NO: 2533179 - RNA, 16 nt, Human
aaccugaccccugcuc

SEQ ID NO: 2533180 - RNA, 17 nt, Human
aaccugaccccugcuca

SEQ ID NO: 2533181 - RNA, 11 nt, Human
aaccugacccc

SEQ ID NO: 2533182 - RNA, 23 nt, Human
aaccugacagaugucagccgagc

SEQ ID NO: 2533183 - RNA, 20 nt, Human
aaccugacagaugucagccg

SEQ ID NO: 2533184 - RNA, 19 nt, Human
aaccugacaaaaaaaaagu

SEQ ID NO: 2533185 - RNA, 21 nt, Human
aaccugaaaaaaaguuuacaa

SEQ ID NO: 2533186 - RNA, 15 nt, Human
aaccugaaccuagga

SEQ ID NO: 2533187 - RNA, 14 nt, Human
aacccagauaaagg

SEQ ID NO: 2533188 - RNA, 15 nt, Human
aacccagacucagac

SEQ ID NO: 2533189 - RNA, 16 nt, Human
aacccagacucagaca

SEQ ID NO: 2533190 - RNA, 18 nt, Human
aacccagacucagacauu

SEQ ID NO: 2533191 - RNA, 11 nt, Human
aacccagagag

SEQ ID NO: 2533192 - RNA, 12 nt, Human
aacccagagagg

SEQ ID NO: 2533193 - RNA, 22 nt, Human
aacccagaccuguuagcagaca

SEQ ID NO: 2533194 - RNA, 22 nt, Human
aacccaccuuguuggagccugc

SEQ ID NO: 2533195 - RNA, 14 nt, Human
aacccaccugcuga

SEQ ID NO: 2533196 - RNA, 12 nt, Human
aacccagacuca

SEQ ID NO: 2533197 - RNA, 14 nt, Human
aacccagacucaga

SEQ ID NO: 2533198 - RNA, 23 nt, Human
aacccagaccuguuagcagacag

SEQ ID NO: 2533199 - RNA, 22 nt, Human
aaccccaguucugcuccucucc

SEQ ID NO: 2533200 - RNA, 19 nt, Human
aaccccaguucugcuccuc

SEQ ID NO: 2533201 - RNA, 18 nt, Human
aaccccaguucugcuccu

SEQ ID NO: 2533202 - RNA, 16 nt, Human
aaccccaguucugcuc

SEQ ID NO: 2533203 - RNA, 13 nt, Human
aaccccaguucug

SEQ ID NO: 2533204 - RNA, 12 nt, Human
aaccccaguucu

SEQ ID NO: 2533205 - RNA, 16 nt, Human
aacccagccgcugccc

SEQ ID NO: 2533206 - RNA, 14 nt, Human
aaccccaggccccg

SEQ ID NO: 2533207 - RNA, 13 nt, Human
aacccccacacac

SEQ ID NO: 2533208 - RNA, 14 nt, Human
aacccccacacaca

SEQ ID NO: 2533209 - RNA, 12 nt, Human
aacccccacaca

SEQ ID NO: 2533210 - RNA, 23 nt, Human
aaccccaguucugcuccucucca

SEQ ID NO: 2533211 - RNA, 10 nt, Human
aacccagcuc

SEQ ID NO: 2533212 - RNA, 13 nt, Human
aacccagauuuug

SEQ ID NO: 2533213 - RNA, 21 nt, Human
aacccagauuuugcuguauau

SEQ ID NO: 2533214 - RNA, 10 nt, Human
aacccagccg

SEQ ID NO: 2533215 - RNA, 14 nt, Human
aacccagccgcugc

SEQ ID NO: 2533216 - RNA, 15 nt, Human
aacccccacacacac

SEQ ID NO: 2533217 - RNA, 10 nt, Human
aacccccacc

SEQ ID NO: 2533218 - RNA, 11 nt, Human
aacccccaccc

SEQ ID NO: 2533219 - RNA, 12 nt, Human
aacccccacccc

SEQ ID NO: 2533220 - RNA, 13 nt, Human
aacccccacccca

SEQ ID NO: 2533221 - RNA, 15 nt, Human
aacccccaccccaca

SEQ ID NO: 2533222 - RNA, 17 nt, Human
aacccccaccccacacu

SEQ ID NO: 2533223 - RNA, 18 nt, Human
aacccccaccccacacuu

SEQ ID NO: 2533224 - RNA, 19 nt, Human
aaccccccagcacugagga

SEQ ID NO: 2533225 - RNA, 18 nt, Human
aaccccccagcacugagg

SEQ ID NO: 2533226 - RNA, 14 nt, Human
aaccccccagcacu

SEQ ID NO: 2533227 - RNA, 11 nt, Human
aaccccccagc

SEQ ID NO: 2533228 - RNA, 19 nt, Human
aacccccaccccacacuug

SEQ ID NO: 2533229 - RNA, 20 nt, Human
aaccccuggcuccaggccag

SEQ ID NO: 2533230 - RNA, 21 nt, Human
aaccccuacaugaaacagaaa

SEQ ID NO: 2533231 - RNA, 19 nt, Human
aacccccuuugugcugugg

SEQ ID NO: 2533232 - RNA, 18 nt, Human
aacccccuuugugcugug

SEQ ID NO: 2533233 - RNA, 16 nt, Human
aacccccuuugugcug

SEQ ID NO: 2533234 - RNA, 17 nt, Human
aaccccccauuucuucc

SEQ ID NO: 2533235 - RNA, 22 nt, Human
aaccccgucgaggggcucucag

SEQ ID NO: 2533236 - RNA, 20 nt, Human
aaccccggggugcccacagg

SEQ ID NO: 2533237 - RNA, 14 nt, Human
aaccaccagaagcc

SEQ ID NO: 2533238 - RNA, 17 nt, Human
aaccaccagaagcccag

SEQ ID NO: 2533239 - RNA, 21 nt, Human
aaccaccacacccagcccacu

SEQ ID NO: 2533240 - RNA, 12 nt, Human
aaccaucauuga

SEQ ID NO: 2533241 - RNA, 20 nt, Human
aaccaagucaugugcauuuc

SEQ ID NO: 2533242 - RNA, 18 nt, Human
aaccaucauugaaaucuu

SEQ ID NO: 2533243 - RNA, 17 nt, Human
aaccaucauugaaaucu

SEQ ID NO: 2533244 - RNA, 23 nt, Human
aaccauuaaaacugaagucugaa

SEQ ID NO: 2533245 - RNA, 13 nt, Human
aaccauguuuugg

SEQ ID NO: 2533246 - RNA, 16 nt, Human
aaccaucauuauaaac

SEQ ID NO: 2533247 - RNA, 14 nt, Human
aaccauugucuugu

SEQ ID NO: 2533248 - RNA, 24 nt, Human
aaccauugucuuguucugugauga

SEQ ID NO: 2533249 - RNA, 19 nt, Human
aaccauugucuuguucugu

SEQ ID NO: 2533250 - RNA, 18 nt, Human
aaccauugucuuguucug

SEQ ID NO: 2533251 - RNA, 15 nt, Human
aaccauugucuuguu

SEQ ID NO: 2533252 - RNA, 23 nt, Human
aacccaaauguucaucaaugaau

SEQ ID NO: 2533253 - RNA, 22 nt, Human
aacccaaauuacguguacuaca

SEQ ID NO: 2533254 - RNA, 18 nt, Human
aacccaaggacugaggga

SEQ ID NO: 2533255 - RNA, 13 nt, Human
aacccaauaguug

SEQ ID NO: 2533256 - RNA, 19 nt, Human
aacccacaggcccacagua

SEQ ID NO: 2533257 - RNA, 16 nt, Human
aacccaagugggggca

SEQ ID NO: 2533258 - RNA, 14 nt, Human
aacccaauccaaau

SEQ ID NO: 2533259 - RNA, 22 nt, Human
aacccaagguggguagaucacg

SEQ ID NO: 2533260 - RNA, 18 nt, Human
aacccaaguccaagcaua

SEQ ID NO: 2533261 - RNA, 15 nt, Human
aacccaagcuuagaa

SEQ ID NO: 2533262 - RNA, 16 nt, Human
aacccaagcuuagaac

SEQ ID NO: 2533263 - RNA, 16 nt, Human
aacccaacucuccugg

SEQ ID NO: 2533264 - RNA, 22 nt, Human
gucuccuuugcacugagggcca

SEQ ID NO: 2533265 - RNA, 20 nt, Human
gucuccuuugcacugagggc

SEQ ID NO: 2533266 - RNA, 18 nt, Human
gucuccuuugcacugagg

SEQ ID NO: 2533267 - RNA, 16 nt, Human
gucuccuuugcacuga

SEQ ID NO: 2533268 - RNA, 15 nt, Human
gucuccuuugcacug

SEQ ID NO: 2533269 - RNA, 21 nt, Human
gucuccuuucucagccacaaa

SEQ ID NO: 2533270 - RNA, 20 nt, Human
gucuccuuucaccccagggc

SEQ ID NO: 2533271 - RNA, 13 nt, Human
gucucgaacuccu

SEQ ID NO: 2533272 - RNA, 18 nt, Human
gucucgaacuccugaccu

SEQ ID NO: 2533273 - RNA, 18 nt, Human
aaccaagccguggcuucc

SEQ ID NO: 2533274 - RNA, 15 nt, Human
aaccaagcucucugc

SEQ ID NO: 2533275 - RNA, 23 nt, Human
gucuccuuugcacugagggccac

SEQ ID NO: 2533276 - RNA, 18 nt, Human
gucuccuuugcaggcuca

SEQ ID NO: 2533277 - RNA, 19 nt, Human
gucucgaacuccugaccuu

SEQ ID NO: 2533278 - RNA, 16 nt, Human
aaccaagccguggcuu

SEQ ID NO: 2533279 - RNA, 17 nt, Human
aaccaagcucucugcau

SEQ ID NO: 2533280 - RNA, 16 nt, Human
aaccaagucaugugca

SEQ ID NO: 2533281 - RNA, 15 nt, Human
aaccaagucaaguga

SEQ ID NO: 2533282 - RNA, 20 nt, Human
aaccacauuggagauguuua

SEQ ID NO: 2533283 - RNA, 19 nt, Human
aaccaccacacccagccca

SEQ ID NO: 2533284 - RNA, 22 nt, Human
gucuccuuaacacugagcuguc

SEQ ID NO: 2533285 - RNA, 18 nt, Human
gucuccuuucaccccagg

SEQ ID NO: 2533286 - RNA, 16 nt, Human
gucuccuuaacacuga

SEQ ID NO: 2533287 - RNA, 22 nt, Human
gucuccugugcccacaucccag

SEQ ID NO: 2533288 - RNA, 21 nt, Human
gucuccugugcccacauccca

SEQ ID NO: 2533289 - RNA, 13 nt, Human
gucucccuucucc

SEQ ID NO: 2533290 - RNA, 16 nt, Human
gucucccuggcccuca

SEQ ID NO: 2533291 - RNA, 18 nt, Human
gucucccuggcccucaag

SEQ ID NO: 2533292 - RNA, 19 nt, Human
gucucccuucucccaugag

SEQ ID NO: 2533293 - RNA, 15 nt, Human
gucucccuucuccca

SEQ ID NO: 2533294 - RNA, 18 nt, Human
gucucccuuucccuucuu

SEQ ID NO: 2533295 - RNA, 14 nt, Human
gucucccucuccug

SEQ ID NO: 2533296 - RNA, 15 nt, Human
gucucccucuccugc

SEQ ID NO: 2533297 - RNA, 16 nt, Human
gucucccucuccugcc

SEQ ID NO: 2533298 - RNA, 17 nt, Human
gucucccucuccugccu

SEQ ID NO: 2533299 - RNA, 18 nt, Human
gucucccucuccugccua

SEQ ID NO: 2533300 - RNA, 19 nt, Human
gucucccucuccugccuac

SEQ ID NO: 2533301 - RNA, 20 nt, Human
gucucccucuccugccuacu

SEQ ID NO: 2533302 - RNA, 15 nt, Human
gucucccuggcccuc

SEQ ID NO: 2533303 - RNA, 14 nt, Human
gucucccuggcccu

SEQ ID NO: 2533304 - RNA, 13 nt, Human
gucucccuggccc

SEQ ID NO: 2533305 - RNA, 12 nt, Human
gucucccuggcc

SEQ ID NO: 2533306 - RNA, 16 nt, Human
gucucccuggagugca

SEQ ID NO: 2533307 - RNA, 21 nt, Human
gucucccucuccugccuacuc

SEQ ID NO: 2533308 - RNA, 22 nt, Human
gucucccucuccugccuacuca

SEQ ID NO: 2533309 - RNA, 23 nt, Human
aacaguguuucccauaauuuucu

SEQ ID NO: 2533310 - RNA, 20 nt, Human
aacaguguuuuggaauaaaa

SEQ ID NO: 2533311 - RNA, 13 nt, Human
aacaguuaacuuu

SEQ ID NO: 2533312 - RNA, 17 nt, Human
aacaguuaacuuucaga

SEQ ID NO: 2533313 - RNA, 18 nt, Human
aacaguuaacuuucagaa

SEQ ID NO: 2533314 - RNA, 19 nt, Human
aacaguuaauaccauuuuu

SEQ ID NO: 2533315 - RNA, 23 nt, Human
aacaguucauguuugcuucauaa

SEQ ID NO: 2533316 - RNA, 14 nt, Human
aacaguuccuucag

SEQ ID NO: 2533317 - RNA, 16 nt, Human
aacaguucauguuugc

SEQ ID NO: 2533318 - RNA, 20 nt, Human
aacaguuaacuuucagaaga

SEQ ID NO: 2533319 - RNA, 16 nt, Human
aacaguuagcuggagc

SEQ ID NO: 2533320 - RNA, 23 nt, Human
gucuucuaauuucaaaaauauaa

SEQ ID NO: 2533321 - RNA, 15 nt, Human
gucuucuaauuucaa

SEQ ID NO: 2533322 - RNA, 13 nt, Human
gucuucuaauuuc

SEQ ID NO: 2533323 - RNA, 20 nt, Human
gucuucguacaguucuucgg

SEQ ID NO: 2533324 - RNA, 14 nt, Human
gucuucuaaacuuc

SEQ ID NO: 2533325 - RNA, 23 nt, Human
gucuucuaaacuuccccaucuuc

SEQ ID NO: 2533326 - RNA, 14 nt, Human
gucuuuaacuguca

SEQ ID NO: 2533327 - RNA, 14 nt, Human
gucugguuucuaga

SEQ ID NO: 2533328 - RNA, 16 nt, Human
gucuuucacagcuccu

SEQ ID NO: 2533329 - RNA, 15 nt, Human
gucuuucacagcucc

SEQ ID NO: 2533330 - RNA, 17 nt, Human
gucuuuaggcagcagcu

SEQ ID NO: 2533331 - RNA, 16 nt, Human
gucuuucacauuuaaa

SEQ ID NO: 2533332 - RNA, 22 nt, Human
gucuuuggguaccuauuuucau

SEQ ID NO: 2533333 - RNA, 15 nt, Human
gucuuugguucagcu

SEQ ID NO: 2533334 - RNA, 18 nt, Human
gucuuuggacccugaggc

SEQ ID NO: 2533335 - RNA, 16 nt, Human
gucuuuugcuuuuggc

SEQ ID NO: 2533336 - RNA, 13 nt, Human
gucuuuugcauga

SEQ ID NO: 2533337 - RNA, 14 nt, Human
gucuuuugcuuuug

SEQ ID NO: 2533338 - RNA, 13 nt, Human
gucuuuugcuuuu

SEQ ID NO: 2533339 - RNA, 12 nt, Human
gucuuuugcuuu

SEQ ID NO: 2533340 - RNA, 12 nt, Human
gucuuuugcaug

SEQ ID NO: 2533341 - RNA, 19 nt, Human
gucuuuugacauguggaaa

SEQ ID NO: 2533342 - RNA, 15 nt, Human
gucuuuguaagagug

SEQ ID NO: 2533343 - RNA, 14 nt, Human
gucuuuguaagagu

SEQ ID NO: 2533344 - RNA, 13 nt, Human
gucuuuguaagag

SEQ ID NO: 2533345 - RNA, 12 nt, Human
gucuuuguaaga

SEQ ID NO: 2533346 - RNA, 21 nt, Human
gucuuuguaagaguguagaag

SEQ ID NO: 2533347 - RNA, 20 nt, Human
gucuuuguaagaguguagaa

SEQ ID NO: 2533348 - RNA, 22 nt, Human
gucuuuguaagaguguagaagc

SEQ ID NO: 2533349 - RNA, 16 nt, Human
gucuuuguaaugucac

SEQ ID NO: 2533350 - RNA, 18 nt, Human
gucuuuguaaugucacca

SEQ ID NO: 2533351 - RNA, 19 nt, Human
gucuuuguaaugucaccac

SEQ ID NO: 2533352 - RNA, 20 nt, Human
gucuuuguaaugucaccacc

SEQ ID NO: 2533353 - RNA, 14 nt, Human
gucuuuugacaugu

SEQ ID NO: 2533354 - RNA, 16 nt, Human
gucuuuugacaugugg

SEQ ID NO: 2533355 - RNA, 15 nt, Human
aaccuguccuugcac

SEQ ID NO: 2533356 - RNA, 22 nt, Human
aaccuguauaaguggaggcacu

SEQ ID NO: 2533357 - RNA, 15 nt, Human
aaccuguacuucaag

SEQ ID NO: 2533358 - RNA, 13 nt, Human
aaccuguaauaaa

SEQ ID NO: 2533359 - RNA, 14 nt, Human
aaccuguaauaaau

SEQ ID NO: 2533360 - RNA, 14 nt, Human
aaccuggugcugga

SEQ ID NO: 2533361 - RNA, 18 nt, Human
aaccuguaauaaauauga

SEQ ID NO: 2533362 - RNA, 16 nt, Human
aaccuguaauaaauau

SEQ ID NO: 2533363 - RNA, 23 nt, Human
aaccuguacuucaaguuaaagug

SEQ ID NO: 2533364 - RNA, 23 nt, Human
aaccuggucacaggacucugccu

SEQ ID NO: 2533365 - RNA, 16 nt, Human
gucuuuuuaugcauuu

SEQ ID NO: 2533366 - RNA, 20 nt, Human
gucuuuuuaagcuuauuuaa

SEQ ID NO: 2533367 - RNA, 11 nt, Human
aaccuggugcu

SEQ ID NO: 2533368 - RNA, 16 nt, Human
gucuuuuucuggacug

SEQ ID NO: 2533369 - RNA, 15 nt, Human
gucuuuuguucgcau

SEQ ID NO: 2533370 - RNA, 15 nt, Human
gucuuuuuaagcuua

SEQ ID NO: 2533371 - RNA, 20 nt, Human
aaccugagucguacagaaag

SEQ ID NO: 2533372 - RNA, 20 nt, Human
aaccugagccccaaaaggua

SEQ ID NO: 2533373 - RNA, 21 nt, Human
gucugguuuuaacaauuuccu

SEQ ID NO: 2533374 - RNA, 18 nt, Human
gucugguuuuaacaauuu

SEQ ID NO: 2533375 - RNA, 16 nt, Human
gucugguuuuaacaau

SEQ ID NO: 2533376 - RNA, 12 nt, Human
gucuguaaaauc

SEQ ID NO: 2533377 - RNA, 11 nt, Human
gucuguaaaau

SEQ ID NO: 2533378 - RNA, 18 nt, Human
gucuguaaaaucuuucuu

SEQ ID NO: 2533379 - RNA, 15 nt, Human
gucuguaaaaucuuu

SEQ ID NO: 2533380 - RNA, 14 nt, Human
gucuguaaaaucuu

SEQ ID NO: 2533381 - RNA, 13 nt, Human
gucuguaaaaucu

SEQ ID NO: 2533382 - RNA, 12 nt, Human
gucuggcagccu

SEQ ID NO: 2533383 - RNA, 22 nt, Human
gucuggcagccucccauccagg

SEQ ID NO: 2533384 - RNA, 14 nt, Human
gucuggcccuuccu

SEQ ID NO: 2533385 - RNA, 20 nt, Human
gucugucccgggguccugug

SEQ ID NO: 2533386 - RNA, 19 nt, Human
gucugucccgggguccugu

SEQ ID NO: 2533387 - RNA, 16 nt, Human
gucugucccggggucc

SEQ ID NO: 2533388 - RNA, 22 nt, Human
gucugucaugaacauguuccug

SEQ ID NO: 2533389 - RNA, 20 nt, Human
gucuguaucggagacaguga

SEQ ID NO: 2533390 - RNA, 15 nt, Human
gucugucccaccagc

SEQ ID NO: 2533391 - RNA, 14 nt, Human
gucugucucuguca

SEQ ID NO: 2533392 - RNA, 22 nt, Human
gucugucucuccaucuguuugg

SEQ ID NO: 2533393 - RNA, 23 nt, Human
gucugucccgggguccuguggca

SEQ ID NO: 2533394 - RNA, 21 nt, Human
gucugucccgggguccugugg

SEQ ID NO: 2533395 - RNA, 24 nt, Human
gucugucccgggguccuguggcag

SEQ ID NO: 2533396 - RNA, 18 nt, Human
gucuucguacaguucuuc

SEQ ID NO: 2533397 - RNA, 16 nt, Human
gucuucguacaguucu

SEQ ID NO: 2533398 - RNA, 14 nt, Human
gucuucguacaguu

SEQ ID NO: 2533399 - RNA, 13 nt, Human
gucuucguacagu

SEQ ID NO: 2533400 - RNA, 17 nt, Human
gucuucggaaaccuugg

SEQ ID NO: 2533401 - RNA, 15 nt, Human
gucuucggaaaccuu

SEQ ID NO: 2533402 - RNA, 15 nt, Human
gucuuccuucugccu

SEQ ID NO: 2533403 - RNA, 14 nt, Human
gucuuccugugggg

SEQ ID NO: 2533404 - RNA, 15 nt, Human
gucugucuucacagc

SEQ ID NO: 2533405 - RNA, 19 nt, Human
gucuuccugaguggugcca

SEQ ID NO: 2533406 - RNA, 17 nt, Human
gucuuccugcauucacc

SEQ ID NO: 2533407 - RNA, 12 nt, Human
gucuuccugugg

SEQ ID NO: 2533408 - RNA, 20 nt, Human
gucuuccugcauucacccag

SEQ ID NO: 2533409 - RNA, 22 nt, Human
gucuguagagggcccugguguu

SEQ ID NO: 2533410 - RNA, 19 nt, Human
gucuguagagggcccuggu

SEQ ID NO: 2533411 - RNA, 18 nt, Human
gucuguagagggcccugg

SEQ ID NO: 2533412 - RNA, 17 nt, Human
gucuguagagggcccug

SEQ ID NO: 2533413 - RNA, 14 nt, Human
gucuguagagggcc

SEQ ID NO: 2533414 - RNA, 21 nt, Human
gucuguacacguguccuguag

SEQ ID NO: 2533415 - RNA, 20 nt, Human
gucuguacacguguccugua

SEQ ID NO: 2533416 - RNA, 19 nt, Human
gucuguacacguguccugu

SEQ ID NO: 2533417 - RNA, 14 nt, Human
gucuguacacgugu

SEQ ID NO: 2533418 - RNA, 14 nt, Human
gucuguaagcugaa

SEQ ID NO: 2533419 - RNA, 23 nt, Human
gucuguauuuaugugugaggagc

SEQ ID NO: 2533420 - RNA, 19 nt, Human
gucuguauuuaugugugag

SEQ ID NO: 2533421 - RNA, 22 nt, Human
aacucgaggacuguauuuguga

SEQ ID NO: 2533422 - RNA, 20 nt, Human
aacucgaggacuguauuugu

SEQ ID NO: 2533423 - RNA, 19 nt, Human
aacucgaggacuguauuug

SEQ ID NO: 2533424 - RNA, 14 nt, Human
aacucgaggacugu

SEQ ID NO: 2533425 - RNA, 21 nt, Human
aacuccuuuagcagguggucc

SEQ ID NO: 2533426 - RNA, 18 nt, Human
aacuccuuuagcaggugg

SEQ ID NO: 2533427 - RNA, 14 nt, Human
aacuccuguccuuu

SEQ ID NO: 2533428 - RNA, 17 nt, Human
aacucaucugucaccaa

SEQ ID NO: 2533429 - RNA, 22 nt, Human
aacucaucuagguaaauuacag

SEQ ID NO: 2533430 - RNA, 19 nt, Human
aacucauuccugccugucu

SEQ ID NO: 2533431 - RNA, 21 nt, Human
aacucauuccugccugucucc

SEQ ID NO: 2533432 - RNA, 15 nt, Human
aacucauuccugccu

SEQ ID NO: 2533433 - RNA, 12 nt, Human
aacuccuggccu

SEQ ID NO: 2533434 - RNA, 22 nt, Human
aacucauuuccuauguaacugc

SEQ ID NO: 2533435 - RNA, 22 nt, Human
aacucauuccugccugucuccu

SEQ ID NO: 2533436 - RNA, 23 nt, Human
aacucauuccugccugucuccuu

SEQ ID NO: 2533437 - RNA, 23 nt, Human
gugaaccaccacacccagcccac

SEQ ID NO: 2533438 - RNA, 22 nt, Human
gugaaccaccacacccagccca

SEQ ID NO: 2533439 - RNA, 16 nt, Human
gugaaccuaccuucau

SEQ ID NO: 2533440 - RNA, 15 nt, Human
gugaaccaugucagc

SEQ ID NO: 2533441 - RNA, 14 nt, Human
gugaaccuguauaa

SEQ ID NO: 2533442 - RNA, 16 nt, Human
gugaacgauuuagaaa

SEQ ID NO: 2533443 - RNA, 14 nt, Human
gugaacgauuuaga

SEQ ID NO: 2533444 - RNA, 14 nt, Human
gugaacucagccaa

SEQ ID NO: 2533445 - RNA, 15 nt, Human
gugaacguggacucc

SEQ ID NO: 2533446 - RNA, 18 nt, Human
aacucuccuccagaguca

SEQ ID NO: 2533447 - RNA, 15 nt, Human
aacucuccuccagag

SEQ ID NO: 2533448 - RNA, 16 nt, Human
aacucuccucugcugc

SEQ ID NO: 2533449 - RNA, 13 nt, Human
aaccuugccuuuc

SEQ ID NO: 2533450 - RNA, 16 nt, Human
aaccuugagacagcuu

SEQ ID NO: 2533451 - RNA, 15 nt, Human
aaccuugagacagcu

SEQ ID NO: 2533452 - RNA, 17 nt, Human
aaccuucuggccuccca

SEQ ID NO: 2533453 - RNA, 22 nt, Human
aaccugugaccagucugacccu

SEQ ID NO: 2533454 - RNA, 18 nt, Human
aaccuugaaaacuuuaug

SEQ ID NO: 2533455 - RNA, 12 nt, Human
aaccugugucuc

SEQ ID NO: 2533456 - RNA, 11 nt, Human
aaccuguccuu

SEQ ID NO: 2533457 - RNA, 22 nt, Human
aacuacaugagaacaaacagau

SEQ ID NO: 2533458 - RNA, 23 nt, Human
aaccuugccuuucucgauuuuau

SEQ ID NO: 2533459 - RNA, 18 nt, Human
aaccuugguguaguugaa

SEQ ID NO: 2533460 - RNA, 20 nt, Human
aaccuugguguaguugaacu

SEQ ID NO: 2533461 - RNA, 19 nt, Human
aacuacuccggagacaggg

SEQ ID NO: 2533462 - RNA, 17 nt, Human
aacuacucagggaauga

SEQ ID NO: 2533463 - RNA, 19 nt, Human
aacuacgcuugcucauuuu

SEQ ID NO: 2533464 - RNA, 21 nt, Human
aaccuugguguaguugaacug

SEQ ID NO: 2533465 - RNA, 18 nt, Human
aacuaucuuggugaauuu

SEQ ID NO: 2533466 - RNA, 11 nt, Human
aacuaucuugg

SEQ ID NO: 2533467 - RNA, 17 nt, Human
aacuaugaacuacaaag

SEQ ID NO: 2533468 - RNA, 18 nt, Human
aacuaugauaugguaaaa

SEQ ID NO: 2533469 - RNA, 17 nt, Human
aacuaugcauggugccc

SEQ ID NO: 2533470 - RNA, 22 nt, Human
aacuaugcauggugccccagga

SEQ ID NO: 2533471 - RNA, 21 nt, Human
aacuaugauuuggaaaauaaa

SEQ ID NO: 2533472 - RNA, 16 nt, Human
aacuaugauuuggaaa

SEQ ID NO: 2533473 - RNA, 21 nt, Human
aacuagaguuuagcuggaaaa

SEQ ID NO: 2533474 - RNA, 23 nt, Human
aacuagagcagcccuggagucau

SEQ ID NO: 2533475 - RNA, 22 nt, Human
aacuagagcagcccuggaguca

SEQ ID NO: 2533476 - RNA, 20 nt, Human
aacuagagaugacugagucc

SEQ ID NO: 2533477 - RNA, 16 nt, Human
aacuagagcagcccug

SEQ ID NO: 2533478 - RNA, 20 nt, Human
aacuagacucccaagcugga

SEQ ID NO: 2533479 - RNA, 23 nt, Human
aacuagacucccaagcuggacua

SEQ ID NO: 2533480 - RNA, 13 nt, Human
aacuacuguguuc

SEQ ID NO: 2533481 - RNA, 14 nt, Human
aacuacuguguucc

SEQ ID NO: 2533482 - RNA, 23 nt, Human
guaacagaaagggcaacaauaaa

SEQ ID NO: 2533483 - RNA, 22 nt, Human
guaacagaaagggcaacaauaa

SEQ ID NO: 2533484 - RNA, 21 nt, Human
guaacagaaagggcaacaaua

SEQ ID NO: 2533485 - RNA, 16 nt, Human
guaacagaaagggcaa

SEQ ID NO: 2533486 - RNA, 15 nt, Human
guaacagaaagggca

SEQ ID NO: 2533487 - RNA, 12 nt, Human
guaacagaaagg

SEQ ID NO: 2533488 - RNA, 11 nt, Human
guaacagaaag

SEQ ID NO: 2533489 - RNA, 17 nt, Human
guaacacuuuacaaugu

SEQ ID NO: 2533490 - RNA, 16 nt, Human
guaacacuuuacaaug

SEQ ID NO: 2533491 - RNA, 19 nt, Human
guaacaauuuuaaugcuau

SEQ ID NO: 2533492 - RNA, 19 nt, Human
guaaauuuccccaacagug

SEQ ID NO: 2533493 - RNA, 18 nt, Human
guaaauuuccccaacagu

SEQ ID NO: 2533494 - RNA, 19 nt, Human
guaaauuuagcauaucaau

SEQ ID NO: 2533495 - RNA, 20 nt, Human
guaacacaagccacagaagc

SEQ ID NO: 2533496 - RNA, 19 nt, Human
guaacacaagccacagaag

SEQ ID NO: 2533497 - RNA, 17 nt, Human
guaacacaagccacaga

SEQ ID NO: 2533498 - RNA, 23 nt, Human
guaacacagugccuucaauaaau

SEQ ID NO: 2533499 - RNA, 22 nt, Human
guaacacagugccuucaauaaa

SEQ ID NO: 2533500 - RNA, 22 nt, Human
guaacacagcugagagacuuuu

SEQ ID NO: 2533501 - RNA, 19 nt, Human
aaaugggggugcauuugag

SEQ ID NO: 2533502 - RNA, 17 nt, Human
guaacaguucauguuug

SEQ ID NO: 2533503 - RNA, 18 nt, Human
guaacagucugaucguga

SEQ ID NO: 2533504 - RNA, 20 nt, Human
guaacaggucuccucuuaaa

SEQ ID NO: 2533505 - RNA, 21 nt, Human
guaacaggucuccucuuaaaa

SEQ ID NO: 2533506 - RNA, 14 nt, Human
guaacagaacagcu

SEQ ID NO: 2533507 - RNA, 14 nt, Human
guaacaggucuccu

SEQ ID NO: 2533508 - RNA, 16 nt, Human
guaacaggucuccucu

SEQ ID NO: 2533509 - RNA, 12 nt, Human
guaacaggcaga

SEQ ID NO: 2533510 - RNA, 22 nt, Human
guaacaggaaaauuuuaaaaau

SEQ ID NO: 2533511 - RNA, 19 nt, Human
aaaugguaggcauuuccua

SEQ ID NO: 2533512 - RNA, 14 nt, Human
aaaugguccaggag

SEQ ID NO: 2533513 - RNA, 16 nt, Human
aaauggucgcccagga

SEQ ID NO: 2533514 - RNA, 17 nt, Human
aaauggucgcccaggag

SEQ ID NO: 2533515 - RNA, 22 nt, Human
aaauggguuggugcuucuaacc

SEQ ID NO: 2533516 - RNA, 20 nt, Human
guaacaguucauguuugcuu

SEQ ID NO: 2533517 - RNA, 18 nt, Human
guaacaguucauguuugc

SEQ ID NO: 2533518 - RNA, 20 nt, Human
aaauggguuggugcuucuaa

SEQ ID NO: 2533519 - RNA, 19 nt, Human
aaauggguagagaaacacu

SEQ ID NO: 2533520 - RNA, 13 nt, Human
aaaugguuaaaag

SEQ ID NO: 2533521 - RNA, 19 nt, Human
aaaugguuaaaagagguuu

SEQ ID NO: 2533522 - RNA, 16 nt, Human
aaaugguguacauaau

SEQ ID NO: 2533523 - RNA, 13 nt, Human
aaaugguuguauu

SEQ ID NO: 2533524 - RNA, 11 nt, Human
aaaugguuaaa

SEQ ID NO: 2533525 - RNA, 14 nt, Human
aaaugguguuuuuu

SEQ ID NO: 2533526 - RNA, 14 nt, Human
aaaugguguacaua

SEQ ID NO: 2533527 - RNA, 20 nt, Human
aaaugguguacauaauguau

SEQ ID NO: 2533528 - RNA, 14 nt, Human
aaauggugccuuca

SEQ ID NO: 2533529 - RNA, 18 nt, Human
aaauggucgcccaggaga

SEQ ID NO: 2533530 - RNA, 11 nt, Human
aaauggugccu

SEQ ID NO: 2533531 - RNA, 23 nt, Human
aaauggugaaaauaaaauaaagc

SEQ ID NO: 2533532 - RNA, 18 nt, Human
guaguugcaauagaacag

SEQ ID NO: 2533533 - RNA, 15 nt, Human
guaguuaggaaauaa

SEQ ID NO: 2533534 - RNA, 16 nt, Human
guaguuaggaaauaaa

SEQ ID NO: 2533535 - RNA, 20 nt, Human
guaguuaggaaauaaaaccu

SEQ ID NO: 2533536 - RNA, 22 nt, Human
guaguuaggaaauaaaaccuuu

SEQ ID NO: 2533537 - RNA, 20 nt, Human
guaguguuggagaagaacug

SEQ ID NO: 2533538 - RNA, 11 nt, Human
guaguuaggaa

SEQ ID NO: 2533539 - RNA, 13 nt, Human
guaguuaggaaau

SEQ ID NO: 2533540 - RNA, 14 nt, Human
guaguuaggaaaua

SEQ ID NO: 2533541 - RNA, 19 nt, Human
guauaaaacuuuccucgcc

SEQ ID NO: 2533542 - RNA, 18 nt, Human
guauaaaacuuuccucgc

SEQ ID NO: 2533543 - RNA, 16 nt, Human
guauaaaacuuuccuc

SEQ ID NO: 2533544 - RNA, 15 nt, Human
guauaaaacuuuccu

SEQ ID NO: 2533545 - RNA, 19 nt, Human
guauaaaagggacugagaa

SEQ ID NO: 2533546 - RNA, 12 nt, Human
guauaaaaacaa

SEQ ID NO: 2533547 - RNA, 15 nt, Human
guauaaaaaaaauag

SEQ ID NO: 2533548 - RNA, 16 nt, Human
guaguugucuuuccug

SEQ ID NO: 2533549 - RNA, 12 nt, Human
guaguugucuuu

SEQ ID NO: 2533550 - RNA, 21 nt, Human
guaguuuuaucacauguaugu

SEQ ID NO: 2533551 - RNA, 17 nt, Human
guaguuuuucuucaaca

SEQ ID NO: 2533552 - RNA, 19 nt, Human
aaaugguuguauuagaugu

SEQ ID NO: 2533553 - RNA, 17 nt, Human
aaaugguuguauuagau

SEQ ID NO: 2533554 - RNA, 16 nt, Human
aaaugguuguauuaga

SEQ ID NO: 2533555 - RNA, 14 nt, Human
aaaugguuguauua

SEQ ID NO: 2533556 - RNA, 22 nt, Human
aaaugguuguauuagauguucu

SEQ ID NO: 2533557 - RNA, 20 nt, Human
aaaugguuguauuagauguu

SEQ ID NO: 2533558 - RNA, 17 nt, Human
aaauguaacagucugau

SEQ ID NO: 2533559 - RNA, 16 nt, Human
aaauguaacagucuga

SEQ ID NO: 2533560 - RNA, 13 nt, Human
aaauguaacaguc

SEQ ID NO: 2533561 - RNA, 17 nt, Human
aaauguaaauauucuau

SEQ ID NO: 2533562 - RNA, 22 nt, Human
aaauguaaagauauuuuuaucu

SEQ ID NO: 2533563 - RNA, 15 nt, Human
aaauguaaauauucu

SEQ ID NO: 2533564 - RNA, 17 nt, Human
aaauguaacuuuuguaa

SEQ ID NO: 2533565 - RNA, 16 nt, Human
aaauguaagggaaacu

SEQ ID NO: 2533566 - RNA, 17 nt, Human
guaguguuggagaagaa

SEQ ID NO: 2533567 - RNA, 18 nt, Human
aaauguaacuuuuguaag

SEQ ID NO: 2533568 - RNA, 22 nt, Human
aaauguaagaucguucucugcc

SEQ ID NO: 2533569 - RNA, 14 nt, Human
aaauguaagaucgu

SEQ ID NO: 2533570 - RNA, 15 nt, Human
guaucaaauaaaauu

SEQ ID NO: 2533571 - RNA, 21 nt, Human
guauauuuugggaaucuuuuc

SEQ ID NO: 2533572 - RNA, 18 nt, Human
guaucaggugcugccauc

SEQ ID NO: 2533573 - RNA, 16 nt, Human
guaucaggugcugcca

SEQ ID NO: 2533574 - RNA, 15 nt, Human
guauauuuguacaaa

SEQ ID NO: 2533575 - RNA, 13 nt, Human
guauauuuguaca

SEQ ID NO: 2533576 - RNA, 22 nt, Human
guauauuuauagucacaagagc

SEQ ID NO: 2533577 - RNA, 13 nt, Human
guauauuuauagu

SEQ ID NO: 2533578 - RNA, 17 nt, Human
guauauuuaaaagaaag

SEQ ID NO: 2533579 - RNA, 16 nt, Human
guauauuuuauaucaa

SEQ ID NO: 2533580 - RNA, 14 nt, Human
guauauuuguacaa

SEQ ID NO: 2533581 - RNA, 20 nt, Human
guauauuugugauagcacuu

SEQ ID NO: 2533582 - RNA, 21 nt, Human
guauauuugugauagcacuuu

SEQ ID NO: 2533583 - RNA, 23 nt, Human
guauauuugugauagcacuuucu

SEQ ID NO: 2533584 - RNA, 21 nt, Human
guauaaaauaauuuuuauauu

SEQ ID NO: 2533585 - RNA, 15 nt, Human
guauaaaauaauuuu

SEQ ID NO: 2533586 - RNA, 18 nt, Human
guauaaguaagaaaauau

SEQ ID NO: 2533587 - RNA, 21 nt, Human
guauaaaacuuuccucgccug

SEQ ID NO: 2533588 - RNA, 18 nt, Human
guauaaaagggacugaga

SEQ ID NO: 2533589 - RNA, 15 nt, Human
guauaaguggugugu

SEQ ID NO: 2533590 - RNA, 19 nt, Human
guauaaguggaggcacuuu

SEQ ID NO: 2533591 - RNA, 20 nt, Human
guauaaguggaggcacuuua

SEQ ID NO: 2533592 - RNA, 23 nt, Human
guauaaguccuugcaagaaucag

SEQ ID NO: 2533593 - RNA, 19 nt, Human
guauauuguguuuguguau

SEQ ID NO: 2533594 - RNA, 20 nt, Human
guauauuguguuuguguauu

SEQ ID NO: 2533595 - RNA, 13 nt, Human
guauauuguguuu

SEQ ID NO: 2533596 - RNA, 17 nt, Human
guauaaguaagaaaaua

SEQ ID NO: 2533597 - RNA, 23 nt, Human
guauaaugguugacuggguuucu

SEQ ID NO: 2533598 - RNA, 21 nt, Human
guauaaguggaggcacuuuag

SEQ ID NO: 2533599 - RNA, 19 nt, Human
guauaaugguugacugggu

SEQ ID NO: 2533600 - RNA, 21 nt, Human
guauaaugguugacuggguuu

SEQ ID NO: 2533601 - RNA, 15 nt, Human
guauaauauuuuuaa

SEQ ID NO: 2533602 - RNA, 12 nt, Human
guauaauauuuu

SEQ ID NO: 2533603 - RNA, 21 nt, Human
guaugcuucauacagggaugg

SEQ ID NO: 2533604 - RNA, 14 nt, Human
guaugguggcuggg

SEQ ID NO: 2533605 - RNA, 16 nt, Human
guaugguggcuggguu

SEQ ID NO: 2533606 - RNA, 15 nt, Human
guaugguggcugggu

SEQ ID NO: 2533607 - RNA, 12 nt, Human
guaugcuucaua

SEQ ID NO: 2533608 - RNA, 13 nt, Human
guaugcuucauac

SEQ ID NO: 2533609 - RNA, 14 nt, Human
guaugcuucauaca

SEQ ID NO: 2533610 - RNA, 15 nt, Human
guaugcuucauacag

SEQ ID NO: 2533611 - RNA, 15 nt, Human
guaugcgugugugug

SEQ ID NO: 2533612 - RNA, 17 nt, Human
guaugcaugugaagaaa

SEQ ID NO: 2533613 - RNA, 16 nt, Human
guaugcaugugaagaa

SEQ ID NO: 2533614 - RNA, 18 nt, Human
guaugcaugugaagaaag

SEQ ID NO: 2533615 - RNA, 21 nt, Human
guaucccaugagccucagcau

SEQ ID NO: 2533616 - RNA, 19 nt, Human
guaucccaugagccucagc

SEQ ID NO: 2533617 - RNA, 17 nt, Human
guauccauuaucaugug

SEQ ID NO: 2533618 - RNA, 16 nt, Human
guauccauuaucaugu

SEQ ID NO: 2533619 - RNA, 18 nt, Human
guauccaugggggcaggg

SEQ ID NO: 2533620 - RNA, 20 nt, Human
guauccaugggggcagggca

SEQ ID NO: 2533621 - RNA, 19 nt, Human
guauccauuaucaugugua

SEQ ID NO: 2533622 - RNA, 18 nt, Human
guauccauuaucaugugu

SEQ ID NO: 2533623 - RNA, 21 nt, Human
guauccauuaucauguguaau

SEQ ID NO: 2533624 - RNA, 19 nt, Human
guaucccaacuccuauaau

SEQ ID NO: 2533625 - RNA, 16 nt, Human
guauccaugggggcag

SEQ ID NO: 2533626 - RNA, 14 nt, Human
guauccacuuugca

SEQ ID NO: 2533627 - RNA, 19 nt, Human
guauccacuuugcacagcu

SEQ ID NO: 2533628 - RNA, 18 nt, Human
guaucaugcccugugcaa

SEQ ID NO: 2533629 - RNA, 22 nt, Human
guaucauuguuguuugauuucu

SEQ ID NO: 2533630 - RNA, 11 nt, Human
guaucaugcau

SEQ ID NO: 2533631 - RNA, 24 nt, Human
guaucaucuggauaggagccugcu

SEQ ID NO: 2533632 - RNA, 17 nt, Human
guaucaugcccugugca

SEQ ID NO: 2533633 - RNA, 14 nt, Human
guaucaucuggaua

SEQ ID NO: 2533634 - RNA, 14 nt, Human
guaucaugaagccu

SEQ ID NO: 2533635 - RNA, 17 nt, Human
guaucaguugcaauaau

SEQ ID NO: 2533636 - RNA, 15 nt, Human
guaucaggucuccca

SEQ ID NO: 2533637 - RNA, 12 nt, Human
guaucauagaaa

SEQ ID NO: 2533638 - RNA, 15 nt, Human
guaucauagaaaugu

SEQ ID NO: 2533639 - RNA, 22 nt, Human
guaucaggugcugccauccagg

SEQ ID NO: 2533640 - RNA, 17 nt, Human
guaucaggacgagaaug

SEQ ID NO: 2533641 - RNA, 18 nt, Human
guaucaggccugccagac

SEQ ID NO: 2533642 - RNA, 22 nt, Human
guaucaggccugccagacggca

SEQ ID NO: 2533643 - RNA, 16 nt, Human
gucaaacaugaagugu

SEQ ID NO: 2533644 - RNA, 15 nt, Human
gucaaacaugaagug

SEQ ID NO: 2533645 - RNA, 16 nt, Human
gucaaacaaagccaga

SEQ ID NO: 2533646 - RNA, 17 nt, Human
gucaaacaaagccagaa

SEQ ID NO: 2533647 - RNA, 21 nt, Human
gucaaaccgcacucacccaug

SEQ ID NO: 2533648 - RNA, 13 nt, Human
gucaaaccgcacu

SEQ ID NO: 2533649 - RNA, 16 nt, Human
gucaaaccauaaacuu

SEQ ID NO: 2533650 - RNA, 14 nt, Human
gucaaacgugaaaa

SEQ ID NO: 2533651 - RNA, 17 nt, Human
gucaaacgugaaaaugc

SEQ ID NO: 2533652 - RNA, 15 nt, Human
gucaaacgugaaaau

SEQ ID NO: 2533653 - RNA, 12 nt, Human
gucaaagaaaug

SEQ ID NO: 2533654 - RNA, 22 nt, Human
gucaaaccgcacucacccaugu

SEQ ID NO: 2533655 - RNA, 16 nt, Human
gucaaacuguagaaau

SEQ ID NO: 2533656 - RNA, 20 nt, Human
gucaaacuguagaaaugaug

SEQ ID NO: 2533657 - RNA, 17 nt, Human
gucaacacuaacaugau

SEQ ID NO: 2533658 - RNA, 21 nt, Human
gucaacaaguaugaauaaaga

SEQ ID NO: 2533659 - RNA, 22 nt, Human
gucaacacuuaaggguuuuaga

SEQ ID NO: 2533660 - RNA, 16 nt, Human
gucaaagaaaugcuga

SEQ ID NO: 2533661 - RNA, 23 nt, Human
gucaaagcaggggaguaugcaaa

SEQ ID NO: 2533662 - RNA, 18 nt, Human
gucaacaaacuauuucuu

SEQ ID NO: 2533663 - RNA, 11 nt, Human
gucaaagaagg

SEQ ID NO: 2533664 - RNA, 13 nt, Human
gucaaaguaaaac

SEQ ID NO: 2533665 - RNA, 16 nt, Human
gucaaauugugugaaa

SEQ ID NO: 2533666 - RNA, 14 nt, Human
guauuuuuaauggg

SEQ ID NO: 2533667 - RNA, 20 nt, Human
aaauuuauuuccuaguucug

SEQ ID NO: 2533668 - RNA, 21 nt, Human
guauuuuucaauaaagcauuu

SEQ ID NO: 2533669 - RNA, 22 nt, Human
guauuuuuaauggggguagcag

SEQ ID NO: 2533670 - RNA, 18 nt, Human
guauuuuuaaugggggua

SEQ ID NO: 2533671 - RNA, 13 nt, Human
aaauuuauuuccu

SEQ ID NO: 2533672 - RNA, 21 nt, Human
aaauuuauuuacugcuagucu

SEQ ID NO: 2533673 - RNA, 22 nt, Human
guauuuuguuuuugucuuaaaa

SEQ ID NO: 2533674 - RNA, 18 nt, Human
guauuuuucaauaaagca

SEQ ID NO: 2533675 - RNA, 15 nt, Human
gucaaaaggugccug

SEQ ID NO: 2533676 - RNA, 16 nt, Human
gucaaaaggugccugu

SEQ ID NO: 2533677 - RNA, 16 nt, Human
gucaaaacucaaaugc

SEQ ID NO: 2533678 - RNA, 15 nt, Human
gucaaaagcuggauu

SEQ ID NO: 2533679 - RNA, 14 nt, Human
gucaaaaggugccu

SEQ ID NO: 2533680 - RNA, 15 nt, Human
gucaaacaaagccag

SEQ ID NO: 2533681 - RNA, 20 nt, Human
gucaaacaaacucucugaac

SEQ ID NO: 2533682 - RNA, 20 nt, Human
aaauuguaagcaugcacaaa

SEQ ID NO: 2533683 - RNA, 18 nt, Human
aaauucugucucuggauu

SEQ ID NO: 2533684 - RNA, 19 nt, Human
aaauuguaagcaugcacaa

SEQ ID NO: 2533685 - RNA, 16 nt, Human
aaauucugucucugga

SEQ ID NO: 2533686 - RNA, 21 nt, Human
aaauuauuuguguaauagaaa

SEQ ID NO: 2533687 - RNA, 16 nt, Human
aaauuauuuguguaau

SEQ ID NO: 2533688 - RNA, 13 nt, Human
aaauuauuugugu

SEQ ID NO: 2533689 - RNA, 15 nt, Human
aaauuauuuauuauu

SEQ ID NO: 2533690 - RNA, 13 nt, Human
aaauuauuugaaa

SEQ ID NO: 2533691 - RNA, 13 nt, Human
aaauuauuugcau

SEQ ID NO: 2533692 - RNA, 13 nt, Human
aaauuauuucaga

SEQ ID NO: 2533693 - RNA, 15 nt, Human
aaauuguacauauuu

SEQ ID NO: 2533694 - RNA, 15 nt, Human
aaauuguauauucac

SEQ ID NO: 2533695 - RNA, 22 nt, Human
aaauuguacauauuuguggaau

SEQ ID NO: 2533696 - RNA, 14 nt, Human
aaauuguauauuca

SEQ ID NO: 2533697 - RNA, 12 nt, Human
aaauuguacaua

SEQ ID NO: 2533698 - RNA, 12 nt, Human
aaauugugaugu

SEQ ID NO: 2533699 - RNA, 15 nt, Human
aaauugugauguguc

SEQ ID NO: 2533700 - RNA, 19 nt, Human
aaauugugggucuauuucu

SEQ ID NO: 2533701 - RNA, 14 nt, Human
aaauuuauuuacug

SEQ ID NO: 2533702 - RNA, 19 nt, Human
aaauuuauuuacugcuagu

SEQ ID NO: 2533703 - RNA, 15 nt, Human
aaauuuaugugaugg

SEQ ID NO: 2533704 - RNA, 22 nt, Human
aaauuguuuccaagauagagag

SEQ ID NO: 2533705 - RNA, 21 nt, Human
aaauuguuucaaaauaaaaac

SEQ ID NO: 2533706 - RNA, 12 nt, Human
aaauuuauguga

SEQ ID NO: 2533707 - RNA, 22 nt, Human
aaauuguuuaaguguuguaaau

SEQ ID NO: 2533708 - RNA, 13 nt, Human
aaaugugaugaau

SEQ ID NO: 2533709 - RNA, 22 nt, Human
aaaugucuuuuuuuuaaugugc

SEQ ID NO: 2533710 - RNA, 20 nt, Human
aaaugucuuuuuuuuaaugu

SEQ ID NO: 2533711 - RNA, 19 nt, Human
aaaugugaaugggaaaaga

SEQ ID NO: 2533712 - RNA, 21 nt, Human
aaaugugaauaaaauuauuuu

SEQ ID NO: 2533713 - RNA, 22 nt, Human
aaaugucuaauguauuuuauug

SEQ ID NO: 2533714 - RNA, 20 nt, Human
aaaugucuaauguauuuuau

SEQ ID NO: 2533715 - RNA, 19 nt, Human
aaaugucuaauguauuuua

SEQ ID NO: 2533716 - RNA, 18 nt, Human
aaaugucuaauguauuuu

SEQ ID NO: 2533717 - RNA, 24 nt, Human
aaaugucuaguuguaacaccauga

SEQ ID NO: 2533718 - RNA, 13 nt, Human
aaaugucuugugu

SEQ ID NO: 2533719 - RNA, 22 nt, Human
aaaugucuuuccuuuugcucuu

SEQ ID NO: 2533720 - RNA, 20 nt, Human
aaaugucagauacaauguau

SEQ ID NO: 2533721 - RNA, 15 nt, Human
aaaugucagauacaa

SEQ ID NO: 2533722 - RNA, 22 nt, Human
aaaugucagauacaauguauuu

SEQ ID NO: 2533723 - RNA, 22 nt, Human
aaaugucaguggaagaagcaga

SEQ ID NO: 2533724 - RNA, 16 nt, Human
aaaugucuaauguauu

SEQ ID NO: 2533725 - RNA, 11 nt, Human
aaaugucuaau

SEQ ID NO: 2533726 - RNA, 22 nt, Human
aaauguccuccagaagccucug

SEQ ID NO: 2533727 - RNA, 19 nt, Human
aaaugucuaguuguaacac

SEQ ID NO: 2533728 - RNA, 18 nt, Human
guauguacuucaugcugu

SEQ ID NO: 2533729 - RNA, 11 nt, Human
guauguauaau

SEQ ID NO: 2533730 - RNA, 15 nt, Human
guauguauaauucaa

SEQ ID NO: 2533731 - RNA, 13 nt, Human
guauguaaaugug

SEQ ID NO: 2533732 - RNA, 15 nt, Human
guauguaaauguaua

SEQ ID NO: 2533733 - RNA, 12 nt, Human
guauguaaaugu

SEQ ID NO: 2533734 - RNA, 11 nt, Human
guauguaaaug

SEQ ID NO: 2533735 - RNA, 15 nt, Human
guauguaaaugugca

SEQ ID NO: 2533736 - RNA, 14 nt, Human
guauguaaaugugc

SEQ ID NO: 2533737 - RNA, 15 nt, Human
guaugguugacacua

SEQ ID NO: 2533738 - RNA, 22 nt, Human
guaugccuuuaaaucugugaug

SEQ ID NO: 2533739 - RNA, 16 nt, Human
guaugcuuauuuuaaa

SEQ ID NO: 2533740 - RNA, 14 nt, Human
guauguaaacagga

SEQ ID NO: 2533741 - RNA, 17 nt, Human
guaugucauuuccuuca

SEQ ID NO: 2533742 - RNA, 14 nt, Human
guaugucauuuccu

SEQ ID NO: 2533743 - RNA, 18 nt, Human
aaauguaugauuacauca

SEQ ID NO: 2533744 - RNA, 12 nt, Human
aaauguguacau

SEQ ID NO: 2533745 - RNA, 12 nt, Human
aaaugugugugu

SEQ ID NO: 2533746 - RNA, 16 nt, Human
aaauguguuuaaaaca

SEQ ID NO: 2533747 - RNA, 21 nt, Human
aaaugugaugaauacuguauu

SEQ ID NO: 2533748 - RNA, 13 nt, Human
aaaugugauuuuu

SEQ ID NO: 2533749 - RNA, 10 nt, Human
aaauguguaa

SEQ ID NO: 2533750 - RNA, 20 nt, Human
aaauguguaucggaugcuuu

SEQ ID NO: 2533751 - RNA, 13 nt, Human
aaauguguauuuu

SEQ ID NO: 2533752 - RNA, 14 nt, Human
aaauuaagaaagga

SEQ ID NO: 2533753 - RNA, 13 nt, Human
aaauguguuucug

SEQ ID NO: 2533754 - RNA, 14 nt, Human
aaauguguuucugu

SEQ ID NO: 2533755 - RNA, 13 nt, Human
aaauuaagaagaa

SEQ ID NO: 2533756 - RNA, 14 nt, Human
aaauuaagaagaaa

SEQ ID NO: 2533757 - RNA, 15 nt, Human
aaauuaagaagaaac

SEQ ID NO: 2533758 - RNA, 16 nt, Human
aaauuaagaagaaacu

SEQ ID NO: 2533759 - RNA, 14 nt, Human
aaauuaagaaggca

SEQ ID NO: 2533760 - RNA, 15 nt, Human
aaauuaagaaggcaa

SEQ ID NO: 2533761 - RNA, 12 nt, Human
aaauuaagacau

SEQ ID NO: 2533762 - RNA, 19 nt, Human
aaauuauaacuuaaaauau

SEQ ID NO: 2533763 - RNA, 22 nt, Human
aaauuauaacuuaaaauauuuu

SEQ ID NO: 2533764 - RNA, 17 nt, Human
aaauuauagaugggaau

SEQ ID NO: 2533765 - RNA, 24 nt, Human
aaauuauguuuauauaaaugcuuu

SEQ ID NO: 2533766 - RNA, 15 nt, Human
aaauuauuuaauaaa

SEQ ID NO: 2533767 - RNA, 23 nt, Human
aaauuauuaguuuacaucauuuu

SEQ ID NO: 2533768 - RNA, 14 nt, Human
aaauuauuaaugaa

SEQ ID NO: 2533769 - RNA, 19 nt, Human
aaauuauuaguuuacauca

SEQ ID NO: 2533770 - RNA, 18 nt, Human
aaauuagguauuuugucc

SEQ ID NO: 2533771 - RNA, 13 nt, Human
aaauuaauaaucu

SEQ ID NO: 2533772 - RNA, 17 nt, Human
aaauuaaggguuaagaa

SEQ ID NO: 2533773 - RNA, 17 nt, Human
aaauuagguuuuguaca

SEQ ID NO: 2533774 - RNA, 19 nt, Human
aaauuagguuuuguacaau

SEQ ID NO: 2533775 - RNA, 23 nt, Human
aaauuagguuuuguacaauugaa

SEQ ID NO: 2533776 - RNA, 21 nt, Human
aaauuaguuagccaauauuuu

SEQ ID NO: 2533777 - RNA, 16 nt, Human
aaauuauaacuuaaaa

SEQ ID NO: 2533778 - RNA, 17 nt, Human
aaauuauaacuuaaaau

SEQ ID NO: 2533779 - RNA, 16 nt, Human
gucaguaucaggccug

SEQ ID NO: 2533780 - RNA, 23 nt, Human
gucaguaucaggccugccagacg

SEQ ID NO: 2533781 - RNA, 22 nt, Human
gucaguaccuucaaacuagggc

SEQ ID NO: 2533782 - RNA, 16 nt, Human
gucaguaccuucaaac

SEQ ID NO: 2533783 - RNA, 20 nt, Human
gucaggcugcuggcgccucu

SEQ ID NO: 2533784 - RNA, 17 nt, Human
gucaggcugcuggcgcc

SEQ ID NO: 2533785 - RNA, 22 nt, Human
gucaggcugcuggcgccucugc

SEQ ID NO: 2533786 - RNA, 13 nt, Human
gucagggaccaag

SEQ ID NO: 2533787 - RNA, 14 nt, Human
gucagggaccaagg

SEQ ID NO: 2533788 - RNA, 16 nt, Human
gucagggaccaaggac

SEQ ID NO: 2533789 - RNA, 21 nt, Human
gucagggaccaaggaccccuc

SEQ ID NO: 2533790 - RNA, 14 nt, Human
gucagggaccccug

SEQ ID NO: 2533791 - RNA, 16 nt, Human
gucaguauuguuuugg

SEQ ID NO: 2533792 - RNA, 14 nt, Human
gucaguauuguuuu

SEQ ID NO: 2533793 - RNA, 13 nt, Human
gucagucacagcc

SEQ ID NO: 2533794 - RNA, 21 nt, Human
gucaguauguggaaguguggg

SEQ ID NO: 2533795 - RNA, 17 nt, Human
gucaguauguggaagug

SEQ ID NO: 2533796 - RNA, 21 nt, Human
gucaguaucuguaucucucuc

SEQ ID NO: 2533797 - RNA, 20 nt, Human
gucaguaucuguaucucucu

SEQ ID NO: 2533798 - RNA, 14 nt, Human
gucaguaugacauu

SEQ ID NO: 2533799 - RNA, 14 nt, Human
gucagucacagcca

SEQ ID NO: 2533800 - RNA, 16 nt, Human
gucagucacagccacc

SEQ ID NO: 2533801 - RNA, 15 nt, Human
gucagugugacugau

SEQ ID NO: 2533802 - RNA, 13 nt, Human
gucaguuguauca

SEQ ID NO: 2533803 - RNA, 19 nt, Human
gucagucaugauggcacca

SEQ ID NO: 2533804 - RNA, 18 nt, Human
gucauaacuaaauaaagc

SEQ ID NO: 2533805 - RNA, 14 nt, Human
aaauuugauugauu

SEQ ID NO: 2533806 - RNA, 13 nt, Human
aaauuuguugcau

SEQ ID NO: 2533807 - RNA, 18 nt, Human
aaauuuguugaaauuaug

SEQ ID NO: 2533808 - RNA, 14 nt, Human
aaauuuguugcaua

SEQ ID NO: 2533809 - RNA, 22 nt, Human
aaauuuguuuugacggaugauu

SEQ ID NO: 2533810 - RNA, 18 nt, Human
aaauuuguuugaaaucuu

SEQ ID NO: 2533811 - RNA, 14 nt, Human
aaauuuguuugaaa

SEQ ID NO: 2533812 - RNA, 22 nt, Human
aaauuuuaauauggguucuuuu

SEQ ID NO: 2533813 - RNA, 23 nt, Human
aaauuugucuugccuuauuaaag

SEQ ID NO: 2533814 - RNA, 19 nt, Human
aaauuuguuauuuugcaac

SEQ ID NO: 2533815 - RNA, 18 nt, Human
aaauuuguuauaaugaau

SEQ ID NO: 2533816 - RNA, 20 nt, Human
aaauuuguaaguuucaggug

SEQ ID NO: 2533817 - RNA, 19 nt, Human
aaauuuguaaguuucaggu

SEQ ID NO: 2533818 - RNA, 17 nt, Human
aaauuuguaaguuucag

SEQ ID NO: 2533819 - RNA, 16 nt, Human
aaauuuguaaguuuca

SEQ ID NO: 2533820 - RNA, 15 nt, Human
aaauuuguaaguuuc

SEQ ID NO: 2533821 - RNA, 14 nt, Human
aaauuuguaaguuu

SEQ ID NO: 2533822 - RNA, 13 nt, Human
aaauuuguaaguu

SEQ ID NO: 2533823 - RNA, 12 nt, Human
aaauuuguaagu

SEQ ID NO: 2533824 - RNA, 22 nt, Human
aaauuuguaaguuucaggugac

SEQ ID NO: 2533825 - RNA, 15 nt, Human
aaauuugauugauuu

SEQ ID NO: 2533826 - RNA, 17 nt, Human
aaauuugauugauuuga

SEQ ID NO: 2533827 - RNA, 14 nt, Human
aaauuugauuucua

SEQ ID NO: 2533828 - RNA, 16 nt, Human
aaauuugguucuaaua

SEQ ID NO: 2533829 - RNA, 15 nt, Human
aaauuugguucuaau

SEQ ID NO: 2533830 - RNA, 19 nt, Human
gucaggcguagaucaccag

SEQ ID NO: 2533831 - RNA, 23 nt, Human
gucaggccugugugugaaaggaa

SEQ ID NO: 2533832 - RNA, 15 nt, Human
gucaggccugugugu

SEQ ID NO: 2533833 - RNA, 13 nt, Human
gucaggccugugu

SEQ ID NO: 2533834 - RNA, 12 nt, Human
gucaggcuccau

SEQ ID NO: 2533835 - RNA, 17 nt, Human
gucaggcuccauuagga

SEQ ID NO: 2533836 - RNA, 16 nt, Human
gucaggcugcuggcgc

SEQ ID NO: 2533837 - RNA, 15 nt, Human
gucaggcugcuggcg

SEQ ID NO: 2533838 - RNA, 14 nt, Human
gucaggcugcuggc

SEQ ID NO: 2533839 - RNA, 13 nt, Human
gucaggcugcugg

SEQ ID NO: 2533840 - RNA, 22 nt, Human
gucaggcccuuauuuucaagaa

SEQ ID NO: 2533841 - RNA, 21 nt, Human
gucaggcccuuauuuucaaga

SEQ ID NO: 2533842 - RNA, 18 nt, Human
gucaggccacggcagccu

SEQ ID NO: 2533843 - RNA, 16 nt, Human
gucaggccacggcagc

SEQ ID NO: 2533844 - RNA, 15 nt, Human
gucaggccacggcag

SEQ ID NO: 2533845 - RNA, 14 nt, Human
gucaggccacggca

SEQ ID NO: 2533846 - RNA, 13 nt, Human
gucaggcagggug

SEQ ID NO: 2533847 - RNA, 12 nt, Human
gucaggccacgg

SEQ ID NO: 2533848 - RNA, 20 nt, Human
gucagacauccauguuugua

SEQ ID NO: 2533849 - RNA, 18 nt, Human
gucagacauccauguuug

SEQ ID NO: 2533850 - RNA, 19 nt, Human
gucaggaguuagaggccag

SEQ ID NO: 2533851 - RNA, 13 nt, Human
gucaggaguuccu

SEQ ID NO: 2533852 - RNA, 22 nt, Human
gucaggaguuagaggccagccu

SEQ ID NO: 2533853 - RNA, 12 nt, Human
gucaggaugacg

SEQ ID NO: 2533854 - RNA, 23 nt, Human
gucaggaguuagaggccagccug

SEQ ID NO: 2533855 - RNA, 23 nt, Human
gucaggaguucgagaccagccug

SEQ ID NO: 2533856 - RNA, 13 nt, Human
gucagaauagaaa

SEQ ID NO: 2533857 - RNA, 16 nt, Human
gucacagccuccucug

SEQ ID NO: 2533858 - RNA, 14 nt, Human
gucacagccuccuc

SEQ ID NO: 2533859 - RNA, 12 nt, Human
gucacagccuca

SEQ ID NO: 2533860 - RNA, 23 nt, Human
gucagaaguuucugccgcagccc

SEQ ID NO: 2533861 - RNA, 17 nt, Human
gucagaauagaaauuag

SEQ ID NO: 2533862 - RNA, 23 nt, Human
gucacagccuccucugucugccc

SEQ ID NO: 2533863 - RNA, 21 nt, Human
gucacagccuccucugucugc

SEQ ID NO: 2533864 - RNA, 20 nt, Human
gucagaauaauaagaggugc

SEQ ID NO: 2533865 - RNA, 22 nt, Human
gucacacaguauuacuucugcu

SEQ ID NO: 2533866 - RNA, 13 nt, Human
gucacaccagcca

SEQ ID NO: 2533867 - RNA, 12 nt, Human
gucacagccacc

SEQ ID NO: 2533868 - RNA, 21 nt, Human
gucacacaguauuacuucugc

SEQ ID NO: 2533869 - RNA, 23 nt, Human
gucaacagagaaggcaggaaugu

SEQ ID NO: 2533870 - RNA, 19 nt, Human
gucaacagagaaggcagga

SEQ ID NO: 2533871 - RNA, 22 nt, Human
gucaacagagaaggcaggaaug

SEQ ID NO: 2533872 - RNA, 19 nt, Human
gucaacacuuaaggguuuu

SEQ ID NO: 2533873 - RNA, 18 nt, Human
gucaacagagaaggcagg

SEQ ID NO: 2533874 - RNA, 15 nt, Human
aaauuuuuuuagaaa

SEQ ID NO: 2533875 - RNA, 13 nt, Human
aaauuuuuuuaga

SEQ ID NO: 2533876 - RNA, 21 nt, Human
aaauuuuuuuagaaagcauuu

SEQ ID NO: 2533877 - RNA, 23 nt, Human
aacaagaccucagugccuuccug

SEQ ID NO: 2533878 - RNA, 22 nt, Human
aacaagaccucagugccuuccu

SEQ ID NO: 2533879 - RNA, 19 nt, Human
aacaagaccccgucucaaa

SEQ ID NO: 2533880 - RNA, 16 nt, Human
aacaaggcaaggcugu

SEQ ID NO: 2533881 - RNA, 15 nt, Human
aacaaggcaaggcug

SEQ ID NO: 2533882 - RNA, 20 nt, Human
aacaagauuuuaaagacaug

SEQ ID NO: 2533883 - RNA, 22 nt, Human
aacaagaugcuggaugucugcc

SEQ ID NO: 2533884 - RNA, 19 nt, Human
aacaagagcacuacauuca

SEQ ID NO: 2533885 - RNA, 17 nt, Human
aacaagaucuuucagga

SEQ ID NO: 2533886 - RNA, 19 nt, Human
aacaagagcgaaacuccgu

SEQ ID NO: 2533887 - RNA, 19 nt, Human
aacaagaucuuucaggaaa

SEQ ID NO: 2533888 - RNA, 20 nt, Human
aaauuuucuagacuuucugu

SEQ ID NO: 2533889 - RNA, 19 nt, Human
aaauuuucuagacuuucug

SEQ ID NO: 2533890 - RNA, 18 nt, Human
aaauuuucuagacuuucu

SEQ ID NO: 2533891 - RNA, 14 nt, Human
aaauuuucuagacu

SEQ ID NO: 2533892 - RNA, 18 nt, Human
aaauuuuauuuccuggac

SEQ ID NO: 2533893 - RNA, 18 nt, Human
aaauuuucacauaaaaua

SEQ ID NO: 2533894 - RNA, 21 nt, Human
aaauuuuauaaaauuaagcaa

SEQ ID NO: 2533895 - RNA, 14 nt, Human
aaauuuuaauuuau

SEQ ID NO: 2533896 - RNA, 12 nt, Human
aaauuuuauucc

SEQ ID NO: 2533897 - RNA, 13 nt, Human
aaauuuuauuccu

SEQ ID NO: 2533898 - RNA, 12 nt, Human
aaauuuuauaug

SEQ ID NO: 2533899 - RNA, 17 nt, Human
aaauuuuaucucuuauu

SEQ ID NO: 2533900 - RNA, 18 nt, Human
aaauuuugauguuuuaag

SEQ ID NO: 2533901 - RNA, 23 nt, Human
aaauuuugauguuuuaaggaugc

SEQ ID NO: 2533902 - RNA, 20 nt, Human
aaauuuuuucucuaggaaau

SEQ ID NO: 2533903 - RNA, 12 nt, Human
aaauuuuggcca

SEQ ID NO: 2533904 - RNA, 18 nt, Human
aaauuuuggccaaagugu

SEQ ID NO: 2533905 - RNA, 15 nt, Human
aacaaugcuguauuu

SEQ ID NO: 2533906 - RNA, 14 nt, Human
aacaaugcuguauu

SEQ ID NO: 2533907 - RNA, 12 nt, Human
aacaauaaaaga

SEQ ID NO: 2533908 - RNA, 21 nt, Human
aacaaggcaaggcugucaauu

SEQ ID NO: 2533909 - RNA, 18 nt, Human
aacaaggcaaggcuguca

SEQ ID NO: 2533910 - RNA, 19 nt, Human
aacaagucgaugaacuauu

SEQ ID NO: 2533911 - RNA, 19 nt, Human
aacaagcaagcucccaagg

SEQ ID NO: 2533912 - RNA, 15 nt, Human
aacaagugcuggcac

SEQ ID NO: 2533913 - RNA, 14 nt, Human
aacaagugcuggca

SEQ ID NO: 2533914 - RNA, 22 nt, Human
aacaaugcuguauuuuaaaaga

SEQ ID NO: 2533915 - RNA, 17 nt, Human
aacaaugcuguauuuua

SEQ ID NO: 2533916 - RNA, 17 nt, Human
aacaaguuuuucuguca

SEQ ID NO: 2533917 - RNA, 14 nt, Human
aacaauaaagagau

SEQ ID NO: 2533918 - RNA, 23 nt, Human
aacaauaaaauuuuuuuucaugu

SEQ ID NO: 2533919 - RNA, 16 nt, Human
aacaauggaaacugaa

SEQ ID NO: 2533920 - RNA, 18 nt, Human
aacaauggaaacugaaug

SEQ ID NO: 2533921 - RNA, 17 nt, Human
aacaauggaaacugaau

SEQ ID NO: 2533922 - RNA, 11 nt, Human
aacaauguuaa

SEQ ID NO: 2533923 - RNA, 12 nt, Human
aacaauguuaag

SEQ ID NO: 2533924 - RNA, 16 nt, Human
aacacaacuauauugu

SEQ ID NO: 2533925 - RNA, 15 nt, Human
aacacaacuauauug

SEQ ID NO: 2533926 - RNA, 22 nt, Human
aacaauguuaaggaaacucuua

SEQ ID NO: 2533927 - RNA, 21 nt, Human
aacaauguuaaggaaacucuu

SEQ ID NO: 2533928 - RNA, 18 nt, Human
aacaauguuaaggaaacu

SEQ ID NO: 2533929 - RNA, 13 nt, Human
aacaauguuaagg

SEQ ID NO: 2533930 - RNA, 16 nt, Human
gucccaccuuggcugc

SEQ ID NO: 2533931 - RNA, 15 nt, Human
gucccaccuuggcug

SEQ ID NO: 2533932 - RNA, 21 nt, Human
gucccaccucuucucuuccug

SEQ ID NO: 2533933 - RNA, 19 nt, Human
gucccaccucuucucuucc

SEQ ID NO: 2533934 - RNA, 14 nt, Human
gucccaccucuucu

SEQ ID NO: 2533935 - RNA, 13 nt, Human
gucccaccucuuc

SEQ ID NO: 2533936 - RNA, 12 nt, Human
gucccaccucuu

SEQ ID NO: 2533937 - RNA, 23 nt, Human
gucccacccccacccccagcuca

SEQ ID NO: 2533938 - RNA, 14 nt, Human
gucccaccuuggcu

SEQ ID NO: 2533939 - RNA, 20 nt, Human
gucccccaaccccagccgcu

SEQ ID NO: 2533940 - RNA, 17 nt, Human
gucccccaaccccagcc

SEQ ID NO: 2533941 - RNA, 19 nt, Human
guccccauggcacccugcu

SEQ ID NO: 2533942 - RNA, 13 nt, Human
gucccccagcucu

SEQ ID NO: 2533943 - RNA, 12 nt, Human
gucccccagcuc

SEQ ID NO: 2533944 - RNA, 22 nt, Human
gucccccauccccauccuccag

SEQ ID NO: 2533945 - RNA, 16 nt, Human
gucccccagcucuggu

SEQ ID NO: 2533946 - RNA, 15 nt, Human
gucccccagcucugg

SEQ ID NO: 2533947 - RNA, 14 nt, Human
gucccccagcucug

SEQ ID NO: 2533948 - RNA, 11 nt, Human
guccccccacc

SEQ ID NO: 2533949 - RNA, 12 nt, Human
guccccccaccc

SEQ ID NO: 2533950 - RNA, 23 nt, Human
gucccaccucuucucuuccugua

SEQ ID NO: 2533951 - RNA, 22 nt, Human
gucccaccucuucucuuccugu

SEQ ID NO: 2533952 - RNA, 19 nt, Human
guccccaggccccaggaag

SEQ ID NO: 2533953 - RNA, 21 nt, Human
guccccaggccccaggaagcc

SEQ ID NO: 2533954 - RNA, 20 nt, Human
guccccaggccccaggaagc

SEQ ID NO: 2533955 - RNA, 18 nt, Human
guccccaguuugcagaaa

SEQ ID NO: 2533956 - RNA, 20 nt, Human
guccccaucaucccagcugc

SEQ ID NO: 2533957 - RNA, 19 nt, Human
guccccaucaucccagcug

SEQ ID NO: 2533958 - RNA, 17 nt, Human
guccccaucaucccagc

SEQ ID NO: 2533959 - RNA, 15 nt, Human
guccccaucauccca

SEQ ID NO: 2533960 - RNA, 19 nt, Human
guccccaguuugcagaaaa

SEQ ID NO: 2533961 - RNA, 17 nt, Human
guccagugaccugcugg

SEQ ID NO: 2533962 - RNA, 12 nt, Human
guccagugccca

SEQ ID NO: 2533963 - RNA, 16 nt, Human
guccagucucuucugc

SEQ ID NO: 2533964 - RNA, 14 nt, Human
guccagugcccauu

SEQ ID NO: 2533965 - RNA, 13 nt, Human
guccagugcccau

SEQ ID NO: 2533966 - RNA, 19 nt, Human
guccaguucccagaaggca

SEQ ID NO: 2533967 - RNA, 14 nt, Human
guccaguucccaga

SEQ ID NO: 2533968 - RNA, 14 nt, Human
guccauagagagca

SEQ ID NO: 2533969 - RNA, 13 nt, Human
guccauagagagc

SEQ ID NO: 2533970 - RNA, 21 nt, Human
gucccaccccacacacgccag

SEQ ID NO: 2533971 - RNA, 19 nt, Human
gucccacccccacccccag

SEQ ID NO: 2533972 - RNA, 15 nt, Human
gucccacccccaccc

SEQ ID NO: 2533973 - RNA, 14 nt, Human
gucccacccccacc

SEQ ID NO: 2533974 - RNA, 22 nt, Human
gucccacccccacccccagcuc

SEQ ID NO: 2533975 - RNA, 21 nt, Human
gucccacccccacccccagcu

SEQ ID NO: 2533976 - RNA, 18 nt, Human
guccaagaagcccaggaa

SEQ ID NO: 2533977 - RNA, 17 nt, Human
guccaagaagcccagga

SEQ ID NO: 2533978 - RNA, 20 nt, Human
guccaagaagcccaggaaag

SEQ ID NO: 2533979 - RNA, 21 nt, Human
guccaacguggggcagcacag

SEQ ID NO: 2533980 - RNA, 20 nt, Human
guccaacguggggcagcaca

SEQ ID NO: 2533981 - RNA, 16 nt, Human
guccaagaagcccagg

SEQ ID NO: 2533982 - RNA, 15 nt, Human
guccaagaagcccag

SEQ ID NO: 2533983 - RNA, 13 nt, Human
guccaagaagccc

SEQ ID NO: 2533984 - RNA, 18 nt, Human
guccaacguggggcagca

SEQ ID NO: 2533985 - RNA, 23 nt, Human
aacacaccaggcugugggccuca

SEQ ID NO: 2533986 - RNA, 20 nt, Human
aacacaaaugcagggauugc

SEQ ID NO: 2533987 - RNA, 13 nt, Human
aacacaaaugcag

SEQ ID NO: 2533988 - RNA, 17 nt, Human
aacacaacuauauuguu

SEQ ID NO: 2533989 - RNA, 18 nt, Human
aacacacugaggcaggga

SEQ ID NO: 2533990 - RNA, 19 nt, Human
aacacacugaggcagggaa

SEQ ID NO: 2533991 - RNA, 20 nt, Human
aacacacugaggcagggaag

SEQ ID NO: 2533992 - RNA, 15 nt, Human
aacacagcaagggug

SEQ ID NO: 2533993 - RNA, 22 nt, Human
aacacagaaagccuaucaaaga

SEQ ID NO: 2533994 - RNA, 21 nt, Human
aacacacuguguccuggugcu

SEQ ID NO: 2533995 - RNA, 19 nt, Human
aacacagaaaccuuuuuaa

SEQ ID NO: 2533996 - RNA, 19 nt, Human
aacacacuguguccuggug

SEQ ID NO: 2533997 - RNA, 16 nt, Human
aacacacuguguccug

SEQ ID NO: 2533998 - RNA, 13 nt, Human
aacacacuguguc

SEQ ID NO: 2533999 - RNA, 21 nt, Human
aacacacugaggcagggaagu

SEQ ID NO: 2534000 - RNA, 19 nt, Human
gucauuuuuuuuaagaaaa

SEQ ID NO: 2534001 - RNA, 21 nt, Human
gucauuuuuuuuaagaaaaag

SEQ ID NO: 2534002 - RNA, 19 nt, Human
aacacagacauucugccag

SEQ ID NO: 2534003 - RNA, 20 nt, Human
aacacagacauucugccagg

SEQ ID NO: 2534004 - RNA, 12 nt, Human
aacagaaaugua

SEQ ID NO: 2534005 - RNA, 13 nt, Human
aacagaaauguac

SEQ ID NO: 2534006 - RNA, 14 nt, Human
aacagaaauguaca

SEQ ID NO: 2534007 - RNA, 15 nt, Human
aacagaaauguacag

SEQ ID NO: 2534008 - RNA, 12 nt, Human
guccuacucugu

SEQ ID NO: 2534009 - RNA, 14 nt, Human
guccuacccauccc

SEQ ID NO: 2534010 - RNA, 16 nt, Human
guccuacccauccccg

SEQ ID NO: 2534011 - RNA, 18 nt, Human
guccuacccauccccgca

SEQ ID NO: 2534012 - RNA, 15 nt, Human
gucccuuucuuggcc

SEQ ID NO: 2534013 - RNA, 15 nt, Human
guccuacccacccuc

SEQ ID NO: 2534014 - RNA, 16 nt, Human
guccuacccacccucc

SEQ ID NO: 2534015 - RNA, 18 nt, Human
gucccccuuccauggacu

SEQ ID NO: 2534016 - RNA, 16 nt, Human
gucccccuuccaugga

SEQ ID NO: 2534017 - RNA, 13 nt, Human
guccccccacccu

SEQ ID NO: 2534018 - RNA, 18 nt, Human
gucccccugacaacacuc

SEQ ID NO: 2534019 - RNA, 14 nt, Human
gucccccuuccaug

SEQ ID NO: 2534020 - RNA, 19 nt, Human
gucccuugccucaaugcca

SEQ ID NO: 2534021 - RNA, 14 nt, Human
gucccuugccucaa

SEQ ID NO: 2534022 - RNA, 13 nt, Human
gucccuugccuca

SEQ ID NO: 2534023 - RNA, 17 nt, Human
gucccuuguuuccagcu

SEQ ID NO: 2534024 - RNA, 20 nt, Human
gucccuuguuuccagcuaga

SEQ ID NO: 2534025 - RNA, 23 nt, Human
gucccuuucgacuugcauuuuug

SEQ ID NO: 2534026 - RNA, 21 nt, Human
gucccuugagaccucagccau

SEQ ID NO: 2534027 - RNA, 19 nt, Human
gucccuugagaccucagcc

SEQ ID NO: 2534028 - RNA, 20 nt, Human
gucccuugagaccucagcca

SEQ ID NO: 2534029 - RNA, 13 nt, Human
gucccuugcagcu

SEQ ID NO: 2534030 - RNA, 22 nt, Human
gucccccuggggcuucuccuga

SEQ ID NO: 2534031 - RNA, 16 nt, Human
gucccuugagaccuca

SEQ ID NO: 2534032 - RNA, 17 nt, Human
gucccuugagaccucag

SEQ ID NO: 2534033 - RNA, 18 nt, Human
gucccuugagaccucagc

SEQ ID NO: 2534034 - RNA, 22 nt, Human
gucccuugagaccucagccaug

SEQ ID NO: 2534035 - RNA, 16 nt, Human
aacagauaaauaguuu

SEQ ID NO: 2534036 - RNA, 13 nt, Human
aacagauaaucag

SEQ ID NO: 2534037 - RNA, 18 nt, Human
aacagauaagcaagagag

SEQ ID NO: 2534038 - RNA, 19 nt, Human
aacagauaagcaagagaga

SEQ ID NO: 2534039 - RNA, 22 nt, Human
aacagaucuggaaccucagccu

SEQ ID NO: 2534040 - RNA, 16 nt, Human
aacagaucaauuugua

SEQ ID NO: 2534041 - RNA, 21 nt, Human
aacagaucuggaaccucagcc

SEQ ID NO: 2534042 - RNA, 13 nt, Human
aacagaucuggaa

SEQ ID NO: 2534043 - RNA, 20 nt, Human
aacagauauaaauggcuggu

SEQ ID NO: 2534044 - RNA, 20 nt, Human
aacagauaguuguguuuuua

SEQ ID NO: 2534045 - RNA, 23 nt, Human
aacagauacuggaaguuuugcau

SEQ ID NO: 2534046 - RNA, 16 nt, Human
aacagaagcuuccauu

SEQ ID NO: 2534047 - RNA, 14 nt, Human
aacagaagcuucca

SEQ ID NO: 2534048 - RNA, 13 nt, Human
aacagaaggauga

SEQ ID NO: 2534049 - RNA, 14 nt, Human
aacagaauguuuua

SEQ ID NO: 2534050 - RNA, 13 nt, Human
aacagaagugguu

SEQ ID NO: 2534051 - RNA, 23 nt, Human
aacagaauacuguuaaaggaaaa

SEQ ID NO: 2534052 - RNA, 13 nt, Human
aacagaauuuuaa

SEQ ID NO: 2534053 - RNA, 18 nt, Human
aacagacaaaaacagccu

SEQ ID NO: 2534054 - RNA, 21 nt, Human
aacagacaaaaacagccucac

SEQ ID NO: 2534055 - RNA, 16 nt, Human
aacagacaacagaagu

SEQ ID NO: 2534056 - RNA, 18 nt, Human
aacagacaacagaaguca

SEQ ID NO: 2534057 - RNA, 15 nt, Human
aacagugauuaccag

SEQ ID NO: 2534058 - RNA, 22 nt, Human
aacagugauuaccagggacuga

SEQ ID NO: 2534059 - RNA, 15 nt, Human
aacagugcauauucc

SEQ ID NO: 2534060 - RNA, 18 nt, Human
aacagguaauauaaaaag

SEQ ID NO: 2534061 - RNA, 12 nt, Human
aacagugccugc

SEQ ID NO: 2534062 - RNA, 22 nt, Human
aacagugcauauuccuuucuau

SEQ ID NO: 2534063 - RNA, 13 nt, Human
aacagugccugcu

SEQ ID NO: 2534064 - RNA, 14 nt, Human
aacagugccugcug

SEQ ID NO: 2534065 - RNA, 19 nt, Human
aacaguguuucccauaauu

SEQ ID NO: 2534066 - RNA, 21 nt, Human
aacaguguuucccauaauuuu

SEQ ID NO: 2534067 - RNA, 15 nt, Human
aacagguaauauaaa

SEQ ID NO: 2534068 - RNA, 23 nt, Human
aacagggucucuagugcugugaa

SEQ ID NO: 2534069 - RNA, 20 nt, Human
aacagggucucuagugcugu

SEQ ID NO: 2534070 - RNA, 22 nt, Human
aacagggucucuagugcuguga

SEQ ID NO: 2534071 - RNA, 13 nt, Human
aacagggucucua

SEQ ID NO: 2534072 - RNA, 18 nt, Human
aacagggucucuagugcu

SEQ ID NO: 2534073 - RNA, 18 nt, Human
aacagggcaucuccagga

SEQ ID NO: 2534074 - RNA, 17 nt, Human
aacagggcaucuccagg

SEQ ID NO: 2534075 - RNA, 11 nt, Human
aacagggaggg

SEQ ID NO: 2534076 - RNA, 19 nt, Human
aaggcucuucuccccagag

SEQ ID NO: 2534077 - RNA, 17 nt, Human
aaggcucuucuccccag

SEQ ID NO: 2534078 - RNA, 23 nt, Human
aaggcucugagcaaauguggcuc

SEQ ID NO: 2534079 - RNA, 23 nt, Human
aaggcucgauuuuguaucugcag

SEQ ID NO: 2534080 - RNA, 17 nt, Human
aaggcucugaaagccag

SEQ ID NO: 2534081 - RNA, 18 nt, Human
aaggcucugaaagccagc

SEQ ID NO: 2534082 - RNA, 22 nt, Human
aaggggcccaaauucuuucagu

SEQ ID NO: 2534083 - RNA, 17 nt, Human
aaggggccagaggcucg

SEQ ID NO: 2534084 - RNA, 16 nt, Human
aaggcucuucugacua

SEQ ID NO: 2534085 - RNA, 15 nt, Human
aaggcugaccaagag

SEQ ID NO: 2534086 - RNA, 13 nt, Human
aaggggccauccu

SEQ ID NO: 2534087 - RNA, 16 nt, Human
aaggcugaccaagaga

SEQ ID NO: 2534088 - RNA, 13 nt, Human
aaggggcccuggu

SEQ ID NO: 2534089 - RNA, 19 nt, Human
aaggguccuucccucuccc

SEQ ID NO: 2534090 - RNA, 18 nt, Human
aaggggcgucuguucccc

SEQ ID NO: 2534091 - RNA, 21 nt, Human
aaggggccuuugucuugucaa

SEQ ID NO: 2534092 - RNA, 15 nt, Human
aaggggcccguggga

SEQ ID NO: 2534093 - RNA, 23 nt, Human
aaggggccucaccgagugggggc

SEQ ID NO: 2534094 - RNA, 14 nt, Human
aaggggcccugguc

SEQ ID NO: 2534095 - RNA, 21 nt, Human
aaggggcccugguccuuccag

SEQ ID NO: 2534096 - RNA, 19 nt, Human
aagggugaugggaaagcau

SEQ ID NO: 2534097 - RNA, 20 nt, Human
aagggucuagggagagaccc

SEQ ID NO: 2534098 - RNA, 22 nt, Human
aagggucuagggagagacccuu

SEQ ID NO: 2534099 - RNA, 16 nt, Human
aaggggcugaaagaac

SEQ ID NO: 2534100 - RNA, 16 nt, Human
aagggucuagggagag

SEQ ID NO: 2534101 - RNA, 17 nt, Human
aagggucuagggagaga

SEQ ID NO: 2534102 - RNA, 18 nt, Human
aagggucuagggagagac

SEQ ID NO: 2534103 - RNA, 14 nt, Human
aagguacuucaaau

SEQ ID NO: 2534104 - RNA, 16 nt, Human
aagggucuugggaaau

SEQ ID NO: 2534105 - RNA, 15 nt, Human
aagggucuugggaaa

SEQ ID NO: 2534106 - RNA, 19 nt, Human
aagggucuugggaaauaug

SEQ ID NO: 2534107 - RNA, 18 nt, Human
aagguauuccuuuugugu

SEQ ID NO: 2534108 - RNA, 22 nt, Human
aagguauuccuuuuguguacag

SEQ ID NO: 2534109 - RNA, 20 nt, Human
aagguagaaauaucugaaaa

SEQ ID NO: 2534110 - RNA, 12 nt, Human
aaggucauuuuu

SEQ ID NO: 2534111 - RNA, 21 nt, Human
aaguaagaaagugaagcaaau

SEQ ID NO: 2534112 - RNA, 20 nt, Human
aaguaagaaagugaagcaaa

SEQ ID NO: 2534113 - RNA, 19 nt, Human
aaggucaccagcaccaaca

SEQ ID NO: 2534114 - RNA, 13 nt, Human
aaggucaucaucg

SEQ ID NO: 2534115 - RNA, 16 nt, Human
aaguaaggaauuuuau

SEQ ID NO: 2534116 - RNA, 13 nt, Human
aaguaagcaaaga

SEQ ID NO: 2534117 - RNA, 13 nt, Human
aaguaagaagaca

SEQ ID NO: 2534118 - RNA, 14 nt, Human
aaguaagaagacau

SEQ ID NO: 2534119 - RNA, 20 nt, Human
aaguaagaagacaugaacca

SEQ ID NO: 2534120 - RNA, 15 nt, Human
aaguaaggugcaguu

SEQ ID NO: 2534121 - RNA, 18 nt, Human
aaguaaguaccacucagg

SEQ ID NO: 2534122 - RNA, 17 nt, Human
aaguaagcaacagcaua

SEQ ID NO: 2534123 - RNA, 15 nt, Human
aaguaagaagacaug

SEQ ID NO: 2534124 - RNA, 19 nt, Human
aaguaagcaacagcauaac

SEQ ID NO: 2534125 - RNA, 23 nt, Human
aaguaagcccuugaagauaucuu

SEQ ID NO: 2534126 - RNA, 22 nt, Human
guuucuaugacacaugcaaggu

SEQ ID NO: 2534127 - RNA, 20 nt, Human
aaguaaguaccacucaggcc

SEQ ID NO: 2534128 - RNA, 21 nt, Human
aaguaaguaccacucaggcca

SEQ ID NO: 2534129 - RNA, 14 nt, Human
guuucucagauccu

SEQ ID NO: 2534130 - RNA, 15 nt, Human
guuucucugcuguug

SEQ ID NO: 2534131 - RNA, 19 nt, Human
guuucuauguguagggcgg

SEQ ID NO: 2534132 - RNA, 18 nt, Human
aaguaaggugcaguuccc

SEQ ID NO: 2534133 - RNA, 18 nt, Human
guuucugaaagggacgcu

SEQ ID NO: 2534134 - RNA, 21 nt, Human
guuucucuuuccuuggcuccc

SEQ ID NO: 2534135 - RNA, 17 nt, Human
guuucugacucugagcu

SEQ ID NO: 2534136 - RNA, 13 nt, Human
guuucugacucug

SEQ ID NO: 2534137 - RNA, 14 nt, Human
guuucucuuuccuu

SEQ ID NO: 2534138 - RNA, 20 nt, Human
guuucugaaaauuaacacug

SEQ ID NO: 2534139 - RNA, 12 nt, Human
guuucugacucu

SEQ ID NO: 2534140 - RNA, 21 nt, Human
guuucugaaaauuaacacugc

SEQ ID NO: 2534141 - RNA, 15 nt, Human
guugggcugguguca

SEQ ID NO: 2534142 - RNA, 15 nt, Human
guugggcccagaucu

SEQ ID NO: 2534143 - RNA, 16 nt, Human
guugggcccagaucug

SEQ ID NO: 2534144 - RNA, 17 nt, Human
guugggcccagaucugg

SEQ ID NO: 2534145 - RNA, 17 nt, Human
guuuaauauuuaaacag

SEQ ID NO: 2534146 - RNA, 21 nt, Human
guuuaauccccaguaaaauug

SEQ ID NO: 2534147 - RNA, 19 nt, Human
guuuaauccccaguaaaau

SEQ ID NO: 2534148 - RNA, 15 nt, Human
guuuaauauugagaa

SEQ ID NO: 2534149 - RNA, 17 nt, Human
guuuaauauugagaaag

SEQ ID NO: 2534150 - RNA, 15 nt, Human
guuuaauauuuaaac

SEQ ID NO: 2534151 - RNA, 12 nt, Human
guuuaauauuua

SEQ ID NO: 2534152 - RNA, 19 nt, Human
guuuaauauugagaaagaa

SEQ ID NO: 2534153 - RNA, 17 nt, Human
guugggccaggagccuc

SEQ ID NO: 2534154 - RNA, 15 nt, Human
guugggccaggagcc

SEQ ID NO: 2534155 - RNA, 13 nt, Human
guugggcuggugu

SEQ ID NO: 2534156 - RNA, 19 nt, Human
guugggccauacuggccuc

SEQ ID NO: 2534157 - RNA, 18 nt, Human
guugggccauacuggccu

SEQ ID NO: 2534158 - RNA, 22 nt, Human
guugggcagggugacccugaag

SEQ ID NO: 2534159 - RNA, 21 nt, Human
guugggccauacuggccucgc

SEQ ID NO: 2534160 - RNA, 20 nt, Human
guugggccauacuggccucg

SEQ ID NO: 2534161 - RNA, 13 nt, Human
guugggcccagau

SEQ ID NO: 2534162 - RNA, 13 nt, Human
guuuacaguguuc

SEQ ID NO: 2534163 - RNA, 15 nt, Human
guuuacaguguuccg

SEQ ID NO: 2534164 - RNA, 13 nt, Human
guuuauugucaaa

SEQ ID NO: 2534165 - RNA, 11 nt, Human
guuuacaugua

SEQ ID NO: 2534166 - RNA, 14 nt, Human
guuuauuuaucagu

SEQ ID NO: 2534167 - RNA, 21 nt, Human
guuuauuuccaaauaaaauga

SEQ ID NO: 2534168 - RNA, 12 nt, Human
guuuauuuccaa

SEQ ID NO: 2534169 - RNA, 17 nt, Human
guuuauuuauucugcau

SEQ ID NO: 2534170 - RNA, 16 nt, Human
guuuauuuaucaguga

SEQ ID NO: 2534171 - RNA, 19 nt, Human
guuuauuuaucagugacag

SEQ ID NO: 2534172 - RNA, 23 nt, Human
guuuacagcacuacucugugcca

SEQ ID NO: 2534173 - RNA, 16 nt, Human
guuuacacucuuugua

SEQ ID NO: 2534174 - RNA, 18 nt, Human
guuuacagggagccuccu

SEQ ID NO: 2534175 - RNA, 17 nt, Human
guuuacagggagccucc

SEQ ID NO: 2534176 - RNA, 16 nt, Human
guuuacagggagccuc

SEQ ID NO: 2534177 - RNA, 20 nt, Human
guuuacagggagccuccugc

SEQ ID NO: 2534178 - RNA, 19 nt, Human
guuuacagggagccuccug

SEQ ID NO: 2534179 - RNA, 17 nt, Human
guuuacagguggacaca

SEQ ID NO: 2534180 - RNA, 19 nt, Human
guuuacaguaaauaaauug

SEQ ID NO: 2534181 - RNA, 15 nt, Human
guuuacaguaaauaa

SEQ ID NO: 2534182 - RNA, 13 nt, Human
guuuacaguaaau

SEQ ID NO: 2534183 - RNA, 23 nt, Human
guuuacagggagccuccugccca

SEQ ID NO: 2534184 - RNA, 18 nt, Human
aaggcucgagcaugccug

SEQ ID NO: 2534185 - RNA, 16 nt, Human
aaggcucgagcaugcc

SEQ ID NO: 2534186 - RNA, 22 nt, Human
aaggcuccaggagcagccacau

SEQ ID NO: 2534187 - RNA, 19 nt, Human
aaggcuccaggagcagcca

SEQ ID NO: 2534188 - RNA, 20 nt, Human
aaggcucgagcaugccugga

SEQ ID NO: 2534189 - RNA, 19 nt, Human
aaggcucgagcaugccugg

SEQ ID NO: 2534190 - RNA, 22 nt, Human
aaggcucgagcaugccuggaug

SEQ ID NO: 2534191 - RNA, 14 nt, Human
guuuauuuuauauu

SEQ ID NO: 2534192 - RNA, 19 nt, Human
guuuauuuucaagaauaau

SEQ ID NO: 2534193 - RNA, 22 nt, Human
aaggcucgauuuuguaucugca

SEQ ID NO: 2534194 - RNA, 17 nt, Human
aaggcucgauuuuguau

SEQ ID NO: 2534195 - RNA, 15 nt, Human
aaggcucgauuuugu

SEQ ID NO: 2534196 - RNA, 15 nt, Human
aaggcuccaggagca

SEQ ID NO: 2534197 - RNA, 18 nt, Human
aaggcuccaggagcagcc

SEQ ID NO: 2534198 - RNA, 16 nt, Human
aaggcuccaggagcag

SEQ ID NO: 2534199 - RNA, 14 nt, Human
guuucaaacuuuac

SEQ ID NO: 2534200 - RNA, 16 nt, Human
guuucaaacuuuacua

SEQ ID NO: 2534201 - RNA, 13 nt, Human
guuucaaacuuua

SEQ ID NO: 2534202 - RNA, 14 nt, Human
guuuauuucuuaaa

SEQ ID NO: 2534203 - RNA, 13 nt, Human
guuuauuuuaaga

SEQ ID NO: 2534204 - RNA, 21 nt, Human
aagcuccacugucacccucca

SEQ ID NO: 2534205 - RNA, 19 nt, Human
aagcuccacugucacccuc

SEQ ID NO: 2534206 - RNA, 16 nt, Human
aagcuccacugucacc

SEQ ID NO: 2534207 - RNA, 15 nt, Human
aagcuccacugucac

SEQ ID NO: 2534208 - RNA, 13 nt, Human
aagcuccaagccc

SEQ ID NO: 2534209 - RNA, 14 nt, Human
aagcuccaucucca

SEQ ID NO: 2534210 - RNA, 15 nt, Human
aaggaaagagggagg

SEQ ID NO: 2534211 - RNA, 13 nt, Human
aaggaaagcaaua

SEQ ID NO: 2534212 - RNA, 16 nt, Human
aaggaaagcaauaaau

SEQ ID NO: 2534213 - RNA, 20 nt, Human
aaggaaagcaauaaaugaau

SEQ ID NO: 2534214 - RNA, 22 nt, Human
aaggaaccaaagcgaauuuuaa

SEQ ID NO: 2534215 - RNA, 23 nt, Human
aaggaaccaaagcgaauuuuaaa

SEQ ID NO: 2534216 - RNA, 22 nt, Human
aaggaaauaccaguucugggca

SEQ ID NO: 2534217 - RNA, 22 nt, Human
aaggaaagggggucccaguggg

SEQ ID NO: 2534218 - RNA, 14 nt, Human
aaggaaaggccuga

SEQ ID NO: 2534219 - RNA, 13 nt, Human
aaggaaaggcaaa

SEQ ID NO: 2534220 - RNA, 21 nt, Human
aaggaaaugauugaggaguga

SEQ ID NO: 2534221 - RNA, 14 nt, Human
aaggaaaugauuga

SEQ ID NO: 2534222 - RNA, 16 nt, Human
aaggaaaucucacccc

SEQ ID NO: 2534223 - RNA, 22 nt, Human
aaggaaaucucaccccauccca

SEQ ID NO: 2534224 - RNA, 13 nt, Human
aaggaagcacaug

SEQ ID NO: 2534225 - RNA, 15 nt, Human
aaggaagacuucauc

SEQ ID NO: 2534226 - RNA, 14 nt, Human
aaggaagacuucau

SEQ ID NO: 2534227 - RNA, 22 nt, Human
aaggaacucuggcuuccaggua

SEQ ID NO: 2534228 - RNA, 20 nt, Human
aaggaacucuggcuuccagg

SEQ ID NO: 2534229 - RNA, 18 nt, Human
aaggaacucuggcuucca

SEQ ID NO: 2534230 - RNA, 17 nt, Human
aaggaauaccugucccc

SEQ ID NO: 2534231 - RNA, 21 nt, Human
aaggaauaaauugcuccuuga

SEQ ID NO: 2534232 - RNA, 16 nt, Human
aaggaagcuccacugu

SEQ ID NO: 2534233 - RNA, 21 nt, Human
aaggaagucaaagcaaggaaa

SEQ ID NO: 2534234 - RNA, 14 nt, Human
aaggaagucuagga

SEQ ID NO: 2534235 - RNA, 16 nt, Human
aaggaagcacaugccu

SEQ ID NO: 2534236 - RNA, 13 nt, Human
aaggaagacuaga

SEQ ID NO: 2534237 - RNA, 22 nt, Human
aaggaagccacagcugguggua

SEQ ID NO: 2534238 - RNA, 18 nt, Human
aaggaggaagagaaaaaa

SEQ ID NO: 2534239 - RNA, 12 nt, Human
aaggagcugcua

SEQ ID NO: 2534240 - RNA, 14 nt, Human
aaggagcugcuaua

SEQ ID NO: 2534241 - RNA, 18 nt, Human
aaggagcugcuauagccu

SEQ ID NO: 2534242 - RNA, 20 nt, Human
aaggagcugcuauagccugg

SEQ ID NO: 2534243 - RNA, 11 nt, Human
aaggaggaaaa

SEQ ID NO: 2534244 - RNA, 21 nt, Human
aaggagcugcuauagccuggg

SEQ ID NO: 2534245 - RNA, 23 nt, Human
aaggaggcgcacuuuccuccugg

SEQ ID NO: 2534246 - RNA, 18 nt, Human
aaggaggcuggcuggggc

SEQ ID NO: 2534247 - RNA, 15 nt, Human
aaggaggcuggcugg

SEQ ID NO: 2534248 - RNA, 13 nt, Human
aaggaggcuggcu

SEQ ID NO: 2534249 - RNA, 14 nt, Human
aaggaggcuggcag

SEQ ID NO: 2534250 - RNA, 20 nt, Human
aaggaggggauagagagaga

SEQ ID NO: 2534251 - RNA, 13 nt, Human
aaggaggggaacc

SEQ ID NO: 2534252 - RNA, 17 nt, Human
aaggaggggcuguaaaa

SEQ ID NO: 2534253 - RNA, 15 nt, Human
aaggagggagaugga

SEQ ID NO: 2534254 - RNA, 18 nt, Human
aaggaguaaucuguguac

SEQ ID NO: 2534255 - RNA, 15 nt, Human
aaggaguaagaaccu

SEQ ID NO: 2534256 - RNA, 19 nt, Human
aaggaggugagggauguga

SEQ ID NO: 2534257 - RNA, 15 nt, Human
aaggaggugagggau

SEQ ID NO: 2534258 - RNA, 17 nt, Human
aaggagucaaaacuaca

SEQ ID NO: 2534259 - RNA, 13 nt, Human
aaggaguagaaaa

SEQ ID NO: 2534260 - RNA, 18 nt, Human
aaggaggguuagggaggg

SEQ ID NO: 2534261 - RNA, 19 nt, Human
aaggaggguuagggagggg

SEQ ID NO: 2534262 - RNA, 17 nt, Human
aaggagggucaggaagg

SEQ ID NO: 2534263 - RNA, 21 nt, Human
aaggaggguggaucaccugag

SEQ ID NO: 2534264 - RNA, 12 nt, Human
aaggagggugag

SEQ ID NO: 2534265 - RNA, 22 nt, Human
aaggagcucacuguggugucug

SEQ ID NO: 2534266 - RNA, 14 nt, Human
aaggagauuuacaa

SEQ ID NO: 2534267 - RNA, 14 nt, Human
aaggagaggaggca

SEQ ID NO: 2534268 - RNA, 18 nt, Human
aaggaauaccuguccccc

SEQ ID NO: 2534269 - RNA, 16 nt, Human
aaggaauauauggcag

SEQ ID NO: 2534270 - RNA, 15 nt, Human
aaggaauauauggca

SEQ ID NO: 2534271 - RNA, 13 nt, Human
aaggaauauaugg

SEQ ID NO: 2534272 - RNA, 14 nt, Human
aaggaagugaagag

SEQ ID NO: 2534273 - RNA, 22 nt, Human
aaggaaguuacuguuauagagg

SEQ ID NO: 2534274 - RNA, 11 nt, Human
aaggagagcua

SEQ ID NO: 2534275 - RNA, 13 nt, Human
aaggagaggaggc

SEQ ID NO: 2534276 - RNA, 17 nt, Human
aaggagaggaaagaacu

SEQ ID NO: 2534277 - RNA, 20 nt, Human
aaggagaggcaacauccaaa

SEQ ID NO: 2534278 - RNA, 15 nt, Human
aaggagaugaagcaa

SEQ ID NO: 2534279 - RNA, 20 nt, Human
aaggagucagacauuuuaag

SEQ ID NO: 2534280 - RNA, 19 nt, Human
aaggaguaaucuguguaca

SEQ ID NO: 2534281 - RNA, 19 nt, Human
aaggagugagaucauuuuc

SEQ ID NO: 2534282 - RNA, 13 nt, Human
aaggaguuaagag

SEQ ID NO: 2534283 - RNA, 20 nt, Human
aaggaguuccaugaagacca

SEQ ID NO: 2534284 - RNA, 13 nt, Human
aaggauacaaaag

SEQ ID NO: 2534285 - RNA, 21 nt, Human
aaggauacaaaagcaugugag

SEQ ID NO: 2534286 - RNA, 20 nt, Human
aaggcaucagucccuaugua

SEQ ID NO: 2534287 - RNA, 12 nt, Human
aaggcaugaagg

SEQ ID NO: 2534288 - RNA, 12 nt, Human
aaggcauucucu

SEQ ID NO: 2534289 - RNA, 16 nt, Human
aaggcauguuccucug

SEQ ID NO: 2534290 - RNA, 21 nt, Human
aaggcaugauguuaaccagaa

SEQ ID NO: 2534291 - RNA, 19 nt, Human
aaggauacuguaacacuuu

SEQ ID NO: 2534292 - RNA, 20 nt, Human
aaggcauaucagucucugag

SEQ ID NO: 2534293 - RNA, 15 nt, Human
aaggauagaugcugg

SEQ ID NO: 2534294 - RNA, 23 nt, Human
aaggauacuguaacacuuuacaa

SEQ ID NO: 2534295 - RNA, 22 nt, Human
aaggcccuaucuguuuacagug

SEQ ID NO: 2534296 - RNA, 22 nt, Human
aaggccgaagaaggguccuucc

SEQ ID NO: 2534297 - RNA, 20 nt, Human
aaggccgaagcucuggcuga

SEQ ID NO: 2534298 - RNA, 19 nt, Human
aaggccgaagcucuggcug

SEQ ID NO: 2534299 - RNA, 18 nt, Human
aaggccgaagcucuggcu

SEQ ID NO: 2534300 - RNA, 16 nt, Human
aaggccgaagcucugg

SEQ ID NO: 2534301 - RNA, 14 nt, Human
aaggccgagaagca

SEQ ID NO: 2534302 - RNA, 17 nt, Human
aaggccgagaagcaaga

SEQ ID NO: 2534303 - RNA, 18 nt, Human
aaggccgagaagcaagaa

SEQ ID NO: 2534304 - RNA, 22 nt, Human
aaggccgcuguucacccacagg

SEQ ID NO: 2534305 - RNA, 22 nt, Human
aaggccauggagagcuggagcc

SEQ ID NO: 2534306 - RNA, 18 nt, Human
aaggccauggagagcugg

SEQ ID NO: 2534307 - RNA, 14 nt, Human
aaggccaucagagc

SEQ ID NO: 2534308 - RNA, 21 nt, Human
aaggccauggagagcuggagc

SEQ ID NO: 2534309 - RNA, 21 nt, Human
aaggcccacgagcuuguucuu

SEQ ID NO: 2534310 - RNA, 13 nt, Human
aaggcauuuuauu

SEQ ID NO: 2534311 - RNA, 16 nt, Human
aaggccaaaccucugu

SEQ ID NO: 2534312 - RNA, 15 nt, Human
aaggcauuguuugag

SEQ ID NO: 2534313 - RNA, 14 nt, Human
aaggcauucucuga

SEQ ID NO: 2534314 - RNA, 17 nt, Human
aaggcauucucugaaga

SEQ ID NO: 2534315 - RNA, 16 nt, Human
aaggccaaaggaagca

SEQ ID NO: 2534316 - RNA, 17 nt, Human
aaggccaaaccucuguu

SEQ ID NO: 2534317 - RNA, 14 nt, Human
aaggccagcuggca

SEQ ID NO: 2534318 - RNA, 14 nt, Human
aaggccauaaaaca

SEQ ID NO: 2534319 - RNA, 17 nt, Human
aaggccauaaaacaggu

SEQ ID NO: 2534320 - RNA, 17 nt, Human
aaggccagcuggcagca

SEQ ID NO: 2534321 - RNA, 19 nt, Human
aaggccagcuggcagcaga

SEQ ID NO: 2534322 - RNA, 18 nt, Human
aaggccauaaaacaggua

SEQ ID NO: 2534323 - RNA, 24 nt, Human
aaggccauaaaacagguaauauaa

SEQ ID NO: 2534324 - RNA, 22 nt, Human
aaggccaucugggcuccuccag

SEQ ID NO: 2534325 - RNA, 22 nt, Human
aaggccauccuucccugucugc

SEQ ID NO: 2534326 - RNA, 19 nt, Human
aaggccucccuagccagca

SEQ ID NO: 2534327 - RNA, 17 nt, Human
aaggccucccacaguga

SEQ ID NO: 2534328 - RNA, 16 nt, Human
aaggccucccacagug

SEQ ID NO: 2534329 - RNA, 19 nt, Human
aaggccucccacagugacu

SEQ ID NO: 2534330 - RNA, 16 nt, Human
guugccuaauaaacau

SEQ ID NO: 2534331 - RNA, 19 nt, Human
guugccuugaaccacuucc

SEQ ID NO: 2534332 - RNA, 18 nt, Human
guugccuuaaagaaaguc

SEQ ID NO: 2534333 - RNA, 21 nt, Human
guugccuugaaccacuucccu

SEQ ID NO: 2534334 - RNA, 13 nt, Human
guugcccaggcug

SEQ ID NO: 2534335 - RNA, 12 nt, Human
guugcccaggcu

SEQ ID NO: 2534336 - RNA, 15 nt, Human
aaggccucccacagu

SEQ ID NO: 2534337 - RNA, 14 nt, Human
aaggccucccacag

SEQ ID NO: 2534338 - RNA, 13 nt, Human
aaggccucccaca

SEQ ID NO: 2534339 - RNA, 23 nt, Human
guugcccaggcaggucuugaacu

SEQ ID NO: 2534340 - RNA, 22 nt, Human
guuggaaugaauuaaauaaacc

SEQ ID NO: 2534341 - RNA, 23 nt, Human
guuggaaauagaaauuuccagag

SEQ ID NO: 2534342 - RNA, 18 nt, Human
guuggaaauauucaugcu

SEQ ID NO: 2534343 - RNA, 16 nt, Human
guuggaaagcaggugg

SEQ ID NO: 2534344 - RNA, 22 nt, Human
guuggaagcuagcuccccuccu

SEQ ID NO: 2534345 - RNA, 14 nt, Human
guugggagcacugg

SEQ ID NO: 2534346 - RNA, 15 nt, Human
guugggagcacugga

SEQ ID NO: 2534347 - RNA, 16 nt, Human
guugggagcacuggag

SEQ ID NO: 2534348 - RNA, 23 nt, Human
guugggauuccugacccaggccg

SEQ ID NO: 2534349 - RNA, 22 nt, Human
guugggauuccugacccaggcc

SEQ ID NO: 2534350 - RNA, 21 nt, Human
guugggauuccugacccaggc

SEQ ID NO: 2534351 - RNA, 20 nt, Human
guugggauuccugacccagg

SEQ ID NO: 2534352 - RNA, 22 nt, Human
guugggauugggggcuggugcc

SEQ ID NO: 2534353 - RNA, 21 nt, Human
guugggauugggggcuggugc

SEQ ID NO: 2534354 - RNA, 19 nt, Human
guugggauuccugacccag

SEQ ID NO: 2534355 - RNA, 18 nt, Human
guugggauuccugaccca

SEQ ID NO: 2534356 - RNA, 16 nt, Human
guugggauuccugacc

SEQ ID NO: 2534357 - RNA, 21 nt, Human
guugggauacugcagggccag

SEQ ID NO: 2534358 - RNA, 18 nt, Human
guugggauacugcagggc

SEQ ID NO: 2534359 - RNA, 14 nt, Human
guugggaggauucu

SEQ ID NO: 2534360 - RNA, 15 nt, Human
guugcuuugcccugg

SEQ ID NO: 2534361 - RNA, 15 nt, Human
guuggaaaagaauac

SEQ ID NO: 2534362 - RNA, 15 nt, Human
guugcuuacaauuuu

SEQ ID NO: 2534363 - RNA, 20 nt, Human
guuggaaaagaauacagaaa

SEQ ID NO: 2534364 - RNA, 22 nt, Human
guuggaaaagaauacagaaaga

SEQ ID NO: 2534365 - RNA, 18 nt, Human
guugcguaacuggcugug

SEQ ID NO: 2534366 - RNA, 15 nt, Human
guugcggggggaggg

SEQ ID NO: 2534367 - RNA, 13 nt, Human
guugcggggggag

SEQ ID NO: 2534368 - RNA, 23 nt, Human
guugcuuaggaugugugcaugug

SEQ ID NO: 2534369 - RNA, 16 nt, Human
guugcuuacaauuuuu

SEQ ID NO: 2534370 - RNA, 23 nt, Human
guugcguggacucugcacauguc

SEQ ID NO: 2534371 - RNA, 21 nt, Human
guugcuugccugauauaaaug

SEQ ID NO: 2534372 - RNA, 13 nt, Human
aaguauuagaaua

SEQ ID NO: 2534373 - RNA, 18 nt, Human
aaguauuuaauuagugcu

SEQ ID NO: 2534374 - RNA, 17 nt, Human
aaguauuuaauuagugc

SEQ ID NO: 2534375 - RNA, 16 nt, Human
aaguauuuaauuagug

SEQ ID NO: 2534376 - RNA, 22 nt, Human
aaguauuagggguaauauauug

SEQ ID NO: 2534377 - RNA, 20 nt, Human
aaguauuagggguaauauau

SEQ ID NO: 2534378 - RNA, 11 nt, Human
aaguauuuagg

SEQ ID NO: 2534379 - RNA, 16 nt, Human
aaguauuuagguuuuu

SEQ ID NO: 2534380 - RNA, 10 nt, Human
aaguauuuag

SEQ ID NO: 2534381 - RNA, 23 nt, Human
aaguauuuaauuagugcuaagug

SEQ ID NO: 2534382 - RNA, 22 nt, Human
aaguauuuaauuagugcuaagu

SEQ ID NO: 2534383 - RNA, 21 nt, Human
aaguauuuaauuagugcuaag

SEQ ID NO: 2534384 - RNA, 20 nt, Human
aaguauuuaauuagugcuaa

SEQ ID NO: 2534385 - RNA, 19 nt, Human
aaguauuuaauuagugcua

SEQ ID NO: 2534386 - RNA, 12 nt, Human
aaguauuuauau

SEQ ID NO: 2534387 - RNA, 13 nt, Human
aaguauuuauaua

SEQ ID NO: 2534388 - RNA, 14 nt, Human
aaguauuuauauau

SEQ ID NO: 2534389 - RNA, 15 nt, Human
aaguauuuauauauu

SEQ ID NO: 2534390 - RNA, 16 nt, Human
aaguauuuauauauuu

SEQ ID NO: 2534391 - RNA, 17 nt, Human
aaguauuuauauauuua

SEQ ID NO: 2534392 - RNA, 18 nt, Human
aaguauuuauauauuuau

SEQ ID NO: 2534393 - RNA, 13 nt, Human
aaguacauuuaau

SEQ ID NO: 2534394 - RNA, 12 nt, Human
aaguacauuuaa

SEQ ID NO: 2534395 - RNA, 20 nt, Human
aaguacauauuaggaaaaua

SEQ ID NO: 2534396 - RNA, 18 nt, Human
aaguacccguucacauuu

SEQ ID NO: 2534397 - RNA, 17 nt, Human
aaguaccacucaggcca

SEQ ID NO: 2534398 - RNA, 19 nt, Human
aaguacacuguuucaaacu

SEQ ID NO: 2534399 - RNA, 20 nt, Human
aaguacacuguuucaaacuu

SEQ ID NO: 2534400 - RNA, 23 nt, Human
aaguacacuguuucaaacuuuac

SEQ ID NO: 2534401 - RNA, 16 nt, Human
aaguaauccuagggaa

SEQ ID NO: 2534402 - RNA, 18 nt, Human
aaguaaucccgccaccua

SEQ ID NO: 2534403 - RNA, 21 nt, Human
aaguaaugaauuuuuaugaua

SEQ ID NO: 2534404 - RNA, 22 nt, Human
guuuugccauguuggccaggcu

SEQ ID NO: 2534405 - RNA, 21 nt, Human
guuuugccauguuggccaggc

SEQ ID NO: 2534406 - RNA, 20 nt, Human
guuuugccauguuggccagg

SEQ ID NO: 2534407 - RNA, 16 nt, Human
guuuugccauguuggc

SEQ ID NO: 2534408 - RNA, 14 nt, Human
guuucugccgcagc

SEQ ID NO: 2534409 - RNA, 22 nt, Human
guuucugcaguagucucugugc

SEQ ID NO: 2534410 - RNA, 20 nt, Human
guuucugcaguagucucugu

SEQ ID NO: 2534411 - RNA, 14 nt, Human
guuucugcaguagu

SEQ ID NO: 2534412 - RNA, 20 nt, Human
guuucugaguuccugcaugc

SEQ ID NO: 2534413 - RNA, 15 nt, Human
guuucugccgcagcc

SEQ ID NO: 2534414 - RNA, 21 nt, Human
guuucugcccacauuggaccc

SEQ ID NO: 2534415 - RNA, 19 nt, Human
aaguaaugauaacuggaaa

SEQ ID NO: 2534416 - RNA, 14 nt, Human
aaguaaugauaacu

SEQ ID NO: 2534417 - RNA, 13 nt, Human
aaguacacuguuu

SEQ ID NO: 2534418 - RNA, 18 nt, Human
aaguacacuguuucaaac

SEQ ID NO: 2534419 - RNA, 18 nt, Human
guuuugcuuuuucugacu

SEQ ID NO: 2534420 - RNA, 16 nt, Human
guuuuggaagcucuga

SEQ ID NO: 2534421 - RNA, 16 nt, Human
guuuugccaacauugc

SEQ ID NO: 2534422 - RNA, 14 nt, Human
guuuugccaacauu

SEQ ID NO: 2534423 - RNA, 13 nt, Human
guuuugcacuuuu

SEQ ID NO: 2534424 - RNA, 19 nt, Human
guuuugcuauuagacugua

SEQ ID NO: 2534425 - RNA, 16 nt, Human
guuuugcuguuuccuu

SEQ ID NO: 2534426 - RNA, 22 nt, Human
guuuuggcugaaauucuccugg

SEQ ID NO: 2534427 - RNA, 20 nt, Human
guuuuggcugaaauucuccu

SEQ ID NO: 2534428 - RNA, 23 nt, Human
guuuuggcugaaauucuccugga

SEQ ID NO: 2534429 - RNA, 16 nt, Human
guuuuggggacucauu

SEQ ID NO: 2534430 - RNA, 20 nt, Human
guuuuggcaaacgcuaaaga

SEQ ID NO: 2534431 - RNA, 21 nt, Human
aaguaauccaccugccucggc

SEQ ID NO: 2534432 - RNA, 16 nt, Human
aagugaaaucaaaggu

SEQ ID NO: 2534433 - RNA, 16 nt, Human
aagucuuuuuugauca

SEQ ID NO: 2534434 - RNA, 18 nt, Human
aagucuuuuguucgcaug

SEQ ID NO: 2534435 - RNA, 21 nt, Human
aagugaaaaaggaggaagaga

SEQ ID NO: 2534436 - RNA, 17 nt, Human
aagugaagacaaugacu

SEQ ID NO: 2534437 - RNA, 19 nt, Human
aagugaagacaaugacuua

SEQ ID NO: 2534438 - RNA, 13 nt, Human
aagugaagacugg

SEQ ID NO: 2534439 - RNA, 16 nt, Human
aagugaagacuggaag

SEQ ID NO: 2534440 - RNA, 16 nt, Human
aagugaagaaaaguga

SEQ ID NO: 2534441 - RNA, 16 nt, Human
aagugaacacuagcca

SEQ ID NO: 2534442 - RNA, 15 nt, Human
aagugagacagucca

SEQ ID NO: 2534443 - RNA, 17 nt, Human
aagugaagguuuacaau

SEQ ID NO: 2534444 - RNA, 10 nt, Human
aagugaaggu

SEQ ID NO: 2534445 - RNA, 12 nt, Human
aagugagagagg

SEQ ID NO: 2534446 - RNA, 14 nt, Human
aagugagagcuggg

SEQ ID NO: 2534447 - RNA, 15 nt, Human
guuuuucauaaagca

SEQ ID NO: 2534448 - RNA, 15 nt, Human
aagugagagcugggu

SEQ ID NO: 2534449 - RNA, 15 nt, Human
guuuuuccacuacug

SEQ ID NO: 2534450 - RNA, 16 nt, Human
guuuuuccacuacugc

SEQ ID NO: 2534451 - RNA, 17 nt, Human
guuuuuccacuacugcu

SEQ ID NO: 2534452 - RNA, 18 nt, Human
guuuuuccacuacugcua

SEQ ID NO: 2534453 - RNA, 20 nt, Human
aagugagacaguccagccug

SEQ ID NO: 2534454 - RNA, 18 nt, Human
aagugaagguuuacaauu

SEQ ID NO: 2534455 - RNA, 14 nt, Human
guuuuucaguuuuc

SEQ ID NO: 2534456 - RNA, 15 nt, Human
guuuuuccuuuaaaa

SEQ ID NO: 2534457 - RNA, 14 nt, Human
guuuuuccuuuaaa

SEQ ID NO: 2534458 - RNA, 20 nt, Human
guuuuucuuaaauaauaaag

SEQ ID NO: 2534459 - RNA, 19 nt, Human
guuuuuccuuguauuuaaa

SEQ ID NO: 2534460 - RNA, 22 nt, Human
aagugagacaguccagccugga

SEQ ID NO: 2534461 - RNA, 19 nt, Human
guuuuuccuguucuuaaga

SEQ ID NO: 2534462 - RNA, 12 nt, Human
aagucuucaggg

SEQ ID NO: 2534463 - RNA, 18 nt, Human
aagucauuuuaacuuuau

SEQ ID NO: 2534464 - RNA, 20 nt, Human
aagucauuuuaacuuuauca

SEQ ID NO: 2534465 - RNA, 21 nt, Human
aaguccaaauguuuacaggga

SEQ ID NO: 2534466 - RNA, 22 nt, Human
aagucauuuuaacuuuaucaca

SEQ ID NO: 2534467 - RNA, 17 nt, Human
aagucuuaucaagcagc

SEQ ID NO: 2534468 - RNA, 16 nt, Human
aagucuuaucaagcag

SEQ ID NO: 2534469 - RNA, 20 nt, Human
aagucuucacucucugaaga

SEQ ID NO: 2534470 - RNA, 18 nt, Human
aagucuucccugaucaag

SEQ ID NO: 2534471 - RNA, 22 nt, Human
aagucuucccugaucaagucac

SEQ ID NO: 2534472 - RNA, 16 nt, Human
aagucuuucacauuua

SEQ ID NO: 2534473 - RNA, 14 nt, Human
aagucuuuuguucg

SEQ ID NO: 2534474 - RNA, 22 nt, Human
aagucuuauauauuguagauaa

SEQ ID NO: 2534475 - RNA, 13 nt, Human
aagucauuggcuu

SEQ ID NO: 2534476 - RNA, 20 nt, Human
aagucauuggcuuuauccuc

SEQ ID NO: 2534477 - RNA, 16 nt, Human
aagucauuuuaacuuu

SEQ ID NO: 2534478 - RNA, 15 nt, Human
aagucauggcugugc

SEQ ID NO: 2534479 - RNA, 20 nt, Human
aagucaugcaaaggcuggga

SEQ ID NO: 2534480 - RNA, 12 nt, Human
aagucauguucc

SEQ ID NO: 2534481 - RNA, 15 nt, Human
aagucaugugcauuu

SEQ ID NO: 2534482 - RNA, 14 nt, Human
aagucaugugcauu

SEQ ID NO: 2534483 - RNA, 13 nt, Human
aaguauuucaaau

SEQ ID NO: 2534484 - RNA, 21 nt, Human
aaguauuucaaauuggagcuu

SEQ ID NO: 2534485 - RNA, 22 nt, Human
aaguauuucaaauuggagcuuc

SEQ ID NO: 2534486 - RNA, 13 nt, Human
aaguauuugggaa

SEQ ID NO: 2534487 - RNA, 20 nt, Human
aaguauuuauauauuuauaa

SEQ ID NO: 2534488 - RNA, 21 nt, Human
aaguauuuauauauuuauaac

SEQ ID NO: 2534489 - RNA, 22 nt, Human
aaguauuuauauauuuauaacu

SEQ ID NO: 2534490 - RNA, 23 nt, Human
aaguauuuauauauuuauaacuc

SEQ ID NO: 2534491 - RNA, 18 nt, Human
aaguauuuuccuguaaaa

SEQ ID NO: 2534492 - RNA, 15 nt, Human
aaguauuuuccugua

SEQ ID NO: 2534493 - RNA, 14 nt, Human
aaguauuuuccugu

SEQ ID NO: 2534494 - RNA, 21 nt, Human
aagucaugcguuuaaucacau

SEQ ID NO: 2534495 - RNA, 17 nt, Human
aaguauuuucauaagua

SEQ ID NO: 2534496 - RNA, 22 nt, Human
aaguauuuucauaaguauuuca

SEQ ID NO: 2534497 - RNA, 14 nt, Human
aaguauuucccagc

SEQ ID NO: 2534498 - RNA, 16 nt, Human
uaaaaaucucaaauuu

SEQ ID NO: 2534499 - RNA, 17 nt, Human
uaaaaaucucaaauuuc

SEQ ID NO: 2534500 - RNA, 15 nt, Human
uaaaaaucucaaauu

SEQ ID NO: 2534501 - RNA, 11 nt, Human
uaaaaaucaua

SEQ ID NO: 2534502 - RNA, 17 nt, Human
uaaaaaucauaaacugu

SEQ ID NO: 2534503 - RNA, 21 nt, Human
uaaaaauaaaaaacacuggga

SEQ ID NO: 2534504 - RNA, 20 nt, Human
uaaaaaguuuuaguuuugau

SEQ ID NO: 2534505 - RNA, 17 nt, Human
uaaaaaguuaaaaaguu

SEQ ID NO: 2534506 - RNA, 14 nt, Human
uaaaaauaaauuca

SEQ ID NO: 2534507 - RNA, 17 nt, Human
uaaaaauaaauuugguu

SEQ ID NO: 2534508 - RNA, 19 nt, Human
uaaaaauaaaaaacacugg

SEQ ID NO: 2534509 - RNA, 18 nt, Human
uaaaaauaaaaaacacug

SEQ ID NO: 2534510 - RNA, 11 nt, Human
uaaaaaguuaa

SEQ ID NO: 2534511 - RNA, 12 nt, Human
uaaaaaguuaaa

SEQ ID NO: 2534512 - RNA, 13 nt, Human
uaaaaaguuaaaa

SEQ ID NO: 2534513 - RNA, 15 nt, Human
uaaaaaguuaaaaag

SEQ ID NO: 2534514 - RNA, 9 nt, Human
uaaaaaguu

SEQ ID NO: 2534515 - RNA, 20 nt, Human
guuuuugaaggcagaaagca

SEQ ID NO: 2534516 - RNA, 17 nt, Human
guuuuugaaacagaacc

SEQ ID NO: 2534517 - RNA, 14 nt, Human
guuuuugaaacaga

SEQ ID NO: 2534518 - RNA, 19 nt, Human
guuuuugaaggcagaaagc

SEQ ID NO: 2534519 - RNA, 15 nt, Human
uaaaaaguggaaaaa

SEQ ID NO: 2534520 - RNA, 21 nt, Human
guuuuucuuaaauaauaaaga

SEQ ID NO: 2534521 - RNA, 12 nt, Human
guuuuucuucaa

SEQ ID NO: 2534522 - RNA, 22 nt, Human
guuuuucuucaacaucaauguu

SEQ ID NO: 2534523 - RNA, 23 nt, Human
guuuuucuucaacaucaauguuc

SEQ ID NO: 2534524 - RNA, 15 nt, Human
guuuuucuucucccu

SEQ ID NO: 2534525 - RNA, 19 nt, Human
uaaaaaucucaaauuucua

SEQ ID NO: 2534526 - RNA, 20 nt, Human
uaaaaaucucaaauuucuaa

SEQ ID NO: 2534527 - RNA, 21 nt, Human
uaaaaaucucaaauuucuaaa

SEQ ID NO: 2534528 - RNA, 19 nt, Human
uaaaacccauuuaaauuuu

SEQ ID NO: 2534529 - RNA, 19 nt, Human
uaaaaaucuaccuucugua

SEQ ID NO: 2534530 - RNA, 20 nt, Human
uaaaaaucauaaacugugug

SEQ ID NO: 2534531 - RNA, 15 nt, Human
uaaaaaucauaguac

SEQ ID NO: 2534532 - RNA, 17 nt, Human
uaaaaaucauugauugu

SEQ ID NO: 2534533 - RNA, 16 nt, Human
uaaaaccugucaauga

SEQ ID NO: 2534534 - RNA, 18 nt, Human
uaaaaccugagcuagaag

SEQ ID NO: 2534535 - RNA, 10 nt, Human
uaaaaccuuu

SEQ ID NO: 2534536 - RNA, 11 nt, Human
uaaaaccuuuc

SEQ ID NO: 2534537 - RNA, 13 nt, Human
uaaaaccuuucaa

SEQ ID NO: 2534538 - RNA, 15 nt, Human
uaaaaccugucaaug

SEQ ID NO: 2534539 - RNA, 21 nt, Human
uaaaaccccagccaacucauu

SEQ ID NO: 2534540 - RNA, 20 nt, Human
uaaaaaucuaccuucuguag

SEQ ID NO: 2534541 - RNA, 19 nt, Human
uaaaaccccaucucuacua

SEQ ID NO: 2534542 - RNA, 15 nt, Human
uaaaacuaaauagca

SEQ ID NO: 2534543 - RNA, 10 nt, Human
uaaaacuaaa

SEQ ID NO: 2534544 - RNA, 14 nt, Human
uaaaaccuuucaaa

SEQ ID NO: 2534545 - RNA, 16 nt, Human
uaaaaccuuucaaauu

SEQ ID NO: 2534546 - RNA, 20 nt, Human
uaaaaccuuucaaauuucac

SEQ ID NO: 2534547 - RNA, 21 nt, Human
uaaaaccuuucaaauuucaca

SEQ ID NO: 2534548 - RNA, 23 nt, Human
uaaaagaauauuuuaacuuccuu

SEQ ID NO: 2534549 - RNA, 12 nt, Human
uaaaagaaugau

SEQ ID NO: 2534550 - RNA, 12 nt, Human
uaaaagacaaau

SEQ ID NO: 2534551 - RNA, 11 nt, Human
uaaaagacaaa

SEQ ID NO: 2534552 - RNA, 21 nt, Human
uaaaagaaugggcaguuacau

SEQ ID NO: 2534553 - RNA, 12 nt, Human
uaaaagaauugu

SEQ ID NO: 2534554 - RNA, 17 nt, Human
uaaaacuuuccucgccu

SEQ ID NO: 2534555 - RNA, 15 nt, Human
uaaaacuuuccucgc

SEQ ID NO: 2534556 - RNA, 20 nt, Human
uaaaagaaugggcaguuaca

SEQ ID NO: 2534557 - RNA, 20 nt, Human
uaaaacuugauguguuaucu

SEQ ID NO: 2534558 - RNA, 22 nt, Human
uaaaacuugauguguuaucucu

SEQ ID NO: 2534559 - RNA, 20 nt, Human
uaaaacuaaauagcauguau

SEQ ID NO: 2534560 - RNA, 18 nt, Human
uaaaacuaaauagcaugu

SEQ ID NO: 2534561 - RNA, 13 nt, Human
uaaaacuugcugc

SEQ ID NO: 2534562 - RNA, 13 nt, Human
uaaaacuuuccuc

SEQ ID NO: 2534563 - RNA, 13 nt, Human
uaaaacuuuaauc

SEQ ID NO: 2534564 - RNA, 12 nt, Human
uaaaauauuuau

SEQ ID NO: 2534565 - RNA, 18 nt, Human
uaaaauauggcuauaaau

SEQ ID NO: 2534566 - RNA, 15 nt, Human
uaaaauauuuaucug

SEQ ID NO: 2534567 - RNA, 22 nt, Human
uaaaauauuccugcauuuguga

SEQ ID NO: 2534568 - RNA, 13 nt, Human
uaaaauauuccug

SEQ ID NO: 2534569 - RNA, 14 nt, Human
uaaaauauggcuau

SEQ ID NO: 2534570 - RNA, 20 nt, Human
uaaaauaugaagacauaaac

SEQ ID NO: 2534571 - RNA, 20 nt, Human
aagugauucucaugccucag

SEQ ID NO: 2534572 - RNA, 15 nt, Human
aagugauaauuucug

SEQ ID NO: 2534573 - RNA, 22 nt, Human
aagugagggccgagugagagcg

SEQ ID NO: 2534574 - RNA, 11 nt, Human
aagugaggaag

SEQ ID NO: 2534575 - RNA, 18 nt, Human
aagugagggucagagagg

SEQ ID NO: 2534576 - RNA, 16 nt, Human
aagugaggaugaaaaa

SEQ ID NO: 2534577 - RNA, 21 nt, Human
aagugagcuuugcugcuacag

SEQ ID NO: 2534578 - RNA, 18 nt, Human
aagugagcuuugcugcua

SEQ ID NO: 2534579 - RNA, 17 nt, Human
aagugagcuuugcugcu

SEQ ID NO: 2534580 - RNA, 18 nt, Human
aagugauucuccugccuc

SEQ ID NO: 2534581 - RNA, 17 nt, Human
aagugauucuccugccu

SEQ ID NO: 2534582 - RNA, 16 nt, Human
aagugauucuccugcc

SEQ ID NO: 2534583 - RNA, 15 nt, Human
aagugauucuccugc

SEQ ID NO: 2534584 - RNA, 19 nt, Human
aagugauucuccugccuca

SEQ ID NO: 2534585 - RNA, 21 nt, Human
aagugauucucaugccucagc

SEQ ID NO: 2534586 - RNA, 13 nt, Human
aagugccccugcu

SEQ ID NO: 2534587 - RNA, 22 nt, Human
aagugccccugcugccucccca

SEQ ID NO: 2534588 - RNA, 23 nt, Human
aagugccccugcugccuccccaa

SEQ ID NO: 2534589 - RNA, 19 nt, Human
aagugauucucaugccuca

SEQ ID NO: 2534590 - RNA, 14 nt, Human
aagugaucaauaaa

SEQ ID NO: 2534591 - RNA, 19 nt, Human
aagugccccugcugccucc

SEQ ID NO: 2534592 - RNA, 12 nt, Human
aagugccuuaau

SEQ ID NO: 2534593 - RNA, 17 nt, Human
uaaaauaaaauaaaaau

SEQ ID NO: 2534594 - RNA, 19 nt, Human
uaaaaguuucaaugugauu

SEQ ID NO: 2534595 - RNA, 15 nt, Human
uaaaauaauucuaaa

SEQ ID NO: 2534596 - RNA, 15 nt, Human
uaaaauaaugggauu

SEQ ID NO: 2534597 - RNA, 21 nt, Human
uaaaauaaaaauucugaaugu

SEQ ID NO: 2534598 - RNA, 18 nt, Human
uaaaaguuucaaugugau

SEQ ID NO: 2534599 - RNA, 15 nt, Human
uaaaaguuucaaugu

SEQ ID NO: 2534600 - RNA, 13 nt, Human
uaaaaguuucaau

SEQ ID NO: 2534601 - RNA, 21 nt, Human
uaaaaguugugauuccagaua

SEQ ID NO: 2534602 - RNA, 15 nt, Human
uaaaaguugugauuc

SEQ ID NO: 2534603 - RNA, 14 nt, Human
uaaaaguugugauu

SEQ ID NO: 2534604 - RNA, 14 nt, Human
uaaaagugugagca

SEQ ID NO: 2534605 - RNA, 23 nt, Human
uaaaagugggcuugauucugcag

SEQ ID NO: 2534606 - RNA, 18 nt, Human
uaaaagugugagcaguga

SEQ ID NO: 2534607 - RNA, 12 nt, Human
uaaaaguuacuu

SEQ ID NO: 2534608 - RNA, 17 nt, Human
uaaaaguuauuaauauu

SEQ ID NO: 2534609 - RNA, 20 nt, Human
uaaaagacagugaaagaaaa

SEQ ID NO: 2534610 - RNA, 22 nt, Human
uaaaagacaaaucaaagcagau

SEQ ID NO: 2534611 - RNA, 20 nt, Human
uaaaagacaaaucaaagcag

SEQ ID NO: 2534612 - RNA, 15 nt, Human
uaaaagacaagacuu

SEQ ID NO: 2534613 - RNA, 23 nt, Human
uaaaagacacuguuuacaagaaa

SEQ ID NO: 2534614 - RNA, 22 nt, Human
uaaaagugggcuugauucugca

SEQ ID NO: 2534615 - RNA, 13 nt, Human
uaaaagacuuuuu

SEQ ID NO: 2534616 - RNA, 22 nt, Human
uaaaauaccagccaguaaaugg

SEQ ID NO: 2534617 - RNA, 20 nt, Human
uaaaauaauuuuuauauuug

SEQ ID NO: 2534618 - RNA, 17 nt, Human
uaaaauaauucuaaagg

SEQ ID NO: 2534619 - RNA, 16 nt, Human
uaaaauaauucuaaag

SEQ ID NO: 2534620 - RNA, 19 nt, Human
uaaaauaugaagacauaaa

SEQ ID NO: 2534621 - RNA, 18 nt, Human
uaaaauaucuuuugaccu

SEQ ID NO: 2534622 - RNA, 20 nt, Human
uaaaauagauaaauaaauau

SEQ ID NO: 2534623 - RNA, 17 nt, Human
uaaaauagaaauaagug

SEQ ID NO: 2534624 - RNA, 21 nt, Human
uaaaauacuauuuuuacugcc

SEQ ID NO: 2534625 - RNA, 20 nt, Human
uaaaauacuauuuuuacugc

SEQ ID NO: 2534626 - RNA, 15 nt, Human
uaaaauacuauuuuu

SEQ ID NO: 2534627 - RNA, 12 nt, Human
uaaaauacuauu

SEQ ID NO: 2534628 - RNA, 22 nt, Human
guggggucacucuggcagcuca

SEQ ID NO: 2534629 - RNA, 21 nt, Human
guggggucacucuggcagcuc

SEQ ID NO: 2534630 - RNA, 20 nt, Human
guggggucacucuggcagcu

SEQ ID NO: 2534631 - RNA, 17 nt, Human
guggggucacucuggca

SEQ ID NO: 2534632 - RNA, 19 nt, Human
aagaggcgucuguauauuu

SEQ ID NO: 2534633 - RNA, 21 nt, Human
aagaggcgggccagccaggcg

SEQ ID NO: 2534634 - RNA, 20 nt, Human
aagaggcgggccagccaggc

SEQ ID NO: 2534635 - RNA, 18 nt, Human
aagaggcgggccagccag

SEQ ID NO: 2534636 - RNA, 17 nt, Human
aagaggcgggccagcca

SEQ ID NO: 2534637 - RNA, 15 nt, Human
aagaggcgggccagc

SEQ ID NO: 2534638 - RNA, 16 nt, Human
aagaggcugaaagagg

SEQ ID NO: 2534639 - RNA, 18 nt, Human
aagaggcugaaagaggcc

SEQ ID NO: 2534640 - RNA, 15 nt, Human
aagaggcugaggccu

SEQ ID NO: 2534641 - RNA, 22 nt, Human
aagaggcgggccagccaggcgg

SEQ ID NO: 2534642 - RNA, 13 nt, Human
aagaggcugaggc

SEQ ID NO: 2534643 - RNA, 19 nt, Human
gugggguagguugggagaa

SEQ ID NO: 2534644 - RNA, 20 nt, Human
guggggguggaggcuuccug

SEQ ID NO: 2534645 - RNA, 15 nt, Human
guggggucaugcccu

SEQ ID NO: 2534646 - RNA, 21 nt, Human
guggggucaugcccuccucuc

SEQ ID NO: 2534647 - RNA, 19 nt, Human
guggggucaugcccuccuc

SEQ ID NO: 2534648 - RNA, 14 nt, Human
guggggucucccuc

SEQ ID NO: 2534649 - RNA, 17 nt, Human
guggggucucccucucc

SEQ ID NO: 2534650 - RNA, 19 nt, Human
guggggucucccucuccug

SEQ ID NO: 2534651 - RNA, 21 nt, Human
guggggucucccucuccugcc

SEQ ID NO: 2534652 - RNA, 22 nt, Human
guggggucucccucuccugccu

SEQ ID NO: 2534653 - RNA, 14 nt, Human
aagagggguggaga

SEQ ID NO: 2534654 - RNA, 13 nt, Human
aagagggggugga

SEQ ID NO: 2534655 - RNA, 20 nt, Human
aagaguagaaacugcaggga

SEQ ID NO: 2534656 - RNA, 13 nt, Human
aagaguagacauu

SEQ ID NO: 2534657 - RNA, 15 nt, Human
aagagggguggagac

SEQ ID NO: 2534658 - RNA, 15 nt, Human
aagaguagaauugca

SEQ ID NO: 2534659 - RNA, 12 nt, Human
aagaguaggaag

SEQ ID NO: 2534660 - RNA, 16 nt, Human
aagaggggguggaggg

SEQ ID NO: 2534661 - RNA, 16 nt, Human
aagaggggcagcccuu

SEQ ID NO: 2534662 - RNA, 15 nt, Human
aagaggggcugggcu

SEQ ID NO: 2534663 - RNA, 13 nt, Human
aagaggggacagg

SEQ ID NO: 2534664 - RNA, 19 nt, Human
aagagggccugugggagcc

SEQ ID NO: 2534665 - RNA, 14 nt, Human
aagagggccugugg

SEQ ID NO: 2534666 - RNA, 12 nt, Human
aagagggccugu

SEQ ID NO: 2534667 - RNA, 15 nt, Human
aagaggggcagcccu

SEQ ID NO: 2534668 - RNA, 13 nt, Human
aagaggggcagcc

SEQ ID NO: 2534669 - RNA, 11 nt, Human
aagaggggcag

SEQ ID NO: 2534670 - RNA, 19 nt, Human
aagaggggaccagaagcca

SEQ ID NO: 2534671 - RNA, 17 nt, Human
aagagggcacacacugu

SEQ ID NO: 2534672 - RNA, 16 nt, Human
aagagggcacacacug

SEQ ID NO: 2534673 - RNA, 23 nt, Human
aagagggagggagggcuccagac

SEQ ID NO: 2534674 - RNA, 14 nt, Human
aagaggcugcagcc

SEQ ID NO: 2534675 - RNA, 20 nt, Human
aagaggcugaggccuggacu

SEQ ID NO: 2534676 - RNA, 18 nt, Human
aagaggcugaggccugga

SEQ ID NO: 2534677 - RNA, 22 nt, Human
aagaggcugaggcuggcacagg

SEQ ID NO: 2534678 - RNA, 21 nt, Human
aagaggcugauaauuccagug

SEQ ID NO: 2534679 - RNA, 14 nt, Human
aagaggcugaggca

SEQ ID NO: 2534680 - RNA, 17 nt, Human
aagaguagcauuucauu

SEQ ID NO: 2534681 - RNA, 14 nt, Human
aagaguagcauuuc

SEQ ID NO: 2534682 - RNA, 23 nt, Human
aagaguagcaaguucuagagaag

SEQ ID NO: 2534683 - RNA, 21 nt, Human
aagaguagcaaguucuagaga

SEQ ID NO: 2534684 - RNA, 14 nt, Human
aagaguaggaagac

SEQ ID NO: 2534685 - RNA, 13 nt, Human
aagaguaggaaga

SEQ ID NO: 2534686 - RNA, 16 nt, Human
aagaucgaauuuuuca

SEQ ID NO: 2534687 - RNA, 19 nt, Human
aagaguagcauuucauucu

SEQ ID NO: 2534688 - RNA, 18 nt, Human
aagaguagcauuucauuc

SEQ ID NO: 2534689 - RNA, 20 nt, Human
aagaucgcgccacugcacuc

SEQ ID NO: 2534690 - RNA, 16 nt, Human
aagaucgcccccaccu

SEQ ID NO: 2534691 - RNA, 17 nt, Human
aagaucguucucugccu

SEQ ID NO: 2534692 - RNA, 16 nt, Human
aagaucguucucugcc

SEQ ID NO: 2534693 - RNA, 13 nt, Human
aagaugaaaauau

SEQ ID NO: 2534694 - RNA, 14 nt, Human
aagaugaaaauauu

SEQ ID NO: 2534695 - RNA, 18 nt, Human
aagaucucagugguuaag

SEQ ID NO: 2534696 - RNA, 14 nt, Human
aagaucguuaguau

SEQ ID NO: 2534697 - RNA, 17 nt, Human
aagaucuguccucagcc

SEQ ID NO: 2534698 - RNA, 23 nt, Human
aagaucugcagggggugugucug

SEQ ID NO: 2534699 - RNA, 23 nt, Human
aagauggcugugccucugccugu

SEQ ID NO: 2534700 - RNA, 18 nt, Human
aagaugggcagcuaguuc

SEQ ID NO: 2534701 - RNA, 21 nt, Human
aagaugggaacgcagaugauc

SEQ ID NO: 2534702 - RNA, 21 nt, Human
aagauggcugugccucugccu

SEQ ID NO: 2534703 - RNA, 20 nt, Human
aagauggcugugccucugcc

SEQ ID NO: 2534704 - RNA, 18 nt, Human
aagauggcugugccucug

SEQ ID NO: 2534705 - RNA, 19 nt, Human
aagaugcuucucacugcca

SEQ ID NO: 2534706 - RNA, 17 nt, Human
aagaugcuucucacugc

SEQ ID NO: 2534707 - RNA, 16 nt, Human
aagaugcuucucacug

SEQ ID NO: 2534708 - RNA, 14 nt, Human
aagaugaagaggau

SEQ ID NO: 2534709 - RNA, 13 nt, Human
aagaugacacaag

SEQ ID NO: 2534710 - RNA, 15 nt, Human
aagaugaaucaaugg

SEQ ID NO: 2534711 - RNA, 23 nt, Human
aagaugaaggagaggcaacaucc

SEQ ID NO: 2534712 - RNA, 21 nt, Human
gugugaccacugcagaagaca

SEQ ID NO: 2534713 - RNA, 15 nt, Human
gugugacaucagugg

SEQ ID NO: 2534714 - RNA, 15 nt, Human
gugugaaugaacacu

SEQ ID NO: 2534715 - RNA, 20 nt, Human
gugugacaucaguggcaugg

SEQ ID NO: 2534716 - RNA, 22 nt, Human
gugugacaaggauugcuacugu

SEQ ID NO: 2534717 - RNA, 14 nt, Human
gugugaaugaacac

SEQ ID NO: 2534718 - RNA, 13 nt, Human
gugugaaugaaca

SEQ ID NO: 2534719 - RNA, 19 nt, Human
guguccaaaggaagacgug

SEQ ID NO: 2534720 - RNA, 17 nt, Human
guguccaagugugugug

SEQ ID NO: 2534721 - RNA, 19 nt, Human
gugucaggcugcuggcgcc

SEQ ID NO: 2534722 - RNA, 16 nt, Human
gugucaggcugcuggc

SEQ ID NO: 2534723 - RNA, 22 nt, Human
gugucaggcugcuggcgccucu

SEQ ID NO: 2534724 - RNA, 23 nt, Human
gugucauauauggggggccaaca

SEQ ID NO: 2534725 - RNA, 18 nt, Human
gugucauaccaggccgcc

SEQ ID NO: 2534726 - RNA, 15 nt, Human
gugucaggcugcugg

SEQ ID NO: 2534727 - RNA, 14 nt, Human
gugucaggcugcug

SEQ ID NO: 2534728 - RNA, 20 nt, Human
gugucagguggggcagcuug

SEQ ID NO: 2534729 - RNA, 16 nt, Human
gugucaucagaagaua

SEQ ID NO: 2534730 - RNA, 21 nt, Human
gugucaugauucacccccaaa

SEQ ID NO: 2534731 - RNA, 18 nt, Human
gugucauuuaugaaaaga

SEQ ID NO: 2534732 - RNA, 13 nt, Human
guguccaaagcag

SEQ ID NO: 2534733 - RNA, 20 nt, Human
gugugucacccuuaggccag

SEQ ID NO: 2534734 - RNA, 18 nt, Human
guguguccaaaacugccu

SEQ ID NO: 2534735 - RNA, 20 nt, Human
gugugugaaaaugugugugu

SEQ ID NO: 2534736 - RNA, 13 nt, Human
guguguauguggg

SEQ ID NO: 2534737 - RNA, 15 nt, Human
guguguauguggggg

SEQ ID NO: 2534738 - RNA, 13 nt, Human
guguguaugugua

SEQ ID NO: 2534739 - RNA, 11 nt, Human
guguguauuaa

SEQ ID NO: 2534740 - RNA, 20 nt, Human
guguguauuaaaaaaaacaa

SEQ ID NO: 2534741 - RNA, 14 nt, Human
guguguauuaaaaa

SEQ ID NO: 2534742 - RNA, 15 nt, Human
guguguauuguuccc

SEQ ID NO: 2534743 - RNA, 16 nt, Human
gugugguagagugugc

SEQ ID NO: 2534744 - RNA, 16 nt, Human
guguggguaccuguau

SEQ ID NO: 2534745 - RNA, 14 nt, Human
gugugggucugugu

SEQ ID NO: 2534746 - RNA, 16 nt, Human
gugugggggcugcagc

SEQ ID NO: 2534747 - RNA, 17 nt, Human
guguggguaccuguauu

SEQ ID NO: 2534748 - RNA, 17 nt, Human
guguauuuuuuuacuaa

SEQ ID NO: 2534749 - RNA, 23 nt, Human
guguauuuuuuuacuaauagaca

SEQ ID NO: 2534750 - RNA, 20 nt, Human
gugucaagagggucugagga

SEQ ID NO: 2534751 - RNA, 19 nt, Human
gugucaaauaaacacugug

SEQ ID NO: 2534752 - RNA, 16 nt, Human
gugucaaauaaacacu

SEQ ID NO: 2534753 - RNA, 23 nt, Human
guguauuuuucaauaaagcauuu

SEQ ID NO: 2534754 - RNA, 23 nt, Human
guguauuuguauuuuuuugcaag

SEQ ID NO: 2534755 - RNA, 19 nt, Human
gugucacuggcugccucca

SEQ ID NO: 2534756 - RNA, 18 nt, Human
gugucacuggcugccucc

SEQ ID NO: 2534757 - RNA, 17 nt, Human
gugucacuggcugccuc

SEQ ID NO: 2534758 - RNA, 16 nt, Human
gugucacuggcugccu

SEQ ID NO: 2534759 - RNA, 15 nt, Human
gugucacuggcugcc

SEQ ID NO: 2534760 - RNA, 14 nt, Human
gugucacuggcugc

SEQ ID NO: 2534761 - RNA, 13 nt, Human
gugucacuggcug

SEQ ID NO: 2534762 - RNA, 15 nt, Human
gugucaacuucaaca

SEQ ID NO: 2534763 - RNA, 17 nt, Human
gugucaaauaaacacug

SEQ ID NO: 2534764 - RNA, 16 nt, Human
gugucagcauagaagu

SEQ ID NO: 2534765 - RNA, 19 nt, Human
gugucacuuacuguuucug

SEQ ID NO: 2534766 - RNA, 17 nt, Human
gugucacuuacuguuuc

SEQ ID NO: 2534767 - RNA, 23 nt, Human
gugucacuggcugccuccacucc

SEQ ID NO: 2534768 - RNA, 19 nt, Human
guguauuuauuuuccuccc

SEQ ID NO: 2534769 - RNA, 21 nt, Human
guguauuuauuuuccucccca

SEQ ID NO: 2534770 - RNA, 19 nt, Human
guguauuuccagugcaauu

SEQ ID NO: 2534771 - RNA, 14 nt, Human
guguauuugcuuuu

SEQ ID NO: 2534772 - RNA, 22 nt, Human
guguauuuauuuuccuccccag

SEQ ID NO: 2534773 - RNA, 14 nt, Human
aagaugggugggga

SEQ ID NO: 2534774 - RNA, 16 nt, Human
aagaugguauauuugg

SEQ ID NO: 2534775 - RNA, 21 nt, Human
guguauuuacgcuuugauuca

SEQ ID NO: 2534776 - RNA, 17 nt, Human
guguauuuacgcuuuga

SEQ ID NO: 2534777 - RNA, 19 nt, Human
aagauggggucuguaaaau

SEQ ID NO: 2534778 - RNA, 18 nt, Human
aagauggggucuguaaaa

SEQ ID NO: 2534779 - RNA, 17 nt, Human
aagauggggucuguaaa

SEQ ID NO: 2534780 - RNA, 15 nt, Human
aagauggggucugua

SEQ ID NO: 2534781 - RNA, 17 nt, Human
aagaugggggcaagaag

SEQ ID NO: 2534782 - RNA, 13 nt, Human
aagauguagagga

SEQ ID NO: 2534783 - RNA, 21 nt, Human
aagauggggucuguaaaaucu

SEQ ID NO: 2534784 - RNA, 20 nt, Human
aagauggggucuguaaaauc

SEQ ID NO: 2534785 - RNA, 22 nt, Human
aagauggggucuguaaaaucuu

SEQ ID NO: 2534786 - RNA, 15 nt, Human
aagacgccugagcuc

SEQ ID NO: 2534787 - RNA, 14 nt, Human
aagacgccugagcu

SEQ ID NO: 2534788 - RNA, 22 nt, Human
aagacgugauuuugcuguagaa

SEQ ID NO: 2534789 - RNA, 16 nt, Human
aagacgugauuuugcu

SEQ ID NO: 2534790 - RNA, 23 nt, Human
aagacgugauuuugcuguagaag

SEQ ID NO: 2534791 - RNA, 16 nt, Human
aagacguguuuguguu

SEQ ID NO: 2534792 - RNA, 15 nt, Human
aagacguguuugugu

SEQ ID NO: 2534793 - RNA, 19 nt, Human
aagacuaauuuaaaaaaua

SEQ ID NO: 2534794 - RNA, 16 nt, Human
aagacuaauuuaaaaa

SEQ ID NO: 2534795 - RNA, 18 nt, Human
aagacgucccuuuuuucu

SEQ ID NO: 2534796 - RNA, 23 nt, Human
aagacguguuuguguuugugugu

SEQ ID NO: 2534797 - RNA, 17 nt, Human
aagacugcauuauauuu

SEQ ID NO: 2534798 - RNA, 16 nt, Human
aagacugcacaucaaa

SEQ ID NO: 2534799 - RNA, 23 nt, Human
aagacugaguacguugugcauuu

SEQ ID NO: 2534800 - RNA, 20 nt, Human
aagacuagaggcuugcauaa

SEQ ID NO: 2534801 - RNA, 22 nt, Human
aagacugaguacguugugcauu

SEQ ID NO: 2534802 - RNA, 19 nt, Human
aagacuuggcaacagaagc

SEQ ID NO: 2534803 - RNA, 18 nt, Human
aagacuuggcaacagaag

SEQ ID NO: 2534804 - RNA, 20 nt, Human
aagacuuggcaacagaagca

SEQ ID NO: 2534805 - RNA, 17 nt, Human
aagacuuggcaacagaa

SEQ ID NO: 2534806 - RNA, 16 nt, Human
aagacuuuggaaagac

SEQ ID NO: 2534807 - RNA, 22 nt, Human
aagacuucaguauguugucaaa

SEQ ID NO: 2534808 - RNA, 21 nt, Human
aagacuucaguauguugucaa

SEQ ID NO: 2534809 - RNA, 16 nt, Human
aagacuuggcaacaga

SEQ ID NO: 2534810 - RNA, 19 nt, Human
aagagcagccuguggcauc

SEQ ID NO: 2534811 - RNA, 17 nt, Human
aagagcagccuguggca

SEQ ID NO: 2534812 - RNA, 18 nt, Human
aagagcagccuguggcau

SEQ ID NO: 2534813 - RNA, 13 nt, Human
aagagcagccugu

SEQ ID NO: 2534814 - RNA, 12 nt, Human
aagacuuguuuu

SEQ ID NO: 2534815 - RNA, 14 nt, Human
aagagcagccugug

SEQ ID NO: 2534816 - RNA, 16 nt, Human
aagagcagccuguggc

SEQ ID NO: 2534817 - RNA, 23 nt, Human
aagagcaggcacauggaggagcu

SEQ ID NO: 2534818 - RNA, 20 nt, Human
aagacuucaguauguuguca

SEQ ID NO: 2534819 - RNA, 19 nt, Human
aagaccuucuccuucaccu

SEQ ID NO: 2534820 - RNA, 18 nt, Human
aagaccuucuccuucacc

SEQ ID NO: 2534821 - RNA, 15 nt, Human
aagaccuucuccuuc

SEQ ID NO: 2534822 - RNA, 20 nt, Human
aacuugcugcaguaugaaaa

SEQ ID NO: 2534823 - RNA, 22 nt, Human
aacuugcugcaguaugaaaaua

SEQ ID NO: 2534824 - RNA, 21 nt, Human
aacuugcauccaacuccagga

SEQ ID NO: 2534825 - RNA, 15 nt, Human
aacuugcauggagca

SEQ ID NO: 2534826 - RNA, 20 nt, Human
aacuugagggcccagagcag

SEQ ID NO: 2534827 - RNA, 14 nt, Human
gugccuuaccuccu

SEQ ID NO: 2534828 - RNA, 15 nt, Human
gugccuuaccuccug

SEQ ID NO: 2534829 - RNA, 17 nt, Human
gugccuuaccuccugcc

SEQ ID NO: 2534830 - RNA, 18 nt, Human
gugccuuaccuccugccc

SEQ ID NO: 2534831 - RNA, 22 nt, Human
aacuugaggguaauaaacuuag

SEQ ID NO: 2534832 - RNA, 19 nt, Human
aacuugaggguaauaaacu

SEQ ID NO: 2534833 - RNA, 16 nt, Human
aacuugaggguaauaa

SEQ ID NO: 2534834 - RNA, 19 nt, Human
gugccuuaccuccugccca

SEQ ID NO: 2534835 - RNA, 20 nt, Human
gugccuuaccuccugcccag

SEQ ID NO: 2534836 - RNA, 22 nt, Human
aacuugagggcccagagcagga

SEQ ID NO: 2534837 - RNA, 21 nt, Human
gugccuuaccuccugcccagg

SEQ ID NO: 2534838 - RNA, 19 nt, Human
aagacgcugugcugcccug

SEQ ID NO: 2534839 - RNA, 18 nt, Human
aagacgcugugcugcccu

SEQ ID NO: 2534840 - RNA, 17 nt, Human
aagacgcugugcugccc

SEQ ID NO: 2534841 - RNA, 15 nt, Human
aagacgcugugcugc

SEQ ID NO: 2534842 - RNA, 23 nt, Human
aagaccuugcuuaugauugcaga

SEQ ID NO: 2534843 - RNA, 21 nt, Human
aagaccuuuggagcaaagcug

SEQ ID NO: 2534844 - RNA, 18 nt, Human
aagaccuuguguguaugu

SEQ ID NO: 2534845 - RNA, 20 nt, Human
aagaccuucuccccauucug

SEQ ID NO: 2534846 - RNA, 13 nt, Human
aagacgcugugcu

SEQ ID NO: 2534847 - RNA, 21 nt, Human
aagacgaggcccucgggccca

SEQ ID NO: 2534848 - RNA, 22 nt, Human
aagaccuuguguguauguguac

SEQ ID NO: 2534849 - RNA, 17 nt, Human
gugggaagggcuacacc

SEQ ID NO: 2534850 - RNA, 14 nt, Human
guggggccagguca

SEQ ID NO: 2534851 - RNA, 17 nt, Human
guggggccgccgccucu

SEQ ID NO: 2534852 - RNA, 14 nt, Human
gugggaagggagag

SEQ ID NO: 2534853 - RNA, 18 nt, Human
gugggagcugccuguuca

SEQ ID NO: 2534854 - RNA, 15 nt, Human
gugggagcugccugu

SEQ ID NO: 2534855 - RNA, 17 nt, Human
guggggcucgccaugcc

SEQ ID NO: 2534856 - RNA, 13 nt, Human
guggggccuuggu

SEQ ID NO: 2534857 - RNA, 15 nt, Human
guggggccuagaucc

SEQ ID NO: 2534858 - RNA, 12 nt, Human
guggggcugcuc

SEQ ID NO: 2534859 - RNA, 14 nt, Human
guggggcugcuccu

SEQ ID NO: 2534860 - RNA, 16 nt, Human
guggggcugcuccucc

SEQ ID NO: 2534861 - RNA, 17 nt, Human
guggggcugcuccucca

SEQ ID NO: 2534862 - RNA, 20 nt, Human
guggggcugguagcucaggu

SEQ ID NO: 2534863 - RNA, 15 nt, Human
guggggucacucugg

SEQ ID NO: 2534864 - RNA, 20 nt, Human
gugggggagagcaggcuggc

SEQ ID NO: 2534865 - RNA, 22 nt, Human
gugggggaagagcacagcccuc

SEQ ID NO: 2534866 - RNA, 21 nt, Human
gugggggaagagcacagcccu

SEQ ID NO: 2534867 - RNA, 19 nt, Human
gugggggaagagcacagcc

SEQ ID NO: 2534868 - RNA, 12 nt, Human
guggggcuuggg

SEQ ID NO: 2534869 - RNA, 17 nt, Human
gugggggaagaccuggc

SEQ ID NO: 2534870 - RNA, 18 nt, Human
guggggcugcuccuccag

SEQ ID NO: 2534871 - RNA, 15 nt, Human
gugggacacccugug

SEQ ID NO: 2534872 - RNA, 14 nt, Human
gugggagcugccug

SEQ ID NO: 2534873 - RNA, 13 nt, Human
gugggacacccug

SEQ ID NO: 2534874 - RNA, 17 nt, Human
gugggaagcgucugucc

SEQ ID NO: 2534875 - RNA, 13 nt, Human
gugggaaggccag

SEQ ID NO: 2534876 - RNA, 14 nt, Human
gugggaaggccagc

SEQ ID NO: 2534877 - RNA, 13 nt, Human
gugggaagggaga

SEQ ID NO: 2534878 - RNA, 20 nt, Human
guggccuuccccagccucuu

SEQ ID NO: 2534879 - RNA, 22 nt, Human
guggcgcagcauauucaggaag

SEQ ID NO: 2534880 - RNA, 20 nt, Human
guggcgacucuauagacucu

SEQ ID NO: 2534881 - RNA, 19 nt, Human
guggccugugucccaugac

SEQ ID NO: 2534882 - RNA, 17 nt, Human
guggccugugucccaug

SEQ ID NO: 2534883 - RNA, 12 nt, Human
guggccuucccc

SEQ ID NO: 2534884 - RNA, 17 nt, Human
guggccuuccccagccu

SEQ ID NO: 2534885 - RNA, 15 nt, Human
guggccuuccccagc

SEQ ID NO: 2534886 - RNA, 19 nt, Human
guggccuuccccagccucu

SEQ ID NO: 2534887 - RNA, 16 nt, Human
guggccuguggccugu

SEQ ID NO: 2534888 - RNA, 15 nt, Human
guggccuguggccug

SEQ ID NO: 2534889 - RNA, 15 nt, Human
guggccugggccucc

SEQ ID NO: 2534890 - RNA, 12 nt, Human
guggccugggcc

SEQ ID NO: 2534891 - RNA, 21 nt, Human
guggccuggccaggagcucuu

SEQ ID NO: 2534892 - RNA, 12 nt, Human
guggccugggca

SEQ ID NO: 2534893 - RNA, 14 nt, Human
guggccugggcaag

SEQ ID NO: 2534894 - RNA, 21 nt, Human
guggccucuugagcaguggcu

SEQ ID NO: 2534895 - RNA, 13 nt, Human
guggccucuuugu

SEQ ID NO: 2534896 - RNA, 16 nt, Human
guggccucuuugucua

SEQ ID NO: 2534897 - RNA, 19 nt, Human
guggccucuuugucuaaaa

SEQ ID NO: 2534898 - RNA, 12 nt, Human
guggccuggcca

SEQ ID NO: 2534899 - RNA, 13 nt, Human
guggccuggccag

SEQ ID NO: 2534900 - RNA, 16 nt, Human
guggccuggccaggag

SEQ ID NO: 2534901 - RNA, 18 nt, Human
guggccuggccaggagcu

SEQ ID NO: 2534902 - RNA, 20 nt, Human
guggccuggccaggagcucu

SEQ ID NO: 2534903 - RNA, 22 nt, Human
guggccucccaacucaccccag

SEQ ID NO: 2534904 - RNA, 21 nt, Human
guggccucccaacucacccca

SEQ ID NO: 2534905 - RNA, 22 nt, Human
guggccucuccuuguggccugg

SEQ ID NO: 2534906 - RNA, 21 nt, Human
guggccucuccuuguggccug

SEQ ID NO: 2534907 - RNA, 22 nt, Human
guggccucgggacaccugcccu

SEQ ID NO: 2534908 - RNA, 19 nt, Human
guggccucaacccucccuc

SEQ ID NO: 2534909 - RNA, 20 nt, Human
guggccucuugagcaguggc

SEQ ID NO: 2534910 - RNA, 17 nt, Human
guggccucuugagcagu

SEQ ID NO: 2534911 - RNA, 23 nt, Human
guggccucuccuuguggccuggg

SEQ ID NO: 2534912 - RNA, 20 nt, Human
guggccucugccccgucuca

SEQ ID NO: 2534913 - RNA, 13 nt, Human
guggccucugugg

SEQ ID NO: 2534914 - RNA, 24 nt, Human
guggccucugccccgucucaugag

SEQ ID NO: 2534915 - RNA, 11 nt, Human
guggcccuugc

SEQ ID NO: 2534916 - RNA, 23 nt, Human
guggcccugucccucccaccucu

SEQ ID NO: 2534917 - RNA, 22 nt, Human
guggcccugucccucccaccuc

SEQ ID NO: 2534918 - RNA, 14 nt, Human
aagaggcaagaggc

SEQ ID NO: 2534919 - RNA, 9 nt, Human
guggccuca

SEQ ID NO: 2534920 - RNA, 17 nt, Human
guggccgcccaaggccc

SEQ ID NO: 2534921 - RNA, 22 nt, Human
aagaggagagaggaagcucucu

SEQ ID NO: 2534922 - RNA, 22 nt, Human
aagaggacauaaugggguccug

SEQ ID NO: 2534923 - RNA, 20 nt, Human
aagaggaguuucgagguaga

SEQ ID NO: 2534924 - RNA, 16 nt, Human
aagaggaucggaggcu

SEQ ID NO: 2534925 - RNA, 21 nt, Human
aagaggaguuucgagguagag

SEQ ID NO: 2534926 - RNA, 23 nt, Human
aagaggaaugaaguacucauaca

SEQ ID NO: 2534927 - RNA, 20 nt, Human
aagagccauauaaguuugaa

SEQ ID NO: 2534928 - RNA, 19 nt, Human
aagagccauauaaguuuga

SEQ ID NO: 2534929 - RNA, 9 nt, Human
aagagccau

SEQ ID NO: 2534930 - RNA, 17 nt, Human
aagccaaaccucuguga

SEQ ID NO: 2534931 - RNA, 14 nt, Human
aagccaaacucugc

SEQ ID NO: 2534932 - RNA, 15 nt, Human
aagccaaacucugcc

SEQ ID NO: 2534933 - RNA, 16 nt, Human
aagccaaacucugcca

SEQ ID NO: 2534934 - RNA, 12 nt, Human
aagccaaagaaa

SEQ ID NO: 2534935 - RNA, 20 nt, Human
aagccaaacucugccagcca

SEQ ID NO: 2534936 - RNA, 13 nt, Human
aagccaaagaaaa

SEQ ID NO: 2534937 - RNA, 11 nt, Human
aagccaaagaa

SEQ ID NO: 2534938 - RNA, 21 nt, Human
aagccaaagaaaaauaacccu

SEQ ID NO: 2534939 - RNA, 22 nt, Human
aagccaaagcuaggccuggcca

SEQ ID NO: 2534940 - RNA, 17 nt, Human
aagcccaggaaaggcuc

SEQ ID NO: 2534941 - RNA, 14 nt, Human
aagcccaggaaagg

SEQ ID NO: 2534942 - RNA, 18 nt, Human
aagccaagaggcugcagc

SEQ ID NO: 2534943 - RNA, 22 nt, Human
aagccaagaggcugcagccagg

SEQ ID NO: 2534944 - RNA, 16 nt, Human
aagccaacacccuguc

SEQ ID NO: 2534945 - RNA, 15 nt, Human
aagccaaagaaaaau

SEQ ID NO: 2534946 - RNA, 16 nt, Human
aagccaacgacaaagc

SEQ ID NO: 2534947 - RNA, 17 nt, Human
aagccaacuuguaaaua

SEQ ID NO: 2534948 - RNA, 16 nt, Human
aagccaacuuguaaau

SEQ ID NO: 2534949 - RNA, 22 nt, Human
aagccaacuuggcuuucccgga

SEQ ID NO: 2534950 - RNA, 17 nt, Human
aagccaacagucaaaac

SEQ ID NO: 2534951 - RNA, 18 nt, Human
aagcccaguucagcuugg

SEQ ID NO: 2534952 - RNA, 19 nt, Human
aagcccaguucagcuuggg

SEQ ID NO: 2534953 - RNA, 19 nt, Human
aagccaacuuguaaauaca

SEQ ID NO: 2534954 - RNA, 22 nt, Human
aagcccaggaaaggcuccagga

SEQ ID NO: 2534955 - RNA, 19 nt, Human
aagcccaggaaaggcucca

SEQ ID NO: 2534956 - RNA, 22 nt, Human
aagcccaugaguccuugaaaau

SEQ ID NO: 2534957 - RNA, 23 nt, Human
aagcccauucauuccauucugga

SEQ ID NO: 2534958 - RNA, 14 nt, Human
aagccccagcaagc

SEQ ID NO: 2534959 - RNA, 12 nt, Human
aagccccaggca

SEQ ID NO: 2534960 - RNA, 14 nt, Human
aagccccaggcagg

SEQ ID NO: 2534961 - RNA, 17 nt, Human
aagccccaggcaggcug

SEQ ID NO: 2534962 - RNA, 21 nt, Human
aagccccaggcaggcugugcg

SEQ ID NO: 2534963 - RNA, 17 nt, Human
aagccccaugcuggagc

SEQ ID NO: 2534964 - RNA, 16 nt, Human
aagccccaugcuggag

SEQ ID NO: 2534965 - RNA, 20 nt, Human
aagcccaugaguccuugaaa

SEQ ID NO: 2534966 - RNA, 19 nt, Human
aagcccaugaguccuugaa

SEQ ID NO: 2534967 - RNA, 16 nt, Human
aagcccauucauucca

SEQ ID NO: 2534968 - RNA, 21 nt, Human
aagcccauucauuccauucug

SEQ ID NO: 2534969 - RNA, 14 nt, Human
aagcccaggccccu

SEQ ID NO: 2534970 - RNA, 22 nt, Human
aagcccaucaauuauagaaagc

SEQ ID NO: 2534971 - RNA, 20 nt, Human
aagcccugucgagacacuug

SEQ ID NO: 2534972 - RNA, 19 nt, Human
aagcccugucgagacacuu

SEQ ID NO: 2534973 - RNA, 18 nt, Human
aagcccugucgagacacu

SEQ ID NO: 2534974 - RNA, 23 nt, Human
aagcccuggagccaacugcugcu

SEQ ID NO: 2534975 - RNA, 22 nt, Human
aagcccuguugacacaggucuu

SEQ ID NO: 2534976 - RNA, 20 nt, Human
aagcccuuccaugucgccuc

SEQ ID NO: 2534977 - RNA, 15 nt, Human
aagcccuuccauguc

SEQ ID NO: 2534978 - RNA, 20 nt, Human
aagccgcuggggccaguugg

SEQ ID NO: 2534979 - RNA, 23 nt, Human
aagcccuuccaugucgccucugc

SEQ ID NO: 2534980 - RNA, 13 nt, Human
aagccgcugcugg

SEQ ID NO: 2534981 - RNA, 21 nt, Human
guuaagaagcuguuguacauu

SEQ ID NO: 2534982 - RNA, 14 nt, Human
guuaagaccuggca

SEQ ID NO: 2534983 - RNA, 16 nt, Human
guuaagaccuggcagc

SEQ ID NO: 2534984 - RNA, 17 nt, Human
guuaagacaugauuucc

SEQ ID NO: 2534985 - RNA, 19 nt, Human
guuaagacaugauuuccuu

SEQ ID NO: 2534986 - RNA, 22 nt, Human
guuaagacaugauuuccuugaa

SEQ ID NO: 2534987 - RNA, 13 nt, Human
guuaagaccuggc

SEQ ID NO: 2534988 - RNA, 17 nt, Human
guuaagaagcuguugua

SEQ ID NO: 2534989 - RNA, 15 nt, Human
guuaagaagcuguug

SEQ ID NO: 2534990 - RNA, 13 nt, Human
guuaagaagcugu

SEQ ID NO: 2534991 - RNA, 20 nt, Human
guuaagaagcuguuguacau

SEQ ID NO: 2534992 - RNA, 19 nt, Human
guuaagaagcuguuguaca

SEQ ID NO: 2534993 - RNA, 18 nt, Human
guuaagacaaacugcaua

SEQ ID NO: 2534994 - RNA, 14 nt, Human
aagccggcggccca

SEQ ID NO: 2534995 - RNA, 13 nt, Human
aagccggcggccc

SEQ ID NO: 2534996 - RNA, 12 nt, Human
aagccggcggcc

SEQ ID NO: 2534997 - RNA, 19 nt, Human
aagccggcggcccaagccc

SEQ ID NO: 2534998 - RNA, 14 nt, Human
aagccgggaacaga

SEQ ID NO: 2534999 - RNA, 21 nt, Human
aagccccaugcuggagccugu

SEQ ID NO: 2535000 - RNA, 20 nt, Human
aagccccaugcuggagccug

SEQ ID NO: 2535001 - RNA, 19 nt, Human
aagccccaugcuggagccu

SEQ ID NO: 2535002 - RNA, 18 nt, Human
aagccccaugcuggagcc

SEQ ID NO: 2535003 - RNA, 23 nt, Human
aagccccaugcuggagccugugu

SEQ ID NO: 2535004 - RNA, 22 nt, Human
aagccccaugcuggagccugug

SEQ ID NO: 2535005 - RNA, 14 nt, Human
aagcccccaccgug

SEQ ID NO: 2535006 - RNA, 20 nt, Human
aagcccccaccgugggcagg

SEQ ID NO: 2535007 - RNA, 16 nt, Human
aagcccccagcuaaga

SEQ ID NO: 2535008 - RNA, 21 nt, Human
aagcccccagcuaagaaccug

SEQ ID NO: 2535009 - RNA, 23 nt, Human
aagcccccagcuaagaaccugga

SEQ ID NO: 2535010 - RNA, 15 nt, Human
aagcccgacuugcug

SEQ ID NO: 2535011 - RNA, 21 nt, Human
aagccccuugcucuccccugc

SEQ ID NO: 2535012 - RNA, 17 nt, Human
aagccccugcccaucug

SEQ ID NO: 2535013 - RNA, 16 nt, Human
aagcccccccuuccac

SEQ ID NO: 2535014 - RNA, 17 nt, Human
aagcccgacuugcuguu

SEQ ID NO: 2535015 - RNA, 9 nt, Human
aagcccucc

SEQ ID NO: 2535016 - RNA, 11 nt, Human
aagcccuccuu

SEQ ID NO: 2535017 - RNA, 12 nt, Human
aagcccuccuuc

SEQ ID NO: 2535018 - RNA, 13 nt, Human
aagcccuccuucc

SEQ ID NO: 2535019 - RNA, 14 nt, Human
aagcccuccuucca

SEQ ID NO: 2535020 - RNA, 16 nt, Human
aagcccucuuccauca

SEQ ID NO: 2535021 - RNA, 14 nt, Human
aagcccucuuccau

SEQ ID NO: 2535022 - RNA, 13 nt, Human
aagcccucuucca

SEQ ID NO: 2535023 - RNA, 15 nt, Human
aagcccuccuuccac

SEQ ID NO: 2535024 - RNA, 19 nt, Human
aagcccugagcuuucugcu

SEQ ID NO: 2535025 - RNA, 21 nt, Human
aagcccucuuccaucaugucc

SEQ ID NO: 2535026 - RNA, 18 nt, Human
aagcccucuuccaucaug

SEQ ID NO: 2535027 - RNA, 23 nt, Human
aagcccugauuguguauauucau

SEQ ID NO: 2535028 - RNA, 19 nt, Human
aagcccuggagccaacugc

SEQ ID NO: 2535029 - RNA, 12 nt, Human
aagcccugaggg

SEQ ID NO: 2535030 - RNA, 19 nt, Human
aagcccugggaucacugug

SEQ ID NO: 2535031 - RNA, 18 nt, Human
aagcaucggagggaauug

SEQ ID NO: 2535032 - RNA, 17 nt, Human
aagcauccaugugugga

SEQ ID NO: 2535033 - RNA, 19 nt, Human
aagcauccauguguggacu

SEQ ID NO: 2535034 - RNA, 20 nt, Human
aagcauccauguguggacuc

SEQ ID NO: 2535035 - RNA, 21 nt, Human
aagcauccauguguggacuca

SEQ ID NO: 2535036 - RNA, 19 nt, Human
aagcauuaccacucaggca

SEQ ID NO: 2535037 - RNA, 18 nt, Human
aagcauuaccacucaggc

SEQ ID NO: 2535038 - RNA, 18 nt, Human
aagcauuacauuuccaaa

SEQ ID NO: 2535039 - RNA, 18 nt, Human
aagcauuaagaacacuuu

SEQ ID NO: 2535040 - RNA, 18 nt, Human
aagcauuaacuucucugg

SEQ ID NO: 2535041 - RNA, 21 nt, Human
aagcauuccuucuuugauaau

SEQ ID NO: 2535042 - RNA, 20 nt, Human
aagcauuccuucuuugauaa

SEQ ID NO: 2535043 - RNA, 18 nt, Human
aagcauuccuucuuugau

SEQ ID NO: 2535044 - RNA, 17 nt, Human
aagcauuccuucuuuga

SEQ ID NO: 2535045 - RNA, 16 nt, Human
aagcauuccuucuuug

SEQ ID NO: 2535046 - RNA, 14 nt, Human
aagcauuccuucuu

SEQ ID NO: 2535047 - RNA, 13 nt, Human
aagcauuccuucu

SEQ ID NO: 2535048 - RNA, 17 nt, Human
aagcauuccaacaaagg

SEQ ID NO: 2535049 - RNA, 23 nt, Human
aagcauuccuucuuugauaaugu

SEQ ID NO: 2535050 - RNA, 22 nt, Human
aagcauuccuucuuugauaaug

SEQ ID NO: 2535051 - RNA, 14 nt, Human
aagcauuccaacaa

SEQ ID NO: 2535052 - RNA, 13 nt, Human
aagcauuccaaca

SEQ ID NO: 2535053 - RNA, 17 nt, Human
aagcauucagagagcag

SEQ ID NO: 2535054 - RNA, 15 nt, Human
aagcauucagagagc

SEQ ID NO: 2535055 - RNA, 13 nt, Human
aagcauucacaac

SEQ ID NO: 2535056 - RNA, 12 nt, Human
aagcauucacaa

SEQ ID NO: 2535057 - RNA, 22 nt, Human
aagcauucaauuuauucaagaa

SEQ ID NO: 2535058 - RNA, 23 nt, Human
aagcauucaauuuauucaagaaa

SEQ ID NO: 2535059 - RNA, 21 nt, Human
aagcauucaauuuauucaaga

SEQ ID NO: 2535060 - RNA, 13 nt, Human
aagcauucugucu

SEQ ID NO: 2535061 - RNA, 13 nt, Human
aagcauuguaaau

SEQ ID NO: 2535062 - RNA, 16 nt, Human
aagcauuuagauguau

SEQ ID NO: 2535063 - RNA, 16 nt, Human
aagcauuuacuuugug

SEQ ID NO: 2535064 - RNA, 16 nt, Human
aagcauuugaaugcau

SEQ ID NO: 2535065 - RNA, 15 nt, Human
aagcauuugaaugca

SEQ ID NO: 2535066 - RNA, 14 nt, Human
aagcauuugaaugc

SEQ ID NO: 2535067 - RNA, 13 nt, Human
aagcauuugaaug

SEQ ID NO: 2535068 - RNA, 12 nt, Human
aagcauuugaau

SEQ ID NO: 2535069 - RNA, 12 nt, Human
aagcauuuauaa

SEQ ID NO: 2535070 - RNA, 22 nt, Human
aagcauuggguggguaaauuca

SEQ ID NO: 2535071 - RNA, 15 nt, Human
aagcaguugugucag

SEQ ID NO: 2535072 - RNA, 17 nt, Human
aagcaguggacaccagg

SEQ ID NO: 2535073 - RNA, 17 nt, Human
aagcagugccuuccaua

SEQ ID NO: 2535074 - RNA, 18 nt, Human
aagcagugccuuccauaa

SEQ ID NO: 2535075 - RNA, 15 nt, Human
aagcagugcuucuca

SEQ ID NO: 2535076 - RNA, 20 nt, Human
aagcagugccuuccauaauu

SEQ ID NO: 2535077 - RNA, 22 nt, Human
aagcaucauuauuugcagagac

SEQ ID NO: 2535078 - RNA, 14 nt, Human
aagcauccaugugu

SEQ ID NO: 2535079 - RNA, 12 nt, Human
aagcauccaugu

SEQ ID NO: 2535080 - RNA, 22 nt, Human
aagcauaaaugcaaacacacaa

SEQ ID NO: 2535081 - RNA, 15 nt, Human
aagcagugcaugcug

SEQ ID NO: 2535082 - RNA, 14 nt, Human
aagcagugcaugcu

SEQ ID NO: 2535083 - RNA, 20 nt, Human
aagcagugcaugcugucccu

SEQ ID NO: 2535084 - RNA, 15 nt, Human
aagcagugccuucca

SEQ ID NO: 2535085 - RNA, 18 nt, Human
aagcagucuacccaccuc

SEQ ID NO: 2535086 - RNA, 19 nt, Human
aagcagucuacccaccuca

SEQ ID NO: 2535087 - RNA, 12 nt, Human
aagcagugcaug

SEQ ID NO: 2535088 - RNA, 19 nt, Human
aagcagucgugccuguguc

SEQ ID NO: 2535089 - RNA, 18 nt, Human
aagcagucgugccugugu

SEQ ID NO: 2535090 - RNA, 17 nt, Human
aagcagucgugccugug

SEQ ID NO: 2535091 - RNA, 22 nt, Human
aagcaguagaaauaauaugcau

SEQ ID NO: 2535092 - RNA, 21 nt, Human
aagcaguagaaauaauaugca

SEQ ID NO: 2535093 - RNA, 14 nt, Human
aagcaguagacaag

SEQ ID NO: 2535094 - RNA, 20 nt, Human
aagcaguagaaauaauaugc

SEQ ID NO: 2535095 - RNA, 13 nt, Human
aagcaguaacuga

SEQ ID NO: 2535096 - RNA, 16 nt, Human
aagcagguuuuucucc

SEQ ID NO: 2535097 - RNA, 14 nt, Human
gugugugaaaggaa

SEQ ID NO: 2535098 - RNA, 17 nt, Human
gugugugaaugaacacu

SEQ ID NO: 2535099 - RNA, 21 nt, Human
gugugugcgccuacaggagug

SEQ ID NO: 2535100 - RNA, 19 nt, Human
aagcagguucccaagcuca

SEQ ID NO: 2535101 - RNA, 10 nt, Human
gugugugcgu

SEQ ID NO: 2535102 - RNA, 22 nt, Human
aagcagguugaggggcuccugg

SEQ ID NO: 2535103 - RNA, 16 nt, Human
gugugugggagugugu

SEQ ID NO: 2535104 - RNA, 14 nt, Human
aagcuaggaaugaa

SEQ ID NO: 2535105 - RNA, 20 nt, Human
aagcuagcuccccuccucuc

SEQ ID NO: 2535106 - RNA, 19 nt, Human
aagcuagcuccccuccucu

SEQ ID NO: 2535107 - RNA, 18 nt, Human
aagcuagcuccccuccuc

SEQ ID NO: 2535108 - RNA, 15 nt, Human
aagcuagcuccccuc

SEQ ID NO: 2535109 - RNA, 13 nt, Human
aagcuagcucccc

SEQ ID NO: 2535110 - RNA, 12 nt, Human
aagcuagcuccc

SEQ ID NO: 2535111 - RNA, 12 nt, Human
aagccugcaacu

SEQ ID NO: 2535112 - RNA, 14 nt, Human
aagcuagagauaug

SEQ ID NO: 2535113 - RNA, 12 nt, Human
aagcuaggccug

SEQ ID NO: 2535114 - RNA, 22 nt, Human
aagccugcaauuucauaugcug

SEQ ID NO: 2535115 - RNA, 17 nt, Human
aagccugcaauuucaua

SEQ ID NO: 2535116 - RNA, 21 nt, Human
aagccugcacaauaaaaaugu

SEQ ID NO: 2535117 - RNA, 15 nt, Human
aagccugaugcugac

SEQ ID NO: 2535118 - RNA, 22 nt, Human
aagcuagacgagcaggcuucuu

SEQ ID NO: 2535119 - RNA, 20 nt, Human
aagccugaguuugcuuucaa

SEQ ID NO: 2535120 - RNA, 24 nt, Human
aagccugaaggggcgucuguuccc

SEQ ID NO: 2535121 - RNA, 15 nt, Human
aagccugaggcuggg

SEQ ID NO: 2535122 - RNA, 14 nt, Human
aagccuaccugcuc

SEQ ID NO: 2535123 - RNA, 14 nt, Human
aagccuaagaaucu

SEQ ID NO: 2535124 - RNA, 22 nt, Human
aagccuagugaaggcuucucuc

SEQ ID NO: 2535125 - RNA, 21 nt, Human
aagccuaucaaagaccuugug

SEQ ID NO: 2535126 - RNA, 19 nt, Human
aagccuaccugcucuccaa

SEQ ID NO: 2535127 - RNA, 16 nt, Human
aagccuaccugcucuc

SEQ ID NO: 2535128 - RNA, 20 nt, Human
aagccuagaagagcuucuga

SEQ ID NO: 2535129 - RNA, 22 nt, Human
aagccucaacuagucauuuuuu

SEQ ID NO: 2535130 - RNA, 13 nt, Human
aagccucagagaa

SEQ ID NO: 2535131 - RNA, 21 nt, Human
aagccugaaggggcgucuguu

SEQ ID NO: 2535132 - RNA, 16 nt, Human
guucagccccuccucu

SEQ ID NO: 2535133 - RNA, 17 nt, Human
guucagccccuccucug

SEQ ID NO: 2535134 - RNA, 18 nt, Human
guucagccccuccucugc

SEQ ID NO: 2535135 - RNA, 19 nt, Human
guucagccccuccucugcc

SEQ ID NO: 2535136 - RNA, 19 nt, Human
guucagcuaagcuaggaau

SEQ ID NO: 2535137 - RNA, 20 nt, Human
guucagccccuccucugcca

SEQ ID NO: 2535138 - RNA, 21 nt, Human
guucagccccuccucugccac

SEQ ID NO: 2535139 - RNA, 22 nt, Human
guucagccccuccucugccacc

SEQ ID NO: 2535140 - RNA, 23 nt, Human
guucagccccuccucugccaccu

SEQ ID NO: 2535141 - RNA, 13 nt, Human
guucagcuccagc

SEQ ID NO: 2535142 - RNA, 13 nt, Human
guucagcuacucc

SEQ ID NO: 2535143 - RNA, 22 nt, Human
guucagcuaagcuaggaaugaa

SEQ ID NO: 2535144 - RNA, 23 nt, Human
aagccuaaaagugggcuugauuc

SEQ ID NO: 2535145 - RNA, 14 nt, Human
aagcuccagguaga

SEQ ID NO: 2535146 - RNA, 13 nt, Human
aagcuccagguag

SEQ ID NO: 2535147 - RNA, 18 nt, Human
aagcuccaagcucccagg

SEQ ID NO: 2535148 - RNA, 17 nt, Human
aagcuccaagcucccag

SEQ ID NO: 2535149 - RNA, 19 nt, Human
aagcucagggccuggcuca

SEQ ID NO: 2535150 - RNA, 18 nt, Human
aagcucagggccuggcuc

SEQ ID NO: 2535151 - RNA, 23 nt, Human
aagcucauauuuuguauauaucu

SEQ ID NO: 2535152 - RNA, 22 nt, Human
aagcucauauuuuguauauauc

SEQ ID NO: 2535153 - RNA, 21 nt, Human
aagcucauauuuuguauauau

SEQ ID NO: 2535154 - RNA, 20 nt, Human
aagcucauauuuuguauaua

SEQ ID NO: 2535155 - RNA, 12 nt, Human
aagcucauauuu

SEQ ID NO: 2535156 - RNA, 17 nt, Human
aagcucaggaccaggca

SEQ ID NO: 2535157 - RNA, 20 nt, Human
aagcucagggccuggcucag

SEQ ID NO: 2535158 - RNA, 17 nt, Human
aagcucagggccuggcu

SEQ ID NO: 2535159 - RNA, 16 nt, Human
aagcucagggccuggc

SEQ ID NO: 2535160 - RNA, 13 nt, Human
aagcucagggccu

SEQ ID NO: 2535161 - RNA, 12 nt, Human
aagcucagggcc

SEQ ID NO: 2535162 - RNA, 20 nt, Human
aagcucacagaccuuugaac

SEQ ID NO: 2535163 - RNA, 11 nt, Human
aagcucacagu

SEQ ID NO: 2535164 - RNA, 15 nt, Human
aagcucagcccaccc

SEQ ID NO: 2535165 - RNA, 16 nt, Human
aagcucagcccacccc

SEQ ID NO: 2535166 - RNA, 17 nt, Human
aagcucagcuacugauu

SEQ ID NO: 2535167 - RNA, 21 nt, Human
aagcucagcccaccccccuca

SEQ ID NO: 2535168 - RNA, 17 nt, Human
aagcuauuuaucuguag

SEQ ID NO: 2535169 - RNA, 20 nt, Human
guuauuuuuacauucugaau

SEQ ID NO: 2535170 - RNA, 19 nt, Human
guuauuuuuacauucugaa

SEQ ID NO: 2535171 - RNA, 13 nt, Human
guuauuuugcaac

SEQ ID NO: 2535172 - RNA, 16 nt, Human
guuauugacaaacucu

SEQ ID NO: 2535173 - RNA, 23 nt, Human
guuauuuuuauaucagccugagu

SEQ ID NO: 2535174 - RNA, 16 nt, Human
guuauuuuuauaucag

SEQ ID NO: 2535175 - RNA, 16 nt, Human
guuauuuuuuaauuau

SEQ ID NO: 2535176 - RNA, 22 nt, Human
guuauuuuuguuucuuccaaag

SEQ ID NO: 2535177 - RNA, 23 nt, Human
guuauuuuuauuuauuuaaauuu

SEQ ID NO: 2535178 - RNA, 13 nt, Human
guuauucuggagu

SEQ ID NO: 2535179 - RNA, 23 nt, Human
guuagggaaaacauuccauccuu

SEQ ID NO: 2535180 - RNA, 13 nt, Human
guuagggaauggc

SEQ ID NO: 2535181 - RNA, 21 nt, Human
guucaaagauauuuugcuuug

SEQ ID NO: 2535182 - RNA, 22 nt, Human
guucaaagauauuuugcuuugu

SEQ ID NO: 2535183 - RNA, 20 nt, Human
guucaaagauauuuugcuuu

SEQ ID NO: 2535184 - RNA, 21 nt, Human
guuauuuuuuaauuauuauuu

SEQ ID NO: 2535185 - RNA, 14 nt, Human
guucaaaaagucua

SEQ ID NO: 2535186 - RNA, 14 nt, Human
guucaaaaugucug

SEQ ID NO: 2535187 - RNA, 13 nt, Human
guucaaaaugucu

SEQ ID NO: 2535188 - RNA, 15 nt, Human
guucaacuuccagaa

SEQ ID NO: 2535189 - RNA, 19 nt, Human
guucaacuuuuccuuugaa

SEQ ID NO: 2535190 - RNA, 18 nt, Human
guucaagcgauucuucug

SEQ ID NO: 2535191 - RNA, 13 nt, Human
guucaaagccagc

SEQ ID NO: 2535192 - RNA, 12 nt, Human
guucaaagccag

SEQ ID NO: 2535193 - RNA, 12 nt, Human
guuaagagaaau

SEQ ID NO: 2535194 - RNA, 11 nt, Human
guuaagagaaa

SEQ ID NO: 2535195 - RNA, 14 nt, Human
guuaagauuccuaa

SEQ ID NO: 2535196 - RNA, 18 nt, Human
guuaagagaaaugagcuu

SEQ ID NO: 2535197 - RNA, 23 nt, Human
guuacuguugugaccugaaguuc

SEQ ID NO: 2535198 - RNA, 16 nt, Human
guuaagcauuaccacu

SEQ ID NO: 2535199 - RNA, 18 nt, Human
guuaagcauuaccacuca

SEQ ID NO: 2535200 - RNA, 22 nt, Human
guuaagagugggggagagcagg

SEQ ID NO: 2535201 - RNA, 15 nt, Human
guuaagauaugaugu

SEQ ID NO: 2535202 - RNA, 14 nt, Human
guuacuucugaggu

SEQ ID NO: 2535203 - RNA, 16 nt, Human
guuacuucacuuuaau

SEQ ID NO: 2535204 - RNA, 17 nt, Human
guuacuuaccuaaacag

SEQ ID NO: 2535205 - RNA, 23 nt, Human
guuacuucacuuuaauucucaug

SEQ ID NO: 2535206 - RNA, 13 nt, Human
guuacuuccuauc

SEQ ID NO: 2535207 - RNA, 19 nt, Human
guuagaaaugcagaauccu

SEQ ID NO: 2535208 - RNA, 19 nt, Human
guuacuugaaauaccagug

SEQ ID NO: 2535209 - RNA, 16 nt, Human
guuacuugaaauacca

SEQ ID NO: 2535210 - RNA, 20 nt, Human
guuagcuccuguggccccac

SEQ ID NO: 2535211 - RNA, 11 nt, Human
guuagcugagc

SEQ ID NO: 2535212 - RNA, 11 nt, Human
guuagcuggag

SEQ ID NO: 2535213 - RNA, 14 nt, Human
guuaggaaauaaaa

SEQ ID NO: 2535214 - RNA, 16 nt, Human
guuagcuccuguggcc

SEQ ID NO: 2535215 - RNA, 15 nt, Human
guuagaaugaggagg

SEQ ID NO: 2535216 - RNA, 16 nt, Human
guuagaaugaggagga

SEQ ID NO: 2535217 - RNA, 14 nt, Human
guuagaaugaggag

SEQ ID NO: 2535218 - RNA, 16 nt, Human
guuaggaaauaaaacc

SEQ ID NO: 2535219 - RNA, 17 nt, Human
guuaggaaauaaaaccu

SEQ ID NO: 2535220 - RNA, 18 nt, Human
guuaggaaauaaaaccuu

SEQ ID NO: 2535221 - RNA, 19 nt, Human
guuaggaaauaaaaccuuu

SEQ ID NO: 2535222 - RNA, 21 nt, Human
guuaggaaauaaaaccuuuca

SEQ ID NO: 2535223 - RNA, 22 nt, Human
guuaggaaauaaaaccuuucaa

SEQ ID NO: 2535224 - RNA, 23 nt, Human
guuaggaaauaaaaccuuucaaa

SEQ ID NO: 2535225 - RNA, 15 nt, Human
guuaggaguucgaga

SEQ ID NO: 2535226 - RNA, 20 nt, Human
guuaggcauugugggaaggg

SEQ ID NO: 2535227 - RNA, 19 nt, Human
guuaggcauugugggaagg

SEQ ID NO: 2535228 - RNA, 15 nt, Human
guuagggaaaacauu

SEQ ID NO: 2535229 - RNA, 20 nt, Human
guuagggaaaacauuccauc

SEQ ID NO: 2535230 - RNA, 15 nt, Human
guuaggccuggcaca

SEQ ID NO: 2535231 - RNA, 13 nt, Human
guuaggccuggca

SEQ ID NO: 2535232 - RNA, 16 nt, Human
guuaggccuggcacag

SEQ ID NO: 2535233 - RNA, 23 nt, Human
guuaggauuuaacagucauuuaa

SEQ ID NO: 2535234 - RNA, 15 nt, Human
guuaggauuuaacag

SEQ ID NO: 2535235 - RNA, 20 nt, Human
aauacagauuuugauagcaa

SEQ ID NO: 2535236 - RNA, 19 nt, Human
aauacagauuuugauagca

SEQ ID NO: 2535237 - RNA, 21 nt, Human
aauacagacacuaaguuauag

SEQ ID NO: 2535238 - RNA, 20 nt, Human
aauacagacacuaaguuaua

SEQ ID NO: 2535239 - RNA, 18 nt, Human
aauacagcaacaauuuau

SEQ ID NO: 2535240 - RNA, 23 nt, Human
aauacagauuuugauagcaaagc

SEQ ID NO: 2535241 - RNA, 21 nt, Human
aauacagauuuugauagcaaa

SEQ ID NO: 2535242 - RNA, 19 nt, Human
aauacagccaaagauaauc

SEQ ID NO: 2535243 - RNA, 24 nt, Human
aauacagccaaagauaaucucuca

SEQ ID NO: 2535244 - RNA, 17 nt, Human
aauacaugacauuuauu

SEQ ID NO: 2535245 - RNA, 23 nt, Human
aauacaugacauuuauuuuucau

SEQ ID NO: 2535246 - RNA, 13 nt, Human
aauacaugcaucu

SEQ ID NO: 2535247 - RNA, 14 nt, Human
aauacaugcugcua

SEQ ID NO: 2535248 - RNA, 15 nt, Human
aauacauucugcuuu

SEQ ID NO: 2535249 - RNA, 23 nt, Human
aauacaucccuuaccugggaaag

SEQ ID NO: 2535250 - RNA, 16 nt, Human
aauacagggcauuuug

SEQ ID NO: 2535251 - RNA, 16 nt, Human
aauacagggcaugcau

SEQ ID NO: 2535252 - RNA, 21 nt, Human
aauacaguaagcugcucuauu

SEQ ID NO: 2535253 - RNA, 19 nt, Human
aauacaguaagcugcucua

SEQ ID NO: 2535254 - RNA, 23 nt, Human
aauacagggcaugcauuuugcag

SEQ ID NO: 2535255 - RNA, 23 nt, Human
aauaccacaggaaccacaagacu

SEQ ID NO: 2535256 - RNA, 12 nt, Human
aauaccaaggaa

SEQ ID NO: 2535257 - RNA, 18 nt, Human
aauacauugaauuagaaa

SEQ ID NO: 2535258 - RNA, 17 nt, Human
aauacauugaauuagaa

SEQ ID NO: 2535259 - RNA, 18 nt, Human
aauaccaugccauuuaaa

SEQ ID NO: 2535260 - RNA, 19 nt, Human
aauaccagccaguaaaugg

SEQ ID NO: 2535261 - RNA, 17 nt, Human
aauaccagccaguaaau

SEQ ID NO: 2535262 - RNA, 12 nt, Human
aauacauuuuau

SEQ ID NO: 2535263 - RNA, 16 nt, Human
aauaccaaguauuuau

SEQ ID NO: 2535264 - RNA, 20 nt, Human
aauaccaaaauuauuucaga

SEQ ID NO: 2535265 - RNA, 23 nt, Human
aauaccauuuuuuaaggaaacaa

SEQ ID NO: 2535266 - RNA, 22 nt, Human
aauaccauuuuuuaaggaaaca

SEQ ID NO: 2535267 - RNA, 20 nt, Human
aauaccauuuuuuaaggaaa

SEQ ID NO: 2535268 - RNA, 13 nt, Human
aauaccaguucug

SEQ ID NO: 2535269 - RNA, 20 nt, Human
aauaccagugaaccaaagag

SEQ ID NO: 2535270 - RNA, 21 nt, Human
aauaccucuuagcugagugga

SEQ ID NO: 2535271 - RNA, 17 nt, Human
aauaccucuuagcugag

SEQ ID NO: 2535272 - RNA, 16 nt, Human
aauaccucuuagcuga

SEQ ID NO: 2535273 - RNA, 14 nt, Human
aauaccucuuagcu

SEQ ID NO: 2535274 - RNA, 16 nt, Human
aauaccucugugugcu

SEQ ID NO: 2535275 - RNA, 15 nt, Human
aauaccucugugugc

SEQ ID NO: 2535276 - RNA, 13 nt, Human
aauaccucugugu

SEQ ID NO: 2535277 - RNA, 14 nt, Human
aauaccucugugug

SEQ ID NO: 2535278 - RNA, 18 nt, Human
aauaccugucccccugac

SEQ ID NO: 2535279 - RNA, 15 nt, Human
aauaccugucccccu

SEQ ID NO: 2535280 - RNA, 19 nt, Human
aauaccugucccccugaca

SEQ ID NO: 2535281 - RNA, 12 nt, Human
aauaccugcccu

SEQ ID NO: 2535282 - RNA, 18 nt, Human
aauagacccacaagaggc

SEQ ID NO: 2535283 - RNA, 18 nt, Human
aauagcauguauuguguc

SEQ ID NO: 2535284 - RNA, 14 nt, Human
aauagcauguauug

SEQ ID NO: 2535285 - RNA, 19 nt, Human
aauagcauguauugugucu

SEQ ID NO: 2535286 - RNA, 17 nt, Human
aauagaguauaugcacu

SEQ ID NO: 2535287 - RNA, 16 nt, Human
aauagaguauaugcac

SEQ ID NO: 2535288 - RNA, 16 nt, Human
aauagagccugaggga

SEQ ID NO: 2535289 - RNA, 15 nt, Human
aauagaguauaugca

SEQ ID NO: 2535290 - RNA, 18 nt, Human
aauagaguauaugcacuu

SEQ ID NO: 2535291 - RNA, 22 nt, Human
aauagagcaaaauugauguguu

SEQ ID NO: 2535292 - RNA, 14 nt, Human
aauagagccugagg

SEQ ID NO: 2535293 - RNA, 20 nt, Human
aauagagcaaaauugaugug

SEQ ID NO: 2535294 - RNA, 16 nt, Human
aauagacuuaaaucuc

SEQ ID NO: 2535295 - RNA, 16 nt, Human
uaaauuauuuauuauu

SEQ ID NO: 2535296 - RNA, 20 nt, Human
uaaauuauguuuauauaaau

SEQ ID NO: 2535297 - RNA, 19 nt, Human
uaaauuauguuuauauaaa

SEQ ID NO: 2535298 - RNA, 19 nt, Human
uaaauuauuaguuuacauc

SEQ ID NO: 2535299 - RNA, 21 nt, Human
uaacaaacaucacucugcugc

SEQ ID NO: 2535300 - RNA, 22 nt, Human
uaacaaacaucacucugcugcu

SEQ ID NO: 2535301 - RNA, 20 nt, Human
uaacaaacuacauguaaucc

SEQ ID NO: 2535302 - RNA, 21 nt, Human
uaaauuaacuuuuauaaacuu

SEQ ID NO: 2535303 - RNA, 17 nt, Human
uaaauuauaacuuaaaa

SEQ ID NO: 2535304 - RNA, 21 nt, Human
uaaauuaugggaaucaagauu

SEQ ID NO: 2535305 - RNA, 20 nt, Human
uaaauuaugggaaucaagau

SEQ ID NO: 2535306 - RNA, 16 nt, Human
uaaauuauacuggaga

SEQ ID NO: 2535307 - RNA, 17 nt, Human
uaaauuauguuuauaua

SEQ ID NO: 2535308 - RNA, 15 nt, Human
uaaauuauguuuaua

SEQ ID NO: 2535309 - RNA, 14 nt, Human
uaaauuauguuuau

SEQ ID NO: 2535310 - RNA, 13 nt, Human
uaaauuauguuua

SEQ ID NO: 2535311 - RNA, 22 nt, Human
uaaauuauaacuuaaaauauuu

SEQ ID NO: 2535312 - RNA, 22 nt, Human
uaacaaugauauauggauaaug

SEQ ID NO: 2535313 - RNA, 19 nt, Human
uaacaaugauauauggaua

SEQ ID NO: 2535314 - RNA, 13 nt, Human
uaacaaugauaua

SEQ ID NO: 2535315 - RNA, 17 nt, Human
uaacaaugaagauaaaa

SEQ ID NO: 2535316 - RNA, 14 nt, Human
uaacaaucagcucc

SEQ ID NO: 2535317 - RNA, 16 nt, Human
uaacaauaacuacugu

SEQ ID NO: 2535318 - RNA, 20 nt, Human
uaacaagucgaugaacuauu

SEQ ID NO: 2535319 - RNA, 17 nt, Human
uaacaauaacuacugug

SEQ ID NO: 2535320 - RNA, 18 nt, Human
uaacaauaacuacugugu

SEQ ID NO: 2535321 - RNA, 23 nt, Human
uaacaauaacuacuguguuccug

SEQ ID NO: 2535322 - RNA, 19 nt, Human
uaacaauaacuacuguguu

SEQ ID NO: 2535323 - RNA, 21 nt, Human
uaacaauaacuacuguguucc

SEQ ID NO: 2535324 - RNA, 13 nt, Human
aauacagaggcaa

SEQ ID NO: 2535325 - RNA, 17 nt, Human
aauacacuaguuguuuc

SEQ ID NO: 2535326 - RNA, 16 nt, Human
aauacacuaguuguuu

SEQ ID NO: 2535327 - RNA, 20 nt, Human
aauacacuaauuccuuucua

SEQ ID NO: 2535328 - RNA, 15 nt, Human
aauacagacacuaag

SEQ ID NO: 2535329 - RNA, 13 nt, Human
aauacagacacua

SEQ ID NO: 2535330 - RNA, 19 nt, Human
aauacagaaauuagccggg

SEQ ID NO: 2535331 - RNA, 13 nt, Human
uaacaaugcugua

SEQ ID NO: 2535332 - RNA, 21 nt, Human
aauacaccacuacauucuguu

SEQ ID NO: 2535333 - RNA, 16 nt, Human
aauacacgagguauga

SEQ ID NO: 2535334 - RNA, 21 nt, Human
aauacaccagguagaacacaa

SEQ ID NO: 2535335 - RNA, 18 nt, Human
aaguguauuuuuuuacua

SEQ ID NO: 2535336 - RNA, 21 nt, Human
aaguguauuuuuuuacuaaua

SEQ ID NO: 2535337 - RNA, 15 nt, Human
uaaaugaaauuguaa

SEQ ID NO: 2535338 - RNA, 14 nt, Human
uaaaugaaauugua

SEQ ID NO: 2535339 - RNA, 16 nt, Human
uaaaugaaauuguaaa

SEQ ID NO: 2535340 - RNA, 18 nt, Human
uaaaugaaaaucgugaca

SEQ ID NO: 2535341 - RNA, 18 nt, Human
aagugcguguguagaguu

SEQ ID NO: 2535342 - RNA, 17 nt, Human
aagugcguguguagagu

SEQ ID NO: 2535343 - RNA, 16 nt, Human
aagugcguguguagag

SEQ ID NO: 2535344 - RNA, 15 nt, Human
aagugcguguguaga

SEQ ID NO: 2535345 - RNA, 22 nt, Human
aagugcguccacgagcuguuua

SEQ ID NO: 2535346 - RNA, 13 nt, Human
aaguguauuuuuc

SEQ ID NO: 2535347 - RNA, 15 nt, Human
aaguguauuuuucaa

SEQ ID NO: 2535348 - RNA, 22 nt, Human
aaguguauuuuucaauaaagca

SEQ ID NO: 2535349 - RNA, 21 nt, Human
aagugcguguguagaguuaag

SEQ ID NO: 2535350 - RNA, 19 nt, Human
aagugcguguguagaguua

SEQ ID NO: 2535351 - RNA, 23 nt, Human
aaguguauaucagaaaagggaag

SEQ ID NO: 2535352 - RNA, 18 nt, Human
aaguguaugcacgugugc

SEQ ID NO: 2535353 - RNA, 23 nt, Human
uaaaugaagcagcuuuaaacaaa

SEQ ID NO: 2535354 - RNA, 22 nt, Human
uaaaugaagcagcuuuaaacaa

SEQ ID NO: 2535355 - RNA, 13 nt, Human
uaaaugugguaaa

SEQ ID NO: 2535356 - RNA, 17 nt, Human
uaaaugaagcagcuuua

SEQ ID NO: 2535357 - RNA, 16 nt, Human
uaaaugaagcagcuuu

SEQ ID NO: 2535358 - RNA, 12 nt, Human
uaaaugaagaaa

SEQ ID NO: 2535359 - RNA, 19 nt, Human
uaaauuaacuuuuauaaac

SEQ ID NO: 2535360 - RNA, 20 nt, Human
uaaauuaacuuuuauaaacu

SEQ ID NO: 2535361 - RNA, 16 nt, Human
aauagucaagaaaaau

SEQ ID NO: 2535362 - RNA, 17 nt, Human
aauagucaagaaaaauu

SEQ ID NO: 2535363 - RNA, 13 nt, Human
aauagucaagaaa

SEQ ID NO: 2535364 - RNA, 14 nt, Human
aauagucuagaugg

SEQ ID NO: 2535365 - RNA, 21 nt, Human
aauagucuagauggcuccucu

SEQ ID NO: 2535366 - RNA, 13 nt, Human
aauagucugugug

SEQ ID NO: 2535367 - RNA, 14 nt, Human
aauagucuguguga

SEQ ID NO: 2535368 - RNA, 19 nt, Human
aauagugcagaaucucaua

SEQ ID NO: 2535369 - RNA, 15 nt, Human
aauagugaaaugaau

SEQ ID NO: 2535370 - RNA, 22 nt, Human
aauagugcucgcuuucuaugua

SEQ ID NO: 2535371 - RNA, 13 nt, Human
aauagugaaauga

SEQ ID NO: 2535372 - RNA, 20 nt, Human
aauagucuagauggcuccuc

SEQ ID NO: 2535373 - RNA, 15 nt, Human
aauagucugugugaa

SEQ ID NO: 2535374 - RNA, 21 nt, Human
aauaguguguucugauuagaa

SEQ ID NO: 2535375 - RNA, 20 nt, Human
aauagugcuuaaaaaucauu

SEQ ID NO: 2535376 - RNA, 16 nt, Human
aauaguguuaaucaau

SEQ ID NO: 2535377 - RNA, 15 nt, Human
aauaguguuaaucaa

SEQ ID NO: 2535378 - RNA, 22 nt, Human
aauaguguguucugauuagaaa

SEQ ID NO: 2535379 - RNA, 23 nt, Human
aauaguguguucugauuagaaau

SEQ ID NO: 2535380 - RNA, 19 nt, Human
aauagucaaauugugugaa

SEQ ID NO: 2535381 - RNA, 15 nt, Human
aauagcuauauccau

SEQ ID NO: 2535382 - RNA, 17 nt, Human
aauagcuauauccaugu

SEQ ID NO: 2535383 - RNA, 18 nt, Human
aauagcuauauccaugua

SEQ ID NO: 2535384 - RNA, 20 nt, Human
aauagcuauauccauguacu

SEQ ID NO: 2535385 - RNA, 14 nt, Human
aauauauuuaauga

SEQ ID NO: 2535386 - RNA, 20 nt, Human
aauauauuuaagauaauuau

SEQ ID NO: 2535387 - RNA, 19 nt, Human
aauauauuuaagauaauua

SEQ ID NO: 2535388 - RNA, 21 nt, Human
aauauauuuuaagacgaaaca

SEQ ID NO: 2535389 - RNA, 15 nt, Human
aauauauuuaagaua

SEQ ID NO: 2535390 - RNA, 21 nt, Human
aauauauugcugcugguaauu

SEQ ID NO: 2535391 - RNA, 22 nt, Human
aauaguucaaagccaaguuuau

SEQ ID NO: 2535392 - RNA, 15 nt, Human
aauaguuacuccagu

SEQ ID NO: 2535393 - RNA, 18 nt, Human
aauaguuacuccagugcc

SEQ ID NO: 2535394 - RNA, 20 nt, Human
aauaguuacuccagugccaa

SEQ ID NO: 2535395 - RNA, 22 nt, Human
aauaguuaagacaugauuuccu

SEQ ID NO: 2535396 - RNA, 23 nt, Human
aauaguuaagacaugauuuccuu

SEQ ID NO: 2535397 - RNA, 22 nt, Human
aauaguguuaaucaauuuaaac

SEQ ID NO: 2535398 - RNA, 19 nt, Human
aauaguguuaaucaauuua

SEQ ID NO: 2535399 - RNA, 18 nt, Human
aauaguguuaaucaauuu

SEQ ID NO: 2535400 - RNA, 17 nt, Human
aauaguguuaaucaauu

SEQ ID NO: 2535401 - RNA, 21 nt, Human
aauaguuaagacaugauuucc

SEQ ID NO: 2535402 - RNA, 21 nt, Human
aauauauucagccuggcuuca

SEQ ID NO: 2535403 - RNA, 21 nt, Human
aauaguucagguaacaggcag

SEQ ID NO: 2535404 - RNA, 21 nt, Human
uaacaugaauauuuaguguuc

SEQ ID NO: 2535405 - RNA, 20 nt, Human
uaacaugaauauuuaguguu

SEQ ID NO: 2535406 - RNA, 21 nt, Human
uaacaguccuaacugguauag

SEQ ID NO: 2535407 - RNA, 18 nt, Human
uaacaugaggggacauuu

SEQ ID NO: 2535408 - RNA, 19 nt, Human
uaacaugaggggacauuuu

SEQ ID NO: 2535409 - RNA, 20 nt, Human
uaacaugaggggacauuuug

SEQ ID NO: 2535410 - RNA, 14 nt, Human
uaacaugaauauuu

SEQ ID NO: 2535411 - RNA, 19 nt, Human
uaacauguaauuaaguacu

SEQ ID NO: 2535412 - RNA, 15 nt, Human
uaacauguaggaagu

SEQ ID NO: 2535413 - RNA, 23 nt, Human
uaacaugaggggacauuuuggug

SEQ ID NO: 2535414 - RNA, 17 nt, Human
uaacauguaauuaagua

SEQ ID NO: 2535415 - RNA, 22 nt, Human
uaacauguguuaaguauuuuca

SEQ ID NO: 2535416 - RNA, 20 nt, Human
uaacgcccuauuuuugcaau

SEQ ID NO: 2535417 - RNA, 17 nt, Human
uaacgcccuauuuuugc

SEQ ID NO: 2535418 - RNA, 15 nt, Human
uaacauguaucccaa

SEQ ID NO: 2535419 - RNA, 20 nt, Human
aauauauuuuuauauuuagu

SEQ ID NO: 2535420 - RNA, 19 nt, Human
aauauauuuuuauauuuag

SEQ ID NO: 2535421 - RNA, 15 nt, Human
aauauauuuuuauau

SEQ ID NO: 2535422 - RNA, 21 nt, Human
aauauauuuucuguuuucuuu

SEQ ID NO: 2535423 - RNA, 15 nt, Human
aauauauuuucuguu

SEQ ID NO: 2535424 - RNA, 18 nt, Human
uaacagucauuuaaaaaa

SEQ ID NO: 2535425 - RNA, 15 nt, Human
uaacagucauuuaaa

SEQ ID NO: 2535426 - RNA, 14 nt, Human
uaacagucauuuaa

SEQ ID NO: 2535427 - RNA, 13 nt, Human
uaacagucauuua

SEQ ID NO: 2535428 - RNA, 23 nt, Human
uaacagguuauuuuaguuucugu

SEQ ID NO: 2535429 - RNA, 22 nt, Human
uaacagguuauuuuaguuucug

SEQ ID NO: 2535430 - RNA, 15 nt, Human
uaacaguaacgcagg

SEQ ID NO: 2535431 - RNA, 19 nt, Human
uaacaugaauauuuagugu

SEQ ID NO: 2535432 - RNA, 23 nt, Human
uaacagggucucuagugcuguga

SEQ ID NO: 2535433 - RNA, 13 nt, Human
uaacaggucuccu

SEQ ID NO: 2535434 - RNA, 14 nt, Human
uaacaggucuccuc

SEQ ID NO: 2535435 - RNA, 15 nt, Human
uaacaggucuccucu

SEQ ID NO: 2535436 - RNA, 16 nt, Human
uaacaggucuccucuu

SEQ ID NO: 2535437 - RNA, 21 nt, Human
uaacagguuauuuuaguuucu

SEQ ID NO: 2535438 - RNA, 16 nt, Human
uaacagguuauuuuag

SEQ ID NO: 2535439 - RNA, 18 nt, Human
uaacaggucuccucuuaa

SEQ ID NO: 2535440 - RNA, 19 nt, Human
uaacaggucuccucuuaaa

SEQ ID NO: 2535441 - RNA, 16 nt, Human
uaagaauuuagggaga

SEQ ID NO: 2535442 - RNA, 22 nt, Human
uaagaauucaaacuggggccuc

SEQ ID NO: 2535443 - RNA, 20 nt, Human
uaagacggauuuauuuuucc

SEQ ID NO: 2535444 - RNA, 18 nt, Human
uaagaccuggcagcucug

SEQ ID NO: 2535445 - RNA, 17 nt, Human
uaagaccuggcagcucu

SEQ ID NO: 2535446 - RNA, 13 nt, Human
uaagaccuggcag

SEQ ID NO: 2535447 - RNA, 20 nt, Human
uaagaagggauggauuccaa

SEQ ID NO: 2535448 - RNA, 19 nt, Human
uaagaagggauggauucca

SEQ ID NO: 2535449 - RNA, 21 nt, Human
uaagaagcuguuguacauuua

SEQ ID NO: 2535450 - RNA, 18 nt, Human
uaagaaggcaaaaaugua

SEQ ID NO: 2535451 - RNA, 17 nt, Human
uaagaauuauuuugaug

SEQ ID NO: 2535452 - RNA, 12 nt, Human
uaagaauuauuu

SEQ ID NO: 2535453 - RNA, 14 nt, Human
uaagaauucaaacu

SEQ ID NO: 2535454 - RNA, 18 nt, Human
uaagaauucaaacugggg

SEQ ID NO: 2535455 - RNA, 22 nt, Human
uaagaagcuguuguacauuuau

SEQ ID NO: 2535456 - RNA, 13 nt, Human
uaagaaggcaaaa

SEQ ID NO: 2535457 - RNA, 17 nt, Human
uaagaaggcaaaaaugu

SEQ ID NO: 2535458 - RNA, 13 nt, Human
uaagaagugaaaa

SEQ ID NO: 2535459 - RNA, 20 nt, Human
uaacuugucuuuggacccug

SEQ ID NO: 2535460 - RNA, 16 nt, Human
uaacuugucuuuggac

SEQ ID NO: 2535461 - RNA, 19 nt, Human
uaagaagcuguuguacauu

SEQ ID NO: 2535462 - RNA, 18 nt, Human
uaagaagcuguuguacau

SEQ ID NO: 2535463 - RNA, 15 nt, Human
uaagaagcuguugua

SEQ ID NO: 2535464 - RNA, 16 nt, Human
uaacuuuaaguuucag

SEQ ID NO: 2535465 - RNA, 15 nt, Human
uaacuuuaaguuuca

SEQ ID NO: 2535466 - RNA, 12 nt, Human
uaacuuuaaguu

SEQ ID NO: 2535467 - RNA, 22 nt, Human
uaacuuuaauucucuuucaaag

SEQ ID NO: 2535468 - RNA, 17 nt, Human
uaacuugucuaaauaag

SEQ ID NO: 2535469 - RNA, 16 nt, Human
uaacuugucuaaauaa

SEQ ID NO: 2535470 - RNA, 17 nt, Human
uaacuuguuuccaaugu

SEQ ID NO: 2535471 - RNA, 21 nt, Human
uaacuuccuuggacucauuuu

SEQ ID NO: 2535472 - RNA, 18 nt, Human
uaacuucuuauggaauug

SEQ ID NO: 2535473 - RNA, 19 nt, Human
uaacuucuuauggaauuga

SEQ ID NO: 2535474 - RNA, 15 nt, Human
uaacuuggcuuucau

SEQ ID NO: 2535475 - RNA, 18 nt, Human
uaacuucuuaaaaguugu

SEQ ID NO: 2535476 - RNA, 17 nt, Human
uaacuucuuauggaauu

SEQ ID NO: 2535477 - RNA, 13 nt, Human
uaacuucugccug

SEQ ID NO: 2535478 - RNA, 16 nt, Human
uaacgcgucuuccuga

SEQ ID NO: 2535479 - RNA, 15 nt, Human
uaacgcgucuuccug

SEQ ID NO: 2535480 - RNA, 17 nt, Human
uaacgcgucuuccugag

SEQ ID NO: 2535481 - RNA, 13 nt, Human
uaacggaucagaa

SEQ ID NO: 2535482 - RNA, 19 nt, Human
uaacggaucagaaauacag

SEQ ID NO: 2535483 - RNA, 14 nt, Human
uaacggaucagaaa

SEQ ID NO: 2535484 - RNA, 12 nt, Human
uaacggcuccag

SEQ ID NO: 2535485 - RNA, 21 nt, Human
uaacggaucagaaauacagau

SEQ ID NO: 2535486 - RNA, 17 nt, Human
uaacguauaaaagccug

SEQ ID NO: 2535487 - RNA, 13 nt, Human
uaacguauaaaag

SEQ ID NO: 2535488 - RNA, 18 nt, Human
uaacguugcugugggaac

SEQ ID NO: 2535489 - RNA, 15 nt, Human
uaacguuuuuccuuu

SEQ ID NO: 2535490 - RNA, 19 nt, Human
uaacguuuuuccuuuaaaa

SEQ ID NO: 2535491 - RNA, 18 nt, Human
uaacguuuuuccuuuaaa

SEQ ID NO: 2535492 - RNA, 20 nt, Human
uaacguuuuuccuuuaaaaa

SEQ ID NO: 2535493 - RNA, 22 nt, Human
uaacuagagcagcccuggaguc

SEQ ID NO: 2535494 - RNA, 16 nt, Human
uaacuagauggugcug

SEQ ID NO: 2535495 - RNA, 18 nt, Human
uaacuagauggugcugag

SEQ ID NO: 2535496 - RNA, 19 nt, Human
uaacuagauggugcugaga

SEQ ID NO: 2535497 - RNA, 20 nt, Human
uaacuagauggugcugagaa

SEQ ID NO: 2535498 - RNA, 21 nt, Human
uaacuagauggugcugagaag

SEQ ID NO: 2535499 - RNA, 17 nt, Human
uaacguugcugugggaa

SEQ ID NO: 2535500 - RNA, 16 nt, Human
uaacguugcuguggga

SEQ ID NO: 2535501 - RNA, 14 nt, Human
uaacguugcugugg

SEQ ID NO: 2535502 - RNA, 22 nt, Human
uaacguuagaccacaaauagug

SEQ ID NO: 2535503 - RNA, 16 nt, Human
uaacguugagccccug

SEQ ID NO: 2535504 - RNA, 15 nt, Human
uaacggcuccaggau

SEQ ID NO: 2535505 - RNA, 13 nt, Human
uaacggcuccagg

SEQ ID NO: 2535506 - RNA, 18 nt, Human
uaacggcuccaggauuuu

SEQ ID NO: 2535507 - RNA, 15 nt, Human
uaacguaaauacaca

SEQ ID NO: 2535508 - RNA, 15 nt, Human
uaacuuaauugcuau

SEQ ID NO: 2535509 - RNA, 18 nt, Human
uaacuuacccuuagggag

SEQ ID NO: 2535510 - RNA, 17 nt, Human
uaacuuacccuuaggga

SEQ ID NO: 2535511 - RNA, 17 nt, Human
uaacuauauuugcuuuu

SEQ ID NO: 2535512 - RNA, 19 nt, Human
uaacuaggcucagagaugu

SEQ ID NO: 2535513 - RNA, 15 nt, Human
uaacuuaaucaauua

SEQ ID NO: 2535514 - RNA, 18 nt, Human
uaacuauauuugcuuuuu

SEQ ID NO: 2535515 - RNA, 23 nt, Human
uaacuauaguccagcuuuguucu

SEQ ID NO: 2535516 - RNA, 17 nt, Human
uaacuaguguugcuugg

SEQ ID NO: 2535517 - RNA, 16 nt, Human
uaacuaggcucagaga

SEQ ID NO: 2535518 - RNA, 15 nt, Human
uaacuagcaccaggg

SEQ ID NO: 2535519 - RNA, 17 nt, Human
uaacuaguccuuuacua

SEQ ID NO: 2535520 - RNA, 15 nt, Human
uaacuaggcucagag

SEQ ID NO: 2535521 - RNA, 15 nt, Human
uaacuagcuuggaaa

SEQ ID NO: 2535522 - RNA, 18 nt, Human
uaacuuauauuguaagaa

SEQ ID NO: 2535523 - RNA, 19 nt, Human
uaacuuauauuguaagaaa

SEQ ID NO: 2535524 - RNA, 20 nt, Human
uaacuuauauuguaagaaau

SEQ ID NO: 2535525 - RNA, 21 nt, Human
uaacuuauauuguaagaaaua

SEQ ID NO: 2535526 - RNA, 23 nt, Human
uaacuuauaucaucagcauaccu

SEQ ID NO: 2535527 - RNA, 17 nt, Human
uaacuuauauuguaaga

SEQ ID NO: 2535528 - RNA, 15 nt, Human
uaacuuagcaugugu

SEQ ID NO: 2535529 - RNA, 15 nt, Human
uaaggacacacuaau

SEQ ID NO: 2535530 - RNA, 14 nt, Human
uaaggacacacuaa

SEQ ID NO: 2535531 - RNA, 18 nt, Human
uaaggacauuucccaggg

SEQ ID NO: 2535532 - RNA, 18 nt, Human
uaaggaauaccugucccc

SEQ ID NO: 2535533 - RNA, 17 nt, Human
uaaggaauaccuguccc

SEQ ID NO: 2535534 - RNA, 22 nt, Human
uaaggaauuuuauuuuuuucug

SEQ ID NO: 2535535 - RNA, 14 nt, Human
uaaggaauauggga

SEQ ID NO: 2535536 - RNA, 20 nt, Human
uaaggaauaugggagaaaua

SEQ ID NO: 2535537 - RNA, 18 nt, Human
uaaggacaaaaaugaacu

SEQ ID NO: 2535538 - RNA, 19 nt, Human
uaaggaauguagcugguuu

SEQ ID NO: 2535539 - RNA, 20 nt, Human
uaaggaaacucuuaucucag

SEQ ID NO: 2535540 - RNA, 19 nt, Human
uaaggaaacuggguuccug

SEQ ID NO: 2535541 - RNA, 16 nt, Human
uaaggaaagcaauaaa

SEQ ID NO: 2535542 - RNA, 18 nt, Human
uaaggaaagcaauaaaug

SEQ ID NO: 2535543 - RNA, 21 nt, Human
uaaggaaagcaauaaaugaau

SEQ ID NO: 2535544 - RNA, 9 nt, Human
uaaggaaua

SEQ ID NO: 2535545 - RNA, 13 nt, Human
uaaggaagacaau

SEQ ID NO: 2535546 - RNA, 11 nt, Human
uaaggaaacaa

SEQ ID NO: 2535547 - RNA, 13 nt, Human
uaagcugaaaaua

SEQ ID NO: 2535548 - RNA, 19 nt, Human
uaaggaaacucuuaucuca

SEQ ID NO: 2535549 - RNA, 17 nt, Human
uaaggaaacucuuaucu

SEQ ID NO: 2535550 - RNA, 15 nt, Human
uaaggaaacucuuau

SEQ ID NO: 2535551 - RNA, 10 nt, Human
uaaggaaacu

SEQ ID NO: 2535552 - RNA, 12 nt, Human
uaaggaaacugg

SEQ ID NO: 2535553 - RNA, 14 nt, Human
uaaggaaacugggu

SEQ ID NO: 2535554 - RNA, 15 nt, Human
uaagcucagaaucca

SEQ ID NO: 2535555 - RNA, 13 nt, Human
uaagcucuggcuu

SEQ ID NO: 2535556 - RNA, 18 nt, Human
uaagauuagaaugaaaau

SEQ ID NO: 2535557 - RNA, 15 nt, Human
uaagauuagaaugaa

SEQ ID NO: 2535558 - RNA, 13 nt, Human
uaagauuagaaug

SEQ ID NO: 2535559 - RNA, 18 nt, Human
aaucaguccccucccauc

SEQ ID NO: 2535560 - RNA, 17 nt, Human
aaucaguccccucccau

SEQ ID NO: 2535561 - RNA, 16 nt, Human
aaucaguccccuccca

SEQ ID NO: 2535562 - RNA, 15 nt, Human
aaucaguccccuccc

SEQ ID NO: 2535563 - RNA, 20 nt, Human
aaucagucuauccacagaga

SEQ ID NO: 2535564 - RNA, 17 nt, Human
aaucagucuauccacag

SEQ ID NO: 2535565 - RNA, 15 nt, Human
uaagcaaaaugugau

SEQ ID NO: 2535566 - RNA, 21 nt, Human
uaagcaaaaugugauauguac

SEQ ID NO: 2535567 - RNA, 14 nt, Human
uaagcaaaauguga

SEQ ID NO: 2535568 - RNA, 14 nt, Human
uaagauucauauuu

SEQ ID NO: 2535569 - RNA, 23 nt, Human
uaagcaggaggaggugccaacag

SEQ ID NO: 2535570 - RNA, 18 nt, Human
uaagcaggaggaggugcc

SEQ ID NO: 2535571 - RNA, 15 nt, Human
uaagcaggaggaggu

SEQ ID NO: 2535572 - RNA, 17 nt, Human
uaagcagcucuugcuaa

SEQ ID NO: 2535573 - RNA, 18 nt, Human
uaagcagcucuugcuaau

SEQ ID NO: 2535574 - RNA, 12 nt, Human
uaagcagcucuu

SEQ ID NO: 2535575 - RNA, 21 nt, Human
uaagcagcauuucugaagugg

SEQ ID NO: 2535576 - RNA, 23 nt, Human
uaagcagcauuucugaaguggac

SEQ ID NO: 2535577 - RNA, 19 nt, Human
uaagcagcauuucugaagu

SEQ ID NO: 2535578 - RNA, 18 nt, Human
uaagcagcauuucugaag

SEQ ID NO: 2535579 - RNA, 16 nt, Human
uaagauuaucugggga

SEQ ID NO: 2535580 - RNA, 21 nt, Human
uaagcagauuuaacaauucca

SEQ ID NO: 2535581 - RNA, 22 nt, Human
uaagcagauggaaugcuguguu

SEQ ID NO: 2535582 - RNA, 21 nt, Human
uaagcuauucaguaauaacuc

SEQ ID NO: 2535583 - RNA, 12 nt, Human
uaagcucagaau

SEQ ID NO: 2535584 - RNA, 20 nt, Human
uaagcucaaggcgugaggau

SEQ ID NO: 2535585 - RNA, 18 nt, Human
aaucaggaauauuuucca

SEQ ID NO: 2535586 - RNA, 20 nt, Human
aaucaggaauauuuuccaaa

SEQ ID NO: 2535587 - RNA, 18 nt, Human
aaucagggaggucauuuu

SEQ ID NO: 2535588 - RNA, 19 nt, Human
aaucagggaggucauuuug

SEQ ID NO: 2535589 - RNA, 14 nt, Human
aaucaguccccucc

SEQ ID NO: 2535590 - RNA, 13 nt, Human
aaucaguccccuc

SEQ ID NO: 2535591 - RNA, 21 nt, Human
aaucagucagugcaaauguca

SEQ ID NO: 2535592 - RNA, 19 nt, Human
aaucagucagugcaaaugu

SEQ ID NO: 2535593 - RNA, 11 nt, Human
aaucaguauau

SEQ ID NO: 2535594 - RNA, 17 nt, Human
aaucaguauaauucugu

SEQ ID NO: 2535595 - RNA, 14 nt, Human
aaucaguauaauuc

SEQ ID NO: 2535596 - RNA, 17 nt, Human
aaucaguauaaacaaag

SEQ ID NO: 2535597 - RNA, 14 nt, Human
aaucaguauaaaca

SEQ ID NO: 2535598 - RNA, 15 nt, Human
aaucaguauaaacaa

SEQ ID NO: 2535599 - RNA, 21 nt, Human
aaucaguaauauuuauauauu

SEQ ID NO: 2535600 - RNA, 20 nt, Human
aaucagcuccuuccuggaga

SEQ ID NO: 2535601 - RNA, 23 nt, Human
aaucagcuauuuacugccaaagg

SEQ ID NO: 2535602 - RNA, 19 nt, Human
aaucagccugcuccagcug

SEQ ID NO: 2535603 - RNA, 13 nt, Human
aaucagccugcuc

SEQ ID NO: 2535604 - RNA, 18 nt, Human
aaucagccugcuccagcu

SEQ ID NO: 2535605 - RNA, 18 nt, Human
aaucacucuuguggaugu

SEQ ID NO: 2535606 - RNA, 16 nt, Human
aaucacucuuguggau

SEQ ID NO: 2535607 - RNA, 12 nt, Human
aaucacucuugu

SEQ ID NO: 2535608 - RNA, 22 nt, Human
aaucacucuuguggauguuuua

SEQ ID NO: 2535609 - RNA, 18 nt, Human
aaucacucuguccuugga

SEQ ID NO: 2535610 - RNA, 12 nt, Human
aaucagcauucu

SEQ ID NO: 2535611 - RNA, 19 nt, Human
aaucagcauucucacuccu

SEQ ID NO: 2535612 - RNA, 18 nt, Human
aaucagcauucucacucc

SEQ ID NO: 2535613 - RNA, 16 nt, Human
aaucagccuaguugau

SEQ ID NO: 2535614 - RNA, 20 nt, Human
aaucagccaauuauguuaaa

SEQ ID NO: 2535615 - RNA, 19 nt, Human
aaucagccaauuauguuaa

SEQ ID NO: 2535616 - RNA, 18 nt, Human
aaucagccaauuauguua

SEQ ID NO: 2535617 - RNA, 14 nt, Human
aaucagccaauuau

SEQ ID NO: 2535618 - RNA, 11 nt, Human
aaucagccugc

SEQ ID NO: 2535619 - RNA, 21 nt, Human
aaucagccaauuauguuaaac

SEQ ID NO: 2535620 - RNA, 23 nt, Human
aaucagccuaggggucagggacc

SEQ ID NO: 2535621 - RNA, 12 nt, Human
aaucagccucuu

SEQ ID NO: 2535622 - RNA, 16 nt, Human
aaucagccucuuaaag

SEQ ID NO: 2535623 - RNA, 15 nt, Human
aauauuuauuuuaau

SEQ ID NO: 2535624 - RNA, 15 nt, Human
aauauuuucuggguu

SEQ ID NO: 2535625 - RNA, 13 nt, Human
aauauuuauuuau

SEQ ID NO: 2535626 - RNA, 18 nt, Human
aauauuuucuuuaaugcu

SEQ ID NO: 2535627 - RNA, 12 nt, Human
aauauuuauugc

SEQ ID NO: 2535628 - RNA, 13 nt, Human
aauauuuauugcu

SEQ ID NO: 2535629 - RNA, 20 nt, Human
aauauuuauuauuuucaccu

SEQ ID NO: 2535630 - RNA, 19 nt, Human
aauauuuauuauuuucacc

SEQ ID NO: 2535631 - RNA, 17 nt, Human
aauauuuauugcuuuau

SEQ ID NO: 2535632 - RNA, 16 nt, Human
aauauuuauugcuuua

SEQ ID NO: 2535633 - RNA, 15 nt, Human
aauauuuauugcuuu

SEQ ID NO: 2535634 - RNA, 14 nt, Human
aauauuuauugcuu

SEQ ID NO: 2535635 - RNA, 23 nt, Human
aauauuuauugcuuuauaaauaa

SEQ ID NO: 2535636 - RNA, 21 nt, Human
aauauuuauugcuuuauaaau

SEQ ID NO: 2535637 - RNA, 11 nt, Human
aauauuuauuu

SEQ ID NO: 2535638 - RNA, 22 nt, Human
aauauuuugaaucaauaauaua

SEQ ID NO: 2535639 - RNA, 18 nt, Human
aauauuuugaaucaauaa

SEQ ID NO: 2535640 - RNA, 16 nt, Human
aauauuuugaaucaau

SEQ ID NO: 2535641 - RNA, 15 nt, Human
aauauuuugaaucaa

SEQ ID NO: 2535642 - RNA, 14 nt, Human
aauauuuugaauca

SEQ ID NO: 2535643 - RNA, 13 nt, Human
aauauuuugaauc

SEQ ID NO: 2535644 - RNA, 19 nt, Human
aauauuuucuuuaaugcuu

SEQ ID NO: 2535645 - RNA, 21 nt, Human
aauauuuucuuuaaugcuuuu

SEQ ID NO: 2535646 - RNA, 20 nt, Human
aauauuuugaaucaauaaua

SEQ ID NO: 2535647 - RNA, 20 nt, Human
aaucacguaaagcuagaaau

SEQ ID NO: 2535648 - RNA, 21 nt, Human
aaucacguaaagcuagaaaug

SEQ ID NO: 2535649 - RNA, 17 nt, Human
aaucacuaaaaaugauc

SEQ ID NO: 2535650 - RNA, 15 nt, Human
aaucacguaaagcua

SEQ ID NO: 2535651 - RNA, 23 nt, Human
aauauuuaugucuauuuaagccu

SEQ ID NO: 2535652 - RNA, 21 nt, Human
aauauuuaugucuauuuaagc

SEQ ID NO: 2535653 - RNA, 19 nt, Human
aauauuuaugucuauuuaa

SEQ ID NO: 2535654 - RNA, 15 nt, Human
aauauuuauguaaac

SEQ ID NO: 2535655 - RNA, 12 nt, Human
aauauuuauuau

SEQ ID NO: 2535656 - RNA, 18 nt, Human
aauauuuauuaccucuga

SEQ ID NO: 2535657 - RNA, 17 nt, Human
aauauuuauuaccucug

SEQ ID NO: 2535658 - RNA, 16 nt, Human
aauauuuauuaccucu

SEQ ID NO: 2535659 - RNA, 15 nt, Human
aauauuuauuaccuc

SEQ ID NO: 2535660 - RNA, 14 nt, Human
aauauuuauuaccu

SEQ ID NO: 2535661 - RNA, 13 nt, Human
aauauuuauuacc

SEQ ID NO: 2535662 - RNA, 12 nt, Human
aauauuuauuac

SEQ ID NO: 2535663 - RNA, 15 nt, Human
aauauuuauagguca

SEQ ID NO: 2535664 - RNA, 19 nt, Human
uaagacuguaaugaaucua

SEQ ID NO: 2535665 - RNA, 15 nt, Human
uaagacuguguauuc

SEQ ID NO: 2535666 - RNA, 14 nt, Human
aauauuuauauauu

SEQ ID NO: 2535667 - RNA, 17 nt, Human
aauauuuauauauuuau

SEQ ID NO: 2535668 - RNA, 14 nt, Human
aauauuuauauuuc

SEQ ID NO: 2535669 - RNA, 17 nt, Human
aauauuuauauuucacu

SEQ ID NO: 2535670 - RNA, 18 nt, Human
aauauuuauauuucacua

SEQ ID NO: 2535671 - RNA, 13 nt, Human
uaagacuccucgg

SEQ ID NO: 2535672 - RNA, 18 nt, Human
uaagacucauucccuaga

SEQ ID NO: 2535673 - RNA, 23 nt, Human
uaagacuccucggccuggcuccu

SEQ ID NO: 2535674 - RNA, 22 nt, Human
uaagacuccucggccuggcucc

SEQ ID NO: 2535675 - RNA, 16 nt, Human
uaagacuguaaugaau

SEQ ID NO: 2535676 - RNA, 14 nt, Human
uaagacgacaagga

SEQ ID NO: 2535677 - RNA, 15 nt, Human
uaagacguguuugug

SEQ ID NO: 2535678 - RNA, 13 nt, Human
uaaguaaaaccac

SEQ ID NO: 2535679 - RNA, 15 nt, Human
uaaguaaaaccacag

SEQ ID NO: 2535680 - RNA, 18 nt, Human
uaagguuaccuuuguucc

SEQ ID NO: 2535681 - RNA, 17 nt, Human
uaaggaugcuaaaccuu

SEQ ID NO: 2535682 - RNA, 16 nt, Human
uaaggaucucucagga

SEQ ID NO: 2535683 - RNA, 21 nt, Human
uaagguuauuuauuuaaaugu

SEQ ID NO: 2535684 - RNA, 19 nt, Human
uaaggagaaaucuauagaa

SEQ ID NO: 2535685 - RNA, 16 nt, Human
uaaggagaugggccuu

SEQ ID NO: 2535686 - RNA, 19 nt, Human
uaaggaguaaucuguguac

SEQ ID NO: 2535687 - RNA, 20 nt, Human
uaaggaguaaucuguguaca

SEQ ID NO: 2535688 - RNA, 19 nt, Human
uaaggaucagaacagcaga

SEQ ID NO: 2535689 - RNA, 17 nt, Human
uaaggauacuuuacaug

SEQ ID NO: 2535690 - RNA, 16 nt, Human
uaaguaaaaccacagc

SEQ ID NO: 2535691 - RNA, 17 nt, Human
uaaguaaaaccacagca

SEQ ID NO: 2535692 - RNA, 18 nt, Human
uaaguaaaaccacagcag

SEQ ID NO: 2535693 - RNA, 19 nt, Human
uaaguaaaaccacagcagu

SEQ ID NO: 2535694 - RNA, 20 nt, Human
uaaguaaugauaacuggaaa

SEQ ID NO: 2535695 - RNA, 22 nt, Human
uaagguuucguuucuguauaca

SEQ ID NO: 2535696 - RNA, 20 nt, Human
uaagguuucguuucuguaua

SEQ ID NO: 2535697 - RNA, 19 nt, Human
uaagguuucguuucuguau

SEQ ID NO: 2535698 - RNA, 16 nt, Human
uaagguucucauagga

SEQ ID NO: 2535699 - RNA, 23 nt, Human
uaaguaauuaucgggaacagugu

SEQ ID NO: 2535700 - RNA, 16 nt, Human
uaaguaauucaagaaa

SEQ ID NO: 2535701 - RNA, 21 nt, Human
uaaguaauuaucgggaacagu

SEQ ID NO: 2535702 - RNA, 17 nt, Human
uaaguaccacucaggcc

SEQ ID NO: 2535703 - RNA, 21 nt, Human
uaaguauucuuauuuaaugaa

SEQ ID NO: 2535704 - RNA, 19 nt, Human
uaaguauugcaucuguaua

SEQ ID NO: 2535705 - RNA, 18 nt, Human
uaaguauugcaucuguau

SEQ ID NO: 2535706 - RNA, 12 nt, Human
uaaguauuuagg

SEQ ID NO: 2535707 - RNA, 17 nt, Human
uaaguauugcaucugua

SEQ ID NO: 2535708 - RNA, 11 nt, Human
uaaguauugca

SEQ ID NO: 2535709 - RNA, 20 nt, Human
uaaguauugcaucuguauaa

SEQ ID NO: 2535710 - RNA, 20 nt, Human
uaaguauuuagguuuuuguu

SEQ ID NO: 2535711 - RNA, 13 nt, Human
uaaguauuuauau

SEQ ID NO: 2535712 - RNA, 14 nt, Human
uaaguauuuauaua

SEQ ID NO: 2535713 - RNA, 15 nt, Human
uaaguauuuauauau

SEQ ID NO: 2535714 - RNA, 17 nt, Human
uaaguauuuauauauuu

SEQ ID NO: 2535715 - RNA, 18 nt, Human
uaaguauuuauauauuua

SEQ ID NO: 2535716 - RNA, 19 nt, Human
uaaguauuuauauauuuau

SEQ ID NO: 2535717 - RNA, 17 nt, Human
uaaguguguguuuuuca

SEQ ID NO: 2535718 - RNA, 13 nt, Human
uaaguauuucaaa

SEQ ID NO: 2535719 - RNA, 23 nt, Human
uaaguauuuauauauuuauaacu

SEQ ID NO: 2535720 - RNA, 19 nt, Human
uaagugugaguaagagcug

SEQ ID NO: 2535721 - RNA, 21 nt, Human
uaagugugaguaagagcuggu

SEQ ID NO: 2535722 - RNA, 14 nt, Human
uaaguguuguaaau

SEQ ID NO: 2535723 - RNA, 14 nt, Human
uaaguuacuucacu

SEQ ID NO: 2535724 - RNA, 14 nt, Human
uaagugugugugug

SEQ ID NO: 2535725 - RNA, 21 nt, Human
uaaguuacacauuuuucagau

SEQ ID NO: 2535726 - RNA, 14 nt, Human
uaaguuucucagcu

SEQ ID NO: 2535727 - RNA, 13 nt, Human
uaaguuucucagc

SEQ ID NO: 2535728 - RNA, 20 nt, Human
uaauaaaaaauggaaagaau

SEQ ID NO: 2535729 - RNA, 19 nt, Human
uaauaaaaaauggaaagaa

SEQ ID NO: 2535730 - RNA, 15 nt, Human
uaauaaaaaauggaa

SEQ ID NO: 2535731 - RNA, 14 nt, Human
uaauaaaaaaugga

SEQ ID NO: 2535732 - RNA, 21 nt, Human
uaauaaaaaauggaaagaauc

SEQ ID NO: 2535733 - RNA, 13 nt, Human
uaauaaaaagauu

SEQ ID NO: 2535734 - RNA, 16 nt, Human
uaauaaaaagauugaa

SEQ ID NO: 2535735 - RNA, 14 nt, Human
uaauaaaaaggcac

SEQ ID NO: 2535736 - RNA, 20 nt, Human
uaaguuucaggugacaugug

SEQ ID NO: 2535737 - RNA, 19 nt, Human
uaaguuucaggugacaugu

SEQ ID NO: 2535738 - RNA, 18 nt, Human
uaaguuucaggugacaug

SEQ ID NO: 2535739 - RNA, 17 nt, Human
uaaguuucaggugacau

SEQ ID NO: 2535740 - RNA, 16 nt, Human
uaaguuucaggugaca

SEQ ID NO: 2535741 - RNA, 20 nt, Human
uaaguuuaugucuaaagagc

SEQ ID NO: 2535742 - RNA, 17 nt, Human
uaaguuuauuucuuaaa

SEQ ID NO: 2535743 - RNA, 18 nt, Human
uaaguuuaugucuaaaga

SEQ ID NO: 2535744 - RNA, 17 nt, Human
uaaguuuaugucuaaag

SEQ ID NO: 2535745 - RNA, 14 nt, Human
uaaguuauaguaua

SEQ ID NO: 2535746 - RNA, 17 nt, Human
uaaguuucaguugauuu

SEQ ID NO: 2535747 - RNA, 22 nt, Human
uaaguuucaggugacaugugaa

SEQ ID NO: 2535748 - RNA, 21 nt, Human
aauccucucaaccaccuuuca

SEQ ID NO: 2535749 - RNA, 14 nt, Human
aaucccuguuuaau

SEQ ID NO: 2535750 - RNA, 17 nt, Human
aauccucuuccucugag

SEQ ID NO: 2535751 - RNA, 15 nt, Human
aauccucuuccucug

SEQ ID NO: 2535752 - RNA, 14 nt, Human
aauccucuuccucu

SEQ ID NO: 2535753 - RNA, 13 nt, Human
aauccucuuccuc

SEQ ID NO: 2535754 - RNA, 18 nt, Human
aauccucucucuguguua

SEQ ID NO: 2535755 - RNA, 11 nt, Human
aauccucuggc

SEQ ID NO: 2535756 - RNA, 11 nt, Human
aauccugcccc

SEQ ID NO: 2535757 - RNA, 12 nt, Human
aauccugccccc

SEQ ID NO: 2535758 - RNA, 10 nt, Human
aauccugccc

SEQ ID NO: 2535759 - RNA, 18 nt, Human
aauccucuuccucugagg

SEQ ID NO: 2535760 - RNA, 20 nt, Human
aauccucuuccucugaggcu

SEQ ID NO: 2535761 - RNA, 23 nt, Human
aaucgcuucucuuuugaaacaau

SEQ ID NO: 2535762 - RNA, 12 nt, Human
aaucgcuucucu

SEQ ID NO: 2535763 - RNA, 21 nt, Human
aaucgcuuaaagauguuccua

SEQ ID NO: 2535764 - RNA, 14 nt, Human
aaucgcuuaaagau

SEQ ID NO: 2535765 - RNA, 22 nt, Human
aaucggaucuggggcucuggga

SEQ ID NO: 2535766 - RNA, 21 nt, Human
aaucggaucuggggcucuggg

SEQ ID NO: 2535767 - RNA, 20 nt, Human
aaucuaugaaguauauaaug

SEQ ID NO: 2535768 - RNA, 19 nt, Human
aaucuaugaaguauauaau

SEQ ID NO: 2535769 - RNA, 17 nt, Human
aaucuaugaaguauaua

SEQ ID NO: 2535770 - RNA, 14 nt, Human
aaucuaugaaguau

SEQ ID NO: 2535771 - RNA, 20 nt, Human
aaucuaucugcuuaugcagu

SEQ ID NO: 2535772 - RNA, 15 nt, Human
aaucgguuuaaacau

SEQ ID NO: 2535773 - RNA, 22 nt, Human
aaucggcccacagcucccaccc

SEQ ID NO: 2535774 - RNA, 18 nt, Human
aaucggcccacagcuccc

SEQ ID NO: 2535775 - RNA, 23 nt, Human
aaucggaucuggggcucugggau

SEQ ID NO: 2535776 - RNA, 15 nt, Human
aaucguuaugugugu

SEQ ID NO: 2535777 - RNA, 16 nt, Human
aaucguuaugugugua

SEQ ID NO: 2535778 - RNA, 17 nt, Human
aaucguuauguguguau

SEQ ID NO: 2535779 - RNA, 18 nt, Human
aaucguuauguguguaua

SEQ ID NO: 2535780 - RNA, 14 nt, Human
aaucuaaagccagu

SEQ ID NO: 2535781 - RNA, 14 nt, Human
aaucuaaaagcuuu

SEQ ID NO: 2535782 - RNA, 20 nt, Human
aaucuaugccaaagaucacu

SEQ ID NO: 2535783 - RNA, 18 nt, Human
aaucuaugccaaagauca

SEQ ID NO: 2535784 - RNA, 17 nt, Human
aaucuaugccaaagauc

SEQ ID NO: 2535785 - RNA, 16 nt, Human
aaucuaugccaaagau

SEQ ID NO: 2535786 - RNA, 12 nt, Human
aaucuauuauac

SEQ ID NO: 2535787 - RNA, 22 nt, Human
aaucuauuaauagcugccuuaa

SEQ ID NO: 2535788 - RNA, 21 nt, Human
aaucuauggucgggagacagc

SEQ ID NO: 2535789 - RNA, 15 nt, Human
aaucuaugauuccag

SEQ ID NO: 2535790 - RNA, 18 nt, Human
aaucuaugauuccaggug

SEQ ID NO: 2535791 - RNA, 19 nt, Human
aaucuauucagacaagcaa

SEQ ID NO: 2535792 - RNA, 18 nt, Human
aaucuauucagacaagca

SEQ ID NO: 2535793 - RNA, 13 nt, Human
aaucuauucagac

SEQ ID NO: 2535794 - RNA, 12 nt, Human
aaucuauucaga

SEQ ID NO: 2535795 - RNA, 18 nt, Human
aaucuauuauacuguauu

SEQ ID NO: 2535796 - RNA, 17 nt, Human
aaucuauuauacuguau

SEQ ID NO: 2535797 - RNA, 16 nt, Human
aaucuauuauacugua

SEQ ID NO: 2535798 - RNA, 15 nt, Human
aaucuauuggguuca

SEQ ID NO: 2535799 - RNA, 16 nt, Human
aaucuauuggguucau

SEQ ID NO: 2535800 - RNA, 17 nt, Human
aaucuauuggguucauu

SEQ ID NO: 2535801 - RNA, 18 nt, Human
aaucuauuggguucauua

SEQ ID NO: 2535802 - RNA, 19 nt, Human
aaucuauuggguucauuau

SEQ ID NO: 2535803 - RNA, 11 nt, Human
aaucuauuuaa

SEQ ID NO: 2535804 - RNA, 11 nt, Human
aaucuguaaac

SEQ ID NO: 2535805 - RNA, 12 nt, Human
aaucuguaaacu

SEQ ID NO: 2535806 - RNA, 18 nt, Human
aaucugggccagaauuuc

SEQ ID NO: 2535807 - RNA, 13 nt, Human
aaucucaaauaac

SEQ ID NO: 2535808 - RNA, 17 nt, Human
aaucuauuuuguaacuu

SEQ ID NO: 2535809 - RNA, 14 nt, Human
aaucuauuuuguaa

SEQ ID NO: 2535810 - RNA, 12 nt, Human
aaucuauuucua

SEQ ID NO: 2535811 - RNA, 12 nt, Human
aaucuauuuaag

SEQ ID NO: 2535812 - RNA, 14 nt, Human
aaucccuggcaaag

SEQ ID NO: 2535813 - RNA, 17 nt, Human
aaucccgccaccuaucu

SEQ ID NO: 2535814 - RNA, 16 nt, Human
aaucccgauucacccu

SEQ ID NO: 2535815 - RNA, 20 nt, Human
aauccucaguuuuugugaaa

SEQ ID NO: 2535816 - RNA, 13 nt, Human
aaucccuguuuaa

SEQ ID NO: 2535817 - RNA, 17 nt, Human
aaucccugggcauugcu

SEQ ID NO: 2535818 - RNA, 19 nt, Human
aaucccugggcauugcuuu

SEQ ID NO: 2535819 - RNA, 23 nt, Human
aaucccugguuuuaaguaucaau

SEQ ID NO: 2535820 - RNA, 21 nt, Human
aaucccugggcauugcuuucc

SEQ ID NO: 2535821 - RNA, 21 nt, Human
aauccccaguaaaauugccau

SEQ ID NO: 2535822 - RNA, 17 nt, Human
aauccccaguaaaauug

SEQ ID NO: 2535823 - RNA, 16 nt, Human
aauccccaguaaaauu

SEQ ID NO: 2535824 - RNA, 15 nt, Human
aauccccaguaaaau

SEQ ID NO: 2535825 - RNA, 18 nt, Human
aaucccauucauaacuuu

SEQ ID NO: 2535826 - RNA, 20 nt, Human
aaucccauucauaacuuuca

SEQ ID NO: 2535827 - RNA, 19 nt, Human
aauccccuccuugggcacu

SEQ ID NO: 2535828 - RNA, 17 nt, Human
aauccccuccuugggca

SEQ ID NO: 2535829 - RNA, 12 nt, Human
aauccccuccuu

SEQ ID NO: 2535830 - RNA, 18 nt, Human
aauccccuucucaucacu

SEQ ID NO: 2535831 - RNA, 18 nt, Human
aauccccuccuugggcac

SEQ ID NO: 2535832 - RNA, 18 nt, Human
aaucccccuugccacccc

SEQ ID NO: 2535833 - RNA, 15 nt, Human
aaucccccuugccac

SEQ ID NO: 2535834 - RNA, 11 nt, Human
aauccccuccu

SEQ ID NO: 2535835 - RNA, 21 nt, Human
aauccccucccugucaaagcu

SEQ ID NO: 2535836 - RNA, 14 nt, Human
aauccccucauuca

SEQ ID NO: 2535837 - RNA, 19 nt, Human
aauccccucauucaggaaa

SEQ ID NO: 2535838 - RNA, 22 nt, Human
aaucagugugucuaaauuugaa

SEQ ID NO: 2535839 - RNA, 18 nt, Human
aaucagugugucuaaauu

SEQ ID NO: 2535840 - RNA, 17 nt, Human
aaucagugugucuaaau

SEQ ID NO: 2535841 - RNA, 14 nt, Human
aaucagugugucua

SEQ ID NO: 2535842 - RNA, 20 nt, Human
aaucauaagauauuuuucau

SEQ ID NO: 2535843 - RNA, 21 nt, Human
aaucccaaauuugauugauuu

SEQ ID NO: 2535844 - RNA, 17 nt, Human
aaucauaaacugugugc

SEQ ID NO: 2535845 - RNA, 18 nt, Human
aaucauaaacugugugca

SEQ ID NO: 2535846 - RNA, 13 nt, Human
uaauaaaaaggca

SEQ ID NO: 2535847 - RNA, 17 nt, Human
aaucccauuuaaaaaaa

SEQ ID NO: 2535848 - RNA, 12 nt, Human
aaucccaggaug

SEQ ID NO: 2535849 - RNA, 20 nt, Human
aaucccagcacuuugggagg

SEQ ID NO: 2535850 - RNA, 18 nt, Human
aaucccagcuacucagga

SEQ ID NO: 2535851 - RNA, 20 nt, Human
aaucccaagaucugugcagc

SEQ ID NO: 2535852 - RNA, 17 nt, Human
aaucccacccacaugug

SEQ ID NO: 2535853 - RNA, 18 nt, Human
aaucccacccacauguga

SEQ ID NO: 2535854 - RNA, 15 nt, Human
aaucccagcacuuug

SEQ ID NO: 2535855 - RNA, 22 nt, Human
aaucuguagggcuggaccuaug

SEQ ID NO: 2535856 - RNA, 19 nt, Human
aaucuguagggcuggaccu

SEQ ID NO: 2535857 - RNA, 16 nt, Human
aaucuguagggcugga

SEQ ID NO: 2535858 - RNA, 20 nt, Human
aaugaccuuucaauaggaaa

SEQ ID NO: 2535859 - RNA, 21 nt, Human
aaugaccuuucaauaggaaaa

SEQ ID NO: 2535860 - RNA, 14 nt, Human
aaucuguaaacugu

SEQ ID NO: 2535861 - RNA, 15 nt, Human
aaucuguaaacugug

SEQ ID NO: 2535862 - RNA, 16 nt, Human
aaucuguaaacugugu

SEQ ID NO: 2535863 - RNA, 21 nt, Human
aaucuguaaacuguguauucc

SEQ ID NO: 2535864 - RNA, 15 nt, Human
aaucuguagggcugg

SEQ ID NO: 2535865 - RNA, 23 nt, Human
aaucuguaaacuguguauuccaa

SEQ ID NO: 2535866 - RNA, 13 nt, Human
aaucuguacaaug

SEQ ID NO: 2535867 - RNA, 20 nt, Human
aaugacucagaauauugcuu

SEQ ID NO: 2535868 - RNA, 20 nt, Human
aaucuguaucuguagugaga

SEQ ID NO: 2535869 - RNA, 17 nt, Human
aaugacuaaaaaacaaa

SEQ ID NO: 2535870 - RNA, 20 nt, Human
aaugacuaaaaaacaaagaa

SEQ ID NO: 2535871 - RNA, 17 nt, Human
aaugacuaaaaauauua

SEQ ID NO: 2535872 - RNA, 24 nt, Human
aaugacuaaaaauauuauaacuua

SEQ ID NO: 2535873 - RNA, 21 nt, Human
aaugagccuacgcugaagaug

SEQ ID NO: 2535874 - RNA, 11 nt, Human
aaugagccugg

SEQ ID NO: 2535875 - RNA, 16 nt, Human
aaugagaucaggcucu

SEQ ID NO: 2535876 - RNA, 23 nt, Human
aaugagagggcaguguuuccuuu

SEQ ID NO: 2535877 - RNA, 16 nt, Human
aaugagauaguagcau

SEQ ID NO: 2535878 - RNA, 17 nt, Human
aaugagagguuccuaag

SEQ ID NO: 2535879 - RNA, 19 nt, Human
aaugagagggcaguguuuc

SEQ ID NO: 2535880 - RNA, 17 nt, Human
aaugagaucccgccucu

SEQ ID NO: 2535881 - RNA, 17 nt, Human
aaugagaucaggcucug

SEQ ID NO: 2535882 - RNA, 22 nt, Human
aaugagaaaucuaaaaaacgaa

SEQ ID NO: 2535883 - RNA, 12 nt, Human
aaugagaaaucu

SEQ ID NO: 2535884 - RNA, 22 nt, Human
aaugagagacacacugaagaag

SEQ ID NO: 2535885 - RNA, 17 nt, Human
aaugagaaggaauuuga

SEQ ID NO: 2535886 - RNA, 14 nt, Human
aaugagaaccaaca

SEQ ID NO: 2535887 - RNA, 18 nt, Human
aaugaggucagagccugc

SEQ ID NO: 2535888 - RNA, 16 nt, Human
aaugaggucagagccu

SEQ ID NO: 2535889 - RNA, 19 nt, Human
aaugaggucagcaugucua

SEQ ID NO: 2535890 - RNA, 15 nt, Human
aaugaggucccaggc

SEQ ID NO: 2535891 - RNA, 16 nt, Human
aaugaggucccaggca

SEQ ID NO: 2535892 - RNA, 14 nt, Human
aaugagggccaaga

SEQ ID NO: 2535893 - RNA, 16 nt, Human
aaugaggucugaaaug

SEQ ID NO: 2535894 - RNA, 21 nt, Human
aaugagggacuggaaccaggg

SEQ ID NO: 2535895 - RNA, 20 nt, Human
aaugagggacuggaaccagg

SEQ ID NO: 2535896 - RNA, 14 nt, Human
aaugagggacugga

SEQ ID NO: 2535897 - RNA, 15 nt, Human
aaugaggucagcaug

SEQ ID NO: 2535898 - RNA, 18 nt, Human
aaugagggccaagaaaga

SEQ ID NO: 2535899 - RNA, 14 nt, Human
aaugagccuggcaa

SEQ ID NO: 2535900 - RNA, 18 nt, Human
aaugaggcuugcugagag

SEQ ID NO: 2535901 - RNA, 15 nt, Human
aaugaggcuugcuga

SEQ ID NO: 2535902 - RNA, 13 nt, Human
aaugaggcuugcu

SEQ ID NO: 2535903 - RNA, 12 nt, Human
aaugaggaggaa

SEQ ID NO: 2535904 - RNA, 18 nt, Human
aaugaggaggaaggagag

SEQ ID NO: 2535905 - RNA, 12 nt, Human
aaugagccuggc

SEQ ID NO: 2535906 - RNA, 13 nt, Human
aaugagccuggca

SEQ ID NO: 2535907 - RNA, 13 nt, Human
aaugauuucaugc

SEQ ID NO: 2535908 - RNA, 22 nt, Human
aaugauuucaugcuaucucugu

SEQ ID NO: 2535909 - RNA, 24 nt, Human
aaugauuucagcucacugcaaccu

SEQ ID NO: 2535910 - RNA, 20 nt, Human
aaugauuguaaaauagcuug

SEQ ID NO: 2535911 - RNA, 14 nt, Human
aaugauuguaaaau

SEQ ID NO: 2535912 - RNA, 13 nt, Human
aaugauuguaaaa

SEQ ID NO: 2535913 - RNA, 21 nt, Human
aaugauucaguguuaaaugug

SEQ ID NO: 2535914 - RNA, 22 nt, Human
aaugauucaguguuaaauguga

SEQ ID NO: 2535915 - RNA, 23 nt, Human
aaugauucaguguuaaaugugau

SEQ ID NO: 2535916 - RNA, 13 nt, Human
aaugauucagugu

SEQ ID NO: 2535917 - RNA, 14 nt, Human
aaugauucaguguu

SEQ ID NO: 2535918 - RNA, 15 nt, Human
aaugauaaacucucu

SEQ ID NO: 2535919 - RNA, 21 nt, Human
aaugaguuuuuauggggcuga

SEQ ID NO: 2535920 - RNA, 23 nt, Human
aaugaggugggagguggaagaag

SEQ ID NO: 2535921 - RNA, 19 nt, Human
aaugaggucugaaauggag

SEQ ID NO: 2535922 - RNA, 19 nt, Human
aaugaguuaccuacauuuu

SEQ ID NO: 2535923 - RNA, 22 nt, Human
uaauuccguagguuauuuucag

SEQ ID NO: 2535924 - RNA, 14 nt, Human
uaauuauuauuugu

SEQ ID NO: 2535925 - RNA, 22 nt, Human
uaauuauuauuuauauauguau

SEQ ID NO: 2535926 - RNA, 17 nt, Human
uaauuauuauuuauaua

SEQ ID NO: 2535927 - RNA, 14 nt, Human
uaauuauuauuuau

SEQ ID NO: 2535928 - RNA, 17 nt, Human
uaauuauuauuuguguu

SEQ ID NO: 2535929 - RNA, 17 nt, Human
uaauucccauuuugcaa

SEQ ID NO: 2535930 - RNA, 18 nt, Human
uaauucccauuuugcaaa

SEQ ID NO: 2535931 - RNA, 19 nt, Human
uaauucccauuuugcaaaa

SEQ ID NO: 2535932 - RNA, 19 nt, Human
uaauuuaaaauugugaugu

SEQ ID NO: 2535933 - RNA, 20 nt, Human
uaauuuaaaauugugaugug

SEQ ID NO: 2535934 - RNA, 20 nt, Human
uaauucccauuuugcaaaau

SEQ ID NO: 2535935 - RNA, 21 nt, Human
uaauucccauuuugcaaaauu

SEQ ID NO: 2535936 - RNA, 23 nt, Human
uaauucccauuuugcaaaauuuc

SEQ ID NO: 2535937 - RNA, 15 nt, Human
uaauucccuaucuuu

SEQ ID NO: 2535938 - RNA, 19 nt, Human
uaauuccuaccucccugca

SEQ ID NO: 2535939 - RNA, 20 nt, Human
uaauucccuaucuuuuaguu

SEQ ID NO: 2535940 - RNA, 19 nt, Human
uaauuuaaacaccuccuca

SEQ ID NO: 2535941 - RNA, 17 nt, Human
uaauuuaaacaccuccu

SEQ ID NO: 2535942 - RNA, 11 nt, Human
uaauuuaaaca

SEQ ID NO: 2535943 - RNA, 19 nt, Human
uaauuccucaacguauugu

SEQ ID NO: 2535944 - RNA, 20 nt, Human
uaauuuaaacaggcccagca

SEQ ID NO: 2535945 - RNA, 17 nt, Human
uaauuuaaacaggccca

SEQ ID NO: 2535946 - RNA, 14 nt, Human
uaauuuaaacaggc

SEQ ID NO: 2535947 - RNA, 19 nt, Human
uaauuuaaacaggcccagc

SEQ ID NO: 2535948 - RNA, 16 nt, Human
uaauuuaguuauugau

SEQ ID NO: 2535949 - RNA, 15 nt, Human
uaauuuaguuauuga

SEQ ID NO: 2535950 - RNA, 21 nt, Human
uaauuuuuauauuugaaauau

SEQ ID NO: 2535951 - RNA, 19 nt, Human
uaauuuuuauauuugaaau

SEQ ID NO: 2535952 - RNA, 18 nt, Human
uaauuuuuauauuugaaa

SEQ ID NO: 2535953 - RNA, 21 nt, Human
uaauuuauaaaagaauaaaau

SEQ ID NO: 2535954 - RNA, 15 nt, Human
aaugcacuuucuauc

SEQ ID NO: 2535955 - RNA, 13 nt, Human
aaugcacuuucua

SEQ ID NO: 2535956 - RNA, 19 nt, Human
aaugcacguagcugaggcc

SEQ ID NO: 2535957 - RNA, 11 nt, Human
aaugcacuuuc

SEQ ID NO: 2535958 - RNA, 13 nt, Human
aaugcaccuggaa

SEQ ID NO: 2535959 - RNA, 22 nt, Human
aaugcacuuucuauccucugua

SEQ ID NO: 2535960 - RNA, 13 nt, Human
uaauuauuauuua

SEQ ID NO: 2535961 - RNA, 12 nt, Human
uaauuauuauuu

SEQ ID NO: 2535962 - RNA, 14 nt, Human
uaauuauuauucuu

SEQ ID NO: 2535963 - RNA, 12 nt, Human
uaauuauuauuc

SEQ ID NO: 2535964 - RNA, 13 nt, Human
uaauuauuauuaa

SEQ ID NO: 2535965 - RNA, 11 nt, Human
aaugcaaacca

SEQ ID NO: 2535966 - RNA, 20 nt, Human
aaugauuuuaucugugaauu

SEQ ID NO: 2535967 - RNA, 20 nt, Human
aaugauuuccaaagagaaaa

SEQ ID NO: 2535968 - RNA, 16 nt, Human
aaugauuucauucaau

SEQ ID NO: 2535969 - RNA, 14 nt, Human
aaugauuuuuagau

SEQ ID NO: 2535970 - RNA, 18 nt, Human
aaugauuuccaaagagaa

SEQ ID NO: 2535971 - RNA, 19 nt, Human
aaugauuuuaucugugaau

SEQ ID NO: 2535972 - RNA, 15 nt, Human
aaugcacacaaaaca

SEQ ID NO: 2535973 - RNA, 20 nt, Human
aaugcaaacacacaaaggua

SEQ ID NO: 2535974 - RNA, 14 nt, Human
aaugcacacaaaac

SEQ ID NO: 2535975 - RNA, 17 nt, Human
aaugcacacaaaacaac

SEQ ID NO: 2535976 - RNA, 13 nt, Human
aaugcacacuagc

SEQ ID NO: 2535977 - RNA, 17 nt, Human
aaugcacacuagccucu

SEQ ID NO: 2535978 - RNA, 12 nt, Human
aaugcaaaccau

SEQ ID NO: 2535979 - RNA, 21 nt, Human
aaugcaaaaauuagccgggcg

SEQ ID NO: 2535980 - RNA, 20 nt, Human
aauguaagggaaacugccag

SEQ ID NO: 2535981 - RNA, 18 nt, Human
aauguaaauauucuauau

SEQ ID NO: 2535982 - RNA, 16 nt, Human
aauguaagcuguuuau

SEQ ID NO: 2535983 - RNA, 15 nt, Human
aauguaagcuguuua

SEQ ID NO: 2535984 - RNA, 12 nt, Human
aauguaaauaaa

SEQ ID NO: 2535985 - RNA, 12 nt, Human
aauguaaauauu

SEQ ID NO: 2535986 - RNA, 16 nt, Human
aaugguuuucuugugu

SEQ ID NO: 2535987 - RNA, 16 nt, Human
aaugguuuucaaaaua

SEQ ID NO: 2535988 - RNA, 20 nt, Human
aauguaaaggagucaaaacu

SEQ ID NO: 2535989 - RNA, 21 nt, Human
aauguaaaggagucaaaacua

SEQ ID NO: 2535990 - RNA, 23 nt, Human
aauguaaaggagucaaaacuaca

SEQ ID NO: 2535991 - RNA, 17 nt, Human
aauguaaaauguugaau

SEQ ID NO: 2535992 - RNA, 16 nt, Human
aauggaagacagcucu

SEQ ID NO: 2535993 - RNA, 17 nt, Human
aauggaggccauugugu

SEQ ID NO: 2535994 - RNA, 18 nt, Human
aauggaagacagcucuua

SEQ ID NO: 2535995 - RNA, 14 nt, Human
aauggaagacacau

SEQ ID NO: 2535996 - RNA, 19 nt, Human
aauggagucaguuugcagu

SEQ ID NO: 2535997 - RNA, 21 nt, Human
aauggauuggauuauuuaaua

SEQ ID NO: 2535998 - RNA, 20 nt, Human
aauggauuggauuauuuaau

SEQ ID NO: 2535999 - RNA, 18 nt, Human
aauggauuggauuauuua

SEQ ID NO: 2536000 - RNA, 16 nt, Human
aauggauuggauuauu

SEQ ID NO: 2536001 - RNA, 14 nt, Human
aaugguuuucaaaa

SEQ ID NO: 2536002 - RNA, 19 nt, Human
aaugguuugcaaggaagcc

SEQ ID NO: 2536003 - RNA, 18 nt, Human
aaugguuugcaaggaagc

SEQ ID NO: 2536004 - RNA, 17 nt, Human
aaugguuugcaaggaag

SEQ ID NO: 2536005 - RNA, 14 nt, Human
uacacccaaagagg

SEQ ID NO: 2536006 - RNA, 15 nt, Human
uacacccuuuuccag

SEQ ID NO: 2536007 - RNA, 16 nt, Human
uacacccuuuuccagc

SEQ ID NO: 2536008 - RNA, 16 nt, Human
aauguaauugaauaaa

SEQ ID NO: 2536009 - RNA, 21 nt, Human
aauguaaugaucauaagucua

SEQ ID NO: 2536010 - RNA, 19 nt, Human
aauguaaucaauguuucuu

SEQ ID NO: 2536011 - RNA, 15 nt, Human
aauguaaugaucaua

SEQ ID NO: 2536012 - RNA, 14 nt, Human
aauguaauugaaua

SEQ ID NO: 2536013 - RNA, 15 nt, Human
uacagacaaagcgug

SEQ ID NO: 2536014 - RNA, 14 nt, Human
uacagacaaagcgu

SEQ ID NO: 2536015 - RNA, 13 nt, Human
uacagacaaagcg

SEQ ID NO: 2536016 - RNA, 17 nt, Human
uacaccgggccuggaga

SEQ ID NO: 2536017 - RNA, 15 nt, Human
uacaccgggccugga

SEQ ID NO: 2536018 - RNA, 14 nt, Human
uacacccuuggacu

SEQ ID NO: 2536019 - RNA, 12 nt, Human
uacaccuaacuc

SEQ ID NO: 2536020 - RNA, 17 nt, Human
uacagagacagaaagca

SEQ ID NO: 2536021 - RNA, 22 nt, Human
uacagagcccacgcccccacug

SEQ ID NO: 2536022 - RNA, 19 nt, Human
uacagagcccacgccccca

SEQ ID NO: 2536023 - RNA, 23 nt, Human
uacagagcagacaguuaagagaa

SEQ ID NO: 2536024 - RNA, 18 nt, Human
uacagagaggagaaacac

SEQ ID NO: 2536025 - RNA, 20 nt, Human
uacagagaggagaaacacau

SEQ ID NO: 2536026 - RNA, 21 nt, Human
uacagagaggagaaacacauc

SEQ ID NO: 2536027 - RNA, 22 nt, Human
uacagagaggagaaacacaucu

SEQ ID NO: 2536028 - RNA, 16 nt, Human
uacagagaggagaaac

SEQ ID NO: 2536029 - RNA, 17 nt, Human
uacagagaggagaaaca

SEQ ID NO: 2536030 - RNA, 18 nt, Human
uaauuuuuuugagacaga

SEQ ID NO: 2536031 - RNA, 22 nt, Human
uaauuuuuuucaauauuuauua

SEQ ID NO: 2536032 - RNA, 21 nt, Human
uacaaaaaaaaaaaaaaauua

SEQ ID NO: 2536033 - RNA, 13 nt, Human
uacaaugacuuua

SEQ ID NO: 2536034 - RNA, 22 nt, Human
uaauuuuuuuuuuccuuuuaaa

SEQ ID NO: 2536035 - RNA, 14 nt, Human
uaauuuuuguaauu

SEQ ID NO: 2536036 - RNA, 15 nt, Human
uaauuuuuguauuuu

SEQ ID NO: 2536037 - RNA, 16 nt, Human
uaauuuuugcucuaga

SEQ ID NO: 2536038 - RNA, 16 nt, Human
uaauuuuuccuauauu

SEQ ID NO: 2536039 - RNA, 23 nt, Human
uaauuuuuauucauaagccaauu

SEQ ID NO: 2536040 - RNA, 13 nt, Human
uaauuuuuauuca

SEQ ID NO: 2536041 - RNA, 22 nt, Human
uacaauguucaucccaugaugu

SEQ ID NO: 2536042 - RNA, 16 nt, Human
uacaauguucauccca

SEQ ID NO: 2536043 - RNA, 18 nt, Human
uacaauuaaaaaaaaaga

SEQ ID NO: 2536044 - RNA, 15 nt, Human
uacaauguucauccc

SEQ ID NO: 2536045 - RNA, 19 nt, Human
uacaauuaaagcuguuauu

SEQ ID NO: 2536046 - RNA, 22 nt, Human
uacaauuaaaaaaaaagaucug

SEQ ID NO: 2536047 - RNA, 15 nt, Human
uacaauuauaucagu

SEQ ID NO: 2536048 - RNA, 19 nt, Human
uacaauuauaucaguccuc

SEQ ID NO: 2536049 - RNA, 18 nt, Human
uacaauucuacauuguca

SEQ ID NO: 2536050 - RNA, 13 nt, Human
uacaauugaaaug

SEQ ID NO: 2536051 - RNA, 14 nt, Human
uacaauugaaauga

SEQ ID NO: 2536052 - RNA, 16 nt, Human
uacaauugaaaugacu

SEQ ID NO: 2536053 - RNA, 19 nt, Human
aaugcauauccugagccau

SEQ ID NO: 2536054 - RNA, 17 nt, Human
uacaauucccugcuguc

SEQ ID NO: 2536055 - RNA, 18 nt, Human
uacaauuauuuuuacagu

SEQ ID NO: 2536056 - RNA, 22 nt, Human
uacaauuauuuuuacaguucuc

SEQ ID NO: 2536057 - RNA, 13 nt, Human
uacaaugcugugc

SEQ ID NO: 2536058 - RNA, 14 nt, Human
uacaaugcugugcc

SEQ ID NO: 2536059 - RNA, 16 nt, Human
uacaaugcugugcccu

SEQ ID NO: 2536060 - RNA, 14 nt, Human
uacaaugacuuuau

SEQ ID NO: 2536061 - RNA, 18 nt, Human
uacaaugacuuuauugca

SEQ ID NO: 2536062 - RNA, 21 nt, Human
uacaaugaacccccaugaugu

SEQ ID NO: 2536063 - RNA, 21 nt, Human
aaugcuguauuuuaaaagaau

SEQ ID NO: 2536064 - RNA, 20 nt, Human
aaugcuguauuuuaaaagaa

SEQ ID NO: 2536065 - RNA, 12 nt, Human
aaugcugggcug

SEQ ID NO: 2536066 - RNA, 15 nt, Human
aaugcugguuuuccu

SEQ ID NO: 2536067 - RNA, 18 nt, Human
aaugcugguuuuccuaaa

SEQ ID NO: 2536068 - RNA, 18 nt, Human
aaugcugggacucagccu

SEQ ID NO: 2536069 - RNA, 18 nt, Human
aaugcauguuaggaaaau

SEQ ID NO: 2536070 - RNA, 22 nt, Human
aaugcuggcuguuggcuggggg

SEQ ID NO: 2536071 - RNA, 16 nt, Human
aaugcaugauuuugua

SEQ ID NO: 2536072 - RNA, 17 nt, Human
aaugcaugauuuuguaa

SEQ ID NO: 2536073 - RNA, 19 nt, Human
aaugcaugauuuuguaacc

SEQ ID NO: 2536074 - RNA, 19 nt, Human
aaugcaugcagccacugug

SEQ ID NO: 2536075 - RNA, 21 nt, Human
aaugcuggcuguuggcugggg

SEQ ID NO: 2536076 - RNA, 15 nt, Human
aaugcaucuguccuc

SEQ ID NO: 2536077 - RNA, 19 nt, Human
aaugcaucuagauuaugga

SEQ ID NO: 2536078 - RNA, 16 nt, Human
aaugcaucuguccuca

SEQ ID NO: 2536079 - RNA, 16 nt, Human
aaugcaucuagauuau

SEQ ID NO: 2536080 - RNA, 23 nt, Human
aaugcauccauuccucagggaca

SEQ ID NO: 2536081 - RNA, 13 nt, Human
aaugcauauugua

SEQ ID NO: 2536082 - RNA, 19 nt, Human
aaugcauccauuccucagg

SEQ ID NO: 2536083 - RNA, 16 nt, Human
aaugcauauuguauua

SEQ ID NO: 2536084 - RNA, 22 nt, Human
aaugcuguauuuuaaaagaaug

SEQ ID NO: 2536085 - RNA, 21 nt, Human
aaugcuuccugacaaucaacu

SEQ ID NO: 2536086 - RNA, 19 nt, Human
aaugcugguuuuccuaaau

SEQ ID NO: 2536087 - RNA, 21 nt, Human
aaugcugguuuuccuaaaugc

SEQ ID NO: 2536088 - RNA, 22 nt, Human
aaugcugguuuuccuaaaugca

SEQ ID NO: 2536089 - RNA, 23 nt, Human
aaugcugguuuuccuaaaugcag

SEQ ID NO: 2536090 - RNA, 13 nt, Human
aaugcuugaaaaa

SEQ ID NO: 2536091 - RNA, 16 nt, Human
aaugcuucuucucagg

SEQ ID NO: 2536092 - RNA, 19 nt, Human
aaugcuugaaaaaugugca

SEQ ID NO: 2536093 - RNA, 17 nt, Human
aaugcuucugacuucau

SEQ ID NO: 2536094 - RNA, 21 nt, Human
aaugcuucugacuucauagau

SEQ ID NO: 2536095 - RNA, 21 nt, Human
aaugcuuggcuucucauacgu

SEQ ID NO: 2536096 - RNA, 16 nt, Human
aaugcuugaaaaaugu

SEQ ID NO: 2536097 - RNA, 17 nt, Human
aaugcuuggcuucucau

SEQ ID NO: 2536098 - RNA, 23 nt, Human
aaugcuuuaaaaacuauuuaacu

SEQ ID NO: 2536099 - RNA, 22 nt, Human
aaugcuuuaaaaacuauuuaac

SEQ ID NO: 2536100 - RNA, 18 nt, Human
aaugcuuuaaaaacuauu

SEQ ID NO: 2536101 - RNA, 20 nt, Human
aaugcuuguggauugagggu

SEQ ID NO: 2536102 - RNA, 13 nt, Human
aauggaagacagc

SEQ ID NO: 2536103 - RNA, 13 nt, Human
aauggaagacaca

SEQ ID NO: 2536104 - RNA, 22 nt, Human
aauggaaccuccuuucucuucu

SEQ ID NO: 2536105 - RNA, 16 nt, Human
aauggaaccuccuuuc

SEQ ID NO: 2536106 - RNA, 18 nt, Human
aauggaaccccaccacug

SEQ ID NO: 2536107 - RNA, 22 nt, Human
aauuauuuauuaaaugcccagc

SEQ ID NO: 2536108 - RNA, 12 nt, Human
aauuauuucaga

SEQ ID NO: 2536109 - RNA, 13 nt, Human
aauuauuucagaa

SEQ ID NO: 2536110 - RNA, 19 nt, Human
aauuauuuauuuaauaaca

SEQ ID NO: 2536111 - RNA, 18 nt, Human
aauuauuuauuauuaaga

SEQ ID NO: 2536112 - RNA, 20 nt, Human
aauuauuuauuuauggagga

SEQ ID NO: 2536113 - RNA, 21 nt, Human
aauuauuuguguaauagaaaa

SEQ ID NO: 2536114 - RNA, 19 nt, Human
aauuauuuguguaauagaa

SEQ ID NO: 2536115 - RNA, 18 nt, Human
aauuauuuguguaauaga

SEQ ID NO: 2536116 - RNA, 15 nt, Human
aauuauuuguguaau

SEQ ID NO: 2536117 - RNA, 12 nt, Human
aauuauuuuaaa

SEQ ID NO: 2536118 - RNA, 14 nt, Human
aauuauuuguguaa

SEQ ID NO: 2536119 - RNA, 12 nt, Human
aauuauuugcau

SEQ ID NO: 2536120 - RNA, 17 nt, Human
aauuauuucagaaaugu

SEQ ID NO: 2536121 - RNA, 17 nt, Human
aauucaauuguaaauug

SEQ ID NO: 2536122 - RNA, 14 nt, Human
aauucaauuguaaa

SEQ ID NO: 2536123 - RNA, 20 nt, Human
aauucaagaaaacaacuuca

SEQ ID NO: 2536124 - RNA, 12 nt, Human
aauucaagaaaa

SEQ ID NO: 2536125 - RNA, 15 nt, Human
aauuauuuuaaaaga

SEQ ID NO: 2536126 - RNA, 18 nt, Human
aauuauuuuaaacaaaau

SEQ ID NO: 2536127 - RNA, 14 nt, Human
aauuauuuuaaaca

SEQ ID NO: 2536128 - RNA, 22 nt, Human
aauucaguuguuagugugucuu

SEQ ID NO: 2536129 - RNA, 17 nt, Human
aauucaguuguuagugu

SEQ ID NO: 2536130 - RNA, 16 nt, Human
aauucagugcuguacu

SEQ ID NO: 2536131 - RNA, 13 nt, Human
aauucauauucug

SEQ ID NO: 2536132 - RNA, 18 nt, Human
aauucaucccaacugucu

SEQ ID NO: 2536133 - RNA, 23 nt, Human
aauucaucaaauggaagacacau

SEQ ID NO: 2536134 - RNA, 11 nt, Human
aauucaguugu

SEQ ID NO: 2536135 - RNA, 23 nt, Human
aauucagcacugauuucacaaca

SEQ ID NO: 2536136 - RNA, 20 nt, Human
aauucagcacugauuucaca

SEQ ID NO: 2536137 - RNA, 15 nt, Human
aauucagcacugauu

SEQ ID NO: 2536138 - RNA, 19 nt, Human
aauucaauuguaaauugaa

SEQ ID NO: 2536139 - RNA, 23 nt, Human
aauucaauuguaaauugaaucag

SEQ ID NO: 2536140 - RNA, 20 nt, Human
aauucagauauauuuuucac

SEQ ID NO: 2536141 - RNA, 20 nt, Human
aauuauuaguuuacaucauu

SEQ ID NO: 2536142 - RNA, 22 nt, Human
aauuauuaaugaaaauaagaau

SEQ ID NO: 2536143 - RNA, 17 nt, Human
aauuauuaaugaaaaua

SEQ ID NO: 2536144 - RNA, 21 nt, Human
aauuauguuuauauaaaugcu

SEQ ID NO: 2536145 - RNA, 21 nt, Human
aauuauuauucuucauaacaa

SEQ ID NO: 2536146 - RNA, 13 nt, Human
aauuauuauucuu

SEQ ID NO: 2536147 - RNA, 16 nt, Human
aauuauuaaugaaaau

SEQ ID NO: 2536148 - RNA, 18 nt, Human
aauuauguuuauauaaau

SEQ ID NO: 2536149 - RNA, 17 nt, Human
aauuauguuuauauaaa

SEQ ID NO: 2536150 - RNA, 22 nt, Human
aauuauguuugccacuuugcaa

SEQ ID NO: 2536151 - RNA, 23 nt, Human
aauuauguuaaacuagcauaucu

SEQ ID NO: 2536152 - RNA, 19 nt, Human
aauuauguuaaacuagcau

SEQ ID NO: 2536153 - RNA, 14 nt, Human
aauuauguuuauau

SEQ ID NO: 2536154 - RNA, 18 nt, Human
aauuauuauuuauauaug

SEQ ID NO: 2536155 - RNA, 16 nt, Human
aauuauuauuuauaua

SEQ ID NO: 2536156 - RNA, 13 nt, Human
aauuauuauuuau

SEQ ID NO: 2536157 - RNA, 11 nt, Human
aauuauuauuu

SEQ ID NO: 2536158 - RNA, 21 nt, Human
aauuauuguacauuuauaguu

SEQ ID NO: 2536159 - RNA, 12 nt, Human
aauuauuguaca

SEQ ID NO: 2536160 - RNA, 21 nt, Human
aauuauuuauuaaaugcccag

SEQ ID NO: 2536161 - RNA, 16 nt, Human
aauuauugugauuucc

SEQ ID NO: 2536162 - RNA, 14 nt, Human
aauuauuuaauaaa

SEQ ID NO: 2536163 - RNA, 13 nt, Human
aauuauugugauu

SEQ ID NO: 2536164 - RNA, 12 nt, Human
aauuauuguaua

SEQ ID NO: 2536165 - RNA, 14 nt, Human
aauuagaagacauu

SEQ ID NO: 2536166 - RNA, 13 nt, Human
aauuagaagacau

SEQ ID NO: 2536167 - RNA, 15 nt, Human
aauuagaagacauuu

SEQ ID NO: 2536168 - RNA, 15 nt, Human
aauuagaauaguguu

SEQ ID NO: 2536169 - RNA, 22 nt, Human
aauuagaaaauguuauuuaaca

SEQ ID NO: 2536170 - RNA, 18 nt, Human
aauuagaaauuggcugga

SEQ ID NO: 2536171 - RNA, 22 nt, Human
aauuacuuaucauccacauugu

SEQ ID NO: 2536172 - RNA, 15 nt, Human
aauuaccaaccuguu

SEQ ID NO: 2536173 - RNA, 13 nt, Human
aauuauguuaaac

SEQ ID NO: 2536174 - RNA, 15 nt, Human
aauuauguuaaacua

SEQ ID NO: 2536175 - RNA, 14 nt, Human
aauuauguuaaacu

SEQ ID NO: 2536176 - RNA, 22 nt, Human
aauuaugugccagauuuaugca

SEQ ID NO: 2536177 - RNA, 22 nt, Human
aauuaugucugcugaauaauaa

SEQ ID NO: 2536178 - RNA, 22 nt, Human
aauuagagcagaugaccccucc

SEQ ID NO: 2536179 - RNA, 12 nt, Human
aauuagagcaga

SEQ ID NO: 2536180 - RNA, 13 nt, Human
uacccccuucugg

SEQ ID NO: 2536181 - RNA, 17 nt, Human
uacccccuccucucugc

SEQ ID NO: 2536182 - RNA, 18 nt, Human
uacccccuccuucagaca

SEQ ID NO: 2536183 - RNA, 23 nt, Human
uacccgggaagggggcugggaca

SEQ ID NO: 2536184 - RNA, 17 nt, Human
uacccguucacauuuuu

SEQ ID NO: 2536185 - RNA, 16 nt, Human
uacccuagccauuccu

SEQ ID NO: 2536186 - RNA, 15 nt, Human
uacccuagccauucc

SEQ ID NO: 2536187 - RNA, 23 nt, Human
uaccucuugagccuugaacuuug

SEQ ID NO: 2536188 - RNA, 13 nt, Human
uaccucuuggcug

SEQ ID NO: 2536189 - RNA, 19 nt, Human
uaccucuuuauuuuuugau

SEQ ID NO: 2536190 - RNA, 23 nt, Human
uacccucaggcauaggccugggu

SEQ ID NO: 2536191 - RNA, 22 nt, Human
uaccucuugagccuugaacuuu

SEQ ID NO: 2536192 - RNA, 16 nt, Human
uacccuauucucucuu

SEQ ID NO: 2536193 - RNA, 22 nt, Human
uacccucaggacaaugucugaa

SEQ ID NO: 2536194 - RNA, 21 nt, Human
uacccucaggcauaggccugg

SEQ ID NO: 2536195 - RNA, 15 nt, Human
uaccugaggggccuc

SEQ ID NO: 2536196 - RNA, 13 nt, Human
uaccugaggggcc

SEQ ID NO: 2536197 - RNA, 16 nt, Human
uaccugaagucuuugu

SEQ ID NO: 2536198 - RNA, 17 nt, Human
uaccugacacucccuug

SEQ ID NO: 2536199 - RNA, 14 nt, Human
uaccugaagucuuu

SEQ ID NO: 2536200 - RNA, 13 nt, Human
uaccugaagucuu

SEQ ID NO: 2536201 - RNA, 23 nt, Human
uaccugaagcuaucguaaaauua

SEQ ID NO: 2536202 - RNA, 13 nt, Human
uaccugaaaacac

SEQ ID NO: 2536203 - RNA, 20 nt, Human
uaccugaaaacacugugcac

SEQ ID NO: 2536204 - RNA, 21 nt, Human
uaccugaaaacacugugcaca

SEQ ID NO: 2536205 - RNA, 20 nt, Human
aauuacaggaaguacuggag

SEQ ID NO: 2536206 - RNA, 19 nt, Human
aauuacaggaaguacugga

SEQ ID NO: 2536207 - RNA, 17 nt, Human
aauuacaggaaguacug

SEQ ID NO: 2536208 - RNA, 13 nt, Human
aauuacauuugua

SEQ ID NO: 2536209 - RNA, 12 nt, Human
uaccuuacugug

SEQ ID NO: 2536210 - RNA, 20 nt, Human
uaccuuacagugagggcuau

SEQ ID NO: 2536211 - RNA, 14 nt, Human
aauuacauaauuuu

SEQ ID NO: 2536212 - RNA, 14 nt, Human
aauuacauuuguau

SEQ ID NO: 2536213 - RNA, 17 nt, Human
aauuacauguaaaacau

SEQ ID NO: 2536214 - RNA, 16 nt, Human
uaccugaggggccucu

SEQ ID NO: 2536215 - RNA, 20 nt, Human
uaccugacacucccuugggc

SEQ ID NO: 2536216 - RNA, 13 nt, Human
uaccugagaccag

SEQ ID NO: 2536217 - RNA, 12 nt, Human
uaccugagacca

SEQ ID NO: 2536218 - RNA, 16 nt, Human
uaccugccaggaagcc

SEQ ID NO: 2536219 - RNA, 19 nt, Human
uaccugaucaaugacagag

SEQ ID NO: 2536220 - RNA, 18 nt, Human
uaccugaucaaugacaga

SEQ ID NO: 2536221 - RNA, 12 nt, Human
uaccugauuuuu

SEQ ID NO: 2536222 - RNA, 22 nt, Human
uaccugccacucacacagccag

SEQ ID NO: 2536223 - RNA, 13 nt, Human
uaccugugaaaua

SEQ ID NO: 2536224 - RNA, 21 nt, Human
uaccugccacucacacagcca

SEQ ID NO: 2536225 - RNA, 20 nt, Human
uaccugccacucacacagcc

SEQ ID NO: 2536226 - RNA, 19 nt, Human
uaccugccacucacacagc

SEQ ID NO: 2536227 - RNA, 16 nt, Human
uaccugccacucacac

SEQ ID NO: 2536228 - RNA, 18 nt, Human
uaccugauuuuuuuuccu

SEQ ID NO: 2536229 - RNA, 12 nt, Human
uaccugugccug

SEQ ID NO: 2536230 - RNA, 16 nt, Human
uaccugugccucggcu

SEQ ID NO: 2536231 - RNA, 20 nt, Human
uaccugugcguuacuaauug

SEQ ID NO: 2536232 - RNA, 13 nt, Human
uaccuguuccuua

SEQ ID NO: 2536233 - RNA, 21 nt, Human
uaccuguucagugucccgggc

SEQ ID NO: 2536234 - RNA, 22 nt, Human
uaccuguuuuguggucagcugu

SEQ ID NO: 2536235 - RNA, 20 nt, Human
uaccuguucagugucccggg

SEQ ID NO: 2536236 - RNA, 16 nt, Human
uaccuguucagugucc

SEQ ID NO: 2536237 - RNA, 12 nt, Human
aauuaacuuuua

SEQ ID NO: 2536238 - RNA, 13 nt, Human
aauuaacuuuuau

SEQ ID NO: 2536239 - RNA, 22 nt, Human
aauguugggacugcuaaauaaa

SEQ ID NO: 2536240 - RNA, 17 nt, Human
aauguuguauucaguga

SEQ ID NO: 2536241 - RNA, 15 nt, Human
aauguuguuauuuaa

SEQ ID NO: 2536242 - RNA, 21 nt, Human
aauguuguucauuauuggagg

SEQ ID NO: 2536243 - RNA, 15 nt, Human
aauuaacuuuuauaa

SEQ ID NO: 2536244 - RNA, 16 nt, Human
aauuaacuuuuauaaa

SEQ ID NO: 2536245 - RNA, 16 nt, Human
aauuaaguacuaugua

SEQ ID NO: 2536246 - RNA, 17 nt, Human
aauuaaguacuauguau

SEQ ID NO: 2536247 - RNA, 21 nt, Human
aauguugggacugcuaaauaa

SEQ ID NO: 2536248 - RNA, 13 nt, Human
aauguugggacug

SEQ ID NO: 2536249 - RNA, 23 nt, Human
aauguuggucauuuuauguuaag

SEQ ID NO: 2536250 - RNA, 19 nt, Human
aauguuggauuuauaaaug

SEQ ID NO: 2536251 - RNA, 22 nt, Human
aauguuggauuuauaaaugcua

SEQ ID NO: 2536252 - RNA, 20 nt, Human
aauguugcuuaggaugugug

SEQ ID NO: 2536253 - RNA, 16 nt, Human
aauguucaucaaugaa

SEQ ID NO: 2536254 - RNA, 20 nt, Human
aauguucaucaaugaaugaa

SEQ ID NO: 2536255 - RNA, 22 nt, Human
aauguucaucccaugauguagu

SEQ ID NO: 2536256 - RNA, 21 nt, Human
aauguucaucccaugauguag

SEQ ID NO: 2536257 - RNA, 12 nt, Human
aauguucaucau

SEQ ID NO: 2536258 - RNA, 21 nt, Human
aauguuauuuuuuaauuauua

SEQ ID NO: 2536259 - RNA, 22 nt, Human
aauguuauuuguuauuuucagu

SEQ ID NO: 2536260 - RNA, 22 nt, Human
aauguucauuguaauguuacug

SEQ ID NO: 2536261 - RNA, 24 nt, Human
aauguucauuguaauguuacugau

SEQ ID NO: 2536262 - RNA, 11 nt, Human
aauguucauug

SEQ ID NO: 2536263 - RNA, 12 nt, Human
aauguucauugu

SEQ ID NO: 2536264 - RNA, 17 nt, Human
aauguucauuguaaugu

SEQ ID NO: 2536265 - RNA, 21 nt, Human
aauguucauuguaauguuacu

SEQ ID NO: 2536266 - RNA, 20 nt, Human
aauguuauuuuuuaauuauu

SEQ ID NO: 2536267 - RNA, 19 nt, Human
aauguuauuuuuuaauuau

SEQ ID NO: 2536268 - RNA, 13 nt, Human
aauguucaucaau

SEQ ID NO: 2536269 - RNA, 23 nt, Human
aauguuauuuguuauuuucagua

SEQ ID NO: 2536270 - RNA, 21 nt, Human
aauguuauuuguuauuuucag

SEQ ID NO: 2536271 - RNA, 14 nt, Human
aauguuauuuaaca

SEQ ID NO: 2536272 - RNA, 22 nt, Human
aauguuauguuguguucuaaua

SEQ ID NO: 2536273 - RNA, 15 nt, Human
aauguuacauuauua

SEQ ID NO: 2536274 - RNA, 17 nt, Human
aauguggccuaaaaaug

SEQ ID NO: 2536275 - RNA, 20 nt, Human
aauguggccuaaaaaugcaa

SEQ ID NO: 2536276 - RNA, 16 nt, Human
aauguuacauuauuau

SEQ ID NO: 2536277 - RNA, 15 nt, Human
aauguuacauuguuu

SEQ ID NO: 2536278 - RNA, 13 nt, Human
aauguuacugauc

SEQ ID NO: 2536279 - RNA, 18 nt, Human
aauguuacugaucaugca

SEQ ID NO: 2536280 - RNA, 19 nt, Human
aauguuacugaucaugcau

SEQ ID NO: 2536281 - RNA, 20 nt, Human
aauguuacugaucaugcauu

SEQ ID NO: 2536282 - RNA, 21 nt, Human
aauguuacugaucaugcauug

SEQ ID NO: 2536283 - RNA, 22 nt, Human
aauguuagagguuuuaaaguga

SEQ ID NO: 2536284 - RNA, 17 nt, Human
aauguuagagguuuuaa

SEQ ID NO: 2536285 - RNA, 22 nt, Human
aauguuacugaucaugcauugu

SEQ ID NO: 2536286 - RNA, 15 nt, Human
aauguuagauaguua

SEQ ID NO: 2536287 - RNA, 19 nt, Human
aaugugcuguguaaaguua

SEQ ID NO: 2536288 - RNA, 18 nt, Human
aaugugcuguguaaaguu

SEQ ID NO: 2536289 - RNA, 17 nt, Human
aaugugcuguguaaagu

SEQ ID NO: 2536290 - RNA, 16 nt, Human
aaugugcuguguaaag

SEQ ID NO: 2536291 - RNA, 15 nt, Human
aaugugcuguguaaa

SEQ ID NO: 2536292 - RNA, 14 nt, Human
aaugugcuguguaa

SEQ ID NO: 2536293 - RNA, 13 nt, Human
aaugugcugugua

SEQ ID NO: 2536294 - RNA, 12 nt, Human
aaugugcugugu

SEQ ID NO: 2536295 - RNA, 21 nt, Human
aaugugcuguguaaaguuagu

SEQ ID NO: 2536296 - RNA, 20 nt, Human
aaugugcuguguaaaguuag

SEQ ID NO: 2536297 - RNA, 21 nt, Human
aauguggccccugaacaagaa

SEQ ID NO: 2536298 - RNA, 22 nt, Human
aauguggcaaggaaaaacaggu

SEQ ID NO: 2536299 - RNA, 21 nt, Human
aaugugcugaaugguuuucaa

SEQ ID NO: 2536300 - RNA, 19 nt, Human
uacaggguagauaaccugu

SEQ ID NO: 2536301 - RNA, 22 nt, Human
uacaggguagcagguaccacug

SEQ ID NO: 2536302 - RNA, 18 nt, Human
uacaggguagcagguacc

SEQ ID NO: 2536303 - RNA, 21 nt, Human
uacagguaaggugagggaaua

SEQ ID NO: 2536304 - RNA, 18 nt, Human
uacagggagccuccugcc

SEQ ID NO: 2536305 - RNA, 17 nt, Human
uacagggagccuccugc

SEQ ID NO: 2536306 - RNA, 16 nt, Human
uacagggagccuccug

SEQ ID NO: 2536307 - RNA, 15 nt, Human
uacagggagccuccu

SEQ ID NO: 2536308 - RNA, 17 nt, Human
uacagggaugguguuca

SEQ ID NO: 2536309 - RNA, 22 nt, Human
uacagagaggucaagcccagga

SEQ ID NO: 2536310 - RNA, 13 nt, Human
uacagggagccuc

SEQ ID NO: 2536311 - RNA, 21 nt, Human
uacagggcaugcauuuugcag

SEQ ID NO: 2536312 - RNA, 21 nt, Human
uacagggagccuccugcccag

SEQ ID NO: 2536313 - RNA, 20 nt, Human
uacagggagccuccugccca

SEQ ID NO: 2536314 - RNA, 16 nt, Human
uacagggagcugggac

SEQ ID NO: 2536315 - RNA, 19 nt, Human
uaccagggacugaggggag

SEQ ID NO: 2536316 - RNA, 16 nt, Human
uaccaggaacuauaaa

SEQ ID NO: 2536317 - RNA, 22 nt, Human
uaccagcugcgcuugcuuuucu

SEQ ID NO: 2536318 - RNA, 21 nt, Human
uaccagcugcgcuugcuuuuc

SEQ ID NO: 2536319 - RNA, 14 nt, Human
uaccagcugcgcuu

SEQ ID NO: 2536320 - RNA, 13 nt, Human
uaccagcugcgcu

SEQ ID NO: 2536321 - RNA, 13 nt, Human
uaccagcgaggag

SEQ ID NO: 2536322 - RNA, 15 nt, Human
uaccagcgaggaggc

SEQ ID NO: 2536323 - RNA, 20 nt, Human
uaccagcgcccgcugggcug

SEQ ID NO: 2536324 - RNA, 19 nt, Human
uaccagcgcccgcugggcu

SEQ ID NO: 2536325 - RNA, 18 nt, Human
uaccagcgcccgcugggc

SEQ ID NO: 2536326 - RNA, 20 nt, Human
uaccagcgaggaggcuccag

SEQ ID NO: 2536327 - RNA, 17 nt, Human
uaccagcgcccgcuggg

SEQ ID NO: 2536328 - RNA, 21 nt, Human
uaccagccuccguauuucaga

SEQ ID NO: 2536329 - RNA, 20 nt, Human
uaccaggccgccccagccuc

SEQ ID NO: 2536330 - RNA, 16 nt, Human
uaccaggucuccucca

SEQ ID NO: 2536331 - RNA, 14 nt, Human
uaccaggucuccuc

SEQ ID NO: 2536332 - RNA, 22 nt, Human
uaccaggccgccccagccucug

SEQ ID NO: 2536333 - RNA, 20 nt, Human
uaccaggucuccuccaccgc

SEQ ID NO: 2536334 - RNA, 18 nt, Human
uaccaggucuccuccacc

SEQ ID NO: 2536335 - RNA, 22 nt, Human
uaccaggucuccuccaccgcca

SEQ ID NO: 2536336 - RNA, 14 nt, Human
uaccagguguucua

SEQ ID NO: 2536337 - RNA, 14 nt, Human
uaccagguugaaag

SEQ ID NO: 2536338 - RNA, 15 nt, Human
uaccagguugaaaga

SEQ ID NO: 2536339 - RNA, 16 nt, Human
uaccagguugaaagac

SEQ ID NO: 2536340 - RNA, 14 nt, Human
uaccauucagugau

SEQ ID NO: 2536341 - RNA, 16 nt, Human
uacccccuaagagcca

SEQ ID NO: 2536342 - RNA, 13 nt, Human
uacccccuccuuc

SEQ ID NO: 2536343 - RNA, 16 nt, Human
uacccccuccuucaga

SEQ ID NO: 2536344 - RNA, 17 nt, Human
uacccccuccuucagac

SEQ ID NO: 2536345 - RNA, 15 nt, Human
uacccccugcaaagc

SEQ ID NO: 2536346 - RNA, 19 nt, Human
uacccccugcaaagcccag

SEQ ID NO: 2536347 - RNA, 23 nt, Human
uacccccugcaaagcccagcuug

SEQ ID NO: 2536348 - RNA, 16 nt, Human
uaccaugccauuuaaa

SEQ ID NO: 2536349 - RNA, 16 nt, Human
uaccagugaaccaaag

SEQ ID NO: 2536350 - RNA, 15 nt, Human
uaccagugaaccaaa

SEQ ID NO: 2536351 - RNA, 11 nt, Human
uaccagugugg

SEQ ID NO: 2536352 - RNA, 15 nt, Human
uaccaugugccugau

SEQ ID NO: 2536353 - RNA, 15 nt, Human
uaccaugucacugug

SEQ ID NO: 2536354 - RNA, 14 nt, Human
uaccaugucacugu

SEQ ID NO: 2536355 - RNA, 18 nt, Human
uaccagugaaccaaagag

SEQ ID NO: 2536356 - RNA, 16 nt, Human
uaccaugugccugauc

SEQ ID NO: 2536357 - RNA, 16 nt, Human
uaccaugucacugugg

SEQ ID NO: 2536358 - RNA, 14 nt, Human
uaccagcagagcac

SEQ ID NO: 2536359 - RNA, 13 nt, Human
uaccagcagagca

SEQ ID NO: 2536360 - RNA, 22 nt, Human
uaccagcagagcaccuuagaca

SEQ ID NO: 2536361 - RNA, 18 nt, Human
uaccagccaguaaauggg

SEQ ID NO: 2536362 - RNA, 15 nt, Human
uaccagauaaaauua

SEQ ID NO: 2536363 - RNA, 19 nt, Human
uaccagaguuguucugucu

SEQ ID NO: 2536364 - RNA, 22 nt, Human
uacauuucuuagacuacauuua

SEQ ID NO: 2536365 - RNA, 18 nt, Human
uaccagaugaugggggag

SEQ ID NO: 2536366 - RNA, 12 nt, Human
uaccagcagagc

SEQ ID NO: 2536367 - RNA, 18 nt, Human
uacauuucuccuuugaua

SEQ ID NO: 2536368 - RNA, 16 nt, Human
uacauuucccugugcu

SEQ ID NO: 2536369 - RNA, 16 nt, Human
uacauuuccaaaugaa

SEQ ID NO: 2536370 - RNA, 21 nt, Human
uacauuuccaaauucacaagu

SEQ ID NO: 2536371 - RNA, 23 nt, Human
uacauuucuccuuugauaaaaua

SEQ ID NO: 2536372 - RNA, 22 nt, Human
uacauuucuccuuugauaaaau

SEQ ID NO: 2536373 - RNA, 14 nt, Human
uacauuucugaaau

SEQ ID NO: 2536374 - RNA, 16 nt, Human
uacauuucugaaauga

SEQ ID NO: 2536375 - RNA, 13 nt, Human
uacauuuccuaaa

SEQ ID NO: 2536376 - RNA, 22 nt, Human
uacauuuaugauuuaauaaaau

SEQ ID NO: 2536377 - RNA, 20 nt, Human
uacauuuaugauuuaauaaa

SEQ ID NO: 2536378 - RNA, 19 nt, Human
uacauuuaugauuuaauaa

SEQ ID NO: 2536379 - RNA, 18 nt, Human
uacauuuaugauuuaaua

SEQ ID NO: 2536380 - RNA, 23 nt, Human
uacauuuaugauuuaauaaaaua

SEQ ID NO: 2536381 - RNA, 15 nt, Human
uacauuuccaaauga

SEQ ID NO: 2536382 - RNA, 12 nt, Human
uacauucuguua

SEQ ID NO: 2536383 - RNA, 17 nt, Human
uacauuuaugauuuaau

SEQ ID NO: 2536384 - RNA, 13 nt, Human
uacauucauuuag

SEQ ID NO: 2536385 - RNA, 15 nt, Human
uacauucauuuagcu

SEQ ID NO: 2536386 - RNA, 15 nt, Human
uacauucaauguuua

SEQ ID NO: 2536387 - RNA, 21 nt, Human
uacauuagucauucaauaaau

SEQ ID NO: 2536388 - RNA, 11 nt, Human
aauuaauaaau

SEQ ID NO: 2536389 - RNA, 13 nt, Human
aauuaaguaucug

SEQ ID NO: 2536390 - RNA, 14 nt, Human
aauuaaguaucuga

SEQ ID NO: 2536391 - RNA, 23 nt, Human
aauuaauaaaaaauggaaagaau

SEQ ID NO: 2536392 - RNA, 14 nt, Human
aauuaaguuaucuu

SEQ ID NO: 2536393 - RNA, 22 nt, Human
aauuaaguuagggaauggcaca

SEQ ID NO: 2536394 - RNA, 22 nt, Human
acaggcccggcuccaggcuccu

SEQ ID NO: 2536395 - RNA, 21 nt, Human
acaggcccggcuccaggcucc

SEQ ID NO: 2536396 - RNA, 20 nt, Human
acaggcccggcuccaggcuc

SEQ ID NO: 2536397 - RNA, 18 nt, Human
acaggcccggcuccaggc

SEQ ID NO: 2536398 - RNA, 22 nt, Human
acaggcccuuccucuccacugc

SEQ ID NO: 2536399 - RNA, 15 nt, Human
acaggcccuuccucu

SEQ ID NO: 2536400 - RNA, 21 nt, Human
acaggcccuuuccucaggcaa

SEQ ID NO: 2536401 - RNA, 20 nt, Human
acaggcccuuuccucaggca

SEQ ID NO: 2536402 - RNA, 19 nt, Human
acaggcccuuuccucaggc

SEQ ID NO: 2536403 - RNA, 18 nt, Human
acaggcccuuuccucagg

SEQ ID NO: 2536404 - RNA, 21 nt, Human
acaggcccucccuguucccca

SEQ ID NO: 2536405 - RNA, 22 nt, Human
acaggcccucccuguuccccag

SEQ ID NO: 2536406 - RNA, 23 nt, Human
acaggcccucccuguuccccaga

SEQ ID NO: 2536407 - RNA, 13 nt, Human
acaggcccuuccu

SEQ ID NO: 2536408 - RNA, 21 nt, Human
acaggccugagauuucaucug

SEQ ID NO: 2536409 - RNA, 17 nt, Human
acaggccugagauuuca

SEQ ID NO: 2536410 - RNA, 16 nt, Human
acaggccucccuguuu

SEQ ID NO: 2536411 - RNA, 15 nt, Human
acaggccugagauuu

SEQ ID NO: 2536412 - RNA, 13 nt, Human
acaggccucccug

SEQ ID NO: 2536413 - RNA, 11 nt, Human
acaggccuccc

SEQ ID NO: 2536414 - RNA, 16 nt, Human
acaggccgcccugcgg

SEQ ID NO: 2536415 - RNA, 23 nt, Human
uauguccacuguguauagaagua

SEQ ID NO: 2536416 - RNA, 17 nt, Human
uauguccacuguguaua

SEQ ID NO: 2536417 - RNA, 13 nt, Human
uauguccuaagga

SEQ ID NO: 2536418 - RNA, 20 nt, Human
uaugucccuucacauaguuu

SEQ ID NO: 2536419 - RNA, 15 nt, Human
uaugucccuucacau

SEQ ID NO: 2536420 - RNA, 15 nt, Human
uaugucccuugcugu

SEQ ID NO: 2536421 - RNA, 10 nt, Human
uaugucuguu

SEQ ID NO: 2536422 - RNA, 16 nt, Human
uaugugauuuuaacuc

SEQ ID NO: 2536423 - RNA, 18 nt, Human
uaugugauuuuaacucug

SEQ ID NO: 2536424 - RNA, 19 nt, Human
uaugugauuuuaacucugu

SEQ ID NO: 2536425 - RNA, 21 nt, Human
uaugugauuuuaacucugucu

SEQ ID NO: 2536426 - RNA, 12 nt, Human
uaugugcacugu

SEQ ID NO: 2536427 - RNA, 15 nt, Human
uaugucuauuuaagc

SEQ ID NO: 2536428 - RNA, 14 nt, Human
uaugucucuucuga

SEQ ID NO: 2536429 - RNA, 19 nt, Human
uaugucucuucugagcuau

SEQ ID NO: 2536430 - RNA, 13 nt, Human
uaugucuauuuaa

SEQ ID NO: 2536431 - RNA, 12 nt, Human
uaugucuauuua

SEQ ID NO: 2536432 - RNA, 16 nt, Human
uaugucuaaagagcuu

SEQ ID NO: 2536433 - RNA, 12 nt, Human
uaugucuaaaga

SEQ ID NO: 2536434 - RNA, 21 nt, Human
uaugucucgugguaggacugu

SEQ ID NO: 2536435 - RNA, 21 nt, Human
acaggcagcuggaugagacuu

SEQ ID NO: 2536436 - RNA, 22 nt, Human
acaggcagcgauggucucagaa

SEQ ID NO: 2536437 - RNA, 22 nt, Human
acaggcagccuggacauagaga

SEQ ID NO: 2536438 - RNA, 20 nt, Human
acaggcagcuuuaaccauua

SEQ ID NO: 2536439 - RNA, 16 nt, Human
acaggaggacaauuca

SEQ ID NO: 2536440 - RNA, 15 nt, Human
acaggaggacaauuc

SEQ ID NO: 2536441 - RNA, 14 nt, Human
acaggagcugggau

SEQ ID NO: 2536442 - RNA, 20 nt, Human
acaggaggacaauucaugaa

SEQ ID NO: 2536443 - RNA, 17 nt, Human
acaggaggacaauucau

SEQ ID NO: 2536444 - RNA, 13 nt, Human
acaggcagcacag

SEQ ID NO: 2536445 - RNA, 17 nt, Human
acaggcagcacagagac

SEQ ID NO: 2536446 - RNA, 16 nt, Human
acaggcagccuggaca

SEQ ID NO: 2536447 - RNA, 13 nt, Human
acaggcagcagag

SEQ ID NO: 2536448 - RNA, 12 nt, Human
acaggcagcaga

SEQ ID NO: 2536449 - RNA, 14 nt, Human
acaggcagcagaga

SEQ ID NO: 2536450 - RNA, 14 nt, Human
acaggcagcauuua

SEQ ID NO: 2536451 - RNA, 17 nt, Human
acaggcccggcuccagg

SEQ ID NO: 2536452 - RNA, 16 nt, Human
acaggcccggcuccag

SEQ ID NO: 2536453 - RNA, 18 nt, Human
acaggcccagcauugcug

SEQ ID NO: 2536454 - RNA, 15 nt, Human
acaggcccagcauug

SEQ ID NO: 2536455 - RNA, 13 nt, Human
acaggcccagcau

SEQ ID NO: 2536456 - RNA, 12 nt, Human
acaggcccagca

SEQ ID NO: 2536457 - RNA, 18 nt, Human
acaggcccaagagaugaa

SEQ ID NO: 2536458 - RNA, 11 nt, Human
acaggcccagc

SEQ ID NO: 2536459 - RNA, 22 nt, Human
acaggcccaagagaugaagagu

SEQ ID NO: 2536460 - RNA, 22 nt, Human
acaggcccagcauugcugguuc

SEQ ID NO: 2536461 - RNA, 20 nt, Human
acaggcccagcauugcuggu

SEQ ID NO: 2536462 - RNA, 12 nt, Human
acaggcccccuu

SEQ ID NO: 2536463 - RNA, 21 nt, Human
acaggcccccuugaguggggu

SEQ ID NO: 2536464 - RNA, 23 nt, Human
acaggcccagcauugcugguucu

SEQ ID NO: 2536465 - RNA, 22 nt, Human
acaggcccggcgcgguggcuca

SEQ ID NO: 2536466 - RNA, 20 nt, Human
acaggaaaauuuuaaaaaua

SEQ ID NO: 2536467 - RNA, 21 nt, Human
acagcuugagccgggccccug

SEQ ID NO: 2536468 - RNA, 16 nt, Human
acagcuugagccgggc

SEQ ID NO: 2536469 - RNA, 23 nt, Human
acagcuugaccugaggcuguggu

SEQ ID NO: 2536470 - RNA, 22 nt, Human
acagcuugagccgggccccugg

SEQ ID NO: 2536471 - RNA, 16 nt, Human
acaggaaaauccucug

SEQ ID NO: 2536472 - RNA, 17 nt, Human
acaggaaaauccucugg

SEQ ID NO: 2536473 - RNA, 18 nt, Human
acaggaaaauccucuggc

SEQ ID NO: 2536474 - RNA, 22 nt, Human
acaggaaccacaagacugcaca

SEQ ID NO: 2536475 - RNA, 23 nt, Human
acaggaaaauccucuggcuggcu

SEQ ID NO: 2536476 - RNA, 16 nt, Human
acaggaaagggaaggc

SEQ ID NO: 2536477 - RNA, 19 nt, Human
acaggaaagggaaggcccc

SEQ ID NO: 2536478 - RNA, 22 nt, Human
acaggaaagggaaggccccaca

SEQ ID NO: 2536479 - RNA, 18 nt, Human
acaggagagaaaggggau

SEQ ID NO: 2536480 - RNA, 19 nt, Human
acaggagagaaaggggaug

SEQ ID NO: 2536481 - RNA, 13 nt, Human
acaggagcuggga

SEQ ID NO: 2536482 - RNA, 15 nt, Human
acaggcagauacagg

SEQ ID NO: 2536483 - RNA, 15 nt, Human
acaggacucugccuc

SEQ ID NO: 2536484 - RNA, 16 nt, Human
acaggacucugccucc

SEQ ID NO: 2536485 - RNA, 14 nt, Human
acaggagaccuggc

SEQ ID NO: 2536486 - RNA, 15 nt, Human
acaggagagaaaggg

SEQ ID NO: 2536487 - RNA, 11 nt, Human
acaggagaaau

SEQ ID NO: 2536488 - RNA, 21 nt, Human
acaggaaaagcugcugacagu

SEQ ID NO: 2536489 - RNA, 20 nt, Human
acaggaaaagcugcugacag

SEQ ID NO: 2536490 - RNA, 19 nt, Human
acaggaaaagcugcugaca

SEQ ID NO: 2536491 - RNA, 18 nt, Human
acaggaaaagcugcugac

SEQ ID NO: 2536492 - RNA, 23 nt, Human
acagcuugaccgugaggccagag

SEQ ID NO: 2536493 - RNA, 22 nt, Human
acagcuugaccgugaggccaga

SEQ ID NO: 2536494 - RNA, 22 nt, Human
acagcuugaccugaggcugugg

SEQ ID NO: 2536495 - RNA, 21 nt, Human
acagcuugaccugaggcugug

SEQ ID NO: 2536496 - RNA, 19 nt, Human
acagcuugaccugaggcug

SEQ ID NO: 2536497 - RNA, 17 nt, Human
acagcuugaccugaggc

SEQ ID NO: 2536498 - RNA, 15 nt, Human
acagcuugaccugag

SEQ ID NO: 2536499 - RNA, 20 nt, Human
acagcuuccccucucuccuc

SEQ ID NO: 2536500 - RNA, 21 nt, Human
acagcuucucauccugcaggc

SEQ ID NO: 2536501 - RNA, 21 nt, Human
acagcuucauuuccugugucu

SEQ ID NO: 2536502 - RNA, 19 nt, Human
acagcuucauuuccugugu

SEQ ID NO: 2536503 - RNA, 17 nt, Human
acagcuucauuuccugu

SEQ ID NO: 2536504 - RNA, 20 nt, Human
acagcuucagguuaucgaaa

SEQ ID NO: 2536505 - RNA, 15 nt, Human
acagcuucagguuau

SEQ ID NO: 2536506 - RNA, 13 nt, Human
acagcuucagguu

SEQ ID NO: 2536507 - RNA, 22 nt, Human
acagcuucagccaggagcuggg

SEQ ID NO: 2536508 - RNA, 21 nt, Human
acagcuucagccaggagcugg

SEQ ID NO: 2536509 - RNA, 21 nt, Human
acagcuugaccgugaggccag

SEQ ID NO: 2536510 - RNA, 20 nt, Human
acagcuugaccgugaggcca

SEQ ID NO: 2536511 - RNA, 17 nt, Human
acagcuugaccgugagg

SEQ ID NO: 2536512 - RNA, 22 nt, Human
acagcuucagguuaucgaaaua

SEQ ID NO: 2536513 - RNA, 22 nt, Human
acagcuuccccucucuccuccu

SEQ ID NO: 2536514 - RNA, 20 nt, Human
acagcuucucauccugcagg

SEQ ID NO: 2536515 - RNA, 23 nt, Human
acagcuguaugauucccagccag

SEQ ID NO: 2536516 - RNA, 20 nt, Human
acagcuguaugauucccagc

SEQ ID NO: 2536517 - RNA, 19 nt, Human
acagcuguaugauucccag

SEQ ID NO: 2536518 - RNA, 14 nt, Human
acagcuguaugauu

SEQ ID NO: 2536519 - RNA, 14 nt, Human
acagcuguuuaaga

SEQ ID NO: 2536520 - RNA, 17 nt, Human
acagcuguuuaagaugg

SEQ ID NO: 2536521 - RNA, 15 nt, Human
acagcuguuuaagau

SEQ ID NO: 2536522 - RNA, 19 nt, Human
acagcuguuuaagaugggc

SEQ ID NO: 2536523 - RNA, 18 nt, Human
acagcuucagccaggagc

SEQ ID NO: 2536524 - RNA, 17 nt, Human
acagcuucagccaggag

SEQ ID NO: 2536525 - RNA, 15 nt, Human
acagcuucagccagg

SEQ ID NO: 2536526 - RNA, 14 nt, Human
acagcugucccugu

SEQ ID NO: 2536527 - RNA, 18 nt, Human
acagcugucccugucacc

SEQ ID NO: 2536528 - RNA, 15 nt, Human
acagcugucccuguc

SEQ ID NO: 2536529 - RNA, 16 nt, Human
acagcugucccuguca

SEQ ID NO: 2536530 - RNA, 19 nt, Human
acagcuaaugggacacuaa

SEQ ID NO: 2536531 - RNA, 17 nt, Human
acagcuaaugggacacu

SEQ ID NO: 2536532 - RNA, 16 nt, Human
acagcuaaugggacac

SEQ ID NO: 2536533 - RNA, 15 nt, Human
acagcuaaugggaca

SEQ ID NO: 2536534 - RNA, 18 nt, Human
acagcucagaaguuucuu

SEQ ID NO: 2536535 - RNA, 20 nt, Human
acagcucaagucuucccuga

SEQ ID NO: 2536536 - RNA, 23 nt, Human
acagcucaagucuucccugauca

SEQ ID NO: 2536537 - RNA, 21 nt, Human
acagcucagcuuuuugucuuu

SEQ ID NO: 2536538 - RNA, 16 nt, Human
acagcuaugggagccc

SEQ ID NO: 2536539 - RNA, 17 nt, Human
acagcuaugggagcccc

SEQ ID NO: 2536540 - RNA, 21 nt, Human
acagcuaugggagccccaggg

SEQ ID NO: 2536541 - RNA, 13 nt, Human
acagcuacacaga

SEQ ID NO: 2536542 - RNA, 14 nt, Human
uaugaggcauuugu

SEQ ID NO: 2536543 - RNA, 15 nt, Human
uaugaggcauuuguu

SEQ ID NO: 2536544 - RNA, 21 nt, Human
uaugaggcauuuguuugaacu

SEQ ID NO: 2536545 - RNA, 15 nt, Human
uaugaaguauauaau

SEQ ID NO: 2536546 - RNA, 14 nt, Human
uaugaaguauauaa

SEQ ID NO: 2536547 - RNA, 16 nt, Human
uaugaggcauuuggca

SEQ ID NO: 2536548 - RNA, 23 nt, Human
uaugaggcauuuguuugaacuga

SEQ ID NO: 2536549 - RNA, 16 nt, Human
uaugaaguauauaaug

SEQ ID NO: 2536550 - RNA, 21 nt, Human
uaugaaggcuguacacugcac

SEQ ID NO: 2536551 - RNA, 23 nt, Human
uaugaagcuuuuaugugaaacau

SEQ ID NO: 2536552 - RNA, 22 nt, Human
uaugaagcuuuuaugugaaaca

SEQ ID NO: 2536553 - RNA, 20 nt, Human
uaugaagcuuuuaugugaaa

SEQ ID NO: 2536554 - RNA, 22 nt, Human
acagcccucccgccccuucccc

SEQ ID NO: 2536555 - RNA, 21 nt, Human
acagcccucccgccccuuccc

SEQ ID NO: 2536556 - RNA, 18 nt, Human
acagcccucccgccccuu

SEQ ID NO: 2536557 - RNA, 15 nt, Human
acagcccucccgccc

SEQ ID NO: 2536558 - RNA, 14 nt, Human
acagcccucccgcc

SEQ ID NO: 2536559 - RNA, 12 nt, Human
acagcccuguca

SEQ ID NO: 2536560 - RNA, 13 nt, Human
acagcccugucag

SEQ ID NO: 2536561 - RNA, 19 nt, Human
acagcccuucuuuccacag

SEQ ID NO: 2536562 - RNA, 20 nt, Human
acagcccugucagugcagcc

SEQ ID NO: 2536563 - RNA, 21 nt, Human
acagcccugucagugcagccc

SEQ ID NO: 2536564 - RNA, 24 nt, Human
uaugaagcucaccuguugcuuaca

SEQ ID NO: 2536565 - RNA, 17 nt, Human
uaugaagcucaccuguu

SEQ ID NO: 2536566 - RNA, 17 nt, Human
uaugaaacuuaggaagg

SEQ ID NO: 2536567 - RNA, 21 nt, Human
uaucuuuuuuuuauuccacau

SEQ ID NO: 2536568 - RNA, 15 nt, Human
uaugaaaacuuauga

SEQ ID NO: 2536569 - RNA, 13 nt, Human
uaugaaaacuuau

SEQ ID NO: 2536570 - RNA, 18 nt, Human
uaugaaaaauaugauauu

SEQ ID NO: 2536571 - RNA, 18 nt, Human
uaugaaaaacaaaaauaa

SEQ ID NO: 2536572 - RNA, 14 nt, Human
uaugaaaaauauga

SEQ ID NO: 2536573 - RNA, 16 nt, Human
acagcccgggcucugc

SEQ ID NO: 2536574 - RNA, 23 nt, Human
acagcccuccaucuaaacugccc

SEQ ID NO: 2536575 - RNA, 15 nt, Human
acagcccgggcucug

SEQ ID NO: 2536576 - RNA, 14 nt, Human
acagccccuccucc

SEQ ID NO: 2536577 - RNA, 16 nt, Human
acagccccuccuccau

SEQ ID NO: 2536578 - RNA, 22 nt, Human
acagcacuggcucucuccagga

SEQ ID NO: 2536579 - RNA, 20 nt, Human
acagcacuggcucucuccag

SEQ ID NO: 2536580 - RNA, 19 nt, Human
acagcacuggcucucucca

SEQ ID NO: 2536581 - RNA, 17 nt, Human
acagcacuacucugugc

SEQ ID NO: 2536582 - RNA, 20 nt, Human
acagcacuacucugugccag

SEQ ID NO: 2536583 - RNA, 15 nt, Human
acagcacuacucugu

SEQ ID NO: 2536584 - RNA, 14 nt, Human
acagcacuacucug

SEQ ID NO: 2536585 - RNA, 13 nt, Human
acagcacuacucu

SEQ ID NO: 2536586 - RNA, 12 nt, Human
acagcacuacuc

SEQ ID NO: 2536587 - RNA, 19 nt, Human
acagcacgggggccaagga

SEQ ID NO: 2536588 - RNA, 15 nt, Human
acagcagagguucuu

SEQ ID NO: 2536589 - RNA, 15 nt, Human
acagcccccucugcc

SEQ ID NO: 2536590 - RNA, 17 nt, Human
acagcagccccugcaca

SEQ ID NO: 2536591 - RNA, 22 nt, Human
acagauuugugaacucagccaa

SEQ ID NO: 2536592 - RNA, 21 nt, Human
acagauuugugaacucagcca

SEQ ID NO: 2536593 - RNA, 15 nt, Human
acagauuugugaacu

SEQ ID NO: 2536594 - RNA, 14 nt, Human
acagauuugugaac

SEQ ID NO: 2536595 - RNA, 13 nt, Human
acagauuugugaa

SEQ ID NO: 2536596 - RNA, 19 nt, Human
uaucuauauguacuuguca

SEQ ID NO: 2536597 - RNA, 22 nt, Human
acagauuuugggguuguguugu

SEQ ID NO: 2536598 - RNA, 20 nt, Human
acagauuuugggguuguguu

SEQ ID NO: 2536599 - RNA, 20 nt, Human
acagauuuugauagcaaagc

SEQ ID NO: 2536600 - RNA, 19 nt, Human
acagauuuugauagcaaag

SEQ ID NO: 2536601 - RNA, 17 nt, Human
acagauuuugauagcaa

SEQ ID NO: 2536602 - RNA, 22 nt, Human
acagauuugagcucagcccugg

SEQ ID NO: 2536603 - RNA, 12 nt, Human
acagauuuguga

SEQ ID NO: 2536604 - RNA, 21 nt, Human
acagcacagagaagacaaaau

SEQ ID NO: 2536605 - RNA, 15 nt, Human
acagcacagagaaga

SEQ ID NO: 2536606 - RNA, 22 nt, Human
acagcacagagaagacaaaauu

SEQ ID NO: 2536607 - RNA, 12 nt, Human
acagcacagcca

SEQ ID NO: 2536608 - RNA, 13 nt, Human
acagcacagagaa

SEQ ID NO: 2536609 - RNA, 14 nt, Human
acagcacagagaag

SEQ ID NO: 2536610 - RNA, 15 nt, Human
acagauuuuuacaaa

SEQ ID NO: 2536611 - RNA, 18 nt, Human
acagcaagggugauggga

SEQ ID NO: 2536612 - RNA, 16 nt, Human
acagcaagucaggguu

SEQ ID NO: 2536613 - RNA, 12 nt, Human
acagcaagucag

SEQ ID NO: 2536614 - RNA, 15 nt, Human
uaugcaugugaagaa

SEQ ID NO: 2536615 - RNA, 16 nt, Human
uaugcaugugaagaaa

SEQ ID NO: 2536616 - RNA, 14 nt, Human
uaugccaaagauca

SEQ ID NO: 2536617 - RNA, 22 nt, Human
uaugcaugguguagaugcccug

SEQ ID NO: 2536618 - RNA, 20 nt, Human
uaugcauggaaaccugaaaa

SEQ ID NO: 2536619 - RNA, 22 nt, Human
uaugcauggugccccaggacca

SEQ ID NO: 2536620 - RNA, 23 nt, Human
uaugcauggugccccaggaccag

SEQ ID NO: 2536621 - RNA, 18 nt, Human
uaugcauggugccccagg

SEQ ID NO: 2536622 - RNA, 20 nt, Human
uaugcauggugccccaggac

SEQ ID NO: 2536623 - RNA, 21 nt, Human
uaugcauggugccccaggacc

SEQ ID NO: 2536624 - RNA, 22 nt, Human
uaugcaugaaguaauaugcaca

SEQ ID NO: 2536625 - RNA, 22 nt, Human
uaugauauuuucugugccugaa

SEQ ID NO: 2536626 - RNA, 15 nt, Human
uaugauauuuucugu

SEQ ID NO: 2536627 - RNA, 17 nt, Human
uaugauacuugaaaauu

SEQ ID NO: 2536628 - RNA, 18 nt, Human
uaugauauugcauaugca

SEQ ID NO: 2536629 - RNA, 14 nt, Human
uauggcagcgaaag

SEQ ID NO: 2536630 - RNA, 18 nt, Human
uaugcccaguuucugccu

SEQ ID NO: 2536631 - RNA, 15 nt, Human
uaugccccauucaac

SEQ ID NO: 2536632 - RNA, 20 nt, Human
uaugcccaguuucugccucu

SEQ ID NO: 2536633 - RNA, 12 nt, Human
uaugcccaguuu

SEQ ID NO: 2536634 - RNA, 17 nt, Human
uaugccaugauggaaau

SEQ ID NO: 2536635 - RNA, 22 nt, Human
uaugccacgggaaguuuagaga

SEQ ID NO: 2536636 - RNA, 17 nt, Human
uaugccaaagaucacuu

SEQ ID NO: 2536637 - RNA, 14 nt, Human
uaugccaugaugga

SEQ ID NO: 2536638 - RNA, 22 nt, Human
uaugccauagcaagauugcuua

SEQ ID NO: 2536639 - RNA, 14 nt, Human
uaugccagcucagu

SEQ ID NO: 2536640 - RNA, 17 nt, Human
uaugccagcucaguccc

SEQ ID NO: 2536641 - RNA, 15 nt, Human
uauggucauagccca

SEQ ID NO: 2536642 - RNA, 20 nt, Human
uauggucaucuuuuucucua

SEQ ID NO: 2536643 - RNA, 14 nt, Human
uaugguauuugagu

SEQ ID NO: 2536644 - RNA, 22 nt, Human
uauggucaacacuuaaggguuu

SEQ ID NO: 2536645 - RNA, 13 nt, Human
uaugguauaaugg

SEQ ID NO: 2536646 - RNA, 20 nt, Human
uaugguauaaugguugacug

SEQ ID NO: 2536647 - RNA, 20 nt, Human
uauggugagaugcagcugga

SEQ ID NO: 2536648 - RNA, 14 nt, Human
uauggugagaugca

SEQ ID NO: 2536649 - RNA, 12 nt, Human
uauggugagaug

SEQ ID NO: 2536650 - RNA, 15 nt, Human
uauggugccaaugga

SEQ ID NO: 2536651 - RNA, 13 nt, Human
uauggugccaaug

SEQ ID NO: 2536652 - RNA, 19 nt, Human
uauggugccaauggaaccu

SEQ ID NO: 2536653 - RNA, 14 nt, Human
acagcgacauagcc

SEQ ID NO: 2536654 - RNA, 20 nt, Human
acagcgacauagcccauccc

SEQ ID NO: 2536655 - RNA, 17 nt, Human
acagcgagacuccgucu

SEQ ID NO: 2536656 - RNA, 18 nt, Human
acagcgagacuccgucuc

SEQ ID NO: 2536657 - RNA, 16 nt, Human
acagcggccccugcau

SEQ ID NO: 2536658 - RNA, 15 nt, Human
acagcggccccugca

SEQ ID NO: 2536659 - RNA, 19 nt, Human
acagcggccccugcauccc

SEQ ID NO: 2536660 - RNA, 22 nt, Human
acagcuaaucagcauucucacu

SEQ ID NO: 2536661 - RNA, 18 nt, Human
acagcggcuggacuugga

SEQ ID NO: 2536662 - RNA, 16 nt, Human
acagcggaggugugga

SEQ ID NO: 2536663 - RNA, 13 nt, Human
acagcggccccug

SEQ ID NO: 2536664 - RNA, 12 nt, Human
acagcgcugggu

SEQ ID NO: 2536665 - RNA, 19 nt, Human
acagcgagaggcagagaaa

SEQ ID NO: 2536666 - RNA, 22 nt, Human
acagcgagaggcagagaaagaa

SEQ ID NO: 2536667 - RNA, 15 nt, Human
acagcgagaggcaga

SEQ ID NO: 2536668 - RNA, 14 nt, Human
acagcgagaggcag

SEQ ID NO: 2536669 - RNA, 15 nt, Human
acagcggaggugugg

SEQ ID NO: 2536670 - RNA, 21 nt, Human
uauggcccuggccuagcauac

SEQ ID NO: 2536671 - RNA, 20 nt, Human
uauggcccuggccuagcaua

SEQ ID NO: 2536672 - RNA, 16 nt, Human
uauggcagugucuuuc

SEQ ID NO: 2536673 - RNA, 19 nt, Human
uaugcucucgcaccuuucc

SEQ ID NO: 2536674 - RNA, 13 nt, Human
uauggcagugucu

SEQ ID NO: 2536675 - RNA, 23 nt, Human
uaugggacucaaugcacugacau

SEQ ID NO: 2536676 - RNA, 16 nt, Human
uaugggacucaaugca

SEQ ID NO: 2536677 - RNA, 21 nt, Human
uaugguaggaacugcugggcu

SEQ ID NO: 2536678 - RNA, 16 nt, Human
uaugggaaucaagauu

SEQ ID NO: 2536679 - RNA, 22 nt, Human
uauggcccagugucaaguugug

SEQ ID NO: 2536680 - RNA, 14 nt, Human
uaugggagaaauag

SEQ ID NO: 2536681 - RNA, 15 nt, Human
acacuuccaccagcc

SEQ ID NO: 2536682 - RNA, 19 nt, Human
acacuucagagagcuggua

SEQ ID NO: 2536683 - RNA, 20 nt, Human
acacuucagagagcugguag

SEQ ID NO: 2536684 - RNA, 16 nt, Human
acacuuccaccagccu

SEQ ID NO: 2536685 - RNA, 17 nt, Human
acacuuccaccagccug

SEQ ID NO: 2536686 - RNA, 21 nt, Human
acacuuccaccagccugcacu

SEQ ID NO: 2536687 - RNA, 14 nt, Human
acacuuccauaauc

SEQ ID NO: 2536688 - RNA, 22 nt, Human
acacuucccucuguuucucuuu

SEQ ID NO: 2536689 - RNA, 15 nt, Human
acacuucccucuguu

SEQ ID NO: 2536690 - RNA, 19 nt, Human
acacuuccaccagccugca

SEQ ID NO: 2536691 - RNA, 22 nt, Human
acacuucaggcucuucuccuuu

SEQ ID NO: 2536692 - RNA, 19 nt, Human
acacuucaggcucuucucc

SEQ ID NO: 2536693 - RNA, 15 nt, Human
acacuucaggcucuu

SEQ ID NO: 2536694 - RNA, 16 nt, Human
acacuucagagagcug

SEQ ID NO: 2536695 - RNA, 17 nt, Human
acacuucagagagcugg

SEQ ID NO: 2536696 - RNA, 18 nt, Human
acacuucagagagcuggu

SEQ ID NO: 2536697 - RNA, 23 nt, Human
acacuuacuguuguccuauggga

SEQ ID NO: 2536698 - RNA, 14 nt, Human
acacuuacuguugu

SEQ ID NO: 2536699 - RNA, 20 nt, Human
acacuuaaggguuuuagaaa

SEQ ID NO: 2536700 - RNA, 20 nt, Human
acacuuauuggaacucugcu

SEQ ID NO: 2536701 - RNA, 13 nt, Human
acacuucagagag

SEQ ID NO: 2536702 - RNA, 18 nt, Human
acacuuacacuuuaugca

SEQ ID NO: 2536703 - RNA, 21 nt, Human
acacuuacacuuuaugcacaa

SEQ ID NO: 2536704 - RNA, 17 nt, Human
acacucauugaccugag

SEQ ID NO: 2536705 - RNA, 16 nt, Human
acacuguuucaaacuu

SEQ ID NO: 2536706 - RNA, 17 nt, Human
acacuguuucaaacuuu

SEQ ID NO: 2536707 - RNA, 18 nt, Human
acacuguuucaaacuuua

SEQ ID NO: 2536708 - RNA, 15 nt, Human
acacucaugcugaaa

SEQ ID NO: 2536709 - RNA, 14 nt, Human
acacuuaacagaug

SEQ ID NO: 2536710 - RNA, 20 nt, Human
acacuguuucaaacuuuacu

SEQ ID NO: 2536711 - RNA, 16 nt, Human
acacuuacacuuuaug

SEQ ID NO: 2536712 - RNA, 14 nt, Human
acacuuaauacuac

SEQ ID NO: 2536713 - RNA, 13 nt, Human
acacucaugcuga

SEQ ID NO: 2536714 - RNA, 17 nt, Human
uauaucuauauguacuu

SEQ ID NO: 2536715 - RNA, 14 nt, Human
acacucaugcugaa

SEQ ID NO: 2536716 - RNA, 16 nt, Human
acacuuaacagaugca

SEQ ID NO: 2536717 - RNA, 18 nt, Human
acagacauacuaaccagc

SEQ ID NO: 2536718 - RNA, 19 nt, Human
acagacauacuaaccagca

SEQ ID NO: 2536719 - RNA, 18 nt, Human
acagaaaguggugcucag

SEQ ID NO: 2536720 - RNA, 17 nt, Human
acagaaaguggugcuca

SEQ ID NO: 2536721 - RNA, 19 nt, Human
acagaaaguggugcucagu

SEQ ID NO: 2536722 - RNA, 15 nt, Human
acagacagcccucca

SEQ ID NO: 2536723 - RNA, 11 nt, Human
acagacaggag

SEQ ID NO: 2536724 - RNA, 13 nt, Human
acagacaggagaa

SEQ ID NO: 2536725 - RNA, 12 nt, Human
acagaaaauaua

SEQ ID NO: 2536726 - RNA, 13 nt, Human
acagaaaauauac

SEQ ID NO: 2536727 - RNA, 14 nt, Human
acagaaaauauacu

SEQ ID NO: 2536728 - RNA, 15 nt, Human
acagaaaauauacug

SEQ ID NO: 2536729 - RNA, 22 nt, Human
acagaaaacauucugauuugga

SEQ ID NO: 2536730 - RNA, 20 nt, Human
acagaaaacgguuaaaacug

SEQ ID NO: 2536731 - RNA, 22 nt, Human
acagaaaguggugcucaguugu

SEQ ID NO: 2536732 - RNA, 14 nt, Human
acagaaaguggugc

SEQ ID NO: 2536733 - RNA, 24 nt, Human
acagaaagggcaacaauaaaauag

SEQ ID NO: 2536734 - RNA, 13 nt, Human
acagaaagcugcc

SEQ ID NO: 2536735 - RNA, 16 nt, Human
acagaaagguuuucuu

SEQ ID NO: 2536736 - RNA, 19 nt, Human
acacuuccuguccagagag

SEQ ID NO: 2536737 - RNA, 14 nt, Human
acacuuccugucca

SEQ ID NO: 2536738 - RNA, 16 nt, Human
acacuuccuguccaga

SEQ ID NO: 2536739 - RNA, 13 nt, Human
acacuuccugccu

SEQ ID NO: 2536740 - RNA, 18 nt, Human
acacuucccucuguuucu

SEQ ID NO: 2536741 - RNA, 14 nt, Human
acacuuccugccua

SEQ ID NO: 2536742 - RNA, 13 nt, Human
acacuuccugucc

SEQ ID NO: 2536743 - RNA, 20 nt, Human
acacuucugugagaccccca

SEQ ID NO: 2536744 - RNA, 21 nt, Human
acacuugagaggaugaaugua

SEQ ID NO: 2536745 - RNA, 16 nt, Human
acacuugagaggauga

SEQ ID NO: 2536746 - RNA, 14 nt, Human
acacuugagaggau

SEQ ID NO: 2536747 - RNA, 23 nt, Human
acacuucugugagacccccacac

SEQ ID NO: 2536748 - RNA, 22 nt, Human
acacuucuucuuggucuuauuu

SEQ ID NO: 2536749 - RNA, 22 nt, Human
acacuuggcccaaguggcagag

SEQ ID NO: 2536750 - RNA, 18 nt, Human
acacuugccuucuucacc

SEQ ID NO: 2536751 - RNA, 18 nt, Human
acacuugagaggaugaau

SEQ ID NO: 2536752 - RNA, 20 nt, Human
acacuuuucaugugugauuu

SEQ ID NO: 2536753 - RNA, 20 nt, Human
acacuugccuucuucaccca

SEQ ID NO: 2536754 - RNA, 17 nt, Human
acacuugguuggguccu

SEQ ID NO: 2536755 - RNA, 20 nt, Human
acacuugguuggguccucac

SEQ ID NO: 2536756 - RNA, 22 nt, Human
acacuugguuggguccucacau

SEQ ID NO: 2536757 - RNA, 13 nt, Human
acacuuuugguua

SEQ ID NO: 2536758 - RNA, 22 nt, Human
acacuuuugguuaagucuguuu

SEQ ID NO: 2536759 - RNA, 23 nt, Human
acacuuuuuuggggauaugcuua

SEQ ID NO: 2536760 - RNA, 22 nt, Human
acacuuuuuuggggauaugcuu

SEQ ID NO: 2536761 - RNA, 21 nt, Human
acagaccuggagccccugggu

SEQ ID NO: 2536762 - RNA, 20 nt, Human
acagaccuggagccccuggg

SEQ ID NO: 2536763 - RNA, 19 nt, Human
acagaccuggagccccugg

SEQ ID NO: 2536764 - RNA, 17 nt, Human
acagaccuggagccccu

SEQ ID NO: 2536765 - RNA, 22 nt, Human
acagaccuggagccccugggug

SEQ ID NO: 2536766 - RNA, 14 nt, Human
acagaccuuugaac

SEQ ID NO: 2536767 - RNA, 16 nt, Human
acagaccuaaugcucc

SEQ ID NO: 2536768 - RNA, 19 nt, Human
acagaccgaacuguuguau

SEQ ID NO: 2536769 - RNA, 18 nt, Human
acagaccgaacuguugua

SEQ ID NO: 2536770 - RNA, 17 nt, Human
acagacauucugccagg

SEQ ID NO: 2536771 - RNA, 13 nt, Human
acagacaggcucu

SEQ ID NO: 2536772 - RNA, 14 nt, Human
acagacaggagaaa

SEQ ID NO: 2536773 - RNA, 15 nt, Human
acagacaggagaaau

SEQ ID NO: 2536774 - RNA, 15 nt, Human
acagacaggcucuua

SEQ ID NO: 2536775 - RNA, 15 nt, Human
acagacaucucugca

SEQ ID NO: 2536776 - RNA, 21 nt, Human
acagacaggagaaaugcaucc

SEQ ID NO: 2536777 - RNA, 21 nt, Human
uaucaaauauuagaugugauu

SEQ ID NO: 2536778 - RNA, 20 nt, Human
uaucaaauauuagaugugau

SEQ ID NO: 2536779 - RNA, 19 nt, Human
uaucaaauauuagauguga

SEQ ID NO: 2536780 - RNA, 18 nt, Human
uaucaaauauuagaugug

SEQ ID NO: 2536781 - RNA, 21 nt, Human
uaucaaagaccuuguguguau

SEQ ID NO: 2536782 - RNA, 20 nt, Human
acagacguaugcuuauuuua

SEQ ID NO: 2536783 - RNA, 21 nt, Human
uaucaaacuucagcuguacuu

SEQ ID NO: 2536784 - RNA, 16 nt, Human
acagacgucccuccac

SEQ ID NO: 2536785 - RNA, 15 nt, Human
acagacguaugcuua

SEQ ID NO: 2536786 - RNA, 15 nt, Human
acagacgucccucca

SEQ ID NO: 2536787 - RNA, 16 nt, Human
uaucacaaaucuuaac

SEQ ID NO: 2536788 - RNA, 20 nt, Human
uaucacaaaucuuaacuuga

SEQ ID NO: 2536789 - RNA, 14 nt, Human
uaucacaaaucuua

SEQ ID NO: 2536790 - RNA, 23 nt, Human
uaucaaauauuagaugugauuua

SEQ ID NO: 2536791 - RNA, 19 nt, Human
uaucacccagaagaaaaua

SEQ ID NO: 2536792 - RNA, 22 nt, Human
uaucacccagaagaaaauagug

SEQ ID NO: 2536793 - RNA, 19 nt, Human
uaucaccgugggcucccug

SEQ ID NO: 2536794 - RNA, 23 nt, Human
uaucaccgugggcucccugacug

SEQ ID NO: 2536795 - RNA, 14 nt, Human
uaucaccucauggc

SEQ ID NO: 2536796 - RNA, 13 nt, Human
uaucaccuccccu

SEQ ID NO: 2536797 - RNA, 17 nt, Human
uaucagaauucucagaa

SEQ ID NO: 2536798 - RNA, 14 nt, Human
uaucaccuccccuc

SEQ ID NO: 2536799 - RNA, 15 nt, Human
uaucaccuccccucc

SEQ ID NO: 2536800 - RNA, 16 nt, Human
uaucaccuccccuccu

SEQ ID NO: 2536801 - RNA, 20 nt, Human
uaucagaggccuauaaugaa

SEQ ID NO: 2536802 - RNA, 17 nt, Human
uaucagaggccuauaau

SEQ ID NO: 2536803 - RNA, 20 nt, Human
uaucagacacucuggcuggu

SEQ ID NO: 2536804 - RNA, 19 nt, Human
uaucagacacucuggcugg

SEQ ID NO: 2536805 - RNA, 18 nt, Human
uaucagacacucuggcug

SEQ ID NO: 2536806 - RNA, 14 nt, Human
uaucagcacgugug

SEQ ID NO: 2536807 - RNA, 22 nt, Human
uauccacagagagucccacugc

SEQ ID NO: 2536808 - RNA, 21 nt, Human
uauccacagaaacauuuucau

SEQ ID NO: 2536809 - RNA, 13 nt, Human
uauccaccaccuc

SEQ ID NO: 2536810 - RNA, 23 nt, Human
uauccacagagagucccacugcc

SEQ ID NO: 2536811 - RNA, 15 nt, Human
uauccaccaccuccc

SEQ ID NO: 2536812 - RNA, 12 nt, Human
uauccacccagc

SEQ ID NO: 2536813 - RNA, 19 nt, Human
uauccaacaucaacaucuu

SEQ ID NO: 2536814 - RNA, 20 nt, Human
uauccccccaucuugcuucc

SEQ ID NO: 2536815 - RNA, 19 nt, Human
uauccccccaucuugcuuc

SEQ ID NO: 2536816 - RNA, 17 nt, Human
uauccccccaucuugcu

SEQ ID NO: 2536817 - RNA, 15 nt, Human
uauccccccaucuug

SEQ ID NO: 2536818 - RNA, 15 nt, Human
uauccccucccaguc

SEQ ID NO: 2536819 - RNA, 21 nt, Human
uauccccccccuguauaguua

SEQ ID NO: 2536820 - RNA, 19 nt, Human
uauccccccccuguauagu

SEQ ID NO: 2536821 - RNA, 17 nt, Human
uaucuaguuuaauuaau

SEQ ID NO: 2536822 - RNA, 16 nt, Human
uauccccauuucuuuu

SEQ ID NO: 2536823 - RNA, 14 nt, Human
uaucccagaaauua

SEQ ID NO: 2536824 - RNA, 13 nt, Human
uauccacccagcc

SEQ ID NO: 2536825 - RNA, 14 nt, Human
uauccacccagccc

SEQ ID NO: 2536826 - RNA, 15 nt, Human
uauccacccagccca

SEQ ID NO: 2536827 - RNA, 16 nt, Human
uaucuauauguacuug

SEQ ID NO: 2536828 - RNA, 22 nt, Human
uaucuauauauguguauguacg

SEQ ID NO: 2536829 - RNA, 17 nt, Human
uaucuauauauguguau

SEQ ID NO: 2536830 - RNA, 16 nt, Human
uaucuauauaugugua

SEQ ID NO: 2536831 - RNA, 15 nt, Human
uaucuauauaugugu

SEQ ID NO: 2536832 - RNA, 13 nt, Human
uaucuauauaugu

SEQ ID NO: 2536833 - RNA, 21 nt, Human
uaucuauauauaauucuguac

SEQ ID NO: 2536834 - RNA, 20 nt, Human
uaucuauauauaauucugua

SEQ ID NO: 2536835 - RNA, 18 nt, Human
uaucuauacauaucuuua

SEQ ID NO: 2536836 - RNA, 20 nt, Human
uaucuauacauaucuuuauu

SEQ ID NO: 2536837 - RNA, 16 nt, Human
uaucuauauauaauuc

SEQ ID NO: 2536838 - RNA, 22 nt, Human
uaucuaguuuaauuaaucugua

SEQ ID NO: 2536839 - RNA, 16 nt, Human
uauccccucccaguca

SEQ ID NO: 2536840 - RNA, 18 nt, Human
uauaauuuaccugaaguc

SEQ ID NO: 2536841 - RNA, 11 nt, Human
uauaauuuaau

SEQ ID NO: 2536842 - RNA, 16 nt, Human
uauaauuuaaugcaug

SEQ ID NO: 2536843 - RNA, 22 nt, Human
uauacacuuacacuuuaugcac

SEQ ID NO: 2536844 - RNA, 21 nt, Human
uauaagugcuguauaaaauca

SEQ ID NO: 2536845 - RNA, 20 nt, Human
uauaagugcuguauaaaauc

SEQ ID NO: 2536846 - RNA, 19 nt, Human
uauaagugcuguauaaaau

SEQ ID NO: 2536847 - RNA, 17 nt, Human
uauaagugcuguauaaa

SEQ ID NO: 2536848 - RNA, 16 nt, Human
uauaagugcuguauaa

SEQ ID NO: 2536849 - RNA, 15 nt, Human
uauaagugcuguaua

SEQ ID NO: 2536850 - RNA, 14 nt, Human
uauaagugcuguau

SEQ ID NO: 2536851 - RNA, 13 nt, Human
uauaagugcugua

SEQ ID NO: 2536852 - RNA, 13 nt, Human
uauaaguguacau

SEQ ID NO: 2536853 - RNA, 18 nt, Human
uauaaguggaggcacuuu

SEQ ID NO: 2536854 - RNA, 14 nt, Human
uauaaguguacaua

SEQ ID NO: 2536855 - RNA, 19 nt, Human
uauaaguggaggcacuuua

SEQ ID NO: 2536856 - RNA, 22 nt, Human
uauaauuuaacuucagagggaa

SEQ ID NO: 2536857 - RNA, 15 nt, Human
uauaauuuaacuuca

SEQ ID NO: 2536858 - RNA, 22 nt, Human
uauacagaauugugucugcagg

SEQ ID NO: 2536859 - RNA, 16 nt, Human
uauacauagcaugaca

SEQ ID NO: 2536860 - RNA, 22 nt, Human
uauacauagcaugacauuucuu

SEQ ID NO: 2536861 - RNA, 18 nt, Human
uauacauguuuaguauua

SEQ ID NO: 2536862 - RNA, 13 nt, Human
uauacaugccagu

SEQ ID NO: 2536863 - RNA, 19 nt, Human
uauagaugggaaugaagcu

SEQ ID NO: 2536864 - RNA, 17 nt, Human
uauagaugggaaugaag

SEQ ID NO: 2536865 - RNA, 16 nt, Human
uauagaugggaaugaa

SEQ ID NO: 2536866 - RNA, 22 nt, Human
uauagaugcaagauauuuauau

SEQ ID NO: 2536867 - RNA, 15 nt, Human
uauagaucccccaga

SEQ ID NO: 2536868 - RNA, 21 nt, Human
uauacauaucuuuauuaauca

SEQ ID NO: 2536869 - RNA, 15 nt, Human
uauacauaucuuuau

SEQ ID NO: 2536870 - RNA, 18 nt, Human
uauacauaucuuuauuaa

SEQ ID NO: 2536871 - RNA, 15 nt, Human
uauacaugccaguga

SEQ ID NO: 2536872 - RNA, 11 nt, Human
uauacaugcca

SEQ ID NO: 2536873 - RNA, 20 nt, Human
uagucacugagacagcccgg

SEQ ID NO: 2536874 - RNA, 17 nt, Human
uagucacugagacagcc

SEQ ID NO: 2536875 - RNA, 23 nt, Human
acacuaaguuauaguauaucugg

SEQ ID NO: 2536876 - RNA, 19 nt, Human
acacuaaguuauaguauau

SEQ ID NO: 2536877 - RNA, 14 nt, Human
acacuaagggugua

SEQ ID NO: 2536878 - RNA, 22 nt, Human
acacuaaugaggaaacugcacu

SEQ ID NO: 2536879 - RNA, 15 nt, Human
acacuaaugaggaaa

SEQ ID NO: 2536880 - RNA, 13 nt, Human
acacucaaaucaa

SEQ ID NO: 2536881 - RNA, 21 nt, Human
acacucaaaagcugggcaggu

SEQ ID NO: 2536882 - RNA, 12 nt, Human
acacuaauuccu

SEQ ID NO: 2536883 - RNA, 18 nt, Human
acacucaaaucaagaaac

SEQ ID NO: 2536884 - RNA, 17 nt, Human
acacucaaaucaagaaa

SEQ ID NO: 2536885 - RNA, 17 nt, Human
acacuaauuccuuucua

SEQ ID NO: 2536886 - RNA, 19 nt, Human
uauaacuauguugauaaaa

SEQ ID NO: 2536887 - RNA, 16 nt, Human
uauaacucaucauaaa

SEQ ID NO: 2536888 - RNA, 17 nt, Human
uauaacucaucauaaaa

SEQ ID NO: 2536889 - RNA, 18 nt, Human
uauaacucaucauaaaau

SEQ ID NO: 2536890 - RNA, 19 nt, Human
uauaacucaucauaaaaua

SEQ ID NO: 2536891 - RNA, 20 nt, Human
uauaacucaucauaaaauaa

SEQ ID NO: 2536892 - RNA, 21 nt, Human
uauaacucaucauaaaauaaa

SEQ ID NO: 2536893 - RNA, 19 nt, Human
uauaagugauugcugguuu

SEQ ID NO: 2536894 - RNA, 20 nt, Human
uauaacuuaaaaauguaaau

SEQ ID NO: 2536895 - RNA, 22 nt, Human
uauaacuuaaaaaaaugacaga

SEQ ID NO: 2536896 - RNA, 22 nt, Human
uauaacuuaaaaauguaaauau

SEQ ID NO: 2536897 - RNA, 23 nt, Human
uauaacucugcacuacuccucug

SEQ ID NO: 2536898 - RNA, 16 nt, Human
uauaacugaaggagaa

SEQ ID NO: 2536899 - RNA, 19 nt, Human
uauaacugccuuaaaacuu

SEQ ID NO: 2536900 - RNA, 18 nt, Human
uauaacuuaaaaaaauga

SEQ ID NO: 2536901 - RNA, 19 nt, Human
uauaacuuaaaaaaaugac

SEQ ID NO: 2536902 - RNA, 20 nt, Human
uauaacugccuuaaaacuuu

SEQ ID NO: 2536903 - RNA, 20 nt, Human
uauauagguuuuguuugcua

SEQ ID NO: 2536904 - RNA, 12 nt, Human
uauauagguuuu

SEQ ID NO: 2536905 - RNA, 17 nt, Human
uauauagguugugcaaa

SEQ ID NO: 2536906 - RNA, 24 nt, Human
uauauagguuuuguuugcuaucuu

SEQ ID NO: 2536907 - RNA, 21 nt, Human
uauauagguuuuguuugcuau

SEQ ID NO: 2536908 - RNA, 18 nt, Human
uauauaggcaucacauuu

SEQ ID NO: 2536909 - RNA, 21 nt, Human
uauauaucugcuucaguggag

SEQ ID NO: 2536910 - RNA, 22 nt, Human
uauauaguuuauugacaauaau

SEQ ID NO: 2536911 - RNA, 17 nt, Human
uauauaguuuacuauuu

SEQ ID NO: 2536912 - RNA, 19 nt, Human
uauauaucugcuucagugg

SEQ ID NO: 2536913 - RNA, 21 nt, Human
uauauaucugcuguccagaca

SEQ ID NO: 2536914 - RNA, 18 nt, Human
uauauaucugcuguccag

SEQ ID NO: 2536915 - RNA, 15 nt, Human
uauauaucuaucuua

SEQ ID NO: 2536916 - RNA, 12 nt, Human
uauauaugugua

SEQ ID NO: 2536917 - RNA, 14 nt, Human
uauauauguguaug

SEQ ID NO: 2536918 - RNA, 18 nt, Human
uauauauguguguuuaaa

SEQ ID NO: 2536919 - RNA, 17 nt, Human
uauauauguguguuuaa

SEQ ID NO: 2536920 - RNA, 16 nt, Human
uauauauguguaugua

SEQ ID NO: 2536921 - RNA, 14 nt, Human
uauauaugugugug

SEQ ID NO: 2536922 - RNA, 22 nt, Human
uauauauguguguuuaaauaaa

SEQ ID NO: 2536923 - RNA, 22 nt, Human
uauauauugguaacauccuuuc

SEQ ID NO: 2536924 - RNA, 13 nt, Human
uauauauuuauaa

SEQ ID NO: 2536925 - RNA, 21 nt, Human
uauaucuauauauaauucugu

SEQ ID NO: 2536926 - RNA, 13 nt, Human
uauaucuauauau

SEQ ID NO: 2536927 - RNA, 18 nt, Human
uauaucuaaauugaauaa

SEQ ID NO: 2536928 - RNA, 17 nt, Human
uauaucuaaauugaaua

SEQ ID NO: 2536929 - RNA, 13 nt, Human
uauaucuaaauug

SEQ ID NO: 2536930 - RNA, 16 nt, Human
uauaucuauauguacu

SEQ ID NO: 2536931 - RNA, 22 nt, Human
uauaucuauauauaauucugua

SEQ ID NO: 2536932 - RNA, 12 nt, Human
acacucaugcug

SEQ ID NO: 2536933 - RNA, 16 nt, Human
acacucaguuguucaa

SEQ ID NO: 2536934 - RNA, 16 nt, Human
acacucauugaccuga

SEQ ID NO: 2536935 - RNA, 20 nt, Human
uauauccuuucuaacaaaaa

SEQ ID NO: 2536936 - RNA, 17 nt, Human
uauauccuuucuaacaa

SEQ ID NO: 2536937 - RNA, 20 nt, Human
uauauauuuuugguugucaa

SEQ ID NO: 2536938 - RNA, 22 nt, Human
uauauauuuuugguugucaaua

SEQ ID NO: 2536939 - RNA, 11 nt, Human
uauauauuucc

SEQ ID NO: 2536940 - RNA, 14 nt, Human
uauauauuuauaac

SEQ ID NO: 2536941 - RNA, 15 nt, Human
uauauauuuauaacu

SEQ ID NO: 2536942 - RNA, 14 nt, Human
uauauauuuuaauu

SEQ ID NO: 2536943 - RNA, 16 nt, Human
uauaggugcuacaaaa

SEQ ID NO: 2536944 - RNA, 14 nt, Human
uauaggcuggagaa

SEQ ID NO: 2536945 - RNA, 15 nt, Human
uauaggcaccuacca

SEQ ID NO: 2536946 - RNA, 14 nt, Human
uauaggucacuccu

SEQ ID NO: 2536947 - RNA, 17 nt, Human
uauaggucacuccuggg

SEQ ID NO: 2536948 - RNA, 21 nt, Human
uauauagauuauaacuugucu

SEQ ID NO: 2536949 - RNA, 12 nt, Human
uauaggaauuga

SEQ ID NO: 2536950 - RNA, 23 nt, Human
uauaggaacuuaaauaaugugaa

SEQ ID NO: 2536951 - RNA, 15 nt, Human
uauaggaucauuugu

SEQ ID NO: 2536952 - RNA, 12 nt, Human
uauaggagagga

SEQ ID NO: 2536953 - RNA, 19 nt, Human
uauaggaacauaugaaaau

SEQ ID NO: 2536954 - RNA, 20 nt, Human
uauagcuguauugaaucaug

SEQ ID NO: 2536955 - RNA, 19 nt, Human
uauagcuguauugaaucau

SEQ ID NO: 2536956 - RNA, 21 nt, Human
uauagcuguauugaaucaugu

SEQ ID NO: 2536957 - RNA, 12 nt, Human
uauagaugucua

SEQ ID NO: 2536958 - RNA, 23 nt, Human
uauagcaauccauguuaguuuuu

SEQ ID NO: 2536959 - RNA, 13 nt, Human
uauagcaauccau

SEQ ID NO: 2536960 - RNA, 18 nt, Human
uauagccuaggugacaga

SEQ ID NO: 2536961 - RNA, 14 nt, Human
uauagcuguauuga

SEQ ID NO: 2536962 - RNA, 13 nt, Human
uauagcuguauug

SEQ ID NO: 2536963 - RNA, 22 nt, Human
uauagcuguacaaauauaagaa

SEQ ID NO: 2536964 - RNA, 18 nt, Human
uauagcuguacaaauaua

SEQ ID NO: 2536965 - RNA, 16 nt, Human
uauagcuguacaaaua

SEQ ID NO: 2536966 - RNA, 13 nt, Human
uauagcccagguc

SEQ ID NO: 2536967 - RNA, 21 nt, Human
uauagccacaucccuuugaaa

SEQ ID NO: 2536968 - RNA, 22 nt, Human
uauagcccagccaggccccagg

SEQ ID NO: 2536969 - RNA, 14 nt, Human
uaggcaucccaggg

SEQ ID NO: 2536970 - RNA, 16 nt, Human
uaggcaucccagggga

SEQ ID NO: 2536971 - RNA, 19 nt, Human
uaggcaucccaggggacca

SEQ ID NO: 2536972 - RNA, 21 nt, Human
uaggcaugagggaucacaggg

SEQ ID NO: 2536973 - RNA, 19 nt, Human
uaggcagggauuugaggag

SEQ ID NO: 2536974 - RNA, 17 nt, Human
uaggcagggauuugagg

SEQ ID NO: 2536975 - RNA, 15 nt, Human
uaggcagggauuuga

SEQ ID NO: 2536976 - RNA, 12 nt, Human
uaggcaggacca

SEQ ID NO: 2536977 - RNA, 15 nt, Human
uaggcaggaccugug

SEQ ID NO: 2536978 - RNA, 22 nt, Human
uaggcaggacaugcugaagcca

SEQ ID NO: 2536979 - RNA, 17 nt, Human
uaggcaggacaugcuga

SEQ ID NO: 2536980 - RNA, 14 nt, Human
uaggcaggaccugu

SEQ ID NO: 2536981 - RNA, 22 nt, Human
uaggauuuaacagucauuuaaa

SEQ ID NO: 2536982 - RNA, 21 nt, Human
uaggauuuaacagucauuuaa

SEQ ID NO: 2536983 - RNA, 12 nt, Human
uaggauuuaaca

SEQ ID NO: 2536984 - RNA, 13 nt, Human
uaggauguugaaa

SEQ ID NO: 2536985 - RNA, 19 nt, Human
uaggauguuuuucaugaaa

SEQ ID NO: 2536986 - RNA, 18 nt, Human
uaggauguuuuucaugaa

SEQ ID NO: 2536987 - RNA, 13 nt, Human
uaggauguuuuuc

SEQ ID NO: 2536988 - RNA, 21 nt, Human
uaggaguucacuucaucuucu

SEQ ID NO: 2536989 - RNA, 17 nt, Human
uaggagugugugauuuu

SEQ ID NO: 2536990 - RNA, 17 nt, Human
uaggaaauaaaaccuuu

SEQ ID NO: 2536991 - RNA, 23 nt, Human
uaggaguucgagaccagccuggc

SEQ ID NO: 2536992 - RNA, 17 nt, Human
uaggaguucgagaccag

SEQ ID NO: 2536993 - RNA, 21 nt, Human
uaggaguucgagaccagccug

SEQ ID NO: 2536994 - RNA, 20 nt, Human
uaggaucauuuguuggaaug

SEQ ID NO: 2536995 - RNA, 21 nt, Human
uaggauccagugauccuuaca

SEQ ID NO: 2536996 - RNA, 19 nt, Human
uaggaucagcccucauuuu

SEQ ID NO: 2536997 - RNA, 22 nt, Human
uaggauaugguggguggacagg

SEQ ID NO: 2536998 - RNA, 23 nt, Human
uaggaguucacuucaucuucuca

SEQ ID NO: 2536999 - RNA, 13 nt, Human
uaggauagcauuu

SEQ ID NO: 2537000 - RNA, 17 nt, Human
uaggaaaaacugauuuu

SEQ ID NO: 2537001 - RNA, 16 nt, Human
uaggaaaaacugauuu

SEQ ID NO: 2537002 - RNA, 19 nt, Human
uaggaaagaccauuuuucc

SEQ ID NO: 2537003 - RNA, 21 nt, Human
uaggaaacaaagcuuagcagg

SEQ ID NO: 2537004 - RNA, 14 nt, Human
uaggaaauaaaacc

SEQ ID NO: 2537005 - RNA, 16 nt, Human
uaggaaauaaaaccuu

SEQ ID NO: 2537006 - RNA, 19 nt, Human
uaggaaaaguacauuuaau

SEQ ID NO: 2537007 - RNA, 17 nt, Human
uaggaaaaguacauuua

SEQ ID NO: 2537008 - RNA, 14 nt, Human
uagggaugaguacc

SEQ ID NO: 2537009 - RNA, 23 nt, Human
uagggaucaaccagcuaagaaaa

SEQ ID NO: 2537010 - RNA, 19 nt, Human
uagggauggggcugugggg

SEQ ID NO: 2537011 - RNA, 15 nt, Human
uagggaacucugggg

SEQ ID NO: 2537012 - RNA, 17 nt, Human
uagggaucccucaucug

SEQ ID NO: 2537013 - RNA, 20 nt, Human
uagggcaccagggguuucuc

SEQ ID NO: 2537014 - RNA, 15 nt, Human
uagggcaccaggggu

SEQ ID NO: 2537015 - RNA, 16 nt, Human
uagggauucaggcugc

SEQ ID NO: 2537016 - RNA, 18 nt, Human
uagggauguucuggcccu

SEQ ID NO: 2537017 - RNA, 15 nt, Human
uagggauucaggcug

SEQ ID NO: 2537018 - RNA, 13 nt, Human
uagggaacucugg

SEQ ID NO: 2537019 - RNA, 18 nt, Human
uagggagggcggcagggg

SEQ ID NO: 2537020 - RNA, 13 nt, Human
uagggaagauaau

SEQ ID NO: 2537021 - RNA, 13 nt, Human
uagggaaaacauu

SEQ ID NO: 2537022 - RNA, 13 nt, Human
uaggcauucugga

SEQ ID NO: 2537023 - RNA, 16 nt, Human
uagggaaaacauucca

SEQ ID NO: 2537024 - RNA, 18 nt, Human
uagggaaaacauuccauc

SEQ ID NO: 2537025 - RNA, 13 nt, Human
uagggaaagaaag

SEQ ID NO: 2537026 - RNA, 16 nt, Human
uagggaaaaguucaua

SEQ ID NO: 2537027 - RNA, 13 nt, Human
uagggaaaugaaa

SEQ ID NO: 2537028 - RNA, 16 nt, Human
uagggaaaugaaagaa

SEQ ID NO: 2537029 - RNA, 23 nt, Human
uaggggagggguugccacaggcc

SEQ ID NO: 2537030 - RNA, 23 nt, Human
uaggggacacuucccucuguuuc

SEQ ID NO: 2537031 - RNA, 13 nt, Human
uaggggagcaggg

SEQ ID NO: 2537032 - RNA, 16 nt, Human
uagggggaacucuagc

SEQ ID NO: 2537033 - RNA, 16 nt, Human
uagggguaauauauug

SEQ ID NO: 2537034 - RNA, 23 nt, Human
uagggguaauauauugcugcugg

SEQ ID NO: 2537035 - RNA, 17 nt, Human
uaggggucaggcuccau

SEQ ID NO: 2537036 - RNA, 14 nt, Human
uaggggucaaagaa

SEQ ID NO: 2537037 - RNA, 13 nt, Human
uagggguugcuaa

SEQ ID NO: 2537038 - RNA, 15 nt, Human
uagggccaggcaggu

SEQ ID NO: 2537039 - RNA, 21 nt, Human
uagggccaggcaggugccugg

SEQ ID NO: 2537040 - RNA, 21 nt, Human
uagggccuggucccugggagg

SEQ ID NO: 2537041 - RNA, 23 nt, Human
uagggcuacaaaaccugauguua

SEQ ID NO: 2537042 - RNA, 14 nt, Human
uagggcuguaaaau

SEQ ID NO: 2537043 - RNA, 14 nt, Human
uagggcuggaccua

SEQ ID NO: 2537044 - RNA, 14 nt, Human
uagggccaggcagg

SEQ ID NO: 2537045 - RNA, 11 nt, Human
uagggccaggc

SEQ ID NO: 2537046 - RNA, 23 nt, Human
uagggccaagcccagcacugcuu

SEQ ID NO: 2537047 - RNA, 16 nt, Human
uagggccaagcccagc

SEQ ID NO: 2537048 - RNA, 18 nt, Human
uagggcauuugagaaaug

SEQ ID NO: 2537049 - RNA, 13 nt, Human
uagggcagcuugc

SEQ ID NO: 2537050 - RNA, 11 nt, Human
uagggcagcuu

SEQ ID NO: 2537051 - RNA, 19 nt, Human
uagggcauaaugaugaugg

SEQ ID NO: 2537052 - RNA, 15 nt, Human
uagggcagcuugccc

SEQ ID NO: 2537053 - RNA, 19 nt, Human
uagggcaguaacauugggu

SEQ ID NO: 2537054 - RNA, 18 nt, Human
uagcuaaacggauuccaa

SEQ ID NO: 2537055 - RNA, 19 nt, Human
uagcuaaacggauuccaaa

SEQ ID NO: 2537056 - RNA, 20 nt, Human
uagcuaaacggauuccaaag

SEQ ID NO: 2537057 - RNA, 23 nt, Human
uagcuaacauuuuaaauaaaaga

SEQ ID NO: 2537058 - RNA, 20 nt, Human
uagcuaacauuuuaaauaaa

SEQ ID NO: 2537059 - RNA, 20 nt, Human
uagcuaagaaauaaaacugu

SEQ ID NO: 2537060 - RNA, 19 nt, Human
uagcuugauaaagggccaa

SEQ ID NO: 2537061 - RNA, 22 nt, Human
uagcuucugcuuuucugcccug

SEQ ID NO: 2537062 - RNA, 19 nt, Human
uagcuugaaggaucuguuu

SEQ ID NO: 2537063 - RNA, 16 nt, Human
uagcuucugcuuuucu

SEQ ID NO: 2537064 - RNA, 15 nt, Human
uagcuucugcuuuuc

SEQ ID NO: 2537065 - RNA, 13 nt, Human
uagcuucugcuuu

SEQ ID NO: 2537066 - RNA, 21 nt, Human
uagcuucuaccaugaacagaa

SEQ ID NO: 2537067 - RNA, 19 nt, Human
uagcuaagcggaccagccu

SEQ ID NO: 2537068 - RNA, 12 nt, Human
uagcuuccauga

SEQ ID NO: 2537069 - RNA, 21 nt, Human
uagcuucaccccaaucccagc

SEQ ID NO: 2537070 - RNA, 14 nt, Human
uagcuuuacccuca

SEQ ID NO: 2537071 - RNA, 15 nt, Human
uagcuuuacccucag

SEQ ID NO: 2537072 - RNA, 19 nt, Human
uagcuuuacuguuuguuau

SEQ ID NO: 2537073 - RNA, 18 nt, Human
uagcuuuagacccugggu

SEQ ID NO: 2537074 - RNA, 17 nt, Human
uagcuuuagacccuggg

SEQ ID NO: 2537075 - RNA, 16 nt, Human
uagcuuuagacccugg

SEQ ID NO: 2537076 - RNA, 14 nt, Human
uagcuuuauucuuc

SEQ ID NO: 2537077 - RNA, 13 nt, Human
uagcuuuauucuu

SEQ ID NO: 2537078 - RNA, 18 nt, Human
uagcuuuauuuuuuaagu

SEQ ID NO: 2537079 - RNA, 15 nt, Human
uagcuuguucccugu

SEQ ID NO: 2537080 - RNA, 19 nt, Human
uagcuuguauaguguaaaa

SEQ ID NO: 2537081 - RNA, 17 nt, Human
uagcuuguauaguguaa

SEQ ID NO: 2537082 - RNA, 13 nt, Human
uagcuuguauagu

SEQ ID NO: 2537083 - RNA, 18 nt, Human
uagcuugggacaaaucaa

SEQ ID NO: 2537084 - RNA, 15 nt, Human
uagcuugggacaaau

SEQ ID NO: 2537085 - RNA, 19 nt, Human
uagcuugggaggcuucccc

SEQ ID NO: 2537086 - RNA, 19 nt, Human
uagcuugcgcauucucaug

SEQ ID NO: 2537087 - RNA, 17 nt, Human
uagcuugcgcauucuca

SEQ ID NO: 2537088 - RNA, 20 nt, Human
uagcuuggaaacuggaugag

SEQ ID NO: 2537089 - RNA, 15 nt, Human
uagcuuggaaacugg

SEQ ID NO: 2537090 - RNA, 16 nt, Human
uagcuuugcucugcca

SEQ ID NO: 2537091 - RNA, 14 nt, Human
uagcuuugcucugc

SEQ ID NO: 2537092 - RNA, 11 nt, Human
uagcuuugcuc

SEQ ID NO: 2537093 - RNA, 17 nt, Human
uagcuuucaauuccgua

SEQ ID NO: 2537094 - RNA, 23 nt, Human
uagcuuucaauuccguagccagc

SEQ ID NO: 2537095 - RNA, 19 nt, Human
uagcuuucccaaauaaacu

SEQ ID NO: 2537096 - RNA, 15 nt, Human
uagcuuuauucuuca

SEQ ID NO: 2537097 - RNA, 15 nt, Human
uagcuuucaauuccg

SEQ ID NO: 2537098 - RNA, 22 nt, Human
uagcuuuauuuuuuaaguauuu

SEQ ID NO: 2537099 - RNA, 19 nt, Human
uagcuuuauuuuuuaagua

SEQ ID NO: 2537100 - RNA, 20 nt, Human
uagcuuuauuuuuuaaguau

SEQ ID NO: 2537101 - RNA, 14 nt, Human
uagcuuuuauugua

SEQ ID NO: 2537102 - RNA, 15 nt, Human
uagcuuugcucuuug

SEQ ID NO: 2537103 - RNA, 18 nt, Human
uagcuuuuauuguauaaa

SEQ ID NO: 2537104 - RNA, 13 nt, Human
uagcuuuucccuu

SEQ ID NO: 2537105 - RNA, 14 nt, Human
uaggaaaaacugau

SEQ ID NO: 2537106 - RNA, 13 nt, Human
uaggaaaaacuga

SEQ ID NO: 2537107 - RNA, 16 nt, Human
uagcuuuuuaauuguu

SEQ ID NO: 2537108 - RNA, 15 nt, Human
uagcuuuuuaauugu

SEQ ID NO: 2537109 - RNA, 14 nt, Human
uagcuuuuuaauug

SEQ ID NO: 2537110 - RNA, 17 nt, Human
uagcgcccaguugggug

SEQ ID NO: 2537111 - RNA, 21 nt, Human
uagcgcugccgcaccccagag

SEQ ID NO: 2537112 - RNA, 22 nt, Human
uagcgcugccgcaccccagagu

SEQ ID NO: 2537113 - RNA, 14 nt, Human
uagcgcccaguugg

SEQ ID NO: 2537114 - RNA, 20 nt, Human
uagccuuauccucugaucuc

SEQ ID NO: 2537115 - RNA, 18 nt, Human
uagccuuauccucugauc

SEQ ID NO: 2537116 - RNA, 17 nt, Human
uagccuuauccucugau

SEQ ID NO: 2537117 - RNA, 16 nt, Human
uagccuuauccucuga

SEQ ID NO: 2537118 - RNA, 20 nt, Human
uagccuuccguaacccaacu

SEQ ID NO: 2537119 - RNA, 21 nt, Human
uagccuuagaagucacacagu

SEQ ID NO: 2537120 - RNA, 15 nt, Human
uagccuuauccucug

SEQ ID NO: 2537121 - RNA, 17 nt, Human
acaauauuuuguggcuu

SEQ ID NO: 2537122 - RNA, 16 nt, Human
acaauauuuaaaauuu

SEQ ID NO: 2537123 - RNA, 14 nt, Human
acaaucaaaggaaa

SEQ ID NO: 2537124 - RNA, 19 nt, Human
acaaucaaaggaaaauagu

SEQ ID NO: 2537125 - RNA, 23 nt, Human
acaaucaacucuaauagugcuua

SEQ ID NO: 2537126 - RNA, 20 nt, Human
uagccuuagaagucacacag

SEQ ID NO: 2537127 - RNA, 22 nt, Human
acaaucagcuccuuccuggaga

SEQ ID NO: 2537128 - RNA, 18 nt, Human
acaaucagcuccuuccug

SEQ ID NO: 2537129 - RNA, 19 nt, Human
acaaucagccacauucuag

SEQ ID NO: 2537130 - RNA, 14 nt, Human
acaauauuguuucu

SEQ ID NO: 2537131 - RNA, 15 nt, Human
acaauauuguuucua

SEQ ID NO: 2537132 - RNA, 10 nt, Human
acaauauuua

SEQ ID NO: 2537133 - RNA, 18 nt, Human
acaauauugacuuugucu

SEQ ID NO: 2537134 - RNA, 13 nt, Human
acaauauuuaaaa

SEQ ID NO: 2537135 - RNA, 14 nt, Human
acaauauuuaaaau

SEQ ID NO: 2537136 - RNA, 18 nt, Human
acaauauuuaaaauuuau

SEQ ID NO: 2537137 - RNA, 21 nt, Human
acaaaucuaugccacucagaa

SEQ ID NO: 2537138 - RNA, 21 nt, Human
acaaaucucaagcaaacagcu

SEQ ID NO: 2537139 - RNA, 15 nt, Human
acaaaucuaugccac

SEQ ID NO: 2537140 - RNA, 14 nt, Human
acaaaucuaugcca

SEQ ID NO: 2537141 - RNA, 18 nt, Human
acaaugcaaaccaucauu

SEQ ID NO: 2537142 - RNA, 17 nt, Human
acaaugcaaaccaucau

SEQ ID NO: 2537143 - RNA, 16 nt, Human
acaaugcaaaccauca

SEQ ID NO: 2537144 - RNA, 11 nt, Human
acaaugcaaac

SEQ ID NO: 2537145 - RNA, 20 nt, Human
acaaugacuuacuguacaug

SEQ ID NO: 2537146 - RNA, 19 nt, Human
acaaugacuuacuguacau

SEQ ID NO: 2537147 - RNA, 22 nt, Human
acaaugacuuacuguacaugaa

SEQ ID NO: 2537148 - RNA, 15 nt, Human
acaaugauauaugga

SEQ ID NO: 2537149 - RNA, 13 nt, Human
acaaugacuuuau

SEQ ID NO: 2537150 - RNA, 14 nt, Human
acaaugacuuuauu

SEQ ID NO: 2537151 - RNA, 15 nt, Human
uagggugggccuuca

SEQ ID NO: 2537152 - RNA, 16 nt, Human
uaggguggagagccac

SEQ ID NO: 2537153 - RNA, 12 nt, Human
uaggguggcccu

SEQ ID NO: 2537154 - RNA, 15 nt, Human
uaggguuauaauaau

SEQ ID NO: 2537155 - RNA, 21 nt, Human
uaggguuuaauccccaguaaa

SEQ ID NO: 2537156 - RNA, 19 nt, Human
uaggguuuaauccccagua

SEQ ID NO: 2537157 - RNA, 12 nt, Human
uaggguuuaauc

SEQ ID NO: 2537158 - RNA, 17 nt, Human
uaggguuauaauaaugu

SEQ ID NO: 2537159 - RNA, 13 nt, Human
uaggguccugggg

SEQ ID NO: 2537160 - RNA, 15 nt, Human
uagggucggaaccca

SEQ ID NO: 2537161 - RNA, 15 nt, Human
uagggucucuucagg

SEQ ID NO: 2537162 - RNA, 19 nt, Human
uaggguaagugagagaggg

SEQ ID NO: 2537163 - RNA, 15 nt, Human
uaggguaaggugccu

SEQ ID NO: 2537164 - RNA, 18 nt, Human
uaggguaaggugccuucu

SEQ ID NO: 2537165 - RNA, 15 nt, Human
acacacacacacagc

SEQ ID NO: 2537166 - RNA, 16 nt, Human
acacacacacacagcc

SEQ ID NO: 2537167 - RNA, 14 nt, Human
acacacacacacau

SEQ ID NO: 2537168 - RNA, 15 nt, Human
acacacacacacaug

SEQ ID NO: 2537169 - RNA, 16 nt, Human
acacacacacacaugc

SEQ ID NO: 2537170 - RNA, 17 nt, Human
acacacacacacaugca

SEQ ID NO: 2537171 - RNA, 12 nt, Human
acacacacacag

SEQ ID NO: 2537172 - RNA, 13 nt, Human
acacacacacagc

SEQ ID NO: 2537173 - RNA, 13 nt, Human
acacacacacaug

SEQ ID NO: 2537174 - RNA, 14 nt, Human
acacacacacaugc

SEQ ID NO: 2537175 - RNA, 14 nt, Human
acacacacacagga

SEQ ID NO: 2537176 - RNA, 14 nt, Human
acacacacacagcc

SEQ ID NO: 2537177 - RNA, 15 nt, Human
acacacacacagcca

SEQ ID NO: 2537178 - RNA, 12 nt, Human
acacacacacau

SEQ ID NO: 2537179 - RNA, 15 nt, Human
acacacacacacagg

SEQ ID NO: 2537180 - RNA, 13 nt, Human
acacacacacagg

SEQ ID NO: 2537181 - RNA, 19 nt, Human
acacaaggauagaugcugg

SEQ ID NO: 2537182 - RNA, 23 nt, Human
acacaaggauagaugcuggccca

SEQ ID NO: 2537183 - RNA, 22 nt, Human
acacaagcuuuuuuacacaaau

SEQ ID NO: 2537184 - RNA, 13 nt, Human
acacaaguaaaca

SEQ ID NO: 2537185 - RNA, 15 nt, Human
acacaagcuggaagc

SEQ ID NO: 2537186 - RNA, 14 nt, Human
acacaagcuggaag

SEQ ID NO: 2537187 - RNA, 19 nt, Human
acacaagccacagaagcca

SEQ ID NO: 2537188 - RNA, 16 nt, Human
acacaagccacagaag

SEQ ID NO: 2537189 - RNA, 15 nt, Human
acacaagccacagaa

SEQ ID NO: 2537190 - RNA, 14 nt, Human
acacaagccacaga

SEQ ID NO: 2537191 - RNA, 16 nt, Human
acacaaguccugugaa

SEQ ID NO: 2537192 - RNA, 15 nt, Human
acacaaguccuguga

SEQ ID NO: 2537193 - RNA, 14 nt, Human
acacaaguaaacau

SEQ ID NO: 2537194 - RNA, 12 nt, Human
acacaauacaau

SEQ ID NO: 2537195 - RNA, 14 nt, Human
acacacacacacag

SEQ ID NO: 2537196 - RNA, 16 nt, Human
acacacacacacacag

SEQ ID NO: 2537197 - RNA, 14 nt, Human
acacaaaugcaggg

SEQ ID NO: 2537198 - RNA, 13 nt, Human
acacaacuauauu

SEQ ID NO: 2537199 - RNA, 13 nt, Human
acacaagccacag

SEQ ID NO: 2537200 - RNA, 13 nt, Human
acacaacacacac

SEQ ID NO: 2537201 - RNA, 21 nt, Human
acaaugcaaaccaucauugaa

SEQ ID NO: 2537202 - RNA, 19 nt, Human
acaaugcaaaccaucauug

SEQ ID NO: 2537203 - RNA, 23 nt, Human
acaaugcaaaccaucauugaaau

SEQ ID NO: 2537204 - RNA, 14 nt, Human
uagucacugagaca

SEQ ID NO: 2537205 - RNA, 23 nt, Human
uagucacauggccuaugcacaua

SEQ ID NO: 2537206 - RNA, 13 nt, Human
uaguagagacggg

SEQ ID NO: 2537207 - RNA, 22 nt, Human
uaguagagacaggguuuugcca

SEQ ID NO: 2537208 - RNA, 15 nt, Human
uaguagagacagggu

SEQ ID NO: 2537209 - RNA, 15 nt, Human
uaguaaucacaguug

SEQ ID NO: 2537210 - RNA, 20 nt, Human
uaguaaugcuacgugugauu

SEQ ID NO: 2537211 - RNA, 12 nt, Human
uaguaaucauau

SEQ ID NO: 2537212 - RNA, 14 nt, Human
uaguagagacaggg

SEQ ID NO: 2537213 - RNA, 15 nt, Human
uaguaauucucaggc

SEQ ID NO: 2537214 - RNA, 14 nt, Human
uaguaauucucagg

SEQ ID NO: 2537215 - RNA, 14 nt, Human
uaguaauugacaug

SEQ ID NO: 2537216 - RNA, 22 nt, Human
uaguaaugcuacgugugauuuu

SEQ ID NO: 2537217 - RNA, 21 nt, Human
uaguaaugcuacgugugauuu

SEQ ID NO: 2537218 - RNA, 15 nt, Human
uaguaauguuuuaua

SEQ ID NO: 2537219 - RNA, 16 nt, Human
acacagguucacgugc

SEQ ID NO: 2537220 - RNA, 14 nt, Human
acacaggucuuucc

SEQ ID NO: 2537221 - RNA, 16 nt, Human
acacaggucuuuccua

SEQ ID NO: 2537222 - RNA, 18 nt, Human
acacagggacuugaaguu

SEQ ID NO: 2537223 - RNA, 15 nt, Human
acacagggacuugaa

SEQ ID NO: 2537224 - RNA, 11 nt, Human
acacagggcag

SEQ ID NO: 2537225 - RNA, 23 nt, Human
uagguuuuguuugcuaucuuaau

SEQ ID NO: 2537226 - RNA, 21 nt, Human
uagguuuuguuugcuaucuua

SEQ ID NO: 2537227 - RNA, 16 nt, Human
uagguuuuguuugcua

SEQ ID NO: 2537228 - RNA, 15 nt, Human
acacaggucuuuccu

SEQ ID NO: 2537229 - RNA, 16 nt, Human
uaguaaaaauaaaauu

SEQ ID NO: 2537230 - RNA, 13 nt, Human
uaguaaaaauaaa

SEQ ID NO: 2537231 - RNA, 15 nt, Human
uagguuuuuguuugu

SEQ ID NO: 2537232 - RNA, 15 nt, Human
uagguuuuuauuagu

SEQ ID NO: 2537233 - RNA, 15 nt, Human
uagguuuuuuuguau

SEQ ID NO: 2537234 - RNA, 19 nt, Human
uagguuuuuuuguauagua

SEQ ID NO: 2537235 - RNA, 14 nt, Human
uaguaaucacaguu

SEQ ID NO: 2537236 - RNA, 16 nt, Human
uaguaaaaauuaaaaa

SEQ ID NO: 2537237 - RNA, 13 nt, Human
uaguaaaaauuaa

SEQ ID NO: 2537238 - RNA, 20 nt, Human
uagguuuuuuuccuucugaa

SEQ ID NO: 2537239 - RNA, 15 nt, Human
uaguaaaaauacaaa

SEQ ID NO: 2537240 - RNA, 18 nt, Human
acacaggcccggcuccag

SEQ ID NO: 2537241 - RNA, 17 nt, Human
acacaggcccggcucca

SEQ ID NO: 2537242 - RNA, 16 nt, Human
acacaggcccggcucc

SEQ ID NO: 2537243 - RNA, 11 nt, Human
acacacagcca

SEQ ID NO: 2537244 - RNA, 12 nt, Human
acacacagccac

SEQ ID NO: 2537245 - RNA, 21 nt, Human
acacaggcaacugaggcagac

SEQ ID NO: 2537246 - RNA, 13 nt, Human
acacacagaaaau

SEQ ID NO: 2537247 - RNA, 14 nt, Human
acacacagaaaaua

SEQ ID NO: 2537248 - RNA, 15 nt, Human
acacacagaaaauau

SEQ ID NO: 2537249 - RNA, 16 nt, Human
acacacagaaaauaua

SEQ ID NO: 2537250 - RNA, 17 nt, Human
acacacagaaaauauac

SEQ ID NO: 2537251 - RNA, 18 nt, Human
acacacagaaaauauacu

SEQ ID NO: 2537252 - RNA, 19 nt, Human
acacacagaaaauauacug

SEQ ID NO: 2537253 - RNA, 20 nt, Human
acacacagaaaauauacugu

SEQ ID NO: 2537254 - RNA, 21 nt, Human
acacacagaaaauauacugua

SEQ ID NO: 2537255 - RNA, 22 nt, Human
acacacagaaaauauacuguaa

SEQ ID NO: 2537256 - RNA, 13 nt, Human
acacacagacaca

SEQ ID NO: 2537257 - RNA, 23 nt, Human
acacacagauuugagcucagccc

SEQ ID NO: 2537258 - RNA, 22 nt, Human
acacacagaggaagagcaggca

SEQ ID NO: 2537259 - RNA, 13 nt, Human
acacacagaggaa

SEQ ID NO: 2537260 - RNA, 22 nt, Human
acacaggcccggcuccaggcuc

SEQ ID NO: 2537261 - RNA, 21 nt, Human
acacaggcccggcuccaggcu

SEQ ID NO: 2537262 - RNA, 20 nt, Human
acacaggcccggcuccaggc

SEQ ID NO: 2537263 - RNA, 19 nt, Human
acacaggcccggcuccagg

SEQ ID NO: 2537264 - RNA, 24 nt, Human
acacaggcccggcuccaggcuccu

SEQ ID NO: 2537265 - RNA, 23 nt, Human
acacaggcccggcuccaggcucc

SEQ ID NO: 2537266 - RNA, 13 nt, Human
acacaggcccucc

SEQ ID NO: 2537267 - RNA, 16 nt, Human
acacaggcccucccug

SEQ ID NO: 2537268 - RNA, 14 nt, Human
acacagggacuuga

SEQ ID NO: 2537269 - RNA, 12 nt, Human
acaaaauaaaca

SEQ ID NO: 2537270 - RNA, 14 nt, Human
acaaaauaaacaaa

SEQ ID NO: 2537271 - RNA, 22 nt, Human
acaaaaguuucauccuuuucau

SEQ ID NO: 2537272 - RNA, 15 nt, Human
acaaaacuacaugag

SEQ ID NO: 2537273 - RNA, 21 nt, Human
acaaaaggguuuaaacugauu

SEQ ID NO: 2537274 - RNA, 23 nt, Human
acaaaacacucggcauuucaaau

SEQ ID NO: 2537275 - RNA, 17 nt, Human
acaaaacaacccuagag

SEQ ID NO: 2537276 - RNA, 12 nt, Human
acaaaacaaaug

SEQ ID NO: 2537277 - RNA, 14 nt, Human
acaaaaauuaggua

SEQ ID NO: 2537278 - RNA, 12 nt, Human
acaaaaauaaca

SEQ ID NO: 2537279 - RNA, 13 nt, Human
acaaaaauauaaa

SEQ ID NO: 2537280 - RNA, 19 nt, Human
acaaaaaugaacugaaguu

SEQ ID NO: 2537281 - RNA, 22 nt, Human
acaaaaaugaaagcaugucuca

SEQ ID NO: 2537282 - RNA, 18 nt, Human
acaaaaaguuuccauaug

SEQ ID NO: 2537283 - RNA, 20 nt, Human
acaaaaagguucucaggugu

SEQ ID NO: 2537284 - RNA, 22 nt, Human
acaaaaagguaaaacuuuuuau

SEQ ID NO: 2537285 - RNA, 21 nt, Human
acaaaaauguaaugaucauaa

SEQ ID NO: 2537286 - RNA, 23 nt, Human
acaaaaaugaacugaaguuucac

SEQ ID NO: 2537287 - RNA, 14 nt, Human
acaaaaauuaaaau

SEQ ID NO: 2537288 - RNA, 19 nt, Human
acaaaaauucucaguucuc

SEQ ID NO: 2537289 - RNA, 15 nt, Human
acaaaaauugacuca

SEQ ID NO: 2537290 - RNA, 16 nt, Human
aauuuuaauauuuuau

SEQ ID NO: 2537291 - RNA, 12 nt, Human
aauuuuacauuu

SEQ ID NO: 2537292 - RNA, 13 nt, Human
acaaaaacacagc

SEQ ID NO: 2537293 - RNA, 21 nt, Human
aauuuuacccuuuagacugua

SEQ ID NO: 2537294 - RNA, 17 nt, Human
aauuuuacccuuuagac

SEQ ID NO: 2537295 - RNA, 15 nt, Human
acaaaaaacuccccu

SEQ ID NO: 2537296 - RNA, 18 nt, Human
aauuuuacccuuuagacu

SEQ ID NO: 2537297 - RNA, 14 nt, Human
acaaaaacacagca

SEQ ID NO: 2537298 - RNA, 15 nt, Human
acaaaaacacagcaa

SEQ ID NO: 2537299 - RNA, 14 nt, Human
acaaaaagcuuccc

SEQ ID NO: 2537300 - RNA, 15 nt, Human
acaaaaagcuucccc

SEQ ID NO: 2537301 - RNA, 14 nt, Human
uagagccugaggga

SEQ ID NO: 2537302 - RNA, 21 nt, Human
uagagccaggcacacacugug

SEQ ID NO: 2537303 - RNA, 14 nt, Human
uagagccagggucu

SEQ ID NO: 2537304 - RNA, 17 nt, Human
acaaauacucaugugua

SEQ ID NO: 2537305 - RNA, 16 nt, Human
acaaauacucaugugu

SEQ ID NO: 2537306 - RNA, 15 nt, Human
acaaauacucaugug

SEQ ID NO: 2537307 - RNA, 14 nt, Human
acaaauacucaugu

SEQ ID NO: 2537308 - RNA, 17 nt, Human
acaaauacucuuaggaa

SEQ ID NO: 2537309 - RNA, 15 nt, Human
acaaauacucuuagg

SEQ ID NO: 2537310 - RNA, 18 nt, Human
acaaauacucauguguau

SEQ ID NO: 2537311 - RNA, 23 nt, Human
acaaauacucuuaggaagagaaa

SEQ ID NO: 2537312 - RNA, 22 nt, Human
uagagcggagaaaggaagggcu

SEQ ID NO: 2537313 - RNA, 16 nt, Human
uagagccugccuggag

SEQ ID NO: 2537314 - RNA, 13 nt, Human
uagagccugccug

SEQ ID NO: 2537315 - RNA, 12 nt, Human
uagagccugccu

SEQ ID NO: 2537316 - RNA, 18 nt, Human
uagagccugccuggagcg

SEQ ID NO: 2537317 - RNA, 17 nt, Human
uagagccugccuggagc

SEQ ID NO: 2537318 - RNA, 16 nt, Human
uagaggcuuccuucau

SEQ ID NO: 2537319 - RNA, 17 nt, Human
uagaggcuuccuucauu

SEQ ID NO: 2537320 - RNA, 18 nt, Human
uagaggcuuccuucauuu

SEQ ID NO: 2537321 - RNA, 19 nt, Human
uagaggcuuccuucauuuc

SEQ ID NO: 2537322 - RNA, 23 nt, Human
uagaggccugaggaugagcugga

SEQ ID NO: 2537323 - RNA, 15 nt, Human
uagaggccugaggau

SEQ ID NO: 2537324 - RNA, 12 nt, Human
uagaggccugag

SEQ ID NO: 2537325 - RNA, 14 nt, Human
acaaaguaauuccu

SEQ ID NO: 2537326 - RNA, 21 nt, Human
acaaagguuuuccucuucuau

SEQ ID NO: 2537327 - RNA, 13 nt, Human
acaaauacucaug

SEQ ID NO: 2537328 - RNA, 16 nt, Human
acaaauaacaaugugc

SEQ ID NO: 2537329 - RNA, 16 nt, Human
acaaauaauaagcaaa

SEQ ID NO: 2537330 - RNA, 20 nt, Human
acaaaauccagcuaugaaua

SEQ ID NO: 2537331 - RNA, 18 nt, Human
acaaaauagaagcuguag

SEQ ID NO: 2537332 - RNA, 15 nt, Human
acaaaauagaagcug

SEQ ID NO: 2537333 - RNA, 12 nt, Human
acaaaauagaag

SEQ ID NO: 2537334 - RNA, 22 nt, Human
acaaaauaaccaauccuggaca

SEQ ID NO: 2537335 - RNA, 14 nt, Human
acaaaaucuccucu

SEQ ID NO: 2537336 - RNA, 19 nt, Human
acaaagguauaauuuuaug

SEQ ID NO: 2537337 - RNA, 24 nt, Human
acaaagguugagauguaaaaggua

SEQ ID NO: 2537338 - RNA, 19 nt, Human
acaaaaucgauuggcuuua

SEQ ID NO: 2537339 - RNA, 22 nt, Human
uagcacagacccugcccugugg

SEQ ID NO: 2537340 - RNA, 24 nt, Human
uagcacagacccugcccugugggc

SEQ ID NO: 2537341 - RNA, 13 nt, Human
uagcaccagggcu

SEQ ID NO: 2537342 - RNA, 13 nt, Human
uagcaccagggac

SEQ ID NO: 2537343 - RNA, 16 nt, Human
uagcacuaccacuccu

SEQ ID NO: 2537344 - RNA, 20 nt, Human
uagcacuaccacuccugcca

SEQ ID NO: 2537345 - RNA, 13 nt, Human
uagcacuggccug

SEQ ID NO: 2537346 - RNA, 13 nt, Human
uagcacugagcaa

SEQ ID NO: 2537347 - RNA, 20 nt, Human
uagccaaaugguuuaacuuc

SEQ ID NO: 2537348 - RNA, 21 nt, Human
uagccaacacccaucuguuuu

SEQ ID NO: 2537349 - RNA, 16 nt, Human
uagccaaacccuuguc

SEQ ID NO: 2537350 - RNA, 12 nt, Human
uagccaaggcca

SEQ ID NO: 2537351 - RNA, 15 nt, Human
uagcacuggccugca

SEQ ID NO: 2537352 - RNA, 18 nt, Human
uagccacccaccacacug

SEQ ID NO: 2537353 - RNA, 18 nt, Human
uagccaccgccuccuaca

SEQ ID NO: 2537354 - RNA, 16 nt, Human
uagccaccaucuuugc

SEQ ID NO: 2537355 - RNA, 14 nt, Human
uagccaccaucuuu

SEQ ID NO: 2537356 - RNA, 13 nt, Human
uagccaccaucuu

SEQ ID NO: 2537357 - RNA, 22 nt, Human
uagccaccaacucuugcagguc

SEQ ID NO: 2537358 - RNA, 21 nt, Human
uagccacauuuggaauacuuu

SEQ ID NO: 2537359 - RNA, 14 nt, Human
uagccaccaacucu

SEQ ID NO: 2537360 - RNA, 13 nt, Human
uagccaaggccaa

SEQ ID NO: 2537361 - RNA, 20 nt, Human
uagccacauuuggaauacuu

SEQ ID NO: 2537362 - RNA, 16 nt, Human
uagccacauuuggaau

SEQ ID NO: 2537363 - RNA, 22 nt, Human
acaaaucaagcuucaguuuccu

SEQ ID NO: 2537364 - RNA, 19 nt, Human
uagccaccgccuccuacag

SEQ ID NO: 2537365 - RNA, 19 nt, Human
uagccaccccagaaauggu

SEQ ID NO: 2537366 - RNA, 13 nt, Human
uagccacucagga

SEQ ID NO: 2537367 - RNA, 14 nt, Human
uagccacucaggag

SEQ ID NO: 2537368 - RNA, 16 nt, Human
uagccacuuaccuuca

SEQ ID NO: 2537369 - RNA, 17 nt, Human
uagccacuuaccuucaa

SEQ ID NO: 2537370 - RNA, 17 nt, Human
uagauuuuguuuugcuu

SEQ ID NO: 2537371 - RNA, 23 nt, Human
uagauuuuguuuugcuuuuucug

SEQ ID NO: 2537372 - RNA, 14 nt, Human
uagagggcccuggu

SEQ ID NO: 2537373 - RNA, 20 nt, Human
uagagggagguguuuaaaga

SEQ ID NO: 2537374 - RNA, 23 nt, Human
uagaggggggauuuccagccagg

SEQ ID NO: 2537375 - RNA, 13 nt, Human
uagaggguuccug

SEQ ID NO: 2537376 - RNA, 17 nt, Human
uagaggguuccuguaga

SEQ ID NO: 2537377 - RNA, 23 nt, Human
uagcaaaacgcauggagugugua

SEQ ID NO: 2537378 - RNA, 22 nt, Human
uagcaaaacgcauggagugugu

SEQ ID NO: 2537379 - RNA, 14 nt, Human
uagaggguguguaa

SEQ ID NO: 2537380 - RNA, 23 nt, Human
uagagggaggagaaugagccucg

SEQ ID NO: 2537381 - RNA, 13 nt, Human
uagagggaggggc

SEQ ID NO: 2537382 - RNA, 14 nt, Human
uagagggaggggcc

SEQ ID NO: 2537383 - RNA, 24 nt, Human
uagaggggaaaagagaugaugaaa

SEQ ID NO: 2537384 - RNA, 23 nt, Human
uagaggcuucuccgccagccucc

SEQ ID NO: 2537385 - RNA, 21 nt, Human
uagaggcuucuccgccagccu

SEQ ID NO: 2537386 - RNA, 20 nt, Human
uagaggcuucuccgccagcc

SEQ ID NO: 2537387 - RNA, 19 nt, Human
uagaggcuucuccgccagc

SEQ ID NO: 2537388 - RNA, 18 nt, Human
uagaggcuucuccgccag

SEQ ID NO: 2537389 - RNA, 14 nt, Human
uagaggcuucuccg

SEQ ID NO: 2537390 - RNA, 13 nt, Human
uagaggcuagcuu

SEQ ID NO: 2537391 - RNA, 15 nt, Human
uagagggaccucucc

SEQ ID NO: 2537392 - RNA, 19 nt, Human
uagagggaccucucccagg

SEQ ID NO: 2537393 - RNA, 22 nt, Human
uagaggcuucuccgccagccuc

SEQ ID NO: 2537394 - RNA, 20 nt, Human
uagagggaccucucccaggg

SEQ ID NO: 2537395 - RNA, 15 nt, Human
uagcaaacagaggaa

SEQ ID NO: 2537396 - RNA, 12 nt, Human
uagcaaacagag

SEQ ID NO: 2537397 - RNA, 21 nt, Human
uagcaaaauucuuaaguaugu

SEQ ID NO: 2537398 - RNA, 14 nt, Human
uagcaaacuuugua

SEQ ID NO: 2537399 - RNA, 18 nt, Human
uagcaaguuacagugaug

SEQ ID NO: 2537400 - RNA, 14 nt, Human
uagcacagacccug

SEQ ID NO: 2537401 - RNA, 21 nt, Human
uagcaaguucuagagaagagg

SEQ ID NO: 2537402 - RNA, 19 nt, Human
uagcaaguucuagagaaga

SEQ ID NO: 2537403 - RNA, 18 nt, Human
uagcaaguucuagagaag

SEQ ID NO: 2537404 - RNA, 17 nt, Human
uagcaaguucuagagaa

SEQ ID NO: 2537405 - RNA, 21 nt, Human
uagcaauccauguuaguuuuu

SEQ ID NO: 2537406 - RNA, 17 nt, Human
uagcaaucacaacacug

SEQ ID NO: 2537407 - RNA, 21 nt, Human
uagcacagacccugcccugug

SEQ ID NO: 2537408 - RNA, 20 nt, Human
uagcacagacccugcccugu

SEQ ID NO: 2537409 - RNA, 15 nt, Human
uagcacagacccugc

SEQ ID NO: 2537410 - RNA, 18 nt, Human
uagcacacacuuuugguu

SEQ ID NO: 2537411 - RNA, 19 nt, Human
uagacacauaugaggggga

SEQ ID NO: 2537412 - RNA, 13 nt, Human
uagacacacauga

SEQ ID NO: 2537413 - RNA, 18 nt, Human
uagacaauuuauuauggc

SEQ ID NO: 2537414 - RNA, 22 nt, Human
uagacacuggcugccagcuauu

SEQ ID NO: 2537415 - RNA, 19 nt, Human
uagacacuggcugccagcu

SEQ ID NO: 2537416 - RNA, 18 nt, Human
uagacacccauuuucaca

SEQ ID NO: 2537417 - RNA, 17 nt, Human
uagacacuggcugccag

SEQ ID NO: 2537418 - RNA, 17 nt, Human
uagacacccauuuucac

SEQ ID NO: 2537419 - RNA, 21 nt, Human
uagacacuccccgaagucuuu

SEQ ID NO: 2537420 - RNA, 16 nt, Human
uagacagucccugcca

SEQ ID NO: 2537421 - RNA, 10 nt, Human
uagacagagu

SEQ ID NO: 2537422 - RNA, 16 nt, Human
uagaagcuguaguagc

SEQ ID NO: 2537423 - RNA, 13 nt, Human
uagaagacauuua

SEQ ID NO: 2537424 - RNA, 17 nt, Human
uagaagcuggaggacua

SEQ ID NO: 2537425 - RNA, 15 nt, Human
uagaaggagacagag

SEQ ID NO: 2537426 - RNA, 17 nt, Human
uagaaggagacagagcu

SEQ ID NO: 2537427 - RNA, 23 nt, Human
uagaaggagacagagcugguugg

SEQ ID NO: 2537428 - RNA, 17 nt, Human
uagaaggauguacauuu

SEQ ID NO: 2537429 - RNA, 19 nt, Human
uagaaggccacaugucacc

SEQ ID NO: 2537430 - RNA, 11 nt, Human
uagaaggccac

SEQ ID NO: 2537431 - RNA, 21 nt, Human
uagaaggauguacauuuccaa

SEQ ID NO: 2537432 - RNA, 21 nt, Human
uagaaggucggaggcuuggga

SEQ ID NO: 2537433 - RNA, 20 nt, Human
uagaaguaggaagugaaaau

SEQ ID NO: 2537434 - RNA, 19 nt, Human
uagaagguucucuccuccc

SEQ ID NO: 2537435 - RNA, 16 nt, Human
uagaaggucggaggcu

SEQ ID NO: 2537436 - RNA, 16 nt, Human
uagaaggguuauauuu

SEQ ID NO: 2537437 - RNA, 19 nt, Human
uagaagggccaguccugcc

SEQ ID NO: 2537438 - RNA, 24 nt, Human
uagaagggcuagaaccuggagagc

SEQ ID NO: 2537439 - RNA, 22 nt, Human
uagaagggcuagaaccuggaga

SEQ ID NO: 2537440 - RNA, 22 nt, Human
uagaagggccaguccugccugg

SEQ ID NO: 2537441 - RNA, 13 nt, Human
uagaauuugauua

SEQ ID NO: 2537442 - RNA, 21 nt, Human
uagacaaauacucauguguau

SEQ ID NO: 2537443 - RNA, 20 nt, Human
uagacaaauacucaugugua

SEQ ID NO: 2537444 - RNA, 19 nt, Human
uagacaaauacucaugugu

SEQ ID NO: 2537445 - RNA, 18 nt, Human
uagacaaauacucaugug

SEQ ID NO: 2537446 - RNA, 17 nt, Human
uagacaaauacucaugu

SEQ ID NO: 2537447 - RNA, 16 nt, Human
uagacaaauacucaug

SEQ ID NO: 2537448 - RNA, 15 nt, Human
uagacaaauacucau

SEQ ID NO: 2537449 - RNA, 14 nt, Human
uagacaaauacuca

SEQ ID NO: 2537450 - RNA, 21 nt, Human
uagaauuuugguauaaagaaa

SEQ ID NO: 2537451 - RNA, 16 nt, Human
uagaauuuuaagugcu

SEQ ID NO: 2537452 - RNA, 21 nt, Human
uagacagucccugccaaugga

SEQ ID NO: 2537453 - RNA, 17 nt, Human
uagacagucccugccaa

SEQ ID NO: 2537454 - RNA, 13 nt, Human
uagacauaacaaa

SEQ ID NO: 2537455 - RNA, 18 nt, Human
uagacagucucacuuugu

SEQ ID NO: 2537456 - RNA, 23 nt, Human
uagacauuucucuuacugcaaau

SEQ ID NO: 2537457 - RNA, 21 nt, Human
uagacauuucucuuacugcaa

SEQ ID NO: 2537458 - RNA, 18 nt, Human
uagacauuucucuuacug

SEQ ID NO: 2537459 - RNA, 13 nt, Human
uagaccaaaauaa

SEQ ID NO: 2537460 - RNA, 14 nt, Human
uagaccaaaauaaa

SEQ ID NO: 2537461 - RNA, 14 nt, Human
uagaccaagcuugu

SEQ ID NO: 2537462 - RNA, 16 nt, Human
uagacauucugucgcc

SEQ ID NO: 2537463 - RNA, 13 nt, Human
uagacauucuguc

SEQ ID NO: 2537464 - RNA, 21 nt, Human
uagacauuugcuaugagcugg

SEQ ID NO: 2537465 - RNA, 19 nt, Human
uagacauuuguaaauguaa

SEQ ID NO: 2537466 - RNA, 14 nt, Human
aauuugugauacaa

SEQ ID NO: 2537467 - RNA, 18 nt, Human
aauuugggggaaaauuua

SEQ ID NO: 2537468 - RNA, 16 nt, Human
aauuuggauugcuaau

SEQ ID NO: 2537469 - RNA, 16 nt, Human
aauuugggagauauau

SEQ ID NO: 2537470 - RNA, 18 nt, Human
aauuuggccugcacuaau

SEQ ID NO: 2537471 - RNA, 17 nt, Human
aauuugugauacaaugc

SEQ ID NO: 2537472 - RNA, 18 nt, Human
aauuugugauacaaugcu

SEQ ID NO: 2537473 - RNA, 13 nt, Human
aauuuuaaugcua

SEQ ID NO: 2537474 - RNA, 16 nt, Human
aauuuuaaugaagaaa

SEQ ID NO: 2537475 - RNA, 13 nt, Human
aauuuuaauuuau

SEQ ID NO: 2537476 - RNA, 15 nt, Human
aauuuuaauuuauuu

SEQ ID NO: 2537477 - RNA, 19 nt, Human
aauuuuaagugcuuuguaa

SEQ ID NO: 2537478 - RNA, 16 nt, Human
aauuugucuugccuua

SEQ ID NO: 2537479 - RNA, 22 nt, Human
aauuuuaagugcuuuguaaugg

SEQ ID NO: 2537480 - RNA, 15 nt, Human
uagaaacacaacuau

SEQ ID NO: 2537481 - RNA, 18 nt, Human
uagaaacauaaauaaaau

SEQ ID NO: 2537482 - RNA, 14 nt, Human
uagaaacauaaaua

SEQ ID NO: 2537483 - RNA, 23 nt, Human
uagaaaauuuguuauuuugcaac

SEQ ID NO: 2537484 - RNA, 22 nt, Human
uagaaaauuuguuauuuugcaa

SEQ ID NO: 2537485 - RNA, 21 nt, Human
uagaaaaggcuagguacacag

SEQ ID NO: 2537486 - RNA, 21 nt, Human
uagaaaagaaaaaaaaaauau

SEQ ID NO: 2537487 - RNA, 21 nt, Human
uagaaaacugaaaaucuaaua

SEQ ID NO: 2537488 - RNA, 20 nt, Human
uagaaaacugaaaaucuaau

SEQ ID NO: 2537489 - RNA, 16 nt, Human
uagaaaacugaaaauc

SEQ ID NO: 2537490 - RNA, 15 nt, Human
uagaaaacugaaaau

SEQ ID NO: 2537491 - RNA, 22 nt, Human
uagaaaacugaaaaucuaauau

SEQ ID NO: 2537492 - RNA, 17 nt, Human
uagaacucccuuucaac

SEQ ID NO: 2537493 - RNA, 18 nt, Human
uagaacucccuuucaaca

SEQ ID NO: 2537494 - RNA, 15 nt, Human
uagaaaccuuaauau

SEQ ID NO: 2537495 - RNA, 14 nt, Human
uagaaaccuuaaua

SEQ ID NO: 2537496 - RNA, 23 nt, Human
uagaaacaugguuuugaaaugcu

SEQ ID NO: 2537497 - RNA, 15 nt, Human
uagaaacauugaaga

SEQ ID NO: 2537498 - RNA, 16 nt, Human
uagaacucccuuucaa

SEQ ID NO: 2537499 - RNA, 19 nt, Human
uagaaacucaccauguaaa

SEQ ID NO: 2537500 - RNA, 18 nt, Human
uagaagaacauccaagga

SEQ ID NO: 2537501 - RNA, 22 nt, Human
uagaagaacauccaaggagaaa

SEQ ID NO: 2537502 - RNA, 21 nt, Human
uagaagaauacaaacauauuu

SEQ ID NO: 2537503 - RNA, 14 nt, Human
uagaagaagugugu

SEQ ID NO: 2537504 - RNA, 12 nt, Human
uagaagaacugc

SEQ ID NO: 2537505 - RNA, 20 nt, Human
uacuuuggaauacauuucuc

SEQ ID NO: 2537506 - RNA, 22 nt, Human
uacuuugccuuuugcaaacuuu

SEQ ID NO: 2537507 - RNA, 20 nt, Human
uacuuugccuuuugcaaacu

SEQ ID NO: 2537508 - RNA, 19 nt, Human
uacuuugccuuuugcaaac

SEQ ID NO: 2537509 - RNA, 21 nt, Human
uacuuugccuuuccauaauca

SEQ ID NO: 2537510 - RNA, 17 nt, Human
uacuuugccuuuugcaa

SEQ ID NO: 2537511 - RNA, 23 nt, Human
aauucaugaacuucgcaucaaaa

SEQ ID NO: 2537512 - RNA, 22 nt, Human
uacuuuguacaaagaccacaca

SEQ ID NO: 2537513 - RNA, 20 nt, Human
aauuccacaccuuuuauuga

SEQ ID NO: 2537514 - RNA, 14 nt, Human
aauuccacagcugc

SEQ ID NO: 2537515 - RNA, 12 nt, Human
aauuccacagcu

SEQ ID NO: 2537516 - RNA, 13 nt, Human
aauuccacagcug

SEQ ID NO: 2537517 - RNA, 16 nt, Human
aauuccacaccuuuua

SEQ ID NO: 2537518 - RNA, 16 nt, Human
aauuccacacccucac

SEQ ID NO: 2537519 - RNA, 17 nt, Human
aauuccaauuauaugag

SEQ ID NO: 2537520 - RNA, 14 nt, Human
aauucaugaacuuc

SEQ ID NO: 2537521 - RNA, 11 nt, Human
aauucaugaac

SEQ ID NO: 2537522 - RNA, 14 nt, Human
aauucauguuucuu

SEQ ID NO: 2537523 - RNA, 16 nt, Human
uagaaaaacccugccc

SEQ ID NO: 2537524 - RNA, 14 nt, Human
uacuuuuuuucaca

SEQ ID NO: 2537525 - RNA, 20 nt, Human
uacuuuuuaaaaucuuuucu

SEQ ID NO: 2537526 - RNA, 16 nt, Human
uacuuuuucauucuuu

SEQ ID NO: 2537527 - RNA, 16 nt, Human
uagaaaacauaaucuu

SEQ ID NO: 2537528 - RNA, 13 nt, Human
uagaaaacugaaa

SEQ ID NO: 2537529 - RNA, 13 nt, Human
uagaaaaagcagu

SEQ ID NO: 2537530 - RNA, 22 nt, Human
uagaaaaacccugcccccaaau

SEQ ID NO: 2537531 - RNA, 17 nt, Human
uacuuuugcaugaaaau

SEQ ID NO: 2537532 - RNA, 15 nt, Human
uacuuuugcccuuug

SEQ ID NO: 2537533 - RNA, 14 nt, Human
uacuuuuuaaaugu

SEQ ID NO: 2537534 - RNA, 16 nt, Human
uacuuuuauaauaaaa

SEQ ID NO: 2537535 - RNA, 21 nt, Human
uacuuuuaaacuguguacaua

SEQ ID NO: 2537536 - RNA, 19 nt, Human
uacuuuuaugauguauauu

SEQ ID NO: 2537537 - RNA, 22 nt, Human
uacuuuuauaauaaaaggaaaa

SEQ ID NO: 2537538 - RNA, 19 nt, Human
acuacuagaugucuuuagg

SEQ ID NO: 2537539 - RNA, 23 nt, Human
acuagaaccuggagggcuagaac

SEQ ID NO: 2537540 - RNA, 15 nt, Human
acuagaaccuggagg

SEQ ID NO: 2537541 - RNA, 14 nt, Human
acuagaaccuggag

SEQ ID NO: 2537542 - RNA, 15 nt, Human
acuagaacacagaaa

SEQ ID NO: 2537543 - RNA, 15 nt, Human
acuagaaaucugcca

SEQ ID NO: 2537544 - RNA, 13 nt, Human
acuagaacucucc

SEQ ID NO: 2537545 - RNA, 15 nt, Human
acuagaacucuccau

SEQ ID NO: 2537546 - RNA, 13 nt, Human
acuaccugucaag

SEQ ID NO: 2537547 - RNA, 18 nt, Human
acuaccuugguuccccca

SEQ ID NO: 2537548 - RNA, 17 nt, Human
acuaccuugaaaauaag

SEQ ID NO: 2537549 - RNA, 18 nt, Human
acuacggaauaguuggcu

SEQ ID NO: 2537550 - RNA, 15 nt, Human
acuacguuaagggaa

SEQ ID NO: 2537551 - RNA, 15 nt, Human
acuacgugacugugg

SEQ ID NO: 2537552 - RNA, 21 nt, Human
acuagaauucuagugcugcug

SEQ ID NO: 2537553 - RNA, 20 nt, Human
acuagaauucuagugcugcu

SEQ ID NO: 2537554 - RNA, 19 nt, Human
acuagaauucuagugcugc

SEQ ID NO: 2537555 - RNA, 18 nt, Human
acuagaauucuagugcug

SEQ ID NO: 2537556 - RNA, 23 nt, Human
acuagaauucuagugcugcugaa

SEQ ID NO: 2537557 - RNA, 22 nt, Human
acuagaauucuagugcugcuga

SEQ ID NO: 2537558 - RNA, 15 nt, Human
acuagaauuuauuca

SEQ ID NO: 2537559 - RNA, 16 nt, Human
acuagaacucuccauc

SEQ ID NO: 2537560 - RNA, 14 nt, Human
acuagaagggccag

SEQ ID NO: 2537561 - RNA, 17 nt, Human
acuagaauucuagugcu

SEQ ID NO: 2537562 - RNA, 18 nt, Human
acuagaagaugaauacaa

SEQ ID NO: 2537563 - RNA, 23 nt, Human
acuagaagggccaguccugccug

SEQ ID NO: 2537564 - RNA, 13 nt, Human
acuagaagaugaa

SEQ ID NO: 2537565 - RNA, 20 nt, Human
acuagagggaccucucccag

SEQ ID NO: 2537566 - RNA, 21 nt, Human
acuagagggaccucucccagg

SEQ ID NO: 2537567 - RNA, 19 nt, Human
acuagagggaccucuccca

SEQ ID NO: 2537568 - RNA, 20 nt, Human
acuagaguuuagcuggaaaa

SEQ ID NO: 2537569 - RNA, 15 nt, Human
acuagagucugaaca

SEQ ID NO: 2537570 - RNA, 22 nt, Human
acuagagggaccucucccaggg

SEQ ID NO: 2537571 - RNA, 13 nt, Human
acguacacauuuu

SEQ ID NO: 2537572 - RNA, 14 nt, Human
acguacacauuuua

SEQ ID NO: 2537573 - RNA, 12 nt, Human
acguacacauuu

SEQ ID NO: 2537574 - RNA, 13 nt, Human
acguacacacaca

SEQ ID NO: 2537575 - RNA, 19 nt, Human
uccccacgcccuccccucc

SEQ ID NO: 2537576 - RNA, 18 nt, Human
uccccacgcccuccccuc

SEQ ID NO: 2537577 - RNA, 16 nt, Human
acggucgccaccuggc

SEQ ID NO: 2537578 - RNA, 21 nt, Human
acggucccacacuggugacug

SEQ ID NO: 2537579 - RNA, 20 nt, Human
acgguauuaugcuucuugga

SEQ ID NO: 2537580 - RNA, 22 nt, Human
uccccacggggccucgggaccu

SEQ ID NO: 2537581 - RNA, 20 nt, Human
uccccacggccgcuccaggg

SEQ ID NO: 2537582 - RNA, 19 nt, Human
uccccacggccgcuccagg

SEQ ID NO: 2537583 - RNA, 18 nt, Human
uccccacggccgcuccag

SEQ ID NO: 2537584 - RNA, 23 nt, Human
uccccacggggccucgggaccuc

SEQ ID NO: 2537585 - RNA, 22 nt, Human
uccccacucccuggcucucaga

SEQ ID NO: 2537586 - RNA, 20 nt, Human
uccccacugccuacugcauc

SEQ ID NO: 2537587 - RNA, 18 nt, Human
uccccacugccuacugca

SEQ ID NO: 2537588 - RNA, 15 nt, Human
uccccacugccuacu

SEQ ID NO: 2537589 - RNA, 16 nt, Human
uccccacugacagccu

SEQ ID NO: 2537590 - RNA, 19 nt, Human
uccccacugacagccuccc

SEQ ID NO: 2537591 - RNA, 14 nt, Human
uccccacugccugc

SEQ ID NO: 2537592 - RNA, 18 nt, Human
uccccacugccugcccac

SEQ ID NO: 2537593 - RNA, 20 nt, Human
uccccacugccugcccaccc

SEQ ID NO: 2537594 - RNA, 22 nt, Human
uccccacugccugcccacccgu

SEQ ID NO: 2537595 - RNA, 14 nt, Human
uccccaguaaaauu

SEQ ID NO: 2537596 - RNA, 22 nt, Human
uccccagguggcugacccaguc

SEQ ID NO: 2537597 - RNA, 15 nt, Human
uccccaguaaaauug

SEQ ID NO: 2537598 - RNA, 17 nt, Human
uccccaguuugcagaaa

SEQ ID NO: 2537599 - RNA, 14 nt, Human
uccccaucauccca

SEQ ID NO: 2537600 - RNA, 16 nt, Human
uccccauccuccagcu

SEQ ID NO: 2537601 - RNA, 15 nt, Human
uccccauccuccagc

SEQ ID NO: 2537602 - RNA, 14 nt, Human
uccccauccuccag

SEQ ID NO: 2537603 - RNA, 18 nt, Human
uccccaucaucuguggaa

SEQ ID NO: 2537604 - RNA, 19 nt, Human
uccccaucaucccagcugc

SEQ ID NO: 2537605 - RNA, 17 nt, Human
uccccaucaucccagcu

SEQ ID NO: 2537606 - RNA, 16 nt, Human
uccccaucaucccagc

SEQ ID NO: 2537607 - RNA, 18 nt, Human
uccccauccuccagcuuc

SEQ ID NO: 2537608 - RNA, 17 nt, Human
uccccauccuccagcuu

SEQ ID NO: 2537609 - RNA, 19 nt, Human
uccccauccuccagcuucu

SEQ ID NO: 2537610 - RNA, 13 nt, Human
ucccccagacuuu

SEQ ID NO: 2537611 - RNA, 14 nt, Human
ucccccacugccau

SEQ ID NO: 2537612 - RNA, 22 nt, Human
ucccccacuccucuuauuugcu

SEQ ID NO: 2537613 - RNA, 19 nt, Human
ucccccacccccuccccgc

SEQ ID NO: 2537614 - RNA, 20 nt, Human
ucccccacccccuccccagg

SEQ ID NO: 2537615 - RNA, 21 nt, Human
ucccccacccccuccccaggg

SEQ ID NO: 2537616 - RNA, 14 nt, Human
uccccaucuggguc

SEQ ID NO: 2537617 - RNA, 22 nt, Human
ucccccaacccccaccccacac

SEQ ID NO: 2537618 - RNA, 17 nt, Human
ucccccaaccucagacu

SEQ ID NO: 2537619 - RNA, 18 nt, Human
ucccccacccccucccca

SEQ ID NO: 2537620 - RNA, 19 nt, Human
ucccccacccccuccccag

SEQ ID NO: 2537621 - RNA, 22 nt, Human
ucccccaccagcuaaggacauu

SEQ ID NO: 2537622 - RNA, 13 nt, Human
acuauucaaacag

SEQ ID NO: 2537623 - RNA, 14 nt, Human
acuauucaaacagu

SEQ ID NO: 2537624 - RNA, 16 nt, Human
acuauucaaacagucu

SEQ ID NO: 2537625 - RNA, 18 nt, Human
acuauucaaacagucuca

SEQ ID NO: 2537626 - RNA, 13 nt, Human
acuauguugauaa

SEQ ID NO: 2537627 - RNA, 12 nt, Human
acuauguaucaa

SEQ ID NO: 2537628 - RNA, 21 nt, Human
acuauggugccaauggaaccu

SEQ ID NO: 2537629 - RNA, 20 nt, Human
acuauggugccaauggaacc

SEQ ID NO: 2537630 - RNA, 14 nt, Human
acuauggugccaau

SEQ ID NO: 2537631 - RNA, 14 nt, Human
acuauguaacaugu

SEQ ID NO: 2537632 - RNA, 21 nt, Human
acuagagucugaacagcugua

SEQ ID NO: 2537633 - RNA, 20 nt, Human
acuagagucugaacagcugu

SEQ ID NO: 2537634 - RNA, 12 nt, Human
acuauaauguaa

SEQ ID NO: 2537635 - RNA, 13 nt, Human
acuauaauguaag

SEQ ID NO: 2537636 - RNA, 14 nt, Human
acuauaauguaagc

SEQ ID NO: 2537637 - RNA, 21 nt, Human
acuaugcauggugccccagga

SEQ ID NO: 2537638 - RNA, 22 nt, Human
acuaugcauggugccccaggac

SEQ ID NO: 2537639 - RNA, 23 nt, Human
acuaugcauggugccccaggacc

SEQ ID NO: 2537640 - RNA, 24 nt, Human
acuaugcauggugccccaggacca

SEQ ID NO: 2537641 - RNA, 16 nt, Human
acuaugauuuggaaaa

SEQ ID NO: 2537642 - RNA, 20 nt, Human
acuaugcauggugccccagg

SEQ ID NO: 2537643 - RNA, 15 nt, Human
acuaugacugcuccc

SEQ ID NO: 2537644 - RNA, 16 nt, Human
acuaugcacaauuuaa

SEQ ID NO: 2537645 - RNA, 15 nt, Human
acuaugauuuggaaa

SEQ ID NO: 2537646 - RNA, 21 nt, Human
acuauaauguaagcucuacug

SEQ ID NO: 2537647 - RNA, 14 nt, Human
uccccucugcugcu

SEQ ID NO: 2537648 - RNA, 13 nt, Human
uccccucugcugc

SEQ ID NO: 2537649 - RNA, 19 nt, Human
uccccucucuugcacccgc

SEQ ID NO: 2537650 - RNA, 17 nt, Human
uccccucucuugcaccc

SEQ ID NO: 2537651 - RNA, 17 nt, Human
uccccucugcugcuguc

SEQ ID NO: 2537652 - RNA, 15 nt, Human
uccccucugcugcug

SEQ ID NO: 2537653 - RNA, 20 nt, Human
uccccucugcugcugucccu

SEQ ID NO: 2537654 - RNA, 14 nt, Human
uccccuccuucucc

SEQ ID NO: 2537655 - RNA, 18 nt, Human
uccccuccuucucccuuu

SEQ ID NO: 2537656 - RNA, 20 nt, Human
uccccgugccccgccucccc

SEQ ID NO: 2537657 - RNA, 12 nt, Human
uccccuccuugc

SEQ ID NO: 2537658 - RNA, 18 nt, Human
uccccuccuugccuccug

SEQ ID NO: 2537659 - RNA, 20 nt, Human
uccccuccuugccuccugug

SEQ ID NO: 2537660 - RNA, 16 nt, Human
uccccucuccuuccug

SEQ ID NO: 2537661 - RNA, 14 nt, Human
uccccucucugcac

SEQ ID NO: 2537662 - RNA, 14 nt, Human
uccccuaaccucau

SEQ ID NO: 2537663 - RNA, 13 nt, Human
uccccggccucag

SEQ ID NO: 2537664 - RNA, 12 nt, Human
uccccggccuca

SEQ ID NO: 2537665 - RNA, 21 nt, Human
uccccggcccuaccagcgccc

SEQ ID NO: 2537666 - RNA, 17 nt, Human
uccccggcccuaccagc

SEQ ID NO: 2537667 - RNA, 13 nt, Human
uccccggcucgag

SEQ ID NO: 2537668 - RNA, 13 nt, Human
uccccguggucuc

SEQ ID NO: 2537669 - RNA, 22 nt, Human
uccccggucccuugagaccuca

SEQ ID NO: 2537670 - RNA, 22 nt, Human
acucaauauuuuccaugaaaau

SEQ ID NO: 2537671 - RNA, 21 nt, Human
acucaauauuuuccaugaaaa

SEQ ID NO: 2537672 - RNA, 18 nt, Human
acucaauauuuuccauga

SEQ ID NO: 2537673 - RNA, 15 nt, Human
acucaauauuuucca

SEQ ID NO: 2537674 - RNA, 15 nt, Human
acucaauaaaaucau

SEQ ID NO: 2537675 - RNA, 18 nt, Human
acucaauaaaaucaugua

SEQ ID NO: 2537676 - RNA, 12 nt, Human
acucaauauuuu

SEQ ID NO: 2537677 - RNA, 23 nt, Human
acucaagugucucaguccaccug

SEQ ID NO: 2537678 - RNA, 14 nt, Human
acucaaugcacuga

SEQ ID NO: 2537679 - RNA, 19 nt, Human
acucacauggcuauguuuu

SEQ ID NO: 2537680 - RNA, 16 nt, Human
acucacauggcuaugu

SEQ ID NO: 2537681 - RNA, 14 nt, Human
acucaaugagcucu

SEQ ID NO: 2537682 - RNA, 23 nt, Human
acucaaucuccccuugcacuaaa

SEQ ID NO: 2537683 - RNA, 23 nt, Human
acucaauauuuuccaugaaaaug

SEQ ID NO: 2537684 - RNA, 20 nt, Human
acucacauuuauucugcuca

SEQ ID NO: 2537685 - RNA, 19 nt, Human
acucacauuuauucugcuc

SEQ ID NO: 2537686 - RNA, 18 nt, Human
uccccgcuucugccugca

SEQ ID NO: 2537687 - RNA, 15 nt, Human
uccccggaguucagu

SEQ ID NO: 2537688 - RNA, 15 nt, Human
uccccggcccuacca

SEQ ID NO: 2537689 - RNA, 20 nt, Human
acucacauggcuauguuuua

SEQ ID NO: 2537690 - RNA, 18 nt, Human
ucccucagucuggcccuu

SEQ ID NO: 2537691 - RNA, 21 nt, Human
uccccucuugccccaaccccc

SEQ ID NO: 2537692 - RNA, 20 nt, Human
uccccucucuugcacccgcc

SEQ ID NO: 2537693 - RNA, 15 nt, Human
uccccucuugcccca

SEQ ID NO: 2537694 - RNA, 22 nt, Human
ucccucaccuuggcaccagaca

SEQ ID NO: 2537695 - RNA, 21 nt, Human
ucccucaccuuggcaccagac

SEQ ID NO: 2537696 - RNA, 12 nt, Human
uccccugaggcu

SEQ ID NO: 2537697 - RNA, 21 nt, Human
uccccugauuacaccagccuc

SEQ ID NO: 2537698 - RNA, 14 nt, Human
uccccugcacugga

SEQ ID NO: 2537699 - RNA, 20 nt, Human
ucccucagucuggcccuucc

SEQ ID NO: 2537700 - RNA, 14 nt, Human
ucccucagccccuc

SEQ ID NO: 2537701 - RNA, 15 nt, Human
ucccucagccccucu

SEQ ID NO: 2537702 - RNA, 16 nt, Human
ucccucagccccucuu

SEQ ID NO: 2537703 - RNA, 17 nt, Human
ucccucagccccucuug

SEQ ID NO: 2537704 - RNA, 11 nt, Human
ucccucuuucc

SEQ ID NO: 2537705 - RNA, 13 nt, Human
ucccucuuucccu

SEQ ID NO: 2537706 - RNA, 22 nt, Human
ucccuccccuggggacagcaag

SEQ ID NO: 2537707 - RNA, 19 nt, Human
ucccucuucucaagugccu

SEQ ID NO: 2537708 - RNA, 14 nt, Human
ucccucuucucaag

SEQ ID NO: 2537709 - RNA, 15 nt, Human
ucccuccccugcccu

SEQ ID NO: 2537710 - RNA, 16 nt, Human
ucccuccccugcccug

SEQ ID NO: 2537711 - RNA, 17 nt, Human
ucccuccccugcccugg

SEQ ID NO: 2537712 - RNA, 19 nt, Human
ucccuccccugcccugguc

SEQ ID NO: 2537713 - RNA, 23 nt, Human
ucccucauuucaggagcagccuc

SEQ ID NO: 2537714 - RNA, 19 nt, Human
ucccucauuucaggagcag

SEQ ID NO: 2537715 - RNA, 15 nt, Human
ucccucauuucagga

SEQ ID NO: 2537716 - RNA, 12 nt, Human
ucccuccccccc

SEQ ID NO: 2537717 - RNA, 14 nt, Human
ucccucccccccau

SEQ ID NO: 2537718 - RNA, 16 nt, Human
ucccucccccccaugc

SEQ ID NO: 2537719 - RNA, 12 nt, Human
ucccucccccuu

SEQ ID NO: 2537720 - RNA, 21 nt, Human
ucccucccccccaugcacugu

SEQ ID NO: 2537721 - RNA, 14 nt, Human
ucccucccccuugu

SEQ ID NO: 2537722 - RNA, 13 nt, Human
ucccuccccugcc

SEQ ID NO: 2537723 - RNA, 16 nt, Human
ucccuccccugccauu

SEQ ID NO: 2537724 - RNA, 14 nt, Human
ucccuccccugccc

SEQ ID NO: 2537725 - RNA, 22 nt, Human
ucccugaaggccccgcccaggc

SEQ ID NO: 2537726 - RNA, 21 nt, Human
ucccugaaggccccgcccagg

SEQ ID NO: 2537727 - RNA, 18 nt, Human
ucccugaaggccccgccc

SEQ ID NO: 2537728 - RNA, 19 nt, Human
ucccugaagccagccuucu

SEQ ID NO: 2537729 - RNA, 18 nt, Human
ucccugaagccagccuuc

SEQ ID NO: 2537730 - RNA, 17 nt, Human
ucccugaagccagccuu

SEQ ID NO: 2537731 - RNA, 16 nt, Human
ucccugaagccagccu

SEQ ID NO: 2537732 - RNA, 17 nt, Human
ucccugaaggccccgcc

SEQ ID NO: 2537733 - RNA, 23 nt, Human
ucccucuuuggcuccccuguacc

SEQ ID NO: 2537734 - RNA, 13 nt, Human
ucccucuuggucu

SEQ ID NO: 2537735 - RNA, 17 nt, Human
ucccucuucucaagugc

SEQ ID NO: 2537736 - RNA, 18 nt, Human
ucccucuuuggcuccccu

SEQ ID NO: 2537737 - RNA, 17 nt, Human
ucccucuuggucuuccc

SEQ ID NO: 2537738 - RNA, 15 nt, Human
ucccugaagccagcc

SEQ ID NO: 2537739 - RNA, 12 nt, Human
ucccugaagcca

SEQ ID NO: 2537740 - RNA, 17 nt, Human
ucccugaacugggaccu

SEQ ID NO: 2537741 - RNA, 16 nt, Human
ucccugaacugggacc

SEQ ID NO: 2537742 - RNA, 15 nt, Human
ucccugaacugggac

SEQ ID NO: 2537743 - RNA, 14 nt, Human
ucccugaacuggga

SEQ ID NO: 2537744 - RNA, 15 nt, Human
ucccugaaccauccc

SEQ ID NO: 2537745 - RNA, 15 nt, Human
ucccugaaaacccag

SEQ ID NO: 2537746 - RNA, 16 nt, Human
ucccugaaaacccaga

SEQ ID NO: 2537747 - RNA, 17 nt, Human
ucccugaaaacccagag

SEQ ID NO: 2537748 - RNA, 18 nt, Human
ucccugaaaacccagaga

SEQ ID NO: 2537749 - RNA, 19 nt, Human
ucccugaaaacccagagag

SEQ ID NO: 2537750 - RNA, 20 nt, Human
ucccugaaaacccagagagg

SEQ ID NO: 2537751 - RNA, 17 nt, Human
ucccugaaaauguuuuu

SEQ ID NO: 2537752 - RNA, 17 nt, Human
acucaccccagccccaa

SEQ ID NO: 2537753 - RNA, 18 nt, Human
acucacccccaaggggca

SEQ ID NO: 2537754 - RNA, 17 nt, Human
acucaccgaagccacuu

SEQ ID NO: 2537755 - RNA, 19 nt, Human
acucaccccggcagacgcc

SEQ ID NO: 2537756 - RNA, 16 nt, Human
acucaccuaauguuua

SEQ ID NO: 2537757 - RNA, 17 nt, Human
acucaccuaauguuuau

SEQ ID NO: 2537758 - RNA, 19 nt, Human
acucaccucccccaucucu

SEQ ID NO: 2537759 - RNA, 20 nt, Human
acucaccucccccaucucuu

SEQ ID NO: 2537760 - RNA, 11 nt, Human
acucaccucug

SEQ ID NO: 2537761 - RNA, 13 nt, Human
acucaccucugcc

SEQ ID NO: 2537762 - RNA, 14 nt, Human
acucaccucugccu

SEQ ID NO: 2537763 - RNA, 15 nt, Human
acucaccucugccuc

SEQ ID NO: 2537764 - RNA, 20 nt, Human
acucaccuaauguuuaugag

SEQ ID NO: 2537765 - RNA, 23 nt, Human
acucaccuaauguuuaugagcca

SEQ ID NO: 2537766 - RNA, 16 nt, Human
acucaccucuaaaaca

SEQ ID NO: 2537767 - RNA, 16 nt, Human
ucccugacucauucug

SEQ ID NO: 2537768 - RNA, 19 nt, Human
ucccugacucauucugaag

SEQ ID NO: 2537769 - RNA, 14 nt, Human
ucccugacucauuc

SEQ ID NO: 2537770 - RNA, 21 nt, Human
ucccugaccucccucuaauuu

SEQ ID NO: 2537771 - RNA, 17 nt, Human
ucccugaccucccucua

SEQ ID NO: 2537772 - RNA, 16 nt, Human
ucccugaccucccucu

SEQ ID NO: 2537773 - RNA, 22 nt, Human
ucccugacccuguauauagccc

SEQ ID NO: 2537774 - RNA, 17 nt, Human
ucccugacccuguauau

SEQ ID NO: 2537775 - RNA, 23 nt, Human
ucccugaaggccccgcccaggcu

SEQ ID NO: 2537776 - RNA, 22 nt, Human
ucccugacacugcggggcuugg

SEQ ID NO: 2537777 - RNA, 16 nt, Human
ucccugacacugcggg

SEQ ID NO: 2537778 - RNA, 21 nt, Human
ucccugaaucccccuugccac

SEQ ID NO: 2537779 - RNA, 14 nt, Human
ucccugacccgucu

SEQ ID NO: 2537780 - RNA, 23 nt, Human
ucccugacacugcggggcuuggc

SEQ ID NO: 2537781 - RNA, 16 nt, Human
ucccugacccuguaua

SEQ ID NO: 2537782 - RNA, 23 nt, Human
acucaucuagguaaauuacaguu

SEQ ID NO: 2537783 - RNA, 17 nt, Human
acucagaucacuacugc

SEQ ID NO: 2537784 - RNA, 16 nt, Human
acucagaucacuacug

SEQ ID NO: 2537785 - RNA, 15 nt, Human
acucagaucacuacu

SEQ ID NO: 2537786 - RNA, 19 nt, Human
acucagaucacuacugcag

SEQ ID NO: 2537787 - RNA, 18 nt, Human
acucagaucacuacugca

SEQ ID NO: 2537788 - RNA, 20 nt, Human
acucagaucacuacugcagu

SEQ ID NO: 2537789 - RNA, 14 nt, Human
acucagagggagga

SEQ ID NO: 2537790 - RNA, 18 nt, Human
acucagacauuggcaccu

SEQ ID NO: 2537791 - RNA, 12 nt, Human
acucagaccuga

SEQ ID NO: 2537792 - RNA, 19 nt, Human
acucagacaggaaagggaa

SEQ ID NO: 2537793 - RNA, 17 nt, Human
acucauugaccugaggc

SEQ ID NO: 2537794 - RNA, 16 nt, Human
acucauugaccugagg

SEQ ID NO: 2537795 - RNA, 21 nt, Human
acucaucuagguaaauuacag

SEQ ID NO: 2537796 - RNA, 12 nt, Human
acucaucuuagg

SEQ ID NO: 2537797 - RNA, 22 nt, Human
acucauugaccugaggcccuuc

SEQ ID NO: 2537798 - RNA, 18 nt, Human
acucauugaccugaggcc

SEQ ID NO: 2537799 - RNA, 21 nt, Human
acucaucuuucauuaaaggcu

SEQ ID NO: 2537800 - RNA, 19 nt, Human
acucaucuuacuguaccug

SEQ ID NO: 2537801 - RNA, 18 nt, Human
acucaucuuagugccuga

SEQ ID NO: 2537802 - RNA, 22 nt, Human
acucaucuuagugccugagagu

SEQ ID NO: 2537803 - RNA, 16 nt, Human
acucauuuuuuuaauu

SEQ ID NO: 2537804 - RNA, 19 nt, Human
acucauuuuuuuaauuuau

SEQ ID NO: 2537805 - RNA, 13 nt, Human
acuccaaaauguu

SEQ ID NO: 2537806 - RNA, 21 nt, Human
acuccaaacugacucuuaaga

SEQ ID NO: 2537807 - RNA, 14 nt, Human
acuccaccaagccu

SEQ ID NO: 2537808 - RNA, 14 nt, Human
acuccaccacccaa

SEQ ID NO: 2537809 - RNA, 15 nt, Human
acuccacccauccua

SEQ ID NO: 2537810 - RNA, 13 nt, Human
acuccaccaccca

SEQ ID NO: 2537811 - RNA, 22 nt, Human
acuccaaaauguuggucauuuu

SEQ ID NO: 2537812 - RNA, 21 nt, Human
acuccaaaccuccuguuagcu

SEQ ID NO: 2537813 - RNA, 17 nt, Human
acuccacaucugccuua

SEQ ID NO: 2537814 - RNA, 15 nt, Human
acuccaccaacccau

SEQ ID NO: 2537815 - RNA, 20 nt, Human
acuccaccaacccaucagaa

SEQ ID NO: 2537816 - RNA, 17 nt, Human
acucagaagacacugau

SEQ ID NO: 2537817 - RNA, 16 nt, Human
acucagaagacacuga

SEQ ID NO: 2537818 - RNA, 15 nt, Human
acucagaagacacug

SEQ ID NO: 2537819 - RNA, 14 nt, Human
acucagaagacacu

SEQ ID NO: 2537820 - RNA, 19 nt, Human
acucaccugccccucaacu

SEQ ID NO: 2537821 - RNA, 14 nt, Human
acucaccugccccu

SEQ ID NO: 2537822 - RNA, 21 nt, Human
acucaccugccccucaacucu

SEQ ID NO: 2537823 - RNA, 16 nt, Human
acucaccucugccuca

SEQ ID NO: 2537824 - RNA, 17 nt, Human
acucaccucugccucaa

SEQ ID NO: 2537825 - RNA, 14 nt, Human
acucagaaauuuuu

SEQ ID NO: 2537826 - RNA, 21 nt, Human
acucagaaauuuaauucaugu

SEQ ID NO: 2537827 - RNA, 12 nt, Human
acucagaagccu

SEQ ID NO: 2537828 - RNA, 15 nt, Human
acucagaagccucug

SEQ ID NO: 2537829 - RNA, 16 nt, Human
acucagaagccucugg

SEQ ID NO: 2537830 - RNA, 20 nt, Human
acucagaagccucuggguca

SEQ ID NO: 2537831 - RNA, 18 nt, Human
acucagaagacacugaug

SEQ ID NO: 2537832 - RNA, 13 nt, Human
acucagaagccug

SEQ ID NO: 2537833 - RNA, 14 nt, Human
acucagaagccuga

SEQ ID NO: 2537834 - RNA, 15 nt, Human
acucagaagccugag

SEQ ID NO: 2537835 - RNA, 16 nt, Human
acucagaagccugagg

SEQ ID NO: 2537836 - RNA, 17 nt, Human
acucagaagccugaggc

SEQ ID NO: 2537837 - RNA, 18 nt, Human
acucagaagccugaggcu

SEQ ID NO: 2537838 - RNA, 21 nt, Human
acucagaauucucuaguuuga

SEQ ID NO: 2537839 - RNA, 22 nt, Human
acucagaauucucuaguuugau

SEQ ID NO: 2537840 - RNA, 14 nt, Human
acucagaauucucu

SEQ ID NO: 2537841 - RNA, 14 nt, Human
acucagaauauugc

SEQ ID NO: 2537842 - RNA, 19 nt, Human
uccucucuuuguucucagc

SEQ ID NO: 2537843 - RNA, 17 nt, Human
uccucucuuuguucuca

SEQ ID NO: 2537844 - RNA, 15 nt, Human
uccucucuuuguucu

SEQ ID NO: 2537845 - RNA, 11 nt, Human
uccucucugcc

SEQ ID NO: 2537846 - RNA, 21 nt, Human
uccucucuuuguucucagcuc

SEQ ID NO: 2537847 - RNA, 20 nt, Human
uccucucuuuguucucagcu

SEQ ID NO: 2537848 - RNA, 15 nt, Human
uccucugacucaggg

SEQ ID NO: 2537849 - RNA, 16 nt, Human
uccucugacucagggc

SEQ ID NO: 2537850 - RNA, 17 nt, Human
uccucugacucagggcu

SEQ ID NO: 2537851 - RNA, 12 nt, Human
uccucugagccu

SEQ ID NO: 2537852 - RNA, 13 nt, Human
uccucugagccuu

SEQ ID NO: 2537853 - RNA, 17 nt, Human
uccucugagccuuggga

SEQ ID NO: 2537854 - RNA, 12 nt, Human
uccucucugccc

SEQ ID NO: 2537855 - RNA, 13 nt, Human
uccucucugcccu

SEQ ID NO: 2537856 - RNA, 14 nt, Human
uccucucugcccua

SEQ ID NO: 2537857 - RNA, 15 nt, Human
uccucucugcccuaa

SEQ ID NO: 2537858 - RNA, 14 nt, Human
uccucucuccagau

SEQ ID NO: 2537859 - RNA, 16 nt, Human
uccucucucuguguua

SEQ ID NO: 2537860 - RNA, 19 nt, Human
uccucucuccagauguuuc

SEQ ID NO: 2537861 - RNA, 16 nt, Human
uccucuccuggaggau

SEQ ID NO: 2537862 - RNA, 15 nt, Human
uccucuccuggagga

SEQ ID NO: 2537863 - RNA, 16 nt, Human
uccucucccauccccc

SEQ ID NO: 2537864 - RNA, 15 nt, Human
uccucucccaucccc

SEQ ID NO: 2537865 - RNA, 14 nt, Human
uccucucccauccc

SEQ ID NO: 2537866 - RNA, 13 nt, Human
uccucucccaucc

SEQ ID NO: 2537867 - RNA, 15 nt, Human
uccucuccaggcacc

SEQ ID NO: 2537868 - RNA, 14 nt, Human
uccucuccaggcac

SEQ ID NO: 2537869 - RNA, 12 nt, Human
uccucuccaggc

SEQ ID NO: 2537870 - RNA, 11 nt, Human
uccucuccagg

SEQ ID NO: 2537871 - RNA, 20 nt, Human
uccucucccaucccccugcc

SEQ ID NO: 2537872 - RNA, 19 nt, Human
uccucucccaucccccugc

SEQ ID NO: 2537873 - RNA, 18 nt, Human
uccucucccaucccccug

SEQ ID NO: 2537874 - RNA, 17 nt, Human
uccucucccaucccccu

SEQ ID NO: 2537875 - RNA, 23 nt, Human
uccucucccaucccccugcccuc

SEQ ID NO: 2537876 - RNA, 22 nt, Human
uccucucccaucccccugcccu

SEQ ID NO: 2537877 - RNA, 18 nt, Human
uccucucccauugucccu

SEQ ID NO: 2537878 - RNA, 19 nt, Human
uccucucccauugucccuc

SEQ ID NO: 2537879 - RNA, 14 nt, Human
uccucccuucugcu

SEQ ID NO: 2537880 - RNA, 15 nt, Human
uccucccuucugcua

SEQ ID NO: 2537881 - RNA, 16 nt, Human
uccucccuucugcuac

SEQ ID NO: 2537882 - RNA, 17 nt, Human
uccucccuucugcuacu

SEQ ID NO: 2537883 - RNA, 20 nt, Human
uccucccuuggguucugaua

SEQ ID NO: 2537884 - RNA, 19 nt, Human
uccucccuuggguucugau

SEQ ID NO: 2537885 - RNA, 18 nt, Human
uccucccuucugcuacug

SEQ ID NO: 2537886 - RNA, 18 nt, Human
uccucuccacugccuucg

SEQ ID NO: 2537887 - RNA, 17 nt, Human
uccucuccacugccuuc

SEQ ID NO: 2537888 - RNA, 17 nt, Human
uccucuccccaugaugu

SEQ ID NO: 2537889 - RNA, 21 nt, Human
uccucuccccagcccagagac

SEQ ID NO: 2537890 - RNA, 23 nt, Human
uccucuccccagcccagagacau

SEQ ID NO: 2537891 - RNA, 20 nt, Human
uccucucccauugucccucu

SEQ ID NO: 2537892 - RNA, 22 nt, Human
uccucucccauugucccucugc

SEQ ID NO: 2537893 - RNA, 20 nt, Human
uccucuccccagcccagaga

SEQ ID NO: 2537894 - RNA, 23 nt, Human
uccucucccauugucccucugcc

SEQ ID NO: 2537895 - RNA, 14 nt, Human
uccucuccuggagg

SEQ ID NO: 2537896 - RNA, 13 nt, Human
uccucuccuggag

SEQ ID NO: 2537897 - RNA, 12 nt, Human
uccucuccugga

SEQ ID NO: 2537898 - RNA, 18 nt, Human
uccucuccccuaccacug

SEQ ID NO: 2537899 - RNA, 17 nt, Human
uccucuccccuaccacu

SEQ ID NO: 2537900 - RNA, 11 nt, Human
uccucuccccu

SEQ ID NO: 2537901 - RNA, 17 nt, Human
uccucuccccucuaagg

SEQ ID NO: 2537902 - RNA, 19 nt, Human
uccucuccccucuaaggcc

SEQ ID NO: 2537903 - RNA, 20 nt, Human
uccucuccgcaguuccuguc

SEQ ID NO: 2537904 - RNA, 19 nt, Human
acucuucuugaaauuuuaa

SEQ ID NO: 2537905 - RNA, 21 nt, Human
uccuccccaaaucaauacacu

SEQ ID NO: 2537906 - RNA, 16 nt, Human
uccuccccaaaucaau

SEQ ID NO: 2537907 - RNA, 21 nt, Human
uccucccaccucagccucccg

SEQ ID NO: 2537908 - RNA, 13 nt, Human
uccucccccugcc

SEQ ID NO: 2537909 - RNA, 16 nt, Human
uccuccccagcaggug

SEQ ID NO: 2537910 - RNA, 14 nt, Human
uccucccccugcca

SEQ ID NO: 2537911 - RNA, 15 nt, Human
uccucccccugccag

SEQ ID NO: 2537912 - RNA, 17 nt, Human
uccucccccugccagug

SEQ ID NO: 2537913 - RNA, 20 nt, Human
uccucccccugccagugccu

SEQ ID NO: 2537914 - RNA, 23 nt, Human
uccucccccugccagugccuuac

SEQ ID NO: 2537915 - RNA, 19 nt, Human
uccuccccaaggagacaca

SEQ ID NO: 2537916 - RNA, 21 nt, Human
uccuccccacuuguccgcugg

SEQ ID NO: 2537917 - RNA, 10 nt, Human
uccuccccag

SEQ ID NO: 2537918 - RNA, 13 nt, Human
uccuccccagcag

SEQ ID NO: 2537919 - RNA, 22 nt, Human
uccuccccauuagagucagccu

SEQ ID NO: 2537920 - RNA, 18 nt, Human
uccucccuuccuuuuccc

SEQ ID NO: 2537921 - RNA, 17 nt, Human
uccucccuuccuuuucc

SEQ ID NO: 2537922 - RNA, 13 nt, Human
uccucccuuccuu

SEQ ID NO: 2537923 - RNA, 21 nt, Human
uccucccuuccuuuucccugc

SEQ ID NO: 2537924 - RNA, 19 nt, Human
uccucccuuccuuuucccu

SEQ ID NO: 2537925 - RNA, 22 nt, Human
uccucccuuccuuuucccugcu

SEQ ID NO: 2537926 - RNA, 13 nt, Human
uccucccuucugc

SEQ ID NO: 2537927 - RNA, 14 nt, Human
uccucccuuagcuc

SEQ ID NO: 2537928 - RNA, 10 nt, Human
uccucccuuc

SEQ ID NO: 2537929 - RNA, 19 nt, Human
uccucccugggcagaaagu

SEQ ID NO: 2537930 - RNA, 22 nt, Human
uccucccuggcugcccuggccc

SEQ ID NO: 2537931 - RNA, 21 nt, Human
uccucccuggcugcccuggcc

SEQ ID NO: 2537932 - RNA, 19 nt, Human
uccucccuggcugcccugg

SEQ ID NO: 2537933 - RNA, 18 nt, Human
uccucccuggcugcccug

SEQ ID NO: 2537934 - RNA, 17 nt, Human
uccucccuggcugcccu

SEQ ID NO: 2537935 - RNA, 12 nt, Human
uccucccuggcu

SEQ ID NO: 2537936 - RNA, 23 nt, Human
uccuccccucacagccucugacc

SEQ ID NO: 2537937 - RNA, 22 nt, Human
uccucccugcaucugaccagca

SEQ ID NO: 2537938 - RNA, 21 nt, Human
uccuccccucacagccucuga

SEQ ID NO: 2537939 - RNA, 19 nt, Human
uccuccccucacagccucu

SEQ ID NO: 2537940 - RNA, 18 nt, Human
uccuccccucacagccuc

SEQ ID NO: 2537941 - RNA, 17 nt, Human
uccuccccucacagccu

SEQ ID NO: 2537942 - RNA, 14 nt, Human
uccuccccucacag

SEQ ID NO: 2537943 - RNA, 16 nt, Human
uccuccccucacagcc

SEQ ID NO: 2537944 - RNA, 24 nt, Human
uccucccccugccagugccuuacc

SEQ ID NO: 2537945 - RNA, 20 nt, Human
uccucccaccucagccuccc

SEQ ID NO: 2537946 - RNA, 18 nt, Human
uccucccaccucagccuc

SEQ ID NO: 2537947 - RNA, 16 nt, Human
uccucccaccucagcc

SEQ ID NO: 2537948 - RNA, 15 nt, Human
uccucccaccucagc

SEQ ID NO: 2537949 - RNA, 19 nt, Human
acucuugaaaaaugcaugu

SEQ ID NO: 2537950 - RNA, 14 nt, Human
acucuugaaaaaug

SEQ ID NO: 2537951 - RNA, 14 nt, Human
uccucccaccucag

SEQ ID NO: 2537952 - RNA, 13 nt, Human
uccucccaccuca

SEQ ID NO: 2537953 - RNA, 17 nt, Human
uccugacccaggccgca

SEQ ID NO: 2537954 - RNA, 16 nt, Human
uccugacccaggccgc

SEQ ID NO: 2537955 - RNA, 15 nt, Human
uccugacccaggccg

SEQ ID NO: 2537956 - RNA, 14 nt, Human
uccugacccaggcc

SEQ ID NO: 2537957 - RNA, 13 nt, Human
uccugacccaggc

SEQ ID NO: 2537958 - RNA, 12 nt, Human
uccugacccagg

SEQ ID NO: 2537959 - RNA, 20 nt, Human
uccugaccacccuccccucu

SEQ ID NO: 2537960 - RNA, 18 nt, Human
uccugaagcugaggcuca

SEQ ID NO: 2537961 - RNA, 13 nt, Human
uccugaagcugag

SEQ ID NO: 2537962 - RNA, 19 nt, Human
uccugaccacccuccccuc

SEQ ID NO: 2537963 - RNA, 23 nt, Human
uccugaagaggcgggccagccag

SEQ ID NO: 2537964 - RNA, 22 nt, Human
uccugaagaggcgggccagcca

SEQ ID NO: 2537965 - RNA, 21 nt, Human
uccugaagaggcgggccagcc

SEQ ID NO: 2537966 - RNA, 20 nt, Human
uccugaagaggcgggccagc

SEQ ID NO: 2537967 - RNA, 19 nt, Human
uccugaagaggcgggccag

SEQ ID NO: 2537968 - RNA, 17 nt, Human
uccugaagaggcgggcc

SEQ ID NO: 2537969 - RNA, 14 nt, Human
uccugaagaggcgg

SEQ ID NO: 2537970 - RNA, 20 nt, Human
uccugaaccugaugcugacu

SEQ ID NO: 2537971 - RNA, 15 nt, Human
uccugaagaauugaa

SEQ ID NO: 2537972 - RNA, 16 nt, Human
uccugacccagucccc

SEQ ID NO: 2537973 - RNA, 15 nt, Human
uccugacccaguccc

SEQ ID NO: 2537974 - RNA, 14 nt, Human
uccugacccagucc

SEQ ID NO: 2537975 - RNA, 19 nt, Human
uccugacccaggccgcagc

SEQ ID NO: 2537976 - RNA, 14 nt, Human
uccugaccugaggc

SEQ ID NO: 2537977 - RNA, 16 nt, Human
uccugaccucagguga

SEQ ID NO: 2537978 - RNA, 16 nt, Human
uccugaccugaggcuc

SEQ ID NO: 2537979 - RNA, 15 nt, Human
uccugaccugucuca

SEQ ID NO: 2537980 - RNA, 20 nt, Human
uccugaccugucucaccaug

SEQ ID NO: 2537981 - RNA, 14 nt, Human
acucuuucuguaua

SEQ ID NO: 2537982 - RNA, 22 nt, Human
acugaaaauucgaaccaggaaa

SEQ ID NO: 2537983 - RNA, 23 nt, Human
acugaaaaucuaauauuaaaaau

SEQ ID NO: 2537984 - RNA, 19 nt, Human
acugaaaaugugcuauacu

SEQ ID NO: 2537985 - RNA, 13 nt, Human
acugaaacuuccc

SEQ ID NO: 2537986 - RNA, 16 nt, Human
acugaaaaucuaauau

SEQ ID NO: 2537987 - RNA, 15 nt, Human
acugaaaaucuaaua

SEQ ID NO: 2537988 - RNA, 15 nt, Human
acugaaaaugugcua

SEQ ID NO: 2537989 - RNA, 20 nt, Human
acugaaaaggaggggucugg

SEQ ID NO: 2537990 - RNA, 19 nt, Human
acugaaaagacucaguguu

SEQ ID NO: 2537991 - RNA, 17 nt, Human
acugaaaaccucuccuc

SEQ ID NO: 2537992 - RNA, 17 nt, Human
acucuuugaaugacaaa

SEQ ID NO: 2537993 - RNA, 13 nt, Human
acucuuugagaaa

SEQ ID NO: 2537994 - RNA, 21 nt, Human
acucuuucuguauauacuuuu

SEQ ID NO: 2537995 - RNA, 22 nt, Human
acucuuucuguauauacuuuuu

SEQ ID NO: 2537996 - RNA, 16 nt, Human
acucuuugagaaacaa

SEQ ID NO: 2537997 - RNA, 18 nt, Human
acucuuugagaaacaaca

SEQ ID NO: 2537998 - RNA, 18 nt, Human
acucuuugaaugacaaag

SEQ ID NO: 2537999 - RNA, 16 nt, Human
acucuuugagauagaa

SEQ ID NO: 2538000 - RNA, 19 nt, Human
acucuuugagauagaagaa

SEQ ID NO: 2538001 - RNA, 22 nt, Human
acucuuugagauagaagaacug

SEQ ID NO: 2538002 - RNA, 23 nt, Human
acucuuugagauagaagaacugc

SEQ ID NO: 2538003 - RNA, 14 nt, Human
acugaaaacaucug

SEQ ID NO: 2538004 - RNA, 18 nt, Human
acugaaaacaucuggaag

SEQ ID NO: 2538005 - RNA, 17 nt, Human
acugaaaacaucuggaa

SEQ ID NO: 2538006 - RNA, 16 nt, Human
acugaaaacaucugga

SEQ ID NO: 2538007 - RNA, 15 nt, Human
acugaaaacaucugg

SEQ ID NO: 2538008 - RNA, 15 nt, Human
acugaaaaccucucc

SEQ ID NO: 2538009 - RNA, 16 nt, Human
acugaaaaccucuccu

SEQ ID NO: 2538010 - RNA, 17 nt, Human
uccucugcagcugaccu

SEQ ID NO: 2538011 - RNA, 16 nt, Human
uccucugcagcugacc

SEQ ID NO: 2538012 - RNA, 17 nt, Human
uccucugaucuccaugg

SEQ ID NO: 2538013 - RNA, 13 nt, Human
uccucugaucucc

SEQ ID NO: 2538014 - RNA, 15 nt, Human
uccucugauacccag

SEQ ID NO: 2538015 - RNA, 23 nt, Human
uccucucuuuguucucagcuccc

SEQ ID NO: 2538016 - RNA, 18 nt, Human
uccucugacucagggcuc

SEQ ID NO: 2538017 - RNA, 14 nt, Human
uccucugaggcuga

SEQ ID NO: 2538018 - RNA, 15 nt, Human
uccucugcagugccu

SEQ ID NO: 2538019 - RNA, 13 nt, Human
uccucugcagugc

SEQ ID NO: 2538020 - RNA, 20 nt, Human
uccucugcagcugaccucug

SEQ ID NO: 2538021 - RNA, 18 nt, Human
uccucugcagcugaccuc

SEQ ID NO: 2538022 - RNA, 18 nt, Human
uccucugcagugccuugg

SEQ ID NO: 2538023 - RNA, 12 nt, Human
uccucugccacc

SEQ ID NO: 2538024 - RNA, 14 nt, Human
uccucugccaccuc

SEQ ID NO: 2538025 - RNA, 15 nt, Human
uccucugccaccucc

SEQ ID NO: 2538026 - RNA, 22 nt, Human
uccucugccugccccgccccca

SEQ ID NO: 2538027 - RNA, 14 nt, Human
uccucugccugccc

SEQ ID NO: 2538028 - RNA, 13 nt, Human
uccucugccugcc

SEQ ID NO: 2538029 - RNA, 12 nt, Human
uccucugccugc

SEQ ID NO: 2538030 - RNA, 11 nt, Human
uccucugccug

SEQ ID NO: 2538031 - RNA, 12 nt, Human
uccucugccuca

SEQ ID NO: 2538032 - RNA, 18 nt, Human
uccucugccaccuccccu

SEQ ID NO: 2538033 - RNA, 22 nt, Human
uccucugccaccuccccuaucc

SEQ ID NO: 2538034 - RNA, 10 nt, Human
uccucugccu

SEQ ID NO: 2538035 - RNA, 23 nt, Human
uccucugccaccuccccuaucca

SEQ ID NO: 2538036 - RNA, 19 nt, Human
uccucuugccacugccucu

SEQ ID NO: 2538037 - RNA, 17 nt, Human
uccucuugccuccugga

SEQ ID NO: 2538038 - RNA, 14 nt, Human
uccucuugcucaaa

SEQ ID NO: 2538039 - RNA, 13 nt, Human
uccucuugcucaa

SEQ ID NO: 2538040 - RNA, 12 nt, Human
uccucuuguaaa

SEQ ID NO: 2538041 - RNA, 22 nt, Human
uccugaaaacccuugccaugug

SEQ ID NO: 2538042 - RNA, 21 nt, Human
uccugaaaacccuugccaugu

SEQ ID NO: 2538043 - RNA, 14 nt, Human
uccugaagaaccag

SEQ ID NO: 2538044 - RNA, 16 nt, Human
uccugaagaaccaguc

SEQ ID NO: 2538045 - RNA, 18 nt, Human
uccugaagaaccaguccc

SEQ ID NO: 2538046 - RNA, 23 nt, Human
uccugaagaaccaguccccccac

SEQ ID NO: 2538047 - RNA, 13 nt, Human
uccugaagaacca

SEQ ID NO: 2538048 - RNA, 16 nt, Human
uccugaaccugaugcu

SEQ ID NO: 2538049 - RNA, 23 nt, Human
uccucuuuggucuacacugugcu

SEQ ID NO: 2538050 - RNA, 21 nt, Human
uccucuuuuaucuuggacuga

SEQ ID NO: 2538051 - RNA, 21 nt, Human
uccucuuguaaauaaagcccu

SEQ ID NO: 2538052 - RNA, 19 nt, Human
uccucuuguaaauaaagcc

SEQ ID NO: 2538053 - RNA, 18 nt, Human
uccucuuguaaauaaagc

SEQ ID NO: 2538054 - RNA, 21 nt, Human
uccucuuuagaguuagacugu

SEQ ID NO: 2538055 - RNA, 20 nt, Human
uccucuuuagaguuagacug

SEQ ID NO: 2538056 - RNA, 15 nt, Human
uccucuuuagaguua

SEQ ID NO: 2538057 - RNA, 20 nt, Human
uccucuuguaaauaaagccc

SEQ ID NO: 2538058 - RNA, 22 nt, Human
acucucaggaccaaagcuuuca

SEQ ID NO: 2538059 - RNA, 14 nt, Human
acucucagucucug

SEQ ID NO: 2538060 - RNA, 16 nt, Human
acucucagucucugag

SEQ ID NO: 2538061 - RNA, 13 nt, Human
acucucagucucu

SEQ ID NO: 2538062 - RNA, 18 nt, Human
acucucaggaucaagaaa

SEQ ID NO: 2538063 - RNA, 19 nt, Human
acucucaggaucaagaaag

SEQ ID NO: 2538064 - RNA, 13 nt, Human
acucugacaacag

SEQ ID NO: 2538065 - RNA, 17 nt, Human
acucugacaacagacuu

SEQ ID NO: 2538066 - RNA, 17 nt, Human
acucucagucucugagc

SEQ ID NO: 2538067 - RNA, 18 nt, Human
acucucagucucugagca

SEQ ID NO: 2538068 - RNA, 22 nt, Human
acucucaggaucaagaaagugu

SEQ ID NO: 2538069 - RNA, 14 nt, Human
acucucauucccca

SEQ ID NO: 2538070 - RNA, 18 nt, Human
acucugacaacagacuuc

SEQ ID NO: 2538071 - RNA, 20 nt, Human
acucugacaacagacuucug

SEQ ID NO: 2538072 - RNA, 22 nt, Human
acucugacaacagacuucugaa

SEQ ID NO: 2538073 - RNA, 23 nt, Human
acucugacaacagacuucugaaa

SEQ ID NO: 2538074 - RNA, 18 nt, Human
acucugcucgccuuagca

SEQ ID NO: 2538075 - RNA, 16 nt, Human
acucugccugcuuaca

SEQ ID NO: 2538076 - RNA, 16 nt, Human
acucugccucugccug

SEQ ID NO: 2538077 - RNA, 15 nt, Human
acucucauuccccag

SEQ ID NO: 2538078 - RNA, 11 nt, Human
acucugccucu

SEQ ID NO: 2538079 - RNA, 12 nt, Human
acucugccucug

SEQ ID NO: 2538080 - RNA, 14 nt, Human
acucugccucugcc

SEQ ID NO: 2538081 - RNA, 16 nt, Human
acucugccuccucuuc

SEQ ID NO: 2538082 - RNA, 16 nt, Human
acucgcgacaaugcaa

SEQ ID NO: 2538083 - RNA, 15 nt, Human
acucgcgacaaugca

SEQ ID NO: 2538084 - RNA, 16 nt, Human
acucgguuucuccaaa

SEQ ID NO: 2538085 - RNA, 14 nt, Human
acucgguuucucca

SEQ ID NO: 2538086 - RNA, 21 nt, Human
acucgcccgcccacuguccug

SEQ ID NO: 2538087 - RNA, 20 nt, Human
acucgcccgcccacuguccu

SEQ ID NO: 2538088 - RNA, 12 nt, Human
acucgguuucuc

SEQ ID NO: 2538089 - RNA, 19 nt, Human
acucgcccgcccacugucc

SEQ ID NO: 2538090 - RNA, 17 nt, Human
acucgcccgcccacugu

SEQ ID NO: 2538091 - RNA, 15 nt, Human
acucgcccgcccacu

SEQ ID NO: 2538092 - RNA, 14 nt, Human
acucgcccgcccac

SEQ ID NO: 2538093 - RNA, 17 nt, Human
acucgcgacaaugcaaa

SEQ ID NO: 2538094 - RNA, 14 nt, Human
acucucacauguuu

SEQ ID NO: 2538095 - RNA, 14 nt, Human
acucguauaugucu

SEQ ID NO: 2538096 - RNA, 16 nt, Human
acucgucugacugugu

SEQ ID NO: 2538097 - RNA, 22 nt, Human
acucgcccgcccacuguccugg

SEQ ID NO: 2538098 - RNA, 17 nt, Human
acucuggcagcucagag

SEQ ID NO: 2538099 - RNA, 16 nt, Human
acucuggcagcucaga

SEQ ID NO: 2538100 - RNA, 15 nt, Human
acucugcugcuuaga

SEQ ID NO: 2538101 - RNA, 14 nt, Human
acucugcugcuuag

SEQ ID NO: 2538102 - RNA, 9 nt, Human
acucugcug

SEQ ID NO: 2538103 - RNA, 23 nt, Human
acucugcugucuaaccugugacc

SEQ ID NO: 2538104 - RNA, 22 nt, Human
acucugcugucuaaccugugac

SEQ ID NO: 2538105 - RNA, 12 nt, Human
acucugcuucuc

SEQ ID NO: 2538106 - RNA, 14 nt, Human
acucugcucugccc

SEQ ID NO: 2538107 - RNA, 20 nt, Human
acucugcucugcccuuguuc

SEQ ID NO: 2538108 - RNA, 20 nt, Human
acucuggcagcucagagagg

SEQ ID NO: 2538109 - RNA, 19 nt, Human
acucuggcagcucagagag

SEQ ID NO: 2538110 - RNA, 15 nt, Human
acucugcuucucuga

SEQ ID NO: 2538111 - RNA, 14 nt, Human
acucugcuucucug

SEQ ID NO: 2538112 - RNA, 21 nt, Human
acucuuauugcccacgcugga

SEQ ID NO: 2538113 - RNA, 17 nt, Human
acucuucacaaaaucug

SEQ ID NO: 2538114 - RNA, 20 nt, Human
acucuucaguuaagccuuug

SEQ ID NO: 2538115 - RNA, 21 nt, Human
acucuucaguuaagccuuugg

SEQ ID NO: 2538116 - RNA, 20 nt, Human
acucuucccccacuccucuu

SEQ ID NO: 2538117 - RNA, 22 nt, Human
acucuuccgaaaaauccucuuc

SEQ ID NO: 2538118 - RNA, 21 nt, Human
acucuuccgaaaaauccucuu

SEQ ID NO: 2538119 - RNA, 20 nt, Human
acucuuccgaaaaauccucu

SEQ ID NO: 2538120 - RNA, 17 nt, Human
acucuuccagaauccca

SEQ ID NO: 2538121 - RNA, 16 nt, Human
acucuuccugcaagga

SEQ ID NO: 2538122 - RNA, 13 nt, Human
acucuugaaaaau

SEQ ID NO: 2538123 - RNA, 15 nt, Human
acucuucuugaaauu

SEQ ID NO: 2538124 - RNA, 16 nt, Human
acucuucuugaaauuu

SEQ ID NO: 2538125 - RNA, 19 nt, Human
acucuucuuaacuuaaauu

SEQ ID NO: 2538126 - RNA, 20 nt, Human
acucuucuuaacuuaaauuu

SEQ ID NO: 2538127 - RNA, 23 nt, Human
acucuucugagcaccuacuuaca

SEQ ID NO: 2538128 - RNA, 15 nt, Human
acucuuccugcaagg

SEQ ID NO: 2538129 - RNA, 18 nt, Human
uccuacucccagacaccc

SEQ ID NO: 2538130 - RNA, 17 nt, Human
uccuacucccagacacc

SEQ ID NO: 2538131 - RNA, 16 nt, Human
uccuacuaggcaaaau

SEQ ID NO: 2538132 - RNA, 20 nt, Human
uccuacgucaaacaugaagu

SEQ ID NO: 2538133 - RNA, 14 nt, Human
uccuaccucagccu

SEQ ID NO: 2538134 - RNA, 16 nt, Human
uccuaccucagccuag

SEQ ID NO: 2538135 - RNA, 13 nt, Human
uccuaccucccug

SEQ ID NO: 2538136 - RNA, 17 nt, Human
uccuaccucagccuaga

SEQ ID NO: 2538137 - RNA, 14 nt, Human
uccuagcagagaga

SEQ ID NO: 2538138 - RNA, 12 nt, Human
uccuagcagaga

SEQ ID NO: 2538139 - RNA, 20 nt, Human
uccuagccacccaccacacu

SEQ ID NO: 2538140 - RNA, 12 nt, Human
uccuacucugug

SEQ ID NO: 2538141 - RNA, 21 nt, Human
uccuagccugugccucuggga

SEQ ID NO: 2538142 - RNA, 21 nt, Human
uccuagccaccgccuccuaca

SEQ ID NO: 2538143 - RNA, 13 nt, Human
uccuagccacuca

SEQ ID NO: 2538144 - RNA, 17 nt, Human
uccuagccacucaggag

SEQ ID NO: 2538145 - RNA, 22 nt, Human
uccuagccuuauccucugaucu

SEQ ID NO: 2538146 - RNA, 17 nt, Human
acuccuggguugagcug

SEQ ID NO: 2538147 - RNA, 21 nt, Human
uccuagccuuauccucugauc

SEQ ID NO: 2538148 - RNA, 20 nt, Human
uccuagccuuauccucugau

SEQ ID NO: 2538149 - RNA, 19 nt, Human
uccuagccuuauccucuga

SEQ ID NO: 2538150 - RNA, 18 nt, Human
uccuagccuuauccucug

SEQ ID NO: 2538151 - RNA, 15 nt, Human
uccuagcagagagac

SEQ ID NO: 2538152 - RNA, 23 nt, Human
acuccuggguugagcuguugccu

SEQ ID NO: 2538153 - RNA, 15 nt, Human
acuccuguaauuccu

SEQ ID NO: 2538154 - RNA, 13 nt, Human
acuccuguacacu

SEQ ID NO: 2538155 - RNA, 15 nt, Human
acuccuguacacuga

SEQ ID NO: 2538156 - RNA, 16 nt, Human
acuccuguacacugaa

SEQ ID NO: 2538157 - RNA, 17 nt, Human
acuccuguacacugaau

SEQ ID NO: 2538158 - RNA, 18 nt, Human
acuccuguacacugaaua

SEQ ID NO: 2538159 - RNA, 16 nt, Human
acuccuguuacuuacc

SEQ ID NO: 2538160 - RNA, 17 nt, Human
acuccuguuacuuaccu

SEQ ID NO: 2538161 - RNA, 12 nt, Human
acuccuuagaga

SEQ ID NO: 2538162 - RNA, 23 nt, Human
acuccuugauuuuagccuucucu

SEQ ID NO: 2538163 - RNA, 20 nt, Human
acuccuguuacuuaccuaaa

SEQ ID NO: 2538164 - RNA, 23 nt, Human
acuccuuccaguguccuuagaac

SEQ ID NO: 2538165 - RNA, 11 nt, Human
acuccuuccug

SEQ ID NO: 2538166 - RNA, 17 nt, Human
acucgagaccuuuucaa

SEQ ID NO: 2538167 - RNA, 16 nt, Human
acucgagaccuuuuca

SEQ ID NO: 2538168 - RNA, 17 nt, Human
acucgagaacuuucauu

SEQ ID NO: 2538169 - RNA, 13 nt, Human
acucgagaacuuu

SEQ ID NO: 2538170 - RNA, 20 nt, Human
acuccuugugguuuauguca

SEQ ID NO: 2538171 - RNA, 19 nt, Human
acuccuugugguuuauguc

SEQ ID NO: 2538172 - RNA, 18 nt, Human
acuccuugugguuuaugu

SEQ ID NO: 2538173 - RNA, 21 nt, Human
acuccuugugguuuaugucau

SEQ ID NO: 2538174 - RNA, 16 nt, Human
acucgaguuacagaca

SEQ ID NO: 2538175 - RNA, 19 nt, Human
acucgaggacuguauuugu

SEQ ID NO: 2538176 - RNA, 23 nt, Human
acucgagaccuuuucaacuuggc

SEQ ID NO: 2538177 - RNA, 21 nt, Human
acucgaggacuguauuuguga

SEQ ID NO: 2538178 - RNA, 19 nt, Human
acucgauucauauugaaua

SEQ ID NO: 2538179 - RNA, 18 nt, Human
acuccagaaagugacaag

SEQ ID NO: 2538180 - RNA, 14 nt, Human
acuccagaaaguga

SEQ ID NO: 2538181 - RNA, 15 nt, Human
acuccacuuucauag

SEQ ID NO: 2538182 - RNA, 17 nt, Human
uccggauuggcuugugu

SEQ ID NO: 2538183 - RNA, 16 nt, Human
uccggauuuaauuuga

SEQ ID NO: 2538184 - RNA, 23 nt, Human
uccggauuggcuuguguguuuca

SEQ ID NO: 2538185 - RNA, 18 nt, Human
uccggcccccagagcgcc

SEQ ID NO: 2538186 - RNA, 14 nt, Human
uccggcccccagag

SEQ ID NO: 2538187 - RNA, 18 nt, Human
uccggcaguucugggugc

SEQ ID NO: 2538188 - RNA, 22 nt, Human
uccggcgucagccuccagccuc

SEQ ID NO: 2538189 - RNA, 21 nt, Human
uccggcgucagccuccagccu

SEQ ID NO: 2538190 - RNA, 19 nt, Human
uccggcgucagccuccagc

SEQ ID NO: 2538191 - RNA, 18 nt, Human
uccggcgucagccuccag

SEQ ID NO: 2538192 - RNA, 17 nt, Human
uccggcgucagccucca

SEQ ID NO: 2538193 - RNA, 16 nt, Human
uccggcgucagccucc

SEQ ID NO: 2538194 - RNA, 15 nt, Human
uccggcgucagccuc

SEQ ID NO: 2538195 - RNA, 21 nt, Human
uccggccugaugacagagcga

SEQ ID NO: 2538196 - RNA, 14 nt, Human
uccggccuccccuc

SEQ ID NO: 2538197 - RNA, 23 nt, Human
uccggcccuccuacccugcgccc

SEQ ID NO: 2538198 - RNA, 21 nt, Human
uccggcccuccuacccugcgc

SEQ ID NO: 2538199 - RNA, 16 nt, Human
uccgugcuuccucagu

SEQ ID NO: 2538200 - RNA, 17 nt, Human
uccgugcugacagcugc

SEQ ID NO: 2538201 - RNA, 18 nt, Human
uccgugcugacagcugcu

SEQ ID NO: 2538202 - RNA, 19 nt, Human
uccgugcugacagcugcuc

SEQ ID NO: 2538203 - RNA, 21 nt, Human
uccgugcugacagcugcuccu

SEQ ID NO: 2538204 - RNA, 13 nt, Human
uccgugcugacag

SEQ ID NO: 2538205 - RNA, 13 nt, Human
uccguuaaaauac

SEQ ID NO: 2538206 - RNA, 23 nt, Human
uccgugggacggugcccaagcca

SEQ ID NO: 2538207 - RNA, 16 nt, Human
uccgugggacggugcc

SEQ ID NO: 2538208 - RNA, 24 nt, Human
uccgugcuuguuugcucaccuggg

SEQ ID NO: 2538209 - RNA, 17 nt, Human
uccgugggacggugccc

SEQ ID NO: 2538210 - RNA, 15 nt, Human
uccguuagcuccugu

SEQ ID NO: 2538211 - RNA, 15 nt, Human
uccguuaaaauacca

SEQ ID NO: 2538212 - RNA, 20 nt, Human
uccuaccgaaaccuugccuu

SEQ ID NO: 2538213 - RNA, 12 nt, Human
uccuaccucagc

SEQ ID NO: 2538214 - RNA, 13 nt, Human
uccuaccucagcc

SEQ ID NO: 2538215 - RNA, 17 nt, Human
uccguuagcuccugugg

SEQ ID NO: 2538216 - RNA, 16 nt, Human
uccguuagcuccugug

SEQ ID NO: 2538217 - RNA, 20 nt, Human
uccuacccugcgcccagucc

SEQ ID NO: 2538218 - RNA, 15 nt, Human
uccuacccugcgccc

SEQ ID NO: 2538219 - RNA, 17 nt, Human
ucccaccaggcugcuca

SEQ ID NO: 2538220 - RNA, 18 nt, Human
ucccaccaaggucuucag

SEQ ID NO: 2538221 - RNA, 15 nt, Human
ucccaccacagcagg

SEQ ID NO: 2538222 - RNA, 15 nt, Human
ucccaccacccugag

SEQ ID NO: 2538223 - RNA, 17 nt, Human
ucccaccacagcaggug

SEQ ID NO: 2538224 - RNA, 19 nt, Human
ucccaccaacccucagagc

SEQ ID NO: 2538225 - RNA, 14 nt, Human
ucccaccccacaca

SEQ ID NO: 2538226 - RNA, 11 nt, Human
ucccaccccac

SEQ ID NO: 2538227 - RNA, 22 nt, Human
ucccacccacaugugacacaua

SEQ ID NO: 2538228 - RNA, 18 nt, Human
ucccacccacaugugaca

SEQ ID NO: 2538229 - RNA, 19 nt, Human
ucccacccaccgccacaau

SEQ ID NO: 2538230 - RNA, 12 nt, Human
ucccacccaccg

SEQ ID NO: 2538231 - RNA, 15 nt, Human
ucccacccacaugug

SEQ ID NO: 2538232 - RNA, 16 nt, Human
ucccacccacauguga

SEQ ID NO: 2538233 - RNA, 22 nt, Human
ucccaccaggcugcucagggcu

SEQ ID NO: 2538234 - RNA, 18 nt, Human
ucccacccgaugcugcuu

SEQ ID NO: 2538235 - RNA, 17 nt, Human
ucccacccgaugcugcu

SEQ ID NO: 2538236 - RNA, 20 nt, Human
ucccacccgaugcugcuuuc

SEQ ID NO: 2538237 - RNA, 20 nt, Human
ucccacccccuucucugcuc

SEQ ID NO: 2538238 - RNA, 21 nt, Human
ucccacccccuucucugcucc

SEQ ID NO: 2538239 - RNA, 16 nt, Human
ucccacccgaugcugc

SEQ ID NO: 2538240 - RNA, 15 nt, Human
ucccacccgaugcug

SEQ ID NO: 2538241 - RNA, 22 nt, Human
ucccacccccuucucugcucca

SEQ ID NO: 2538242 - RNA, 23 nt, Human
ucccacccccacccccagcucaa

SEQ ID NO: 2538243 - RNA, 22 nt, Human
ucccacccccacccccagcuca

SEQ ID NO: 2538244 - RNA, 20 nt, Human
ucccacccccacccccagcu

SEQ ID NO: 2538245 - RNA, 20 nt, Human
ucccacccccaucucucccu

SEQ ID NO: 2538246 - RNA, 17 nt, Human
ucccacccccuucucug

SEQ ID NO: 2538247 - RNA, 19 nt, Human
ucccacccccuucucugcu

SEQ ID NO: 2538248 - RNA, 14 nt, Human
acggggacugggga

SEQ ID NO: 2538249 - RNA, 12 nt, Human
acggggagaaaa

SEQ ID NO: 2538250 - RNA, 18 nt, Human
acggggccggccaggugg

SEQ ID NO: 2538251 - RNA, 15 nt, Human
acggggccggccagg

SEQ ID NO: 2538252 - RNA, 15 nt, Human
acggggcucuucuca

SEQ ID NO: 2538253 - RNA, 23 nt, Human
acggggaggccaagugcaggcug

SEQ ID NO: 2538254 - RNA, 14 nt, Human
acggggccggccag

SEQ ID NO: 2538255 - RNA, 14 nt, Human
acggggaggccaag

SEQ ID NO: 2538256 - RNA, 18 nt, Human
acgggugggcggcuggag

SEQ ID NO: 2538257 - RNA, 23 nt, Human
acggggggccccagucagccucu

SEQ ID NO: 2538258 - RNA, 18 nt, Human
acgguauuaugcuucuug

SEQ ID NO: 2538259 - RNA, 17 nt, Human
acgguauuaugcuucuu

SEQ ID NO: 2538260 - RNA, 14 nt, Human
acgguauuaugcuu

SEQ ID NO: 2538261 - RNA, 15 nt, Human
acggggggccccagu

SEQ ID NO: 2538262 - RNA, 14 nt, Human
acggggggccccag

SEQ ID NO: 2538263 - RNA, 18 nt, Human
acggggcucuucucauuu

SEQ ID NO: 2538264 - RNA, 22 nt, Human
acggggggccccagucagccuc

SEQ ID NO: 2538265 - RNA, 16 nt, Human
acggggggccccaguc

SEQ ID NO: 2538266 - RNA, 14 nt, Human
acgggguccuucaa

SEQ ID NO: 2538267 - RNA, 15 nt, Human
ucccacaggcagcuu

SEQ ID NO: 2538268 - RNA, 14 nt, Human
ucccacaggcagcu

SEQ ID NO: 2538269 - RNA, 17 nt, Human
ucccacaggcagcuuua

SEQ ID NO: 2538270 - RNA, 23 nt, Human
ucccacagugacucgggcuccug

SEQ ID NO: 2538271 - RNA, 22 nt, Human
ucccacaggcccuuccucucca

SEQ ID NO: 2538272 - RNA, 21 nt, Human
ucccacaggcccuuccucucc

SEQ ID NO: 2538273 - RNA, 17 nt, Human
ucccacaggcccuuccu

SEQ ID NO: 2538274 - RNA, 15 nt, Human
ucccacaggcccuuc

SEQ ID NO: 2538275 - RNA, 17 nt, Human
ucccacaggacauuucu

SEQ ID NO: 2538276 - RNA, 18 nt, Human
ucccacaggacauuucuc

SEQ ID NO: 2538277 - RNA, 21 nt, Human
ucccacaggacauuucucuaa

SEQ ID NO: 2538278 - RNA, 13 nt, Human
ucccacaggcagc

SEQ ID NO: 2538279 - RNA, 20 nt, Human
ucccaauuaggaaguguaac

SEQ ID NO: 2538280 - RNA, 14 nt, Human
ucccaauuaggaag

SEQ ID NO: 2538281 - RNA, 15 nt, Human
ucccaauuaggaagu

SEQ ID NO: 2538282 - RNA, 19 nt, Human
ucccaauuaggaaguguaa

SEQ ID NO: 2538283 - RNA, 15 nt, Human
ucccaauucacaucu

SEQ ID NO: 2538284 - RNA, 17 nt, Human
ucccaauuucagacucc

SEQ ID NO: 2538285 - RNA, 18 nt, Human
ucccaauuucagacuccc

SEQ ID NO: 2538286 - RNA, 23 nt, Human
ucccaauuucagacucccauucc

SEQ ID NO: 2538287 - RNA, 14 nt, Human
ucccacaaaggaga

SEQ ID NO: 2538288 - RNA, 12 nt, Human
uccauuugcaag

SEQ ID NO: 2538289 - RNA, 15 nt, Human
uccauuugcaaggga

SEQ ID NO: 2538290 - RNA, 14 nt, Human
uccauuugugugug

SEQ ID NO: 2538291 - RNA, 16 nt, Human
ucccaaagugcuggga

SEQ ID NO: 2538292 - RNA, 20 nt, Human
ucccaaagugcugggauuac

SEQ ID NO: 2538293 - RNA, 15 nt, Human
ucccaaagugcuggg

SEQ ID NO: 2538294 - RNA, 14 nt, Human
uccagugagacagc

SEQ ID NO: 2538295 - RNA, 17 nt, Human
uccagugaggcucugcc

SEQ ID NO: 2538296 - RNA, 19 nt, Human
uccagugaggcucugcccu

SEQ ID NO: 2538297 - RNA, 18 nt, Human
uccagugaggcucugccc

SEQ ID NO: 2538298 - RNA, 20 nt, Human
uccagugaggcucugcccuu

SEQ ID NO: 2538299 - RNA, 22 nt, Human
uccaucccuacccccuaagagc

SEQ ID NO: 2538300 - RNA, 18 nt, Human
uccaucccuacccccuaa

SEQ ID NO: 2538301 - RNA, 21 nt, Human
uccagucuuccugacacuuua

SEQ ID NO: 2538302 - RNA, 22 nt, Human
uccagucuuccugacacuuuaa

SEQ ID NO: 2538303 - RNA, 23 nt, Human
uccagucuuccugacacuuuaau

SEQ ID NO: 2538304 - RNA, 15 nt, Human
uccagucuuccugac

SEQ ID NO: 2538305 - RNA, 19 nt, Human
uccagucuuccugacacuu

SEQ ID NO: 2538306 - RNA, 20 nt, Human
uccagucugcugcccuccau

SEQ ID NO: 2538307 - RNA, 22 nt, Human
uccagucugcugcccuccaucc

SEQ ID NO: 2538308 - RNA, 15 nt, Human
acggcucacugcagc

SEQ ID NO: 2538309 - RNA, 15 nt, Human
uccagucugcugccc

SEQ ID NO: 2538310 - RNA, 16 nt, Human
uccagucugcugcccu

SEQ ID NO: 2538311 - RNA, 18 nt, Human
uccagucugcugcccucc

SEQ ID NO: 2538312 - RNA, 19 nt, Human
uccagucugcugcccucca

SEQ ID NO: 2538313 - RNA, 21 nt, Human
acggccuucaacugaaaagac

SEQ ID NO: 2538314 - RNA, 20 nt, Human
acggccugaugcucccuccc

SEQ ID NO: 2538315 - RNA, 22 nt, Human
acggccugaugcucccuccccu

SEQ ID NO: 2538316 - RNA, 14 nt, Human
acggcucacugcag

SEQ ID NO: 2538317 - RNA, 18 nt, Human
acggccgcuccaggggug

SEQ ID NO: 2538318 - RNA, 15 nt, Human
acggccgcuccaggg

SEQ ID NO: 2538319 - RNA, 15 nt, Human
acggccugaugcucc

SEQ ID NO: 2538320 - RNA, 18 nt, Human
acggccugaugcucccuc

SEQ ID NO: 2538321 - RNA, 19 nt, Human
acggccugaugcucccucc

SEQ ID NO: 2538322 - RNA, 14 nt, Human
acggccgcuccagg

SEQ ID NO: 2538323 - RNA, 17 nt, Human
uccaugaguccccuguu

SEQ ID NO: 2538324 - RNA, 16 nt, Human
uccaugaguccccugu

SEQ ID NO: 2538325 - RNA, 15 nt, Human
uccaugaguccccug

SEQ ID NO: 2538326 - RNA, 20 nt, Human
uccaugaccuaguuuuccau

SEQ ID NO: 2538327 - RNA, 21 nt, Human
uccauugacauguacagagaa

SEQ ID NO: 2538328 - RNA, 20 nt, Human
uccauugacauguacagaga

SEQ ID NO: 2538329 - RNA, 16 nt, Human
uccauuggaucucauu

SEQ ID NO: 2538330 - RNA, 15 nt, Human
uccaugagcacccca

SEQ ID NO: 2538331 - RNA, 13 nt, Human
uccaugagcaccc

SEQ ID NO: 2538332 - RNA, 19 nt, Human
uccaugagcaccccaaggc

SEQ ID NO: 2538333 - RNA, 19 nt, Human
uccauugacauguacagag

SEQ ID NO: 2538334 - RNA, 18 nt, Human
uccaugaguuugcccugg

SEQ ID NO: 2538335 - RNA, 19 nt, Human
uccauuguuuggagacauu

SEQ ID NO: 2538336 - RNA, 23 nt, Human
uccauuguuugaaacaaagaagg

SEQ ID NO: 2538337 - RNA, 23 nt, Human
uccauuguaaaccacaaggcugu

SEQ ID NO: 2538338 - RNA, 22 nt, Human
uccauugguuuaccugugaaau

SEQ ID NO: 2538339 - RNA, 21 nt, Human
uccauuguuugaaacaaagaa

SEQ ID NO: 2538340 - RNA, 20 nt, Human
uccauuguuugaaacaaaga

SEQ ID NO: 2538341 - RNA, 14 nt, Human
uccauuguuugaaa

SEQ ID NO: 2538342 - RNA, 14 nt, Human
uccauugugugagu

SEQ ID NO: 2538343 - RNA, 11 nt, Human
uccauccugag

SEQ ID NO: 2538344 - RNA, 20 nt, Human
uccaucucuuguuuaaauuc

SEQ ID NO: 2538345 - RNA, 15 nt, Human
uccaucuucuuugca

SEQ ID NO: 2538346 - RNA, 23 nt, Human
uccaucuucagcuucuucaucuu

SEQ ID NO: 2538347 - RNA, 16 nt, Human
uccaucuucagcuucu

SEQ ID NO: 2538348 - RNA, 14 nt, Human
uccaucuucagcuu

SEQ ID NO: 2538349 - RNA, 18 nt, Human
uccaucuuuccugauggc

SEQ ID NO: 2538350 - RNA, 16 nt, Human
uccaucuucuuugcag

SEQ ID NO: 2538351 - RNA, 13 nt, Human
uccaucuuuacaa

SEQ ID NO: 2538352 - RNA, 15 nt, Human
uccaucuggcagggu

SEQ ID NO: 2538353 - RNA, 21 nt, Human
uccaugaauguaucaggaaau

SEQ ID NO: 2538354 - RNA, 15 nt, Human
uccaugaauguauca

SEQ ID NO: 2538355 - RNA, 16 nt, Human
uccaugaauguaucag

SEQ ID NO: 2538356 - RNA, 19 nt, Human
uccaugaaucgcuucucuu

SEQ ID NO: 2538357 - RNA, 18 nt, Human
uccaugaaucgcuucucu

SEQ ID NO: 2538358 - RNA, 15 nt, Human
uccaugaaggcagag

SEQ ID NO: 2538359 - RNA, 20 nt, Human
uccaugaaucgcuucucuuu

SEQ ID NO: 2538360 - RNA, 12 nt, Human
uccaugaaugua

SEQ ID NO: 2538361 - RNA, 13 nt, Human
uccaugaauguau

SEQ ID NO: 2538362 - RNA, 14 nt, Human
uccaugaauguauc

SEQ ID NO: 2538363 - RNA, 22 nt, Human
uccaugaagauguagaggagaa

SEQ ID NO: 2538364 - RNA, 11 nt, Human
uccaugaaaac

SEQ ID NO: 2538365 - RNA, 15 nt, Human
uccaugaaaacguuu

SEQ ID NO: 2538366 - RNA, 18 nt, Human
uccaugaaaacguuuuau

SEQ ID NO: 2538367 - RNA, 19 nt, Human
uccaugaaaacguuuuauu

SEQ ID NO: 2538368 - RNA, 21 nt, Human
uccaugaaaacguuuuauugu

SEQ ID NO: 2538369 - RNA, 22 nt, Human
uccaugaaaacguuuuauugug

SEQ ID NO: 2538370 - RNA, 12 nt, Human
uccaugaaaaug

SEQ ID NO: 2538371 - RNA, 22 nt, Human
acggauuagggcauuugagaaa

SEQ ID NO: 2538372 - RNA, 22 nt, Human
acggaugccuuccccugggccc

SEQ ID NO: 2538373 - RNA, 21 nt, Human
acggagucccaccuuggcugc

SEQ ID NO: 2538374 - RNA, 21 nt, Human
acggauuauuuuuucagaccg

SEQ ID NO: 2538375 - RNA, 20 nt, Human
acggauuauuuuuucagacc

SEQ ID NO: 2538376 - RNA, 19 nt, Human
acggauuauuuuuucagac

SEQ ID NO: 2538377 - RNA, 18 nt, Human
acggauuauuuuuucaga

SEQ ID NO: 2538378 - RNA, 17 nt, Human
acggauuauuuuuucag

SEQ ID NO: 2538379 - RNA, 16 nt, Human
acggauuauuuuuuca

SEQ ID NO: 2538380 - RNA, 13 nt, Human
acggauuauuuuu

SEQ ID NO: 2538381 - RNA, 23 nt, Human
acggauuagggcauuugagaaau

SEQ ID NO: 2538382 - RNA, 15 nt, Human
acggauuuauuuuuc

SEQ ID NO: 2538383 - RNA, 12 nt, Human
acggauuccaaa

SEQ ID NO: 2538384 - RNA, 13 nt, Human
acggcacccaccc

SEQ ID NO: 2538385 - RNA, 16 nt, Human
acggccaggccagagg

SEQ ID NO: 2538386 - RNA, 21 nt, Human
acggcaggacaacgaggaagc

SEQ ID NO: 2538387 - RNA, 13 nt, Human
acggccaggccag

SEQ ID NO: 2538388 - RNA, 17 nt, Human
acggccagggagaagcu

SEQ ID NO: 2538389 - RNA, 23 nt, Human
acggccagggagaagcuccucuc

SEQ ID NO: 2538390 - RNA, 18 nt, Human
acggccagggagaagcuc

SEQ ID NO: 2538391 - RNA, 17 nt, Human
acgcucucuggccuucg

SEQ ID NO: 2538392 - RNA, 16 nt, Human
acgcugaauaaauguc

SEQ ID NO: 2538393 - RNA, 15 nt, Human
acgcugaauaaaugu

SEQ ID NO: 2538394 - RNA, 13 nt, Human
acgcugaauaaau

SEQ ID NO: 2538395 - RNA, 12 nt, Human
acgcugaauaaa

SEQ ID NO: 2538396 - RNA, 20 nt, Human
acgcuaaagagcccuugccu

SEQ ID NO: 2538397 - RNA, 18 nt, Human
acgcuaaagagcccuugc

SEQ ID NO: 2538398 - RNA, 21 nt, Human
acgcuaaagagcccuugccuc

SEQ ID NO: 2538399 - RNA, 12 nt, Human
acgcugccugcc

SEQ ID NO: 2538400 - RNA, 13 nt, Human
acgcugccugccc

SEQ ID NO: 2538401 - RNA, 15 nt, Human
acgcugccugcccac

SEQ ID NO: 2538402 - RNA, 14 nt, Human
acgcugccugcccg

SEQ ID NO: 2538403 - RNA, 19 nt, Human
acgcugaauaaaugucuuu

SEQ ID NO: 2538404 - RNA, 18 nt, Human
acgcugaauaaaugucuu

SEQ ID NO: 2538405 - RNA, 21 nt, Human
acggagccacuccucugacuc

SEQ ID NO: 2538406 - RNA, 20 nt, Human
acggagccacuccucugacu

SEQ ID NO: 2538407 - RNA, 15 nt, Human
acggagcccagcccu

SEQ ID NO: 2538408 - RNA, 20 nt, Human
acggagcccagcccucccca

SEQ ID NO: 2538409 - RNA, 21 nt, Human
acggagccccaggccucugug

SEQ ID NO: 2538410 - RNA, 18 nt, Human
acggagccccaggccucu

SEQ ID NO: 2538411 - RNA, 19 nt, Human
acggagucccaccuuggcu

SEQ ID NO: 2538412 - RNA, 17 nt, Human
acgcuacccgggaaggg

SEQ ID NO: 2538413 - RNA, 13 nt, Human
acgcuacccggga

SEQ ID NO: 2538414 - RNA, 15 nt, Human
acgcucucuggccuu

SEQ ID NO: 2538415 - RNA, 16 nt, Human
acgcucucuggccuuc

SEQ ID NO: 2538416 - RNA, 17 nt, Human
acgcuaaagagcccuug

SEQ ID NO: 2538417 - RNA, 16 nt, Human
acgcuaaagagcccuu

SEQ ID NO: 2538418 - RNA, 23 nt, Human
acgcguguguacacgggacugac

SEQ ID NO: 2538419 - RNA, 21 nt, Human
acgcguguguacacgggacug

SEQ ID NO: 2538420 - RNA, 18 nt, Human
acgcuacccgggaagggg

SEQ ID NO: 2538421 - RNA, 19 nt, Human
acgcccguccugccugugg

SEQ ID NO: 2538422 - RNA, 18 nt, Human
acgcccguccugccugug

SEQ ID NO: 2538423 - RNA, 16 nt, Human
acgcccguccugccug

SEQ ID NO: 2538424 - RNA, 14 nt, Human
acgcccccccccac

SEQ ID NO: 2538425 - RNA, 16 nt, Human
acgcccccccccaccc

SEQ ID NO: 2538426 - RNA, 15 nt, Human
acgcccuccccuccc

SEQ ID NO: 2538427 - RNA, 14 nt, Human
acgcccuccccucc

SEQ ID NO: 2538428 - RNA, 13 nt, Human
acgcccuccccuc

SEQ ID NO: 2538429 - RNA, 12 nt, Human
acgcccuccccu

SEQ ID NO: 2538430 - RNA, 20 nt, Human
acgcccguccugccuguggc

SEQ ID NO: 2538431 - RNA, 13 nt, Human
acgcccuauuuuu

SEQ ID NO: 2538432 - RNA, 23 nt, Human
acgcccccccccaccccuggggg

SEQ ID NO: 2538433 - RNA, 14 nt, Human
acgcccccacuggu

SEQ ID NO: 2538434 - RNA, 14 nt, Human
acgcccauguguga

SEQ ID NO: 2538435 - RNA, 21 nt, Human
acgccccagauaccagccccu

SEQ ID NO: 2538436 - RNA, 16 nt, Human
acgcccaugugugagu

SEQ ID NO: 2538437 - RNA, 23 nt, Human
acgccggggacagaggccugccc

SEQ ID NO: 2538438 - RNA, 22 nt, Human
acgccggggacagaggccugcc

SEQ ID NO: 2538439 - RNA, 21 nt, Human
acgccggggacagaggccugc

SEQ ID NO: 2538440 - RNA, 20 nt, Human
acgcgugcacacaccagagc

SEQ ID NO: 2538441 - RNA, 23 nt, Human
acgcgugcacacaccagagccca

SEQ ID NO: 2538442 - RNA, 22 nt, Human
acgcccuccccuccccugcugc

SEQ ID NO: 2538443 - RNA, 21 nt, Human
acgcccuccccuccccugcug

SEQ ID NO: 2538444 - RNA, 19 nt, Human
acgcccuccccuccccugc

SEQ ID NO: 2538445 - RNA, 18 nt, Human
acgcccuccccuccccug

SEQ ID NO: 2538446 - RNA, 20 nt, Human
acgccggggacagaggccug

SEQ ID NO: 2538447 - RNA, 23 nt, Human
acgcccuccccuccccugcugca

SEQ ID NO: 2538448 - RNA, 20 nt, Human
acgccgcccuaaaagcacac

SEQ ID NO: 2538449 - RNA, 13 nt, Human
acgaccuuuaccu

SEQ ID NO: 2538450 - RNA, 17 nt, Human
acgaccacagggucugc

SEQ ID NO: 2538451 - RNA, 12 nt, Human
acgacugucucc

SEQ ID NO: 2538452 - RNA, 14 nt, Human
acgacuucagggca

SEQ ID NO: 2538453 - RNA, 20 nt, Human
acgaggcccucgggcccagc

SEQ ID NO: 2538454 - RNA, 22 nt, Human
acgacuucagggcagggcucug

SEQ ID NO: 2538455 - RNA, 22 nt, Human
acgaggcccucgggcccagccc

SEQ ID NO: 2538456 - RNA, 21 nt, Human
acgaggcccucgggcccagcc

SEQ ID NO: 2538457 - RNA, 23 nt, Human
acgaggcccucgggcccagcccc

SEQ ID NO: 2538458 - RNA, 22 nt, Human
acgacaaagccaaacucugcca

SEQ ID NO: 2538459 - RNA, 19 nt, Human
acgacaaggaaaggcaaau

SEQ ID NO: 2538460 - RNA, 20 nt, Human
acgacaauagcuuuacccuc

SEQ ID NO: 2538461 - RNA, 15 nt, Human
acgacugcccggcag

SEQ ID NO: 2538462 - RNA, 16 nt, Human
acgaguaauuuauugu

SEQ ID NO: 2538463 - RNA, 17 nt, Human
acgagucaauccccuca

SEQ ID NO: 2538464 - RNA, 18 nt, Human
acgccaggggaaaaucag

SEQ ID NO: 2538465 - RNA, 20 nt, Human
acgaggggugucuugggcag

SEQ ID NO: 2538466 - RNA, 18 nt, Human
acgaggggugucuugggc

SEQ ID NO: 2538467 - RNA, 14 nt, Human
acgagguaugaggu

SEQ ID NO: 2538468 - RNA, 21 nt, Human
acgaggggugucuugggcaga

SEQ ID NO: 2538469 - RNA, 18 nt, Human
acgccaucccagccccaa

SEQ ID NO: 2538470 - RNA, 16 nt, Human
acgcccaacccuuccc

SEQ ID NO: 2538471 - RNA, 17 nt, Human
acgccaucccagcccca

SEQ ID NO: 2538472 - RNA, 16 nt, Human
acgccaucccagcccc

SEQ ID NO: 2538473 - RNA, 15 nt, Human
acgccaucccagccc

SEQ ID NO: 2538474 - RNA, 14 nt, Human
acgccaucccagcc

SEQ ID NO: 2538475 - RNA, 11 nt, Human
acgccauccca

SEQ ID NO: 2538476 - RNA, 23 nt, Human
acgccaggggaaaaucagccugc

SEQ ID NO: 2538477 - RNA, 17 nt, Human
uccaggcugggagagcc

SEQ ID NO: 2538478 - RNA, 14 nt, Human
uccaggcugggaga

SEQ ID NO: 2538479 - RNA, 18 nt, Human
uccaggcugggagagccu

SEQ ID NO: 2538480 - RNA, 16 nt, Human
uccaggcugccguggg

SEQ ID NO: 2538481 - RNA, 23 nt, Human
uccaggcucuuuggggucagcca

SEQ ID NO: 2538482 - RNA, 23 nt, Human
uccagggaagcuggccgaggguc

SEQ ID NO: 2538483 - RNA, 14 nt, Human
uccacggagccacu

SEQ ID NO: 2538484 - RNA, 15 nt, Human
uccacggagccacuc

SEQ ID NO: 2538485 - RNA, 20 nt, Human
uccacggagccacuccucug

SEQ ID NO: 2538486 - RNA, 21 nt, Human
uccacggagccacuccucuga

SEQ ID NO: 2538487 - RNA, 20 nt, Human
uccacggcucuagguggggc

SEQ ID NO: 2538488 - RNA, 22 nt, Human
uccaggcucuuuggggucagcc

SEQ ID NO: 2538489 - RNA, 14 nt, Human
uccacggcucuagg

SEQ ID NO: 2538490 - RNA, 22 nt, Human
uccacggagccacuccucugac

SEQ ID NO: 2538491 - RNA, 22 nt, Human
uccacgagcuguuuacuaggga

SEQ ID NO: 2538492 - RNA, 12 nt, Human
uccacgcugucu

SEQ ID NO: 2538493 - RNA, 15 nt, Human
uccacgcugucucca

SEQ ID NO: 2538494 - RNA, 16 nt, Human
uccacgcugucuccag

SEQ ID NO: 2538495 - RNA, 17 nt, Human
uccacgcugucuccaga

SEQ ID NO: 2538496 - RNA, 18 nt, Human
uccacgcugucuccagac

SEQ ID NO: 2538497 - RNA, 19 nt, Human
uccacgcugucuccagacc

SEQ ID NO: 2538498 - RNA, 20 nt, Human
uccacgcugucuccagaccc

SEQ ID NO: 2538499 - RNA, 21 nt, Human
uccacgcugucuccagacccc

SEQ ID NO: 2538500 - RNA, 22 nt, Human
uccacgcugucuccagaccccc

SEQ ID NO: 2538501 - RNA, 23 nt, Human
uccacgcugucuccagaccccca

SEQ ID NO: 2538502 - RNA, 14 nt, Human
acgaacuuccaugg

SEQ ID NO: 2538503 - RNA, 17 nt, Human
uccagggccacgugcca

SEQ ID NO: 2538504 - RNA, 18 nt, Human
uccagggaguccccuccc

SEQ ID NO: 2538505 - RNA, 20 nt, Human
uccagggaugccaucugugg

SEQ ID NO: 2538506 - RNA, 14 nt, Human
uccagggacugaag

SEQ ID NO: 2538507 - RNA, 19 nt, Human
uccagggagcauuuuccuc

SEQ ID NO: 2538508 - RNA, 14 nt, Human
uccagggacagagg

SEQ ID NO: 2538509 - RNA, 15 nt, Human
uccagggacagaggc

SEQ ID NO: 2538510 - RNA, 19 nt, Human
uccagggacagaggcccca

SEQ ID NO: 2538511 - RNA, 21 nt, Human
uccagggacagaggccccagc

SEQ ID NO: 2538512 - RNA, 23 nt, Human
uccagggacagaggccccagccu

SEQ ID NO: 2538513 - RNA, 14 nt, Human
acgaauauugcuga

SEQ ID NO: 2538514 - RNA, 14 nt, Human
acgacaaggaaagg

SEQ ID NO: 2538515 - RNA, 22 nt, Human
acgaauacuuuugcccuuugau

SEQ ID NO: 2538516 - RNA, 14 nt, Human
acgaauacuuuugc

SEQ ID NO: 2538517 - RNA, 14 nt, Human
acgaaguguugcau

SEQ ID NO: 2538518 - RNA, 17 nt, Human
acgaagggaaaugucuu

SEQ ID NO: 2538519 - RNA, 16 nt, Human
accugacacucccuug

SEQ ID NO: 2538520 - RNA, 17 nt, Human
accugacacucccuugg

SEQ ID NO: 2538521 - RNA, 16 nt, Human
accugacaagcacugc

SEQ ID NO: 2538522 - RNA, 23 nt, Human
accugaagaguggucagaacaga

SEQ ID NO: 2538523 - RNA, 22 nt, Human
accugacagaugucagccgagc

SEQ ID NO: 2538524 - RNA, 12 nt, Human
accugacagaug

SEQ ID NO: 2538525 - RNA, 19 nt, Human
accugacacucccuugggc

SEQ ID NO: 2538526 - RNA, 17 nt, Human
accugaccccugacccc

SEQ ID NO: 2538527 - RNA, 15 nt, Human
accugaccccugcuc

SEQ ID NO: 2538528 - RNA, 17 nt, Human
accugaccaacauggag

SEQ ID NO: 2538529 - RNA, 18 nt, Human
accugagcaggaccucug

SEQ ID NO: 2538530 - RNA, 16 nt, Human
accugagccagccugc

SEQ ID NO: 2538531 - RNA, 19 nt, Human
accugaccaacauggagaa

SEQ ID NO: 2538532 - RNA, 12 nt, Human
accugagcccca

SEQ ID NO: 2538533 - RNA, 17 nt, Human
accugagccccaaaagg

SEQ ID NO: 2538534 - RNA, 23 nt, Human
accugaggcccuucucuccagcc

SEQ ID NO: 2538535 - RNA, 21 nt, Human
accugagcccggaugcuucuc

SEQ ID NO: 2538536 - RNA, 23 nt, Human
accugagcccggaugcuucucca

SEQ ID NO: 2538537 - RNA, 19 nt, Human
accugaauuuuggcugugu

SEQ ID NO: 2538538 - RNA, 11 nt, Human
accugaagaau

SEQ ID NO: 2538539 - RNA, 14 nt, Human
accugaagaaucac

SEQ ID NO: 2538540 - RNA, 16 nt, Human
accugaagaaucacaa

SEQ ID NO: 2538541 - RNA, 18 nt, Human
accugaagacucauucuu

SEQ ID NO: 2538542 - RNA, 19 nt, Human
ucauaauaaauaucuguac

SEQ ID NO: 2538543 - RNA, 14 nt, Human
accugaaccuagga

SEQ ID NO: 2538544 - RNA, 16 nt, Human
ucauaauaaguugcau

SEQ ID NO: 2538545 - RNA, 12 nt, Human
ucauaaugacuu

SEQ ID NO: 2538546 - RNA, 14 nt, Human
ucauaaucuuugcu

SEQ ID NO: 2538547 - RNA, 15 nt, Human
ucauaaucuuugcuu

SEQ ID NO: 2538548 - RNA, 17 nt, Human
accugccucggccuccc

SEQ ID NO: 2538549 - RNA, 22 nt, Human
accugccucccuucaugcaugg

SEQ ID NO: 2538550 - RNA, 13 nt, Human
accugccuccugc

SEQ ID NO: 2538551 - RNA, 19 nt, Human
accugcaccuccccccacu

SEQ ID NO: 2538552 - RNA, 23 nt, Human
accugccucccuucaugcaugga

SEQ ID NO: 2538553 - RNA, 21 nt, Human
accugccucccuucaugcaug

SEQ ID NO: 2538554 - RNA, 17 nt, Human
accugcaccucccccca

SEQ ID NO: 2538555 - RNA, 18 nt, Human
accugcaccuccccccac

SEQ ID NO: 2538556 - RNA, 18 nt, Human
accugccaggaagccagc

SEQ ID NO: 2538557 - RNA, 13 nt, Human
accugccucagga

SEQ ID NO: 2538558 - RNA, 20 nt, Human
accugcaccuccccccacug

SEQ ID NO: 2538559 - RNA, 17 nt, Human
accugccaggaagccag

SEQ ID NO: 2538560 - RNA, 16 nt, Human
accugccaggaagcca

SEQ ID NO: 2538561 - RNA, 16 nt, Human
accugcaaagaucugu

SEQ ID NO: 2538562 - RNA, 22 nt, Human
accugcaaagaucuguccucag

SEQ ID NO: 2538563 - RNA, 15 nt, Human
accugcaaagaucug

SEQ ID NO: 2538564 - RNA, 15 nt, Human
accugcaaaaaauag

SEQ ID NO: 2538565 - RNA, 20 nt, Human
accugcaagggcuccccacu

SEQ ID NO: 2538566 - RNA, 18 nt, Human
accugcaagggcucccca

SEQ ID NO: 2538567 - RNA, 14 nt, Human
accugcaccucccc

SEQ ID NO: 2538568 - RNA, 15 nt, Human
accugcaccuccccc

SEQ ID NO: 2538569 - RNA, 16 nt, Human
accugcaccucccccc

SEQ ID NO: 2538570 - RNA, 16 nt, Human
accugaggcuccugug

SEQ ID NO: 2538571 - RNA, 12 nt, Human
accugaggcugu

SEQ ID NO: 2538572 - RNA, 19 nt, Human
accugaggcuccugugcua

SEQ ID NO: 2538573 - RNA, 14 nt, Human
accugaggggccuc

SEQ ID NO: 2538574 - RNA, 22 nt, Human
accugauccuggaggcccaguu

SEQ ID NO: 2538575 - RNA, 13 nt, Human
accugauccugga

SEQ ID NO: 2538576 - RNA, 20 nt, Human
accugauccuggaggcccag

SEQ ID NO: 2538577 - RNA, 23 nt, Human
accugagggcagaaagguucugc

SEQ ID NO: 2538578 - RNA, 14 nt, Human
accugaggcugugg

SEQ ID NO: 2538579 - RNA, 16 nt, Human
accugaggggccucuu

SEQ ID NO: 2538580 - RNA, 16 nt, Human
accugauuuuuuuucc

SEQ ID NO: 2538581 - RNA, 17 nt, Human
accugauuuuuuuuccu

SEQ ID NO: 2538582 - RNA, 13 nt, Human
accugcaaaaaau

SEQ ID NO: 2538583 - RNA, 20 nt, Human
accugauuuuuuuuccuuuu

SEQ ID NO: 2538584 - RNA, 11 nt, Human
accugauuuuu

SEQ ID NO: 2538585 - RNA, 19 nt, Human
accugauucaacuaaaaaa

SEQ ID NO: 2538586 - RNA, 21 nt, Human
accugauggcacuuagcuauc

SEQ ID NO: 2538587 - RNA, 13 nt, Human
accugauguguac

SEQ ID NO: 2538588 - RNA, 11 nt, Human
accugauucaa

SEQ ID NO: 2538589 - RNA, 21 nt, Human
accugauguuaaaauuccauc

SEQ ID NO: 2538590 - RNA, 22 nt, Human
accugauguguacaucccaugu

SEQ ID NO: 2538591 - RNA, 15 nt, Human
accugauguguacau

SEQ ID NO: 2538592 - RNA, 20 nt, Human
accuggagagcuagaaccug

SEQ ID NO: 2538593 - RNA, 21 nt, Human
accuggagagcuagaaccuag

SEQ ID NO: 2538594 - RNA, 13 nt, Human
accuggagagcua

SEQ ID NO: 2538595 - RNA, 23 nt, Human
accuggagagccagaaccuggag

SEQ ID NO: 2538596 - RNA, 22 nt, Human
accuggagagccagaaccugga

SEQ ID NO: 2538597 - RNA, 20 nt, Human
accuggagagccagaaccug

SEQ ID NO: 2538598 - RNA, 13 nt, Human
accuggagaccag

SEQ ID NO: 2538599 - RNA, 23 nt, Human
accuggagaacuagaaccuggag

SEQ ID NO: 2538600 - RNA, 23 nt, Human
accuggagagcuagaaccuggag

SEQ ID NO: 2538601 - RNA, 22 nt, Human
accuggagagcuagaaccugga

SEQ ID NO: 2538602 - RNA, 14 nt, Human
accuggagccccug

SEQ ID NO: 2538603 - RNA, 16 nt, Human
accuggagccccuggg

SEQ ID NO: 2538604 - RNA, 15 nt, Human
accuggagccccugg

SEQ ID NO: 2538605 - RNA, 14 nt, Human
ucauuugucacaca

SEQ ID NO: 2538606 - RNA, 13 nt, Human
ucauuugcuuuuu

SEQ ID NO: 2538607 - RNA, 18 nt, Human
ucauuugguucauuaauu

SEQ ID NO: 2538608 - RNA, 23 nt, Human
ucauuugggguagcuagaggaac

SEQ ID NO: 2538609 - RNA, 14 nt, Human
ucauuuucugcaag

SEQ ID NO: 2538610 - RNA, 13 nt, Human
ucauuuucugcaa

SEQ ID NO: 2538611 - RNA, 21 nt, Human
ucauuuucuuaucuucugcaa

SEQ ID NO: 2538612 - RNA, 18 nt, Human
ucauuuucugcaagccug

SEQ ID NO: 2538613 - RNA, 16 nt, Human
ucauuuucugcaagcc

SEQ ID NO: 2538614 - RNA, 15 nt, Human
ucauuuugagcugaa

SEQ ID NO: 2538615 - RNA, 14 nt, Human
ucauuuugcauuca

SEQ ID NO: 2538616 - RNA, 15 nt, Human
ucauuuucugcauuu

SEQ ID NO: 2538617 - RNA, 20 nt, Human
ucauuugguucauuaauucu

SEQ ID NO: 2538618 - RNA, 16 nt, Human
ucauuugucacacacu

SEQ ID NO: 2538619 - RNA, 19 nt, Human
uccaaaaagauuuucagaa

SEQ ID NO: 2538620 - RNA, 15 nt, Human
ucauuuuuguacagu

SEQ ID NO: 2538621 - RNA, 12 nt, Human
ucauuuuuguac

SEQ ID NO: 2538622 - RNA, 17 nt, Human
ucauuuuuuuuaagaaa

SEQ ID NO: 2538623 - RNA, 18 nt, Human
ucauuuuuuuuaagaaaa

SEQ ID NO: 2538624 - RNA, 14 nt, Human
ucauuuuugaauac

SEQ ID NO: 2538625 - RNA, 22 nt, Human
ucauuuuuccuucccuucucca

SEQ ID NO: 2538626 - RNA, 19 nt, Human
ucauuuuuaaucaugaaau

SEQ ID NO: 2538627 - RNA, 18 nt, Human
ucauuuuuaaucaugaaa

SEQ ID NO: 2538628 - RNA, 19 nt, Human
ucauuuuuaguagagacag

SEQ ID NO: 2538629 - RNA, 17 nt, Human
ucauuuugcauucaaau

SEQ ID NO: 2538630 - RNA, 16 nt, Human
ucauuuugcauucaaa

SEQ ID NO: 2538631 - RNA, 22 nt, Human
ucauuuugguaaaauacuucuu

SEQ ID NO: 2538632 - RNA, 16 nt, Human
ucauuuuuaaucauga

SEQ ID NO: 2538633 - RNA, 21 nt, Human
ucauuuuguugcuuuugugaa

SEQ ID NO: 2538634 - RNA, 12 nt, Human
ucauuuuuaauc

SEQ ID NO: 2538635 - RNA, 21 nt, Human
accugccugacauuuggagug

SEQ ID NO: 2538636 - RNA, 17 nt, Human
accugccuccugccugc

SEQ ID NO: 2538637 - RNA, 14 nt, Human
accugccuccugcc

SEQ ID NO: 2538638 - RNA, 21 nt, Human
accugccucggccucccaaag

SEQ ID NO: 2538639 - RNA, 23 nt, Human
accugccucggccucccaaagug

SEQ ID NO: 2538640 - RNA, 23 nt, Human
accugccuguugggccaggagcc

SEQ ID NO: 2538641 - RNA, 13 nt, Human
accugccuggguu

SEQ ID NO: 2538642 - RNA, 18 nt, Human
accugccuccugccugcc

SEQ ID NO: 2538643 - RNA, 11 nt, Human
accugccugua

SEQ ID NO: 2538644 - RNA, 14 nt, Human
accugccuguagcc

SEQ ID NO: 2538645 - RNA, 17 nt, Human
accugcucccaggccag

SEQ ID NO: 2538646 - RNA, 13 nt, Human
accugcucccagg

SEQ ID NO: 2538647 - RNA, 21 nt, Human
accugcuagacacauuuuuaa

SEQ ID NO: 2538648 - RNA, 22 nt, Human
accugcggcugcugugugccuu

SEQ ID NO: 2538649 - RNA, 16 nt, Human
accugcggcugcugug

SEQ ID NO: 2538650 - RNA, 16 nt, Human
accugcggugcuaucu

SEQ ID NO: 2538651 - RNA, 21 nt, Human
accugcgucucauacucaccu

SEQ ID NO: 2538652 - RNA, 12 nt, Human
accugcucuccu

SEQ ID NO: 2538653 - RNA, 18 nt, Human
accugcugagggaccagc

SEQ ID NO: 2538654 - RNA, 13 nt, Human
accugcuggcccc

SEQ ID NO: 2538655 - RNA, 19 nt, Human
accugcugagggaccagcc

SEQ ID NO: 2538656 - RNA, 20 nt, Human
accugcugagggaccagcca

SEQ ID NO: 2538657 - RNA, 23 nt, Human
accugcugagggaccagccaaga

SEQ ID NO: 2538658 - RNA, 14 nt, Human
accugcuggccccu

SEQ ID NO: 2538659 - RNA, 15 nt, Human
accugcuggccccuc

SEQ ID NO: 2538660 - RNA, 16 nt, Human
accugcuggccccuca

SEQ ID NO: 2538661 - RNA, 17 nt, Human
accugcuggccccucac

SEQ ID NO: 2538662 - RNA, 19 nt, Human
accugcuggccccucaccu

SEQ ID NO: 2538663 - RNA, 17 nt, Human
accugcuggguaaacug

SEQ ID NO: 2538664 - RNA, 21 nt, Human
accugcuggccccucaccugg

SEQ ID NO: 2538665 - RNA, 20 nt, Human
accuggaauauauaaccagu

SEQ ID NO: 2538666 - RNA, 19 nt, Human
accugcuucaugcucagcc

SEQ ID NO: 2538667 - RNA, 23 nt, Human
accugcuucaugcucagcccuga

SEQ ID NO: 2538668 - RNA, 21 nt, Human
accugcuucaugcucagcccu

SEQ ID NO: 2538669 - RNA, 21 nt, Human
accugcuuggguggagaagcc

SEQ ID NO: 2538670 - RNA, 18 nt, Human
accugcuuggguggagaa

SEQ ID NO: 2538671 - RNA, 19 nt, Human
accuggaauuguggggcaa

SEQ ID NO: 2538672 - RNA, 20 nt, Human
accugcuuggguggagaagc

SEQ ID NO: 2538673 - RNA, 23 nt, Human
uccaagggcuucugcacccucca

SEQ ID NO: 2538674 - RNA, 16 nt, Human
uccaauuaaggauuuu

SEQ ID NO: 2538675 - RNA, 17 nt, Human
uccaauuaaggauuuua

SEQ ID NO: 2538676 - RNA, 17 nt, Human
uccaauguuuagcaaau

SEQ ID NO: 2538677 - RNA, 19 nt, Human
uccaauguuuagcaaauac

SEQ ID NO: 2538678 - RNA, 15 nt, Human
uccaauuaaggauuu

SEQ ID NO: 2538679 - RNA, 18 nt, Human
uccaauguggcaaggaaa

SEQ ID NO: 2538680 - RNA, 21 nt, Human
uccaaugucuuuuuaagcuua

SEQ ID NO: 2538681 - RNA, 22 nt, Human
uccacauaaggaaacuggguuc

SEQ ID NO: 2538682 - RNA, 19 nt, Human
uccaauuccuugcacauag

SEQ ID NO: 2538683 - RNA, 14 nt, Human
uccacaucccggga

SEQ ID NO: 2538684 - RNA, 12 nt, Human
uccacauccucc

SEQ ID NO: 2538685 - RNA, 13 nt, Human
uccacauccucca

SEQ ID NO: 2538686 - RNA, 18 nt, Human
uccacaucugccuuaaaa

SEQ ID NO: 2538687 - RNA, 15 nt, Human
uccacaucugccuua

SEQ ID NO: 2538688 - RNA, 14 nt, Human
uccacaucugccuu

SEQ ID NO: 2538689 - RNA, 15 nt, Human
uccacauuguuuuaa

SEQ ID NO: 2538690 - RNA, 14 nt, Human
uccacauuguuuua

SEQ ID NO: 2538691 - RNA, 15 nt, Human
uccacaugggagccg

SEQ ID NO: 2538692 - RNA, 13 nt, Human
uccacaucugccu

SEQ ID NO: 2538693 - RNA, 12 nt, Human
uccacaucugcc

SEQ ID NO: 2538694 - RNA, 21 nt, Human
uccacaucuacguuuuuggug

SEQ ID NO: 2538695 - RNA, 19 nt, Human
uccacaucuacguuuuugg

SEQ ID NO: 2538696 - RNA, 19 nt, Human
uccacauccuccacguucu

SEQ ID NO: 2538697 - RNA, 22 nt, Human
uccacauccuuucuaaacaaga

SEQ ID NO: 2538698 - RNA, 15 nt, Human
uccaaaaaaauacug

SEQ ID NO: 2538699 - RNA, 14 nt, Human
uccaaaaaaauacu

SEQ ID NO: 2538700 - RNA, 13 nt, Human
uccaaaaaaauac

SEQ ID NO: 2538701 - RNA, 18 nt, Human
uccaaauggcgucuggaa

SEQ ID NO: 2538702 - RNA, 20 nt, Human
uccaaauggcgucuggaagu

SEQ ID NO: 2538703 - RNA, 20 nt, Human
uccaaaaagauuuucagaaa

SEQ ID NO: 2538704 - RNA, 19 nt, Human
uccaaaugcagcuuuaaaa

SEQ ID NO: 2538705 - RNA, 13 nt, Human
uccaaauucacaa

SEQ ID NO: 2538706 - RNA, 17 nt, Human
uccaaauguccuccaga

SEQ ID NO: 2538707 - RNA, 19 nt, Human
uccaaauguccuccagaag

SEQ ID NO: 2538708 - RNA, 20 nt, Human
uccaaauguccuccagaagc

SEQ ID NO: 2538709 - RNA, 22 nt, Human
uccaaauguccuccagaagccu

SEQ ID NO: 2538710 - RNA, 23 nt, Human
uccaaggaaaccacagcugcugg

SEQ ID NO: 2538711 - RNA, 22 nt, Human
uccaacaaaggguuuuaaugua

SEQ ID NO: 2538712 - RNA, 18 nt, Human
uccaacaaaggguuuuaa

SEQ ID NO: 2538713 - RNA, 15 nt, Human
uccaaggagaaacag

SEQ ID NO: 2538714 - RNA, 21 nt, Human
uccaaggaaaccacagcugcu

SEQ ID NO: 2538715 - RNA, 16 nt, Human
uccaaggagaaacaga

SEQ ID NO: 2538716 - RNA, 19 nt, Human
uccaaggagaaacagagac

SEQ ID NO: 2538717 - RNA, 20 nt, Human
uccaaggagaaacagagaca

SEQ ID NO: 2538718 - RNA, 22 nt, Human
uccaaggagaaacagagacagg

SEQ ID NO: 2538719 - RNA, 22 nt, Human
uccaagggcuucugcacccucc

SEQ ID NO: 2538720 - RNA, 21 nt, Human
uccaagggcuucugcacccuc

SEQ ID NO: 2538721 - RNA, 21 nt, Human
uccaaggggaaucagaacuca

SEQ ID NO: 2538722 - RNA, 19 nt, Human
uccaagggcuucugcaccc

SEQ ID NO: 2538723 - RNA, 16 nt, Human
uccaagggcuucugca

SEQ ID NO: 2538724 - RNA, 23 nt, Human
uccaaggcagaagcagcagggga

SEQ ID NO: 2538725 - RNA, 20 nt, Human
uccaaggaggggcuguaaaa

SEQ ID NO: 2538726 - RNA, 16 nt, Human
uccaaggcagaagcag

SEQ ID NO: 2538727 - RNA, 21 nt, Human
uccaaggaguuccaugaagac

SEQ ID NO: 2538728 - RNA, 12 nt, Human
uccaaggaguuc

SEQ ID NO: 2538729 - RNA, 23 nt, Human
uccaaggagaaacagagacaggc

SEQ ID NO: 2538730 - RNA, 20 nt, Human
uccacccaggagccccgagg

SEQ ID NO: 2538731 - RNA, 23 nt, Human
uccaccaugggguccuaccaaua

SEQ ID NO: 2538732 - RNA, 17 nt, Human
uccacauuguuuuaaaa

SEQ ID NO: 2538733 - RNA, 16 nt, Human
uccacauuguuuuaaa

SEQ ID NO: 2538734 - RNA, 21 nt, Human
uccaccaugggguccuaccaa

SEQ ID NO: 2538735 - RNA, 22 nt, Human
uccacccauccuaccaaugcau

SEQ ID NO: 2538736 - RNA, 20 nt, Human
uccaccccagugcacccacu

SEQ ID NO: 2538737 - RNA, 23 nt, Human
uccaccccagugcacccacucug

SEQ ID NO: 2538738 - RNA, 20 nt, Human
uccaccccaucccuccccag

SEQ ID NO: 2538739 - RNA, 12 nt, Human
uccaccccaucc

SEQ ID NO: 2538740 - RNA, 22 nt, Human
uccaccccaucccuccccaguu

SEQ ID NO: 2538741 - RNA, 20 nt, Human
accuggccaccugagguggg

SEQ ID NO: 2538742 - RNA, 18 nt, Human
accuggccaccugaggug

SEQ ID NO: 2538743 - RNA, 17 nt, Human
uccacccaggagccccg

SEQ ID NO: 2538744 - RNA, 13 nt, Human
uccacccaccuca

SEQ ID NO: 2538745 - RNA, 18 nt, Human
uccaccaucaagccacca

SEQ ID NO: 2538746 - RNA, 12 nt, Human
uccacccaccuc

SEQ ID NO: 2538747 - RNA, 13 nt, Human
accuggccucugc

SEQ ID NO: 2538748 - RNA, 12 nt, Human
accuggccucug

SEQ ID NO: 2538749 - RNA, 23 nt, Human
accuggccccaugucucucagaa

SEQ ID NO: 2538750 - RNA, 21 nt, Human
accuggccaccugaggugggc

SEQ ID NO: 2538751 - RNA, 21 nt, Human
accuggccccaugucucucag

SEQ ID NO: 2538752 - RNA, 15 nt, Human
accugggcauaucca

SEQ ID NO: 2538753 - RNA, 21 nt, Human
accugggcauacuaauaaagu

SEQ ID NO: 2538754 - RNA, 14 nt, Human
accugggcaccugg

SEQ ID NO: 2538755 - RNA, 18 nt, Human
accugggcaccuggggag

SEQ ID NO: 2538756 - RNA, 19 nt, Human
accugggcaccuggggagu

SEQ ID NO: 2538757 - RNA, 18 nt, Human
accugggauucaggaaug

SEQ ID NO: 2538758 - RNA, 13 nt, Human
accugggcaccug

SEQ ID NO: 2538759 - RNA, 16 nt, Human
accuggcugccauacu

SEQ ID NO: 2538760 - RNA, 23 nt, Human
accuggcugagguuccucugccu

SEQ ID NO: 2538761 - RNA, 20 nt, Human
accuggcuuuucuuucuacc

SEQ ID NO: 2538762 - RNA, 22 nt, Human
accugggaggcggauguugaag

SEQ ID NO: 2538763 - RNA, 13 nt, Human
accugggaagggg

SEQ ID NO: 2538764 - RNA, 14 nt, Human
accuuuuuuauaca

SEQ ID NO: 2538765 - RNA, 16 nt, Human
accuuuguccccaccg

SEQ ID NO: 2538766 - RNA, 15 nt, Human
accuuuguccccacc

SEQ ID NO: 2538767 - RNA, 14 nt, Human
accuuuguccccac

SEQ ID NO: 2538768 - RNA, 16 nt, Human
accuuuuuuauacaua

SEQ ID NO: 2538769 - RNA, 17 nt, Human
accuuuuuuauacauaa

SEQ ID NO: 2538770 - RNA, 18 nt, Human
accuuuuuuauacauaaa

SEQ ID NO: 2538771 - RNA, 21 nt, Human
accuugccugaacauccuucc

SEQ ID NO: 2538772 - RNA, 18 nt, Human
accuugccugaacauccu

SEQ ID NO: 2538773 - RNA, 24 nt, Human
accuugccugaacauccuuccuuc

SEQ ID NO: 2538774 - RNA, 23 nt, Human
accuugccugaacauccuuccuu

SEQ ID NO: 2538775 - RNA, 13 nt, Human
accuuugucccca

SEQ ID NO: 2538776 - RNA, 19 nt, Human
accuugcaucucauugcuc

SEQ ID NO: 2538777 - RNA, 15 nt, Human
accuugcaacuucau

SEQ ID NO: 2538778 - RNA, 17 nt, Human
accuugcaacacacaga

SEQ ID NO: 2538779 - RNA, 19 nt, Human
accuugcaacacacagaca

SEQ ID NO: 2538780 - RNA, 16 nt, Human
accuugacagggcaca

SEQ ID NO: 2538781 - RNA, 11 nt, Human
accuucuguag

SEQ ID NO: 2538782 - RNA, 22 nt, Human
accuugaggaggggcagguaaa

SEQ ID NO: 2538783 - RNA, 15 nt, Human
accuugagacagcuu

SEQ ID NO: 2538784 - RNA, 19 nt, Human
accuugaggagucuugugu

SEQ ID NO: 2538785 - RNA, 11 nt, Human
accuugagguc

SEQ ID NO: 2538786 - RNA, 15 nt, Human
accuugcaacacaca

SEQ ID NO: 2538787 - RNA, 16 nt, Human
accuugcaacacacag

SEQ ID NO: 2538788 - RNA, 22 nt, Human
accuugaggucuuuugacaugu

SEQ ID NO: 2538789 - RNA, 22 nt, Human
accuucuccuucaccuuugucc

SEQ ID NO: 2538790 - RNA, 22 nt, Human
accuucguuuacuaugccugug

SEQ ID NO: 2538791 - RNA, 23 nt, Human
accuucguuuacuaugccugugu

SEQ ID NO: 2538792 - RNA, 14 nt, Human
accuucuccuucac

SEQ ID NO: 2538793 - RNA, 23 nt, Human
accuucucuggagccaaguccag

SEQ ID NO: 2538794 - RNA, 22 nt, Human
accuucucuggagccaagucca

SEQ ID NO: 2538795 - RNA, 17 nt, Human
accuucucuggagccaa

SEQ ID NO: 2538796 - RNA, 15 nt, Human
accuucucuggagcc

SEQ ID NO: 2538797 - RNA, 22 nt, Human
accuucuaggacgccacccagc

SEQ ID NO: 2538798 - RNA, 12 nt, Human
accuucucugga

SEQ ID NO: 2538799 - RNA, 19 nt, Human
accuucuggcuuccuucuc

SEQ ID NO: 2538800 - RNA, 22 nt, Human
accuucuggccucccacagacu

SEQ ID NO: 2538801 - RNA, 18 nt, Human
accuucuggccucccaca

SEQ ID NO: 2538802 - RNA, 21 nt, Human
accuucguuuacuaugccugu

SEQ ID NO: 2538803 - RNA, 18 nt, Human
accuucgggcugugcccg

SEQ ID NO: 2538804 - RNA, 16 nt, Human
accuucgggcugugcc

SEQ ID NO: 2538805 - RNA, 17 nt, Human
accuucgggcugugccc

SEQ ID NO: 2538806 - RNA, 14 nt, Human
accuucgggcugug

SEQ ID NO: 2538807 - RNA, 15 nt, Human
accuucgggcugugc

SEQ ID NO: 2538808 - RNA, 15 nt, Human
accuucgccaccugg

SEQ ID NO: 2538809 - RNA, 17 nt, Human
accuucgccaccugggu

SEQ ID NO: 2538810 - RNA, 11 nt, Human
accuuccugcc

SEQ ID NO: 2538811 - RNA, 16 nt, Human
accuuccucgcagaga

SEQ ID NO: 2538812 - RNA, 17 nt, Human
accuuccucgcagagag

SEQ ID NO: 2538813 - RNA, 17 nt, Human
accuuccucacuuccau

SEQ ID NO: 2538814 - RNA, 16 nt, Human
accuuccucacuucca

SEQ ID NO: 2538815 - RNA, 15 nt, Human
accuuccucgcagag

SEQ ID NO: 2538816 - RNA, 13 nt, Human
accuuccucgcag

SEQ ID NO: 2538817 - RNA, 24 nt, Human
accuuccuucccugggcugugcua

SEQ ID NO: 2538818 - RNA, 18 nt, Human
accuuccugccaccaguc

SEQ ID NO: 2538819 - RNA, 22 nt, Human
accuuccuucccugggcugugc

SEQ ID NO: 2538820 - RNA, 19 nt, Human
accuuccuucccugggcug

SEQ ID NO: 2538821 - RNA, 12 nt, Human
accuuccucacu

SEQ ID NO: 2538822 - RNA, 19 nt, Human
accuucccucucaccaucc

SEQ ID NO: 2538823 - RNA, 17 nt, Human
accuucccaugcccugg

SEQ ID NO: 2538824 - RNA, 16 nt, Human
accuuccaagagccug

SEQ ID NO: 2538825 - RNA, 13 nt, Human
accuucccagcuc

SEQ ID NO: 2538826 - RNA, 17 nt, Human
accuucccagcucuccc

SEQ ID NO: 2538827 - RNA, 18 nt, Human
accuucccagcucucccu

SEQ ID NO: 2538828 - RNA, 19 nt, Human
accuucccagcucucccuc

SEQ ID NO: 2538829 - RNA, 18 nt, Human
accuggggcugcuggccu

SEQ ID NO: 2538830 - RNA, 15 nt, Human
accuggggcugcugg

SEQ ID NO: 2538831 - RNA, 20 nt, Human
accuggggcugcuggccuga

SEQ ID NO: 2538832 - RNA, 13 nt, Human
accuggggagugg

SEQ ID NO: 2538833 - RNA, 15 nt, Human
accuggggaguggga

SEQ ID NO: 2538834 - RNA, 14 nt, Human
accuggggcugcug

SEQ ID NO: 2538835 - RNA, 19 nt, Human
accuggggcagucaccugc

SEQ ID NO: 2538836 - RNA, 14 nt, Human
accuggggagccag

SEQ ID NO: 2538837 - RNA, 24 nt, Human
accuggggagugggacagagucug

SEQ ID NO: 2538838 - RNA, 21 nt, Human
accuggguaacuagggaagau

SEQ ID NO: 2538839 - RNA, 22 nt, Human
accuggggggcaguggugugga

SEQ ID NO: 2538840 - RNA, 18 nt, Human
accuggggugugggaggc

SEQ ID NO: 2538841 - RNA, 21 nt, Human
accuggggugugggaggcccg

SEQ ID NO: 2538842 - RNA, 17 nt, Human
accuucaauuccugggc

SEQ ID NO: 2538843 - RNA, 17 nt, Human
accuucagacuuugcuu

SEQ ID NO: 2538844 - RNA, 18 nt, Human
accuucaauuccugggcc

SEQ ID NO: 2538845 - RNA, 19 nt, Human
accuggguaaaugcagcgu

SEQ ID NO: 2538846 - RNA, 21 nt, Human
accuucauuucaggagggauu

SEQ ID NO: 2538847 - RNA, 15 nt, Human
accuuccaagagccu

SEQ ID NO: 2538848 - RNA, 18 nt, Human
accuucauuucaggaggg

SEQ ID NO: 2538849 - RNA, 19 nt, Human
accuucaguuaugauuuuu

SEQ ID NO: 2538850 - RNA, 22 nt, Human
ucacagaaucauaugauucugc

SEQ ID NO: 2538851 - RNA, 14 nt, Human
ucacagaccuggag

SEQ ID NO: 2538852 - RNA, 15 nt, Human
ucaauuuaaauaacc

SEQ ID NO: 2538853 - RNA, 11 nt, Human
ucacagaagaa

SEQ ID NO: 2538854 - RNA, 23 nt, Human
ucacagaaaugagaucaggcucu

SEQ ID NO: 2538855 - RNA, 12 nt, Human
ucacagaagaau

SEQ ID NO: 2538856 - RNA, 16 nt, Human
ucacagaccuuugaac

SEQ ID NO: 2538857 - RNA, 19 nt, Human
ucacagaccuggagccccu

SEQ ID NO: 2538858 - RNA, 18 nt, Human
ucacagaccuggagcccc

SEQ ID NO: 2538859 - RNA, 17 nt, Human
ucacagaccuggagccc

SEQ ID NO: 2538860 - RNA, 15 nt, Human
ucacagaccuggagc

SEQ ID NO: 2538861 - RNA, 22 nt, Human
ucacagaccuggagccccuggg

SEQ ID NO: 2538862 - RNA, 20 nt, Human
ucacagaccuggagccccug

SEQ ID NO: 2538863 - RNA, 21 nt, Human
ucacagagacauuccuccgag

SEQ ID NO: 2538864 - RNA, 12 nt, Human
ucaauuuaaaaa

SEQ ID NO: 2538865 - RNA, 12 nt, Human
accacacccagc

SEQ ID NO: 2538866 - RNA, 13 nt, Human
accacacccagcc

SEQ ID NO: 2538867 - RNA, 13 nt, Human
ucaauuuaaaaaa

SEQ ID NO: 2538868 - RNA, 23 nt, Human
ucaauuuaaacccauuuuaguca

SEQ ID NO: 2538869 - RNA, 21 nt, Human
ucaauuuaaacccauuuuagu

SEQ ID NO: 2538870 - RNA, 19 nt, Human
ucaauuuaaacccauuuua

SEQ ID NO: 2538871 - RNA, 14 nt, Human
ucaauuuaaaccca

SEQ ID NO: 2538872 - RNA, 21 nt, Human
ucacagaacccuuggagccaa

SEQ ID NO: 2538873 - RNA, 18 nt, Human
ucacagagugugcuggag

SEQ ID NO: 2538874 - RNA, 15 nt, Human
ucacagagugugcug

SEQ ID NO: 2538875 - RNA, 14 nt, Human
ucacagagugugcu

SEQ ID NO: 2538876 - RNA, 23 nt, Human
ucacagagacauuccuccgagcc

SEQ ID NO: 2538877 - RNA, 19 nt, Human
ucacagagugugcuggagg

SEQ ID NO: 2538878 - RNA, 16 nt, Human
ucacagccaccccuga

SEQ ID NO: 2538879 - RNA, 15 nt, Human
ucacagaugggugcu

SEQ ID NO: 2538880 - RNA, 14 nt, Human
ucacagaugggugc

SEQ ID NO: 2538881 - RNA, 22 nt, Human
ucacagagacauuccuccgagc

SEQ ID NO: 2538882 - RNA, 23 nt, Human
ucacagaccuggagccccugggu

SEQ ID NO: 2538883 - RNA, 12 nt, Human
ucacagaggcuu

SEQ ID NO: 2538884 - RNA, 17 nt, Human
ucacagaggcuucuuca

SEQ ID NO: 2538885 - RNA, 17 nt, Human
ucacagccagacuggca

SEQ ID NO: 2538886 - RNA, 23 nt, Human
ucacagccagacuggcacaguuu

SEQ ID NO: 2538887 - RNA, 20 nt, Human
ucacagccucaagucacucc

SEQ ID NO: 2538888 - RNA, 23 nt, Human
ucacagcccugcuuaccagauaa

SEQ ID NO: 2538889 - RNA, 16 nt, Human
ucacagccacuuggga

SEQ ID NO: 2538890 - RNA, 18 nt, Human
ucacauauugauuuccgu

SEQ ID NO: 2538891 - RNA, 20 nt, Human
ucacauauugauuuccguua

SEQ ID NO: 2538892 - RNA, 17 nt, Human
ucacagcuuguauuuug

SEQ ID NO: 2538893 - RNA, 13 nt, Human
ucacagcugcuuu

SEQ ID NO: 2538894 - RNA, 13 nt, Human
ucacaucacagga

SEQ ID NO: 2538895 - RNA, 16 nt, Human
ucacauauugauuucc

SEQ ID NO: 2538896 - RNA, 19 nt, Human
ucacagcuucagccaggag

SEQ ID NO: 2538897 - RNA, 17 nt, Human
ucacagcuucagccagg

SEQ ID NO: 2538898 - RNA, 11 nt, Human
ucacagcugcu

SEQ ID NO: 2538899 - RNA, 16 nt, Human
ucacagcuccucccac

SEQ ID NO: 2538900 - RNA, 14 nt, Human
ucacagcuccuccc

SEQ ID NO: 2538901 - RNA, 11 nt, Human
ucacagcuccu

SEQ ID NO: 2538902 - RNA, 16 nt, Human
ucacagcuucagccag

SEQ ID NO: 2538903 - RNA, 15 nt, Human
ucacagcuucagcca

SEQ ID NO: 2538904 - RNA, 17 nt, Human
ucaccagccccagugcc

SEQ ID NO: 2538905 - RNA, 15 nt, Human
ucacauuauuugcau

SEQ ID NO: 2538906 - RNA, 13 nt, Human
ucacauucaggaa

SEQ ID NO: 2538907 - RNA, 16 nt, Human
ucacauuauuugcaug

SEQ ID NO: 2538908 - RNA, 19 nt, Human
ucacauuaauauuugcuga

SEQ ID NO: 2538909 - RNA, 19 nt, Human
ucacauuacuguauauacu

SEQ ID NO: 2538910 - RNA, 20 nt, Human
ucacauuaauauuugcugac

SEQ ID NO: 2538911 - RNA, 16 nt, Human
ucacauguauguuuug

SEQ ID NO: 2538912 - RNA, 15 nt, Human
ucacauguauguuuu

SEQ ID NO: 2538913 - RNA, 13 nt, Human
ucacauguauguu

SEQ ID NO: 2538914 - RNA, 21 nt, Human
ucacaugucaguaccuucaaa

SEQ ID NO: 2538915 - RNA, 23 nt, Human
ucacauguauguuuugguaucug

SEQ ID NO: 2538916 - RNA, 21 nt, Human
ucacauggccuaugcacauau

SEQ ID NO: 2538917 - RNA, 16 nt, Human
ucacauggccuaugca

SEQ ID NO: 2538918 - RNA, 21 nt, Human
ucacauggugcuacgccugca

SEQ ID NO: 2538919 - RNA, 23 nt, Human
accacacccagcccacuucugcc

SEQ ID NO: 2538920 - RNA, 21 nt, Human
accacacccagcccacuucug

SEQ ID NO: 2538921 - RNA, 20 nt, Human
accacacccagcccacuucu

SEQ ID NO: 2538922 - RNA, 16 nt, Human
accacacccagcccac

SEQ ID NO: 2538923 - RNA, 17 nt, Human
accacaccaaaccucuc

SEQ ID NO: 2538924 - RNA, 15 nt, Human
accacaccaaaccuc

SEQ ID NO: 2538925 - RNA, 15 nt, Human
accacacccagccca

SEQ ID NO: 2538926 - RNA, 21 nt, Human
accacaaggcuguugcauggg

SEQ ID NO: 2538927 - RNA, 17 nt, Human
accacacagaggcugcc

SEQ ID NO: 2538928 - RNA, 17 nt, Human
accaaugcaugcagcca

SEQ ID NO: 2538929 - RNA, 12 nt, Human
accaaugcaugc

SEQ ID NO: 2538930 - RNA, 17 nt, Human
accaaugaaaaaaugua

SEQ ID NO: 2538931 - RNA, 14 nt, Human
accaaugaaaaaau

SEQ ID NO: 2538932 - RNA, 13 nt, Human
accaauccuggac

SEQ ID NO: 2538933 - RNA, 16 nt, Human
accaacccagccgcug

SEQ ID NO: 2538934 - RNA, 15 nt, Human
accaacccagccgcu

SEQ ID NO: 2538935 - RNA, 14 nt, Human
accaacccagccgc

SEQ ID NO: 2538936 - RNA, 13 nt, Human
accaacccagccg

SEQ ID NO: 2538937 - RNA, 15 nt, Human
accaacccucagagc

SEQ ID NO: 2538938 - RNA, 20 nt, Human
accaaucauuuuaauuauua

SEQ ID NO: 2538939 - RNA, 20 nt, Human
accaacccagccgcugcccg

SEQ ID NO: 2538940 - RNA, 19 nt, Human
accaacccagccgcugccc

SEQ ID NO: 2538941 - RNA, 22 nt, Human
accaacccaucagaaggagaag

SEQ ID NO: 2538942 - RNA, 18 nt, Human
accacaaauagugcucgc

SEQ ID NO: 2538943 - RNA, 20 nt, Human
accacaaagcacaguuugaa

SEQ ID NO: 2538944 - RNA, 16 nt, Human
accacaagacugcaca

SEQ ID NO: 2538945 - RNA, 19 nt, Human
accaaugcuuuuaucaaac

SEQ ID NO: 2538946 - RNA, 12 nt, Human
accaaugucuug

SEQ ID NO: 2538947 - RNA, 18 nt, Human
accaaugcuuuuaucaaa

SEQ ID NO: 2538948 - RNA, 22 nt, Human
accaaugcaugcagccacugug

SEQ ID NO: 2538949 - RNA, 20 nt, Human
accaaugcaugcagccacug

SEQ ID NO: 2538950 - RNA, 18 nt, Human
accaaugcaugcagccac

SEQ ID NO: 2538951 - RNA, 21 nt, Human
accaaugccaaaaaaagacag

SEQ ID NO: 2538952 - RNA, 14 nt, Human
accaacacgagcag

SEQ ID NO: 2538953 - RNA, 19 nt, Human
accaacacgagcaggcuac

SEQ ID NO: 2538954 - RNA, 14 nt, Human
accaaauuccuugg

SEQ ID NO: 2538955 - RNA, 20 nt, Human
accaaccacugcgaccacaa

SEQ ID NO: 2538956 - RNA, 22 nt, Human
accaacaucccauugcccuggu

SEQ ID NO: 2538957 - RNA, 15 nt, Human
accaacauggagaaa

SEQ ID NO: 2538958 - RNA, 16 nt, Human
accaacauggagaaac

SEQ ID NO: 2538959 - RNA, 23 nt, Human
accaacauggagaaacccugucu

SEQ ID NO: 2538960 - RNA, 12 nt, Human
accaacccagcc

SEQ ID NO: 2538961 - RNA, 24 nt, Human
accaacauggagaaacccugucuc

SEQ ID NO: 2538962 - RNA, 16 nt, Human
accaacauacucccau

SEQ ID NO: 2538963 - RNA, 21 nt, Human
accaacaucccauugcccugg

SEQ ID NO: 2538964 - RNA, 16 nt, Human
accaacaguuccuuca

SEQ ID NO: 2538965 - RNA, 13 nt, Human
accaaaucuggaa

SEQ ID NO: 2538966 - RNA, 22 nt, Human
accaaaugcuuuaaaaacuauu

SEQ ID NO: 2538967 - RNA, 19 nt, Human
accaaaugcuuuaaaaacu

SEQ ID NO: 2538968 - RNA, 13 nt, Human
accaaaugcuuua

SEQ ID NO: 2538969 - RNA, 15 nt, Human
accaaaucuggaagc

SEQ ID NO: 2538970 - RNA, 11 nt, Human
accaaaugcuu

SEQ ID NO: 2538971 - RNA, 16 nt, Human
accaaaucagcugcua

SEQ ID NO: 2538972 - RNA, 19 nt, Human
accaaaucagcugcuacua

SEQ ID NO: 2538973 - RNA, 18 nt, Human
accaaauaaaaauauugu

SEQ ID NO: 2538974 - RNA, 16 nt, Human
accaaauaaaaauauu

SEQ ID NO: 2538975 - RNA, 17 nt, Human
accaaaaagaccagacu

SEQ ID NO: 2538976 - RNA, 19 nt, Human
accaaaaacugaaagugaa

SEQ ID NO: 2538977 - RNA, 18 nt, Human
ucaaggcgugaggauggg

SEQ ID NO: 2538978 - RNA, 20 nt, Human
ucaagguggccaaauuauuu

SEQ ID NO: 2538979 - RNA, 16 nt, Human
ucaaggcacugccuga

SEQ ID NO: 2538980 - RNA, 15 nt, Human
ucaaggcacugccug

SEQ ID NO: 2538981 - RNA, 14 nt, Human
ucaaggcacugccu

SEQ ID NO: 2538982 - RNA, 13 nt, Human
ucaaggcacugcc

SEQ ID NO: 2538983 - RNA, 16 nt, Human
ucaaggccucccacag

SEQ ID NO: 2538984 - RNA, 15 nt, Human
ucaaggccucccaca

SEQ ID NO: 2538985 - RNA, 17 nt, Human
ucaaggcaucaugcaga

SEQ ID NO: 2538986 - RNA, 14 nt, Human
ucaaggccucccac

SEQ ID NO: 2538987 - RNA, 18 nt, Human
ucaaggccucccacagug

SEQ ID NO: 2538988 - RNA, 17 nt, Human
ucaaggccucccacagu

SEQ ID NO: 2538989 - RNA, 19 nt, Human
ucaaggccucccacaguga

SEQ ID NO: 2538990 - RNA, 23 nt, Human
ucaaggauccugagccagauuuc

SEQ ID NO: 2538991 - RNA, 22 nt, Human
ucaagcagcgaccgcccccucc

SEQ ID NO: 2538992 - RNA, 21 nt, Human
ucaagcagcgaccgcccccuc

SEQ ID NO: 2538993 - RNA, 18 nt, Human
ucaagcagcgaccgcccc

SEQ ID NO: 2538994 - RNA, 12 nt, Human
ucaagcagccaa

SEQ ID NO: 2538995 - RNA, 17 nt, Human
ucaagcagauuggagaa

SEQ ID NO: 2538996 - RNA, 21 nt, Human
ucaagcaaacagcuucacaaa

SEQ ID NO: 2538997 - RNA, 18 nt, Human
ucaagauuuugaaugcuu

SEQ ID NO: 2538998 - RNA, 19 nt, Human
ucaagauuuugaaugcuuc

SEQ ID NO: 2538999 - RNA, 17 nt, Human
ucaagauuucaggauua

SEQ ID NO: 2539000 - RNA, 13 nt, Human
ucaagauuuugaa

SEQ ID NO: 2539001 - RNA, 16 nt, Human
ucaagauuuugaaugc

SEQ ID NO: 2539002 - RNA, 16 nt, Human
ucaagcagauuggaga

SEQ ID NO: 2539003 - RNA, 17 nt, Human
ucaagcaagauuucaga

SEQ ID NO: 2539004 - RNA, 12 nt, Human
ucaagaggcuga

SEQ ID NO: 2539005 - RNA, 14 nt, Human
acauuauuugcaug

SEQ ID NO: 2539006 - RNA, 17 nt, Human
ucaagagcugcccuccu

SEQ ID NO: 2539007 - RNA, 18 nt, Human
acauuauuaucaacaaua

SEQ ID NO: 2539008 - RNA, 16 nt, Human
acauuauuuauucagc

SEQ ID NO: 2539009 - RNA, 13 nt, Human
acauuauuugcau

SEQ ID NO: 2539010 - RNA, 18 nt, Human
acauuaucgggagcagug

SEQ ID NO: 2539011 - RNA, 19 nt, Human
acauuaucgggagcagugu

SEQ ID NO: 2539012 - RNA, 21 nt, Human
acauuaucgggagcagugucu

SEQ ID NO: 2539013 - RNA, 19 nt, Human
acauuaucucacuugugcc

SEQ ID NO: 2539014 - RNA, 22 nt, Human
acauuaucgggagcagugucuu

SEQ ID NO: 2539015 - RNA, 21 nt, Human
ucaagagggcacugguggccc

SEQ ID NO: 2539016 - RNA, 20 nt, Human
ucaagagggcacugguggcc

SEQ ID NO: 2539017 - RNA, 17 nt, Human
ucaagagggucugagga

SEQ ID NO: 2539018 - RNA, 19 nt, Human
ucaauaggaaaaacugauu

SEQ ID NO: 2539019 - RNA, 18 nt, Human
ucaauaggaaaaacugau

SEQ ID NO: 2539020 - RNA, 17 nt, Human
ucaauaggaaaaacuga

SEQ ID NO: 2539021 - RNA, 17 nt, Human
ucaagugauucuccugc

SEQ ID NO: 2539022 - RNA, 21 nt, Human
ucaagugauucucaugccuca

SEQ ID NO: 2539023 - RNA, 22 nt, Human
ucaagugauucucaugccucag

SEQ ID NO: 2539024 - RNA, 16 nt, Human
ucaagugauucuccug

SEQ ID NO: 2539025 - RNA, 18 nt, Human
ucaaguaagaagacauga

SEQ ID NO: 2539026 - RNA, 22 nt, Human
ucaaguaagaagacaugaacca

SEQ ID NO: 2539027 - RNA, 17 nt, Human
ucaaguaauucugcugu

SEQ ID NO: 2539028 - RNA, 23 nt, Human
ucaaguaagaagacaugaaccaa

SEQ ID NO: 2539029 - RNA, 15 nt, Human
ucaaguaauugugaa

SEQ ID NO: 2539030 - RNA, 16 nt, Human
ucaaguaauugugaaa

SEQ ID NO: 2539031 - RNA, 16 nt, Human
ucaaguaagaagacau

SEQ ID NO: 2539032 - RNA, 19 nt, Human
ucaaguaauccaccugccu

SEQ ID NO: 2539033 - RNA, 21 nt, Human
ucaaucaguauaauucuguac

SEQ ID NO: 2539034 - RNA, 16 nt, Human
ucaaucaguauaauuc

SEQ ID NO: 2539035 - RNA, 15 nt, Human
ucaaucaguauaauu

SEQ ID NO: 2539036 - RNA, 14 nt, Human
ucaaucaguauaau

SEQ ID NO: 2539037 - RNA, 20 nt, Human
ucaaucacagcuuguauuuu

SEQ ID NO: 2539038 - RNA, 12 nt, Human
ucaaucacagcu

SEQ ID NO: 2539039 - RNA, 22 nt, Human
ucaaucaguauaauucuguacu

SEQ ID NO: 2539040 - RNA, 15 nt, Human
ucaaucaucugugug

SEQ ID NO: 2539041 - RNA, 20 nt, Human
ucaaucaucugugugaaaau

SEQ ID NO: 2539042 - RNA, 16 nt, Human
ucaaucaucuguguga

SEQ ID NO: 2539043 - RNA, 16 nt, Human
ucaaucauuguacagu

SEQ ID NO: 2539044 - RNA, 15 nt, Human
ucaaucauuguacag

SEQ ID NO: 2539045 - RNA, 14 nt, Human
ucaaucauuguaca

SEQ ID NO: 2539046 - RNA, 19 nt, Human
ucaaucaucugugugaaaa

SEQ ID NO: 2539047 - RNA, 18 nt, Human
ucaaucauuguacaguuu

SEQ ID NO: 2539048 - RNA, 15 nt, Human
ucaauccagcuaugu

SEQ ID NO: 2539049 - RNA, 15 nt, Human
ucaauccccucauuc

SEQ ID NO: 2539050 - RNA, 17 nt, Human
ucaauccccucauucag

SEQ ID NO: 2539051 - RNA, 20 nt, Human
ucaauccccucauucaggaa

SEQ ID NO: 2539052 - RNA, 23 nt, Human
ucaauauuucagauaaucacaau

SEQ ID NO: 2539053 - RNA, 22 nt, Human
ucaauaggaaaaacugauuuuu

SEQ ID NO: 2539054 - RNA, 16 nt, Human
ucaauauuuuuagaua

SEQ ID NO: 2539055 - RNA, 18 nt, Human
ucaauauuuuccaugaaa

SEQ ID NO: 2539056 - RNA, 17 nt, Human
ucaauauuuuccaugaa

SEQ ID NO: 2539057 - RNA, 16 nt, Human
ucaauauuuuccauga

SEQ ID NO: 2539058 - RNA, 15 nt, Human
ucaauauuuuccaug

SEQ ID NO: 2539059 - RNA, 15 nt, Human
acauuuuuaagugcu

SEQ ID NO: 2539060 - RNA, 18 nt, Human
acauuuuuaagugcugca

SEQ ID NO: 2539061 - RNA, 14 nt, Human
acauuuuuacaaua

SEQ ID NO: 2539062 - RNA, 15 nt, Human
acauuuuuacaauaa

SEQ ID NO: 2539063 - RNA, 21 nt, Human
acauuuuucagauauaaaaga

SEQ ID NO: 2539064 - RNA, 13 nt, Human
acauuuuucuuag

SEQ ID NO: 2539065 - RNA, 23 nt, Human
acauuuuucuuagggaaggauac

SEQ ID NO: 2539066 - RNA, 15 nt, Human
accaaaaaaguuaca

SEQ ID NO: 2539067 - RNA, 21 nt, Human
acauuuuguauaauuguaucg

SEQ ID NO: 2539068 - RNA, 19 nt, Human
acauuuuguauaauuguau

SEQ ID NO: 2539069 - RNA, 16 nt, Human
acauuuuguauaauug

SEQ ID NO: 2539070 - RNA, 13 nt, Human
acauuuuguauaa

SEQ ID NO: 2539071 - RNA, 15 nt, Human
acauuuuaguucuuu

SEQ ID NO: 2539072 - RNA, 12 nt, Human
acauuuuguaua

SEQ ID NO: 2539073 - RNA, 18 nt, Human
acauuuuacuuuuuccug

SEQ ID NO: 2539074 - RNA, 23 nt, Human
acauuuaaauuuuacccuuuaga

SEQ ID NO: 2539075 - RNA, 21 nt, Human
acauuguuuugccaacauugc

SEQ ID NO: 2539076 - RNA, 17 nt, Human
acauuuaaacuugucag

SEQ ID NO: 2539077 - RNA, 16 nt, Human
acauuuaauacagcag

SEQ ID NO: 2539078 - RNA, 22 nt, Human
acauuuaacuuguuuccaaugu

SEQ ID NO: 2539079 - RNA, 20 nt, Human
acauuuaagagacagucacc

SEQ ID NO: 2539080 - RNA, 17 nt, Human
acauuuaauacagcagu

SEQ ID NO: 2539081 - RNA, 18 nt, Human
acauuuuaaauggacaga

SEQ ID NO: 2539082 - RNA, 13 nt, Human
acauuuuaauuca

SEQ ID NO: 2539083 - RNA, 15 nt, Human
acauuuuaaugcacc

SEQ ID NO: 2539084 - RNA, 19 nt, Human
acauuuuaaugcaccugaa

SEQ ID NO: 2539085 - RNA, 22 nt, Human
acauugcggacagccacggcca

SEQ ID NO: 2539086 - RNA, 21 nt, Human
acauugcggacagccacggcc

SEQ ID NO: 2539087 - RNA, 15 nt, Human
acauugcguuugacc

SEQ ID NO: 2539088 - RNA, 23 nt, Human
acauugcguuugaccuuuuaugu

SEQ ID NO: 2539089 - RNA, 22 nt, Human
ucaauccuaauuucuccucccu

SEQ ID NO: 2539090 - RNA, 15 nt, Human
ucaauccuaccuguu

SEQ ID NO: 2539091 - RNA, 21 nt, Human
ucaauccuaauuucuccuccc

SEQ ID NO: 2539092 - RNA, 22 nt, Human
ucaauccccucauucaggaaaa

SEQ ID NO: 2539093 - RNA, 23 nt, Human
acauugcuuugaccacucuuccu

SEQ ID NO: 2539094 - RNA, 21 nt, Human
acauugcuuuacugucaaaau

SEQ ID NO: 2539095 - RNA, 18 nt, Human
acauugcuuuacugucaa

SEQ ID NO: 2539096 - RNA, 17 nt, Human
acauugcuaagaugcuc

SEQ ID NO: 2539097 - RNA, 14 nt, Human
acauugcuaagaug

SEQ ID NO: 2539098 - RNA, 22 nt, Human
acauugccuuuucuagcccgaa

SEQ ID NO: 2539099 - RNA, 20 nt, Human
acauugcuugugccacaccc

SEQ ID NO: 2539100 - RNA, 16 nt, Human
acauuggagccugggc

SEQ ID NO: 2539101 - RNA, 21 nt, Human
acauuggcaccuaauccaggc

SEQ ID NO: 2539102 - RNA, 22 nt, Human
acauuggcaccuaauccaggca

SEQ ID NO: 2539103 - RNA, 17 nt, Human
acauugggcagcgcccu

SEQ ID NO: 2539104 - RNA, 17 nt, Human
acauugggaaaucuuau

SEQ ID NO: 2539105 - RNA, 23 nt, Human
acauugggaaggggacccccgcc

SEQ ID NO: 2539106 - RNA, 19 nt, Human
acauugggaaggggacccc

SEQ ID NO: 2539107 - RNA, 15 nt, Human
acauugggaagggga

SEQ ID NO: 2539108 - RNA, 16 nt, Human
acauugguaagaauga

SEQ ID NO: 2539109 - RNA, 22 nt, Human
acauugggcagcgcccuuccuc

SEQ ID NO: 2539110 - RNA, 21 nt, Human
acauugggcagcgcccuuccu

SEQ ID NO: 2539111 - RNA, 20 nt, Human
acauugggcagcgcccuucc

SEQ ID NO: 2539112 - RNA, 23 nt, Human
acauuggguccugggucuuucau

SEQ ID NO: 2539113 - RNA, 14 nt, Human
acauugguucuugu

SEQ ID NO: 2539114 - RNA, 16 nt, Human
acauugguucuuguau

SEQ ID NO: 2539115 - RNA, 18 nt, Human
acauugguucuuguauua

SEQ ID NO: 2539116 - RNA, 21 nt, Human
acauugguucuuguauuaaga

SEQ ID NO: 2539117 - RNA, 21 nt, Human
acauuguaaauaguauuugag

SEQ ID NO: 2539118 - RNA, 19 nt, Human
acauuguaaauaguauuug

SEQ ID NO: 2539119 - RNA, 17 nt, Human
acauuguaaauaguauu

SEQ ID NO: 2539120 - RNA, 22 nt, Human
acauugguucuuguauuaagaa

SEQ ID NO: 2539121 - RNA, 23 nt, Human
acauugguucuuguauuaagaau

SEQ ID NO: 2539122 - RNA, 12 nt, Human
acauuguuuugc

SEQ ID NO: 2539123 - RNA, 18 nt, Human
acauuguuuuaaaaagaa

SEQ ID NO: 2539124 - RNA, 17 nt, Human
acauuguuuuaaaaaga

SEQ ID NO: 2539125 - RNA, 16 nt, Human
acauuguuuuaaaaag

SEQ ID NO: 2539126 - RNA, 15 nt, Human
acauuguuuuaaaaa

SEQ ID NO: 2539127 - RNA, 13 nt, Human
acauuguuuuaaa

SEQ ID NO: 2539128 - RNA, 19 nt, Human
uauuuuaauaauguuucaa

SEQ ID NO: 2539129 - RNA, 17 nt, Human
uauuuuaauaaacacuc

SEQ ID NO: 2539130 - RNA, 14 nt, Human
uauuuuaauaaaca

SEQ ID NO: 2539131 - RNA, 14 nt, Human
uauuuuacaauuuu

SEQ ID NO: 2539132 - RNA, 23 nt, Human
uauuuuacaauuuuuuaucaugc

SEQ ID NO: 2539133 - RNA, 22 nt, Human
uauuuuaauaauguuucaaaca

SEQ ID NO: 2539134 - RNA, 19 nt, Human
uauuuuaauuuaugaguuu

SEQ ID NO: 2539135 - RNA, 14 nt, Human
uauuuuaaguauug

SEQ ID NO: 2539136 - RNA, 16 nt, Human
uauuuuggagaaauua

SEQ ID NO: 2539137 - RNA, 20 nt, Human
uauuuuggauuguauauugu

SEQ ID NO: 2539138 - RNA, 17 nt, Human
uauuuugguacuuuuau

SEQ ID NO: 2539139 - RNA, 14 nt, Human
uauuuugguacuuu

SEQ ID NO: 2539140 - RNA, 23 nt, Human
uauuuuggauuguauauuguguu

SEQ ID NO: 2539141 - RNA, 20 nt, Human
uauuuugcuuugugauuuuu

SEQ ID NO: 2539142 - RNA, 13 nt, Human
uauuuugcuuugu

SEQ ID NO: 2539143 - RNA, 15 nt, Human
uauuuugcuuuguga

SEQ ID NO: 2539144 - RNA, 16 nt, Human
uauuuuacuacugugg

SEQ ID NO: 2539145 - RNA, 18 nt, Human
uauuuuacuucuagagau

SEQ ID NO: 2539146 - RNA, 14 nt, Human
uauuuugcacaguu

SEQ ID NO: 2539147 - RNA, 18 nt, Human
uauuuugauuauuguauu

SEQ ID NO: 2539148 - RNA, 14 nt, Human
uauuuugcuggaau

SEQ ID NO: 2539149 - RNA, 17 nt, Human
uauuuugauuauuguau

SEQ ID NO: 2539150 - RNA, 16 nt, Human
uauuuugauuauugua

SEQ ID NO: 2539151 - RNA, 19 nt, Human
uauuuuucauauugugcca

SEQ ID NO: 2539152 - RNA, 15 nt, Human
uauuuuucauauugu

SEQ ID NO: 2539153 - RNA, 12 nt, Human
uauuuuucauga

SEQ ID NO: 2539154 - RNA, 20 nt, Human
uauuuuucaugauuuugaaa

SEQ ID NO: 2539155 - RNA, 18 nt, Human
uauuuuugguugucaaua

SEQ ID NO: 2539156 - RNA, 20 nt, Human
uauuuuuggcagucugaauu

SEQ ID NO: 2539157 - RNA, 19 nt, Human
uauuuuuggcagucugaau

SEQ ID NO: 2539158 - RNA, 17 nt, Human
uauuuuuguagagccag

SEQ ID NO: 2539159 - RNA, 20 nt, Human
uauuuuuguaauuuuaaaua

SEQ ID NO: 2539160 - RNA, 14 nt, Human
uauuuuucauauug

SEQ ID NO: 2539161 - RNA, 13 nt, Human
uauuuuucauauu

SEQ ID NO: 2539162 - RNA, 11 nt, Human
uauuuuucaua

SEQ ID NO: 2539163 - RNA, 20 nt, Human
uauuuuucaauaaagcauuu

SEQ ID NO: 2539164 - RNA, 15 nt, Human
uauuuuucacaguuu

SEQ ID NO: 2539165 - RNA, 21 nt, Human
uauuuuuaauauauacuauga

SEQ ID NO: 2539166 - RNA, 14 nt, Human
uauuuuuaagauaa

SEQ ID NO: 2539167 - RNA, 18 nt, Human
uauuuuucaauaaagcau

SEQ ID NO: 2539168 - RNA, 12 nt, Human
uauuuuuaaugg

SEQ ID NO: 2539169 - RNA, 13 nt, Human
uauuuuuauuugu

SEQ ID NO: 2539170 - RNA, 17 nt, Human
uauuuuuauuuguuugu

SEQ ID NO: 2539171 - RNA, 20 nt, Human
uauuuuguguuuaggaacua

SEQ ID NO: 2539172 - RNA, 17 nt, Human
uauuuuguguuuaggaa

SEQ ID NO: 2539173 - RNA, 13 nt, Human
uauuuugucuaaa

SEQ ID NO: 2539174 - RNA, 12 nt, Human
uauuuugucuaa

SEQ ID NO: 2539175 - RNA, 13 nt, Human
uauuuugugaaga

SEQ ID NO: 2539176 - RNA, 14 nt, Human
uauuuugucuaaaa

SEQ ID NO: 2539177 - RNA, 21 nt, Human
uauuuugguucuuaguucuca

SEQ ID NO: 2539178 - RNA, 13 nt, Human
uauuuuguaaacu

SEQ ID NO: 2539179 - RNA, 20 nt, Human
uauuuuguaaacucaaaaua

SEQ ID NO: 2539180 - RNA, 15 nt, Human
uauuuuguauauauc

SEQ ID NO: 2539181 - RNA, 16 nt, Human
uauuuuguaauuauug

SEQ ID NO: 2539182 - RNA, 19 nt, Human
uauuuugguucuuaguucu

SEQ ID NO: 2539183 - RNA, 21 nt, Human
uauuuuguaaacucaaaauau

SEQ ID NO: 2539184 - RNA, 14 nt, Human
uauuuuguaauuau

SEQ ID NO: 2539185 - RNA, 22 nt, Human
uaugugcacugucacuuugcuc

SEQ ID NO: 2539186 - RNA, 21 nt, Human
uaugugcacugucacuuugcu

SEQ ID NO: 2539187 - RNA, 20 nt, Human
uaugugcacugucacuuugc

SEQ ID NO: 2539188 - RNA, 17 nt, Human
uaugugcacugucacuu

SEQ ID NO: 2539189 - RNA, 18 nt, Human
uaugugggggucugugug

SEQ ID NO: 2539190 - RNA, 19 nt, Human
uaugugggggucugugugu

SEQ ID NO: 2539191 - RNA, 20 nt, Human
uaugugggggucuguguguu

SEQ ID NO: 2539192 - RNA, 19 nt, Human
uaugugccagauuuaugca

SEQ ID NO: 2539193 - RNA, 14 nt, Human
uaugugccagauuu

SEQ ID NO: 2539194 - RNA, 16 nt, Human
acaucuugcucugcug

SEQ ID NO: 2539195 - RNA, 15 nt, Human
acaucuugcucugcu

SEQ ID NO: 2539196 - RNA, 17 nt, Human
uauguguaaaaugugaa

SEQ ID NO: 2539197 - RNA, 14 nt, Human
uauguguaaaaugu

SEQ ID NO: 2539198 - RNA, 19 nt, Human
uaugugguuuccacgauga

SEQ ID NO: 2539199 - RNA, 17 nt, Human
acaucuugcucugcuga

SEQ ID NO: 2539200 - RNA, 22 nt, Human
acaucuugcucugcugacagac

SEQ ID NO: 2539201 - RNA, 19 nt, Human
acaucuuggucagauuuga

SEQ ID NO: 2539202 - RNA, 14 nt, Human
acaucuugcucugc

SEQ ID NO: 2539203 - RNA, 24 nt, Human
acaucuuggcacauuuaagagaca

SEQ ID NO: 2539204 - RNA, 13 nt, Human
acaucuuggcaca

SEQ ID NO: 2539205 - RNA, 24 nt, Human
acaucuuuucuugccucugucccc

SEQ ID NO: 2539206 - RNA, 23 nt, Human
acaugaaaaaaggacaauuucaa

SEQ ID NO: 2539207 - RNA, 19 nt, Human
acaucuuuuuucacaaauu

SEQ ID NO: 2539208 - RNA, 15 nt, Human
acaucuuuuuucaca

SEQ ID NO: 2539209 - RNA, 14 nt, Human
acaucuuuccuguc

SEQ ID NO: 2539210 - RNA, 20 nt, Human
acaucuuucacacuuccacc

SEQ ID NO: 2539211 - RNA, 17 nt, Human
acaucuuuaucuguucu

SEQ ID NO: 2539212 - RNA, 13 nt, Human
acaucuuuauccg

SEQ ID NO: 2539213 - RNA, 12 nt, Human
acaucuuucaca

SEQ ID NO: 2539214 - RNA, 14 nt, Human
acaucuuucacacu

SEQ ID NO: 2539215 - RNA, 15 nt, Human
acaucuuucacacuu

SEQ ID NO: 2539216 - RNA, 13 nt, Human
acaucuuucacau

SEQ ID NO: 2539217 - RNA, 15 nt, Human
acaucuuucacauug

SEQ ID NO: 2539218 - RNA, 14 nt, Human
uauuuuaaaagaau

SEQ ID NO: 2539219 - RNA, 18 nt, Human
uauuuguuauuuucagua

SEQ ID NO: 2539220 - RNA, 15 nt, Human
uauuuguuugcauag

SEQ ID NO: 2539221 - RNA, 18 nt, Human
uauuuuaaaagaaugauu

SEQ ID NO: 2539222 - RNA, 14 nt, Human
uauuuguuuucaug

SEQ ID NO: 2539223 - RNA, 13 nt, Human
uauuuguuuucau

SEQ ID NO: 2539224 - RNA, 17 nt, Human
uauuuguuauuuucagu

SEQ ID NO: 2539225 - RNA, 21 nt, Human
uauuuuaaaagauaaauauua

SEQ ID NO: 2539226 - RNA, 22 nt, Human
uauuuuaagacgaaacauuugu

SEQ ID NO: 2539227 - RNA, 14 nt, Human
uauuuuaagacgaa

SEQ ID NO: 2539228 - RNA, 19 nt, Human
uauuuuaaacaaaauagaa

SEQ ID NO: 2539229 - RNA, 14 nt, Human
uauuuuaaacaaaa

SEQ ID NO: 2539230 - RNA, 12 nt, Human
uauuuuaaacaa

SEQ ID NO: 2539231 - RNA, 13 nt, Human
uauuuuaaaauga

SEQ ID NO: 2539232 - RNA, 18 nt, Human
uauuuuaaaaucugucac

SEQ ID NO: 2539233 - RNA, 15 nt, Human
uauuugucuuucagg

SEQ ID NO: 2539234 - RNA, 21 nt, Human
uauuuguauuuuuuugcaagu

SEQ ID NO: 2539235 - RNA, 15 nt, Human
uauuuguaucucuga

SEQ ID NO: 2539236 - RNA, 12 nt, Human
uauuuguaucuc

SEQ ID NO: 2539237 - RNA, 23 nt, Human
uauuuguauaguugcuugccuga

SEQ ID NO: 2539238 - RNA, 17 nt, Human
uauuuguauaguugcuu

SEQ ID NO: 2539239 - RNA, 23 nt, Human
uauuuguaucucugaagcauguu

SEQ ID NO: 2539240 - RNA, 22 nt, Human
uauuuguaucucugaagcaugu

SEQ ID NO: 2539241 - RNA, 21 nt, Human
uauuuguguuuuaauuuaaac

SEQ ID NO: 2539242 - RNA, 19 nt, Human
uauuuguguuuuaauuuaa

SEQ ID NO: 2539243 - RNA, 12 nt, Human
uauuuguguuuu

SEQ ID NO: 2539244 - RNA, 14 nt, Human
uauuuguuauuuuc

SEQ ID NO: 2539245 - RNA, 17 nt, Human
uauuuguuaaauauuua

SEQ ID NO: 2539246 - RNA, 22 nt, Human
uauuuguuaaugguuugaauau

SEQ ID NO: 2539247 - RNA, 20 nt, Human
uauuuguuaaugguuugaau

SEQ ID NO: 2539248 - RNA, 15 nt, Human
acaugaaaacacauu

SEQ ID NO: 2539249 - RNA, 12 nt, Human
uauuuguacaaa

SEQ ID NO: 2539250 - RNA, 12 nt, Human
uauuuguacaua

SEQ ID NO: 2539251 - RNA, 19 nt, Human
uauuuguacaguucaguuc

SEQ ID NO: 2539252 - RNA, 14 nt, Human
acaugaacauacug

SEQ ID NO: 2539253 - RNA, 15 nt, Human
ucaaauacuuuaaag

SEQ ID NO: 2539254 - RNA, 13 nt, Human
acaugaaacagaa

SEQ ID NO: 2539255 - RNA, 15 nt, Human
acaugaaacagaaac

SEQ ID NO: 2539256 - RNA, 23 nt, Human
acaugaaaacacauuuuucuuag

SEQ ID NO: 2539257 - RNA, 22 nt, Human
acaugaaaacacauuuuucuua

SEQ ID NO: 2539258 - RNA, 13 nt, Human
acaugagcaucag

SEQ ID NO: 2539259 - RNA, 15 nt, Human
acaugagaacaaaca

SEQ ID NO: 2539260 - RNA, 14 nt, Human
acaugacacagcuu

SEQ ID NO: 2539261 - RNA, 15 nt, Human
acaugacaacuuugc

SEQ ID NO: 2539262 - RNA, 19 nt, Human
acaugacccuaaaucuuga

SEQ ID NO: 2539263 - RNA, 21 nt, Human
acaugacccuaaaucuugacu

SEQ ID NO: 2539264 - RNA, 23 nt, Human
ucaaauacuuuaaaggaaaaaau

SEQ ID NO: 2539265 - RNA, 12 nt, Human
ucaaauacuuua

SEQ ID NO: 2539266 - RNA, 13 nt, Human
ucaaauauauuca

SEQ ID NO: 2539267 - RNA, 21 nt, Human
ucaaagcaccaaaauaagaaa

SEQ ID NO: 2539268 - RNA, 19 nt, Human
ucaaagguagccaucaugg

SEQ ID NO: 2539269 - RNA, 14 nt, Human
ucaaaguaaaacuu

SEQ ID NO: 2539270 - RNA, 18 nt, Human
ucaaaguaggcaggacca

SEQ ID NO: 2539271 - RNA, 19 nt, Human
ucaaaguaaaacuugcugc

SEQ ID NO: 2539272 - RNA, 20 nt, Human
ucaaaguguaaacaccauag

SEQ ID NO: 2539273 - RNA, 13 nt, Human
ucaaagauauuuu

SEQ ID NO: 2539274 - RNA, 20 nt, Human
ucaaagauauuuugcuuugu

SEQ ID NO: 2539275 - RNA, 22 nt, Human
ucaaagauauuuugcuuuguga

SEQ ID NO: 2539276 - RNA, 20 nt, Human
ucaaacaguagguuggcagu

SEQ ID NO: 2539277 - RNA, 15 nt, Human
ucaaacaguagguug

SEQ ID NO: 2539278 - RNA, 22 nt, Human
ucaaacaguacacuaucuuaau

SEQ ID NO: 2539279 - RNA, 16 nt, Human
ucaaacagaauuuuaa

SEQ ID NO: 2539280 - RNA, 15 nt, Human
ucaaagcaaaugucu

SEQ ID NO: 2539281 - RNA, 23 nt, Human
ucaaagcaaaugucuuccuggau

SEQ ID NO: 2539282 - RNA, 15 nt, Human
ucaaagcaaggaaac

SEQ ID NO: 2539283 - RNA, 16 nt, Human
ucaaagcaaggaaacu

SEQ ID NO: 2539284 - RNA, 15 nt, Human
ucaaagcaaugcauu

SEQ ID NO: 2539285 - RNA, 14 nt, Human
ucaaagcaaugcau

SEQ ID NO: 2539286 - RNA, 20 nt, Human
ucaaagcaaggaaacuaugu

SEQ ID NO: 2539287 - RNA, 19 nt, Human
ucaaagcaaugcauuuugg

SEQ ID NO: 2539288 - RNA, 18 nt, Human
ucaaagcaaugcauuuug

SEQ ID NO: 2539289 - RNA, 17 nt, Human
ucaaagcaaugcauuuu

SEQ ID NO: 2539290 - RNA, 16 nt, Human
ucaaagcaaugcauuu

SEQ ID NO: 2539291 - RNA, 18 nt, Human
ucaaagcaccaaaauaag

SEQ ID NO: 2539292 - RNA, 20 nt, Human
ucaaagcaccaaaauaagaa

SEQ ID NO: 2539293 - RNA, 20 nt, Human
ucaaacagucucaggaaauc

SEQ ID NO: 2539294 - RNA, 21 nt, Human
ucaaacagucucaggaaauca

SEQ ID NO: 2539295 - RNA, 13 nt, Human
ucaaacagucuca

SEQ ID NO: 2539296 - RNA, 20 nt, Human
ucaaaaguauuuuccuguaa

SEQ ID NO: 2539297 - RNA, 18 nt, Human
ucaaaaguauuuuccugu

SEQ ID NO: 2539298 - RNA, 17 nt, Human
ucaaaaguauuuuccug

SEQ ID NO: 2539299 - RNA, 16 nt, Human
ucaaaaguauuuuccu

SEQ ID NO: 2539300 - RNA, 15 nt, Human
ucaaaaguauuuucc

SEQ ID NO: 2539301 - RNA, 14 nt, Human
ucaaaaguauuuuc

SEQ ID NO: 2539302 - RNA, 13 nt, Human
ucaaaaggugccu

SEQ ID NO: 2539303 - RNA, 23 nt, Human
ucaaaaggugccugugaggcagg

SEQ ID NO: 2539304 - RNA, 16 nt, Human
ucaaaagcugggcagg

SEQ ID NO: 2539305 - RNA, 20 nt, Human
acauggccuaugcacauaug

SEQ ID NO: 2539306 - RNA, 18 nt, Human
acauggccuaugcacaua

SEQ ID NO: 2539307 - RNA, 17 nt, Human
acauggccuaugcacau

SEQ ID NO: 2539308 - RNA, 19 nt, Human
acauggugccugagaggca

SEQ ID NO: 2539309 - RNA, 20 nt, Human
acauggcucuaaaaaguuuu

SEQ ID NO: 2539310 - RNA, 14 nt, Human
acauggccuuugcu

SEQ ID NO: 2539311 - RNA, 21 nt, Human
acauggccccucccccugcca

SEQ ID NO: 2539312 - RNA, 22 nt, Human
acauggccccucccccugccag

SEQ ID NO: 2539313 - RNA, 14 nt, Human
acauggccagugug

SEQ ID NO: 2539314 - RNA, 15 nt, Human
acauggccaguguga

SEQ ID NO: 2539315 - RNA, 17 nt, Human
acauggagacuccugcc

SEQ ID NO: 2539316 - RNA, 16 nt, Human
acauggagacuccugc

SEQ ID NO: 2539317 - RNA, 15 nt, Human
acauggagacuccug

SEQ ID NO: 2539318 - RNA, 23 nt, Human
acauggacuuguauauuuguaca

SEQ ID NO: 2539319 - RNA, 18 nt, Human
acauggacuuguauauuu

SEQ ID NO: 2539320 - RNA, 17 nt, Human
acauggacuuguauauu

SEQ ID NO: 2539321 - RNA, 15 nt, Human
acauggacuuguaua

SEQ ID NO: 2539322 - RNA, 14 nt, Human
acauggacuuguau

SEQ ID NO: 2539323 - RNA, 22 nt, Human
acauggagacuccugcccuguu

SEQ ID NO: 2539324 - RNA, 21 nt, Human
acauggagacuccugcccugu

SEQ ID NO: 2539325 - RNA, 15 nt, Human
acauggaguauaugu

SEQ ID NO: 2539326 - RNA, 19 nt, Human
acauggaguauaugucaag

SEQ ID NO: 2539327 - RNA, 23 nt, Human
acaugagcaucaggccaggcccu

SEQ ID NO: 2539328 - RNA, 23 nt, Human
acaugagcuauuuccauuccaga

SEQ ID NO: 2539329 - RNA, 14 nt, Human
acaugagauuuaua

SEQ ID NO: 2539330 - RNA, 16 nt, Human
acaugaggggacauuu

SEQ ID NO: 2539331 - RNA, 17 nt, Human
acaugaggggacauuuu

SEQ ID NO: 2539332 - RNA, 22 nt, Human
acaugagcuauuuccauuccag

SEQ ID NO: 2539333 - RNA, 21 nt, Human
acaugaggacaugauggagcg

SEQ ID NO: 2539334 - RNA, 12 nt, Human
acauggacccgg

SEQ ID NO: 2539335 - RNA, 13 nt, Human
acauggacccgga

SEQ ID NO: 2539336 - RNA, 16 nt, Human
acauggacccggagcu

SEQ ID NO: 2539337 - RNA, 22 nt, Human
acauggacccggagcuaacacu

SEQ ID NO: 2539338 - RNA, 13 nt, Human
acauggacuugua

SEQ ID NO: 2539339 - RNA, 19 nt, Human
acauggacccggagcuaac

SEQ ID NO: 2539340 - RNA, 20 nt, Human
acauggaauaacauguaauu

SEQ ID NO: 2539341 - RNA, 14 nt, Human
acauggaaguacua

SEQ ID NO: 2539342 - RNA, 18 nt, Human
acauggaauaacauguaa

SEQ ID NO: 2539343 - RNA, 21 nt, Human
acauguauugcacauuguaaa

SEQ ID NO: 2539344 - RNA, 12 nt, Human
acauguauuugu

SEQ ID NO: 2539345 - RNA, 15 nt, Human
acaugucuuaaugaa

SEQ ID NO: 2539346 - RNA, 19 nt, Human
acauguauugcacauugua

SEQ ID NO: 2539347 - RNA, 18 nt, Human
acauguauugcacauugu

SEQ ID NO: 2539348 - RNA, 15 nt, Human
acauguauuauuuca

SEQ ID NO: 2539349 - RNA, 23 nt, Human
acauguauguuuugguaucuguu

SEQ ID NO: 2539350 - RNA, 22 nt, Human
acauguauguuuugguaucugu

SEQ ID NO: 2539351 - RNA, 15 nt, Human
acauguauguuuugg

SEQ ID NO: 2539352 - RNA, 14 nt, Human
acauguauguuuug

SEQ ID NO: 2539353 - RNA, 11 nt, Human
acauguauguu

SEQ ID NO: 2539354 - RNA, 20 nt, Human
acauguaauaaaaaguauau

SEQ ID NO: 2539355 - RNA, 18 nt, Human
acauguaucuaugcauuu

SEQ ID NO: 2539356 - RNA, 21 nt, Human
acauguaucuaugcauuuucu

SEQ ID NO: 2539357 - RNA, 20 nt, Human
acauguauaauauuuuuaau

SEQ ID NO: 2539358 - RNA, 19 nt, Human
acauguauaauauuuuuaa

SEQ ID NO: 2539359 - RNA, 23 nt, Human
acauggugcuacgccugcaugua

SEQ ID NO: 2539360 - RNA, 23 nt, Human
acauggugccugagaggcaggca

SEQ ID NO: 2539361 - RNA, 20 nt, Human
acauggugccugagaggcag

SEQ ID NO: 2539362 - RNA, 19 nt, Human
acauggugcuacgccugca

SEQ ID NO: 2539363 - RNA, 18 nt, Human
acaugguuacaaucauug

SEQ ID NO: 2539364 - RNA, 23 nt, Human
acauggugucuggauucccagga

SEQ ID NO: 2539365 - RNA, 19 nt, Human
acaugguggguccaugggc

SEQ ID NO: 2539366 - RNA, 18 nt, Human
acaugguggguccauggg

SEQ ID NO: 2539367 - RNA, 23 nt, Human
acaugguuacaaucauugcugaa

SEQ ID NO: 2539368 - RNA, 22 nt, Human
acaugguuacaaucauugcuga

SEQ ID NO: 2539369 - RNA, 18 nt, Human
acaugguugugaccugag

SEQ ID NO: 2539370 - RNA, 20 nt, Human
acaugguugugaccugagga

SEQ ID NO: 2539371 - RNA, 17 nt, Human
acaugguuugacucccg

SEQ ID NO: 2539372 - RNA, 17 nt, Human
acauguaauaaaaagua

SEQ ID NO: 2539373 - RNA, 19 nt, Human
acauguaauaaaaaguaua

SEQ ID NO: 2539374 - RNA, 23 nt, Human
acauguaauaaaaaguauauguu

SEQ ID NO: 2539375 - RNA, 20 nt, Human
acauguaguaguacuugaaa

SEQ ID NO: 2539376 - RNA, 14 nt, Human
acauguauaauauu

SEQ ID NO: 2539377 - RNA, 21 nt, Human
acaugucuuaaugaaguuuga

SEQ ID NO: 2539378 - RNA, 20 nt, Human
acaugucuuaaugaaguuug

SEQ ID NO: 2539379 - RNA, 18 nt, Human
acaugucuuaaugaaguu

SEQ ID NO: 2539380 - RNA, 16 nt, Human
acaugucuuaaugaag

SEQ ID NO: 2539381 - RNA, 23 nt, Human
acaugucuuaaugaaguuugaau

SEQ ID NO: 2539382 - RNA, 22 nt, Human
acaugucuuaaugaaguuugaa

SEQ ID NO: 2539383 - RNA, 14 nt, Human
acaugucuuguaca

SEQ ID NO: 2539384 - RNA, 13 nt, Human
acaugucuuguac

SEQ ID NO: 2539385 - RNA, 19 nt, Human
acaugucuuguacaugugu

SEQ ID NO: 2539386 - RNA, 16 nt, Human
acaugucuuguacaug

SEQ ID NO: 2539387 - RNA, 20 nt, Human
acauuaagauugaggccugc

SEQ ID NO: 2539388 - RNA, 12 nt, Human
acaugucuuaau

SEQ ID NO: 2539389 - RNA, 22 nt, Human
acaugucuuguacauguguagc

SEQ ID NO: 2539390 - RNA, 21 nt, Human
acaugucuuuucuugcaugag

SEQ ID NO: 2539391 - RNA, 19 nt, Human
acauuaccuuacuguggag

SEQ ID NO: 2539392 - RNA, 16 nt, Human
acauuaccuuacugug

SEQ ID NO: 2539393 - RNA, 18 nt, Human
acauuagaacacugcauu

SEQ ID NO: 2539394 - RNA, 15 nt, Human
acauuaccuuacugu

SEQ ID NO: 2539395 - RNA, 21 nt, Human
acauuaauguuaauucagcac

SEQ ID NO: 2539396 - RNA, 15 nt, Human
acauuaauguuaauu

SEQ ID NO: 2539397 - RNA, 22 nt, Human
acauuaauguuaauucagcacu

SEQ ID NO: 2539398 - RNA, 21 nt, Human
acauuaaucaaucaucugugu

SEQ ID NO: 2539399 - RNA, 17 nt, Human
acauuaagccuuccaca

SEQ ID NO: 2539400 - RNA, 19 nt, Human
ucaguauugaagcauuuua

SEQ ID NO: 2539401 - RNA, 12 nt, Human
ucagugcucccu

SEQ ID NO: 2539402 - RNA, 13 nt, Human
ucagugcucccuc

SEQ ID NO: 2539403 - RNA, 19 nt, Human
ucagugcucccucacaugu

SEQ ID NO: 2539404 - RNA, 18 nt, Human
ucagugcucgagacacag

SEQ ID NO: 2539405 - RNA, 13 nt, Human
ucaguggcagcug

SEQ ID NO: 2539406 - RNA, 12 nt, Human
ucagugcugugg

SEQ ID NO: 2539407 - RNA, 14 nt, Human
ucagugcuguggcc

SEQ ID NO: 2539408 - RNA, 15 nt, Human
ucagugcuguggccu

SEQ ID NO: 2539409 - RNA, 16 nt, Human
ucaguggcagcugcuu

SEQ ID NO: 2539410 - RNA, 17 nt, Human
ucagugcuguggccugg

SEQ ID NO: 2539411 - RNA, 19 nt, Human
ucagugcuguggccugggc

SEQ ID NO: 2539412 - RNA, 15 nt, Human
ucaguggcagcugcu

SEQ ID NO: 2539413 - RNA, 14 nt, Human
ucaguggcagcugc

SEQ ID NO: 2539414 - RNA, 23 nt, Human
ucagugccuuauggaacacucug

SEQ ID NO: 2539415 - RNA, 22 nt, Human
ucagugccuuauggaacacucu

SEQ ID NO: 2539416 - RNA, 20 nt, Human
ucagugccuuauggaacacu

SEQ ID NO: 2539417 - RNA, 19 nt, Human
ucagugccuuauggaacac

SEQ ID NO: 2539418 - RNA, 20 nt, Human
ucaguauguugucaaagaga

SEQ ID NO: 2539419 - RNA, 18 nt, Human
ucaguauguugucaaaga

SEQ ID NO: 2539420 - RNA, 17 nt, Human
ucaguauguugucaaag

SEQ ID NO: 2539421 - RNA, 16 nt, Human
ucaguauguugucaaa

SEQ ID NO: 2539422 - RNA, 15 nt, Human
ucaguauguugucaa

SEQ ID NO: 2539423 - RNA, 15 nt, Human
ucaguauugaagcau

SEQ ID NO: 2539424 - RNA, 16 nt, Human
ucaguauugaagcauu

SEQ ID NO: 2539425 - RNA, 17 nt, Human
ucaguauugaagcauuu

SEQ ID NO: 2539426 - RNA, 18 nt, Human
ucaguauugaagcauuuu

SEQ ID NO: 2539427 - RNA, 14 nt, Human
ucaguauugaagca

SEQ ID NO: 2539428 - RNA, 20 nt, Human
ucaguuuaauccuucuaguu

SEQ ID NO: 2539429 - RNA, 19 nt, Human
ucaguuuaauccuucuagu

SEQ ID NO: 2539430 - RNA, 16 nt, Human
ucaguuuaauccuucu

SEQ ID NO: 2539431 - RNA, 15 nt, Human
ucaguuuaauccuuc

SEQ ID NO: 2539432 - RNA, 23 nt, Human
ucaguuuauccaagguguaacuc

SEQ ID NO: 2539433 - RNA, 19 nt, Human
ucaguuguuagugugucuu

SEQ ID NO: 2539434 - RNA, 12 nt, Human
ucaguuguuuuc

SEQ ID NO: 2539435 - RNA, 22 nt, Human
ucagugcuguggccugggcaag

SEQ ID NO: 2539436 - RNA, 15 nt, Human
ucaguuuguauauac

SEQ ID NO: 2539437 - RNA, 16 nt, Human
ucaguuugugugucuu

SEQ ID NO: 2539438 - RNA, 15 nt, Human
ucaguuugugugucu

SEQ ID NO: 2539439 - RNA, 17 nt, Human
ucaguuugugugucuua

SEQ ID NO: 2539440 - RNA, 16 nt, Human
ucauaaaauaaaguau

SEQ ID NO: 2539441 - RNA, 21 nt, Human
ucauaaaauaaaguauauaua

SEQ ID NO: 2539442 - RNA, 16 nt, Human
ucaguuuccuggucug

SEQ ID NO: 2539443 - RNA, 19 nt, Human
ucaguuucaauucagugcu

SEQ ID NO: 2539444 - RNA, 20 nt, Human
ucaguuuccuggucuguaga

SEQ ID NO: 2539445 - RNA, 19 nt, Human
ucaguuugcuagcagaaau

SEQ ID NO: 2539446 - RNA, 20 nt, Human
ucauaaguauuaugucucuu

SEQ ID NO: 2539447 - RNA, 15 nt, Human
ucauaaguauuucaa

SEQ ID NO: 2539448 - RNA, 20 nt, Human
ucauaaguauuucaaauugg

SEQ ID NO: 2539449 - RNA, 23 nt, Human
ucauaagccaauuuuucugcacu

SEQ ID NO: 2539450 - RNA, 22 nt, Human
ucauaagccaauuuuucugcac

SEQ ID NO: 2539451 - RNA, 16 nt, Human
ucauaagcgaucacuu

SEQ ID NO: 2539452 - RNA, 21 nt, Human
ucauaagccaauuuuucugca

SEQ ID NO: 2539453 - RNA, 20 nt, Human
ucauaagccaauuuuucugc

SEQ ID NO: 2539454 - RNA, 18 nt, Human
ucauaagccaauuuuucu

SEQ ID NO: 2539455 - RNA, 15 nt, Human
ucauaagccaauuuu

SEQ ID NO: 2539456 - RNA, 14 nt, Human
ucauaaaugaauuu

SEQ ID NO: 2539457 - RNA, 12 nt, Human
ucauaaaugaag

SEQ ID NO: 2539458 - RNA, 21 nt, Human
ucauaagauauuuuucaugau

SEQ ID NO: 2539459 - RNA, 18 nt, Human
ucauaagauauuuuucau

SEQ ID NO: 2539460 - RNA, 19 nt, Human
ucauaagacuuugggauag

SEQ ID NO: 2539461 - RNA, 17 nt, Human
ucauaacuuucauuaaa

SEQ ID NO: 2539462 - RNA, 18 nt, Human
ucauaaauaaaguuuguu

SEQ ID NO: 2539463 - RNA, 11 nt, Human
ucauaaaugaa

SEQ ID NO: 2539464 - RNA, 24 nt, Human
ucauaaagcaggcagaacucaucu

SEQ ID NO: 2539465 - RNA, 21 nt, Human
ucauaaacaacuuaauguucu

SEQ ID NO: 2539466 - RNA, 18 nt, Human
ucaguuuguccuguagag

SEQ ID NO: 2539467 - RNA, 16 nt, Human
ucauaaaccuuaagua

SEQ ID NO: 2539468 - RNA, 13 nt, Human
ucauaaacugugu

SEQ ID NO: 2539469 - RNA, 14 nt, Human
ucauaaacugugug

SEQ ID NO: 2539470 - RNA, 15 nt, Human
ucauaaacugugugc

SEQ ID NO: 2539471 - RNA, 16 nt, Human
ucauaaacugugugca

SEQ ID NO: 2539472 - RNA, 16 nt, Human
ucagguucuccuugau

SEQ ID NO: 2539473 - RNA, 14 nt, Human
ucagguuccauccc

SEQ ID NO: 2539474 - RNA, 23 nt, Human
ucagguuaucgaaauaacaaugu

SEQ ID NO: 2539475 - RNA, 21 nt, Human
ucagguuaucgaaauaacaau

SEQ ID NO: 2539476 - RNA, 20 nt, Human
ucagguuaucgaaauaacaa

SEQ ID NO: 2539477 - RNA, 19 nt, Human
ucagguuaucgaaauaaca

SEQ ID NO: 2539478 - RNA, 22 nt, Human
ucagguugcugguugcugugug

SEQ ID NO: 2539479 - RNA, 21 nt, Human
ucagguugcugguugcugugu

SEQ ID NO: 2539480 - RNA, 20 nt, Human
ucagguugcugguugcugug

SEQ ID NO: 2539481 - RNA, 19 nt, Human
ucagguugcugguugcugu

SEQ ID NO: 2539482 - RNA, 17 nt, Human
ucagguugcugguugcu

SEQ ID NO: 2539483 - RNA, 15 nt, Human
ucagguugcugguug

SEQ ID NO: 2539484 - RNA, 18 nt, Human
ucagguucuuagugucac

SEQ ID NO: 2539485 - RNA, 17 nt, Human
accgaaacagcgcuggg

SEQ ID NO: 2539486 - RNA, 18 nt, Human
ucagguuaucgaaauaac

SEQ ID NO: 2539487 - RNA, 14 nt, Human
ucagguguugccaa

SEQ ID NO: 2539488 - RNA, 12 nt, Human
accgaaacagcg

SEQ ID NO: 2539489 - RNA, 22 nt, Human
ucaggugucccugcacuugcag

SEQ ID NO: 2539490 - RNA, 14 nt, Human
ucagguuuuguaaa

SEQ ID NO: 2539491 - RNA, 13 nt, Human
ucagguuuuguaa

SEQ ID NO: 2539492 - RNA, 22 nt, Human
ucagguugucugaagucacugc

SEQ ID NO: 2539493 - RNA, 23 nt, Human
ucagguugcugguugcugugugg

SEQ ID NO: 2539494 - RNA, 17 nt, Human
ucagguuguaguaaaga

SEQ ID NO: 2539495 - RNA, 19 nt, Human
ucagguuguaguaaagaaa

SEQ ID NO: 2539496 - RNA, 20 nt, Human
ucagguuguaguaaagaaau

SEQ ID NO: 2539497 - RNA, 17 nt, Human
ucagguuugaguagagg

SEQ ID NO: 2539498 - RNA, 17 nt, Human
ucagguuugccugaggg

SEQ ID NO: 2539499 - RNA, 13 nt, Human
ucagguuuggggu

SEQ ID NO: 2539500 - RNA, 18 nt, Human
ucagguuugccugagggc

SEQ ID NO: 2539501 - RNA, 18 nt, Human
ucaguaccuggaggagga

SEQ ID NO: 2539502 - RNA, 16 nt, Human
ucaguaccuggaggag

SEQ ID NO: 2539503 - RNA, 15 nt, Human
ucaguaccuggagga

SEQ ID NO: 2539504 - RNA, 14 nt, Human
ucaguaccuggagg

SEQ ID NO: 2539505 - RNA, 13 nt, Human
ucaguaccuggag

SEQ ID NO: 2539506 - RNA, 23 nt, Human
ucaguaggugcccagaauaaguu

SEQ ID NO: 2539507 - RNA, 23 nt, Human
ucaguagaaacucuacauaauuu

SEQ ID NO: 2539508 - RNA, 14 nt, Human
ucaguaauuugagg

SEQ ID NO: 2539509 - RNA, 15 nt, Human
ucaguaauuugagga

SEQ ID NO: 2539510 - RNA, 17 nt, Human
ucaguaauuugaggaca

SEQ ID NO: 2539511 - RNA, 18 nt, Human
ucaguaauuugaggacaa

SEQ ID NO: 2539512 - RNA, 19 nt, Human
ucaguacccucucagcucc

SEQ ID NO: 2539513 - RNA, 17 nt, Human
ucaguacccucucagcu

SEQ ID NO: 2539514 - RNA, 16 nt, Human
ucaguacccucucagc

SEQ ID NO: 2539515 - RNA, 13 nt, Human
ucaguaauaacuc

SEQ ID NO: 2539516 - RNA, 14 nt, Human
ucaguaauauuuau

SEQ ID NO: 2539517 - RNA, 19 nt, Human
ucaguaauaaacuguguuu

SEQ ID NO: 2539518 - RNA, 17 nt, Human
ucaguaaguaucuggag

SEQ ID NO: 2539519 - RNA, 22 nt, Human
ucaguaagacgacaaggaaagg

SEQ ID NO: 2539520 - RNA, 21 nt, Human
ucaguaagacgacaaggaaag

SEQ ID NO: 2539521 - RNA, 13 nt, Human
ucaguaagacgac

SEQ ID NO: 2539522 - RNA, 19 nt, Human
ucaguaagaaaaagaagaa

SEQ ID NO: 2539523 - RNA, 17 nt, Human
ucaguaagaaaaagaag

SEQ ID NO: 2539524 - RNA, 21 nt, Human
ucaguaacuuacccuuaggga

SEQ ID NO: 2539525 - RNA, 13 nt, Human
ucaguaagccgug

SEQ ID NO: 2539526 - RNA, 22 nt, Human
accgaaaacguggcugcuucaa

SEQ ID NO: 2539527 - RNA, 21 nt, Human
accgaaaacguggcugcuuca

SEQ ID NO: 2539528 - RNA, 22 nt, Human
ucagguggggucacucuggcag

SEQ ID NO: 2539529 - RNA, 18 nt, Human
ucaggugucccugcacuu

SEQ ID NO: 2539530 - RNA, 17 nt, Human
ucaggugucccugcacu

SEQ ID NO: 2539531 - RNA, 23 nt, Human
ucagguggggucacucuggcagc

SEQ ID NO: 2539532 - RNA, 15 nt, Human
ucaggugucccugca

SEQ ID NO: 2539533 - RNA, 20 nt, Human
accgaaaacguggcugcuuc

SEQ ID NO: 2539534 - RNA, 18 nt, Human
acccuuggacuugaggau

SEQ ID NO: 2539535 - RNA, 21 nt, Human
acccuuggaggcugucuucuc

SEQ ID NO: 2539536 - RNA, 11 nt, Human
acccuuggccu

SEQ ID NO: 2539537 - RNA, 12 nt, Human
acccuuggccug

SEQ ID NO: 2539538 - RNA, 17 nt, Human
acccuuggcuugcccac

SEQ ID NO: 2539539 - RNA, 17 nt, Human
acccuuggcucaauccu

SEQ ID NO: 2539540 - RNA, 13 nt, Human
acccuuggccugu

SEQ ID NO: 2539541 - RNA, 17 nt, Human
acccuuggccugucuca

SEQ ID NO: 2539542 - RNA, 15 nt, Human
acccuuggacuugag

SEQ ID NO: 2539543 - RNA, 13 nt, Human
acccuuggacuug

SEQ ID NO: 2539544 - RNA, 17 nt, Human
acccuggaccagugguc

SEQ ID NO: 2539545 - RNA, 20 nt, Human
acccuggaccaguggucuca

SEQ ID NO: 2539546 - RNA, 20 nt, Human
acccuugccgucuaccugag

SEQ ID NO: 2539547 - RNA, 17 nt, Human
acccugcguggggacag

SEQ ID NO: 2539548 - RNA, 16 nt, Human
acccugcguggggaca

SEQ ID NO: 2539549 - RNA, 15 nt, Human
acccugcguggggac

SEQ ID NO: 2539550 - RNA, 17 nt, Human
acccuggaaaaugaauc

SEQ ID NO: 2539551 - RNA, 19 nt, Human
ucaggguuggccccugccc

SEQ ID NO: 2539552 - RNA, 18 nt, Human
ucaggguuggccccugcc

SEQ ID NO: 2539553 - RNA, 19 nt, Human
ucagguaaucgaccugccu

SEQ ID NO: 2539554 - RNA, 20 nt, Human
ucagguaaucgaccugccuc

SEQ ID NO: 2539555 - RNA, 18 nt, Human
ucagguaaucgaccugcc

SEQ ID NO: 2539556 - RNA, 23 nt, Human
ucaggguuggccccugcccggcu

SEQ ID NO: 2539557 - RNA, 19 nt, Human
acccgcuaagagggaggga

SEQ ID NO: 2539558 - RNA, 23 nt, Human
acccgccucucccgucagggccc

SEQ ID NO: 2539559 - RNA, 21 nt, Human
acccgccucucccgucagggc

SEQ ID NO: 2539560 - RNA, 18 nt, Human
acccgccucucccgucag

SEQ ID NO: 2539561 - RNA, 13 nt, Human
acccgccucuccc

SEQ ID NO: 2539562 - RNA, 21 nt, Human
ucagguaaucgaccugccucg

SEQ ID NO: 2539563 - RNA, 23 nt, Human
ucaggggucgucaccaccucucc

SEQ ID NO: 2539564 - RNA, 15 nt, Human
ucagguauguugccu

SEQ ID NO: 2539565 - RNA, 16 nt, Human
ucagguauguugccuu

SEQ ID NO: 2539566 - RNA, 13 nt, Human
ucagguagcugcc

SEQ ID NO: 2539567 - RNA, 19 nt, Human
ucagguaguugcaauugaa

SEQ ID NO: 2539568 - RNA, 18 nt, Human
ucaggccaggcccucugc

SEQ ID NO: 2539569 - RNA, 17 nt, Human
ucaggccaggcccucug

SEQ ID NO: 2539570 - RNA, 20 nt, Human
ucagggggguugugaggccu

SEQ ID NO: 2539571 - RNA, 19 nt, Human
ucaggccaggcccucugcc

SEQ ID NO: 2539572 - RNA, 12 nt, Human
ucaggggugugc

SEQ ID NO: 2539573 - RNA, 19 nt, Human
ucaggggugugcggccuuu

SEQ ID NO: 2539574 - RNA, 23 nt, Human
ucaggggugugcggccuuuggcu

SEQ ID NO: 2539575 - RNA, 17 nt, Human
ucaggguuggccccugc

SEQ ID NO: 2539576 - RNA, 16 nt, Human
ucaggccaggcccucu

SEQ ID NO: 2539577 - RNA, 15 nt, Human
ucaggccaggcccuc

SEQ ID NO: 2539578 - RNA, 14 nt, Human
ucaggccaggcccu

SEQ ID NO: 2539579 - RNA, 13 nt, Human
ucaggccaggccc

SEQ ID NO: 2539580 - RNA, 14 nt, Human
ucaggccagcugcu

SEQ ID NO: 2539581 - RNA, 12 nt, Human
ucaggccaggcc

SEQ ID NO: 2539582 - RNA, 13 nt, Human
ucaggccagcugc

SEQ ID NO: 2539583 - RNA, 17 nt, Human
ucaggccaccugccccc

SEQ ID NO: 2539584 - RNA, 19 nt, Human
ucaggccaccugcccccuu

SEQ ID NO: 2539585 - RNA, 21 nt, Human
ucaggccaccugcccccuucu

SEQ ID NO: 2539586 - RNA, 16 nt, Human
ucaggccacggcagcc

SEQ ID NO: 2539587 - RNA, 14 nt, Human
ucaggccacggcag

SEQ ID NO: 2539588 - RNA, 13 nt, Human
ucaggccacuuga

SEQ ID NO: 2539589 - RNA, 17 nt, Human
ucaggccacggcagccu

SEQ ID NO: 2539590 - RNA, 17 nt, Human
ucaggcaggugggaugg

SEQ ID NO: 2539591 - RNA, 13 nt, Human
ucaggcagcucaa

SEQ ID NO: 2539592 - RNA, 13 nt, Human
ucaggcaggaagg

SEQ ID NO: 2539593 - RNA, 21 nt, Human
ucaggcaggaagggcaggaag

SEQ ID NO: 2539594 - RNA, 18 nt, Human
ucaggcaggugggaugga

SEQ ID NO: 2539595 - RNA, 22 nt, Human
acccccagcacccgggcucagg

SEQ ID NO: 2539596 - RNA, 15 nt, Human
ucaggcauaggccug

SEQ ID NO: 2539597 - RNA, 16 nt, Human
ucaggcauaggccugg

SEQ ID NO: 2539598 - RNA, 17 nt, Human
ucaggcauaggccuggg

SEQ ID NO: 2539599 - RNA, 21 nt, Human
acccccagcacccgggcucag

SEQ ID NO: 2539600 - RNA, 18 nt, Human
acccccagcacccgggcu

SEQ ID NO: 2539601 - RNA, 13 nt, Human
acccccagccugc

SEQ ID NO: 2539602 - RNA, 12 nt, Human
acccccagccug

SEQ ID NO: 2539603 - RNA, 11 nt, Human
acccccagcaa

SEQ ID NO: 2539604 - RNA, 13 nt, Human
acccccagcaacc

SEQ ID NO: 2539605 - RNA, 13 nt, Human
acccccagcaccc

SEQ ID NO: 2539606 - RNA, 16 nt, Human
acccccagcaacccuc

SEQ ID NO: 2539607 - RNA, 21 nt, Human
acccccacucucauuccccag

SEQ ID NO: 2539608 - RNA, 22 nt, Human
acccccacucucauuccccagg

SEQ ID NO: 2539609 - RNA, 23 nt, Human
acccuccuguugcacccagcccu

SEQ ID NO: 2539610 - RNA, 22 nt, Human
acccuccuguugcacccagccc

SEQ ID NO: 2539611 - RNA, 21 nt, Human
acccuccuguugcacccagcc

SEQ ID NO: 2539612 - RNA, 20 nt, Human
acccuccuguugcacccagc

SEQ ID NO: 2539613 - RNA, 24 nt, Human
acccuccuguugcacccagcccug

SEQ ID NO: 2539614 - RNA, 21 nt, Human
acccuccuuucaccacaugug

SEQ ID NO: 2539615 - RNA, 19 nt, Human
acccuccuguugcacccag

SEQ ID NO: 2539616 - RNA, 11 nt, Human
acccuccuguu

SEQ ID NO: 2539617 - RNA, 23 nt, Human
acccuccugucuucccaggguag

SEQ ID NO: 2539618 - RNA, 21 nt, Human
acccuccugucuucccagggu

SEQ ID NO: 2539619 - RNA, 23 nt, Human
acccucccuccgauccuuccucc

SEQ ID NO: 2539620 - RNA, 22 nt, Human
acccucccuccgauccuuccuc

SEQ ID NO: 2539621 - RNA, 20 nt, Human
acccuccugucuucccaggg

SEQ ID NO: 2539622 - RNA, 16 nt, Human
acccucccuccgaucc

SEQ ID NO: 2539623 - RNA, 18 nt, Human
acccucccucagccccuc

SEQ ID NO: 2539624 - RNA, 19 nt, Human
acccucccucagccccucu

SEQ ID NO: 2539625 - RNA, 20 nt, Human
acccucccucagccccucuu

SEQ ID NO: 2539626 - RNA, 23 nt, Human
acccucccucagccccucuugcc

SEQ ID NO: 2539627 - RNA, 19 nt, Human
acccuccccucucuugcac

SEQ ID NO: 2539628 - RNA, 18 nt, Human
acccuccccucucuugca

SEQ ID NO: 2539629 - RNA, 14 nt, Human
acccuccccucucu

SEQ ID NO: 2539630 - RNA, 13 nt, Human
acccuccccucuc

SEQ ID NO: 2539631 - RNA, 12 nt, Human
acccuccccucu

SEQ ID NO: 2539632 - RNA, 13 nt, Human
acccuccccuccc

SEQ ID NO: 2539633 - RNA, 12 nt, Human
acccuccccucc

SEQ ID NO: 2539634 - RNA, 12 nt, Human
acccucccucag

SEQ ID NO: 2539635 - RNA, 14 nt, Human
acccucccucagcc

SEQ ID NO: 2539636 - RNA, 17 nt, Human
acccucccucagccccu

SEQ ID NO: 2539637 - RNA, 20 nt, Human
acccucaugcugugugacuc

SEQ ID NO: 2539638 - RNA, 17 nt, Human
acccucauucuacugaa

SEQ ID NO: 2539639 - RNA, 15 nt, Human
acccgggaggcagag

SEQ ID NO: 2539640 - RNA, 19 nt, Human
acccggaggccacaugagu

SEQ ID NO: 2539641 - RNA, 10 nt, Human
acccuccccc

SEQ ID NO: 2539642 - RNA, 23 nt, Human
acccuccccgcaccccccaagcu

SEQ ID NO: 2539643 - RNA, 23 nt, Human
acccucccccaggaggucgaccc

SEQ ID NO: 2539644 - RNA, 22 nt, Human
acccgggaagggggcugggaca

SEQ ID NO: 2539645 - RNA, 14 nt, Human
acccucauguucuu

SEQ ID NO: 2539646 - RNA, 15 nt, Human
acccucauguucuua

SEQ ID NO: 2539647 - RNA, 17 nt, Human
acccucauguucuuaau

SEQ ID NO: 2539648 - RNA, 20 nt, Human
acccgggaagggggcuggga

SEQ ID NO: 2539649 - RNA, 19 nt, Human
acccgggaagggggcuggg

SEQ ID NO: 2539650 - RNA, 15 nt, Human
acccggaggccacau

SEQ ID NO: 2539651 - RNA, 12 nt, Human
acccggaggcca

SEQ ID NO: 2539652 - RNA, 22 nt, Human
acccggagcuaacacuggcccc

SEQ ID NO: 2539653 - RNA, 23 nt, Human
acccggagcuaacacuggccccu

SEQ ID NO: 2539654 - RNA, 18 nt, Human
acccgcucaucacuggau

SEQ ID NO: 2539655 - RNA, 19 nt, Human
acccgccuuuuauaaaccu

SEQ ID NO: 2539656 - RNA, 16 nt, Human
acccgccuuuuauaaa

SEQ ID NO: 2539657 - RNA, 24 nt, Human
acccgccucucccgucagggccca

SEQ ID NO: 2539658 - RNA, 13 nt, Human
acccgcucuggac

SEQ ID NO: 2539659 - RNA, 12 nt, Human
acccgcucugga

SEQ ID NO: 2539660 - RNA, 15 nt, Human
acccgcucuggacca

SEQ ID NO: 2539661 - RNA, 16 nt, Human
acccgcuuucuugcug

SEQ ID NO: 2539662 - RNA, 21 nt, Human
acccugaggcccagagggccu

SEQ ID NO: 2539663 - RNA, 19 nt, Human
acccugaggcccagagggc

SEQ ID NO: 2539664 - RNA, 13 nt, Human
acccugaggccca

SEQ ID NO: 2539665 - RNA, 17 nt, Human
acccugaggcccagagg

SEQ ID NO: 2539666 - RNA, 11 nt, Human
acccugaggcc

SEQ ID NO: 2539667 - RNA, 17 nt, Human
acccugagccccuuccu

SEQ ID NO: 2539668 - RNA, 16 nt, Human
acccugagccccuucc

SEQ ID NO: 2539669 - RNA, 11 nt, Human
acccugagccc

SEQ ID NO: 2539670 - RNA, 17 nt, Human
acccugagcugaggcag

SEQ ID NO: 2539671 - RNA, 22 nt, Human
acccugagcugaggcagcagug

SEQ ID NO: 2539672 - RNA, 23 nt, Human
acccugagcugaggcagcagugu

SEQ ID NO: 2539673 - RNA, 21 nt, Human
acccucgaagcgcgccacucg

SEQ ID NO: 2539674 - RNA, 14 nt, Human
acccucgaggcgga

SEQ ID NO: 2539675 - RNA, 16 nt, Human
acccucgaagcgcgcc

SEQ ID NO: 2539676 - RNA, 20 nt, Human
acccucgaagcgcgccacuc

SEQ ID NO: 2539677 - RNA, 12 nt, Human
acccugccccug

SEQ ID NO: 2539678 - RNA, 13 nt, Human
acccugccccugc

SEQ ID NO: 2539679 - RNA, 14 nt, Human
acccugccuuaucu

SEQ ID NO: 2539680 - RNA, 18 nt, Human
acccugccuuaucuugca

SEQ ID NO: 2539681 - RNA, 18 nt, Human
acccugcgaaggggcccu

SEQ ID NO: 2539682 - RNA, 19 nt, Human
acccugcgaaggggcccug

SEQ ID NO: 2539683 - RNA, 20 nt, Human
acccugcgaaggggcccugg

SEQ ID NO: 2539684 - RNA, 22 nt, Human
acccugcgaaggggcccugguc

SEQ ID NO: 2539685 - RNA, 22 nt, Human
acccugcgcccaguccuuccac

SEQ ID NO: 2539686 - RNA, 22 nt, Human
acccugauuuaggagaagccag

SEQ ID NO: 2539687 - RNA, 23 nt, Human
acccugauuuaggagaagccagg

SEQ ID NO: 2539688 - RNA, 20 nt, Human
acccugauuuaggagaagcc

SEQ ID NO: 2539689 - RNA, 18 nt, Human
acccugcaaaggacuguu

SEQ ID NO: 2539690 - RNA, 23 nt, Human
acccugaggcccagagggccugc

SEQ ID NO: 2539691 - RNA, 14 nt, Human
ucaccagcugccuc

SEQ ID NO: 2539692 - RNA, 21 nt, Human
ucacuauguugcccaggcagg

SEQ ID NO: 2539693 - RNA, 15 nt, Human
ucaccagcuccuccc

SEQ ID NO: 2539694 - RNA, 19 nt, Human
ucaccagcccggccugcuc

SEQ ID NO: 2539695 - RNA, 13 nt, Human
ucaccagcuccuc

SEQ ID NO: 2539696 - RNA, 22 nt, Human
ucaccagccccagugcccacag

SEQ ID NO: 2539697 - RNA, 18 nt, Human
ucacuauuuuuauuuaua

SEQ ID NO: 2539698 - RNA, 17 nt, Human
ucacuauuuccuuuaua

SEQ ID NO: 2539699 - RNA, 15 nt, Human
ucacuauuuccuuua

SEQ ID NO: 2539700 - RNA, 13 nt, Human
ucacuauuuccuu

SEQ ID NO: 2539701 - RNA, 18 nt, Human
ucacuauucaaguauuag

SEQ ID NO: 2539702 - RNA, 19 nt, Human
ucacuauuuccuuuauaau

SEQ ID NO: 2539703 - RNA, 18 nt, Human
ucacuauuuccuuuauaa

SEQ ID NO: 2539704 - RNA, 20 nt, Human
ucacuauuuuuauuuauauu

SEQ ID NO: 2539705 - RNA, 17 nt, Human
ucacucauacaucuggc

SEQ ID NO: 2539706 - RNA, 13 nt, Human
ucacucauugcug

SEQ ID NO: 2539707 - RNA, 14 nt, Human
ucacucagauggaa

SEQ ID NO: 2539708 - RNA, 21 nt, Human
ucacugaacuuugcugagccu

SEQ ID NO: 2539709 - RNA, 18 nt, Human
ucacugaaaacaucugga

SEQ ID NO: 2539710 - RNA, 20 nt, Human
ucacugaaaacaucuggaag

SEQ ID NO: 2539711 - RNA, 17 nt, Human
ucacugaaaacaucugg

SEQ ID NO: 2539712 - RNA, 20 nt, Human
ucacucuuguggauguuuua

SEQ ID NO: 2539713 - RNA, 21 nt, Human
ucacucuuguggauguuuuaa

SEQ ID NO: 2539714 - RNA, 14 nt, Human
ucacuccagccugg

SEQ ID NO: 2539715 - RNA, 23 nt, Human
ucacugagacagcccgggcucug

SEQ ID NO: 2539716 - RNA, 16 nt, Human
ucacugaaggccuggc

SEQ ID NO: 2539717 - RNA, 14 nt, Human
ucacucuuggagcc

SEQ ID NO: 2539718 - RNA, 16 nt, Human
ucacucuuggagccug

SEQ ID NO: 2539719 - RNA, 17 nt, Human
ucacucuuggagccugc

SEQ ID NO: 2539720 - RNA, 18 nt, Human
ucacucuuggagccugca

SEQ ID NO: 2539721 - RNA, 15 nt, Human
ucacucauugcugag

SEQ ID NO: 2539722 - RNA, 17 nt, Human
ucacucauugcugagcc

SEQ ID NO: 2539723 - RNA, 18 nt, Human
ucacucauugcugagccu

SEQ ID NO: 2539724 - RNA, 19 nt, Human
ucacucauugcugagccuc

SEQ ID NO: 2539725 - RNA, 20 nt, Human
ucacucauugcugagccucu

SEQ ID NO: 2539726 - RNA, 22 nt, Human
ucacucauugcugagccucugc

SEQ ID NO: 2539727 - RNA, 13 nt, Human
ucacuccaccacc

SEQ ID NO: 2539728 - RNA, 14 nt, Human
ucacuccaccaccc

SEQ ID NO: 2539729 - RNA, 15 nt, Human
ucacuccaccaccca

SEQ ID NO: 2539730 - RNA, 16 nt, Human
ucacuccaccacccaa

SEQ ID NO: 2539731 - RNA, 18 nt, Human
ucacugcaaccucugccu

SEQ ID NO: 2539732 - RNA, 21 nt, Human
ucacugcaaccuucgccaccu

SEQ ID NO: 2539733 - RNA, 18 nt, Human
ucacugcaaccuccgccu

SEQ ID NO: 2539734 - RNA, 18 nt, Human
ucacuguugaaaauuauu

SEQ ID NO: 2539735 - RNA, 15 nt, Human
ucacuguugaaaauu

SEQ ID NO: 2539736 - RNA, 22 nt, Human
ucacuguucuauucaucucaag

SEQ ID NO: 2539737 - RNA, 22 nt, Human
ucacuguucccucugcuccugg

SEQ ID NO: 2539738 - RNA, 21 nt, Human
ucacuguucccucugcuccug

SEQ ID NO: 2539739 - RNA, 20 nt, Human
ucacuguucccucugcuccu

SEQ ID NO: 2539740 - RNA, 19 nt, Human
ucacuguucccucugcucc

SEQ ID NO: 2539741 - RNA, 18 nt, Human
ucacuguucccucugcuc

SEQ ID NO: 2539742 - RNA, 14 nt, Human
ucacuguugcccag

SEQ ID NO: 2539743 - RNA, 17 nt, Human
ucacuguucccucugcu

SEQ ID NO: 2539744 - RNA, 18 nt, Human
ucacugcaagcuccgccu

SEQ ID NO: 2539745 - RNA, 18 nt, Human
ucacugcaacuucugccu

SEQ ID NO: 2539746 - RNA, 17 nt, Human
ucacugcaacuucugcc

SEQ ID NO: 2539747 - RNA, 16 nt, Human
ucacuuaauugcuaca

SEQ ID NO: 2539748 - RNA, 22 nt, Human
ucacuuacuguuucugucagga

SEQ ID NO: 2539749 - RNA, 19 nt, Human
ucacuuacuguuucuguca

SEQ ID NO: 2539750 - RNA, 21 nt, Human
ucacuuaggaaauggcuuugu

SEQ ID NO: 2539751 - RNA, 16 nt, Human
ucacuuacuguuucug

SEQ ID NO: 2539752 - RNA, 15 nt, Human
ucacuuacuguuucu

SEQ ID NO: 2539753 - RNA, 17 nt, Human
ucacuuaccuagauuua

SEQ ID NO: 2539754 - RNA, 15 nt, Human
ucacuguugcccagg

SEQ ID NO: 2539755 - RNA, 20 nt, Human
ucacuguugaaaauuauuuu

SEQ ID NO: 2539756 - RNA, 19 nt, Human
ucacuguugaaaauuauuu

SEQ ID NO: 2539757 - RNA, 20 nt, Human
ucacuguuucucugcuguug

SEQ ID NO: 2539758 - RNA, 19 nt, Human
ucacuuccauacagcucua

SEQ ID NO: 2539759 - RNA, 18 nt, Human
ucacuuccauacagcucu

SEQ ID NO: 2539760 - RNA, 20 nt, Human
ucacuucaucuucucagcuc

SEQ ID NO: 2539761 - RNA, 19 nt, Human
ucacuucaucuucucagcu

SEQ ID NO: 2539762 - RNA, 22 nt, Human
ucacuucgcgugcccucgcugc

SEQ ID NO: 2539763 - RNA, 22 nt, Human
ucacuuccauacagcucuacgu

SEQ ID NO: 2539764 - RNA, 17 nt, Human
ucacuuccuacaagagc

SEQ ID NO: 2539765 - RNA, 23 nt, Human
ucacuucgcgugcccucgcugcu

SEQ ID NO: 2539766 - RNA, 16 nt, Human
ucacuucgugggaucu

SEQ ID NO: 2539767 - RNA, 13 nt, Human
ucacuucuaaaug

SEQ ID NO: 2539768 - RNA, 16 nt, Human
ucacuucuaaaugcau

SEQ ID NO: 2539769 - RNA, 12 nt, Human
ucacuucuccca

SEQ ID NO: 2539770 - RNA, 17 nt, Human
ucacuucugaccacacu

SEQ ID NO: 2539771 - RNA, 15 nt, Human
ucacuucaucuucuc

SEQ ID NO: 2539772 - RNA, 14 nt, Human
ucacuucaucuucu

SEQ ID NO: 2539773 - RNA, 16 nt, Human
ucacuucauaauccag

SEQ ID NO: 2539774 - RNA, 17 nt, Human
ucacuuauauguucuaa

SEQ ID NO: 2539775 - RNA, 19 nt, Human
ucacuuaucccaagagaau

SEQ ID NO: 2539776 - RNA, 15 nt, Human
ucacuucacccugga

SEQ ID NO: 2539777 - RNA, 16 nt, Human
acccaaauguucauca

SEQ ID NO: 2539778 - RNA, 20 nt, Human
acccaaauguucaucaauga

SEQ ID NO: 2539779 - RNA, 17 nt, Human
acccaaauccucuccag

SEQ ID NO: 2539780 - RNA, 15 nt, Human
acccaaauccucucc

SEQ ID NO: 2539781 - RNA, 14 nt, Human
acccaaauccucuc

SEQ ID NO: 2539782 - RNA, 18 nt, Human
acccaaagaccaauauuc

SEQ ID NO: 2539783 - RNA, 18 nt, Human
acccaaagagguauuuau

SEQ ID NO: 2539784 - RNA, 19 nt, Human
accauguuugagcucagac

SEQ ID NO: 2539785 - RNA, 22 nt, Human
acccagaugggggaaagcacag

SEQ ID NO: 2539786 - RNA, 14 nt, Human
acccagauccucac

SEQ ID NO: 2539787 - RNA, 21 nt, Human
acccagauaaagguucaugca

SEQ ID NO: 2539788 - RNA, 16 nt, Human
acccacuucccugggc

SEQ ID NO: 2539789 - RNA, 21 nt, Human
acccacuggacucaccucccc

SEQ ID NO: 2539790 - RNA, 14 nt, Human
acccacuggacuca

SEQ ID NO: 2539791 - RNA, 17 nt, Human
acccacuggacucaccu

SEQ ID NO: 2539792 - RNA, 20 nt, Human
acccacugcuuuuggucugu

SEQ ID NO: 2539793 - RNA, 21 nt, Human
accauucuccaccugccaggg

SEQ ID NO: 2539794 - RNA, 20 nt, Human
accauucuccaccugccagg

SEQ ID NO: 2539795 - RNA, 19 nt, Human
accauucuccaccugccag

SEQ ID NO: 2539796 - RNA, 16 nt, Human
accaugugccugaucc

SEQ ID NO: 2539797 - RNA, 18 nt, Human
accauguuggccaggcug

SEQ ID NO: 2539798 - RNA, 23 nt, Human
accauuuugcugucccuuuuccu

SEQ ID NO: 2539799 - RNA, 21 nt, Human
accauuuugggguacccacug

SEQ ID NO: 2539800 - RNA, 22 nt, Human
accauuuugcugucccuuuucc

SEQ ID NO: 2539801 - RNA, 21 nt, Human
accauucugacucgguuucuc

SEQ ID NO: 2539802 - RNA, 13 nt, Human
accauucugacuc

SEQ ID NO: 2539803 - RNA, 12 nt, Human
accauguuugag

SEQ ID NO: 2539804 - RNA, 16 nt, Human
accauggagacaagaa

SEQ ID NO: 2539805 - RNA, 15 nt, Human
accauggcugaagga

SEQ ID NO: 2539806 - RNA, 15 nt, Human
accauggccagccaa

SEQ ID NO: 2539807 - RNA, 18 nt, Human
accaugucagcaaaaagc

SEQ ID NO: 2539808 - RNA, 15 nt, Human
accaugucagcaaaa

SEQ ID NO: 2539809 - RNA, 15 nt, Human
accaugucacugugg

SEQ ID NO: 2539810 - RNA, 20 nt, Human
accaugggaccaggucuugg

SEQ ID NO: 2539811 - RNA, 12 nt, Human
accaugggacca

SEQ ID NO: 2539812 - RNA, 23 nt, Human
accauggcugaaggaaaccagug

SEQ ID NO: 2539813 - RNA, 13 nt, Human
accaugucacugu

SEQ ID NO: 2539814 - RNA, 21 nt, Human
accaugucagcaaaaagcaaa

SEQ ID NO: 2539815 - RNA, 19 nt, Human
accaugucagcaaaaagca

SEQ ID NO: 2539816 - RNA, 22 nt, Human
accaugucagcaaaaagcaaaa

SEQ ID NO: 2539817 - RNA, 13 nt, Human
accaugugccuga

SEQ ID NO: 2539818 - RNA, 17 nt, Human
accagggguuucucgca

SEQ ID NO: 2539819 - RNA, 16 nt, Human
accagggguuucucgc

SEQ ID NO: 2539820 - RNA, 14 nt, Human
accagggguuucuc

SEQ ID NO: 2539821 - RNA, 17 nt, Human
ucacuucugagaacuca

SEQ ID NO: 2539822 - RNA, 18 nt, Human
ucacuucugaccacacuu

SEQ ID NO: 2539823 - RNA, 20 nt, Human
accaggguugaccccagagg

SEQ ID NO: 2539824 - RNA, 21 nt, Human
accaggguugaccccagagga

SEQ ID NO: 2539825 - RNA, 16 nt, Human
accaggucuuggagcu

SEQ ID NO: 2539826 - RNA, 20 nt, Human
accaggucuccuccaccgcc

SEQ ID NO: 2539827 - RNA, 19 nt, Human
accaggucuccuccaccgc

SEQ ID NO: 2539828 - RNA, 24 nt, Human
accaggggugauuucagagagggc

SEQ ID NO: 2539829 - RNA, 14 nt, Human
accagguugaaaga

SEQ ID NO: 2539830 - RNA, 20 nt, Human
accagguguucuacacucau

SEQ ID NO: 2539831 - RNA, 23 nt, Human
accagguguucuacacucaucuu

SEQ ID NO: 2539832 - RNA, 22 nt, Human
accaggucuuggagcugagccu

SEQ ID NO: 2539833 - RNA, 19 nt, Human
accagguguucuacacuca

SEQ ID NO: 2539834 - RNA, 16 nt, Human
accaugcaaaugcuau

SEQ ID NO: 2539835 - RNA, 14 nt, Human
accaugcagagcgc

SEQ ID NO: 2539836 - RNA, 18 nt, Human
accaguaauugugaaaau

SEQ ID NO: 2539837 - RNA, 20 nt, Human
accaugcucaucugcugguc

SEQ ID NO: 2539838 - RNA, 19 nt, Human
accaugcucaucugcuggu

SEQ ID NO: 2539839 - RNA, 20 nt, Human
accaugcccggcuaauuuuu

SEQ ID NO: 2539840 - RNA, 17 nt, Human
acccagggccugcagga

SEQ ID NO: 2539841 - RNA, 13 nt, Human
acccagggguggg

SEQ ID NO: 2539842 - RNA, 23 nt, Human
acccaggugcuaggaacacuccu

SEQ ID NO: 2539843 - RNA, 11 nt, Human
acccaggugcu

SEQ ID NO: 2539844 - RNA, 22 nt, Human
accccagcuggggccaggcugg

SEQ ID NO: 2539845 - RNA, 19 nt, Human
accccagcuggggccaggc

SEQ ID NO: 2539846 - RNA, 13 nt, Human
accccagcggcug

SEQ ID NO: 2539847 - RNA, 14 nt, Human
accccagcucccua

SEQ ID NO: 2539848 - RNA, 17 nt, Human
accccagcucccuagga

SEQ ID NO: 2539849 - RNA, 10 nt, Human
accccagcug

SEQ ID NO: 2539850 - RNA, 12 nt, Human
accccagcuggg

SEQ ID NO: 2539851 - RNA, 11 nt, Human
accccagcugg

SEQ ID NO: 2539852 - RNA, 23 nt, Human
accccagcucccuaggagaccaa

SEQ ID NO: 2539853 - RNA, 17 nt, Human
accccagcugggaggca

SEQ ID NO: 2539854 - RNA, 15 nt, Human
accccagcugggagg

SEQ ID NO: 2539855 - RNA, 14 nt, Human
accccagcugggag

SEQ ID NO: 2539856 - RNA, 13 nt, Human
accccagcuggga

SEQ ID NO: 2539857 - RNA, 20 nt, Human
accccagcugggaggcaaga

SEQ ID NO: 2539858 - RNA, 11 nt, Human
accccagggcc

SEQ ID NO: 2539859 - RNA, 13 nt, Human
accccagggccug

SEQ ID NO: 2539860 - RNA, 14 nt, Human
accccagggccuga

SEQ ID NO: 2539861 - RNA, 15 nt, Human
accccagggccugag

SEQ ID NO: 2539862 - RNA, 16 nt, Human
accccaguggccacuc

SEQ ID NO: 2539863 - RNA, 17 nt, Human
accccagggccugagcc

SEQ ID NO: 2539864 - RNA, 24 nt, Human
accccagggccugagccuggccag

SEQ ID NO: 2539865 - RNA, 13 nt, Human
accccagguuucu

SEQ ID NO: 2539866 - RNA, 15 nt, Human
acccccacccccagc

SEQ ID NO: 2539867 - RNA, 14 nt, Human
acccccacccccag

SEQ ID NO: 2539868 - RNA, 16 nt, Human
acccccacccccacca

SEQ ID NO: 2539869 - RNA, 16 nt, Human
accccaguucugcucc

SEQ ID NO: 2539870 - RNA, 17 nt, Human
acccccaccccacacuu

SEQ ID NO: 2539871 - RNA, 15 nt, Human
accccaguucugcuc

SEQ ID NO: 2539872 - RNA, 23 nt, Human
accccaguggccacucagcuucc

SEQ ID NO: 2539873 - RNA, 19 nt, Human
accccaguggccacucagc

SEQ ID NO: 2539874 - RNA, 17 nt, Human
accccaguggccacuca

SEQ ID NO: 2539875 - RNA, 15 nt, Human
acccccaccccacac

SEQ ID NO: 2539876 - RNA, 16 nt, Human
acccccaccccacacu

SEQ ID NO: 2539877 - RNA, 19 nt, Human
acccccacccccagcucaa

SEQ ID NO: 2539878 - RNA, 18 nt, Human
acccccacccccagcuca

SEQ ID NO: 2539879 - RNA, 13 nt, Human
acccccaccccuu

SEQ ID NO: 2539880 - RNA, 14 nt, Human
acccccaccccuuc

SEQ ID NO: 2539881 - RNA, 15 nt, Human
acccccaccccuucc

SEQ ID NO: 2539882 - RNA, 20 nt, Human
acccccaccccuuccccacu

SEQ ID NO: 2539883 - RNA, 17 nt, Human
acccccaccccuugcuc

SEQ ID NO: 2539884 - RNA, 16 nt, Human
acccccaccccuugcu

SEQ ID NO: 2539885 - RNA, 11 nt, Human
acccccacccu

SEQ ID NO: 2539886 - RNA, 12 nt, Human
acccccacccuu

SEQ ID NO: 2539887 - RNA, 15 nt, Human
acccccacuccagcu

SEQ ID NO: 2539888 - RNA, 13 nt, Human
acccccacucuca

SEQ ID NO: 2539889 - RNA, 17 nt, Human
acccccacucucauucc

SEQ ID NO: 2539890 - RNA, 18 nt, Human
acccccacucucauuccc

SEQ ID NO: 2539891 - RNA, 17 nt, Human
acccagcgagcccuggu

SEQ ID NO: 2539892 - RNA, 16 nt, Human
acccagcgagcccugg

SEQ ID NO: 2539893 - RNA, 13 nt, Human
acccagcgagccc

SEQ ID NO: 2539894 - RNA, 23 nt, Human
acccagccucaguccuccccuca

SEQ ID NO: 2539895 - RNA, 22 nt, Human
acccagccucaguccuccccuc

SEQ ID NO: 2539896 - RNA, 23 nt, Human
ucagcccuaggguggagagccac

SEQ ID NO: 2539897 - RNA, 15 nt, Human
acccaggagccccga

SEQ ID NO: 2539898 - RNA, 23 nt, Human
acccaggagcauccaccuccuuc

SEQ ID NO: 2539899 - RNA, 22 nt, Human
acccaggagcauccaccuccuu

SEQ ID NO: 2539900 - RNA, 15 nt, Human
acccagggccugcag

SEQ ID NO: 2539901 - RNA, 23 nt, Human
acccaggacuuauuuaaacucug

SEQ ID NO: 2539902 - RNA, 23 nt, Human
acccaggagauggaaguugcagu

SEQ ID NO: 2539903 - RNA, 18 nt, Human
acccaggacgcuucugaa

SEQ ID NO: 2539904 - RNA, 15 nt, Human
acccagccuguuuua

SEQ ID NO: 2539905 - RNA, 13 nt, Human
acccaggagcccc

SEQ ID NO: 2539906 - RNA, 15 nt, Human
ucagauuuccagucu

SEQ ID NO: 2539907 - RNA, 17 nt, Human
ucagauuuccagucucc

SEQ ID NO: 2539908 - RNA, 19 nt, Human
ucagccccuccucugccac

SEQ ID NO: 2539909 - RNA, 20 nt, Human
ucagccccuccucugccacc

SEQ ID NO: 2539910 - RNA, 21 nt, Human
ucagccccuccucugccaccu

SEQ ID NO: 2539911 - RNA, 22 nt, Human
ucagccccuccucugccaccuc

SEQ ID NO: 2539912 - RNA, 23 nt, Human
ucagccccuccucugccaccucc

SEQ ID NO: 2539913 - RNA, 11 nt, Human
ucagccccucu

SEQ ID NO: 2539914 - RNA, 12 nt, Human
ucagccccucuu

SEQ ID NO: 2539915 - RNA, 22 nt, Human
ucagccccugauccugugaagu

SEQ ID NO: 2539916 - RNA, 14 nt, Human
ucagccccugaucc

SEQ ID NO: 2539917 - RNA, 19 nt, Human
ucagcccuaggguggagag

SEQ ID NO: 2539918 - RNA, 20 nt, Human
ucagccccucuugcccccca

SEQ ID NO: 2539919 - RNA, 21 nt, Human
ucagccccucuugccccccac

SEQ ID NO: 2539920 - RNA, 22 nt, Human
ucagccccucuugccccccacc

SEQ ID NO: 2539921 - RNA, 23 nt, Human
ucagccccucuugccccccaccc

SEQ ID NO: 2539922 - RNA, 15 nt, Human
ucagauugcauguga

SEQ ID NO: 2539923 - RNA, 16 nt, Human
ucagauugcaugugac

SEQ ID NO: 2539924 - RNA, 17 nt, Human
ucagauugcaugugacu

SEQ ID NO: 2539925 - RNA, 18 nt, Human
ucagauugcaugugacuc

SEQ ID NO: 2539926 - RNA, 19 nt, Human
ucagauugcaugugacucu

SEQ ID NO: 2539927 - RNA, 21 nt, Human
ucagauugcaugugacucuga

SEQ ID NO: 2539928 - RNA, 22 nt, Human
ucagauugcaugugacucugaa

SEQ ID NO: 2539929 - RNA, 14 nt, Human
ucagauugcaugug

SEQ ID NO: 2539930 - RNA, 23 nt, Human
ucagauggaaccgcaggaagcug

SEQ ID NO: 2539931 - RNA, 21 nt, Human
ucagauucccagagcaaaaua

SEQ ID NO: 2539932 - RNA, 22 nt, Human
ucagauucccagagcaaaauaa

SEQ ID NO: 2539933 - RNA, 19 nt, Human
ucagauucccagagcaaaa

SEQ ID NO: 2539934 - RNA, 21 nt, Human
ucagauggaaccgcaggaagc

SEQ ID NO: 2539935 - RNA, 22 nt, Human
ucagauggaaccgcaggaagcu

SEQ ID NO: 2539936 - RNA, 20 nt, Human
ucagauggaaccgcaggaag

SEQ ID NO: 2539937 - RNA, 20 nt, Human
ucagagccgugguccuuugg

SEQ ID NO: 2539938 - RNA, 15 nt, Human
ucagaucucuaacuu

SEQ ID NO: 2539939 - RNA, 16 nt, Human
ucagaucucuaacuuc

SEQ ID NO: 2539940 - RNA, 23 nt, Human
ucagaucugacaugauuccuucc

SEQ ID NO: 2539941 - RNA, 21 nt, Human
ucagaugcugugcaaauguua

SEQ ID NO: 2539942 - RNA, 13 nt, Human
ucagaugcuucug

SEQ ID NO: 2539943 - RNA, 14 nt, Human
ucagaugcuucugg

SEQ ID NO: 2539944 - RNA, 18 nt, Human
ucagaugcuucugggaga

SEQ ID NO: 2539945 - RNA, 22 nt, Human
ucagaugcccagagggcccagg

SEQ ID NO: 2539946 - RNA, 21 nt, Human
ucagaugcccagagggcccag

SEQ ID NO: 2539947 - RNA, 14 nt, Human
ucagagcagggguc

SEQ ID NO: 2539948 - RNA, 16 nt, Human
ucagagccgugguccu

SEQ ID NO: 2539949 - RNA, 22 nt, Human
ucagagaugcaccaccaagcca

SEQ ID NO: 2539950 - RNA, 17 nt, Human
ucagagaugugcaccca

SEQ ID NO: 2539951 - RNA, 16 nt, Human
ucagagcaaauuuggg

SEQ ID NO: 2539952 - RNA, 21 nt, Human
ucagagcagcagugaaaacaa

SEQ ID NO: 2539953 - RNA, 20 nt, Human
ucagagcagcagugaaaaca

SEQ ID NO: 2539954 - RNA, 17 nt, Human
ucagagcagcagugaaa

SEQ ID NO: 2539955 - RNA, 21 nt, Human
ucagagccaccccuaaagaga

SEQ ID NO: 2539956 - RNA, 23 nt, Human
ucagagacuccugcaggcagcca

SEQ ID NO: 2539957 - RNA, 12 nt, Human
ucagagagcagc

SEQ ID NO: 2539958 - RNA, 15 nt, Human
ucagagacugcugug

SEQ ID NO: 2539959 - RNA, 14 nt, Human
ucagagagaguguu

SEQ ID NO: 2539960 - RNA, 21 nt, Human
ucagagaugcaccaccaagcc

SEQ ID NO: 2539961 - RNA, 16 nt, Human
ucagagaugcaccacc

SEQ ID NO: 2539962 - RNA, 17 nt, Human
ucagagaggagucagag

SEQ ID NO: 2539963 - RNA, 20 nt, Human
ucagagaggagucagagaga

SEQ ID NO: 2539964 - RNA, 22 nt, Human
ucagagagcgagcgcuacccac

SEQ ID NO: 2539965 - RNA, 13 nt, Human
ucagagagcuggu

SEQ ID NO: 2539966 - RNA, 14 nt, Human
ucagagagcuggua

SEQ ID NO: 2539967 - RNA, 16 nt, Human
ucagagagcugguagu

SEQ ID NO: 2539968 - RNA, 22 nt, Human
ucagagacuccugcaggcagcc

SEQ ID NO: 2539969 - RNA, 14 nt, Human
ucagagacucaggg

SEQ ID NO: 2539970 - RNA, 17 nt, Human
ucagagacucagggccc

SEQ ID NO: 2539971 - RNA, 19 nt, Human
ucagagacucagggcccca

SEQ ID NO: 2539972 - RNA, 20 nt, Human
ucagagacucagggccccag

SEQ ID NO: 2539973 - RNA, 15 nt, Human
ucagagaccauugca

SEQ ID NO: 2539974 - RNA, 23 nt, Human
ucagagacaggaagucuucaggg

SEQ ID NO: 2539975 - RNA, 20 nt, Human
ucagagacaggaagucuuca

SEQ ID NO: 2539976 - RNA, 23 nt, Human
ucagagaauuucuaccauuucag

SEQ ID NO: 2539977 - RNA, 13 nt, Human
ucagagaauuucu

SEQ ID NO: 2539978 - RNA, 20 nt, Human
ucagaauucucagaaucuca

SEQ ID NO: 2539979 - RNA, 10 nt, Human
ucagaauucu

SEQ ID NO: 2539980 - RNA, 12 nt, Human
ucagaauucuca

SEQ ID NO: 2539981 - RNA, 23 nt, Human
ucagaaguuucugccgcagcccu

SEQ ID NO: 2539982 - RNA, 15 nt, Human
acccagcccacuucu

SEQ ID NO: 2539983 - RNA, 19 nt, Human
acccagccaucugcccagg

SEQ ID NO: 2539984 - RNA, 18 nt, Human
acccagccaucugcccag

SEQ ID NO: 2539985 - RNA, 15 nt, Human
acccagccaucugcc

SEQ ID NO: 2539986 - RNA, 13 nt, Human
acccagccaucug

SEQ ID NO: 2539987 - RNA, 19 nt, Human
acccagauuuugcuguaua

SEQ ID NO: 2539988 - RNA, 20 nt, Human
acccagauuuugcuguauau

SEQ ID NO: 2539989 - RNA, 17 nt, Human
acccagcaacuccaacu

SEQ ID NO: 2539990 - RNA, 21 nt, Human
acccagccaucugcccagggg

SEQ ID NO: 2539991 - RNA, 20 nt, Human
acccagccaucugcccaggg

SEQ ID NO: 2539992 - RNA, 17 nt, Human
ucagaaguuuggcaaua

SEQ ID NO: 2539993 - RNA, 21 nt, Human
ucagaauagccacauuuggaa

SEQ ID NO: 2539994 - RNA, 16 nt, Human
ucagaauagaaauuag

SEQ ID NO: 2539995 - RNA, 19 nt, Human
ucagaaucacuucugagaa

SEQ ID NO: 2539996 - RNA, 17 nt, Human
ucagaaucacuucugag

SEQ ID NO: 2539997 - RNA, 22 nt, Human
ucagaauagccacauuuggaau

SEQ ID NO: 2539998 - RNA, 23 nt, Human
ucagaauagccacauuuggaaua

SEQ ID NO: 2539999 - RNA, 14 nt, Human
ucagaaucuaccca

SEQ ID NO: 2540000 - RNA, 22 nt, Human
ucagaauccaagugaacacuag

SEQ ID NO: 2540001 - RNA, 19 nt, Human
ucagaaucuacccaaagga

SEQ ID NO: 2540002 - RNA, 21 nt, Human
ucguauagcuguauugaauca

SEQ ID NO: 2540003 - RNA, 17 nt, Human
ucguauagcuguauuga

SEQ ID NO: 2540004 - RNA, 15 nt, Human
ucguacaguucuucg

SEQ ID NO: 2540005 - RNA, 14 nt, Human
ucguacaguucuuc

SEQ ID NO: 2540006 - RNA, 12 nt, Human
ucguagcuuucc

SEQ ID NO: 2540007 - RNA, 22 nt, Human
ucguagcuuucccaaauaaacu

SEQ ID NO: 2540008 - RNA, 21 nt, Human
ucguauaacacaauaugaaua

SEQ ID NO: 2540009 - RNA, 15 nt, Human
ucguacagaaagcug

SEQ ID NO: 2540010 - RNA, 16 nt, Human
ucguacagaaagcugc

SEQ ID NO: 2540011 - RNA, 20 nt, Human
ucguaaccagccagauccuc

SEQ ID NO: 2540012 - RNA, 16 nt, Human
ucggggcaugcugggg

SEQ ID NO: 2540013 - RNA, 17 nt, Human
ucggggcaugcuggggc

SEQ ID NO: 2540014 - RNA, 18 nt, Human
ucggggcaugcuggggca

SEQ ID NO: 2540015 - RNA, 19 nt, Human
ucggggagaggcugaggac

SEQ ID NO: 2540016 - RNA, 13 nt, Human
ucgggcugugccc

SEQ ID NO: 2540017 - RNA, 17 nt, Human
ucgggcuccugugcccu

SEQ ID NO: 2540018 - RNA, 16 nt, Human
ucgggcuccugugccc

SEQ ID NO: 2540019 - RNA, 15 nt, Human
ucggggaacuccugg

SEQ ID NO: 2540020 - RNA, 16 nt, Human
ucggggaacuccugga

SEQ ID NO: 2540021 - RNA, 12 nt, Human
ucgggcugugcc

SEQ ID NO: 2540022 - RNA, 14 nt, Human
ucgggcuccugugc

SEQ ID NO: 2540023 - RNA, 15 nt, Human
ucgggcuccugugcc

SEQ ID NO: 2540024 - RNA, 23 nt, Human
ucgggagcagugucuuccauaau

SEQ ID NO: 2540025 - RNA, 13 nt, Human
ucgggagcagugu

SEQ ID NO: 2540026 - RNA, 14 nt, Human
ucgggagcaguguc

SEQ ID NO: 2540027 - RNA, 15 nt, Human
ucgggagcagugucu

SEQ ID NO: 2540028 - RNA, 16 nt, Human
ucgggagcagugucuu

SEQ ID NO: 2540029 - RNA, 16 nt, Human
ucgggaggcugagaca

SEQ ID NO: 2540030 - RNA, 19 nt, Human
ucgggagcagugucuucca

SEQ ID NO: 2540031 - RNA, 22 nt, Human
ucgggagcagugucuuccauaa

SEQ ID NO: 2540032 - RNA, 22 nt, Human
ucuaaaaugccucaguguauuu

SEQ ID NO: 2540033 - RNA, 21 nt, Human
ucuaaaaugccucaguguauu

SEQ ID NO: 2540034 - RNA, 16 nt, Human
ucguuucaaaaacaca

SEQ ID NO: 2540035 - RNA, 12 nt, Human
ucguuucaaaaa

SEQ ID NO: 2540036 - RNA, 19 nt, Human
ucguuuauuuucaagaaua

SEQ ID NO: 2540037 - RNA, 15 nt, Human
ucguuuacuaugccu

SEQ ID NO: 2540038 - RNA, 14 nt, Human
ucuaaacauuaauc

SEQ ID NO: 2540039 - RNA, 13 nt, Human
ucuaaacauuaau

SEQ ID NO: 2540040 - RNA, 16 nt, Human
ucuaaacccaauccaa

SEQ ID NO: 2540041 - RNA, 19 nt, Human
ucuaaacccaauccaaaug

SEQ ID NO: 2540042 - RNA, 19 nt, Human
ucuaaacaagauuuuaaag

SEQ ID NO: 2540043 - RNA, 18 nt, Human
ucuaaacaagaaucaguc

SEQ ID NO: 2540044 - RNA, 20 nt, Human
ucuaaacaaugcugauuugg

SEQ ID NO: 2540045 - RNA, 12 nt, Human
ucguugugaggg

SEQ ID NO: 2540046 - RNA, 16 nt, Human
ucguugacuuuaggga

SEQ ID NO: 2540047 - RNA, 17 nt, Human
ucguugacuuuagggac

SEQ ID NO: 2540048 - RNA, 21 nt, Human
ucguucuguuuacaucaguuu

SEQ ID NO: 2540049 - RNA, 19 nt, Human
ucguucuguuuacaucagu

SEQ ID NO: 2540050 - RNA, 11 nt, Human
ucguucugugg

SEQ ID NO: 2540051 - RNA, 15 nt, Human
ucguucuguuuacau

SEQ ID NO: 2540052 - RNA, 13 nt, Human
ucguucucugccu

SEQ ID NO: 2540053 - RNA, 23 nt, Human
ucgucacugcuuaacuucacaua

SEQ ID NO: 2540054 - RNA, 15 nt, Human
ucguuauguguguau

SEQ ID NO: 2540055 - RNA, 19 nt, Human
ucguuaguaucuaacaugu

SEQ ID NO: 2540056 - RNA, 16 nt, Human
ucgggacaccugcccu

SEQ ID NO: 2540057 - RNA, 20 nt, Human
ucgggaauacuagggagaag

SEQ ID NO: 2540058 - RNA, 24 nt, Human
ucgggaagagaggaguucaaugau

SEQ ID NO: 2540059 - RNA, 23 nt, Human
ucgggaagagaggaguucaauga

SEQ ID NO: 2540060 - RNA, 22 nt, Human
ucgggaagagaggaguucaaug

SEQ ID NO: 2540061 - RNA, 21 nt, Human
ucgggaagagaggaguucaau

SEQ ID NO: 2540062 - RNA, 20 nt, Human
ucgggaagagaggaguucaa

SEQ ID NO: 2540063 - RNA, 16 nt, Human
ucgggaagagaggagu

SEQ ID NO: 2540064 - RNA, 21 nt, Human
ucgggagacagcaucaggguu

SEQ ID NO: 2540065 - RNA, 16 nt, Human
ucgggagacagcauca

SEQ ID NO: 2540066 - RNA, 20 nt, Human
ucgggacaccugcccugccc

SEQ ID NO: 2540067 - RNA, 19 nt, Human
ucgggacaccugcccugcc

SEQ ID NO: 2540068 - RNA, 15 nt, Human
ucgggaagagaggag

SEQ ID NO: 2540069 - RNA, 12 nt, Human
ucgggaagagag

SEQ ID NO: 2540070 - RNA, 16 nt, Human
ucgggaaccucacucu

SEQ ID NO: 2540071 - RNA, 15 nt, Human
ucgggaaccucacuc

SEQ ID NO: 2540072 - RNA, 15 nt, Human
ucgggaacaguguuu

SEQ ID NO: 2540073 - RNA, 21 nt, Human
acuguuaauaguucagguaac

SEQ ID NO: 2540074 - RNA, 18 nt, Human
acuguguuucaaguucaa

SEQ ID NO: 2540075 - RNA, 20 nt, Human
acuguuaaauugcuguguau

SEQ ID NO: 2540076 - RNA, 16 nt, Human
acuguuaaaggaaaaa

SEQ ID NO: 2540077 - RNA, 17 nt, Human
acuguuaauaguucagg

SEQ ID NO: 2540078 - RNA, 14 nt, Human
acuguguuucaagu

SEQ ID NO: 2540079 - RNA, 15 nt, Human
acuguguuucaaguu

SEQ ID NO: 2540080 - RNA, 15 nt, Human
acuguguuccuggca

SEQ ID NO: 2540081 - RNA, 14 nt, Human
acuguguguugcca

SEQ ID NO: 2540082 - RNA, 19 nt, Human
acuguguguugccacagga

SEQ ID NO: 2540083 - RNA, 20 nt, Human
acuguguguugccacaggac

SEQ ID NO: 2540084 - RNA, 22 nt, Human
acuguguguugccacaggacac

SEQ ID NO: 2540085 - RNA, 14 nt, Human
acuguguucauuag

SEQ ID NO: 2540086 - RNA, 12 nt, Human
acuguguuccug

SEQ ID NO: 2540087 - RNA, 12 nt, Human
acuguccugggc

SEQ ID NO: 2540088 - RNA, 20 nt, Human
acuguccugcuccacagugu

SEQ ID NO: 2540089 - RNA, 19 nt, Human
acuguccugcuccacagug

SEQ ID NO: 2540090 - RNA, 18 nt, Human
acuguccugcuccacagu

SEQ ID NO: 2540091 - RNA, 22 nt, Human
acuguggaggaaggauuguaaa

SEQ ID NO: 2540092 - RNA, 14 nt, Human
acuguccugggccu

SEQ ID NO: 2540093 - RNA, 17 nt, Human
acuguccugcuccacag

SEQ ID NO: 2540094 - RNA, 16 nt, Human
acuguccugcuccaca

SEQ ID NO: 2540095 - RNA, 13 nt, Human
acuguccugcucc

SEQ ID NO: 2540096 - RNA, 12 nt, Human
acuguccugcuc

SEQ ID NO: 2540097 - RNA, 10 nt, Human
acuguccugc

SEQ ID NO: 2540098 - RNA, 17 nt, Human
acuguggccguuaucug

SEQ ID NO: 2540099 - RNA, 23 nt, Human
acuguggaggaaggauuguaaaa

SEQ ID NO: 2540100 - RNA, 15 nt, Human
acuguggcacacgcc

SEQ ID NO: 2540101 - RNA, 12 nt, Human
acuguggcugcu

SEQ ID NO: 2540102 - RNA, 20 nt, Human
acuguggccguuaucuggaa

SEQ ID NO: 2540103 - RNA, 19 nt, Human
acuguggcugcuagcacuu

SEQ ID NO: 2540104 - RNA, 20 nt, Human
acuguguguggaggagucca

SEQ ID NO: 2540105 - RNA, 15 nt, Human
acugugugugugaau

SEQ ID NO: 2540106 - RNA, 16 nt, Human
acugugugugugaaug

SEQ ID NO: 2540107 - RNA, 18 nt, Human
acugugugugugaaugaa

SEQ ID NO: 2540108 - RNA, 22 nt, Human
acugugugugugaaugaacacu

SEQ ID NO: 2540109 - RNA, 13 nt, Human
acuguggguagac

SEQ ID NO: 2540110 - RNA, 20 nt, Human
acugugggaaggccagcugc

SEQ ID NO: 2540111 - RNA, 23 nt, Human
acuguggccguuaucuggaagua

SEQ ID NO: 2540112 - RNA, 22 nt, Human
acuguggggugugcacaucucu

SEQ ID NO: 2540113 - RNA, 17 nt, Human
ucuaccaaaaaucucaa

SEQ ID NO: 2540114 - RNA, 15 nt, Human
ucuacccauauuaca

SEQ ID NO: 2540115 - RNA, 22 nt, Human
ucuacaucuuuuuucacaaauu

SEQ ID NO: 2540116 - RNA, 19 nt, Human
ucuacaucuuuuuucacaa

SEQ ID NO: 2540117 - RNA, 17 nt, Human
ucuacaucuucugccuu

SEQ ID NO: 2540118 - RNA, 16 nt, Human
ucuacaucuucugccu

SEQ ID NO: 2540119 - RNA, 23 nt, Human
ucuacauacuuucauccugacuc

SEQ ID NO: 2540120 - RNA, 15 nt, Human
ucuacauauucuuua

SEQ ID NO: 2540121 - RNA, 15 nt, Human
ucuacaucuucugcc

SEQ ID NO: 2540122 - RNA, 16 nt, Human
ucuacauauucuuuaa

SEQ ID NO: 2540123 - RNA, 15 nt, Human
ucuaccccuuacuua

SEQ ID NO: 2540124 - RNA, 14 nt, Human
ucuacauuucuuag

SEQ ID NO: 2540125 - RNA, 21 nt, Human
ucuacccucuuagaaaaacca

SEQ ID NO: 2540126 - RNA, 18 nt, Human
ucuacccucccacccccu

SEQ ID NO: 2540127 - RNA, 15 nt, Human
ucuacccucccaccc

SEQ ID NO: 2540128 - RNA, 16 nt, Human
ucuacccucccacccc

SEQ ID NO: 2540129 - RNA, 13 nt, Human
ucuaagucuuucc

SEQ ID NO: 2540130 - RNA, 14 nt, Human
ucuaagucuuucca

SEQ ID NO: 2540131 - RNA, 13 nt, Human
ucuaagugauaua

SEQ ID NO: 2540132 - RNA, 16 nt, Human
ucuaaguauuugaaac

SEQ ID NO: 2540133 - RNA, 19 nt, Human
ucuaagucaauccaagagu

SEQ ID NO: 2540134 - RNA, 17 nt, Human
ucuaaguuccacugagc

SEQ ID NO: 2540135 - RNA, 21 nt, Human
ucuaagauucauccauuuauu

SEQ ID NO: 2540136 - RNA, 14 nt, Human
ucuaagcagcauuu

SEQ ID NO: 2540137 - RNA, 14 nt, Human
ucuaagccugaagg

SEQ ID NO: 2540138 - RNA, 15 nt, Human
ucuaagccugaaggg

SEQ ID NO: 2540139 - RNA, 16 nt, Human
ucuaagccugaagggg

SEQ ID NO: 2540140 - RNA, 17 nt, Human
ucuaagccuuuccauaa

SEQ ID NO: 2540141 - RNA, 21 nt, Human
ucuaagauaguaacaaugaag

SEQ ID NO: 2540142 - RNA, 12 nt, Human
ucuaagagaagu

SEQ ID NO: 2540143 - RNA, 20 nt, Human
ucuaagagaacaaugugcua

SEQ ID NO: 2540144 - RNA, 13 nt, Human
ucuaaacugcccc

SEQ ID NO: 2540145 - RNA, 16 nt, Human
ucuaaacugcccccuc

SEQ ID NO: 2540146 - RNA, 22 nt, Human
ucuaaacugcccccucugcccu

SEQ ID NO: 2540147 - RNA, 23 nt, Human
ucuaaacugcccccucugcccug

SEQ ID NO: 2540148 - RNA, 21 nt, Human
ucuaaacuggauucacagcuc

SEQ ID NO: 2540149 - RNA, 14 nt, Human
ucuaaacugcauua

SEQ ID NO: 2540150 - RNA, 17 nt, Human
ucuaaacauuaaucaau

SEQ ID NO: 2540151 - RNA, 17 nt, Human
ucuaaacuuccccaucu

SEQ ID NO: 2540152 - RNA, 20 nt, Human
ucuaaagaguuuauuuuaag

SEQ ID NO: 2540153 - RNA, 13 nt, Human
ucuaaaggcuacc

SEQ ID NO: 2540154 - RNA, 16 nt, Human
ucuaaaggcuaccuuu

SEQ ID NO: 2540155 - RNA, 17 nt, Human
ucuaaagcugccagccg

SEQ ID NO: 2540156 - RNA, 21 nt, Human
ucuaaagaguuuauuuuaaga

SEQ ID NO: 2540157 - RNA, 21 nt, Human
acuggggccuacagcuuugau

SEQ ID NO: 2540158 - RNA, 12 nt, Human
acuggggccucc

SEQ ID NO: 2540159 - RNA, 13 nt, Human
acuggggccucca

SEQ ID NO: 2540160 - RNA, 16 nt, Human
acuggggccuccagaa

SEQ ID NO: 2540161 - RNA, 21 nt, Human
acugggcugaacacuccaauu

SEQ ID NO: 2540162 - RNA, 13 nt, Human
acugggcugaggg

SEQ ID NO: 2540163 - RNA, 14 nt, Human
acugggcugaggga

SEQ ID NO: 2540164 - RNA, 17 nt, Human
acugggcugagggagcc

SEQ ID NO: 2540165 - RNA, 21 nt, Human
acugggcuuggggaccagagc

SEQ ID NO: 2540166 - RNA, 15 nt, Human
acuggguacuugugg

SEQ ID NO: 2540167 - RNA, 19 nt, Human
acuggggugccgccugccc

SEQ ID NO: 2540168 - RNA, 15 nt, Human
acuggggugccgccu

SEQ ID NO: 2540169 - RNA, 19 nt, Human
acuggggguugcgggggga

SEQ ID NO: 2540170 - RNA, 18 nt, Human
acugggguccuggggccu

SEQ ID NO: 2540171 - RNA, 20 nt, Human
acugggguccuggggccucg

SEQ ID NO: 2540172 - RNA, 15 nt, Human
acuggggcuggcaca

SEQ ID NO: 2540173 - RNA, 14 nt, Human
acuggggcugaagg

SEQ ID NO: 2540174 - RNA, 17 nt, Human
acuggggccuccagaac

SEQ ID NO: 2540175 - RNA, 16 nt, Human
acuggggcuggcacaa

SEQ ID NO: 2540176 - RNA, 13 nt, Human
acuggggggcuug

SEQ ID NO: 2540177 - RNA, 13 nt, Human
acugggggagggg

SEQ ID NO: 2540178 - RNA, 19 nt, Human
ucgcugaugcugggcuggg

SEQ ID NO: 2540179 - RNA, 18 nt, Human
ucgcugaugcugggcugg

SEQ ID NO: 2540180 - RNA, 17 nt, Human
ucgcugaugcugggcug

SEQ ID NO: 2540181 - RNA, 16 nt, Human
ucgcugaugcugggcu

SEQ ID NO: 2540182 - RNA, 22 nt, Human
ucgcugaugcugggcugggugc

SEQ ID NO: 2540183 - RNA, 20 nt, Human
ucgcugaugcugggcugggu

SEQ ID NO: 2540184 - RNA, 19 nt, Human
ucgcugccagcucuguauc

SEQ ID NO: 2540185 - RNA, 11 nt, Human
ucgcugcugcg

SEQ ID NO: 2540186 - RNA, 20 nt, Human
ucgcugccagcucuguauca

SEQ ID NO: 2540187 - RNA, 20 nt, Human
ucgcuggacucucagucucu

SEQ ID NO: 2540188 - RNA, 22 nt, Human
ucgcuggacucucagucucuga

SEQ ID NO: 2540189 - RNA, 19 nt, Human
ucgcugauauauguguuuu

SEQ ID NO: 2540190 - RNA, 14 nt, Human
ucgcugaugcuggg

SEQ ID NO: 2540191 - RNA, 22 nt, Human
ucgcugauauauguguuuuuca

SEQ ID NO: 2540192 - RNA, 22 nt, Human
ucgcucugucacccaggcugga

SEQ ID NO: 2540193 - RNA, 18 nt, Human
ucgcucugucacccaggc

SEQ ID NO: 2540194 - RNA, 21 nt, Human
ucgcucuguugcccaggcugg

SEQ ID NO: 2540195 - RNA, 23 nt, Human
ucgcugugucagcauagaaguaa

SEQ ID NO: 2540196 - RNA, 16 nt, Human
ucgcugucacaggcgg

SEQ ID NO: 2540197 - RNA, 23 nt, Human
ucgcuggacucucagucucugag

SEQ ID NO: 2540198 - RNA, 16 nt, Human
acugggcugaacacuc

SEQ ID NO: 2540199 - RNA, 16 nt, Human
acugggcccugccucu

SEQ ID NO: 2540200 - RNA, 13 nt, Human
acugggcccugcc

SEQ ID NO: 2540201 - RNA, 16 nt, Human
ucgcugugguuguuuu

SEQ ID NO: 2540202 - RNA, 15 nt, Human
ucgccuggccugagg

SEQ ID NO: 2540203 - RNA, 14 nt, Human
ucgccuggccugag

SEQ ID NO: 2540204 - RNA, 22 nt, Human
ucgccugacaaccacuggucug

SEQ ID NO: 2540205 - RNA, 21 nt, Human
ucgccugacaaccacuggucu

SEQ ID NO: 2540206 - RNA, 20 nt, Human
ucgccugacaaccacugguc

SEQ ID NO: 2540207 - RNA, 11 nt, Human
ucgccugacaa

SEQ ID NO: 2540208 - RNA, 17 nt, Human
ucgccguugaagaggaa

SEQ ID NO: 2540209 - RNA, 23 nt, Human
ucgcucugcuggccuggccggca

SEQ ID NO: 2540210 - RNA, 21 nt, Human
ucgcucugcuggccuggccgg

SEQ ID NO: 2540211 - RNA, 20 nt, Human
ucgcucugcuggccuggccg

SEQ ID NO: 2540212 - RNA, 17 nt, Human
ucgcucugcuggccugg

SEQ ID NO: 2540213 - RNA, 15 nt, Human
ucgcucugcuggccu

SEQ ID NO: 2540214 - RNA, 12 nt, Human
ucgccuguaauc

SEQ ID NO: 2540215 - RNA, 14 nt, Human
ucgcuccugugucu

SEQ ID NO: 2540216 - RNA, 15 nt, Human
ucgccgucugugaau

SEQ ID NO: 2540217 - RNA, 14 nt, Human
ucgccguggcugcg

SEQ ID NO: 2540218 - RNA, 23 nt, Human
ucgcccgcccacuguccugggcg

SEQ ID NO: 2540219 - RNA, 14 nt, Human
ucgcccucccaggc

SEQ ID NO: 2540220 - RNA, 18 nt, Human
ucgcccuggacugugugc

SEQ ID NO: 2540221 - RNA, 22 nt, Human
ucgcccgcccacuguccugggc

SEQ ID NO: 2540222 - RNA, 21 nt, Human
ucgcccgcccacuguccuggg

SEQ ID NO: 2540223 - RNA, 13 nt, Human
ucgcccucccagg

SEQ ID NO: 2540224 - RNA, 17 nt, Human
ucgcccucccaggcucu

SEQ ID NO: 2540225 - RNA, 20 nt, Human
ucgcccgcccacuguccugg

SEQ ID NO: 2540226 - RNA, 19 nt, Human
ucgcccgcccacuguccug

SEQ ID NO: 2540227 - RNA, 18 nt, Human
ucgcccgcccacuguccu

SEQ ID NO: 2540228 - RNA, 17 nt, Human
ucgcccgcccacugucc

SEQ ID NO: 2540229 - RNA, 15 nt, Human
ucgcccgcccacugu

SEQ ID NO: 2540230 - RNA, 13 nt, Human
ucgcccgcccacu

SEQ ID NO: 2540231 - RNA, 11 nt, Human
ucgcccgccca

SEQ ID NO: 2540232 - RNA, 20 nt, Human
ucgccccagaucaccagccc

SEQ ID NO: 2540233 - RNA, 18 nt, Human
ucgccccagaucaccagc

SEQ ID NO: 2540234 - RNA, 14 nt, Human
ucgccccagcaggu

SEQ ID NO: 2540235 - RNA, 13 nt, Human
ucgcccccaccuc

SEQ ID NO: 2540236 - RNA, 22 nt, Human
ucgccccagaucaccagcccgg

SEQ ID NO: 2540237 - RNA, 20 nt, Human
ucgccccagcaggugcugac

SEQ ID NO: 2540238 - RNA, 12 nt, Human
acugaagccugc

SEQ ID NO: 2540239 - RNA, 14 nt, Human
acugaagccugcag

SEQ ID NO: 2540240 - RNA, 15 nt, Human
acugaagccugcagg

SEQ ID NO: 2540241 - RNA, 15 nt, Human
ucgccccagaucacc

SEQ ID NO: 2540242 - RNA, 16 nt, Human
acugaagccugcagga

SEQ ID NO: 2540243 - RNA, 14 nt, Human
acugaagcagccuc

SEQ ID NO: 2540244 - RNA, 13 nt, Human
acugaagcagccu

SEQ ID NO: 2540245 - RNA, 21 nt, Human
acugaagcagccucuccccag

SEQ ID NO: 2540246 - RNA, 18 nt, Human
acugaagccagaaauaaa

SEQ ID NO: 2540247 - RNA, 22 nt, Human
acugaagaagcaccaaucauga

SEQ ID NO: 2540248 - RNA, 17 nt, Human
acugaaauauacacaca

SEQ ID NO: 2540249 - RNA, 22 nt, Human
acugaacaaacuaucagaggaa

SEQ ID NO: 2540250 - RNA, 13 nt, Human
acugaaagguuac

SEQ ID NO: 2540251 - RNA, 15 nt, Human
acugaaauauacaca

SEQ ID NO: 2540252 - RNA, 16 nt, Human
acugaaauauacacac

SEQ ID NO: 2540253 - RNA, 18 nt, Human
acuggguacuuguggaca

SEQ ID NO: 2540254 - RNA, 17 nt, Human
acuggguacuuguggac

SEQ ID NO: 2540255 - RNA, 16 nt, Human
acuguacaaaguagaa

SEQ ID NO: 2540256 - RNA, 22 nt, Human
acuguacaaaguagaagucuua

SEQ ID NO: 2540257 - RNA, 19 nt, Human
acuguacaugaaaacacau

SEQ ID NO: 2540258 - RNA, 16 nt, Human
acuguacaugaaaaca

SEQ ID NO: 2540259 - RNA, 18 nt, Human
acuguacagacagaaaaa

SEQ ID NO: 2540260 - RNA, 20 nt, Human
acuguacaugaaaacacauu

SEQ ID NO: 2540261 - RNA, 21 nt, Human
acuguacaugaaaacacauuu

SEQ ID NO: 2540262 - RNA, 15 nt, Human
acuguacuugcucuu

SEQ ID NO: 2540263 - RNA, 22 nt, Human
acuguacaaugacuuuauugca

SEQ ID NO: 2540264 - RNA, 15 nt, Human
acuguacuccuccca

SEQ ID NO: 2540265 - RNA, 20 nt, Human
acuguacuccucccaggcgc

SEQ ID NO: 2540266 - RNA, 14 nt, Human
acuguaucaugaca

SEQ ID NO: 2540267 - RNA, 23 nt, Human
acuguacuugcucuugaugccug

SEQ ID NO: 2540268 - RNA, 15 nt, Human
acuguacuucacugu

SEQ ID NO: 2540269 - RNA, 13 nt, Human
acuguacuucacu

SEQ ID NO: 2540270 - RNA, 16 nt, Human
acuguacuucacuguc

SEQ ID NO: 2540271 - RNA, 17 nt, Human
acuguacuuaauaaauu

SEQ ID NO: 2540272 - RNA, 18 nt, Human
acuguacuuaauaaauuc

SEQ ID NO: 2540273 - RNA, 22 nt, Human
acugucagcuccccucggagaa

SEQ ID NO: 2540274 - RNA, 23 nt, Human
acugucagcuccccucggagaag

SEQ ID NO: 2540275 - RNA, 17 nt, Human
acugucacccuccaccu

SEQ ID NO: 2540276 - RNA, 15 nt, Human
acugucacccuccac

SEQ ID NO: 2540277 - RNA, 21 nt, Human
acugucaaggcugcuuagaau

SEQ ID NO: 2540278 - RNA, 22 nt, Human
acugucaaggcugcuuagaauc

SEQ ID NO: 2540279 - RNA, 14 nt, Human
acugucacucauug

SEQ ID NO: 2540280 - RNA, 15 nt, Human
acugucacucauugc

SEQ ID NO: 2540281 - RNA, 19 nt, Human
acugucaaaauaauuuuau

SEQ ID NO: 2540282 - RNA, 20 nt, Human
acugucaaggcugcuuagaa

SEQ ID NO: 2540283 - RNA, 14 nt, Human
acugucacccucca

SEQ ID NO: 2540284 - RNA, 14 nt, Human
acuguccagagagc

SEQ ID NO: 2540285 - RNA, 13 nt, Human
acuguccagagag

SEQ ID NO: 2540286 - RNA, 22 nt, Human
acugucaggaagaaaucacaga

SEQ ID NO: 2540287 - RNA, 14 nt, Human
acugucccucaaau

SEQ ID NO: 2540288 - RNA, 15 nt, Human
acuguccagagagca

SEQ ID NO: 2540289 - RNA, 13 nt, Human
acugucccucaaa

SEQ ID NO: 2540290 - RNA, 16 nt, Human
acugucaggaagaaau

SEQ ID NO: 2540291 - RNA, 12 nt, Human
acugucaggaag

SEQ ID NO: 2540292 - RNA, 13 nt, Human
acugucauagaaa

SEQ ID NO: 2540293 - RNA, 16 nt, Human
acuguccuccaagcca

SEQ ID NO: 2540294 - RNA, 18 nt, Human
acuguccuccaagccagc

SEQ ID NO: 2540295 - RNA, 21 nt, Human
acuguauuaagagugaaaauu

SEQ ID NO: 2540296 - RNA, 13 nt, Human
acuguauuaagag

SEQ ID NO: 2540297 - RNA, 12 nt, Human
acuguauugaug

SEQ ID NO: 2540298 - RNA, 11 nt, Human
acuguauggaa

SEQ ID NO: 2540299 - RNA, 13 nt, Human
acuguaugcugga

SEQ ID NO: 2540300 - RNA, 20 nt, Human
acuguauuugugacuaauug

SEQ ID NO: 2540301 - RNA, 17 nt, Human
acuguauuugugacuaa

SEQ ID NO: 2540302 - RNA, 16 nt, Human
acuguauuugugacua

SEQ ID NO: 2540303 - RNA, 15 nt, Human
acuguauuugugacu

SEQ ID NO: 2540304 - RNA, 14 nt, Human
acuguauuugugac

SEQ ID NO: 2540305 - RNA, 13 nt, Human
acuguauuuguga

SEQ ID NO: 2540306 - RNA, 14 nt, Human
acuguauuuguauc

SEQ ID NO: 2540307 - RNA, 13 nt, Human
acuguauuuguau

SEQ ID NO: 2540308 - RNA, 23 nt, Human
acuguauuugugacuaauuguau

SEQ ID NO: 2540309 - RNA, 22 nt, Human
acuguauuugugacuaauugua

SEQ ID NO: 2540310 - RNA, 21 nt, Human
acuguauuuuguauuguuuca

SEQ ID NO: 2540311 - RNA, 15 nt, Human
acugucaaaauaauu

SEQ ID NO: 2540312 - RNA, 23 nt, Human
acugucaaaaaguuugguucugu

SEQ ID NO: 2540313 - RNA, 20 nt, Human
acuguauuuuuaccuuuuuc

SEQ ID NO: 2540314 - RNA, 16 nt, Human
acuguaucaugacaaa

SEQ ID NO: 2540315 - RNA, 20 nt, Human
acuguaucaugacaaagacu

SEQ ID NO: 2540316 - RNA, 18 nt, Human
acuuagaucuccaggaga

SEQ ID NO: 2540317 - RNA, 21 nt, Human
acuuagaggaaauaagaaaaa

SEQ ID NO: 2540318 - RNA, 13 nt, Human
acuuagaggaaau

SEQ ID NO: 2540319 - RNA, 15 nt, Human
acuuauauuguaaga

SEQ ID NO: 2540320 - RNA, 17 nt, Human
acuuauauuguaagaaa

SEQ ID NO: 2540321 - RNA, 18 nt, Human
acuuauauuguaagaaau

SEQ ID NO: 2540322 - RNA, 19 nt, Human
acuuauauuguaagaaaua

SEQ ID NO: 2540323 - RNA, 20 nt, Human
acuuauauuguaagaaauac

SEQ ID NO: 2540324 - RNA, 21 nt, Human
acuuauauuguaagaaauacu

SEQ ID NO: 2540325 - RNA, 19 nt, Human
acuuaucauccacauuguu

SEQ ID NO: 2540326 - RNA, 22 nt, Human
acuuaucucucugugcugugga

SEQ ID NO: 2540327 - RNA, 17 nt, Human
acuuaucucucugugcu

SEQ ID NO: 2540328 - RNA, 16 nt, Human
acuuaucucucugugc

SEQ ID NO: 2540329 - RNA, 14 nt, Human
acuuaucccucucc

SEQ ID NO: 2540330 - RNA, 16 nt, Human
acuucaggcucuucuc

SEQ ID NO: 2540331 - RNA, 15 nt, Human
acuuaucccucucca

SEQ ID NO: 2540332 - RNA, 22 nt, Human
acuuaucauccacauuguuuua

SEQ ID NO: 2540333 - RNA, 20 nt, Human
acuuaucauccacauuguuu

SEQ ID NO: 2540334 - RNA, 19 nt, Human
acuuauccuaaaacaaaua

SEQ ID NO: 2540335 - RNA, 18 nt, Human
acuuauccuaaaacaaau

SEQ ID NO: 2540336 - RNA, 21 nt, Human
ucuaccugccacucacacagc

SEQ ID NO: 2540337 - RNA, 15 nt, Human
ucuaccugccacuca

SEQ ID NO: 2540338 - RNA, 14 nt, Human
ucuaccugccacuc

SEQ ID NO: 2540339 - RNA, 16 nt, Human
ucuaccugccacucac

SEQ ID NO: 2540340 - RNA, 19 nt, Human
ucuaccucaggcagcucaa

SEQ ID NO: 2540341 - RNA, 12 nt, Human
ucuaccugccac

SEQ ID NO: 2540342 - RNA, 15 nt, Human
ucuaccucuuggcug

SEQ ID NO: 2540343 - RNA, 19 nt, Human
ucuaccugaggggccucuu

SEQ ID NO: 2540344 - RNA, 12 nt, Human
ucuaccugaggg

SEQ ID NO: 2540345 - RNA, 13 nt, Human
acuuacuguacau

SEQ ID NO: 2540346 - RNA, 14 nt, Human
acuuacuguacaug

SEQ ID NO: 2540347 - RNA, 15 nt, Human
acuuacuguacauga

SEQ ID NO: 2540348 - RNA, 20 nt, Human
acuuagagguggggagcaga

SEQ ID NO: 2540349 - RNA, 18 nt, Human
acuuccaauuuacauacu

SEQ ID NO: 2540350 - RNA, 19 nt, Human
acuuccaaauccccuaagc

SEQ ID NO: 2540351 - RNA, 21 nt, Human
acuuccaaauccccuaagcag

SEQ ID NO: 2540352 - RNA, 17 nt, Human
acuuccacugccauccu

SEQ ID NO: 2540353 - RNA, 14 nt, Human
acuuccaccagccu

SEQ ID NO: 2540354 - RNA, 15 nt, Human
acuuccaccagccug

SEQ ID NO: 2540355 - RNA, 16 nt, Human
acuuccaccagccugc

SEQ ID NO: 2540356 - RNA, 18 nt, Human
acuuccaccagccugcac

SEQ ID NO: 2540357 - RNA, 20 nt, Human
acuuccagauccuggaaauc

SEQ ID NO: 2540358 - RNA, 20 nt, Human
acuuccagguguuacuguaa

SEQ ID NO: 2540359 - RNA, 21 nt, Human
acuuccagguguuacuguaau

SEQ ID NO: 2540360 - RNA, 17 nt, Human
acuuccauggcccucau

SEQ ID NO: 2540361 - RNA, 18 nt, Human
acuuccauggcccucauu

SEQ ID NO: 2540362 - RNA, 17 nt, Human
acuuccaugaggccaaa

SEQ ID NO: 2540363 - RNA, 17 nt, Human
acuuccauaaucuggac

SEQ ID NO: 2540364 - RNA, 17 nt, Human
acuuccauacagcucua

SEQ ID NO: 2540365 - RNA, 16 nt, Human
acuuccauacagcucu

SEQ ID NO: 2540366 - RNA, 20 nt, Human
acuuccagugcaacacugaa

SEQ ID NO: 2540367 - RNA, 19 nt, Human
acuucagggcagggcucug

SEQ ID NO: 2540368 - RNA, 20 nt, Human
acuucagggcagggcucuga

SEQ ID NO: 2540369 - RNA, 15 nt, Human
acuucaggggcugcc

SEQ ID NO: 2540370 - RNA, 21 nt, Human
acuucagggcagggcucugau

SEQ ID NO: 2540371 - RNA, 23 nt, Human
acuucagggcagggcucugauau

SEQ ID NO: 2540372 - RNA, 18 nt, Human
acuucaggcucuucuccu

SEQ ID NO: 2540373 - RNA, 17 nt, Human
acuucaggcucuucucc

SEQ ID NO: 2540374 - RNA, 20 nt, Human
acuucaggcucuucuccuuu

SEQ ID NO: 2540375 - RNA, 20 nt, Human
acuuccaaaccugacagaug

SEQ ID NO: 2540376 - RNA, 21 nt, Human
acuucauugagaguuuugucu

SEQ ID NO: 2540377 - RNA, 14 nt, Human
acuucaugucaacu

SEQ ID NO: 2540378 - RNA, 21 nt, Human
acuucauucuugaaagcugug

SEQ ID NO: 2540379 - RNA, 19 nt, Human
acuucauucuugaaagcug

SEQ ID NO: 2540380 - RNA, 17 nt, Human
acuucauuaauaauaaa

SEQ ID NO: 2540381 - RNA, 15 nt, Human
acuucauucuugaaa

SEQ ID NO: 2540382 - RNA, 14 nt, Human
acuucauucuugaa

SEQ ID NO: 2540383 - RNA, 16 nt, Human
acuucaucuucucagc

SEQ ID NO: 2540384 - RNA, 15 nt, Human
acuucaucuucucag

SEQ ID NO: 2540385 - RNA, 19 nt, Human
acuucaucuucucagcucc

SEQ ID NO: 2540386 - RNA, 16 nt, Human
ucuagcacuggccugc

SEQ ID NO: 2540387 - RNA, 15 nt, Human
ucuagcacuggccug

SEQ ID NO: 2540388 - RNA, 14 nt, Human
ucuagcacuggccu

SEQ ID NO: 2540389 - RNA, 17 nt, Human
ucuagcacuggccugca

SEQ ID NO: 2540390 - RNA, 19 nt, Human
ucuagauuuuguuuugcuu

SEQ ID NO: 2540391 - RNA, 15 nt, Human
ucuagcaaauguuau

SEQ ID NO: 2540392 - RNA, 23 nt, Human
ucuagcaaucacaacacuggcug

SEQ ID NO: 2540393 - RNA, 16 nt, Human
ucuagcaaauguuaug

SEQ ID NO: 2540394 - RNA, 15 nt, Human
ucuagauugagagaa

SEQ ID NO: 2540395 - RNA, 23 nt, Human
ucuagauuacccccucauuguuu

SEQ ID NO: 2540396 - RNA, 13 nt, Human
ucuagcccaugga

SEQ ID NO: 2540397 - RNA, 12 nt, Human
ucuagccugggc

SEQ ID NO: 2540398 - RNA, 23 nt, Human
ucuagcuagaaauaugauuuuau

SEQ ID NO: 2540399 - RNA, 21 nt, Human
ucuagcuagaaauaugauuuu

SEQ ID NO: 2540400 - RNA, 16 nt, Human
ucuagcuagaaauaug

SEQ ID NO: 2540401 - RNA, 19 nt, Human
ucuagaugaaguuuuacau

SEQ ID NO: 2540402 - RNA, 20 nt, Human
ucuagaugaaguuuuacauu

SEQ ID NO: 2540403 - RNA, 21 nt, Human
ucuagaugaaguuuuacauug

SEQ ID NO: 2540404 - RNA, 15 nt, Human
ucuagauaucgacuu

SEQ ID NO: 2540405 - RNA, 22 nt, Human
ucuagaugaaguuuuacauugu

SEQ ID NO: 2540406 - RNA, 23 nt, Human
ucuagaugaaguuuuacauuguu

SEQ ID NO: 2540407 - RNA, 18 nt, Human
ucuagauggcuccucuca

SEQ ID NO: 2540408 - RNA, 19 nt, Human
ucuagauggcuccucucag

SEQ ID NO: 2540409 - RNA, 20 nt, Human
ucuagauggcuccucucagu

SEQ ID NO: 2540410 - RNA, 21 nt, Human
ucuagauuacccccucauugu

SEQ ID NO: 2540411 - RNA, 17 nt, Human
acuucccagugaauucu

SEQ ID NO: 2540412 - RNA, 20 nt, Human
acuucccacucuagggcagu

SEQ ID NO: 2540413 - RNA, 20 nt, Human
acuuccauggcccucauuaa

SEQ ID NO: 2540414 - RNA, 22 nt, Human
acuucccaguucaggaguccca

SEQ ID NO: 2540415 - RNA, 23 nt, Human
acuucccaguucaggagucccaa

SEQ ID NO: 2540416 - RNA, 24 nt, Human
acuucccaguucaggagucccaag

SEQ ID NO: 2540417 - RNA, 24 nt, Human
ucuagauacuguaucaugacaaag

SEQ ID NO: 2540418 - RNA, 19 nt, Human
acuucccauuuuggaaguu

SEQ ID NO: 2540419 - RNA, 13 nt, Human
ucuauaauuuaaa

SEQ ID NO: 2540420 - RNA, 20 nt, Human
ucuaguuuucaguuuguaua

SEQ ID NO: 2540421 - RNA, 18 nt, Human
ucuaguuuucaguuugua

SEQ ID NO: 2540422 - RNA, 17 nt, Human
ucuaguuuucaguuugu

SEQ ID NO: 2540423 - RNA, 14 nt, Human
ucuaguuuucaguu

SEQ ID NO: 2540424 - RNA, 12 nt, Human
ucuaguuuucag

SEQ ID NO: 2540425 - RNA, 11 nt, Human
ucuaguuuuca

SEQ ID NO: 2540426 - RNA, 18 nt, Human
ucuaguuugcauuccuga

SEQ ID NO: 2540427 - RNA, 15 nt, Human
ucuaguuugcauucc

SEQ ID NO: 2540428 - RNA, 13 nt, Human
ucuaguuuuguca

SEQ ID NO: 2540429 - RNA, 21 nt, Human
ucuauaaucccagcacuuugg

SEQ ID NO: 2540430 - RNA, 20 nt, Human
ucuauaaucccagcacuuug

SEQ ID NO: 2540431 - RNA, 19 nt, Human
ucuauaaucccagcacuuu

SEQ ID NO: 2540432 - RNA, 22 nt, Human
ucuauaaggccauaaaacaggu

SEQ ID NO: 2540433 - RNA, 18 nt, Human
ucuauacauaucuuuauu

SEQ ID NO: 2540434 - RNA, 15 nt, Human
ucuauacauaucuuu

SEQ ID NO: 2540435 - RNA, 18 nt, Human
ucuauaggaacauaugaa

SEQ ID NO: 2540436 - RNA, 20 nt, Human
ucuauaggaacauaugaaaa

SEQ ID NO: 2540437 - RNA, 21 nt, Human
ucuauaggaacauaugaaaau

SEQ ID NO: 2540438 - RNA, 23 nt, Human
ucuaguuugauuaaauucuugca

SEQ ID NO: 2540439 - RNA, 13 nt, Human
ucuaguuugcauu

SEQ ID NO: 2540440 - RNA, 23 nt, Human
ucuaguggucuuuguaagagugu

SEQ ID NO: 2540441 - RNA, 22 nt, Human
ucuaguggucuuuguaagagug

SEQ ID NO: 2540442 - RNA, 21 nt, Human
ucuaguggucuuuguaagagu

SEQ ID NO: 2540443 - RNA, 21 nt, Human
ucuagcugggggugggccagg

SEQ ID NO: 2540444 - RNA, 11 nt, Human
ucuagcuguug

SEQ ID NO: 2540445 - RNA, 19 nt, Human
ucuagcuguugagcuguuu

SEQ ID NO: 2540446 - RNA, 18 nt, Human
ucuagcuguugagcuguu

SEQ ID NO: 2540447 - RNA, 17 nt, Human
ucuagcuggugguuuca

SEQ ID NO: 2540448 - RNA, 22 nt, Human
ucucacauggugcuacgccugc

SEQ ID NO: 2540449 - RNA, 23 nt, Human
ucucacauggugcuacgccugca

SEQ ID NO: 2540450 - RNA, 15 nt, Human
ucucaccaggaaggg

SEQ ID NO: 2540451 - RNA, 12 nt, Human
ucucaccaggaa

SEQ ID NO: 2540452 - RNA, 12 nt, Human
ucucacuccacc

SEQ ID NO: 2540453 - RNA, 13 nt, Human
ucucacuccacca

SEQ ID NO: 2540454 - RNA, 14 nt, Human
ucucacuccaccac

SEQ ID NO: 2540455 - RNA, 15 nt, Human
ucucacuccaccacc

SEQ ID NO: 2540456 - RNA, 13 nt, Human
ucucacuccuacc

SEQ ID NO: 2540457 - RNA, 18 nt, Human
ucucacuccaccacccaa

SEQ ID NO: 2540458 - RNA, 17 nt, Human
ucucacuccaccaccca

SEQ ID NO: 2540459 - RNA, 17 nt, Human
ucucaaaacugcacugu

SEQ ID NO: 2540460 - RNA, 22 nt, Human
ucucaaaaaaaaaaaaaugcac

SEQ ID NO: 2540461 - RNA, 13 nt, Human
ucucaaaaaauaa

SEQ ID NO: 2540462 - RNA, 13 nt, Human
ucuauuuuugucu

SEQ ID NO: 2540463 - RNA, 14 nt, Human
ucuauuuuuguaga

SEQ ID NO: 2540464 - RNA, 23 nt, Human
ucucacagugggagccagggcug

SEQ ID NO: 2540465 - RNA, 22 nt, Human
ucucacagugggagccagggcu

SEQ ID NO: 2540466 - RNA, 21 nt, Human
ucucacagugggagccagggc

SEQ ID NO: 2540467 - RNA, 19 nt, Human
ucucacagugggagccagg

SEQ ID NO: 2540468 - RNA, 14 nt, Human
ucucaaaaauaaau

SEQ ID NO: 2540469 - RNA, 12 nt, Human
ucucacaguggg

SEQ ID NO: 2540470 - RNA, 16 nt, Human
ucuauuguuuauucuu

SEQ ID NO: 2540471 - RNA, 16 nt, Human
ucuauuguuacucugg

SEQ ID NO: 2540472 - RNA, 23 nt, Human
ucuauuguuguacacagaaauac

SEQ ID NO: 2540473 - RNA, 12 nt, Human
ucuauuguuacu

SEQ ID NO: 2540474 - RNA, 20 nt, Human
ucuauuguagcauuucuuga

SEQ ID NO: 2540475 - RNA, 22 nt, Human
ucuauuguuguacacagaaaua

SEQ ID NO: 2540476 - RNA, 16 nt, Human
ucuauuguuucuuuca

SEQ ID NO: 2540477 - RNA, 17 nt, Human
ucuauuguuuauucuuu

SEQ ID NO: 2540478 - RNA, 12 nt, Human
ucuauuuaagcc

SEQ ID NO: 2540479 - RNA, 16 nt, Human
ucucaaaaaaagaaaa

SEQ ID NO: 2540480 - RNA, 19 nt, Human
ucuauuguagcauuucuug

SEQ ID NO: 2540481 - RNA, 18 nt, Human
ucuauuguagcauuucuu

SEQ ID NO: 2540482 - RNA, 17 nt, Human
ucuauuguagcauuucu

SEQ ID NO: 2540483 - RNA, 15 nt, Human
ucuauuguagcauuu

SEQ ID NO: 2540484 - RNA, 13 nt, Human
ucuauuguacaga

SEQ ID NO: 2540485 - RNA, 14 nt, Human
ucuauuguagcauu

SEQ ID NO: 2540486 - RNA, 22 nt, Human
ucuauuggguucauuauuggaa

SEQ ID NO: 2540487 - RNA, 14 nt, Human
ucuauaugaauuua

SEQ ID NO: 2540488 - RNA, 12 nt, Human
ucuauaugaauu

SEQ ID NO: 2540489 - RNA, 19 nt, Human
ucuauauauguguauguac

SEQ ID NO: 2540490 - RNA, 16 nt, Human
ucuauauauguguaug

SEQ ID NO: 2540491 - RNA, 15 nt, Human
ucuauuggguucauu

SEQ ID NO: 2540492 - RNA, 16 nt, Human
ucuauuggguucauua

SEQ ID NO: 2540493 - RNA, 17 nt, Human
ucuauuggguucauuau

SEQ ID NO: 2540494 - RNA, 18 nt, Human
ucuauuggguucauuauu

SEQ ID NO: 2540495 - RNA, 15 nt, Human
ucuauauauguguau

SEQ ID NO: 2540496 - RNA, 14 nt, Human
ucuauauaugugua

SEQ ID NO: 2540497 - RNA, 23 nt, Human
ucuauauauaauucuguacauag

SEQ ID NO: 2540498 - RNA, 21 nt, Human
ucuauauauaauucuguacau

SEQ ID NO: 2540499 - RNA, 20 nt, Human
ucuauauauaauucuguaca

SEQ ID NO: 2540500 - RNA, 19 nt, Human
ucuauauauaauucuguac

SEQ ID NO: 2540501 - RNA, 18 nt, Human
ucuauauauaauucugua

SEQ ID NO: 2540502 - RNA, 14 nt, Human
ucuauauauaauuc

SEQ ID NO: 2540503 - RNA, 13 nt, Human
ucuauauauaauu

SEQ ID NO: 2540504 - RNA, 12 nt, Human
acuuccugucca

SEQ ID NO: 2540505 - RNA, 13 nt, Human
acuuccuguccag

SEQ ID NO: 2540506 - RNA, 17 nt, Human
acuucgcaucaaaagac

SEQ ID NO: 2540507 - RNA, 16 nt, Human
acuucgcaucaaaaga

SEQ ID NO: 2540508 - RNA, 14 nt, Human
acuucgacugugac

SEQ ID NO: 2540509 - RNA, 12 nt, Human
acuuccugccua

SEQ ID NO: 2540510 - RNA, 17 nt, Human
acuucgggaggucgagg

SEQ ID NO: 2540511 - RNA, 20 nt, Human
acuucgggaggucgaggcag

SEQ ID NO: 2540512 - RNA, 14 nt, Human
acuucccuuucugc

SEQ ID NO: 2540513 - RNA, 18 nt, Human
ucucacuccuaccuggua

SEQ ID NO: 2540514 - RNA, 17 nt, Human
ucucacuccuaccuggu

SEQ ID NO: 2540515 - RNA, 16 nt, Human
ucucacuccuaccugg

SEQ ID NO: 2540516 - RNA, 22 nt, Human
acuucccuuucugcuuguguua

SEQ ID NO: 2540517 - RNA, 17 nt, Human
acuuccuccuccccacu

SEQ ID NO: 2540518 - RNA, 15 nt, Human
acuuccuccucccca

SEQ ID NO: 2540519 - RNA, 18 nt, Human
acuuccuccuccccacuu

SEQ ID NO: 2540520 - RNA, 18 nt, Human
acuucuaaguaaaaccac

SEQ ID NO: 2540521 - RNA, 19 nt, Human
acuucuaaguaaaaccaca

SEQ ID NO: 2540522 - RNA, 13 nt, Human
acuucuaaguaaa

SEQ ID NO: 2540523 - RNA, 24 nt, Human
acuucgcaucaaaagacaauucuu

SEQ ID NO: 2540524 - RNA, 23 nt, Human
acuucgcaucaaaagacaauucu

SEQ ID NO: 2540525 - RNA, 22 nt, Human
acuucgcaucaaaagacaauuc

SEQ ID NO: 2540526 - RNA, 20 nt, Human
acuucgcaucaaaagacaau

SEQ ID NO: 2540527 - RNA, 18 nt, Human
acuucuccacccugcucu

SEQ ID NO: 2540528 - RNA, 21 nt, Human
acuucuaaguaaaaccacagc

SEQ ID NO: 2540529 - RNA, 22 nt, Human
acuucuccagacccaccacacc

SEQ ID NO: 2540530 - RNA, 22 nt, Human
acuucggcagauacugucucuu

SEQ ID NO: 2540531 - RNA, 22 nt, Human
acuucuccauccuuucugccuc

SEQ ID NO: 2540532 - RNA, 16 nt, Human
acuucuccaggucuca

SEQ ID NO: 2540533 - RNA, 15 nt, Human
acuucuccagccuag

SEQ ID NO: 2540534 - RNA, 13 nt, Human
acuucuccagccu

SEQ ID NO: 2540535 - RNA, 10 nt, Human
acuucuccca

SEQ ID NO: 2540536 - RNA, 17 nt, Human
acuucucugaagggagg

SEQ ID NO: 2540537 - RNA, 14 nt, Human
acuucucugaaggg

SEQ ID NO: 2540538 - RNA, 13 nt, Human
acuucucugaagg

SEQ ID NO: 2540539 - RNA, 20 nt, Human
acuucucuggaaagggggga

SEQ ID NO: 2540540 - RNA, 17 nt, Human
acuugaaaauuaacaug

SEQ ID NO: 2540541 - RNA, 18 nt, Human
acuugaaaauuaacauga

SEQ ID NO: 2540542 - RNA, 16 nt, Human
acuugaaaauuaacau

SEQ ID NO: 2540543 - RNA, 13 nt, Human
acuugaaagcauc

SEQ ID NO: 2540544 - RNA, 23 nt, Human
acuugaacccgggaggcagaggu

SEQ ID NO: 2540545 - RNA, 19 nt, Human
acuugaaauaccagugaac

SEQ ID NO: 2540546 - RNA, 18 nt, Human
acuugaaaucuaggauua

SEQ ID NO: 2540547 - RNA, 14 nt, Human
acuugaaagcaucc

SEQ ID NO: 2540548 - RNA, 18 nt, Human
acuugaaagcauccaugu

SEQ ID NO: 2540549 - RNA, 18 nt, Human
acuugaaauaccagugaa

SEQ ID NO: 2540550 - RNA, 20 nt, Human
acuugaaagcauccaugugu

SEQ ID NO: 2540551 - RNA, 15 nt, Human
acuugaggguaauaa

SEQ ID NO: 2540552 - RNA, 21 nt, Human
acuugagggcccagagcagga

SEQ ID NO: 2540553 - RNA, 20 nt, Human
acuugagggcccagagcagg

SEQ ID NO: 2540554 - RNA, 19 nt, Human
acuugagggcccagagcag

SEQ ID NO: 2540555 - RNA, 18 nt, Human
acuugagggcccagagca

SEQ ID NO: 2540556 - RNA, 17 nt, Human
acuugagggcccagagc

SEQ ID NO: 2540557 - RNA, 16 nt, Human
acuugagggcccagag

SEQ ID NO: 2540558 - RNA, 15 nt, Human
acuugagggcccaga

SEQ ID NO: 2540559 - RNA, 19 nt, Human
acuugaggguaauaaacuu

SEQ ID NO: 2540560 - RNA, 18 nt, Human
acuugaggguaauaaacu

SEQ ID NO: 2540561 - RNA, 17 nt, Human
acuugaggguaauaaac

SEQ ID NO: 2540562 - RNA, 19 nt, Human
acuugagaauuacccuuuu

SEQ ID NO: 2540563 - RNA, 12 nt, Human
acuugaggauuu

SEQ ID NO: 2540564 - RNA, 18 nt, Human
acuugaggauuuugagua

SEQ ID NO: 2540565 - RNA, 17 nt, Human
acuugacuuuuaaggcu

SEQ ID NO: 2540566 - RNA, 20 nt, Human
acuugaauuuucccacugca

SEQ ID NO: 2540567 - RNA, 19 nt, Human
acuugacccccuugagggu

SEQ ID NO: 2540568 - RNA, 20 nt, Human
acuugacagaacacugucuu

SEQ ID NO: 2540569 - RNA, 18 nt, Human
acuugacagaacacuguc

SEQ ID NO: 2540570 - RNA, 19 nt, Human
acuugaauuuucccacugc

SEQ ID NO: 2540571 - RNA, 18 nt, Human
acuugaauuuucccacug

SEQ ID NO: 2540572 - RNA, 17 nt, Human
acuugacagaacacugu

SEQ ID NO: 2540573 - RNA, 16 nt, Human
acuugaaugugucacu

SEQ ID NO: 2540574 - RNA, 22 nt, Human
acuugucuaaauaaguuugcaa

SEQ ID NO: 2540575 - RNA, 20 nt, Human
acuugucuaaauaaguuugc

SEQ ID NO: 2540576 - RNA, 19 nt, Human
acuugucuaaauaaguuug

SEQ ID NO: 2540577 - RNA, 15 nt, Human
acuugucuaaauaag

SEQ ID NO: 2540578 - RNA, 16 nt, Human
acuugucuauuaccug

SEQ ID NO: 2540579 - RNA, 14 nt, Human
acuugucuuuggac

SEQ ID NO: 2540580 - RNA, 15 nt, Human
acuuguauuaugugu

SEQ ID NO: 2540581 - RNA, 23 nt, Human
acuuguccuuuuguaccauggug

SEQ ID NO: 2540582 - RNA, 18 nt, Human
acuuguauuaaagacaga

SEQ ID NO: 2540583 - RNA, 14 nt, Human
acuuguauuaugug

SEQ ID NO: 2540584 - RNA, 13 nt, Human
acuuguauuaugu

SEQ ID NO: 2540585 - RNA, 20 nt, Human
acuuguauauuuuaagaaau

SEQ ID NO: 2540586 - RNA, 19 nt, Human
acuuguauauuuguacaaa

SEQ ID NO: 2540587 - RNA, 14 nt, Human
acuuguaugaaaga

SEQ ID NO: 2540588 - RNA, 14 nt, Human
acuuguauauuuua

SEQ ID NO: 2540589 - RNA, 21 nt, Human
acuuggacuuguccucagcag

SEQ ID NO: 2540590 - RNA, 18 nt, Human
acuuguauauuuguacaa

SEQ ID NO: 2540591 - RNA, 14 nt, Human
acuuggagccaagg

SEQ ID NO: 2540592 - RNA, 19 nt, Human
acuuggagccaaggguuca

SEQ ID NO: 2540593 - RNA, 21 nt, Human
acuugcccacaccgagggcga

SEQ ID NO: 2540594 - RNA, 17 nt, Human
acuugcauuuuugcagg

SEQ ID NO: 2540595 - RNA, 18 nt, Human
acuugcauuuuugcagga

SEQ ID NO: 2540596 - RNA, 19 nt, Human
acuugcauuuuugcaggag

SEQ ID NO: 2540597 - RNA, 19 nt, Human
acuugcauugaauauauua

SEQ ID NO: 2540598 - RNA, 15 nt, Human
acuugcauggagcag

SEQ ID NO: 2540599 - RNA, 13 nt, Human
acuugcaucugug

SEQ ID NO: 2540600 - RNA, 14 nt, Human
acuugcauuuuugc

SEQ ID NO: 2540601 - RNA, 11 nt, Human
acuugcauuuc

SEQ ID NO: 2540602 - RNA, 19 nt, Human
acuugcauccaacuccagg

SEQ ID NO: 2540603 - RNA, 21 nt, Human
acuugaguuuuauuuauuuua

SEQ ID NO: 2540604 - RNA, 15 nt, Human
acuugaguuuuauuu

SEQ ID NO: 2540605 - RNA, 21 nt, Human
acuuggaauuuguaaccucag

SEQ ID NO: 2540606 - RNA, 18 nt, Human
acuuggaauuuguaaccu

SEQ ID NO: 2540607 - RNA, 16 nt, Human
acuuggaauuuguaac

SEQ ID NO: 2540608 - RNA, 22 nt, Human
acuuggaaaaauccagaaagaa

SEQ ID NO: 2540609 - RNA, 23 nt, Human
acuuggaauuuguaaccucagcu

SEQ ID NO: 2540610 - RNA, 22 nt, Human
acuuggaauuuguaaccucagc

SEQ ID NO: 2540611 - RNA, 16 nt, Human
acuuggacucuugcuc

SEQ ID NO: 2540612 - RNA, 15 nt, Human
acuuggacucuugcu

SEQ ID NO: 2540613 - RNA, 19 nt, Human
acuuggacucuugcucuuu

SEQ ID NO: 2540614 - RNA, 18 nt, Human
acuuggacucuugcucuu

SEQ ID NO: 2540615 - RNA, 11 nt, Human
acuuggagcca

SEQ ID NO: 2540616 - RNA, 14 nt, Human
acuuggaagcuccg

SEQ ID NO: 2540617 - RNA, 12 nt, Human
acuugccucuuc

SEQ ID NO: 2540618 - RNA, 21 nt, Human
acuuggaaaaauccagaaaga

SEQ ID NO: 2540619 - RNA, 22 nt, Human
acuugccgcgucgcccucccag

SEQ ID NO: 2540620 - RNA, 23 nt, Human
acuugccgcgucgcccucccagg

SEQ ID NO: 2540621 - RNA, 17 nt, Human
acuugugauuauuuauu

SEQ ID NO: 2540622 - RNA, 20 nt, Human
acuugugauuauuuauuauu

SEQ ID NO: 2540623 - RNA, 18 nt, Human
acuugugccaacacucaa

SEQ ID NO: 2540624 - RNA, 13 nt, Human
acuugugccaaca

SEQ ID NO: 2540625 - RNA, 14 nt, Human
acuuguggacacag

SEQ ID NO: 2540626 - RNA, 16 nt, Human
acuugugauuauuuau

SEQ ID NO: 2540627 - RNA, 16 nt, Human
acuuuaaaaggagcca

SEQ ID NO: 2540628 - RNA, 16 nt, Human
acuuguuuucugggaa

SEQ ID NO: 2540629 - RNA, 22 nt, Human
acuugugcugaucgugcuaaau

SEQ ID NO: 2540630 - RNA, 22 nt, Human
acuuuacuaagaugacauugcu

SEQ ID NO: 2540631 - RNA, 18 nt, Human
acuuuacuaagaugacau

SEQ ID NO: 2540632 - RNA, 16 nt, Human
acuuuacuaagaugac

SEQ ID NO: 2540633 - RNA, 15 nt, Human
acuuuacuaagauga

SEQ ID NO: 2540634 - RNA, 15 nt, Human
acuuuagaaugagag

SEQ ID NO: 2540635 - RNA, 15 nt, Human
acuuuagaguagcau

SEQ ID NO: 2540636 - RNA, 19 nt, Human
acuuuagaguagcaugaga

SEQ ID NO: 2540637 - RNA, 21 nt, Human
acuuuagaguagcaugagaga

SEQ ID NO: 2540638 - RNA, 22 nt, Human
acuuuagcugcauccuccaaga

SEQ ID NO: 2540639 - RNA, 13 nt, Human
acuuuagggaagu

SEQ ID NO: 2540640 - RNA, 14 nt, Human
acuuuagaugcuga

SEQ ID NO: 2540641 - RNA, 13 nt, Human
acuuuagaugcug

SEQ ID NO: 2540642 - RNA, 15 nt, Human
acuuuagaugcugau

SEQ ID NO: 2540643 - RNA, 19 nt, Human
acuuucuuuucuggaaugu

SEQ ID NO: 2540644 - RNA, 15 nt, Human
acuuucuuuucugga

SEQ ID NO: 2540645 - RNA, 21 nt, Human
acuuucuuuucgccguggcug

SEQ ID NO: 2540646 - RNA, 20 nt, Human
acuuucuuuucgccguggcu

SEQ ID NO: 2540647 - RNA, 14 nt, Human
acuuuggaaagagu

SEQ ID NO: 2540648 - RNA, 13 nt, Human
acuuuggaaagag

SEQ ID NO: 2540649 - RNA, 23 nt, Human
acuuuggaaagacuuuuccaacc

SEQ ID NO: 2540650 - RNA, 23 nt, Human
acuuuggaaagaguaggaagacu

SEQ ID NO: 2540651 - RNA, 19 nt, Human
acuuuguauaaaagggacu

SEQ ID NO: 2540652 - RNA, 15 nt, Human
acuuuggaaaaugca

SEQ ID NO: 2540653 - RNA, 18 nt, Human
acuuuggaaaaugcauug

SEQ ID NO: 2540654 - RNA, 19 nt, Human
acuuuguaugucauuuccu

SEQ ID NO: 2540655 - RNA, 23 nt, Human
acuuugccagcuuuuccucccuu

SEQ ID NO: 2540656 - RNA, 19 nt, Human
acuuugccagcuuuuccuc

SEQ ID NO: 2540657 - RNA, 23 nt, Human
acuuugcagccggcacagggucu

SEQ ID NO: 2540658 - RNA, 19 nt, Human
acuuugcacugauauauca

SEQ ID NO: 2540659 - RNA, 18 nt, Human
acuuugcacugauauauc

SEQ ID NO: 2540660 - RNA, 21 nt, Human
acuuugcacugauauaucaug

SEQ ID NO: 2540661 - RNA, 20 nt, Human
acuuugccuuuccauaauca

SEQ ID NO: 2540662 - RNA, 14 nt, Human
acuuugcucugggu

SEQ ID NO: 2540663 - RNA, 15 nt, Human
acuuugcucuuucuu

SEQ ID NO: 2540664 - RNA, 14 nt, Human
acuuugcuucccau

SEQ ID NO: 2540665 - RNA, 20 nt, Human
acuuugcuugcaguagauuu

SEQ ID NO: 2540666 - RNA, 17 nt, Human
acuuugcucuuucuuga

SEQ ID NO: 2540667 - RNA, 17 nt, Human
acuuugcacugauauau

SEQ ID NO: 2540668 - RNA, 19 nt, Human
acuuugaaauguguuucug

SEQ ID NO: 2540669 - RNA, 17 nt, Human
acuuugaaauguguuuc

SEQ ID NO: 2540670 - RNA, 23 nt, Human
acuuugaaauguguuucuguaua

SEQ ID NO: 2540671 - RNA, 12 nt, Human
acuuugaaggac

SEQ ID NO: 2540672 - RNA, 19 nt, Human
ucucucaggagcacaggca

SEQ ID NO: 2540673 - RNA, 18 nt, Human
ucucucaggagcacaggc

SEQ ID NO: 2540674 - RNA, 17 nt, Human
ucucucaggagcacagg

SEQ ID NO: 2540675 - RNA, 15 nt, Human
ucucucaggagcaca

SEQ ID NO: 2540676 - RNA, 14 nt, Human
ucucucaggagcac

SEQ ID NO: 2540677 - RNA, 13 nt, Human
ucucucaggagca

SEQ ID NO: 2540678 - RNA, 20 nt, Human
ucucucagaagggaggcugg

SEQ ID NO: 2540679 - RNA, 17 nt, Human
ucucucagaagggaggc

SEQ ID NO: 2540680 - RNA, 12 nt, Human
ucucucaggcca

SEQ ID NO: 2540681 - RNA, 16 nt, Human
ucucucagaagggagg

SEQ ID NO: 2540682 - RNA, 15 nt, Human
ucucggcucacugca

SEQ ID NO: 2540683 - RNA, 19 nt, Human
ucucggaguaucugggaac

SEQ ID NO: 2540684 - RNA, 22 nt, Human
ucucucaggagcacaggcagcu

SEQ ID NO: 2540685 - RNA, 21 nt, Human
ucucucaggagcacaggcagc

SEQ ID NO: 2540686 - RNA, 21 nt, Human
ucucucaggccaaacucaccu

SEQ ID NO: 2540687 - RNA, 13 nt, Human
ucucuccaggauc

SEQ ID NO: 2540688 - RNA, 11 nt, Human
ucucuccagga

SEQ ID NO: 2540689 - RNA, 11 nt, Human
ucucuccaucu

SEQ ID NO: 2540690 - RNA, 17 nt, Human
ucucucccauggagccc

SEQ ID NO: 2540691 - RNA, 15 nt, Human
ucucucccauggagc

SEQ ID NO: 2540692 - RNA, 13 nt, Human
ucucucccaugga

SEQ ID NO: 2540693 - RNA, 23 nt, Human
ucucucccagucuacccagagaa

SEQ ID NO: 2540694 - RNA, 22 nt, Human
ucucucccagucuacccagaga

SEQ ID NO: 2540695 - RNA, 21 nt, Human
ucucucccagucuacccagag

SEQ ID NO: 2540696 - RNA, 19 nt, Human
ucucucccagucuacccag

SEQ ID NO: 2540697 - RNA, 22 nt, Human
ucucucccaggggcuggcuuca

SEQ ID NO: 2540698 - RNA, 20 nt, Human
ucucucccaggggcuggcuu

SEQ ID NO: 2540699 - RNA, 14 nt, Human
ucucucccaggggc

SEQ ID NO: 2540700 - RNA, 17 nt, Human
ucucuccaucuaccuuc

SEQ ID NO: 2540701 - RNA, 14 nt, Human
ucucuccauucccg

SEQ ID NO: 2540702 - RNA, 19 nt, Human
ucuccuuuuccucucuccc

SEQ ID NO: 2540703 - RNA, 17 nt, Human
ucucgaacuccugaccu

SEQ ID NO: 2540704 - RNA, 18 nt, Human
ucuccuugcuacccagaa

SEQ ID NO: 2540705 - RNA, 15 nt, Human
ucuccuugcuaccca

SEQ ID NO: 2540706 - RNA, 14 nt, Human
ucucgaugcaauga

SEQ ID NO: 2540707 - RNA, 17 nt, Human
ucucgaugcaaugaaca

SEQ ID NO: 2540708 - RNA, 14 nt, Human
ucucgauuuuaucu

SEQ ID NO: 2540709 - RNA, 14 nt, Human
ucuccuuguggccu

SEQ ID NO: 2540710 - RNA, 23 nt, Human
ucucgaacauggaacucauuccu

SEQ ID NO: 2540711 - RNA, 15 nt, Human
ucucgcucugucacc

SEQ ID NO: 2540712 - RNA, 20 nt, Human
ucucgcugaugcugggcugg

SEQ ID NO: 2540713 - RNA, 19 nt, Human
ucucgcugaugcugggcug

SEQ ID NO: 2540714 - RNA, 18 nt, Human
ucucgcugaugcugggcu

SEQ ID NO: 2540715 - RNA, 19 nt, Human
ucucggacuaagccuaccu

SEQ ID NO: 2540716 - RNA, 21 nt, Human
ucucggaccuuucagcuguga

SEQ ID NO: 2540717 - RNA, 22 nt, Human
ucucgcugaugcugggcugggu

SEQ ID NO: 2540718 - RNA, 21 nt, Human
ucucggaacugcaugcugcug

SEQ ID NO: 2540719 - RNA, 17 nt, Human
ucucggaaggcuggcug

SEQ ID NO: 2540720 - RNA, 23 nt, Human
ucucgcauaggaccuuuccacca

SEQ ID NO: 2540721 - RNA, 16 nt, Human
ucucgcauaggaccuu

SEQ ID NO: 2540722 - RNA, 20 nt, Human
ucucgcuauugucaccaggg

SEQ ID NO: 2540723 - RNA, 17 nt, Human
ucucgcucuguugccca

SEQ ID NO: 2540724 - RNA, 19 nt, Human
ucuccuguaccucuugagc

SEQ ID NO: 2540725 - RNA, 14 nt, Human
ucuccuguccaacc

SEQ ID NO: 2540726 - RNA, 19 nt, Human
ucuccuguuuuucugggug

SEQ ID NO: 2540727 - RNA, 17 nt, Human
ucuccuguuuuucuggg

SEQ ID NO: 2540728 - RNA, 14 nt, Human
ucuccuguuuuucu

SEQ ID NO: 2540729 - RNA, 17 nt, Human
ucuccugugcccacauc

SEQ ID NO: 2540730 - RNA, 18 nt, Human
ucuccugugcccacaucc

SEQ ID NO: 2540731 - RNA, 16 nt, Human
ucuccugugcccacau

SEQ ID NO: 2540732 - RNA, 15 nt, Human
ucuccugugcccaca

SEQ ID NO: 2540733 - RNA, 17 nt, Human
ucuccugugcaugggug

SEQ ID NO: 2540734 - RNA, 16 nt, Human
ucuccuguccaaccua

SEQ ID NO: 2540735 - RNA, 23 nt, Human
ucuccugugcaugggugaaggga

SEQ ID NO: 2540736 - RNA, 23 nt, Human
ucuccuuggugucgggcaugaca

SEQ ID NO: 2540737 - RNA, 21 nt, Human
ucuccuuggugucgggcauga

SEQ ID NO: 2540738 - RNA, 16 nt, Human
ucuccuuccugugugu

SEQ ID NO: 2540739 - RNA, 14 nt, Human
ucuccuuagucuuc

SEQ ID NO: 2540740 - RNA, 19 nt, Human
agaaaaaaaaagaaaaaag

SEQ ID NO: 2540741 - RNA, 17 nt, Human
agaaaaaaagauuuauu

SEQ ID NO: 2540742 - RNA, 21 nt, Human
agaaaaaaaguuugccagaag

SEQ ID NO: 2540743 - RNA, 21 nt, Human
acuuuguggaugucuuccuug

SEQ ID NO: 2540744 - RNA, 19 nt, Human
acuuuguggaugucuuccu

SEQ ID NO: 2540745 - RNA, 17 nt, Human
acuuuguggaugucuuc

SEQ ID NO: 2540746 - RNA, 16 nt, Human
acuuuguggaugucuu

SEQ ID NO: 2540747 - RNA, 17 nt, Human
agaaaaaaaaagaaaaa

SEQ ID NO: 2540748 - RNA, 18 nt, Human
agaaaaaaaaagaaaaaa

SEQ ID NO: 2540749 - RNA, 18 nt, Human
acuuuguguucaccuugu

SEQ ID NO: 2540750 - RNA, 17 nt, Human
acuuugucugaaaaauu

SEQ ID NO: 2540751 - RNA, 15 nt, Human
acuuugucugaaaaa

SEQ ID NO: 2540752 - RNA, 14 nt, Human
acuuugugaauaga

SEQ ID NO: 2540753 - RNA, 14 nt, Human
acuuugucugaaaa

SEQ ID NO: 2540754 - RNA, 22 nt, Human
acuuuguaugucauuuccuuca

SEQ ID NO: 2540755 - RNA, 20 nt, Human
acuuugucgcccaggcugga

SEQ ID NO: 2540756 - RNA, 15 nt, Human
acuuugucagaggca

SEQ ID NO: 2540757 - RNA, 16 nt, Human
acuuuguguucaccuu

SEQ ID NO: 2540758 - RNA, 10 nt, Human
acuuugugcu

SEQ ID NO: 2540759 - RNA, 19 nt, Human
agaaauagcuccguggagc

SEQ ID NO: 2540760 - RNA, 15 nt, Human
agaaaucuaaaaaac

SEQ ID NO: 2540761 - RNA, 18 nt, Human
agaaauagacaguauauu

SEQ ID NO: 2540762 - RNA, 20 nt, Human
agaaauagccugcgcuguuu

SEQ ID NO: 2540763 - RNA, 13 nt, Human
agaaauacuguac

SEQ ID NO: 2540764 - RNA, 14 nt, Human
agaaauacuguaca

SEQ ID NO: 2540765 - RNA, 16 nt, Human
agaaauacuguacaau

SEQ ID NO: 2540766 - RNA, 21 nt, Human
agaaauacagauuuugauagc

SEQ ID NO: 2540767 - RNA, 16 nt, Human
agaaauacagauuuug

SEQ ID NO: 2540768 - RNA, 23 nt, Human
agaaauaccaaaauuauuucaga

SEQ ID NO: 2540769 - RNA, 18 nt, Human
agaaauaccaaaauuauu

SEQ ID NO: 2540770 - RNA, 12 nt, Human
agaaaugaaaaa

SEQ ID NO: 2540771 - RNA, 22 nt, Human
agaaaucuauagaacugaauga

SEQ ID NO: 2540772 - RNA, 23 nt, Human
agaaaucuaguauuucaugcugg

SEQ ID NO: 2540773 - RNA, 14 nt, Human
agaaaucuagaaga

SEQ ID NO: 2540774 - RNA, 13 nt, Human
agaaaugaaaaaa

SEQ ID NO: 2540775 - RNA, 18 nt, Human
agaaaucucacuuuucuc

SEQ ID NO: 2540776 - RNA, 23 nt, Human
ucugaaggcgucaacgugcauuu

SEQ ID NO: 2540777 - RNA, 18 nt, Human
ucugaaggcuggguucug

SEQ ID NO: 2540778 - RNA, 16 nt, Human
agaaaugguuguauua

SEQ ID NO: 2540779 - RNA, 15 nt, Human
agaaaugguuguauu

SEQ ID NO: 2540780 - RNA, 22 nt, Human
ucugaaggacauugcggacagc

SEQ ID NO: 2540781 - RNA, 20 nt, Human
ucugaaggagccccauuccu

SEQ ID NO: 2540782 - RNA, 12 nt, Human
ucugaaggagau

SEQ ID NO: 2540783 - RNA, 21 nt, Human
ucugaaggagccccauuccug

SEQ ID NO: 2540784 - RNA, 19 nt, Human
ucugaaggagauuuuccuu

SEQ ID NO: 2540785 - RNA, 15 nt, Human
agaaaugccuuaccc

SEQ ID NO: 2540786 - RNA, 22 nt, Human
agaaaugcugccugccugucug

SEQ ID NO: 2540787 - RNA, 15 nt, Human
agaaaugcugccugc

SEQ ID NO: 2540788 - RNA, 14 nt, Human
agaaaugcugccug

SEQ ID NO: 2540789 - RNA, 13 nt, Human
agaaaugcugccu

SEQ ID NO: 2540790 - RNA, 15 nt, Human
agaaaugcugcccau

SEQ ID NO: 2540791 - RNA, 23 nt, Human
agaaaugcugccugccugucugu

SEQ ID NO: 2540792 - RNA, 20 nt, Human
agaaaugggacuuaacuccu

SEQ ID NO: 2540793 - RNA, 21 nt, Human
agaaaugcugguuuuucaguu

SEQ ID NO: 2540794 - RNA, 20 nt, Human
agaaaugcugguuuuucagu

SEQ ID NO: 2540795 - RNA, 16 nt, Human
agaaagcauuacauuu

SEQ ID NO: 2540796 - RNA, 13 nt, Human
agaaagcauuuga

SEQ ID NO: 2540797 - RNA, 20 nt, Human
agaaagcaggggcuacaaga

SEQ ID NO: 2540798 - RNA, 19 nt, Human
agaaauacaauucuacauu

SEQ ID NO: 2540799 - RNA, 20 nt, Human
agaaagcagaacagugauua

SEQ ID NO: 2540800 - RNA, 21 nt, Human
agaaagcagauaccucacccu

SEQ ID NO: 2540801 - RNA, 14 nt, Human
agaaagcaggggcu

SEQ ID NO: 2540802 - RNA, 12 nt, Human
agaaagcagggg

SEQ ID NO: 2540803 - RNA, 14 nt, Human
agaaagcauaaaau

SEQ ID NO: 2540804 - RNA, 17 nt, Human
agaaagcagaacaguga

SEQ ID NO: 2540805 - RNA, 18 nt, Human
agaaagcagaacagugau

SEQ ID NO: 2540806 - RNA, 15 nt, Human
agaaagcaaaauuau

SEQ ID NO: 2540807 - RNA, 17 nt, Human
agaaagcaaaauuaugu

SEQ ID NO: 2540808 - RNA, 21 nt, Human
agaaagcaaaauuauguuugc

SEQ ID NO: 2540809 - RNA, 20 nt, Human
agaaagauuacuuagaggaa

SEQ ID NO: 2540810 - RNA, 17 nt, Human
agaaagaucauugaaau

SEQ ID NO: 2540811 - RNA, 18 nt, Human
agaaagaucauugaaauu

SEQ ID NO: 2540812 - RNA, 19 nt, Human
agaaagauggaugugcuuu

SEQ ID NO: 2540813 - RNA, 12 nt, Human
agaaagagagaa

SEQ ID NO: 2540814 - RNA, 13 nt, Human
agaaagagagaaa

SEQ ID NO: 2540815 - RNA, 14 nt, Human
agaaagagagaaaa

SEQ ID NO: 2540816 - RNA, 15 nt, Human
agaaagagagaaaau

SEQ ID NO: 2540817 - RNA, 10 nt, Human
agaaagagag

SEQ ID NO: 2540818 - RNA, 11 nt, Human
agaaagagaga

SEQ ID NO: 2540819 - RNA, 16 nt, Human
agaaagagagaaaaua

SEQ ID NO: 2540820 - RNA, 17 nt, Human
agaaagagagaaaauaa

SEQ ID NO: 2540821 - RNA, 18 nt, Human
agaaagagagaaaauaaa

SEQ ID NO: 2540822 - RNA, 22 nt, Human
agaaagagagaaaauaaaaagu

SEQ ID NO: 2540823 - RNA, 16 nt, Human
agaaagaggagugcuu

SEQ ID NO: 2540824 - RNA, 19 nt, Human
agaaagagcacuuaagaga

SEQ ID NO: 2540825 - RNA, 22 nt, Human
agaaagagcacuuaagagaaua

SEQ ID NO: 2540826 - RNA, 23 nt, Human
agaaagagagagaauucuuucaa

SEQ ID NO: 2540827 - RNA, 13 nt, Human
agaaagagcacuu

SEQ ID NO: 2540828 - RNA, 20 nt, Human
agaaagacuaucuaaauguu

SEQ ID NO: 2540829 - RNA, 22 nt, Human
agaaagacuaucuaaauguuga

SEQ ID NO: 2540830 - RNA, 16 nt, Human
agaaagacuauucaaa

SEQ ID NO: 2540831 - RNA, 15 nt, Human
agaaagacagagcug

SEQ ID NO: 2540832 - RNA, 12 nt, Human
agaaagacugag

SEQ ID NO: 2540833 - RNA, 18 nt, Human
agaaagacagagcuggga

SEQ ID NO: 2540834 - RNA, 18 nt, Human
ucucuugguccugcugca

SEQ ID NO: 2540835 - RNA, 17 nt, Human
ucucuugguccugcugc

SEQ ID NO: 2540836 - RNA, 16 nt, Human
ucucuugguccugcug

SEQ ID NO: 2540837 - RNA, 22 nt, Human
ucucugcaggucccuaauaaag

SEQ ID NO: 2540838 - RNA, 21 nt, Human
ucucugcaggucccuaauaaa

SEQ ID NO: 2540839 - RNA, 20 nt, Human
ucucugcaggucccuaauaa

SEQ ID NO: 2540840 - RNA, 19 nt, Human
ucucugcaggucccuaaua

SEQ ID NO: 2540841 - RNA, 13 nt, Human
ucucuccccucaa

SEQ ID NO: 2540842 - RNA, 23 nt, Human
ucucucccauggagccccagccc

SEQ ID NO: 2540843 - RNA, 21 nt, Human
ucucucccauggagccccagc

SEQ ID NO: 2540844 - RNA, 20 nt, Human
ucucucccauggagccccag

SEQ ID NO: 2540845 - RNA, 21 nt, Human
ucucuccccucaaagucugca

SEQ ID NO: 2540846 - RNA, 20 nt, Human
ucucuccccucaaagucugc

SEQ ID NO: 2540847 - RNA, 14 nt, Human
ucucucccuccccu

SEQ ID NO: 2540848 - RNA, 19 nt, Human
agaaaaaauauuuucccua

SEQ ID NO: 2540849 - RNA, 22 nt, Human
ucucuccccucaaagucugcaa

SEQ ID NO: 2540850 - RNA, 18 nt, Human
ucucugcaggucccuaau

SEQ ID NO: 2540851 - RNA, 16 nt, Human
ucucuugguuuccuuc

SEQ ID NO: 2540852 - RNA, 17 nt, Human
ucucuugguuuccuucc

SEQ ID NO: 2540853 - RNA, 18 nt, Human
ucucuugguuuccuuccu

SEQ ID NO: 2540854 - RNA, 17 nt, Human
agaaaaaauauuuuccu

SEQ ID NO: 2540855 - RNA, 23 nt, Human
agaaaaaauauuuuccugccagg

SEQ ID NO: 2540856 - RNA, 19 nt, Human
agaaaaauuuacauggcaa

SEQ ID NO: 2540857 - RNA, 15 nt, Human
agaaaaauuauugua

SEQ ID NO: 2540858 - RNA, 20 nt, Human
agaaaacaaaaaaaccucua

SEQ ID NO: 2540859 - RNA, 19 nt, Human
ucucuugguuuccuuccuu

SEQ ID NO: 2540860 - RNA, 18 nt, Human
agaaaaaugagccuggca

SEQ ID NO: 2540861 - RNA, 13 nt, Human
agaaaagcuauaa

SEQ ID NO: 2540862 - RNA, 21 nt, Human
agaaaagcuauaaaaugaaua

SEQ ID NO: 2540863 - RNA, 14 nt, Human
agaaaagcuuugaa

SEQ ID NO: 2540864 - RNA, 17 nt, Human
agaaacaauaaagagau

SEQ ID NO: 2540865 - RNA, 16 nt, Human
agaaacaauaaagaga

SEQ ID NO: 2540866 - RNA, 15 nt, Human
agaaacaauaaagag

SEQ ID NO: 2540867 - RNA, 14 nt, Human
agaaaaggacagaa

SEQ ID NO: 2540868 - RNA, 17 nt, Human
agaaacaacucuuugag

SEQ ID NO: 2540869 - RNA, 14 nt, Human
agaaacaauaaaga

SEQ ID NO: 2540870 - RNA, 20 nt, Human
agaaacaacucuuugagaaa

SEQ ID NO: 2540871 - RNA, 16 nt, Human
agaaacacaacuauau

SEQ ID NO: 2540872 - RNA, 14 nt, Human
agaaacacaauauu

SEQ ID NO: 2540873 - RNA, 15 nt, Human
agaaacacacugagg

SEQ ID NO: 2540874 - RNA, 17 nt, Human
agaaacacacugaggca

SEQ ID NO: 2540875 - RNA, 19 nt, Human
agaaacacacugaggcagg

SEQ ID NO: 2540876 - RNA, 20 nt, Human
agaaacacacugaggcaggg

SEQ ID NO: 2540877 - RNA, 17 nt, Human
agaaaagauaaagauga

SEQ ID NO: 2540878 - RNA, 12 nt, Human
agaaaagauuuu

SEQ ID NO: 2540879 - RNA, 19 nt, Human
agaaaagauguagauuuau

SEQ ID NO: 2540880 - RNA, 15 nt, Human
agaaaagauuuuaau

SEQ ID NO: 2540881 - RNA, 18 nt, Human
agaaaagauuuuaaucaa

SEQ ID NO: 2540882 - RNA, 20 nt, Human
agaaaagauuuuaaucaagu

SEQ ID NO: 2540883 - RNA, 15 nt, Human
agaaaagcaccugcc

SEQ ID NO: 2540884 - RNA, 16 nt, Human
agaaaagcaccugccg

SEQ ID NO: 2540885 - RNA, 18 nt, Human
agaaaagcaccugccgac

SEQ ID NO: 2540886 - RNA, 16 nt, Human
agaaaacaaggaugaa

SEQ ID NO: 2540887 - RNA, 23 nt, Human
agaaaagagauauuuuaaaauga

SEQ ID NO: 2540888 - RNA, 19 nt, Human
agaaaagagauauuuuaaa

SEQ ID NO: 2540889 - RNA, 16 nt, Human
agaaaagauaaagaug

SEQ ID NO: 2540890 - RNA, 15 nt, Human
agaaaagauaaagau

SEQ ID NO: 2540891 - RNA, 20 nt, Human
agaaaagauacgacuuuauu

SEQ ID NO: 2540892 - RNA, 22 nt, Human
agaaacacacugaggcagggaa

SEQ ID NO: 2540893 - RNA, 22 nt, Human
agaaacauaaauaaaaugacca

SEQ ID NO: 2540894 - RNA, 17 nt, Human
agaaacauaaauaaaau

SEQ ID NO: 2540895 - RNA, 16 nt, Human
agaaacauaaauaaaa

SEQ ID NO: 2540896 - RNA, 15 nt, Human
agaaacauaaauaaa

SEQ ID NO: 2540897 - RNA, 14 nt, Human
agaaacaucaguua

SEQ ID NO: 2540898 - RNA, 16 nt, Human
agaaacaucaguuacu

SEQ ID NO: 2540899 - RNA, 15 nt, Human
agaaacauugaagau

SEQ ID NO: 2540900 - RNA, 14 nt, Human
agaaacauugaaga

SEQ ID NO: 2540901 - RNA, 14 nt, Human
agaaacaugguuuu

SEQ ID NO: 2540902 - RNA, 23 nt, Human
agaaacauaaauaaaaugaccag

SEQ ID NO: 2540903 - RNA, 21 nt, Human
agaaacaucaguuacucugaa

SEQ ID NO: 2540904 - RNA, 23 nt, Human
agaaacaucaguuacucugaagg

SEQ ID NO: 2540905 - RNA, 15 nt, Human
agaaacauuugguaa

SEQ ID NO: 2540906 - RNA, 14 nt, Human
agaaacuguagucu

SEQ ID NO: 2540907 - RNA, 20 nt, Human
agaaacuguagucucaggac

SEQ ID NO: 2540908 - RNA, 23 nt, Human
agaaacuuaagguuaccuuuguu

SEQ ID NO: 2540909 - RNA, 22 nt, Human
agaaacuguucccaccugcugg

SEQ ID NO: 2540910 - RNA, 15 nt, Human
agaaacuguucccac

SEQ ID NO: 2540911 - RNA, 21 nt, Human
agaaacuguucccaccugcug

SEQ ID NO: 2540912 - RNA, 23 nt, Human
ucugcaggucccuaauaaagcug

SEQ ID NO: 2540913 - RNA, 22 nt, Human
ucugcaggucccuaauaaagcu

SEQ ID NO: 2540914 - RNA, 19 nt, Human
ucugcaggucccuaauaaa

SEQ ID NO: 2540915 - RNA, 21 nt, Human
ucugcaggucccuaauaaagc

SEQ ID NO: 2540916 - RNA, 18 nt, Human
ucugaagugaaacugcuu

SEQ ID NO: 2540917 - RNA, 22 nt, Human
ucugaagugaaacugcuuguuu

SEQ ID NO: 2540918 - RNA, 13 nt, Human
ucugaagggaggu

SEQ ID NO: 2540919 - RNA, 12 nt, Human
ucugaagggagg

SEQ ID NO: 2540920 - RNA, 16 nt, Human
ucugaagugaaacugc

SEQ ID NO: 2540921 - RNA, 14 nt, Human
ucugaagggaggug

SEQ ID NO: 2540922 - RNA, 16 nt, Human
ucugaauaacauuugu

SEQ ID NO: 2540923 - RNA, 15 nt, Human
ucugaauaauuucuu

SEQ ID NO: 2540924 - RNA, 16 nt, Human
ucugaauaauuucuua

SEQ ID NO: 2540925 - RNA, 14 nt, Human
ucugaauaugcugc

SEQ ID NO: 2540926 - RNA, 13 nt, Human
ucugaauccuaag

SEQ ID NO: 2540927 - RNA, 13 nt, Human
agaaccuggaacu

SEQ ID NO: 2540928 - RNA, 20 nt, Human
agaaccuggaacuuggggag

SEQ ID NO: 2540929 - RNA, 15 nt, Human
agaaccuggaagggc

SEQ ID NO: 2540930 - RNA, 21 nt, Human
agaaccuggaacuuggggagu

SEQ ID NO: 2540931 - RNA, 12 nt, Human
agaaauuaugug

SEQ ID NO: 2540932 - RNA, 18 nt, Human
agaaccuggaguuccuga

SEQ ID NO: 2540933 - RNA, 17 nt, Human
agaaccuggaguuccug

SEQ ID NO: 2540934 - RNA, 17 nt, Human
agaaccuggagggcugg

SEQ ID NO: 2540935 - RNA, 23 nt, Human
agaaccuggagggcuagaacugg

SEQ ID NO: 2540936 - RNA, 12 nt, Human
agaaccuggagg

SEQ ID NO: 2540937 - RNA, 17 nt, Human
agaaccuggagagcuag

SEQ ID NO: 2540938 - RNA, 12 nt, Human
agaaccuggaga

SEQ ID NO: 2540939 - RNA, 16 nt, Human
agaaccuggaagggcu

SEQ ID NO: 2540940 - RNA, 17 nt, Human
agaaccuguagagcuag

SEQ ID NO: 2540941 - RNA, 12 nt, Human
agaaccuguccu

SEQ ID NO: 2540942 - RNA, 13 nt, Human
agaaccuguccuu

SEQ ID NO: 2540943 - RNA, 17 nt, Human
ucugaaugcugcuacuu

SEQ ID NO: 2540944 - RNA, 18 nt, Human
agaaauuacacccaaaga

SEQ ID NO: 2540945 - RNA, 13 nt, Human
agaaauuaaguau

SEQ ID NO: 2540946 - RNA, 17 nt, Human
agaaauuaaguaucuga

SEQ ID NO: 2540947 - RNA, 21 nt, Human
ucugcagguucuucuuccuga

SEQ ID NO: 2540948 - RNA, 15 nt, Human
ucugcaguaaaucuu

SEQ ID NO: 2540949 - RNA, 16 nt, Human
ucugaaugcugcuacu

SEQ ID NO: 2540950 - RNA, 13 nt, Human
ucugaaugcugcu

SEQ ID NO: 2540951 - RNA, 17 nt, Human
agaaauuagcuguguga

SEQ ID NO: 2540952 - RNA, 15 nt, Human
agaaauuagccgggc

SEQ ID NO: 2540953 - RNA, 17 nt, Human
agaaauuagaaaccuua

SEQ ID NO: 2540954 - RNA, 15 nt, Human
agaaauuagcugugu

SEQ ID NO: 2540955 - RNA, 14 nt, Human
agaaauuagccggg

SEQ ID NO: 2540956 - RNA, 23 nt, Human
agaaccuuuugagugccuuacac

SEQ ID NO: 2540957 - RNA, 23 nt, Human
agaaccuugugccuggcucagag

SEQ ID NO: 2540958 - RNA, 22 nt, Human
agaaccuugugccuggcucaga

SEQ ID NO: 2540959 - RNA, 17 nt, Human
agaaccuugugccuggc

SEQ ID NO: 2540960 - RNA, 22 nt, Human
agaacgcagcccuagagccugc

SEQ ID NO: 2540961 - RNA, 13 nt, Human
agaacgcagcccu

SEQ ID NO: 2540962 - RNA, 23 nt, Human
agaacgcagcccuagagccugcc

SEQ ID NO: 2540963 - RNA, 19 nt, Human
agaaccuuuugagugccuu

SEQ ID NO: 2540964 - RNA, 22 nt, Human
agaaccuugccugaacauccuu

SEQ ID NO: 2540965 - RNA, 19 nt, Human
agaaccuugccugaacauc

SEQ ID NO: 2540966 - RNA, 14 nt, Human
agaaccuugccuga

SEQ ID NO: 2540967 - RNA, 14 nt, Human
agaaccuguccuug

SEQ ID NO: 2540968 - RNA, 21 nt, Human
agaaccuguccuugcacacuc

SEQ ID NO: 2540969 - RNA, 17 nt, Human
agaacuagaauuugauu

SEQ ID NO: 2540970 - RNA, 18 nt, Human
agaacuagaaccuggagg

SEQ ID NO: 2540971 - RNA, 17 nt, Human
agaacuagaaccuggag

SEQ ID NO: 2540972 - RNA, 19 nt, Human
agaacuacucagggaauga

SEQ ID NO: 2540973 - RNA, 22 nt, Human
agaacuacucagggaaugaagg

SEQ ID NO: 2540974 - RNA, 19 nt, Human
agaacucaaauggggccag

SEQ ID NO: 2540975 - RNA, 21 nt, Human
agaacuauaugugaauccucu

SEQ ID NO: 2540976 - RNA, 19 nt, Human
agaacuauaugugaauccu

SEQ ID NO: 2540977 - RNA, 16 nt, Human
agaacuauaugugaau

SEQ ID NO: 2540978 - RNA, 15 nt, Human
agaacucccuuucaa

SEQ ID NO: 2540979 - RNA, 16 nt, Human
agaacucccuuucaac

SEQ ID NO: 2540980 - RNA, 17 nt, Human
agaacucccuuucaaca

SEQ ID NO: 2540981 - RNA, 20 nt, Human
agaacucaaauggggccaga

SEQ ID NO: 2540982 - RNA, 14 nt, Human
agaacucacugggg

SEQ ID NO: 2540983 - RNA, 16 nt, Human
agaacucacuggggcc

SEQ ID NO: 2540984 - RNA, 11 nt, Human
agaacuccuag

SEQ ID NO: 2540985 - RNA, 18 nt, Human
agaacugcaggcccuggc

SEQ ID NO: 2540986 - RNA, 16 nt, Human
agaacugcaggcccug

SEQ ID NO: 2540987 - RNA, 20 nt, Human
agaacugcaggcccuggccu

SEQ ID NO: 2540988 - RNA, 15 nt, Human
agaacugcauauguu

SEQ ID NO: 2540989 - RNA, 19 nt, Human
agaacugcauauguuucgc

SEQ ID NO: 2540990 - RNA, 20 nt, Human
agaacugcauauguuucgcu

SEQ ID NO: 2540991 - RNA, 21 nt, Human
agaacugcauauguuucgcug

SEQ ID NO: 2540992 - RNA, 15 nt, Human
agaacugcaggcccu

SEQ ID NO: 2540993 - RNA, 12 nt, Human
agaacugcaggc

SEQ ID NO: 2540994 - RNA, 16 nt, Human
agaacugagcuccucu

SEQ ID NO: 2540995 - RNA, 22 nt, Human
agaacugagcuccucugggcag

SEQ ID NO: 2540996 - RNA, 15 nt, Human
agaacugaaugagaa

SEQ ID NO: 2540997 - RNA, 14 nt, Human
agaacuccuagggu

SEQ ID NO: 2540998 - RNA, 12 nt, Human
agaacugagcuc

SEQ ID NO: 2540999 - RNA, 15 nt, Human
agaacugagcuccuc

SEQ ID NO: 2541000 - RNA, 23 nt, Human
ucugcccuugguuaggcauugug

SEQ ID NO: 2541001 - RNA, 12 nt, Human
ucugcccuuggu

SEQ ID NO: 2541002 - RNA, 21 nt, Human
ucugcccuggcugcugccccc

SEQ ID NO: 2541003 - RNA, 16 nt, Human
ucugcccuggcugcug

SEQ ID NO: 2541004 - RNA, 15 nt, Human
ucugcccuggcugcu

SEQ ID NO: 2541005 - RNA, 14 nt, Human
ucugcccuggcugc

SEQ ID NO: 2541006 - RNA, 13 nt, Human
ucugcccuggcug

SEQ ID NO: 2541007 - RNA, 16 nt, Human
ucugcccccugcuggc

SEQ ID NO: 2541008 - RNA, 14 nt, Human
ucugcccccugcug

SEQ ID NO: 2541009 - RNA, 22 nt, Human
ucugcccugcgggucacaggag

SEQ ID NO: 2541010 - RNA, 23 nt, Human
ucugcccaggggugcccccuccu

SEQ ID NO: 2541011 - RNA, 22 nt, Human
ucugcccaggggugcccccucc

SEQ ID NO: 2541012 - RNA, 21 nt, Human
ucugcccaggggugcccccuc

SEQ ID NO: 2541013 - RNA, 20 nt, Human
ucugcccaggggugcccccu

SEQ ID NO: 2541014 - RNA, 18 nt, Human
ucugccccagaggccucu

SEQ ID NO: 2541015 - RNA, 15 nt, Human
ucugccccagaggcc

SEQ ID NO: 2541016 - RNA, 14 nt, Human
ucugccccagaggc

SEQ ID NO: 2541017 - RNA, 14 nt, Human
ucugccccagcucu

SEQ ID NO: 2541018 - RNA, 15 nt, Human
ucugccccauccucc

SEQ ID NO: 2541019 - RNA, 18 nt, Human
ucugccccauccuccagc

SEQ ID NO: 2541020 - RNA, 19 nt, Human
ucugccccauccuccagca

SEQ ID NO: 2541021 - RNA, 21 nt, Human
ucugccccauccuccagcagg

SEQ ID NO: 2541022 - RNA, 20 nt, Human
ucugccccagcucuggcuuc

SEQ ID NO: 2541023 - RNA, 16 nt, Human
ucugccccagcucugg

SEQ ID NO: 2541024 - RNA, 17 nt, Human
ucugccccagcucuggc

SEQ ID NO: 2541025 - RNA, 21 nt, Human
agaagccccuuccccauggga

SEQ ID NO: 2541026 - RNA, 20 nt, Human
agaagccccuuccccauggg

SEQ ID NO: 2541027 - RNA, 17 nt, Human
agaagcccccagcuaag

SEQ ID NO: 2541028 - RNA, 23 nt, Human
agaagcccccagcuaagaaccug

SEQ ID NO: 2541029 - RNA, 15 nt, Human
agaagccccuucccc

SEQ ID NO: 2541030 - RNA, 20 nt, Human
agaagccauugucuucggaa

SEQ ID NO: 2541031 - RNA, 24 nt, Human
agaagcccccagcuaagaaccugg

SEQ ID NO: 2541032 - RNA, 12 nt, Human
agaagcccccag

SEQ ID NO: 2541033 - RNA, 14 nt, Human
agaagcccccagcu

SEQ ID NO: 2541034 - RNA, 23 nt, Human
agaagcccaggaaaggcuccagg

SEQ ID NO: 2541035 - RNA, 20 nt, Human
ucugcccauccugccccuga

SEQ ID NO: 2541036 - RNA, 19 nt, Human
ucugcccaggggugccccc

SEQ ID NO: 2541037 - RNA, 14 nt, Human
ucugcccaggggug

SEQ ID NO: 2541038 - RNA, 23 nt, Human
ucugcccaggacggggccggcca

SEQ ID NO: 2541039 - RNA, 12 nt, Human
ucugcccaggac

SEQ ID NO: 2541040 - RNA, 23 nt, Human
ucugcccacucccugcaaccuga

SEQ ID NO: 2541041 - RNA, 16 nt, Human
ucugcccagcuugggc

SEQ ID NO: 2541042 - RNA, 19 nt, Human
ucugcccagcuugggccca

SEQ ID NO: 2541043 - RNA, 20 nt, Human
agaagcccgugugagaagug

SEQ ID NO: 2541044 - RNA, 12 nt, Human
ucugcccagcuu

SEQ ID NO: 2541045 - RNA, 12 nt, Human
agaagccaggaa

SEQ ID NO: 2541046 - RNA, 13 nt, Human
agaagccaggaau

SEQ ID NO: 2541047 - RNA, 21 nt, Human
agaagccacaggccugagauu

SEQ ID NO: 2541048 - RNA, 19 nt, Human
agaagccacaggccugaga

SEQ ID NO: 2541049 - RNA, 20 nt, Human
agaagccaggagcaaauguu

SEQ ID NO: 2541050 - RNA, 14 nt, Human
agaagccaggagca

SEQ ID NO: 2541051 - RNA, 12 nt, Human
agaagccaggag

SEQ ID NO: 2541052 - RNA, 22 nt, Human
agaagccaggaauuucccagga

SEQ ID NO: 2541053 - RNA, 12 nt, Human
agaagccauugu

SEQ ID NO: 2541054 - RNA, 11 nt, Human
agaagccauug

SEQ ID NO: 2541055 - RNA, 10 nt, Human
agaagccauu

SEQ ID NO: 2541056 - RNA, 15 nt, Human
agaagccauugucuu

SEQ ID NO: 2541057 - RNA, 14 nt, Human
agaagccauugucu

SEQ ID NO: 2541058 - RNA, 18 nt, Human
agaagcccaauauuauaa

SEQ ID NO: 2541059 - RNA, 14 nt, Human
agaagcagaaauac

SEQ ID NO: 2541060 - RNA, 20 nt, Human
agaagcaauaaagaagagug

SEQ ID NO: 2541061 - RNA, 21 nt, Human
agaagcaauaaagaagagugc

SEQ ID NO: 2541062 - RNA, 12 nt, Human
agaagcagcucu

SEQ ID NO: 2541063 - RNA, 14 nt, Human
agaagcaggcugga

SEQ ID NO: 2541064 - RNA, 18 nt, Human
agaagcaggcuacacuga

SEQ ID NO: 2541065 - RNA, 13 nt, Human
agaagcagaugag

SEQ ID NO: 2541066 - RNA, 15 nt, Human
agaagcagaaauaca

SEQ ID NO: 2541067 - RNA, 13 nt, Human
agaagcagcucuu

SEQ ID NO: 2541068 - RNA, 18 nt, Human
agaagccacaggccugag

SEQ ID NO: 2541069 - RNA, 13 nt, Human
agaagcauuccuu

SEQ ID NO: 2541070 - RNA, 21 nt, Human
agaagcauuaacuucucugga

SEQ ID NO: 2541071 - RNA, 18 nt, Human
agaagcauuaacuucucu

SEQ ID NO: 2541072 - RNA, 13 nt, Human
agaagcaugaaaa

SEQ ID NO: 2541073 - RNA, 15 nt, Human
agaagcaugaaaaag

SEQ ID NO: 2541074 - RNA, 16 nt, Human
agaagcaugaaaaagc

SEQ ID NO: 2541075 - RNA, 13 nt, Human
agaagcagugagc

SEQ ID NO: 2541076 - RNA, 14 nt, Human
agaagcagugagcc

SEQ ID NO: 2541077 - RNA, 17 nt, Human
agaagcagugagccgca

SEQ ID NO: 2541078 - RNA, 23 nt, Human
agaagcagugagccgcaucuucu

SEQ ID NO: 2541079 - RNA, 15 nt, Human
agaagcauacaacuu

SEQ ID NO: 2541080 - RNA, 19 nt, Human
agaagcaacccaaauguuc

SEQ ID NO: 2541081 - RNA, 15 nt, Human
agaagcaagaaagaa

SEQ ID NO: 2541082 - RNA, 19 nt, Human
agaagcaccaaucaugaau

SEQ ID NO: 2541083 - RNA, 16 nt, Human
agaagcagaggaagga

SEQ ID NO: 2541084 - RNA, 18 nt, Human
agaacuuucauuuuuuuc

SEQ ID NO: 2541085 - RNA, 16 nt, Human
agaacuuucauuuuuu

SEQ ID NO: 2541086 - RNA, 15 nt, Human
agaacuuucauuuuu

SEQ ID NO: 2541087 - RNA, 14 nt, Human
agaacuuucauuuu

SEQ ID NO: 2541088 - RNA, 16 nt, Human
agaacuuugaaggaca

SEQ ID NO: 2541089 - RNA, 18 nt, Human
agaacuuggauguaccug

SEQ ID NO: 2541090 - RNA, 23 nt, Human
agaacuuggauguaccugccccc

SEQ ID NO: 2541091 - RNA, 14 nt, Human
ucugccugucuccc

SEQ ID NO: 2541092 - RNA, 12 nt, Human
ucugccugucuc

SEQ ID NO: 2541093 - RNA, 16 nt, Human
ucugcccuucacccca

SEQ ID NO: 2541094 - RNA, 17 nt, Human
ucugcccuggcugcugc

SEQ ID NO: 2541095 - RNA, 18 nt, Human
ucugcccuugccaacgga

SEQ ID NO: 2541096 - RNA, 13 nt, Human
ucugccugucccu

SEQ ID NO: 2541097 - RNA, 17 nt, Human
ucugccugucccucuca

SEQ ID NO: 2541098 - RNA, 18 nt, Human
ucugccugucccucucag

SEQ ID NO: 2541099 - RNA, 21 nt, Human
ucugccugucccucucaggca

SEQ ID NO: 2541100 - RNA, 18 nt, Human
ucugcuuugacugagcag

SEQ ID NO: 2541101 - RNA, 13 nt, Human
ucugccuuccuug

SEQ ID NO: 2541102 - RNA, 19 nt, Human
ucugccuuagucucaguuu

SEQ ID NO: 2541103 - RNA, 20 nt, Human
ucugccuuaaaaccaaagag

SEQ ID NO: 2541104 - RNA, 15 nt, Human
ucugccuuagucuca

SEQ ID NO: 2541105 - RNA, 17 nt, Human
ucugccuuaaaaccaaa

SEQ ID NO: 2541106 - RNA, 16 nt, Human
ucugccuuaaaaccaa

SEQ ID NO: 2541107 - RNA, 22 nt, Human
ucugccuguuauaacucugcac

SEQ ID NO: 2541108 - RNA, 21 nt, Human
ucugccuguuauaacucugca

SEQ ID NO: 2541109 - RNA, 19 nt, Human
ucugccuguuauaacucug

SEQ ID NO: 2541110 - RNA, 15 nt, Human
ucugccuguuauaac

SEQ ID NO: 2541111 - RNA, 16 nt, Human
ucugccuguggaacug

SEQ ID NO: 2541112 - RNA, 20 nt, Human
ucugcuuuucugcccuggcu

SEQ ID NO: 2541113 - RNA, 19 nt, Human
ucugcuuuucugcccuggc

SEQ ID NO: 2541114 - RNA, 18 nt, Human
ucugcuuuucugcccugg

SEQ ID NO: 2541115 - RNA, 17 nt, Human
ucugcuuuucugcccug

SEQ ID NO: 2541116 - RNA, 16 nt, Human
ucugcuuuucugcccu

SEQ ID NO: 2541117 - RNA, 15 nt, Human
ucugcuuuucugccc

SEQ ID NO: 2541118 - RNA, 13 nt, Human
ucugcuuuuacca

SEQ ID NO: 2541119 - RNA, 12 nt, Human
ucugccuguccc

SEQ ID NO: 2541120 - RNA, 22 nt, Human
ucugcuuuucugcccuggcugc

SEQ ID NO: 2541121 - RNA, 21 nt, Human
ucugcuuuucugcccuggcug

SEQ ID NO: 2541122 - RNA, 17 nt, Human
ucuggaaccucagccug

SEQ ID NO: 2541123 - RNA, 16 nt, Human
ucuggaaccucagccu

SEQ ID NO: 2541124 - RNA, 18 nt, Human
ucugcuuuuaccaugccc

SEQ ID NO: 2541125 - RNA, 20 nt, Human
ucugcuuugcucuucaagaa

SEQ ID NO: 2541126 - RNA, 21 nt, Human
ucugcuuugacugagcagacu

SEQ ID NO: 2541127 - RNA, 22 nt, Human
ucugcuuugggguuuaucagaa

SEQ ID NO: 2541128 - RNA, 21 nt, Human
ucuggcaaagcuuuuagaaau

SEQ ID NO: 2541129 - RNA, 22 nt, Human
ucuggcacacaguaggugcuca

SEQ ID NO: 2541130 - RNA, 22 nt, Human
ucuggauucccaggaugagcau

SEQ ID NO: 2541131 - RNA, 21 nt, Human
ucuggauucccaggaugagca

SEQ ID NO: 2541132 - RNA, 17 nt, Human
ucuggauucccaggaug

SEQ ID NO: 2541133 - RNA, 14 nt, Human
ucuggauucccagg

SEQ ID NO: 2541134 - RNA, 13 nt, Human
ucuggauucccag

SEQ ID NO: 2541135 - RNA, 15 nt, Human
ucuggcaacaucuuu

SEQ ID NO: 2541136 - RNA, 16 nt, Human
ucuggcaacaucuuua

SEQ ID NO: 2541137 - RNA, 15 nt, Human
ucuggauucuuggcc

SEQ ID NO: 2541138 - RNA, 16 nt, Human
ucuggauucuuggccc

SEQ ID NO: 2541139 - RNA, 14 nt, Human
ucuggauuguggga

SEQ ID NO: 2541140 - RNA, 19 nt, Human
ucuggaagugacuuuggcu

SEQ ID NO: 2541141 - RNA, 22 nt, Human
ucuggaagugacuuuggcugca

SEQ ID NO: 2541142 - RNA, 18 nt, Human
ucuggaagugacuuuggc

SEQ ID NO: 2541143 - RNA, 13 nt, Human
ucuggaaguccaa

SEQ ID NO: 2541144 - RNA, 18 nt, Human
ucuggaaccucagccugg

SEQ ID NO: 2541145 - RNA, 19 nt, Human
ucuggaaccucagccuggc

SEQ ID NO: 2541146 - RNA, 20 nt, Human
ucuggaaccucagccuggcc

SEQ ID NO: 2541147 - RNA, 21 nt, Human
ucuggaaccucagccuggcca

SEQ ID NO: 2541148 - RNA, 23 nt, Human
ucuggaaccucagccuggccaga

SEQ ID NO: 2541149 - RNA, 13 nt, Human
ucuggaagagagg

SEQ ID NO: 2541150 - RNA, 20 nt, Human
ucuggaagagaggaaugccu

SEQ ID NO: 2541151 - RNA, 16 nt, Human
ucuggccucccacccg

SEQ ID NO: 2541152 - RNA, 15 nt, Human
ucuggccucccaccc

SEQ ID NO: 2541153 - RNA, 14 nt, Human
ucuggccucccacc

SEQ ID NO: 2541154 - RNA, 11 nt, Human
ucuggccucca

SEQ ID NO: 2541155 - RNA, 23 nt, Human
ucuggccucccacccgaugcugc

SEQ ID NO: 2541156 - RNA, 10 nt, Human
ucuggccuuc

SEQ ID NO: 2541157 - RNA, 14 nt, Human
agaagccgggaaca

SEQ ID NO: 2541158 - RNA, 16 nt, Human
agaagccgggaacaga

SEQ ID NO: 2541159 - RNA, 18 nt, Human
agaagccgggaacagaca

SEQ ID NO: 2541160 - RNA, 22 nt, Human
agaagccgggaacagacaacag

SEQ ID NO: 2541161 - RNA, 17 nt, Human
agaagcucccaggaaca

SEQ ID NO: 2541162 - RNA, 16 nt, Human
agaagcucccaggaac

SEQ ID NO: 2541163 - RNA, 15 nt, Human
agaagcucccaggaa

SEQ ID NO: 2541164 - RNA, 14 nt, Human
agaagccgugggug

SEQ ID NO: 2541165 - RNA, 17 nt, Human
agaagccugaugcugac

SEQ ID NO: 2541166 - RNA, 17 nt, Human
agaagccugaggcuggg

SEQ ID NO: 2541167 - RNA, 12 nt, Human
agaagccugagg

SEQ ID NO: 2541168 - RNA, 14 nt, Human
agaagccugaggcu

SEQ ID NO: 2541169 - RNA, 22 nt, Human
agaagccucugggucagugguc

SEQ ID NO: 2541170 - RNA, 23 nt, Human
agaagccucugggucaguggucc

SEQ ID NO: 2541171 - RNA, 16 nt, Human
agaagccucuggcuag

SEQ ID NO: 2541172 - RNA, 23 nt, Human
agaagccucuggcuagaggccag

SEQ ID NO: 2541173 - RNA, 15 nt, Human
agaagccuccccagc

SEQ ID NO: 2541174 - RNA, 12 nt, Human
agaagccucugg

SEQ ID NO: 2541175 - RNA, 13 nt, Human
agaagccucuggc

SEQ ID NO: 2541176 - RNA, 14 nt, Human
agaagccucuggcu

SEQ ID NO: 2541177 - RNA, 23 nt, Human
ucuggcagaguugaagacagagc

SEQ ID NO: 2541178 - RNA, 20 nt, Human
ucuggcagaguugaagacag

SEQ ID NO: 2541179 - RNA, 17 nt, Human
ucuggcagcucagagag

SEQ ID NO: 2541180 - RNA, 16 nt, Human
ucuggcagcucagaga

SEQ ID NO: 2541181 - RNA, 21 nt, Human
ucuggcagcucagagagggug

SEQ ID NO: 2541182 - RNA, 18 nt, Human
ucuggcagcucagagagg

SEQ ID NO: 2541183 - RNA, 19 nt, Human
ucuggcagggugggaugga

SEQ ID NO: 2541184 - RNA, 13 nt, Human
ucuggccuagucc

SEQ ID NO: 2541185 - RNA, 20 nt, Human
ucuggcagggugggauggag

SEQ ID NO: 2541186 - RNA, 18 nt, Human
ucuggccucaggugggcc

SEQ ID NO: 2541187 - RNA, 13 nt, Human
ucuggccucaggu

SEQ ID NO: 2541188 - RNA, 20 nt, Human
ucuggccuagucccuuccac

SEQ ID NO: 2541189 - RNA, 18 nt, Human
ucuggccuagucccuucc

SEQ ID NO: 2541190 - RNA, 13 nt, Human
ucuggccucccac

SEQ ID NO: 2541191 - RNA, 14 nt, Human
ucuggccucccaca

SEQ ID NO: 2541192 - RNA, 22 nt, Human
agaauaaagcaauuuuccuuga

SEQ ID NO: 2541193 - RNA, 20 nt, Human
agaauaaagcaauuuuccuu

SEQ ID NO: 2541194 - RNA, 19 nt, Human
agaauaaagcaauuuuccu

SEQ ID NO: 2541195 - RNA, 18 nt, Human
agaauaaagcaauuuucc

SEQ ID NO: 2541196 - RNA, 23 nt, Human
agaauaaagcaauuuuccuugaa

SEQ ID NO: 2541197 - RNA, 21 nt, Human
agaauaaaguucugaguguuu

SEQ ID NO: 2541198 - RNA, 17 nt, Human
agaauaaaguucugagu

SEQ ID NO: 2541199 - RNA, 17 nt, Human
agaauaaucacgcuuuc

SEQ ID NO: 2541200 - RNA, 20 nt, Human
agaauaaucacgcuuuccug

SEQ ID NO: 2541201 - RNA, 21 nt, Human
agaauaaucacgcuuuccuga

SEQ ID NO: 2541202 - RNA, 13 nt, Human
agaauaaucuuug

SEQ ID NO: 2541203 - RNA, 17 nt, Human
agaaguuuuuguacugu

SEQ ID NO: 2541204 - RNA, 16 nt, Human
agaaguuuuuguacug

SEQ ID NO: 2541205 - RNA, 13 nt, Human
agaauaaacuggc

SEQ ID NO: 2541206 - RNA, 17 nt, Human
agaauaaagcaauuuuc

SEQ ID NO: 2541207 - RNA, 16 nt, Human
agaauaaagcaauuuu

SEQ ID NO: 2541208 - RNA, 15 nt, Human
agaauaaagcaauuu

SEQ ID NO: 2541209 - RNA, 14 nt, Human
agaauaaagcaauu

SEQ ID NO: 2541210 - RNA, 13 nt, Human
agaauaaagcaau

SEQ ID NO: 2541211 - RNA, 12 nt, Human
agaauaaagcaa

SEQ ID NO: 2541212 - RNA, 11 nt, Human
agaauaaagca

SEQ ID NO: 2541213 - RNA, 15 nt, Human
agaaguuuuuguacu

SEQ ID NO: 2541214 - RNA, 14 nt, Human
agaaguuuuuguac

SEQ ID NO: 2541215 - RNA, 12 nt, Human
agaaguuuuugu

SEQ ID NO: 2541216 - RNA, 11 nt, Human
agaaguuuuug

SEQ ID NO: 2541217 - RNA, 16 nt, Human
agaaguuuuguacaga

SEQ ID NO: 2541218 - RNA, 20 nt, Human
agaaguuugauauuaaagga

SEQ ID NO: 2541219 - RNA, 15 nt, Human
agaaguuugucaagu

SEQ ID NO: 2541220 - RNA, 15 nt, Human
agaauaaugaaugga

SEQ ID NO: 2541221 - RNA, 23 nt, Human
agaauaauaugcugccaaauuuu

SEQ ID NO: 2541222 - RNA, 16 nt, Human
agaauaaucuuugggu

SEQ ID NO: 2541223 - RNA, 15 nt, Human
agaauacaaacauau

SEQ ID NO: 2541224 - RNA, 16 nt, Human
agaauacaaacauauu

SEQ ID NO: 2541225 - RNA, 12 nt, Human
agaauacagaaa

SEQ ID NO: 2541226 - RNA, 18 nt, Human
agaauacagaaagaugga

SEQ ID NO: 2541227 - RNA, 22 nt, Human
agaauacaguaagcugcucuau

SEQ ID NO: 2541228 - RNA, 21 nt, Human
agaauacagaaagauggaugu

SEQ ID NO: 2541229 - RNA, 21 nt, Human
agaauagccacauuuggaaua

SEQ ID NO: 2541230 - RNA, 20 nt, Human
agaauagccacauuuggaau

SEQ ID NO: 2541231 - RNA, 19 nt, Human
agaauagccacauuuggaa

SEQ ID NO: 2541232 - RNA, 18 nt, Human
agaauacaguaagcugcu

SEQ ID NO: 2541233 - RNA, 23 nt, Human
agaaucaacauuucucaauaauu

SEQ ID NO: 2541234 - RNA, 21 nt, Human
agaaucaacauuucucaauaa

SEQ ID NO: 2541235 - RNA, 21 nt, Human
agaaucaaagcaaugcauuuu

SEQ ID NO: 2541236 - RNA, 19 nt, Human
agaaucaaagcaaugcauu

SEQ ID NO: 2541237 - RNA, 13 nt, Human
agaaucaaagcaa

SEQ ID NO: 2541238 - RNA, 13 nt, Human
agaauauauacau

SEQ ID NO: 2541239 - RNA, 20 nt, Human
agaauauuuuaaguauugca

SEQ ID NO: 2541240 - RNA, 17 nt, Human
agaauauaauuaucgga

SEQ ID NO: 2541241 - RNA, 14 nt, Human
agaaucaaaacucu

SEQ ID NO: 2541242 - RNA, 14 nt, Human
agaauauaauuauc

SEQ ID NO: 2541243 - RNA, 15 nt, Human
agaauauaauuaucg

SEQ ID NO: 2541244 - RNA, 23 nt, Human
agaauauaauuaucggaagcagu

SEQ ID NO: 2541245 - RNA, 13 nt, Human
agaauauaauacu

SEQ ID NO: 2541246 - RNA, 16 nt, Human
agaauauaaaaaacuu

SEQ ID NO: 2541247 - RNA, 13 nt, Human
agaaguugauaug

SEQ ID NO: 2541248 - RNA, 17 nt, Human
agaaguggaccaggaca

SEQ ID NO: 2541249 - RNA, 18 nt, Human
agaaguggaccaggacag

SEQ ID NO: 2541250 - RNA, 19 nt, Human
agaaguggaccaggacagg

SEQ ID NO: 2541251 - RNA, 19 nt, Human
agaagugagcuuugcugcu

SEQ ID NO: 2541252 - RNA, 18 nt, Human
agaagugagaauaggcag

SEQ ID NO: 2541253 - RNA, 21 nt, Human
agaagugagaauaggcagccc

SEQ ID NO: 2541254 - RNA, 23 nt, Human
agaagugagcuuugcugcuacag

SEQ ID NO: 2541255 - RNA, 13 nt, Human
agaagugccccug

SEQ ID NO: 2541256 - RNA, 14 nt, Human
agaagugccccugc

SEQ ID NO: 2541257 - RNA, 16 nt, Human
agaagugccccugcug

SEQ ID NO: 2541258 - RNA, 22 nt, Human
agaagugccccugcugccuccc

SEQ ID NO: 2541259 - RNA, 19 nt, Human
agaagugccccugcugccu

SEQ ID NO: 2541260 - RNA, 15 nt, Human
agaaguggaccagga

SEQ ID NO: 2541261 - RNA, 14 nt, Human
agaaguuguuuguc

SEQ ID NO: 2541262 - RNA, 19 nt, Human
agaaguugauauagaacag

SEQ ID NO: 2541263 - RNA, 18 nt, Human
agaaguugauauagaaca

SEQ ID NO: 2541264 - RNA, 19 nt, Human
agaaguugaaugggcacag

SEQ ID NO: 2541265 - RNA, 15 nt, Human
agaaguuuaaggaau

SEQ ID NO: 2541266 - RNA, 16 nt, Human
agaaguuuaaggaaua

SEQ ID NO: 2541267 - RNA, 17 nt, Human
agaaguuuaaggaauau

SEQ ID NO: 2541268 - RNA, 23 nt, Human
agaaguuucuggcccuggcugac

SEQ ID NO: 2541269 - RNA, 16 nt, Human
agaaguuucuggcccu

SEQ ID NO: 2541270 - RNA, 22 nt, Human
agaaguuugagaucagccuggg

SEQ ID NO: 2541271 - RNA, 23 nt, Human
agaagugacagggaagcuacagg

SEQ ID NO: 2541272 - RNA, 22 nt, Human
agaagugacagggaagcuacag

SEQ ID NO: 2541273 - RNA, 19 nt, Human
agaagugacagggaagcua

SEQ ID NO: 2541274 - RNA, 18 nt, Human
agaagugacagggaagcu

SEQ ID NO: 2541275 - RNA, 11 nt, Human
agaaggcaaaa

SEQ ID NO: 2541276 - RNA, 17 nt, Human
agaaggauguacauuuc

SEQ ID NO: 2541277 - RNA, 19 nt, Human
agaaggagagaaagugggu

SEQ ID NO: 2541278 - RNA, 18 nt, Human
agaaggagagaaaguggg

SEQ ID NO: 2541279 - RNA, 14 nt, Human
agaaggagagaaag

SEQ ID NO: 2541280 - RNA, 20 nt, Human
agaaggagacagagcugguu

SEQ ID NO: 2541281 - RNA, 20 nt, Human
agaaggagucagaaacuguu

SEQ ID NO: 2541282 - RNA, 14 nt, Human
agaaggaugaauga

SEQ ID NO: 2541283 - RNA, 21 nt, Human
agaaggaugaaugagguccca

SEQ ID NO: 2541284 - RNA, 16 nt, Human
agaaggauguacauuu

SEQ ID NO: 2541285 - RNA, 14 nt, Human
agaagcuccucucc

SEQ ID NO: 2541286 - RNA, 17 nt, Human
agaagcuccucucccca

SEQ ID NO: 2541287 - RNA, 18 nt, Human
agaagcuccucuccccag

SEQ ID NO: 2541288 - RNA, 20 nt, Human
agaagcuccucuccccagcc

SEQ ID NO: 2541289 - RNA, 18 nt, Human
agaagcucccaggaacaa

SEQ ID NO: 2541290 - RNA, 23 nt, Human
agaagcucccugaaguaagcaaa

SEQ ID NO: 2541291 - RNA, 22 nt, Human
agaaggaauucuaggcauccca

SEQ ID NO: 2541292 - RNA, 15 nt, Human
agaaggaauuugagu

SEQ ID NO: 2541293 - RNA, 15 nt, Human
agaaggagaaggaag

SEQ ID NO: 2541294 - RNA, 14 nt, Human
agaaggagacagag

SEQ ID NO: 2541295 - RNA, 17 nt, Human
agaaggagacagagcug

SEQ ID NO: 2541296 - RNA, 13 nt, Human
agaaggagagaaa

SEQ ID NO: 2541297 - RNA, 22 nt, Human
agaagcuccucuccccagccca

SEQ ID NO: 2541298 - RNA, 23 nt, Human
agaagcuccucuccccagcccag

SEQ ID NO: 2541299 - RNA, 21 nt, Human
agaagcugaagugcauccaaa

SEQ ID NO: 2541300 - RNA, 20 nt, Human
ugaaaaucuuauaauuuaaa

SEQ ID NO: 2541301 - RNA, 19 nt, Human
ugaaaaucgugacaacacu

SEQ ID NO: 2541302 - RNA, 17 nt, Human
ugaaaauguauguguaa

SEQ ID NO: 2541303 - RNA, 16 nt, Human
ugaaaauguacugaga

SEQ ID NO: 2541304 - RNA, 13 nt, Human
ugaaaauguacug

SEQ ID NO: 2541305 - RNA, 12 nt, Human
ugaaaauguacu

SEQ ID NO: 2541306 - RNA, 21 nt, Human
ugaaaaucuaauauuaaaaau

SEQ ID NO: 2541307 - RNA, 17 nt, Human
ugaaaaucuaauauuaa

SEQ ID NO: 2541308 - RNA, 15 nt, Human
ugaaaaucuaauauu

SEQ ID NO: 2541309 - RNA, 14 nt, Human
ugaaaaucuaauau

SEQ ID NO: 2541310 - RNA, 14 nt, Human
ugaaaaugucuugu

SEQ ID NO: 2541311 - RNA, 15 nt, Human
ugaaaaugucuugug

SEQ ID NO: 2541312 - RNA, 16 nt, Human
ugaaacgcaaccacca

SEQ ID NO: 2541313 - RNA, 13 nt, Human
ugaaaaugucuug

SEQ ID NO: 2541314 - RNA, 21 nt, Human
ugaaaaugucagaaaccaguu

SEQ ID NO: 2541315 - RNA, 14 nt, Human
ugaaaaugucaaag

SEQ ID NO: 2541316 - RNA, 14 nt, Human
ugaaaaugucagaa

SEQ ID NO: 2541317 - RNA, 15 nt, Human
ugaaaaugucagaaa

SEQ ID NO: 2541318 - RNA, 18 nt, Human
ugaaaaugucagaaacca

SEQ ID NO: 2541319 - RNA, 13 nt, Human
ugaaacuccaccu

SEQ ID NO: 2541320 - RNA, 21 nt, Human
ugaaacuccaccuugcgggga

SEQ ID NO: 2541321 - RNA, 19 nt, Human
ugaaacucguuaauuugua

SEQ ID NO: 2541322 - RNA, 22 nt, Human
ugaaacugagaugugaacacau

SEQ ID NO: 2541323 - RNA, 12 nt, Human
ugaaacuuggau

SEQ ID NO: 2541324 - RNA, 12 nt, Human
ugaaacuuauuu

SEQ ID NO: 2541325 - RNA, 16 nt, Human
ugaaacuuacacacaa

SEQ ID NO: 2541326 - RNA, 18 nt, Human
ugaaacuggcacugaauu

SEQ ID NO: 2541327 - RNA, 16 nt, Human
ugaaaaaugugcaaaa

SEQ ID NO: 2541328 - RNA, 18 nt, Human
ugaaaaaucggcuuacca

SEQ ID NO: 2541329 - RNA, 13 nt, Human
ugaaaaauuccua

SEQ ID NO: 2541330 - RNA, 20 nt, Human
ugaaaaaugugcaaaacagc

SEQ ID NO: 2541331 - RNA, 12 nt, Human
ugaaaaauuccu

SEQ ID NO: 2541332 - RNA, 22 nt, Human
ugaaaaauuccuauugugauuu

SEQ ID NO: 2541333 - RNA, 20 nt, Human
ugaaaaauuccuauugugau

SEQ ID NO: 2541334 - RNA, 19 nt, Human
ugaaaaauuccuuuguguu

SEQ ID NO: 2541335 - RNA, 13 nt, Human
ugaaaaauucuca

SEQ ID NO: 2541336 - RNA, 18 nt, Human
ugaaaaauuuaagcauug

SEQ ID NO: 2541337 - RNA, 19 nt, Human
ugaaaaauuuaagcauugu

SEQ ID NO: 2541338 - RNA, 20 nt, Human
ugaaaagcuccauuuuuagu

SEQ ID NO: 2541339 - RNA, 20 nt, Human
ugaaaaaggaggaagagaaa

SEQ ID NO: 2541340 - RNA, 22 nt, Human
ugaaaaaggaggaagagaaaaa

SEQ ID NO: 2541341 - RNA, 22 nt, Human
ugaaaaaguucugcagauaaac

SEQ ID NO: 2541342 - RNA, 22 nt, Human
ugaaaaaguauccugcuucuga

SEQ ID NO: 2541343 - RNA, 20 nt, Human
ugaaaauaugauguuucaca

SEQ ID NO: 2541344 - RNA, 11 nt, Human
ugaaaauauuu

SEQ ID NO: 2541345 - RNA, 12 nt, Human
ugaaaauauuua

SEQ ID NO: 2541346 - RNA, 13 nt, Human
ugaaaauauuuaa

SEQ ID NO: 2541347 - RNA, 14 nt, Human
ugaaaauauuuaaa

SEQ ID NO: 2541348 - RNA, 16 nt, Human
ugaaaaucgugacaac

SEQ ID NO: 2541349 - RNA, 20 nt, Human
ugaaaaguuacuaccuguca

SEQ ID NO: 2541350 - RNA, 14 nt, Human
ugaaaagucaaacu

SEQ ID NO: 2541351 - RNA, 12 nt, Human
ugaaaagucaaa

SEQ ID NO: 2541352 - RNA, 14 nt, Human
ugaaaauauaacca

SEQ ID NO: 2541353 - RNA, 16 nt, Human
ugaaaauauaaccagc

SEQ ID NO: 2541354 - RNA, 23 nt, Human
ugaaaaggugaccuugcaacuuc

SEQ ID NO: 2541355 - RNA, 16 nt, Human
ugaaaaggugaccuug

SEQ ID NO: 2541356 - RNA, 17 nt, Human
ucuuucucugccaguga

SEQ ID NO: 2541357 - RNA, 16 nt, Human
ucuuucucugccagug

SEQ ID NO: 2541358 - RNA, 15 nt, Human
ucuuucucugccagu

SEQ ID NO: 2541359 - RNA, 13 nt, Human
ucuuucucugcca

SEQ ID NO: 2541360 - RNA, 12 nt, Human
ucuuucucugcc

SEQ ID NO: 2541361 - RNA, 11 nt, Human
ucuuucucugc

SEQ ID NO: 2541362 - RNA, 14 nt, Human
ucuuucugauaacu

SEQ ID NO: 2541363 - RNA, 20 nt, Human
ucuuucugauaacuagaugg

SEQ ID NO: 2541364 - RNA, 23 nt, Human
ucuuucugauaacuagauggugc

SEQ ID NO: 2541365 - RNA, 21 nt, Human
ucuuucugagcacacuuuagu

SEQ ID NO: 2541366 - RNA, 19 nt, Human
ucuuucugagcacacuuua

SEQ ID NO: 2541367 - RNA, 18 nt, Human
ucuuucugagcacacuuu

SEQ ID NO: 2541368 - RNA, 20 nt, Human
ucuuucuggcuaugcauuug

SEQ ID NO: 2541369 - RNA, 21 nt, Human
ucuuucuggcuaugcauuuga

SEQ ID NO: 2541370 - RNA, 10 nt, Human
ucuuucugua

SEQ ID NO: 2541371 - RNA, 16 nt, Human
ucuuucugaugucaaa

SEQ ID NO: 2541372 - RNA, 13 nt, Human
ucuuucuuagaaa

SEQ ID NO: 2541373 - RNA, 14 nt, Human
ucuuucugucccuu

SEQ ID NO: 2541374 - RNA, 13 nt, Human
ucuuucugucccu

SEQ ID NO: 2541375 - RNA, 14 nt, Human
ucuuucuguauuga

SEQ ID NO: 2541376 - RNA, 15 nt, Human
agagacaggagggca

SEQ ID NO: 2541377 - RNA, 20 nt, Human
ucuuucuuacaaggaaggug

SEQ ID NO: 2541378 - RNA, 14 nt, Human
agagacaggagggc

SEQ ID NO: 2541379 - RNA, 23 nt, Human
agagacaggaaaauccucuggcu

SEQ ID NO: 2541380 - RNA, 17 nt, Human
agagacauacuugaagg

SEQ ID NO: 2541381 - RNA, 22 nt, Human
agagacauacuugaagggccag

SEQ ID NO: 2541382 - RNA, 23 nt, Human
agagacauacuugaagggccaga

SEQ ID NO: 2541383 - RNA, 23 nt, Human
agagacaguugggugagaacaac

SEQ ID NO: 2541384 - RNA, 12 nt, Human
agagacagucac

SEQ ID NO: 2541385 - RNA, 20 nt, Human
agagacaguugggugagaac

SEQ ID NO: 2541386 - RNA, 22 nt, Human
agagacaguugggugagaacaa

SEQ ID NO: 2541387 - RNA, 20 nt, Human
agagacaggcccaagagaug

SEQ ID NO: 2541388 - RNA, 15 nt, Human
agagacaggcccaag

SEQ ID NO: 2541389 - RNA, 18 nt, Human
agagacaggcccaagaga

SEQ ID NO: 2541390 - RNA, 22 nt, Human
ucuuuggucuacacugugcuga

SEQ ID NO: 2541391 - RNA, 14 nt, Human
agagacauuccucc

SEQ ID NO: 2541392 - RNA, 12 nt, Human
agagacauuccu

SEQ ID NO: 2541393 - RNA, 17 nt, Human
ucuuugguggcuuugca

SEQ ID NO: 2541394 - RNA, 18 nt, Human
ucuuuguaagaguguaga

SEQ ID NO: 2541395 - RNA, 14 nt, Human
ucuuuguaagagug

SEQ ID NO: 2541396 - RNA, 13 nt, Human
ucuuuguaagagu

SEQ ID NO: 2541397 - RNA, 13 nt, Human
ucuuuguguagcu

SEQ ID NO: 2541398 - RNA, 15 nt, Human
ucuuuguguagcuuu

SEQ ID NO: 2541399 - RNA, 18 nt, Human
ucuuuguguagcuuugcu

SEQ ID NO: 2541400 - RNA, 13 nt, Human
ucuuuuaaaagac

SEQ ID NO: 2541401 - RNA, 19 nt, Human
ucuuuuaaaaauucaaaug

SEQ ID NO: 2541402 - RNA, 18 nt, Human
ucuuuuaaaaauucaaau

SEQ ID NO: 2541403 - RNA, 22 nt, Human
ucuuuguucucagcucccccug

SEQ ID NO: 2541404 - RNA, 18 nt, Human
ucuuuguuggaaaagaau

SEQ ID NO: 2541405 - RNA, 20 nt, Human
ucuuuguucucagcuccccc

SEQ ID NO: 2541406 - RNA, 19 nt, Human
ucuuuguucucagcucccc

SEQ ID NO: 2541407 - RNA, 18 nt, Human
ucuuuguucucagcuccc

SEQ ID NO: 2541408 - RNA, 17 nt, Human
ucuuuguucucagcucc

SEQ ID NO: 2541409 - RNA, 16 nt, Human
ucuuuguucucagcuc

SEQ ID NO: 2541410 - RNA, 12 nt, Human
ucuuuguucuca

SEQ ID NO: 2541411 - RNA, 23 nt, Human
ucuuuguucauagcccaguagac

SEQ ID NO: 2541412 - RNA, 16 nt, Human
ucuuuguucauagccc

SEQ ID NO: 2541413 - RNA, 21 nt, Human
ucuuuguuaucaaacuucagc

SEQ ID NO: 2541414 - RNA, 15 nt, Human
ucuuuguuacaggca

SEQ ID NO: 2541415 - RNA, 16 nt, Human
ucuuuuaaaagacaag

SEQ ID NO: 2541416 - RNA, 14 nt, Human
ucuuuuaaaagaca

SEQ ID NO: 2541417 - RNA, 21 nt, Human
ucuuuuaaaagacaagacuuc

SEQ ID NO: 2541418 - RNA, 12 nt, Human
ucuuuuacaacu

SEQ ID NO: 2541419 - RNA, 14 nt, Human
ucuuuuacauucug

SEQ ID NO: 2541420 - RNA, 18 nt, Human
ucuuuuacucaugaucuu

SEQ ID NO: 2541421 - RNA, 14 nt, Human
ugaaaaaaaaguuu

SEQ ID NO: 2541422 - RNA, 16 nt, Human
ugaaaaaaaaguuuca

SEQ ID NO: 2541423 - RNA, 17 nt, Human
ugaaaaaaaguuuacaa

SEQ ID NO: 2541424 - RNA, 16 nt, Human
ugaaaaaaaguuuaca

SEQ ID NO: 2541425 - RNA, 21 nt, Human
ugaaaaaaggacaauuucaaa

SEQ ID NO: 2541426 - RNA, 22 nt, Human
ugaaaaaauagagccugaggga

SEQ ID NO: 2541427 - RNA, 18 nt, Human
ugaaaaaaggacaauuuc

SEQ ID NO: 2541428 - RNA, 23 nt, Human
ugaaaaaauauauaucaaauaua

SEQ ID NO: 2541429 - RNA, 18 nt, Human
ugaaaaaauguauaugca

SEQ ID NO: 2541430 - RNA, 12 nt, Human
ugaaaaacuucc

SEQ ID NO: 2541431 - RNA, 23 nt, Human
ugaaaaagcauguacaguguucu

SEQ ID NO: 2541432 - RNA, 21 nt, Human
ugaaaaagcauguacaguguu

SEQ ID NO: 2541433 - RNA, 20 nt, Human
ugaaaaagcauguacagugu

SEQ ID NO: 2541434 - RNA, 18 nt, Human
ugaaaaagcauguacagu

SEQ ID NO: 2541435 - RNA, 16 nt, Human
ugaaaaaggaggaaga

SEQ ID NO: 2541436 - RNA, 22 nt, Human
ugaaaaagaccuuuggagcaaa

SEQ ID NO: 2541437 - RNA, 17 nt, Human
ugaaaaagcauguacag

SEQ ID NO: 2541438 - RNA, 16 nt, Human
ugaaaaagcauguaca

SEQ ID NO: 2541439 - RNA, 15 nt, Human
ugaaaaagcauguac

SEQ ID NO: 2541440 - RNA, 14 nt, Human
ugaaaaagcaugua

SEQ ID NO: 2541441 - RNA, 21 nt, Human
ugaaaaagcagcuaccaggug

SEQ ID NO: 2541442 - RNA, 13 nt, Human
ugaaaaagcaugu

SEQ ID NO: 2541443 - RNA, 15 nt, Human
agagaucaaauggaa

SEQ ID NO: 2541444 - RNA, 18 nt, Human
agagauauuuuaaaauga

SEQ ID NO: 2541445 - RNA, 22 nt, Human
agagaucaaccccuucgcuccu

SEQ ID NO: 2541446 - RNA, 16 nt, Human
agagagaaagccaggc

SEQ ID NO: 2541447 - RNA, 15 nt, Human
agagagaaagccagg

SEQ ID NO: 2541448 - RNA, 22 nt, Human
agagagaaagccaggcagguag

SEQ ID NO: 2541449 - RNA, 20 nt, Human
agagagaacaacuacuguga

SEQ ID NO: 2541450 - RNA, 20 nt, Human
agagauauuuuaaaaugaga

SEQ ID NO: 2541451 - RNA, 17 nt, Human
agagauauuuuaaaaug

SEQ ID NO: 2541452 - RNA, 13 nt, Human
agagauauuuuaa

SEQ ID NO: 2541453 - RNA, 18 nt, Human
agagagaagacccuucuc

SEQ ID NO: 2541454 - RNA, 17 nt, Human
agagauauggcagcgaa

SEQ ID NO: 2541455 - RNA, 13 nt, Human
agagagaaaauaa

SEQ ID NO: 2541456 - RNA, 14 nt, Human
agagagaaaauaaa

SEQ ID NO: 2541457 - RNA, 23 nt, Human
agagacuccugcaggcagccagg

SEQ ID NO: 2541458 - RNA, 15 nt, Human
agagagaaaauaaaa

SEQ ID NO: 2541459 - RNA, 16 nt, Human
agagagaaaauaaaaa

SEQ ID NO: 2541460 - RNA, 17 nt, Human
agagagaaaauaaaaag

SEQ ID NO: 2541461 - RNA, 18 nt, Human
agagagaaaauaaaaagu

SEQ ID NO: 2541462 - RNA, 20 nt, Human
agagagaaaauaaaaaguua

SEQ ID NO: 2541463 - RNA, 22 nt, Human
agagagaaaauaaaaaguuaaa

SEQ ID NO: 2541464 - RNA, 14 nt, Human
agagagaaagccag

SEQ ID NO: 2541465 - RNA, 12 nt, Human
agagagaaaaua

SEQ ID NO: 2541466 - RNA, 21 nt, Human
agagagaaagaaguaggcaug

SEQ ID NO: 2541467 - RNA, 15 nt, Human
agagaugugcaccca

SEQ ID NO: 2541468 - RNA, 14 nt, Human
agagaugugcaccc

SEQ ID NO: 2541469 - RNA, 17 nt, Human
agagaugugcacccaug

SEQ ID NO: 2541470 - RNA, 24 nt, Human
agagaugggagcuccucuccugga

SEQ ID NO: 2541471 - RNA, 21 nt, Human
agagaugggagcuccucuccu

SEQ ID NO: 2541472 - RNA, 20 nt, Human
agagaugggagcuccucucc

SEQ ID NO: 2541473 - RNA, 19 nt, Human
agagaugggagcuccucuc

SEQ ID NO: 2541474 - RNA, 17 nt, Human
agagaugggagcuccuc

SEQ ID NO: 2541475 - RNA, 15 nt, Human
agagaugggagcucc

SEQ ID NO: 2541476 - RNA, 23 nt, Human
agagaugggacugggagggccca

SEQ ID NO: 2541477 - RNA, 19 nt, Human
agagaugggaaugaggugg

SEQ ID NO: 2541478 - RNA, 16 nt, Human
agagaugggacuggga

SEQ ID NO: 2541479 - RNA, 22 nt, Human
agagaugggacugggagggccc

SEQ ID NO: 2541480 - RNA, 20 nt, Human
agagauggccugagaagaga

SEQ ID NO: 2541481 - RNA, 18 nt, Human
agagauggaggaggaggc

SEQ ID NO: 2541482 - RNA, 21 nt, Human
agagaucauccuuuccagcau

SEQ ID NO: 2541483 - RNA, 15 nt, Human
agagauggaggagga

SEQ ID NO: 2541484 - RNA, 19 nt, Human
agagaucaaauggaaagga

SEQ ID NO: 2541485 - RNA, 23 nt, Human
agagcaagacgcugugcugcccu

SEQ ID NO: 2541486 - RNA, 19 nt, Human
agagcaagacgcugugcug

SEQ ID NO: 2541487 - RNA, 20 nt, Human
agagcaaaauugauguguuu

SEQ ID NO: 2541488 - RNA, 13 nt, Human
ugaaagacuguac

SEQ ID NO: 2541489 - RNA, 15 nt, Human
ugaaagacuguacaa

SEQ ID NO: 2541490 - RNA, 14 nt, Human
agagacguguacau

SEQ ID NO: 2541491 - RNA, 15 nt, Human
agagaccuccugccu

SEQ ID NO: 2541492 - RNA, 19 nt, Human
agagaccucaucaggauga

SEQ ID NO: 2541493 - RNA, 16 nt, Human
agagaccucaucagga

SEQ ID NO: 2541494 - RNA, 19 nt, Human
ugaaagaccuucuccaaau

SEQ ID NO: 2541495 - RNA, 12 nt, Human
ugaaagaccuuc

SEQ ID NO: 2541496 - RNA, 17 nt, Human
ugaaagaccuucuccaa

SEQ ID NO: 2541497 - RNA, 16 nt, Human
ugaaagaaaggacucu

SEQ ID NO: 2541498 - RNA, 20 nt, Human
ugaaagaacauggacuugua

SEQ ID NO: 2541499 - RNA, 22 nt, Human
ugaaacuuauuuuuuucugauu

SEQ ID NO: 2541500 - RNA, 21 nt, Human
ugaaacuuauuuuuuucugau

SEQ ID NO: 2541501 - RNA, 23 nt, Human
ugaaacuuauuuuuuucugauug

SEQ ID NO: 2541502 - RNA, 22 nt, Human
agagacuccugcaggcagccag

SEQ ID NO: 2541503 - RNA, 21 nt, Human
agagacuccugcaggcagcca

SEQ ID NO: 2541504 - RNA, 20 nt, Human
agagacuccugcaggcagcc

SEQ ID NO: 2541505 - RNA, 19 nt, Human
agagacuccugcaggcagc

SEQ ID NO: 2541506 - RNA, 18 nt, Human
agagacuccugcaggcag

SEQ ID NO: 2541507 - RNA, 17 nt, Human
agagacuccugcaggca

SEQ ID NO: 2541508 - RNA, 15 nt, Human
agagacuccugcagg

SEQ ID NO: 2541509 - RNA, 16 nt, Human
agagacuccagcuggg

SEQ ID NO: 2541510 - RNA, 19 nt, Human
agagacucagggccccagc

SEQ ID NO: 2541511 - RNA, 20 nt, Human
agagacucagggccccagca

SEQ ID NO: 2541512 - RNA, 20 nt, Human
agagcaggaagcauucagag

SEQ ID NO: 2541513 - RNA, 18 nt, Human
agagcaggaagcauucag

SEQ ID NO: 2541514 - RNA, 21 nt, Human
agagcagcuuuaaacucaggg

SEQ ID NO: 2541515 - RNA, 20 nt, Human
agagcagcuuuaaacucagg

SEQ ID NO: 2541516 - RNA, 23 nt, Human
agagcaggaagcauucagagagc

SEQ ID NO: 2541517 - RNA, 18 nt, Human
agagcagcuuuaaacuca

SEQ ID NO: 2541518 - RNA, 23 nt, Human
agagcagcuucugccacuuccca

SEQ ID NO: 2541519 - RNA, 20 nt, Human
agagcagcuucugccacuuc

SEQ ID NO: 2541520 - RNA, 13 nt, Human
agagcagcuucug

SEQ ID NO: 2541521 - RNA, 23 nt, Human
agagcagcggggcgaagcccagg

SEQ ID NO: 2541522 - RNA, 19 nt, Human
agagcagccuguggcaucu

SEQ ID NO: 2541523 - RNA, 19 nt, Human
agagcagcagugaaaacaa

SEQ ID NO: 2541524 - RNA, 23 nt, Human
agagcagcagugaaaacaagugc

SEQ ID NO: 2541525 - RNA, 12 nt, Human
agagcagccugu

SEQ ID NO: 2541526 - RNA, 16 nt, Human
agagcagccuguggca

SEQ ID NO: 2541527 - RNA, 17 nt, Human
agagcagccuguggcau

SEQ ID NO: 2541528 - RNA, 21 nt, Human
agagcaccuuagacagucccu

SEQ ID NO: 2541529 - RNA, 22 nt, Human
agagcaccuuagacagucccug

SEQ ID NO: 2541530 - RNA, 23 nt, Human
agagcaccuuagacagucccugc

SEQ ID NO: 2541531 - RNA, 21 nt, Human
agagcaccuuccucacuucca

SEQ ID NO: 2541532 - RNA, 20 nt, Human
agagcaccuuccucacuucc

SEQ ID NO: 2541533 - RNA, 14 nt, Human
agagcaccuuccuc

SEQ ID NO: 2541534 - RNA, 14 nt, Human
agagcaacucugag

SEQ ID NO: 2541535 - RNA, 14 nt, Human
agagcaagacucug

SEQ ID NO: 2541536 - RNA, 23 nt, Human
agagcaguuucuguccugcuggu

SEQ ID NO: 2541537 - RNA, 22 nt, Human
agagcaguuucuguccugcugg

SEQ ID NO: 2541538 - RNA, 13 nt, Human
agagccaggcaca

SEQ ID NO: 2541539 - RNA, 19 nt, Human
agagccaggcacacacugu

SEQ ID NO: 2541540 - RNA, 22 nt, Human
agagccaggggggugaggagcu

SEQ ID NO: 2541541 - RNA, 13 nt, Human
agagccagcuccc

SEQ ID NO: 2541542 - RNA, 22 nt, Human
agagccagcccucccuguccuc

SEQ ID NO: 2541543 - RNA, 21 nt, Human
agagccagagaagugacaggg

SEQ ID NO: 2541544 - RNA, 20 nt, Human
agagccagagaagugacagg

SEQ ID NO: 2541545 - RNA, 17 nt, Human
agagcauuacgugagcc

SEQ ID NO: 2541546 - RNA, 18 nt, Human
agagccagagaagugaca

SEQ ID NO: 2541547 - RNA, 23 nt, Human
agagcauccugcuucuaccaugu

SEQ ID NO: 2541548 - RNA, 13 nt, Human
agagccagcaacu

SEQ ID NO: 2541549 - RNA, 12 nt, Human
agagccagcccu

SEQ ID NO: 2541550 - RNA, 13 nt, Human
agagccagcccuc

SEQ ID NO: 2541551 - RNA, 14 nt, Human
agagccagcccucc

SEQ ID NO: 2541552 - RNA, 16 nt, Human
agagccagcccucccu

SEQ ID NO: 2541553 - RNA, 17 nt, Human
agagccagcccucccug

SEQ ID NO: 2541554 - RNA, 20 nt, Human
agagccagcccucccugucc

SEQ ID NO: 2541555 - RNA, 21 nt, Human
agagccagcccucccuguccu

SEQ ID NO: 2541556 - RNA, 22 nt, Human
agagccuuccaggggugggaca

SEQ ID NO: 2541557 - RNA, 17 nt, Human
agagccuuccaggggug

SEQ ID NO: 2541558 - RNA, 15 nt, Human
agagccuuccagggg

SEQ ID NO: 2541559 - RNA, 13 nt, Human
agagccuuccagg

SEQ ID NO: 2541560 - RNA, 17 nt, Human
agagcuagaacauggag

SEQ ID NO: 2541561 - RNA, 21 nt, Human
agagcuacuugggccauagcu

SEQ ID NO: 2541562 - RNA, 16 nt, Human
agagcuacuugggcca

SEQ ID NO: 2541563 - RNA, 20 nt, Human
agagccaggcacacacugug

SEQ ID NO: 2541564 - RNA, 23 nt, Human
agagccaggggggugaggagcug

SEQ ID NO: 2541565 - RNA, 21 nt, Human
agagcuaacccuuaucuguaa

SEQ ID NO: 2541566 - RNA, 19 nt, Human
agagcuagaaccuggagag

SEQ ID NO: 2541567 - RNA, 22 nt, Human
agagcuagaaccuggagaacua

SEQ ID NO: 2541568 - RNA, 18 nt, Human
agagcuagaaccuggaga

SEQ ID NO: 2541569 - RNA, 16 nt, Human
agagcuagaaccugga

SEQ ID NO: 2541570 - RNA, 23 nt, Human
agagcuagaacccggcaggcuag

SEQ ID NO: 2541571 - RNA, 22 nt, Human
agagcuagaacauggagagcua

SEQ ID NO: 2541572 - RNA, 19 nt, Human
agagcuagaacauggagag

SEQ ID NO: 2541573 - RNA, 18 nt, Human
agagcuagaacauggaga

SEQ ID NO: 2541574 - RNA, 20 nt, Human
agagcuagcagcagggaggg

SEQ ID NO: 2541575 - RNA, 16 nt, Human
agagcuagcgcugccg

SEQ ID NO: 2541576 - RNA, 21 nt, Human
agagcuagcgcugccgcaccc

SEQ ID NO: 2541577 - RNA, 22 nt, Human
agagcuagaaccuggagggcua

SEQ ID NO: 2541578 - RNA, 18 nt, Human
agagcuagaaccuggagg

SEQ ID NO: 2541579 - RNA, 13 nt, Human
agagcuagcgcug

SEQ ID NO: 2541580 - RNA, 14 nt, Human
agagcuagcgcugc

SEQ ID NO: 2541581 - RNA, 23 nt, Human
agagcuauuuaauggccggcugg

SEQ ID NO: 2541582 - RNA, 20 nt, Human
agagcucccggcguggugga

SEQ ID NO: 2541583 - RNA, 14 nt, Human
agagcucuccagcu

SEQ ID NO: 2541584 - RNA, 16 nt, Human
agagcucuccagcucc

SEQ ID NO: 2541585 - RNA, 21 nt, Human
agagcugauccagagcacaga

SEQ ID NO: 2541586 - RNA, 19 nt, Human
agagcugauccagagcaca

SEQ ID NO: 2541587 - RNA, 14 nt, Human
agagcugccaccug

SEQ ID NO: 2541588 - RNA, 22 nt, Human
agagcugacacaaaccugccug

SEQ ID NO: 2541589 - RNA, 20 nt, Human
agagcugacacaaaccugcc

SEQ ID NO: 2541590 - RNA, 18 nt, Human
agagcugacacaaaccug

SEQ ID NO: 2541591 - RNA, 15 nt, Human
agagcucuccagcuc

SEQ ID NO: 2541592 - RNA, 18 nt, Human
agagcugauccagagcac

SEQ ID NO: 2541593 - RNA, 17 nt, Human
agagcugauccagagca

SEQ ID NO: 2541594 - RNA, 14 nt, Human
agagcugauccaga

SEQ ID NO: 2541595 - RNA, 13 nt, Human
agagcugauccag

SEQ ID NO: 2541596 - RNA, 23 nt, Human
agagcugacacaggaugaaggca

SEQ ID NO: 2541597 - RNA, 23 nt, Human
agagcugacacaaaccugccugg

SEQ ID NO: 2541598 - RNA, 11 nt, Human
agagcugaggc

SEQ ID NO: 2541599 - RNA, 14 nt, Human
ucuugguauucuua

SEQ ID NO: 2541600 - RNA, 14 nt, Human
ucuugguagagauu

SEQ ID NO: 2541601 - RNA, 22 nt, Human
ucuugguaaauuuccccaacag

SEQ ID NO: 2541602 - RNA, 19 nt, Human
ucuugguccugcugcaguu

SEQ ID NO: 2541603 - RNA, 17 nt, Human
ucuugguccugcugcag

SEQ ID NO: 2541604 - RNA, 15 nt, Human
ucuugguccugcugc

SEQ ID NO: 2541605 - RNA, 14 nt, Human
ucuuuaagaaagua

SEQ ID NO: 2541606 - RNA, 20 nt, Human
ucuuuaacuuaauugcuaug

SEQ ID NO: 2541607 - RNA, 11 nt, Human
ucuuuauauga

SEQ ID NO: 2541608 - RNA, 15 nt, Human
ucuuuauaugaagaa

SEQ ID NO: 2541609 - RNA, 23 nt, Human
ucuuuaaucauuuugccucuuuu

SEQ ID NO: 2541610 - RNA, 14 nt, Human
ucuuuaaucuucag

SEQ ID NO: 2541611 - RNA, 15 nt, Human
ucuuuaaucuucagu

SEQ ID NO: 2541612 - RNA, 15 nt, Human
ucuuuaacucauaaa

SEQ ID NO: 2541613 - RNA, 15 nt, Human
ucuugguagagauuc

SEQ ID NO: 2541614 - RNA, 18 nt, Human
ucuuucuaaugugugaau

SEQ ID NO: 2541615 - RNA, 17 nt, Human
ucuuucgcacagcaguu

SEQ ID NO: 2541616 - RNA, 21 nt, Human
ucuuucuaacuccagugaagu

SEQ ID NO: 2541617 - RNA, 17 nt, Human
ucuuuccugaggcuggg

SEQ ID NO: 2541618 - RNA, 16 nt, Human
ucuuuccugccuucuu

SEQ ID NO: 2541619 - RNA, 14 nt, Human
ucuuuccugccuuc

SEQ ID NO: 2541620 - RNA, 11 nt, Human
ucuuuccuguc

SEQ ID NO: 2541621 - RNA, 18 nt, Human
ucuuuccuguuguuguua

SEQ ID NO: 2541622 - RNA, 13 nt, Human
ucuuuccuugcuc

SEQ ID NO: 2541623 - RNA, 10 nt, Human
ucuuuccuug

SEQ ID NO: 2541624 - RNA, 15 nt, Human
ucuuuccuucuugcc

SEQ ID NO: 2541625 - RNA, 19 nt, Human
ucuuuauugagaaagagca

SEQ ID NO: 2541626 - RNA, 16 nt, Human
ucuuuauugagaaaga

SEQ ID NO: 2541627 - RNA, 15 nt, Human
ucuuuauugagaaag

SEQ ID NO: 2541628 - RNA, 14 nt, Human
ucuuuauugagaaa

SEQ ID NO: 2541629 - RNA, 13 nt, Human
ucuuuauugagaa

SEQ ID NO: 2541630 - RNA, 16 nt, Human
ucuuuauuaaucacua

SEQ ID NO: 2541631 - RNA, 15 nt, Human
ucuuuaugacuguuu

SEQ ID NO: 2541632 - RNA, 24 nt, Human
ucuugggggacagggcuggcccag

SEQ ID NO: 2541633 - RNA, 23 nt, Human
ucuugggggacagggcuggccca

SEQ ID NO: 2541634 - RNA, 19 nt, Human
ucuuggggggguggccgcu

SEQ ID NO: 2541635 - RNA, 22 nt, Human
ucuugggggacagggcuggccc

SEQ ID NO: 2541636 - RNA, 21 nt, Human
ucuugggggacagggcuggcc

SEQ ID NO: 2541637 - RNA, 20 nt, Human
ucuugggggacagggcuggc

SEQ ID NO: 2541638 - RNA, 20 nt, Human
ucuuggggggguggccgcug

SEQ ID NO: 2541639 - RNA, 16 nt, Human
ucuuggguaggcggga

SEQ ID NO: 2541640 - RNA, 16 nt, Human
ucuugggucuaugccu

SEQ ID NO: 2541641 - RNA, 14 nt, Human
ucuugguaagaagc

SEQ ID NO: 2541642 - RNA, 14 nt, Human
ucuugguccugcug

SEQ ID NO: 2541643 - RNA, 17 nt, Human
ucuuggucagauuugaa

SEQ ID NO: 2541644 - RNA, 13 nt, Human
ucuugggaacuga

SEQ ID NO: 2541645 - RNA, 14 nt, Human
ucuugggaacugaa

SEQ ID NO: 2541646 - RNA, 22 nt, Human
ucuugggacuggguuuggaccc

SEQ ID NO: 2541647 - RNA, 16 nt, Human
ucuugggacuggguuu

SEQ ID NO: 2541648 - RNA, 21 nt, Human
ucuugggcagagcuggcucug

SEQ ID NO: 2541649 - RNA, 20 nt, Human
ucuugggcagagcuggcucu

SEQ ID NO: 2541650 - RNA, 19 nt, Human
ucuugggcagagcuggcuc

SEQ ID NO: 2541651 - RNA, 21 nt, Human
ucuuggggacaucucuuugaa

SEQ ID NO: 2541652 - RNA, 17 nt, Human
ucuuggggacaucucuu

SEQ ID NO: 2541653 - RNA, 23 nt, Human
ucuugggcagagcuggcucugag

SEQ ID NO: 2541654 - RNA, 11 nt, Human
ucuugggcccu

SEQ ID NO: 2541655 - RNA, 13 nt, Human
ucuugggcccucc

SEQ ID NO: 2541656 - RNA, 18 nt, Human
ucuuggcagcaccugucu

SEQ ID NO: 2541657 - RNA, 19 nt, Human
ucuuggcagcaccugucuc

SEQ ID NO: 2541658 - RNA, 22 nt, Human
ucuugcaauggcagccuuggca

SEQ ID NO: 2541659 - RNA, 18 nt, Human
ucuugcaauggcagccuu

SEQ ID NO: 2541660 - RNA, 19 nt, Human
ucuugcaauggcagccuug

SEQ ID NO: 2541661 - RNA, 13 nt, Human
ucuuggcucacug

SEQ ID NO: 2541662 - RNA, 19 nt, Human
ucuuggcggcagcagccau

SEQ ID NO: 2541663 - RNA, 18 nt, Human
ucuuggcggcagcagcca

SEQ ID NO: 2541664 - RNA, 15 nt, Human
ucuuggcggcagcag

SEQ ID NO: 2541665 - RNA, 18 nt, Human
ucuuggcccgcacagagc

SEQ ID NO: 2541666 - RNA, 21 nt, Human
ucuuggcccgcacagagcugg

SEQ ID NO: 2541667 - RNA, 13 nt, Human
ucuuggcagucac

SEQ ID NO: 2541668 - RNA, 20 nt, Human
ucuugggaaauaugaaugcc

SEQ ID NO: 2541669 - RNA, 19 nt, Human
ucuugggaaauaugaaugc

SEQ ID NO: 2541670 - RNA, 14 nt, Human
ucuugggaaauaug

SEQ ID NO: 2541671 - RNA, 12 nt, Human
ucuugggaaaua

SEQ ID NO: 2541672 - RNA, 16 nt, Human
ucuuggcuuucauguu

SEQ ID NO: 2541673 - RNA, 15 nt, Human
ucuuggcuuucaugu

SEQ ID NO: 2541674 - RNA, 11 nt, Human
ucuugggaaau

SEQ ID NO: 2541675 - RNA, 19 nt, Human
ucuuggcuuacugcagccu

SEQ ID NO: 2541676 - RNA, 17 nt, Human
ucuuggcuuggugagga

SEQ ID NO: 2541677 - RNA, 16 nt, Human
ucuugagccuugaacu

SEQ ID NO: 2541678 - RNA, 20 nt, Human
ucuugagccuugaacuuuga

SEQ ID NO: 2541679 - RNA, 14 nt, Human
ucuugagcaguggc

SEQ ID NO: 2541680 - RNA, 17 nt, Human
ucuugagcaaguuccuu

SEQ ID NO: 2541681 - RNA, 16 nt, Human
ucuugagaugucuucu

SEQ ID NO: 2541682 - RNA, 13 nt, Human
ucuugagccuggg

SEQ ID NO: 2541683 - RNA, 16 nt, Human
ucuugagccugggagg

SEQ ID NO: 2541684 - RNA, 16 nt, Human
ucuugacuacagucag

SEQ ID NO: 2541685 - RNA, 21 nt, Human
agacucagggccccagcacua

SEQ ID NO: 2541686 - RNA, 18 nt, Human
agacucagggccccagca

SEQ ID NO: 2541687 - RNA, 20 nt, Human
agacucagggccccagcacu

SEQ ID NO: 2541688 - RNA, 23 nt, Human
agacucaggccaagaaacgucuu

SEQ ID NO: 2541689 - RNA, 12 nt, Human
agacucagggcc

SEQ ID NO: 2541690 - RNA, 16 nt, Human
agacucagggccccag

SEQ ID NO: 2541691 - RNA, 17 nt, Human
agacucagggccccagc

SEQ ID NO: 2541692 - RNA, 16 nt, Human
agacucaccucugccu

SEQ ID NO: 2541693 - RNA, 17 nt, Human
agacucaccucugccuc

SEQ ID NO: 2541694 - RNA, 18 nt, Human
agacucaccucugccuca

SEQ ID NO: 2541695 - RNA, 15 nt, Human
agacucagacuccau

SEQ ID NO: 2541696 - RNA, 19 nt, Human
agacucaggccaagaaacg

SEQ ID NO: 2541697 - RNA, 20 nt, Human
agacucaggccaagaaacgu

SEQ ID NO: 2541698 - RNA, 19 nt, Human
agacucaccucugccucaa

SEQ ID NO: 2541699 - RNA, 18 nt, Human
ucuugauguggugaggca

SEQ ID NO: 2541700 - RNA, 16 nt, Human
ucuugauguugcuuag

SEQ ID NO: 2541701 - RNA, 21 nt, Human
ucuugaugccuggcggggugg

SEQ ID NO: 2541702 - RNA, 14 nt, Human
ucuugauuauccau

SEQ ID NO: 2541703 - RNA, 23 nt, Human
ucuugauuauccauauugaguca

SEQ ID NO: 2541704 - RNA, 13 nt, Human
ucuugauucauaa

SEQ ID NO: 2541705 - RNA, 20 nt, Human
ucuugagguacucugcacau

SEQ ID NO: 2541706 - RNA, 20 nt, Human
ucuugaguuugucgcucaug

SEQ ID NO: 2541707 - RNA, 14 nt, Human
ucuugaguuugucg

SEQ ID NO: 2541708 - RNA, 13 nt, Human
ucuugaguuuguc

SEQ ID NO: 2541709 - RNA, 22 nt, Human
ucuugagcaguggcugguccag

SEQ ID NO: 2541710 - RNA, 15 nt, Human
ucuugaggccaggag

SEQ ID NO: 2541711 - RNA, 16 nt, Human
ucuugaggccaggagu

SEQ ID NO: 2541712 - RNA, 14 nt, Human
ucuugagggagcuu

SEQ ID NO: 2541713 - RNA, 20 nt, Human
ucuucugggagggcagcagg

SEQ ID NO: 2541714 - RNA, 16 nt, Human
agacuauucaaacagu

SEQ ID NO: 2541715 - RNA, 15 nt, Human
agacuauucaaacag

SEQ ID NO: 2541716 - RNA, 12 nt, Human
agacuauucaaa

SEQ ID NO: 2541717 - RNA, 14 nt, Human
agacuauucaaaca

SEQ ID NO: 2541718 - RNA, 23 nt, Human
agaccuucuccuucaccuuuguc

SEQ ID NO: 2541719 - RNA, 21 nt, Human
agaccuucuccuucaccuuug

SEQ ID NO: 2541720 - RNA, 20 nt, Human
agaccuuguucacacucuca

SEQ ID NO: 2541721 - RNA, 16 nt, Human
agaccuuguucacacu

SEQ ID NO: 2541722 - RNA, 22 nt, Human
agaccuuguuacuucugaggua

SEQ ID NO: 2541723 - RNA, 21 nt, Human
agaccuuguuacuucugaggu

SEQ ID NO: 2541724 - RNA, 19 nt, Human
agaccuuguuacuucugag

SEQ ID NO: 2541725 - RNA, 18 nt, Human
agaccuuguguguaugug

SEQ ID NO: 2541726 - RNA, 15 nt, Human
agaccuuguguguau

SEQ ID NO: 2541727 - RNA, 18 nt, Human
agaccuuguuacuucuga

SEQ ID NO: 2541728 - RNA, 16 nt, Human
agaccuucuccaaaug

SEQ ID NO: 2541729 - RNA, 18 nt, Human
agaccuucuccaaaugag

SEQ ID NO: 2541730 - RNA, 23 nt, Human
agaccuuggaucagaugaacucu

SEQ ID NO: 2541731 - RNA, 19 nt, Human
agaccuucuccaaaugaga

SEQ ID NO: 2541732 - RNA, 18 nt, Human
agaccuucuccuucaccu

SEQ ID NO: 2541733 - RNA, 15 nt, Human
agaccuucuccuuca

SEQ ID NO: 2541734 - RNA, 18 nt, Human
agaccuucuaggacgcca

SEQ ID NO: 2541735 - RNA, 23 nt, Human
agaccuuccauaaugcuacuguc

SEQ ID NO: 2541736 - RNA, 22 nt, Human
agaccuuccauaaugcuacugu

SEQ ID NO: 2541737 - RNA, 13 nt, Human
agaccuuccauaa

SEQ ID NO: 2541738 - RNA, 16 nt, Human
agaccuucaccaaaca

SEQ ID NO: 2541739 - RNA, 21 nt, Human
agaccuguugguuccaagccc

SEQ ID NO: 2541740 - RNA, 19 nt, Human
agaccuguuagcagacagg

SEQ ID NO: 2541741 - RNA, 11 nt, Human
agaccuucucc

SEQ ID NO: 2541742 - RNA, 11 nt, Human
agaccuggcag

SEQ ID NO: 2541743 - RNA, 14 nt, Human
agaccuggcagcuc

SEQ ID NO: 2541744 - RNA, 15 nt, Human
agaccuggcagcucu

SEQ ID NO: 2541745 - RNA, 16 nt, Human
agaccuggcagcucug

SEQ ID NO: 2541746 - RNA, 16 nt, Human
agaccccuggccuccg

SEQ ID NO: 2541747 - RNA, 14 nt, Human
agaccccuggccuc

SEQ ID NO: 2541748 - RNA, 13 nt, Human
agaccccuggccu

SEQ ID NO: 2541749 - RNA, 12 nt, Human
agaccccuggcc

SEQ ID NO: 2541750 - RNA, 22 nt, Human
agaccuggcaaggacacagaug

SEQ ID NO: 2541751 - RNA, 22 nt, Human
agaccuggagccccuggguggg

SEQ ID NO: 2541752 - RNA, 13 nt, Human
agaccuguaauca

SEQ ID NO: 2541753 - RNA, 23 nt, Human
agaccuggcagcucuggacagcc

SEQ ID NO: 2541754 - RNA, 17 nt, Human
agaccuggcagcucugg

SEQ ID NO: 2541755 - RNA, 18 nt, Human
agaccuggcagcucugga

SEQ ID NO: 2541756 - RNA, 15 nt, Human
agaccuguccuccug

SEQ ID NO: 2541757 - RNA, 17 nt, Human
agaccuguccuccuggu

SEQ ID NO: 2541758 - RNA, 18 nt, Human
agaccuguuagcagacag

SEQ ID NO: 2541759 - RNA, 18 nt, Human
ucuuccugcaaggacuac

SEQ ID NO: 2541760 - RNA, 18 nt, Human
ucuuccugaguggugcca

SEQ ID NO: 2541761 - RNA, 14 nt, Human
ucuuccugaguggu

SEQ ID NO: 2541762 - RNA, 15 nt, Human
ucuuccugacacuuu

SEQ ID NO: 2541763 - RNA, 16 nt, Human
ucuuccugacacuuua

SEQ ID NO: 2541764 - RNA, 13 nt, Human
ucuuccugacacu

SEQ ID NO: 2541765 - RNA, 20 nt, Human
ucuucucucucaauuuuauc

SEQ ID NO: 2541766 - RNA, 20 nt, Human
ucuucucuagcuggugguuu

SEQ ID NO: 2541767 - RNA, 13 nt, Human
ucuucucuuccug

SEQ ID NO: 2541768 - RNA, 19 nt, Human
agaauauuuuaaguauugc

SEQ ID NO: 2541769 - RNA, 21 nt, Human
ucuucucuggcgacaguuuuc

SEQ ID NO: 2541770 - RNA, 14 nt, Human
ucuuccucugaggc

SEQ ID NO: 2541771 - RNA, 13 nt, Human
ucuuccucugagg

SEQ ID NO: 2541772 - RNA, 16 nt, Human
ucuuccucugaggcug

SEQ ID NO: 2541773 - RNA, 14 nt, Human
ucuuccucugcuga

SEQ ID NO: 2541774 - RNA, 12 nt, Human
ucuuccucugcu

SEQ ID NO: 2541775 - RNA, 11 nt, Human
ucuuccucugc

SEQ ID NO: 2541776 - RNA, 22 nt, Human
ucuuccucccaaguggugccua

SEQ ID NO: 2541777 - RNA, 14 nt, Human
ucuuccucccaagu

SEQ ID NO: 2541778 - RNA, 13 nt, Human
ucuuccucccaag

SEQ ID NO: 2541779 - RNA, 18 nt, Human
ucuuccuccgaggccagu

SEQ ID NO: 2541780 - RNA, 17 nt, Human
ucuuccuccgaggccag

SEQ ID NO: 2541781 - RNA, 15 nt, Human
ucuuccucccucccu

SEQ ID NO: 2541782 - RNA, 18 nt, Human
ucuucccgaaccccaagg

SEQ ID NO: 2541783 - RNA, 19 nt, Human
ucuucccgaaccccaagga

SEQ ID NO: 2541784 - RNA, 14 nt, Human
ucuuccucccuccc

SEQ ID NO: 2541785 - RNA, 19 nt, Human
ucuucccuacaguugaaaa

SEQ ID NO: 2541786 - RNA, 22 nt, Human
ucuucccuacaguugaaaaaca

SEQ ID NO: 2541787 - RNA, 18 nt, Human
ucuucccccacuccucuu

SEQ ID NO: 2541788 - RNA, 15 nt, Human
ucuuccccuugcccu

SEQ ID NO: 2541789 - RNA, 13 nt, Human
ucuuccccuugcc

SEQ ID NO: 2541790 - RNA, 14 nt, Human
ucuuccccucucag

SEQ ID NO: 2541791 - RNA, 22 nt, Human
ucuuccccuugcccuugcccug

SEQ ID NO: 2541792 - RNA, 16 nt, Human
ucuuccccuugcccuu

SEQ ID NO: 2541793 - RNA, 23 nt, Human
ucuuccccuugcccuugcccuga

SEQ ID NO: 2541794 - RNA, 17 nt, Human
ucuucccgaaccccaag

SEQ ID NO: 2541795 - RNA, 20 nt, Human
ucuuccccagaaaggagacu

SEQ ID NO: 2541796 - RNA, 14 nt, Human
ucuuccccacuccc

SEQ ID NO: 2541797 - RNA, 19 nt, Human
ucuuccccacuccccaccu

SEQ ID NO: 2541798 - RNA, 16 nt, Human
ucuucccaucacugga

SEQ ID NO: 2541799 - RNA, 17 nt, Human
ucuucccaucacuggag

SEQ ID NO: 2541800 - RNA, 20 nt, Human
ucuuccaggcugggagagcc

SEQ ID NO: 2541801 - RNA, 17 nt, Human
ucuuccaggcugggaga

SEQ ID NO: 2541802 - RNA, 15 nt, Human
ucuuccaggcuggga

SEQ ID NO: 2541803 - RNA, 20 nt, Human
ucuucagagacuccugcagg

SEQ ID NO: 2541804 - RNA, 16 nt, Human
ucuuccaucccaggac

SEQ ID NO: 2541805 - RNA, 13 nt, Human
ucuuccauuugca

SEQ ID NO: 2541806 - RNA, 21 nt, Human
ucuucccaggguagcccgccu

SEQ ID NO: 2541807 - RNA, 14 nt, Human
ucuucccaggguag

SEQ ID NO: 2541808 - RNA, 12 nt, Human
ucuucccagggu

SEQ ID NO: 2541809 - RNA, 18 nt, Human
ucuucccaggcuggggcu

SEQ ID NO: 2541810 - RNA, 14 nt, Human
ucuuccauuugcaa

SEQ ID NO: 2541811 - RNA, 21 nt, Human
ucuuccaggcugggagagccu

SEQ ID NO: 2541812 - RNA, 14 nt, Human
ucuucaagaaaucu

SEQ ID NO: 2541813 - RNA, 13 nt, Human
ucuucacaaaauc

SEQ ID NO: 2541814 - RNA, 15 nt, Human
ucuuccaucccagga

SEQ ID NO: 2541815 - RNA, 15 nt, Human
ucuucacaacagauu

SEQ ID NO: 2541816 - RNA, 12 nt, Human
ucuucagagacu

SEQ ID NO: 2541817 - RNA, 18 nt, Human
ucuucagagacuccugca

SEQ ID NO: 2541818 - RNA, 17 nt, Human
ucuucagagacuccugc

SEQ ID NO: 2541819 - RNA, 14 nt, Human
agaaucacuugaac

SEQ ID NO: 2541820 - RNA, 22 nt, Human
agaaucacuucugagaacucau

SEQ ID NO: 2541821 - RNA, 19 nt, Human
ucuucaacugaccagccuc

SEQ ID NO: 2541822 - RNA, 16 nt, Human
ucuucaacugaccagc

SEQ ID NO: 2541823 - RNA, 15 nt, Human
ucuucaacucccugc

SEQ ID NO: 2541824 - RNA, 19 nt, Human
ucuucugcuucagccuccc

SEQ ID NO: 2541825 - RNA, 12 nt, Human
ucuucugcuuca

SEQ ID NO: 2541826 - RNA, 18 nt, Human
ucuucugcuuaggagaga

SEQ ID NO: 2541827 - RNA, 22 nt, Human
ucuucugggagggcagcagggc

SEQ ID NO: 2541828 - RNA, 23 nt, Human
ucuucugggagggcagcagggcu

SEQ ID NO: 2541829 - RNA, 22 nt, Human
ucuucugcuccacccuuggccu

SEQ ID NO: 2541830 - RNA, 23 nt, Human
ucuucugcuccacccuuggccug

SEQ ID NO: 2541831 - RNA, 14 nt, Human
ucuucucuuccugu

SEQ ID NO: 2541832 - RNA, 19 nt, Human
ucuucucuuccuuuuauca

SEQ ID NO: 2541833 - RNA, 21 nt, Human
ucuucucuuccuuuuaucagu

SEQ ID NO: 2541834 - RNA, 19 nt, Human
ucuucugaacucaaacuga

SEQ ID NO: 2541835 - RNA, 21 nt, Human
ucuucugaacuuggcgcugcc

SEQ ID NO: 2541836 - RNA, 15 nt, Human
ucuucucuuccugua

SEQ ID NO: 2541837 - RNA, 13 nt, Human
ucuucugcuccac

SEQ ID NO: 2541838 - RNA, 24 nt, Human
ucuucugaacucaaacugaggaau

SEQ ID NO: 2541839 - RNA, 14 nt, Human
ucuucugcuccacc

SEQ ID NO: 2541840 - RNA, 15 nt, Human
ucuucugcuccaccc

SEQ ID NO: 2541841 - RNA, 16 nt, Human
ucuucugcuccacccu

SEQ ID NO: 2541842 - RNA, 17 nt, Human
ucuucugcuccacccuu

SEQ ID NO: 2541843 - RNA, 19 nt, Human
ucuucugcuccacccuugg

SEQ ID NO: 2541844 - RNA, 20 nt, Human
ucuucugcuccacccuuggc

SEQ ID NO: 2541845 - RNA, 18 nt, Human
ucuucuggguuccuuccu

SEQ ID NO: 2541846 - RNA, 19 nt, Human
ucuucuguauacuguggag

SEQ ID NO: 2541847 - RNA, 14 nt, Human
ucuucuguauuuuu

SEQ ID NO: 2541848 - RNA, 23 nt, Human
ucuucugugauucgguggagacu

SEQ ID NO: 2541849 - RNA, 22 nt, Human
ucuucuguauuuuuuuuucuaa

SEQ ID NO: 2541850 - RNA, 15 nt, Human
ucuucuguacgucug

SEQ ID NO: 2541851 - RNA, 22 nt, Human
agacaguuucuuagcuuuuuaa

SEQ ID NO: 2541852 - RNA, 20 nt, Human
agacaguuucuuagcuuuuu

SEQ ID NO: 2541853 - RNA, 18 nt, Human
agacaguuucuuagcuuu

SEQ ID NO: 2541854 - RNA, 21 nt, Human
agacaguuucuuagcuuuuua

SEQ ID NO: 2541855 - RNA, 18 nt, Human
ucuucuuaagacuuuugg

SEQ ID NO: 2541856 - RNA, 18 nt, Human
ucuucuguuuucuguuuc

SEQ ID NO: 2541857 - RNA, 15 nt, Human
agacaguuucuuagc

SEQ ID NO: 2541858 - RNA, 20 nt, Human
ucuucuguggguuucuaaag

SEQ ID NO: 2541859 - RNA, 13 nt, Human
ucuucuguggacc

SEQ ID NO: 2541860 - RNA, 17 nt, Human
ucuucuguuuucuguuu

SEQ ID NO: 2541861 - RNA, 16 nt, Human
ucuucuguuuucuguu

SEQ ID NO: 2541862 - RNA, 13 nt, Human
ucuucuuaacuua

SEQ ID NO: 2541863 - RNA, 17 nt, Human
agacaucaacagauaaa

SEQ ID NO: 2541864 - RNA, 18 nt, Human
agacaucaacagauaaau

SEQ ID NO: 2541865 - RNA, 17 nt, Human
agacauccauguuugua

SEQ ID NO: 2541866 - RNA, 22 nt, Human
agacauccauaaagaagcaaua

SEQ ID NO: 2541867 - RNA, 19 nt, Human
agacauccauaaagaagca

SEQ ID NO: 2541868 - RNA, 18 nt, Human
agacauccauaaagaagc

SEQ ID NO: 2541869 - RNA, 15 nt, Human
agacauccauaaaga

SEQ ID NO: 2541870 - RNA, 19 nt, Human
agacauaggccaugaaaaa

SEQ ID NO: 2541871 - RNA, 17 nt, Human
agacauaacguuuuucc

SEQ ID NO: 2541872 - RNA, 18 nt, Human
agacauaggccaugaaaa

SEQ ID NO: 2541873 - RNA, 17 nt, Human
agacaucaagcacagaa

SEQ ID NO: 2541874 - RNA, 20 nt, Human
agacaucaagcacagaagga

SEQ ID NO: 2541875 - RNA, 21 nt, Human
agacauagaauuaacacauga

SEQ ID NO: 2541876 - RNA, 19 nt, Human
agacauacuaaccagcaga

SEQ ID NO: 2541877 - RNA, 20 nt, Human
agacauaacguuuuuccuuu

SEQ ID NO: 2541878 - RNA, 14 nt, Human
agacauaacguuuu

SEQ ID NO: 2541879 - RNA, 15 nt, Human
agacccccuggagac

SEQ ID NO: 2541880 - RNA, 19 nt, Human
agacccccuggagacuaac

SEQ ID NO: 2541881 - RNA, 14 nt, Human
agaccccucuggcc

SEQ ID NO: 2541882 - RNA, 19 nt, Human
agacccccggaacaagccu

SEQ ID NO: 2541883 - RNA, 17 nt, Human
agaccccucuggccagg

SEQ ID NO: 2541884 - RNA, 19 nt, Human
agaccccucuggccaggau

SEQ ID NO: 2541885 - RNA, 21 nt, Human
agaccccucuggccaggaugg

SEQ ID NO: 2541886 - RNA, 22 nt, Human
agaccccucuggccaggaugga

SEQ ID NO: 2541887 - RNA, 13 nt, Human
agacccccuggag

SEQ ID NO: 2541888 - RNA, 14 nt, Human
agacccccuggaga

SEQ ID NO: 2541889 - RNA, 20 nt, Human
agacccccagcaacccuccu

SEQ ID NO: 2541890 - RNA, 22 nt, Human
agacauuguuuugccaacauug

SEQ ID NO: 2541891 - RNA, 23 nt, Human
agacccccccccccaacagaaca

SEQ ID NO: 2541892 - RNA, 19 nt, Human
agacauuguuuugccaaca

SEQ ID NO: 2541893 - RNA, 17 nt, Human
agacauugucagcaaau

SEQ ID NO: 2541894 - RNA, 13 nt, Human
agacauugucagc

SEQ ID NO: 2541895 - RNA, 16 nt, Human
agacauugucaauaaa

SEQ ID NO: 2541896 - RNA, 14 nt, Human
agacaucucugcac

SEQ ID NO: 2541897 - RNA, 22 nt, Human
agacauccauguuuguaaaacu

SEQ ID NO: 2541898 - RNA, 21 nt, Human
agacauccauguuuguaaaac

SEQ ID NO: 2541899 - RNA, 18 nt, Human
agacauccauguuuguaa

SEQ ID NO: 2541900 - RNA, 18 nt, Human
agacauguuuuccgugaa

SEQ ID NO: 2541901 - RNA, 16 nt, Human
agacaucucugcaccc

SEQ ID NO: 2541902 - RNA, 17 nt, Human
agacauuccugggcaca

SEQ ID NO: 2541903 - RNA, 22 nt, Human
agacauuaaaucuaugaaguau

SEQ ID NO: 2541904 - RNA, 15 nt, Human
agacauuaaaucuau

SEQ ID NO: 2541905 - RNA, 14 nt, Human
agacauuaaaucua

SEQ ID NO: 2541906 - RNA, 12 nt, Human
agacauuaaauc

SEQ ID NO: 2541907 - RNA, 19 nt, Human
agacauucuuccaaaaaga

SEQ ID NO: 2541908 - RNA, 14 nt, Human
agacauucugccag

SEQ ID NO: 2541909 - RNA, 15 nt, Human
agacauucugccagg

SEQ ID NO: 2541910 - RNA, 15 nt, Human
agacauuggcaccua

SEQ ID NO: 2541911 - RNA, 12 nt, Human
agacauucuguc

SEQ ID NO: 2541912 - RNA, 19 nt, Human
agacauucugccaggcccc

SEQ ID NO: 2541913 - RNA, 13 nt, Human
agacauugucaau

SEQ ID NO: 2541914 - RNA, 15 nt, Human
ugacaaagaaaccca

SEQ ID NO: 2541915 - RNA, 18 nt, Human
ugacaaaauuuguugaaa

SEQ ID NO: 2541916 - RNA, 17 nt, Human
ugacaaagaaacccaag

SEQ ID NO: 2541917 - RNA, 17 nt, Human
ugacaaaccucuaaccc

SEQ ID NO: 2541918 - RNA, 15 nt, Human
ugaauuuuucucuaa

SEQ ID NO: 2541919 - RNA, 13 nt, Human
ugaauuuuucucu

SEQ ID NO: 2541920 - RNA, 22 nt, Human
ugaauuuuuaaaacccauuuaa

SEQ ID NO: 2541921 - RNA, 16 nt, Human
ugaauuuuguugcugu

SEQ ID NO: 2541922 - RNA, 18 nt, Human
ugaauuuuguuuggacuu

SEQ ID NO: 2541923 - RNA, 14 nt, Human
ugaauuuuguugcu

SEQ ID NO: 2541924 - RNA, 23 nt, Human
ugaauuugugaagguggaaauaa

SEQ ID NO: 2541925 - RNA, 19 nt, Human
ugaauuugaaugaaaaauu

SEQ ID NO: 2541926 - RNA, 21 nt, Human
ugaauuuggccugcacuaauu

SEQ ID NO: 2541927 - RNA, 23 nt, Human
ugaauuucuuuugccguuauuaa

SEQ ID NO: 2541928 - RNA, 15 nt, Human
agaucaaauacuuua

SEQ ID NO: 2541929 - RNA, 14 nt, Human
agaucaaauacuuu

SEQ ID NO: 2541930 - RNA, 13 nt, Human
agaucaaauacuu

SEQ ID NO: 2541931 - RNA, 16 nt, Human
agaucaaaauaaaaag

SEQ ID NO: 2541932 - RNA, 14 nt, Human
agaucaaaauaaaa

SEQ ID NO: 2541933 - RNA, 17 nt, Human
agaucaaaauaaaaagu

SEQ ID NO: 2541934 - RNA, 16 nt, Human
agaucaaauggaaagg

SEQ ID NO: 2541935 - RNA, 16 nt, Human
agaucaaauacuuuaa

SEQ ID NO: 2541936 - RNA, 20 nt, Human
agaucaaauacuuuaaagga

SEQ ID NO: 2541937 - RNA, 14 nt, Human
agaucaaauuucac

SEQ ID NO: 2541938 - RNA, 23 nt, Human
agaucaaauuucacgucgucuuc

SEQ ID NO: 2541939 - RNA, 21 nt, Human
ugaauuugugaagguggaaau

SEQ ID NO: 2541940 - RNA, 13 nt, Human
ugaauuugugaag

SEQ ID NO: 2541941 - RNA, 13 nt, Human
ugaauuugaauga

SEQ ID NO: 2541942 - RNA, 15 nt, Human
ugaauuugaaugaaa

SEQ ID NO: 2541943 - RNA, 16 nt, Human
ugaauuugaaugaaaa

SEQ ID NO: 2541944 - RNA, 17 nt, Human
ugaauuugaaugaaaaa

SEQ ID NO: 2541945 - RNA, 18 nt, Human
ugaauuugaaugaaaaau

SEQ ID NO: 2541946 - RNA, 14 nt, Human
ugaauuuggagacu

SEQ ID NO: 2541947 - RNA, 15 nt, Human
ugaauuuggagacuc

SEQ ID NO: 2541948 - RNA, 17 nt, Human
ugaauuuggagacucug

SEQ ID NO: 2541949 - RNA, 20 nt, Human
ugaauuuggagacucugugg

SEQ ID NO: 2541950 - RNA, 20 nt, Human
ugaauuuggccugcacuaau

SEQ ID NO: 2541951 - RNA, 22 nt, Human
ugacacuagcccaaugaaauga

SEQ ID NO: 2541952 - RNA, 23 nt, Human
ugacacuagcccaaugaaaugaa

SEQ ID NO: 2541953 - RNA, 19 nt, Human
ugacacuauaucuguauau

SEQ ID NO: 2541954 - RNA, 18 nt, Human
ugacacuauaucuguaua

SEQ ID NO: 2541955 - RNA, 17 nt, Human
ugacacuauaucuguau

SEQ ID NO: 2541956 - RNA, 22 nt, Human
ugacacuauaucuguauauaaa

SEQ ID NO: 2541957 - RNA, 22 nt, Human
ugacacucccuugggcucccug

SEQ ID NO: 2541958 - RNA, 19 nt, Human
ugacacccauguuucucug

SEQ ID NO: 2541959 - RNA, 24 nt, Human
ugacaccagcuguucugucccuug

SEQ ID NO: 2541960 - RNA, 13 nt, Human
ugacacccauguu

SEQ ID NO: 2541961 - RNA, 23 nt, Human
ugacaccagccuuucucccaggc

SEQ ID NO: 2541962 - RNA, 19 nt, Human
ugacacuagcccaaugaaa

SEQ ID NO: 2541963 - RNA, 21 nt, Human
ugacacuagcccaaugaaaug

SEQ ID NO: 2541964 - RNA, 18 nt, Human
ugacacuagcccaaugaa

SEQ ID NO: 2541965 - RNA, 17 nt, Human
ugacacguccaccccag

SEQ ID NO: 2541966 - RNA, 12 nt, Human
ugacacaugcaa

SEQ ID NO: 2541967 - RNA, 20 nt, Human
ugacacaugcaaggucauuu

SEQ ID NO: 2541968 - RNA, 16 nt, Human
ugacacauggccccuc

SEQ ID NO: 2541969 - RNA, 22 nt, Human
ugacacauggccccucccccug

SEQ ID NO: 2541970 - RNA, 22 nt, Human
ugacacauaugcaccuuguguc

SEQ ID NO: 2541971 - RNA, 21 nt, Human
ugacacauaugcaccuugugu

SEQ ID NO: 2541972 - RNA, 18 nt, Human
ugacacaggucuuuccua

SEQ ID NO: 2541973 - RNA, 12 nt, Human
ugacaccagccu

SEQ ID NO: 2541974 - RNA, 13 nt, Human
ugacaccagccuu

SEQ ID NO: 2541975 - RNA, 15 nt, Human
ugacaccagccuuuc

SEQ ID NO: 2541976 - RNA, 16 nt, Human
ugacaccagccuuucu

SEQ ID NO: 2541977 - RNA, 22 nt, Human
ugacaccagccuuucucccagg

SEQ ID NO: 2541978 - RNA, 18 nt, Human
ugacacacagcucugucc

SEQ ID NO: 2541979 - RNA, 16 nt, Human
ugacacacagcucugu

SEQ ID NO: 2541980 - RNA, 19 nt, Human
ugacaaagacugaguacgu

SEQ ID NO: 2541981 - RNA, 21 nt, Human
ugacaaagaguagacauuucu

SEQ ID NO: 2541982 - RNA, 17 nt, Human
ugacaaaggcaagcacu

SEQ ID NO: 2541983 - RNA, 16 nt, Human
ugacaaagcuuggaag

SEQ ID NO: 2541984 - RNA, 19 nt, Human
ugacaaagaaacccaagug

SEQ ID NO: 2541985 - RNA, 23 nt, Human
ugacacagaaaauguugagaauc

SEQ ID NO: 2541986 - RNA, 19 nt, Human
ugacacacagcucuguccu

SEQ ID NO: 2541987 - RNA, 22 nt, Human
ugacacagcagcuucaccagag

SEQ ID NO: 2541988 - RNA, 16 nt, Human
ugacacaggaugaagg

SEQ ID NO: 2541989 - RNA, 16 nt, Human
ugacacagcagcuuca

SEQ ID NO: 2541990 - RNA, 16 nt, Human
ugacacaggucuuucc

SEQ ID NO: 2541991 - RNA, 17 nt, Human
ugacacaggucuuuccu

SEQ ID NO: 2541992 - RNA, 23 nt, Human
ugacacagucuuggcucacugca

SEQ ID NO: 2541993 - RNA, 22 nt, Human
ugacacagucuuggcucacugc

SEQ ID NO: 2541994 - RNA, 11 nt, Human
agauacuguau

SEQ ID NO: 2541995 - RNA, 22 nt, Human
agauacaguuacucagaauucu

SEQ ID NO: 2541996 - RNA, 14 nt, Human
agauaaucagccuc

SEQ ID NO: 2541997 - RNA, 17 nt, Human
agauaauaugagaauca

SEQ ID NO: 2541998 - RNA, 13 nt, Human
agauacaguuacu

SEQ ID NO: 2541999 - RNA, 20 nt, Human
agauacaggaaaagcugcug

SEQ ID NO: 2542000 - RNA, 18 nt, Human
agauaauauuaaggaaga

SEQ ID NO: 2542001 - RNA, 22 nt, Human
agauaauauuaaggaagacaau

SEQ ID NO: 2542002 - RNA, 15 nt, Human
agauacuguaucaug

SEQ ID NO: 2542003 - RNA, 16 nt, Human
agauacuguaucauga

SEQ ID NO: 2542004 - RNA, 18 nt, Human
agauauuuuaaaaugaga

SEQ ID NO: 2542005 - RNA, 15 nt, Human
agauauuuuaaaaug

SEQ ID NO: 2542006 - RNA, 14 nt, Human
agauauuuauauau

SEQ ID NO: 2542007 - RNA, 23 nt, Human
agauauuuauuguuuauuuauca

SEQ ID NO: 2542008 - RNA, 22 nt, Human
agauacauaugaguguggaagc

SEQ ID NO: 2542009 - RNA, 18 nt, Human
agauacauaugagugugg

SEQ ID NO: 2542010 - RNA, 17 nt, Human
agauauuuauauauauu

SEQ ID NO: 2542011 - RNA, 17 nt, Human
agauauuuauauuuuua

SEQ ID NO: 2542012 - RNA, 20 nt, Human
agauauuuauauuuuuauuu

SEQ ID NO: 2542013 - RNA, 23 nt, Human
agauauuuauauuuuuauuuuau

SEQ ID NO: 2542014 - RNA, 20 nt, Human
agauauuuugcuuugugauu

SEQ ID NO: 2542015 - RNA, 21 nt, Human
agauauuuugcuuugugauuu

SEQ ID NO: 2542016 - RNA, 12 nt, Human
agaucaaaauaa

SEQ ID NO: 2542017 - RNA, 13 nt, Human
agauauuuuuucu

SEQ ID NO: 2542018 - RNA, 18 nt, Human
agaucaaaagguuaauaa

SEQ ID NO: 2542019 - RNA, 18 nt, Human
agauaauacaccacuaca

SEQ ID NO: 2542020 - RNA, 13 nt, Human
agauaauaguuua

SEQ ID NO: 2542021 - RNA, 22 nt, Human
agauaagcaagagagauguuuu

SEQ ID NO: 2542022 - RNA, 15 nt, Human
agauaauaugagaau

SEQ ID NO: 2542023 - RNA, 13 nt, Human
agauaagcaagag

SEQ ID NO: 2542024 - RNA, 16 nt, Human
agauaagcaagagaga

SEQ ID NO: 2542025 - RNA, 17 nt, Human
agauaagcaagagagau

SEQ ID NO: 2542026 - RNA, 20 nt, Human
agauaagcaagagagauguu

SEQ ID NO: 2542027 - RNA, 20 nt, Human
agauaacuguuauuuauaau

SEQ ID NO: 2542028 - RNA, 19 nt, Human
agauaacuguuauuuauaa

SEQ ID NO: 2542029 - RNA, 22 nt, Human
agauaagaaugcugguuuuccu

SEQ ID NO: 2542030 - RNA, 14 nt, Human
agauaacugagaau

SEQ ID NO: 2542031 - RNA, 16 nt, Human
agauaacuguuauuua

SEQ ID NO: 2542032 - RNA, 19 nt, Human
agaguuuuggaugcagugc

SEQ ID NO: 2542033 - RNA, 18 nt, Human
agaguuuuggaugcagug

SEQ ID NO: 2542034 - RNA, 17 nt, Human
agaguuuuggaugcagu

SEQ ID NO: 2542035 - RNA, 13 nt, Human
agaguuuuggaug

SEQ ID NO: 2542036 - RNA, 20 nt, Human
agaguuuuggaugcagugcu

SEQ ID NO: 2542037 - RNA, 21 nt, Human
agauaaccagcuguaacacag

SEQ ID NO: 2542038 - RNA, 13 nt, Human
agauaacuaggaa

SEQ ID NO: 2542039 - RNA, 19 nt, Human
agaguuugaaggaggugag

SEQ ID NO: 2542040 - RNA, 13 nt, Human
agaguuugaagga

SEQ ID NO: 2542041 - RNA, 16 nt, Human
agaguuuguguguugu

SEQ ID NO: 2542042 - RNA, 13 nt, Human
agaguuugugugu

SEQ ID NO: 2542043 - RNA, 19 nt, Human
agaguuuguguguugucuu

SEQ ID NO: 2542044 - RNA, 18 nt, Human
agaguuuguguguugucu

SEQ ID NO: 2542045 - RNA, 22 nt, Human
agaguuuguguguugucuugaa

SEQ ID NO: 2542046 - RNA, 15 nt, Human
ugaauguauuuauuu

SEQ ID NO: 2542047 - RNA, 15 nt, Human
agagucacuggaaca

SEQ ID NO: 2542048 - RNA, 22 nt, Human
agagucagaaguuucugccgca

SEQ ID NO: 2542049 - RNA, 16 nt, Human
agaguuguuacauuuu

SEQ ID NO: 2542050 - RNA, 17 nt, Human
agaguuguuacauuuuu

SEQ ID NO: 2542051 - RNA, 19 nt, Human
agaguuguuacauuuuuaa

SEQ ID NO: 2542052 - RNA, 20 nt, Human
agaguuguuacauuuuuaag

SEQ ID NO: 2542053 - RNA, 21 nt, Human
agagucacacgggggcagcug

SEQ ID NO: 2542054 - RNA, 20 nt, Human
agagucacacgggggcagcu

SEQ ID NO: 2542055 - RNA, 23 nt, Human
ugaauguaugugcacugucacuu

SEQ ID NO: 2542056 - RNA, 13 nt, Human
agaguuuccugaa

SEQ ID NO: 2542057 - RNA, 16 nt, Human
agaguuuaguuguagc

SEQ ID NO: 2542058 - RNA, 24 nt, Human
agagggaggagaaugagccucggc

SEQ ID NO: 2542059 - RNA, 16 nt, Human
agagggaggcaagccc

SEQ ID NO: 2542060 - RNA, 17 nt, Human
agagggaggcaagcccu

SEQ ID NO: 2542061 - RNA, 16 nt, Human
agagggagggagggcu

SEQ ID NO: 2542062 - RNA, 22 nt, Human
agagggacuguucuuuuguccc

SEQ ID NO: 2542063 - RNA, 23 nt, Human
agaggcuucuccgccagccuccu

SEQ ID NO: 2542064 - RNA, 14 nt, Human
agaggcuucuucag

SEQ ID NO: 2542065 - RNA, 13 nt, Human
agagggagaagaa

SEQ ID NO: 2542066 - RNA, 15 nt, Human
agagggagaagaagu

SEQ ID NO: 2542067 - RNA, 14 nt, Human
agagggagaagaag

SEQ ID NO: 2542068 - RNA, 16 nt, Human
agagggagaagcauga

SEQ ID NO: 2542069 - RNA, 19 nt, Human
agagggagaagcaugaaaa

SEQ ID NO: 2542070 - RNA, 13 nt, Human
agagggagagaga

SEQ ID NO: 2542071 - RNA, 12 nt, Human
agagggagagag

SEQ ID NO: 2542072 - RNA, 19 nt, Human
agagggagaagggauggag

SEQ ID NO: 2542073 - RNA, 22 nt, Human
agaggcuucuccgccagccucc

SEQ ID NO: 2542074 - RNA, 21 nt, Human
agaggcuucuccgccagccuc

SEQ ID NO: 2542075 - RNA, 20 nt, Human
agaggcuucuccgccagccu

SEQ ID NO: 2542076 - RNA, 19 nt, Human
agaggcuucuccgccagcc

SEQ ID NO: 2542077 - RNA, 17 nt, Human
agaggcuucuccgccag

SEQ ID NO: 2542078 - RNA, 16 nt, Human
agaggcuucuccgcca

SEQ ID NO: 2542079 - RNA, 12 nt, Human
agaggcuucucc

SEQ ID NO: 2542080 - RNA, 22 nt, Human
agaggcuggugcuguggccagg

SEQ ID NO: 2542081 - RNA, 16 nt, Human
agaggcugguuccaga

SEQ ID NO: 2542082 - RNA, 20 nt, Human
agaggcuuccuucauuuccu

SEQ ID NO: 2542083 - RNA, 22 nt, Human
agaggcuguucccaccaggcug

SEQ ID NO: 2542084 - RNA, 14 nt, Human
agaggcccucgcug

SEQ ID NO: 2542085 - RNA, 19 nt, Human
agaggcccucgcugccagc

SEQ ID NO: 2542086 - RNA, 14 nt, Human
agaggcccucugga

SEQ ID NO: 2542087 - RNA, 18 nt, Human
agaggcccucuggagugg

SEQ ID NO: 2542088 - RNA, 17 nt, Human
agaggcuggaggcaggg

SEQ ID NO: 2542089 - RNA, 19 nt, Human
agaggcuggaggcagggcc

SEQ ID NO: 2542090 - RNA, 21 nt, Human
agaggcuggugcuguggccag

SEQ ID NO: 2542091 - RNA, 16 nt, Human
agaggcuggugcugug

SEQ ID NO: 2542092 - RNA, 14 nt, Human
agaggcuggugcug

SEQ ID NO: 2542093 - RNA, 14 nt, Human
agaggcuggguuca

SEQ ID NO: 2542094 - RNA, 20 nt, Human
agaggcuggaggcagggccu

SEQ ID NO: 2542095 - RNA, 22 nt, Human
agaggcuggaggcagggccuug

SEQ ID NO: 2542096 - RNA, 22 nt, Human
agaggcccccagcccagggcuc

SEQ ID NO: 2542097 - RNA, 21 nt, Human
agaggcccccagcccagggcu

SEQ ID NO: 2542098 - RNA, 20 nt, Human
agaggcccccagcccagggc

SEQ ID NO: 2542099 - RNA, 17 nt, Human
agaggcccccagcccag

SEQ ID NO: 2542100 - RNA, 16 nt, Human
agaggcccccagccca

SEQ ID NO: 2542101 - RNA, 14 nt, Human
agaggcccccagcc

SEQ ID NO: 2542102 - RNA, 23 nt, Human
agaggccccagccucccugaagc

SEQ ID NO: 2542103 - RNA, 13 nt, Human
agaggccccagcc

SEQ ID NO: 2542104 - RNA, 14 nt, Human
agaggccccagccu

SEQ ID NO: 2542105 - RNA, 15 nt, Human
agaggccccagccuc

SEQ ID NO: 2542106 - RNA, 16 nt, Human
agaggccccagccucc

SEQ ID NO: 2542107 - RNA, 12 nt, Human
agaggccccagc

SEQ ID NO: 2542108 - RNA, 18 nt, Human
ugaaaguccagaaacugu

SEQ ID NO: 2542109 - RNA, 14 nt, Human
ugaaaguacauuug

SEQ ID NO: 2542110 - RNA, 15 nt, Human
ugaaagguuuacauu

SEQ ID NO: 2542111 - RNA, 23 nt, Human
ugaaaguacauuuggagacacaa

SEQ ID NO: 2542112 - RNA, 15 nt, Human
ugaaaguauaacuga

SEQ ID NO: 2542113 - RNA, 15 nt, Human
ugaaagucagaugcc

SEQ ID NO: 2542114 - RNA, 18 nt, Human
ugaaagucagaugcccag

SEQ ID NO: 2542115 - RNA, 16 nt, Human
ugaaaguccagaaacu

SEQ ID NO: 2542116 - RNA, 21 nt, Human
agaguauggagcucagagagg

SEQ ID NO: 2542117 - RNA, 14 nt, Human
agaguauggagcuc

SEQ ID NO: 2542118 - RNA, 13 nt, Human
agaguauggagcu

SEQ ID NO: 2542119 - RNA, 14 nt, Human
agaguaugaacacc

SEQ ID NO: 2542120 - RNA, 14 nt, Human
ugaagcauuuuaua

SEQ ID NO: 2542121 - RNA, 13 nt, Human
agaguauaugcac

SEQ ID NO: 2542122 - RNA, 18 nt, Human
agaguauauuauguauuu

SEQ ID NO: 2542123 - RNA, 22 nt, Human
agaguagccgagagccugcucc

SEQ ID NO: 2542124 - RNA, 14 nt, Human
agaguaguccaggu

SEQ ID NO: 2542125 - RNA, 23 nt, Human
agaguagccgagagccugcuccc

SEQ ID NO: 2542126 - RNA, 23 nt, Human
agaguagccaggguguggcccug

SEQ ID NO: 2542127 - RNA, 18 nt, Human
agaguagcauuucauucu

SEQ ID NO: 2542128 - RNA, 15 nt, Human
agaguagcauuucau

SEQ ID NO: 2542129 - RNA, 20 nt, Human
agagguuaucugucccaggu

SEQ ID NO: 2542130 - RNA, 13 nt, Human
agaguagccgaga

SEQ ID NO: 2542131 - RNA, 17 nt, Human
agaguagccgagagccu

SEQ ID NO: 2542132 - RNA, 18 nt, Human
agaguagccgagagccug

SEQ ID NO: 2542133 - RNA, 19 nt, Human
agaguagccgagagccugc

SEQ ID NO: 2542134 - RNA, 16 nt, Human
agagguuaaggugcaa

SEQ ID NO: 2542135 - RNA, 24 nt, Human
agaggugggccagucuguggauca

SEQ ID NO: 2542136 - RNA, 14 nt, Human
agaguagcauuuca

SEQ ID NO: 2542137 - RNA, 17 nt, Human
agagguuaucuguccca

SEQ ID NO: 2542138 - RNA, 18 nt, Human
agagggaggcaagcccug

SEQ ID NO: 2542139 - RNA, 15 nt, Human
agagguuaagguggg

SEQ ID NO: 2542140 - RNA, 22 nt, Human
agaggugugcaagagagggaug

SEQ ID NO: 2542141 - RNA, 23 nt, Human
agaggugugcaagagagggaugc

SEQ ID NO: 2542142 - RNA, 16 nt, Human
agagguggggagcaga

SEQ ID NO: 2542143 - RNA, 15 nt, Human
ugaagcauuuuauaa

SEQ ID NO: 2542144 - RNA, 16 nt, Human
ugaagcauuuuauaaa

SEQ ID NO: 2542145 - RNA, 17 nt, Human
ugaagcauuuuauaaau

SEQ ID NO: 2542146 - RNA, 18 nt, Human
ugaagcauuuuauaaauc

SEQ ID NO: 2542147 - RNA, 14 nt, Human
ugaagccaaguggg

SEQ ID NO: 2542148 - RNA, 15 nt, Human
ugaagccaaagccaa

SEQ ID NO: 2542149 - RNA, 14 nt, Human
ugaagccaaagaaa

SEQ ID NO: 2542150 - RNA, 12 nt, Human
ugaagccaaaga

SEQ ID NO: 2542151 - RNA, 11 nt, Human
ugaagccaaag

SEQ ID NO: 2542152 - RNA, 23 nt, Human
agaguauuggucuccucucagcc

SEQ ID NO: 2542153 - RNA, 22 nt, Human
ugaagcauuuuauaaaucgcuu

SEQ ID NO: 2542154 - RNA, 22 nt, Human
ugaagccaaguggggugcuggg

SEQ ID NO: 2542155 - RNA, 21 nt, Human
ugaagccaaguggggugcugg

SEQ ID NO: 2542156 - RNA, 19 nt, Human
ugaagccaauucagacagg

SEQ ID NO: 2542157 - RNA, 13 nt, Human
ugaagccuuucuu

SEQ ID NO: 2542158 - RNA, 23 nt, Human
ugaagccaaguggggugcuggga

SEQ ID NO: 2542159 - RNA, 16 nt, Human
ugaagccacugaagcu

SEQ ID NO: 2542160 - RNA, 12 nt, Human
ugaagccuuugu

SEQ ID NO: 2542161 - RNA, 18 nt, Human
ugaagccuuucuuuugga

SEQ ID NO: 2542162 - RNA, 20 nt, Human
ugaagcuaucguaaaauuaa

SEQ ID NO: 2542163 - RNA, 22 nt, Human
ugaagcuacugugugugugaau

SEQ ID NO: 2542164 - RNA, 15 nt, Human
ugaagcuaagauuua

SEQ ID NO: 2542165 - RNA, 19 nt, Human
ugaagcuauuuaucuguag

SEQ ID NO: 2542166 - RNA, 14 nt, Human
ugaagcuacugugu

SEQ ID NO: 2542167 - RNA, 19 nt, Human
ugaagcucaccuguugcuu

SEQ ID NO: 2542168 - RNA, 18 nt, Human
ugaagcucaccuguugcu

SEQ ID NO: 2542169 - RNA, 16 nt, Human
ugaagcucacuucugg

SEQ ID NO: 2542170 - RNA, 18 nt, Human
ugaagggccagagccagg

SEQ ID NO: 2542171 - RNA, 19 nt, Human
ugaagggccagagccaggg

SEQ ID NO: 2542172 - RNA, 19 nt, Human
ugaagggggauaugaaugg

SEQ ID NO: 2542173 - RNA, 10 nt, Human
ugaaggggcg

SEQ ID NO: 2542174 - RNA, 23 nt, Human
ugaagcucaccuguugcuuacaa

SEQ ID NO: 2542175 - RNA, 22 nt, Human
ugaaggggccaaggagggugag

SEQ ID NO: 2542176 - RNA, 21 nt, Human
ugaauauggacucaguuuucu

SEQ ID NO: 2542177 - RNA, 19 nt, Human
ugaauaugauuaguaaaga

SEQ ID NO: 2542178 - RNA, 17 nt, Human
ugaauaggcgaucacaa

SEQ ID NO: 2542179 - RNA, 16 nt, Human
ugaauacuuuuuacaa

SEQ ID NO: 2542180 - RNA, 19 nt, Human
ugaauaggcgaucacaacg

SEQ ID NO: 2542181 - RNA, 18 nt, Human
ugaauaggcgaucacaac

SEQ ID NO: 2542182 - RNA, 22 nt, Human
ugaauaugaggcauuuggcauu

SEQ ID NO: 2542183 - RNA, 20 nt, Human
ugaauaugaacggugagcau

SEQ ID NO: 2542184 - RNA, 14 nt, Human
ugaauguaugcuuc

SEQ ID NO: 2542185 - RNA, 19 nt, Human
ugaauguaugcuucauaca

SEQ ID NO: 2542186 - RNA, 20 nt, Human
ugaauguaugcuucauacag

SEQ ID NO: 2542187 - RNA, 23 nt, Human
ugaauguaugcuucauacaggga

SEQ ID NO: 2542188 - RNA, 18 nt, Human
ugaauguaugugcacugu

SEQ ID NO: 2542189 - RNA, 15 nt, Human
ugaauguaugugcac

SEQ ID NO: 2542190 - RNA, 11 nt, Human
ugaauguauuu

SEQ ID NO: 2542191 - RNA, 16 nt, Human
ugaauguauugaacuu

SEQ ID NO: 2542192 - RNA, 14 nt, Human
ugaaugggaaaaga

SEQ ID NO: 2542193 - RNA, 22 nt, Human
ugaauauuuacguuuuuguaaa

SEQ ID NO: 2542194 - RNA, 17 nt, Human
ugaauauuuacguuuuu

SEQ ID NO: 2542195 - RNA, 18 nt, Human
ugaauauuguucauauug

SEQ ID NO: 2542196 - RNA, 18 nt, Human
ugaaugggaaaagagaug

SEQ ID NO: 2542197 - RNA, 15 nt, Human
ugaauguaucaggaa

SEQ ID NO: 2542198 - RNA, 16 nt, Human
ugaauguaucaggaaa

SEQ ID NO: 2542199 - RNA, 14 nt, Human
ugaauaaaugucuu

SEQ ID NO: 2542200 - RNA, 13 nt, Human
ugaauaaaugucu

SEQ ID NO: 2542201 - RNA, 19 nt, Human
ugaauaaauaccucuuagc

SEQ ID NO: 2542202 - RNA, 17 nt, Human
ugaauaaauaccucuua

SEQ ID NO: 2542203 - RNA, 15 nt, Human
ugaauaaauaccucu

SEQ ID NO: 2542204 - RNA, 14 nt, Human
ugaauaaauaccuc

SEQ ID NO: 2542205 - RNA, 23 nt, Human
ugaauaaauaccucuuagcugag

SEQ ID NO: 2542206 - RNA, 12 nt, Human
ugaauaaauguc

SEQ ID NO: 2542207 - RNA, 15 nt, Human
ugaauacuuuauaaa

SEQ ID NO: 2542208 - RNA, 16 nt, Human
ugaauacuguauuuug

SEQ ID NO: 2542209 - RNA, 14 nt, Human
ugaagucacugcac

SEQ ID NO: 2542210 - RNA, 22 nt, Human
ugaaggucacucuuccugcaag

SEQ ID NO: 2542211 - RNA, 14 nt, Human
ugaagucacacagu

SEQ ID NO: 2542212 - RNA, 21 nt, Human
ugaagguaaaauugaaaggca

SEQ ID NO: 2542213 - RNA, 16 nt, Human
ugaauaaagacaccua

SEQ ID NO: 2542214 - RNA, 21 nt, Human
ugaagucacugcacagugcau

SEQ ID NO: 2542215 - RNA, 16 nt, Human
ugaagucacugcacag

SEQ ID NO: 2542216 - RNA, 15 nt, Human
ugaagucacugcaca

SEQ ID NO: 2542217 - RNA, 18 nt, Human
ugaauaaagccugcuuuu

SEQ ID NO: 2542218 - RNA, 18 nt, Human
ugaagucacaucacagga

SEQ ID NO: 2542219 - RNA, 20 nt, Human
ugaauaaagccugcuuuuua

SEQ ID NO: 2542220 - RNA, 16 nt, Human
ugaauaaauaaaugua

SEQ ID NO: 2542221 - RNA, 13 nt, Human
ugaauaaauaccu

SEQ ID NO: 2542222 - RNA, 17 nt, Human
ugaauaaaguugaagcu

SEQ ID NO: 2542223 - RNA, 16 nt, Human
agcaagacgcugugcu

SEQ ID NO: 2542224 - RNA, 13 nt, Human
agcaagacgcugu

SEQ ID NO: 2542225 - RNA, 17 nt, Human
agcaacuuguucguggg

SEQ ID NO: 2542226 - RNA, 12 nt, Human
agcaagaaagaa

SEQ ID NO: 2542227 - RNA, 21 nt, Human
agcaagaagauccuaaaacaa

SEQ ID NO: 2542228 - RNA, 15 nt, Human
agcaagaaagaaacc

SEQ ID NO: 2542229 - RNA, 13 nt, Human
agcaacuuucuua

SEQ ID NO: 2542230 - RNA, 20 nt, Human
agcaacuugucuuuuucugg

SEQ ID NO: 2542231 - RNA, 21 nt, Human
agcaacuugucuuuuucugga

SEQ ID NO: 2542232 - RNA, 23 nt, Human
agcaacuugucuuuuucuggacu

SEQ ID NO: 2542233 - RNA, 16 nt, Human
agcaacugucuauuuc

SEQ ID NO: 2542234 - RNA, 13 nt, Human
agcaacugucuau

SEQ ID NO: 2542235 - RNA, 19 nt, Human
agcaacugcuguuggaagg

SEQ ID NO: 2542236 - RNA, 23 nt, Human
agcaacugaauaaauaccucuua

SEQ ID NO: 2542237 - RNA, 22 nt, Human
agcaacugaauaaauaccucuu

SEQ ID NO: 2542238 - RNA, 21 nt, Human
agcaacugaauaaauaccucu

SEQ ID NO: 2542239 - RNA, 19 nt, Human
agcaacugaauaaauaccu

SEQ ID NO: 2542240 - RNA, 15 nt, Human
agcaacugaauaaau

SEQ ID NO: 2542241 - RNA, 14 nt, Human
agcaacugaauaaa

SEQ ID NO: 2542242 - RNA, 13 nt, Human
agcaacugaauaa

SEQ ID NO: 2542243 - RNA, 12 nt, Human
agcaacugaaua

SEQ ID NO: 2542244 - RNA, 23 nt, Human
agcaacucuaagacuacagcaca

SEQ ID NO: 2542245 - RNA, 16 nt, Human
agcaacucuugauuau

SEQ ID NO: 2542246 - RNA, 20 nt, Human
agcaacucuugauuauccau

SEQ ID NO: 2542247 - RNA, 20 nt, Human
agcaacuguuaugaaauaaa

SEQ ID NO: 2542248 - RNA, 18 nt, Human
agcaacuguuaugaaaua

SEQ ID NO: 2542249 - RNA, 17 nt, Human
agcaacuguuaugaaau

SEQ ID NO: 2542250 - RNA, 13 nt, Human
agcaacuguuaug

SEQ ID NO: 2542251 - RNA, 22 nt, Human
agcaacugucuauuucugcuga

SEQ ID NO: 2542252 - RNA, 21 nt, Human
agcaacugucuauuucugcug

SEQ ID NO: 2542253 - RNA, 20 nt, Human
agcaacugucuauuucugcu

SEQ ID NO: 2542254 - RNA, 17 nt, Human
agcaacugucuauuucu

SEQ ID NO: 2542255 - RNA, 21 nt, Human
agcaacuguuaugaaauaaag

SEQ ID NO: 2542256 - RNA, 15 nt, Human
agcaacuugucuuuu

SEQ ID NO: 2542257 - RNA, 23 nt, Human
agcaacgcaggcccccaggugcc

SEQ ID NO: 2542258 - RNA, 23 nt, Human
agcaaaaaaaaaaaaaagcaucu

SEQ ID NO: 2542259 - RNA, 14 nt, Human
agcaacucuugauu

SEQ ID NO: 2542260 - RNA, 20 nt, Human
agcaacguagcuucuaccau

SEQ ID NO: 2542261 - RNA, 22 nt, Human
agauuuuucucaaaguuuugaa

SEQ ID NO: 2542262 - RNA, 13 nt, Human
agauuuuucucaa

SEQ ID NO: 2542263 - RNA, 16 nt, Human
agauuuuuaacgaaug

SEQ ID NO: 2542264 - RNA, 19 nt, Human
ugagaacuacucagggaau

SEQ ID NO: 2542265 - RNA, 17 nt, Human
ugagaacugcauauguu

SEQ ID NO: 2542266 - RNA, 20 nt, Human
ugagaacugcauauguuucg

SEQ ID NO: 2542267 - RNA, 14 nt, Human
ugagaagaaaacau

SEQ ID NO: 2542268 - RNA, 17 nt, Human
ugagaagaaaacaucua

SEQ ID NO: 2542269 - RNA, 17 nt, Human
ugagaagagggccugug

SEQ ID NO: 2542270 - RNA, 16 nt, Human
ugagaagagggccugu

SEQ ID NO: 2542271 - RNA, 15 nt, Human
ugagaagagggccug

SEQ ID NO: 2542272 - RNA, 23 nt, Human
ugagaagaaaacaucuauucucu

SEQ ID NO: 2542273 - RNA, 18 nt, Human
ugagaagagagaucaaau

SEQ ID NO: 2542274 - RNA, 20 nt, Human
ugagaagcagaggaaggaga

SEQ ID NO: 2542275 - RNA, 21 nt, Human
ugagaagagggccugugggag

SEQ ID NO: 2542276 - RNA, 20 nt, Human
ugagaagagggccuguggga

SEQ ID NO: 2542277 - RNA, 23 nt, Human
ugagaagagggccugugggagcc

SEQ ID NO: 2542278 - RNA, 24 nt, Human
ugagaaguuuuguacagagaauua

SEQ ID NO: 2542279 - RNA, 18 nt, Human
ugagaaguuuuguacaga

SEQ ID NO: 2542280 - RNA, 17 nt, Human
ugagaaguuuuguacag

SEQ ID NO: 2542281 - RNA, 19 nt, Human
ugagaaguccccuuccauc

SEQ ID NO: 2542282 - RNA, 22 nt, Human
ugagaagugaaugcugggacuc

SEQ ID NO: 2542283 - RNA, 21 nt, Human
ugagaagugaaugcugggacu

SEQ ID NO: 2542284 - RNA, 16 nt, Human
ugagaaucaaaacucu

SEQ ID NO: 2542285 - RNA, 19 nt, Human
ugagaauaagagagucaua

SEQ ID NO: 2542286 - RNA, 17 nt, Human
ugagaauaagagaguca

SEQ ID NO: 2542287 - RNA, 17 nt, Human
ugagaaucagaucauuu

SEQ ID NO: 2542288 - RNA, 19 nt, Human
ugagaagugaaugcuggga

SEQ ID NO: 2542289 - RNA, 18 nt, Human
ugagaagugaaugcuggg

SEQ ID NO: 2542290 - RNA, 18 nt, Human
ugagaaguccccuuccau

SEQ ID NO: 2542291 - RNA, 20 nt, Human
ugagaaggcagccaccagcg

SEQ ID NO: 2542292 - RNA, 16 nt, Human
ugagaagguccuuaau

SEQ ID NO: 2542293 - RNA, 17 nt, Human
ugagaaggcagccacca

SEQ ID NO: 2542294 - RNA, 16 nt, Human
ugagaaggcagccacc

SEQ ID NO: 2542295 - RNA, 16 nt, Human
ugagaagauugugaau

SEQ ID NO: 2542296 - RNA, 22 nt, Human
agcaagacgcugugcugcccug

SEQ ID NO: 2542297 - RNA, 21 nt, Human
agcaagacgcugugcugcccu

SEQ ID NO: 2542298 - RNA, 20 nt, Human
agcaagacgcugugcugccc

SEQ ID NO: 2542299 - RNA, 17 nt, Human
agcaagacgcugugcug

SEQ ID NO: 2542300 - RNA, 13 nt, Human
agcaagagcuggc

SEQ ID NO: 2542301 - RNA, 15 nt, Human
agcaagagagauguu

SEQ ID NO: 2542302 - RNA, 12 nt, Human
agcaagagagau

SEQ ID NO: 2542303 - RNA, 21 nt, Human
agcaagauccugucuuuaagg

SEQ ID NO: 2542304 - RNA, 23 nt, Human
agcaagagcuggcaaagguggcu

SEQ ID NO: 2542305 - RNA, 17 nt, Human
agcaagagcuggcaaag

SEQ ID NO: 2542306 - RNA, 23 nt, Human
agcaagacgcugugcugcccugc

SEQ ID NO: 2542307 - RNA, 12 nt, Human
agcaagacucug

SEQ ID NO: 2542308 - RNA, 16 nt, Human
agcaagacuguugcuc

SEQ ID NO: 2542309 - RNA, 24 nt, Human
agauuuuguuuugcuuuuucugac

SEQ ID NO: 2542310 - RNA, 23 nt, Human
agauuuuguuuugcuuuuucuga

SEQ ID NO: 2542311 - RNA, 22 nt, Human
agauuuuguuuugcuuuuucug

SEQ ID NO: 2542312 - RNA, 13 nt, Human
agauuuuuacaaa

SEQ ID NO: 2542313 - RNA, 17 nt, Human
agauuuuucaugauuuu

SEQ ID NO: 2542314 - RNA, 14 nt, Human
agauuuuguuuugc

SEQ ID NO: 2542315 - RNA, 21 nt, Human
agauuuuguuuugcuuuuucu

SEQ ID NO: 2542316 - RNA, 17 nt, Human
agauuuuguuuugcuuu

SEQ ID NO: 2542317 - RNA, 16 nt, Human
agauuuuguuuugcuu

SEQ ID NO: 2542318 - RNA, 22 nt, Human
agauuuugggguuguguuguca

SEQ ID NO: 2542319 - RNA, 16 nt, Human
agauuuugcuuuucca

SEQ ID NO: 2542320 - RNA, 19 nt, Human
agauuuugauagcaaagcg

SEQ ID NO: 2542321 - RNA, 18 nt, Human
agauuuugauagcaaagc

SEQ ID NO: 2542322 - RNA, 15 nt, Human
agauuuugauagcaa

SEQ ID NO: 2542323 - RNA, 14 nt, Human
agauuuugaaugcu

SEQ ID NO: 2542324 - RNA, 13 nt, Human
agauuuucuuuaa

SEQ ID NO: 2542325 - RNA, 21 nt, Human
agauuuugaaauuuuuauuaa

SEQ ID NO: 2542326 - RNA, 20 nt, Human
agauuuucuuuaaaagaaug

SEQ ID NO: 2542327 - RNA, 18 nt, Human
agauuuucuuuaaaagaa

SEQ ID NO: 2542328 - RNA, 17 nt, Human
agauuuucuuuaaaaga

SEQ ID NO: 2542329 - RNA, 14 nt, Human
agauuuucuuuaaa

SEQ ID NO: 2542330 - RNA, 15 nt, Human
agauuuuagguguug

SEQ ID NO: 2542331 - RNA, 14 nt, Human
agauuuuagguguu

SEQ ID NO: 2542332 - RNA, 19 nt, Human
agauuucuugaguuuuguu

SEQ ID NO: 2542333 - RNA, 15 nt, Human
agauuuccagucucc

SEQ ID NO: 2542334 - RNA, 19 nt, Human
agauuggcucacacugaga

SEQ ID NO: 2542335 - RNA, 14 nt, Human
agauuggcucacac

SEQ ID NO: 2542336 - RNA, 18 nt, Human
agauuuccauauaaauau

SEQ ID NO: 2542337 - RNA, 23 nt, Human
agauuuccagucuccaccaggaa

SEQ ID NO: 2542338 - RNA, 20 nt, Human
agauuucucauuugccaaua

SEQ ID NO: 2542339 - RNA, 17 nt, Human
agauuugaacucuucaa

SEQ ID NO: 2542340 - RNA, 22 nt, Human
ugacuucuaaguaaaaccacag

SEQ ID NO: 2542341 - RNA, 23 nt, Human
ugacuucuaaguaaaaccacagc

SEQ ID NO: 2542342 - RNA, 15 nt, Human
ugacuucuaaguaaa

SEQ ID NO: 2542343 - RNA, 19 nt, Human
ugacuuacuguacaugaaa

SEQ ID NO: 2542344 - RNA, 20 nt, Human
agauucauuuuuaaucauga

SEQ ID NO: 2542345 - RNA, 17 nt, Human
agauucauuuuuaauca

SEQ ID NO: 2542346 - RNA, 21 nt, Human
agauucauuauuuuuccacuu

SEQ ID NO: 2542347 - RNA, 21 nt, Human
ugacucgggcuccugugcccu

SEQ ID NO: 2542348 - RNA, 18 nt, Human
agauuccagagaguggcu

SEQ ID NO: 2542349 - RNA, 12 nt, Human
agauucauuuuu

SEQ ID NO: 2542350 - RNA, 15 nt, Human
agauucauccauuua

SEQ ID NO: 2542351 - RNA, 24 nt, Human
ugacuucuaaguaaaaccacagca

SEQ ID NO: 2542352 - RNA, 22 nt, Human
agauucauauuuacuucuuaua

SEQ ID NO: 2542353 - RNA, 23 nt, Human
agauugcuuugauuaauccagaa

SEQ ID NO: 2542354 - RNA, 23 nt, Human
agauuggagaaacccuugaaaag

SEQ ID NO: 2542355 - RNA, 15 nt, Human
agauugcuuaaaaua

SEQ ID NO: 2542356 - RNA, 16 nt, Human
agauugcuuaaaauag

SEQ ID NO: 2542357 - RNA, 13 nt, Human
agauuggaaggaa

SEQ ID NO: 2542358 - RNA, 16 nt, Human
agauucgcuuuccaug

SEQ ID NO: 2542359 - RNA, 22 nt, Human
agauugcugaaauuuuauaugc

SEQ ID NO: 2542360 - RNA, 15 nt, Human
agauucccugagcag

SEQ ID NO: 2542361 - RNA, 17 nt, Human
agauucauuuuucuuuc

SEQ ID NO: 2542362 - RNA, 19 nt, Human
agauuccccauugccuccu

SEQ ID NO: 2542363 - RNA, 24 nt, Human
agauuccccauugccuccuccuuc

SEQ ID NO: 2542364 - RNA, 23 nt, Human
agauuccccauugccuccuccuu

SEQ ID NO: 2542365 - RNA, 22 nt, Human
agauuccccauugccuccuccu

SEQ ID NO: 2542366 - RNA, 21 nt, Human
agauuccccauugccuccucc

SEQ ID NO: 2542367 - RNA, 16 nt, Human
ugacccaugcugcccu

SEQ ID NO: 2542368 - RNA, 12 nt, Human
ugacccaugcug

SEQ ID NO: 2542369 - RNA, 21 nt, Human
ugacccaugcugcccugugag

SEQ ID NO: 2542370 - RNA, 21 nt, Human
ugaccccaaacaccuuccagc

SEQ ID NO: 2542371 - RNA, 15 nt, Human
ugacccaugcugccc

SEQ ID NO: 2542372 - RNA, 14 nt, Human
ugacccaugcugcc

SEQ ID NO: 2542373 - RNA, 20 nt, Human
agauguuuuuaaaaguuuca

SEQ ID NO: 2542374 - RNA, 18 nt, Human
agauguuuuuaaaaguuu

SEQ ID NO: 2542375 - RNA, 22 nt, Human
agauguuuuuaaaaguuucaau

SEQ ID NO: 2542376 - RNA, 16 nt, Human
agauguuuuuaaaagu

SEQ ID NO: 2542377 - RNA, 13 nt, Human
agauguuuuuaaa

SEQ ID NO: 2542378 - RNA, 23 nt, Human
agauguuuuagaguuaacaauga

SEQ ID NO: 2542379 - RNA, 11 nt, Human
agauguuuuag

SEQ ID NO: 2542380 - RNA, 17 nt, Human
agauguuuuacgucugg

SEQ ID NO: 2542381 - RNA, 22 nt, Human
agauguuuuaccguaauaauua

SEQ ID NO: 2542382 - RNA, 24 nt, Human
agauguuugucagauaugauaugu

SEQ ID NO: 2542383 - RNA, 21 nt, Human
agauguuuccagacuuccuug

SEQ ID NO: 2542384 - RNA, 23 nt, Human
agauguuuccagacuuccuugag

SEQ ID NO: 2542385 - RNA, 14 nt, Human
agauguuuccagac

SEQ ID NO: 2542386 - RNA, 14 nt, Human
agauguuucacgaa

SEQ ID NO: 2542387 - RNA, 21 nt, Human
agauguuucuuuuguauguaa

SEQ ID NO: 2542388 - RNA, 18 nt, Human
agauguuucuuuuguaug

SEQ ID NO: 2542389 - RNA, 22 nt, Human
agauguuucuuuuguauguaaa

SEQ ID NO: 2542390 - RNA, 15 nt, Human
agauguuugucagau

SEQ ID NO: 2542391 - RNA, 17 nt, Human
agauguuugucagauau

SEQ ID NO: 2542392 - RNA, 19 nt, Human
agauguuugucagauauga

SEQ ID NO: 2542393 - RNA, 15 nt, Human
agauggaaugcugug

SEQ ID NO: 2542394 - RNA, 13 nt, Human
agauggaaugcug

SEQ ID NO: 2542395 - RNA, 23 nt, Human
agauggaaguugcagugagcuga

SEQ ID NO: 2542396 - RNA, 22 nt, Human
agauggaaguugcagugagcug

SEQ ID NO: 2542397 - RNA, 16 nt, Human
agauggaagcuuccag

SEQ ID NO: 2542398 - RNA, 12 nt, Human
agauggaagcuu

SEQ ID NO: 2542399 - RNA, 20 nt, Human
agauggaaccgcaggaagcu

SEQ ID NO: 2542400 - RNA, 21 nt, Human
agauggaaccgcaggaagcug

SEQ ID NO: 2542401 - RNA, 20 nt, Human
agauguucucucccaggggc

SEQ ID NO: 2542402 - RNA, 21 nt, Human
agauguucucuaucauuuaau

SEQ ID NO: 2542403 - RNA, 18 nt, Human
agauggaaugcuguguua

SEQ ID NO: 2542404 - RNA, 20 nt, Human
agauguucucuaucauuuaa

SEQ ID NO: 2542405 - RNA, 12 nt, Human
agauggacacac

SEQ ID NO: 2542406 - RNA, 16 nt, Human
agauggaggaggaggc

SEQ ID NO: 2542407 - RNA, 17 nt, Human
ugacacuuaaaaauggu

SEQ ID NO: 2542408 - RNA, 16 nt, Human
ugacacuuaaaaaugg

SEQ ID NO: 2542409 - RNA, 18 nt, Human
agaugcagagagccauuu

SEQ ID NO: 2542410 - RNA, 23 nt, Human
ugacacuucagagagcugguagu

SEQ ID NO: 2542411 - RNA, 24 nt, Human
ugacacuucagagagcugguaguu

SEQ ID NO: 2542412 - RNA, 17 nt, Human
ugacacuucagagagcu

SEQ ID NO: 2542413 - RNA, 18 nt, Human
ugacacuucagagagcug

SEQ ID NO: 2542414 - RNA, 19 nt, Human
ugacacuucagagagcugg

SEQ ID NO: 2542415 - RNA, 20 nt, Human
ugacacuucagagagcuggu

SEQ ID NO: 2542416 - RNA, 14 nt, Human
ugacacucccuugg

SEQ ID NO: 2542417 - RNA, 16 nt, Human
ugacacuucagagagc

SEQ ID NO: 2542418 - RNA, 15 nt, Human
agaugcagcuggaaa

SEQ ID NO: 2542419 - RNA, 13 nt, Human
agaugcagcugga

SEQ ID NO: 2542420 - RNA, 13 nt, Human
agaugcagggcag

SEQ ID NO: 2542421 - RNA, 12 nt, Human
agaugcagcugg

SEQ ID NO: 2542422 - RNA, 14 nt, Human
agaugcagcaaaau

SEQ ID NO: 2542423 - RNA, 20 nt, Human
agaugcagagagccauuuug

SEQ ID NO: 2542424 - RNA, 19 nt, Human
agaugcagagagccauuuu

SEQ ID NO: 2542425 - RNA, 14 nt, Human
ugacacuuccaguc

SEQ ID NO: 2542426 - RNA, 21 nt, Human
agaugcagcaaaaugugaaug

SEQ ID NO: 2542427 - RNA, 19 nt, Human
agaugcagcaaaaugugaa

SEQ ID NO: 2542428 - RNA, 16 nt, Human
agaugcaguucugaag

SEQ ID NO: 2542429 - RNA, 16 nt, Human
agaugccgcauuugga

SEQ ID NO: 2542430 - RNA, 16 nt, Human
agaugcagggcaguca

SEQ ID NO: 2542431 - RNA, 21 nt, Human
agaugcccagagggcccaggc

SEQ ID NO: 2542432 - RNA, 22 nt, Human
agaugcccagagggcccaggca

SEQ ID NO: 2542433 - RNA, 12 nt, Human
agaugccccaga

SEQ ID NO: 2542434 - RNA, 11 nt, Human
agaugcccuga

SEQ ID NO: 2542435 - RNA, 17 nt, Human
agaugccccagagcugu

SEQ ID NO: 2542436 - RNA, 12 nt, Human
agaugccuccac

SEQ ID NO: 2542437 - RNA, 13 nt, Human
agaugccuccacc

SEQ ID NO: 2542438 - RNA, 21 nt, Human
agaugccuccaccccccagaa

SEQ ID NO: 2542439 - RNA, 22 nt, Human
agaugccuccaccccccagaac

SEQ ID NO: 2542440 - RNA, 14 nt, Human
agaugccuccaccg

SEQ ID NO: 2542441 - RNA, 15 nt, Human
agaugccuccaccgc

SEQ ID NO: 2542442 - RNA, 16 nt, Human
agaugccuccaccgcu

SEQ ID NO: 2542443 - RNA, 17 nt, Human
agaugccuccaccgcug

SEQ ID NO: 2542444 - RNA, 21 nt, Human
agaugccuccaccgcugccua

SEQ ID NO: 2542445 - RNA, 23 nt, Human
agaugcucuaucuugcucuguaa

SEQ ID NO: 2542446 - RNA, 21 nt, Human
agaugcucuaucuugcucugu

SEQ ID NO: 2542447 - RNA, 18 nt, Human
agaugcucuaucuugcuc

SEQ ID NO: 2542448 - RNA, 17 nt, Human
agaugcucuaucuugcu

SEQ ID NO: 2542449 - RNA, 15 nt, Human
agaugcuccuugggc

SEQ ID NO: 2542450 - RNA, 20 nt, Human
agaugcuccuugggcccuuu

SEQ ID NO: 2542451 - RNA, 20 nt, Human
agaugcugacuguacuccuc

SEQ ID NO: 2542452 - RNA, 18 nt, Human
agaugcugaaacaggaga

SEQ ID NO: 2542453 - RNA, 13 nt, Human
agaugcucuuuua

SEQ ID NO: 2542454 - RNA, 23 nt, Human
agaugcugacuguacuccuccca

SEQ ID NO: 2542455 - RNA, 15 nt, Human
agaugcucuucugug

SEQ ID NO: 2542456 - RNA, 21 nt, Human
agaugcugaaacaggagagaa

SEQ ID NO: 2542457 - RNA, 11 nt, Human
agaugcugaug

SEQ ID NO: 2542458 - RNA, 22 nt, Human
agaugcugaaacaggagagaaa

SEQ ID NO: 2542459 - RNA, 15 nt, Human
agaugcugauguuca

SEQ ID NO: 2542460 - RNA, 14 nt, Human
agaugcugauguuc

SEQ ID NO: 2542461 - RNA, 13 nt, Human
agaugcugauguu

SEQ ID NO: 2542462 - RNA, 17 nt, Human
agauggaaccgcaggaa

SEQ ID NO: 2542463 - RNA, 18 nt, Human
agauggaaccgcaggaag

SEQ ID NO: 2542464 - RNA, 22 nt, Human
agauggaacccuuuuggccccc

SEQ ID NO: 2542465 - RNA, 19 nt, Human
ugaccugaggcccuucucu

SEQ ID NO: 2542466 - RNA, 18 nt, Human
ugaccugaggcccuucuc

SEQ ID NO: 2542467 - RNA, 20 nt, Human
ugacccggaggccacaugag

SEQ ID NO: 2542468 - RNA, 17 nt, Human
ugacccggaggccacau

SEQ ID NO: 2542469 - RNA, 21 nt, Human
ugacccggaggccacaugagu

SEQ ID NO: 2542470 - RNA, 14 nt, Human
ugacccggaggcca

SEQ ID NO: 2542471 - RNA, 22 nt, Human
ugaccccuuuucagcuucugcu

SEQ ID NO: 2542472 - RNA, 21 nt, Human
ugaccccuuuucagcuucugc

SEQ ID NO: 2542473 - RNA, 22 nt, Human
ugaccccaaagagccuggagaa

SEQ ID NO: 2542474 - RNA, 19 nt, Human
ugaccccaaagagccugga

SEQ ID NO: 2542475 - RNA, 22 nt, Human
ugaccccaaacaccuuccagcu

SEQ ID NO: 2542476 - RNA, 13 nt, Human
ugaccccagagga

SEQ ID NO: 2542477 - RNA, 20 nt, Human
ugaccccuccucacuggcca

SEQ ID NO: 2542478 - RNA, 15 nt, Human
ugaccccuccucacu

SEQ ID NO: 2542479 - RNA, 13 nt, Human
ugaccccuccuca

SEQ ID NO: 2542480 - RNA, 23 nt, Human
ugaccccucauagcccucacccu

SEQ ID NO: 2542481 - RNA, 22 nt, Human
ugaccccuccucacuggccauc

SEQ ID NO: 2542482 - RNA, 13 nt, Human
ugaccccugcuca

SEQ ID NO: 2542483 - RNA, 21 nt, Human
ugaccccuccucacuggccau

SEQ ID NO: 2542484 - RNA, 23 nt, Human
ugaccuuccucgcagagaggcca

SEQ ID NO: 2542485 - RNA, 21 nt, Human
ugaccuuccucgcagagaggc

SEQ ID NO: 2542486 - RNA, 20 nt, Human
ugaccuuccucgcagagagg

SEQ ID NO: 2542487 - RNA, 18 nt, Human
ugaccuuccucgcagaga

SEQ ID NO: 2542488 - RNA, 22 nt, Human
ugaccuuaguguuucugugcau

SEQ ID NO: 2542489 - RNA, 19 nt, Human
ugaccuuccaagagccuga

SEQ ID NO: 2542490 - RNA, 20 nt, Human
ugaccuuccaagagccugag

SEQ ID NO: 2542491 - RNA, 23 nt, Human
ugaccuuaguguuucugugcaug

SEQ ID NO: 2542492 - RNA, 18 nt, Human
ugaccuuccaagagccug

SEQ ID NO: 2542493 - RNA, 21 nt, Human
ugaccuuaguguuucugugca

SEQ ID NO: 2542494 - RNA, 16 nt, Human
ugaccuuaguguuucu

SEQ ID NO: 2542495 - RNA, 15 nt, Human
ugaccuuaguguuuc

SEQ ID NO: 2542496 - RNA, 13 nt, Human
ugaccuuacauuu

SEQ ID NO: 2542497 - RNA, 20 nt, Human
ugaccugugagcccagcugg

SEQ ID NO: 2542498 - RNA, 18 nt, Human
ugaccugugaccagcacu

SEQ ID NO: 2542499 - RNA, 22 nt, Human
ugaccugugaccagcacugucu

SEQ ID NO: 2542500 - RNA, 21 nt, Human
ugaccugucaugccccccuca

SEQ ID NO: 2542501 - RNA, 20 nt, Human
ugaccugucaugccccccuc

SEQ ID NO: 2542502 - RNA, 13 nt, Human
ugaccugugacca

SEQ ID NO: 2542503 - RNA, 15 nt, Human
ugaccugugaccagc

SEQ ID NO: 2542504 - RNA, 19 nt, Human
ugaccuguggggauuucuc

SEQ ID NO: 2542505 - RNA, 21 nt, Human
ugaccuguggggauuucuccc

SEQ ID NO: 2542506 - RNA, 22 nt, Human
ugaccuguggggauuucuccca

SEQ ID NO: 2542507 - RNA, 23 nt, Human
ugaccuguggggauuucucccag

SEQ ID NO: 2542508 - RNA, 14 nt, Human
ugaccuguggugca

SEQ ID NO: 2542509 - RNA, 14 nt, Human
ugaccugugucacu

SEQ ID NO: 2542510 - RNA, 15 nt, Human
ugaccugugucacua

SEQ ID NO: 2542511 - RNA, 15 nt, Human
ugaccugaggcugug

SEQ ID NO: 2542512 - RNA, 18 nt, Human
ugaccugaggcuccugug

SEQ ID NO: 2542513 - RNA, 12 nt, Human
ugaccugaggcu

SEQ ID NO: 2542514 - RNA, 12 nt, Human
ugaccugagggc

SEQ ID NO: 2542515 - RNA, 20 nt, Human
ugaccugaggcuccugugcu

SEQ ID NO: 2542516 - RNA, 17 nt, Human
ugaccugaggcuguggu

SEQ ID NO: 2542517 - RNA, 11 nt, Human
ugaccugcagg

SEQ ID NO: 2542518 - RNA, 20 nt, Human
ugaccugcaggccaagagca

SEQ ID NO: 2542519 - RNA, 20 nt, Human
ugacucgggcuccugugccc

SEQ ID NO: 2542520 - RNA, 19 nt, Human
ugacucgggcuccugugcc

SEQ ID NO: 2542521 - RNA, 18 nt, Human
ugacucgggcuccugugc

SEQ ID NO: 2542522 - RNA, 17 nt, Human
ugacucgggcuccugug

SEQ ID NO: 2542523 - RNA, 17 nt, Human
ugacucgggggugggga

SEQ ID NO: 2542524 - RNA, 16 nt, Human
ugacucgggggugggg

SEQ ID NO: 2542525 - RNA, 13 nt, Human
ugacuuacuguac

SEQ ID NO: 2542526 - RNA, 15 nt, Human
ugacuuacuguacau

SEQ ID NO: 2542527 - RNA, 16 nt, Human
ugacuuacuguacaug

SEQ ID NO: 2542528 - RNA, 17 nt, Human
ugacuccucuaagccac

SEQ ID NO: 2542529 - RNA, 21 nt, Human
ugacuccgcuggagguggggc

SEQ ID NO: 2542530 - RNA, 16 nt, Human
ugacuccgcuggaggu

SEQ ID NO: 2542531 - RNA, 22 nt, Human
ugacucccuuaaaauagaaaua

SEQ ID NO: 2542532 - RNA, 21 nt, Human
ugacuccuugugguuuauguc

SEQ ID NO: 2542533 - RNA, 14 nt, Human
ugacuccuuguggu

SEQ ID NO: 2542534 - RNA, 20 nt, Human
ugacuccuaugaucucaggu

SEQ ID NO: 2542535 - RNA, 22 nt, Human
ugacuccuuagagacaucaaaa

SEQ ID NO: 2542536 - RNA, 16 nt, Human
ugacucgggcuccugu

SEQ ID NO: 2542537 - RNA, 15 nt, Human
ugacucgggcuccug

SEQ ID NO: 2542538 - RNA, 21 nt, Human
ugacucgaggguuggguucau

SEQ ID NO: 2542539 - RNA, 23 nt, Human
ugacuccaguggggcaagauuuu

SEQ ID NO: 2542540 - RNA, 18 nt, Human
ugacuccaggagaggagc

SEQ ID NO: 2542541 - RNA, 14 nt, Human
ugacucacccaagc

SEQ ID NO: 2542542 - RNA, 14 nt, Human
ugacuccaggagag

SEQ ID NO: 2542543 - RNA, 20 nt, Human
ugacucacaagaagaccaga

SEQ ID NO: 2542544 - RNA, 11 nt, Human
ugacucaccca

SEQ ID NO: 2542545 - RNA, 12 nt, Human
ugacucacccaa

SEQ ID NO: 2542546 - RNA, 13 nt, Human
ugacucacccaag

SEQ ID NO: 2542547 - RNA, 19 nt, Human
ugacuagugaggaaagauu

SEQ ID NO: 2542548 - RNA, 16 nt, Human
ugacucaaaucuccag

SEQ ID NO: 2542549 - RNA, 14 nt, Human
ugacucaacauguu

SEQ ID NO: 2542550 - RNA, 15 nt, Human
ugacucaacauguua

SEQ ID NO: 2542551 - RNA, 22 nt, Human
ugacucaacauguuacugacca

SEQ ID NO: 2542552 - RNA, 20 nt, Human
ugacuagggauucaggcugc

SEQ ID NO: 2542553 - RNA, 21 nt, Human
ugacuagggauucaggcugcu

SEQ ID NO: 2542554 - RNA, 23 nt, Human
ugacuagggauucaggcugcuug

SEQ ID NO: 2542555 - RNA, 23 nt, Human
ugacucaacauguuacugaccag

SEQ ID NO: 2542556 - RNA, 19 nt, Human
ugacucacaagaagaccag

SEQ ID NO: 2542557 - RNA, 20 nt, Human
ugacucaagugucucagucc

SEQ ID NO: 2542558 - RNA, 17 nt, Human
ugacuagggaaaugauc

SEQ ID NO: 2542559 - RNA, 23 nt, Human
ugacuagaugauggaugccaaua

SEQ ID NO: 2542560 - RNA, 17 nt, Human
ugacuagaggcagggag

SEQ ID NO: 2542561 - RNA, 21 nt, Human
ugacuagaggcagggagggga

SEQ ID NO: 2542562 - RNA, 17 nt, Human
ugacuagggauucaggc

SEQ ID NO: 2542563 - RNA, 18 nt, Human
ugacuagggauucaggcu

SEQ ID NO: 2542564 - RNA, 19 nt, Human
ugacuagggauucaggcug

SEQ ID NO: 2542565 - RNA, 21 nt, Human
ugaccuugaggagucuugugu

SEQ ID NO: 2542566 - RNA, 20 nt, Human
ugaccuugaggagucuugug

SEQ ID NO: 2542567 - RNA, 21 nt, Human
ugacuagaagggccaguccug

SEQ ID NO: 2542568 - RNA, 22 nt, Human
ugaccuugaggagucuugugug

SEQ ID NO: 2542569 - RNA, 17 nt, Human
ugaccuugaacuccugg

SEQ ID NO: 2542570 - RNA, 18 nt, Human
ugaccuugaacuccuggg

SEQ ID NO: 2542571 - RNA, 19 nt, Human
ugaccuugaacuccugggc

SEQ ID NO: 2542572 - RNA, 20 nt, Human
ugaccuugaacuccugggcu

SEQ ID NO: 2542573 - RNA, 13 nt, Human
ugaccuucuggga

SEQ ID NO: 2542574 - RNA, 14 nt, Human
ugaccuucugggaa

SEQ ID NO: 2542575 - RNA, 17 nt, Human
ugaccuucuaggaagcu

SEQ ID NO: 2542576 - RNA, 21 nt, Human
ugauagaaggcuauggggaua

SEQ ID NO: 2542577 - RNA, 21 nt, Human
ugauacuuuugacaacaaauu

SEQ ID NO: 2542578 - RNA, 15 nt, Human
ugauacuuuuaagag

SEQ ID NO: 2542579 - RNA, 15 nt, Human
ugauacuuuugacaa

SEQ ID NO: 2542580 - RNA, 12 nt, Human
ugauaugggucu

SEQ ID NO: 2542581 - RNA, 18 nt, Human
ugauauggcagaagacac

SEQ ID NO: 2542582 - RNA, 17 nt, Human
ugauauggcagaagaca

SEQ ID NO: 2542583 - RNA, 20 nt, Human
ugauauggcagaagacacca

SEQ ID NO: 2542584 - RNA, 19 nt, Human
ugauauggcagaagacacc

SEQ ID NO: 2542585 - RNA, 15 nt, Human
ugauauguaaacaua

SEQ ID NO: 2542586 - RNA, 19 nt, Human
ugauauguugguagauucu

SEQ ID NO: 2542587 - RNA, 17 nt, Human
ugauauugcauaugcau

SEQ ID NO: 2542588 - RNA, 21 nt, Human
ugauauuccccccacuuaaga

SEQ ID NO: 2542589 - RNA, 16 nt, Human
ugauauuccaugaaug

SEQ ID NO: 2542590 - RNA, 18 nt, Human
ugauauuccaugaaugua

SEQ ID NO: 2542591 - RNA, 19 nt, Human
ugauauuccaugaauguau

SEQ ID NO: 2542592 - RNA, 20 nt, Human
ugauauuccaugaauguauc

SEQ ID NO: 2542593 - RNA, 22 nt, Human
ugauauuccaugaauguaucag

SEQ ID NO: 2542594 - RNA, 23 nt, Human
ugauauuaaaggaguuaagagua

SEQ ID NO: 2542595 - RNA, 16 nt, Human
ugauauuaaaggaguu

SEQ ID NO: 2542596 - RNA, 20 nt, Human
ugauauucaaauggacaaac

SEQ ID NO: 2542597 - RNA, 13 nt, Human
ugauauuaaagga

SEQ ID NO: 2542598 - RNA, 21 nt, Human
ugauauguaaacauaauucuu

SEQ ID NO: 2542599 - RNA, 23 nt, Human
ugauauuuucaacgcagcccugc

SEQ ID NO: 2542600 - RNA, 22 nt, Human
ugauauuuucaacgcagcccug

SEQ ID NO: 2542601 - RNA, 21 nt, Human
ugauauuuucaacgcagcccu

SEQ ID NO: 2542602 - RNA, 19 nt, Human
ugauauuuucaacgcagcc

SEQ ID NO: 2542603 - RNA, 19 nt, Human
ugauauuuccccaugguuu

SEQ ID NO: 2542604 - RNA, 23 nt, Human
ugauauuucccuccccuggggac

SEQ ID NO: 2542605 - RNA, 12 nt, Human
agcaucaggcca

SEQ ID NO: 2542606 - RNA, 13 nt, Human
agcaucaggccag

SEQ ID NO: 2542607 - RNA, 15 nt, Human
agcaucacaguuuug

SEQ ID NO: 2542608 - RNA, 17 nt, Human
agcaucacaguuuuggu

SEQ ID NO: 2542609 - RNA, 21 nt, Human
ugaucacggcucacugcagcc

SEQ ID NO: 2542610 - RNA, 20 nt, Human
ugaucacggcucacugcagc

SEQ ID NO: 2542611 - RNA, 22 nt, Human
agcauauucaggaagcucaggg

SEQ ID NO: 2542612 - RNA, 20 nt, Human
agcauauuuguauaguugcu

SEQ ID NO: 2542613 - RNA, 18 nt, Human
agcauauuuguauaguug

SEQ ID NO: 2542614 - RNA, 18 nt, Human
ugaucaauaaaaugugau

SEQ ID NO: 2542615 - RNA, 22 nt, Human
agcauauuuguauaguugcuug

SEQ ID NO: 2542616 - RNA, 21 nt, Human
agcauauuuguauaguugcuu

SEQ ID NO: 2542617 - RNA, 13 nt, Human
agcaucaaacucu

SEQ ID NO: 2542618 - RNA, 14 nt, Human
agcaucaaacucuu

SEQ ID NO: 2542619 - RNA, 21 nt, Human
ugaucaacaucuuuucuugcc

SEQ ID NO: 2542620 - RNA, 18 nt, Human
ugaucaacaucuuuucuu

SEQ ID NO: 2542621 - RNA, 17 nt, Human
ugaucaacaucuuuucu

SEQ ID NO: 2542622 - RNA, 14 nt, Human
ugaucaacaucuuu

SEQ ID NO: 2542623 - RNA, 17 nt, Human
ugaucaagggaauguaa

SEQ ID NO: 2542624 - RNA, 20 nt, Human
ugaucaagggaauguaacug

SEQ ID NO: 2542625 - RNA, 23 nt, Human
ugaucaaauucauuuuuuucacu

SEQ ID NO: 2542626 - RNA, 23 nt, Human
ugaucaacaucuuuucuugccuc

SEQ ID NO: 2542627 - RNA, 19 nt, Human
ugaucacggcucacugcag

SEQ ID NO: 2542628 - RNA, 22 nt, Human
ugaucaagggaauguaacugcu

SEQ ID NO: 2542629 - RNA, 13 nt, Human
ugaucaauaaaau

SEQ ID NO: 2542630 - RNA, 15 nt, Human
ugaucaauaaaaugu

SEQ ID NO: 2542631 - RNA, 16 nt, Human
ugaucaauaaaaugug

SEQ ID NO: 2542632 - RNA, 20 nt, Human
ugaucaaaguccgaggggcg

SEQ ID NO: 2542633 - RNA, 15 nt, Human
ugaucaaauucauuu

SEQ ID NO: 2542634 - RNA, 22 nt, Human
ugaucaaauucauuuuuuucac

SEQ ID NO: 2542635 - RNA, 17 nt, Human
ugaucaaauucauuuuu

SEQ ID NO: 2542636 - RNA, 16 nt, Human
ugaucaaauucauuuu

SEQ ID NO: 2542637 - RNA, 19 nt, Human
ugauauuuuaccucuuauu

SEQ ID NO: 2542638 - RNA, 17 nt, Human
ugauauuuucugugccu

SEQ ID NO: 2542639 - RNA, 20 nt, Human
ugauauuuucugugccugaa

SEQ ID NO: 2542640 - RNA, 18 nt, Human
ugaucaaagccacacucu

SEQ ID NO: 2542641 - RNA, 20 nt, Human
agcaucaggccaggcccucu

SEQ ID NO: 2542642 - RNA, 19 nt, Human
agcaucaggccaggcccuc

SEQ ID NO: 2542643 - RNA, 18 nt, Human
agcaucaggccaggcccu

SEQ ID NO: 2542644 - RNA, 17 nt, Human
agcaucaggccaggccc

SEQ ID NO: 2542645 - RNA, 16 nt, Human
agcaucaggccaggcc

SEQ ID NO: 2542646 - RNA, 14 nt, Human
agcaucaggccagg

SEQ ID NO: 2542647 - RNA, 17 nt, Human
agcaugucgucaaagcu

SEQ ID NO: 2542648 - RNA, 20 nt, Human
agcaugucgucaaagcugaa

SEQ ID NO: 2542649 - RNA, 12 nt, Human
agcauggcugcc

SEQ ID NO: 2542650 - RNA, 18 nt, Human
agcauggcucaaagugca

SEQ ID NO: 2542651 - RNA, 16 nt, Human
agcauguacaguguuc

SEQ ID NO: 2542652 - RNA, 19 nt, Human
agcauguacaguguucugu

SEQ ID NO: 2542653 - RNA, 21 nt, Human
agcauguacugagccuuguaa

SEQ ID NO: 2542654 - RNA, 15 nt, Human
agcauguaggagaau

SEQ ID NO: 2542655 - RNA, 23 nt, Human
agcauguauugugucuuuugcau

SEQ ID NO: 2542656 - RNA, 16 nt, Human
agcauguauugugucu

SEQ ID NO: 2542657 - RNA, 14 nt, Human
agcauguauugugu

SEQ ID NO: 2542658 - RNA, 17 nt, Human
agcaugucuauucagcu

SEQ ID NO: 2542659 - RNA, 19 nt, Human
agcaugucuauucagcuuc

SEQ ID NO: 2542660 - RNA, 22 nt, Human
agcauguauugugucuuuugca

SEQ ID NO: 2542661 - RNA, 17 nt, Human
agcauguggcauguuca

SEQ ID NO: 2542662 - RNA, 19 nt, Human
agcauguguauuuccagug

SEQ ID NO: 2542663 - RNA, 16 nt, Human
agcauguugagccagg

SEQ ID NO: 2542664 - RNA, 18 nt, Human
agcauguggcauguucau

SEQ ID NO: 2542665 - RNA, 16 nt, Human
agcauguguugaaaaa

SEQ ID NO: 2542666 - RNA, 17 nt, Human
agcauguuucauguuuu

SEQ ID NO: 2542667 - RNA, 14 nt, Human
agcauguuucaugu

SEQ ID NO: 2542668 - RNA, 18 nt, Human
agcauguugcugaggagu

SEQ ID NO: 2542669 - RNA, 17 nt, Human
agcauguugcugaggag

SEQ ID NO: 2542670 - RNA, 22 nt, Human
agcauguguuugguucuggggc

SEQ ID NO: 2542671 - RNA, 19 nt, Human
agcauguugagccaggccu

SEQ ID NO: 2542672 - RNA, 20 nt, Human
agcauguugagccaggccug

SEQ ID NO: 2542673 - RNA, 21 nt, Human
agcauguugagccaggccugg

SEQ ID NO: 2542674 - RNA, 15 nt, Human
agcauguuugcugaa

SEQ ID NO: 2542675 - RNA, 14 nt, Human
agcauguuugcuga

SEQ ID NO: 2542676 - RNA, 21 nt, Human
agcauguuucauguuuuguga

SEQ ID NO: 2542677 - RNA, 18 nt, Human
agcauguuucauguuuug

SEQ ID NO: 2542678 - RNA, 17 nt, Human
agcauguuugcugaaca

SEQ ID NO: 2542679 - RNA, 16 nt, Human
agcauguuugcugaac

SEQ ID NO: 2542680 - RNA, 20 nt, Human
agcauguuugcugaacaccu

SEQ ID NO: 2542681 - RNA, 14 nt, Human
agcauuaacuaauc

SEQ ID NO: 2542682 - RNA, 17 nt, Human
agcauuaagaacacuuu

SEQ ID NO: 2542683 - RNA, 18 nt, Human
agcauuaacuucucugga

SEQ ID NO: 2542684 - RNA, 17 nt, Human
agcauuaacuucucugg

SEQ ID NO: 2542685 - RNA, 18 nt, Human
agcauuaacuaaucuauu

SEQ ID NO: 2542686 - RNA, 23 nt, Human
agcauugcugguucuauuuaaug

SEQ ID NO: 2542687 - RNA, 16 nt, Human
agcauugcugguucua

SEQ ID NO: 2542688 - RNA, 15 nt, Human
agcauugcugguucu

SEQ ID NO: 2542689 - RNA, 22 nt, Human
agcauugccauucccugccugg

SEQ ID NO: 2542690 - RNA, 14 nt, Human
agcauugccauucc

SEQ ID NO: 2542691 - RNA, 14 nt, Human
agcauugcugguuc

SEQ ID NO: 2542692 - RNA, 13 nt, Human
agcauugccauuc

SEQ ID NO: 2542693 - RNA, 13 nt, Human
agcauugcaugga

SEQ ID NO: 2542694 - RNA, 15 nt, Human
agcauuacaaauugc

SEQ ID NO: 2542695 - RNA, 21 nt, Human
agcauugugaacugacaggca

SEQ ID NO: 2542696 - RNA, 17 nt, Human
agcauugugaacugaca

SEQ ID NO: 2542697 - RNA, 20 nt, Human
agcauuguggcugucagcag

SEQ ID NO: 2542698 - RNA, 21 nt, Human
agcauuguggcugucagcagg

SEQ ID NO: 2542699 - RNA, 13 nt, Human
agcauuucauucu

SEQ ID NO: 2542700 - RNA, 15 nt, Human
agcauuguuugcuua

SEQ ID NO: 2542701 - RNA, 22 nt, Human
agcauuuccaacaccacagaca

SEQ ID NO: 2542702 - RNA, 21 nt, Human
agcauuuccaacaccacagac

SEQ ID NO: 2542703 - RNA, 19 nt, Human
agcauuuccaacaccacag

SEQ ID NO: 2542704 - RNA, 18 nt, Human
agcauuuccaacaccaca

SEQ ID NO: 2542705 - RNA, 17 nt, Human
agcauuuccaacaccac

SEQ ID NO: 2542706 - RNA, 14 nt, Human
agcauuuccaacac

SEQ ID NO: 2542707 - RNA, 21 nt, Human
agcauuucauucuucucuagc

SEQ ID NO: 2542708 - RNA, 20 nt, Human
agcauuucauucuucucuag

SEQ ID NO: 2542709 - RNA, 23 nt, Human
agcauuuccaacaccacagacac

SEQ ID NO: 2542710 - RNA, 20 nt, Human
agcauuucgcgauggacaga

SEQ ID NO: 2542711 - RNA, 17 nt, Human
agcauuguaaaugugcu

SEQ ID NO: 2542712 - RNA, 18 nt, Human
agcauuguaaaugugcuu

SEQ ID NO: 2542713 - RNA, 11 nt, Human
agcauugcuuu

SEQ ID NO: 2542714 - RNA, 12 nt, Human
agcauugcuuuc

SEQ ID NO: 2542715 - RNA, 13 nt, Human
agcauugcuuucu

SEQ ID NO: 2542716 - RNA, 14 nt, Human
agcauugcuuucug

SEQ ID NO: 2542717 - RNA, 15 nt, Human
agcauugcuuucuga

SEQ ID NO: 2542718 - RNA, 16 nt, Human
agcauugcuuucugaa

SEQ ID NO: 2542719 - RNA, 17 nt, Human
agcauugcuuucugaaa

SEQ ID NO: 2542720 - RNA, 23 nt, Human
ugaguacuacaguccucccaucu

SEQ ID NO: 2542721 - RNA, 22 nt, Human
ugaguacuacaguccucccauc

SEQ ID NO: 2542722 - RNA, 21 nt, Human
ugaguacuacaguccucccau

SEQ ID NO: 2542723 - RNA, 17 nt, Human
ugaguacuacaguccuc

SEQ ID NO: 2542724 - RNA, 23 nt, Human
ugaguagaaaggccuuuaaaauu

SEQ ID NO: 2542725 - RNA, 18 nt, Human
ugaguagaaaggccuuua

SEQ ID NO: 2542726 - RNA, 14 nt, Human
ugaguagaggcuua

SEQ ID NO: 2542727 - RNA, 19 nt, Human
ugaguaagaaaugcugccc

SEQ ID NO: 2542728 - RNA, 17 nt, Human
ugaguagaaaggccuuu

SEQ ID NO: 2542729 - RNA, 13 nt, Human
ugaguaagagcug

SEQ ID NO: 2542730 - RNA, 13 nt, Human
ugaguagcuggga

SEQ ID NO: 2542731 - RNA, 13 nt, Human
ugaguagcuggau

SEQ ID NO: 2542732 - RNA, 16 nt, Human
agcauaucugccuuua

SEQ ID NO: 2542733 - RNA, 12 nt, Human
agcauaugagga

SEQ ID NO: 2542734 - RNA, 18 nt, Human
agcauauguguuggcuug

SEQ ID NO: 2542735 - RNA, 16 nt, Human
agcauauguguuggcu

SEQ ID NO: 2542736 - RNA, 21 nt, Human
agcauaugaguuucauagcua

SEQ ID NO: 2542737 - RNA, 20 nt, Human
agcauaugaguuucauagcu

SEQ ID NO: 2542738 - RNA, 16 nt, Human
agcauaugaguuucau

SEQ ID NO: 2542739 - RNA, 16 nt, Human
agcauaugaggaugca

SEQ ID NO: 2542740 - RNA, 23 nt, Human
agcauaugaggaugcagagucag

SEQ ID NO: 2542741 - RNA, 14 nt, Human
agcauauucaggaa

SEQ ID NO: 2542742 - RNA, 15 nt, Human
ugagguuuuuaagcc

SEQ ID NO: 2542743 - RNA, 21 nt, Human
ugaguaaaggaguaagaaccu

SEQ ID NO: 2542744 - RNA, 22 nt, Human
ugaguaacugauuuguaacaag

SEQ ID NO: 2542745 - RNA, 15 nt, Human
ugaguacuacagucc

SEQ ID NO: 2542746 - RNA, 17 nt, Human
ugaguaagaaaugcugc

SEQ ID NO: 2542747 - RNA, 16 nt, Human
agcauacguacacauu

SEQ ID NO: 2542748 - RNA, 17 nt, Human
agcauacguacacauuu

SEQ ID NO: 2542749 - RNA, 18 nt, Human
agcauacguacacauuuu

SEQ ID NO: 2542750 - RNA, 19 nt, Human
agcauacguacacauuuua

SEQ ID NO: 2542751 - RNA, 23 nt, Human
agcauaucugccuuuauuguguu

SEQ ID NO: 2542752 - RNA, 22 nt, Human
agcauaucugccuuuauugugu

SEQ ID NO: 2542753 - RNA, 20 nt, Human
agcauaucugccuuuauugu

SEQ ID NO: 2542754 - RNA, 17 nt, Human
agcauaucugccuuuau

SEQ ID NO: 2542755 - RNA, 19 nt, Human
agcauaccuuuauugugau

SEQ ID NO: 2542756 - RNA, 17 nt, Human
agcauaccuuuauugug

SEQ ID NO: 2542757 - RNA, 16 nt, Human
agcauaccuuuauugu

SEQ ID NO: 2542758 - RNA, 20 nt, Human
agcauacguacacauuuuau

SEQ ID NO: 2542759 - RNA, 21 nt, Human
agcauacguacacauuuuauu

SEQ ID NO: 2542760 - RNA, 12 nt, Human
ugagaauuaccc

SEQ ID NO: 2542761 - RNA, 19 nt, Human
ugagaauuuaaaaauaaga

SEQ ID NO: 2542762 - RNA, 20 nt, Human
ugagaauuugagugcucuga

SEQ ID NO: 2542763 - RNA, 15 nt, Human
ugagaauuccaagga

SEQ ID NO: 2542764 - RNA, 16 nt, Human
ugagaauuccaaggag

SEQ ID NO: 2542765 - RNA, 20 nt, Human
ugagaaucagaucauuucaa

SEQ ID NO: 2542766 - RNA, 18 nt, Human
ugagacaaauggaggccu

SEQ ID NO: 2542767 - RNA, 20 nt, Human
ugagaauugugcucaaaauu

SEQ ID NO: 2542768 - RNA, 13 nt, Human
ugagaauuuuaaa

SEQ ID NO: 2542769 - RNA, 15 nt, Human
ugagaauuuuaaauu

SEQ ID NO: 2542770 - RNA, 23 nt, Human
ugagaauuuuaaauuauaacuua

SEQ ID NO: 2542771 - RNA, 15 nt, Human
agcauacguacacau

SEQ ID NO: 2542772 - RNA, 21 nt, Human
agcauaauacuugcuuuggaa

SEQ ID NO: 2542773 - RNA, 23 nt, Human
agcauaaauguugacaugggaca

SEQ ID NO: 2542774 - RNA, 23 nt, Human
agcauaaguuucugggaccucag

SEQ ID NO: 2542775 - RNA, 17 nt, Human
agcauaaguuucuggga

SEQ ID NO: 2542776 - RNA, 20 nt, Human
agcauaacaagguccaagau

SEQ ID NO: 2542777 - RNA, 14 nt, Human
agcauaaaugcaaa

SEQ ID NO: 2542778 - RNA, 13 nt, Human
agcauaaaugcaa

SEQ ID NO: 2542779 - RNA, 18 nt, Human
ugauaaucaacugggcug

SEQ ID NO: 2542780 - RNA, 24 nt, Human
ugauaaucaacugggcugaacacu

SEQ ID NO: 2542781 - RNA, 14 nt, Human
ugauaaucaacugg

SEQ ID NO: 2542782 - RNA, 12 nt, Human
ugauaaguaaau

SEQ ID NO: 2542783 - RNA, 16 nt, Human
ugauaaggaucagaac

SEQ ID NO: 2542784 - RNA, 20 nt, Human
ugauaaggaucagaacagca

SEQ ID NO: 2542785 - RNA, 14 nt, Human
ugauaauguuaaau

SEQ ID NO: 2542786 - RNA, 13 nt, Human
ugauaauguuaaa

SEQ ID NO: 2542787 - RNA, 18 nt, Human
ugauaauguuaaauuugu

SEQ ID NO: 2542788 - RNA, 17 nt, Human
ugauaauguuaaauuug

SEQ ID NO: 2542789 - RNA, 16 nt, Human
ugauaauguuaaauuu

SEQ ID NO: 2542790 - RNA, 15 nt, Human
ugauaauguuaaauu

SEQ ID NO: 2542791 - RNA, 22 nt, Human
ugauaauguuaaauuuguaagu

SEQ ID NO: 2542792 - RNA, 21 nt, Human
ugauaauguuaaauuuguaag

SEQ ID NO: 2542793 - RNA, 17 nt, Human
ugauaauuccagugguc

SEQ ID NO: 2542794 - RNA, 15 nt, Human
ugauaauuccagugg

SEQ ID NO: 2542795 - RNA, 20 nt, Human
ugauaagaaccuuuugagug

SEQ ID NO: 2542796 - RNA, 17 nt, Human
ugaguucauacccuguu

SEQ ID NO: 2542797 - RNA, 21 nt, Human
ugauaagagggcacacacugu

SEQ ID NO: 2542798 - RNA, 19 nt, Human
ugauaagagggcacacacu

SEQ ID NO: 2542799 - RNA, 24 nt, Human
ugauaagcagucauccucagauca

SEQ ID NO: 2542800 - RNA, 18 nt, Human
ugauaagagaaucaacau

SEQ ID NO: 2542801 - RNA, 17 nt, Human
ugauaagagaaucaaca

SEQ ID NO: 2542802 - RNA, 17 nt, Human
ugaguuauuuuaauuau

SEQ ID NO: 2542803 - RNA, 16 nt, Human
ugaguucagguagcug

SEQ ID NO: 2542804 - RNA, 18 nt, Human
ugauacaaugcugugccc

SEQ ID NO: 2542805 - RNA, 19 nt, Human
ugauaauugcauucaucuu

SEQ ID NO: 2542806 - RNA, 16 nt, Human
ugauaauugcauucau

SEQ ID NO: 2542807 - RNA, 14 nt, Human
ugauaauugcauuc

SEQ ID NO: 2542808 - RNA, 20 nt, Human
ugauacaaugcugugcccua

SEQ ID NO: 2542809 - RNA, 21 nt, Human
ugauacaaugcugugcccuaa

SEQ ID NO: 2542810 - RNA, 14 nt, Human
ugauacuacaguuu

SEQ ID NO: 2542811 - RNA, 17 nt, Human
ugauacuacaguuuguu

SEQ ID NO: 2542812 - RNA, 19 nt, Human
ugauacgcaacauaauuaa

SEQ ID NO: 2542813 - RNA, 17 nt, Human
ugauacuaaaaguucuu

SEQ ID NO: 2542814 - RNA, 23 nt, Human
ugauacacuaugaagauguuuca

SEQ ID NO: 2542815 - RNA, 20 nt, Human
ugagugccuuacacaauggu

SEQ ID NO: 2542816 - RNA, 17 nt, Human
ugagugccuuacacaau

SEQ ID NO: 2542817 - RNA, 17 nt, Human
ugagucaccaagcccag

SEQ ID NO: 2542818 - RNA, 16 nt, Human
ugagucaccaagccca

SEQ ID NO: 2542819 - RNA, 21 nt, Human
ugaguauccuuucaguguuau

SEQ ID NO: 2542820 - RNA, 15 nt, Human
ugaguaucuccucgc

SEQ ID NO: 2542821 - RNA, 21 nt, Human
ugaguaucuccucgcaagcug

SEQ ID NO: 2542822 - RNA, 14 nt, Human
ugagucaccaagcc

SEQ ID NO: 2542823 - RNA, 13 nt, Human
ugagucaaugugc

SEQ ID NO: 2542824 - RNA, 15 nt, Human
ugagucaaaaaaucu

SEQ ID NO: 2542825 - RNA, 15 nt, Human
ugagucaaugugcag

SEQ ID NO: 2542826 - RNA, 18 nt, Human
ugagucaaugugcagugu

SEQ ID NO: 2542827 - RNA, 12 nt, Human
ugagugcucuga

SEQ ID NO: 2542828 - RNA, 13 nt, Human
ugagugcucugau

SEQ ID NO: 2542829 - RNA, 13 nt, Human
ugaguggacugga

SEQ ID NO: 2542830 - RNA, 19 nt, Human
ugagugcucugaucccucu

SEQ ID NO: 2542831 - RNA, 23 nt, Human
ugagugggggaucacagccucug

SEQ ID NO: 2542832 - RNA, 21 nt, Human
ugagugggugaauaauacagu

SEQ ID NO: 2542833 - RNA, 20 nt, Human
ugaguuauauguucacuguc

SEQ ID NO: 2542834 - RNA, 18 nt, Human
ugaguucauaaauuuaug

SEQ ID NO: 2542835 - RNA, 14 nt, Human
ugaguuauuuuaau

SEQ ID NO: 2542836 - RNA, 15 nt, Human
ugaguucagguagcu

SEQ ID NO: 2542837 - RNA, 18 nt, Human
ugagugucuuaauuaaaa

SEQ ID NO: 2542838 - RNA, 15 nt, Human
ugaguguaaguguga

SEQ ID NO: 2542839 - RNA, 11 nt, Human
ugaguguacca

SEQ ID NO: 2542840 - RNA, 22 nt, Human
ugagugggguuaucucuguguu

SEQ ID NO: 2542841 - RNA, 14 nt, Human
ugaguguaagugug

SEQ ID NO: 2542842 - RNA, 21 nt, Human
ugagugggguuaucucugugu

SEQ ID NO: 2542843 - RNA, 20 nt, Human
ugaguggacuggaguggagc

SEQ ID NO: 2542844 - RNA, 17 nt, Human
agcccaggagagagaaa

SEQ ID NO: 2542845 - RNA, 16 nt, Human
agcccaggagagagaa

SEQ ID NO: 2542846 - RNA, 12 nt, Human
ugauucaguguu

SEQ ID NO: 2542847 - RNA, 21 nt, Human
ugauucaguguuaaaugugau

SEQ ID NO: 2542848 - RNA, 20 nt, Human
ugauucauuuuaacaucuga

SEQ ID NO: 2542849 - RNA, 24 nt, Human
ugauucaguguuaaaugugaugaa

SEQ ID NO: 2542850 - RNA, 17 nt, Human
ugauucauuuuaacauc

SEQ ID NO: 2542851 - RNA, 13 nt, Human
ugauucagcucug

SEQ ID NO: 2542852 - RNA, 14 nt, Human
ugauucagcucugc

SEQ ID NO: 2542853 - RNA, 23 nt, Human
agcccaggaaaggcuccaggagc

SEQ ID NO: 2542854 - RNA, 22 nt, Human
agcccaggaaaggcuccaggag

SEQ ID NO: 2542855 - RNA, 24 nt, Human
agcccaggaaaggcuccaggagca

SEQ ID NO: 2542856 - RNA, 18 nt, Human
agcccaggaaaggcucca

SEQ ID NO: 2542857 - RNA, 15 nt, Human
agcccaggagagaga

SEQ ID NO: 2542858 - RNA, 14 nt, Human
agcccaggagagag

SEQ ID NO: 2542859 - RNA, 13 nt, Human
agcccaggagaga

SEQ ID NO: 2542860 - RNA, 18 nt, Human
ugauucccaagcucugcu

SEQ ID NO: 2542861 - RNA, 16 nt, Human
ugauucccaagcucug

SEQ ID NO: 2542862 - RNA, 15 nt, Human
ugauucccaagcucu

SEQ ID NO: 2542863 - RNA, 23 nt, Human
ugauuccacuacaccuggcugag

SEQ ID NO: 2542864 - RNA, 22 nt, Human
ugauuccacuacaccuggcuga

SEQ ID NO: 2542865 - RNA, 21 nt, Human
ugauuccacuacaccuggcug

SEQ ID NO: 2542866 - RNA, 20 nt, Human
ugauuccacuacaccuggcu

SEQ ID NO: 2542867 - RNA, 22 nt, Human
ugauucauuuuaacaucugaga

SEQ ID NO: 2542868 - RNA, 19 nt, Human
ugauuccacuacaccuggc

SEQ ID NO: 2542869 - RNA, 17 nt, Human
ugauucauaauaaauau

SEQ ID NO: 2542870 - RNA, 21 nt, Human
ugauucccaagcucugcuccu

SEQ ID NO: 2542871 - RNA, 19 nt, Human
ugauucccaagcucugcuc

SEQ ID NO: 2542872 - RNA, 21 nt, Human
ugauuccuuugaagaggaaaa

SEQ ID NO: 2542873 - RNA, 20 nt, Human
ugauuccuuugaagaggaaa

SEQ ID NO: 2542874 - RNA, 17 nt, Human
ugauuccuuugaagagg

SEQ ID NO: 2542875 - RNA, 22 nt, Human
ugauuccuugauggagauauuu

SEQ ID NO: 2542876 - RNA, 20 nt, Human
ugauuccuuccuguucugaa

SEQ ID NO: 2542877 - RNA, 15 nt, Human
ugauuccacuuuuau

SEQ ID NO: 2542878 - RNA, 18 nt, Human
ugauuccuuccuguucug

SEQ ID NO: 2542879 - RNA, 19 nt, Human
ugauuccuuccuguucuga

SEQ ID NO: 2542880 - RNA, 21 nt, Human
agcccaggaaaggcuccagga

SEQ ID NO: 2542881 - RNA, 20 nt, Human
agcccaggaaaggcuccagg

SEQ ID NO: 2542882 - RNA, 14 nt, Human
agcccagcucugaa

SEQ ID NO: 2542883 - RNA, 13 nt, Human
agcccagcugggu

SEQ ID NO: 2542884 - RNA, 15 nt, Human
agcccagcuggguca

SEQ ID NO: 2542885 - RNA, 16 nt, Human
agcccagcugggucag

SEQ ID NO: 2542886 - RNA, 19 nt, Human
agcccaggaaaggcuccag

SEQ ID NO: 2542887 - RNA, 15 nt, Human
agcccagaggagggc

SEQ ID NO: 2542888 - RNA, 21 nt, Human
agcccagccauuaccauggag

SEQ ID NO: 2542889 - RNA, 14 nt, Human
agcccagaggaggg

SEQ ID NO: 2542890 - RNA, 12 nt, Human
agcccagaggag

SEQ ID NO: 2542891 - RNA, 15 nt, Human
agcccagcccagcug

SEQ ID NO: 2542892 - RNA, 23 nt, Human
agcccagccauuaccauggagac

SEQ ID NO: 2542893 - RNA, 16 nt, Human
agcccagcccagcugg

SEQ ID NO: 2542894 - RNA, 12 nt, Human
agcccagcucca

SEQ ID NO: 2542895 - RNA, 13 nt, Human
agcccagcccucc

SEQ ID NO: 2542896 - RNA, 23 nt, Human
agccaugugcugcgugccugugg

SEQ ID NO: 2542897 - RNA, 17 nt, Human
agcccagaaaaggacag

SEQ ID NO: 2542898 - RNA, 22 nt, Human
agcccacuucugccauauucug

SEQ ID NO: 2542899 - RNA, 12 nt, Human
agcccagagaca

SEQ ID NO: 2542900 - RNA, 21 nt, Human
agcccagagacauacuugaag

SEQ ID NO: 2542901 - RNA, 15 nt, Human
agcccagacacagaa

SEQ ID NO: 2542902 - RNA, 22 nt, Human
agcccagagacauacuugaagg

SEQ ID NO: 2542903 - RNA, 10 nt, Human
agcccagaga

SEQ ID NO: 2542904 - RNA, 11 nt, Human
agcccagagac

SEQ ID NO: 2542905 - RNA, 12 nt, Human
agcccagacaaa

SEQ ID NO: 2542906 - RNA, 15 nt, Human
agccaugucugcauu

SEQ ID NO: 2542907 - RNA, 13 nt, Human
agccaucaaaaug

SEQ ID NO: 2542908 - RNA, 14 nt, Human
agccaucaaaaugc

SEQ ID NO: 2542909 - RNA, 15 nt, Human
agccaucaaaaugcu

SEQ ID NO: 2542910 - RNA, 16 nt, Human
agccaucaaaaugcuu

SEQ ID NO: 2542911 - RNA, 17 nt, Human
agccaugggaccaaacc

SEQ ID NO: 2542912 - RNA, 22 nt, Human
agccauguagaagcugcaucuu

SEQ ID NO: 2542913 - RNA, 14 nt, Human
agccaugucugcau

SEQ ID NO: 2542914 - RNA, 22 nt, Human
agccagaacguggcucugcugg

SEQ ID NO: 2542915 - RNA, 21 nt, Human
agccagaacguggcucugcug

SEQ ID NO: 2542916 - RNA, 12 nt, Human
agccagaagcug

SEQ ID NO: 2542917 - RNA, 14 nt, Human
agccagaagcugag

SEQ ID NO: 2542918 - RNA, 22 nt, Human
agccagacacucugcucugccc

SEQ ID NO: 2542919 - RNA, 19 nt, Human
agccagacacucugcucug

SEQ ID NO: 2542920 - RNA, 16 nt, Human
agccagacacucugcu

SEQ ID NO: 2542921 - RNA, 20 nt, Human
agccagaagcugagcaccag

SEQ ID NO: 2542922 - RNA, 14 nt, Human
agccagacacucug

SEQ ID NO: 2542923 - RNA, 15 nt, Human
agccagaagcugagc

SEQ ID NO: 2542924 - RNA, 14 nt, Human
agccagacuggcac

SEQ ID NO: 2542925 - RNA, 19 nt, Human
agccagaccuauuccuccu

SEQ ID NO: 2542926 - RNA, 20 nt, Human
agccagacacucugcucugc

SEQ ID NO: 2542927 - RNA, 20 nt, Human
agccagaccuauuccuccug

SEQ ID NO: 2542928 - RNA, 18 nt, Human
agccagaccuauuccucc

SEQ ID NO: 2542929 - RNA, 21 nt, Human
agccagacagcaacggggagg

SEQ ID NO: 2542930 - RNA, 13 nt, Human
agccagcuuuccc

SEQ ID NO: 2542931 - RNA, 14 nt, Human
agccagcuuucccu

SEQ ID NO: 2542932 - RNA, 16 nt, Human
agccagcugcucccca

SEQ ID NO: 2542933 - RNA, 20 nt, Human
agccagcugccgaccagagc

SEQ ID NO: 2542934 - RNA, 16 nt, Human
agccagcugccgacca

SEQ ID NO: 2542935 - RNA, 19 nt, Human
agccagacuggcacaguuu

SEQ ID NO: 2542936 - RNA, 16 nt, Human
agccagacucuggucu

SEQ ID NO: 2542937 - RNA, 14 nt, Human
agccagacucuggu

SEQ ID NO: 2542938 - RNA, 18 nt, Human
agccagacucuggucuuc

SEQ ID NO: 2542939 - RNA, 16 nt, Human
agccagcucugcauua

SEQ ID NO: 2542940 - RNA, 23 nt, Human
agccaggagcaaauguuucugca

SEQ ID NO: 2542941 - RNA, 22 nt, Human
agccaggagcaaauguuucugc

SEQ ID NO: 2542942 - RNA, 13 nt, Human
agccaggagcaaa

SEQ ID NO: 2542943 - RNA, 20 nt, Human
agccaggaauuucccaggac

SEQ ID NO: 2542944 - RNA, 21 nt, Human
agccaggaauuucccaggacc

SEQ ID NO: 2542945 - RNA, 22 nt, Human
agccaggaauuucccaggaccc

SEQ ID NO: 2542946 - RNA, 23 nt, Human
agccaggaauuucccaggacccu

SEQ ID NO: 2542947 - RNA, 16 nt, Human
agccagcuuucccugc

SEQ ID NO: 2542948 - RNA, 18 nt, Human
agccagcuuucccugccu

SEQ ID NO: 2542949 - RNA, 22 nt, Human
agccagcuuucccugccucuca

SEQ ID NO: 2542950 - RNA, 17 nt, Human
agccaggaauuucccag

SEQ ID NO: 2542951 - RNA, 19 nt, Human
agccaggaauuucccagga

SEQ ID NO: 2542952 - RNA, 14 nt, Human
agccaggccacaag

SEQ ID NO: 2542953 - RNA, 12 nt, Human
agccaggccaca

SEQ ID NO: 2542954 - RNA, 11 nt, Human
agccaggcaca

SEQ ID NO: 2542955 - RNA, 22 nt, Human
agccaggaucaugguguaauaa

SEQ ID NO: 2542956 - RNA, 23 nt, Human
agccaggaucaugguguaauaag

SEQ ID NO: 2542957 - RNA, 20 nt, Human
agccaggaucaugguguaau

SEQ ID NO: 2542958 - RNA, 18 nt, Human
agccaggaucauggugua

SEQ ID NO: 2542959 - RNA, 15 nt, Human
agccaggaucauggu

SEQ ID NO: 2542960 - RNA, 14 nt, Human
agccaggaucaugg

SEQ ID NO: 2542961 - RNA, 18 nt, Human
agccaggagcugggcaga

SEQ ID NO: 2542962 - RNA, 14 nt, Human
agccaggagcuggg

SEQ ID NO: 2542963 - RNA, 22 nt, Human
agccagugacuccaggagagga

SEQ ID NO: 2542964 - RNA, 21 nt, Human
agccagugacuccaggagagg

SEQ ID NO: 2542965 - RNA, 19 nt, Human
agccagugacuccaggaga

SEQ ID NO: 2542966 - RNA, 18 nt, Human
agccagugacuccaggag

SEQ ID NO: 2542967 - RNA, 17 nt, Human
agccagugacuccagga

SEQ ID NO: 2542968 - RNA, 16 nt, Human
agccagugacuccagg

SEQ ID NO: 2542969 - RNA, 15 nt, Human
agccagugacuccag

SEQ ID NO: 2542970 - RNA, 13 nt, Human
agccagugacucc

SEQ ID NO: 2542971 - RNA, 19 nt, Human
agccaguucaguaccugga

SEQ ID NO: 2542972 - RNA, 17 nt, Human
agccaguucaguaccug

SEQ ID NO: 2542973 - RNA, 22 nt, Human
agccaguucaguaccuggagga

SEQ ID NO: 2542974 - RNA, 21 nt, Human
agccaguucaguaccuggagg

SEQ ID NO: 2542975 - RNA, 21 nt, Human
agccauauaaguuugaaggaa

SEQ ID NO: 2542976 - RNA, 19 nt, Human
agccauacuuaucucucug

SEQ ID NO: 2542977 - RNA, 16 nt, Human
agccauacuuaucucu

SEQ ID NO: 2542978 - RNA, 22 nt, Human
agccauacuuaucucucugugc

SEQ ID NO: 2542979 - RNA, 23 nt, Human
agccagguaaugagggacuggaa

SEQ ID NO: 2542980 - RNA, 18 nt, Human
agccagguaaugagggac

SEQ ID NO: 2542981 - RNA, 22 nt, Human
agccaggguguggcccugccau

SEQ ID NO: 2542982 - RNA, 21 nt, Human
agccaggguguggcccugcca

SEQ ID NO: 2542983 - RNA, 23 nt, Human
agccaguaaaugggggugcauuu

SEQ ID NO: 2542984 - RNA, 22 nt, Human
agccaguaaaugggggugcauu

SEQ ID NO: 2542985 - RNA, 14 nt, Human
agccagucccaggg

SEQ ID NO: 2542986 - RNA, 13 nt, Human
agccagucuuuac

SEQ ID NO: 2542987 - RNA, 17 nt, Human
agccagugaccugagga

SEQ ID NO: 2542988 - RNA, 18 nt, Human
agccagugaccugaggaa

SEQ ID NO: 2542989 - RNA, 19 nt, Human
agccagugaccugaggaag

SEQ ID NO: 2542990 - RNA, 21 nt, Human
agccagugaccugaggaagcg

SEQ ID NO: 2542991 - RNA, 19 nt, Human
agccaggcgggcucaagga

SEQ ID NO: 2542992 - RNA, 15 nt, Human
agccaggcgggcuca

SEQ ID NO: 2542993 - RNA, 14 nt, Human
agccaggcgggcuc

SEQ ID NO: 2542994 - RNA, 13 nt, Human
agccaggcgggcu

SEQ ID NO: 2542995 - RNA, 22 nt, Human
agccaggccugggucugugucu

SEQ ID NO: 2542996 - RNA, 18 nt, Human
agccagggggacuagccc

SEQ ID NO: 2542997 - RNA, 18 nt, Human
agccaggcgggcucaagg

SEQ ID NO: 2542998 - RNA, 22 nt, Human
agccagggggacuagccccugu

SEQ ID NO: 2542999 - RNA, 21 nt, Human
agccagggggacuagccccug

SEQ ID NO: 2543000 - RNA, 23 nt, Human
agccagggggacuagccccugug

SEQ ID NO: 2543001 - RNA, 12 nt, Human
agccagggucuc

SEQ ID NO: 2543002 - RNA, 22 nt, Human
agccaggccacaagacccuugu

SEQ ID NO: 2543003 - RNA, 21 nt, Human
agccaggccacaagacccuug

SEQ ID NO: 2543004 - RNA, 20 nt, Human
agccaggcacacacugugcu

SEQ ID NO: 2543005 - RNA, 18 nt, Human
agccaggcacacacugug

SEQ ID NO: 2543006 - RNA, 17 nt, Human
agccaggcacacacugu

SEQ ID NO: 2543007 - RNA, 12 nt, Human
agccaggcacac

SEQ ID NO: 2543008 - RNA, 15 nt, Human
agccaggccacuggc

SEQ ID NO: 2543009 - RNA, 12 nt, Human
agccaggccugg

SEQ ID NO: 2543010 - RNA, 15 nt, Human
agccaggccccaggc

SEQ ID NO: 2543011 - RNA, 21 nt, Human
agccaggcagguagccagggg

SEQ ID NO: 2543012 - RNA, 23 nt, Human
agccaggcacacacugugcuuuc

SEQ ID NO: 2543013 - RNA, 14 nt, Human
agccaggccccagg

SEQ ID NO: 2543014 - RNA, 16 nt, Human
ugauguuuguggccuc

SEQ ID NO: 2543015 - RNA, 13 nt, Human
ugauguuuguccu

SEQ ID NO: 2543016 - RNA, 11 nt, Human
ugauguuugug

SEQ ID NO: 2543017 - RNA, 17 nt, Human
ugauguuuguggccuca

SEQ ID NO: 2543018 - RNA, 18 nt, Human
ugauguuuguggccucag

SEQ ID NO: 2543019 - RNA, 19 nt, Human
ugauguuuguggccucaga

SEQ ID NO: 2543020 - RNA, 20 nt, Human
ugauguuuguggccucagaa

SEQ ID NO: 2543021 - RNA, 15 nt, Human
ugauggugcugaccu

SEQ ID NO: 2543022 - RNA, 15 nt, Human
ugaugauacaagauu

SEQ ID NO: 2543023 - RNA, 21 nt, Human
ugaugaucagcuguuugucau

SEQ ID NO: 2543024 - RNA, 17 nt, Human
ugauguuuuaaggaugc

SEQ ID NO: 2543025 - RNA, 18 nt, Human
ugauguuuuaaggaugcu

SEQ ID NO: 2543026 - RNA, 18 nt, Human
ugauguuuuccuauaaua

SEQ ID NO: 2543027 - RNA, 17 nt, Human
ugaugaucuuuaaaaua

SEQ ID NO: 2543028 - RNA, 16 nt, Human
ugauggugcaaugacc

SEQ ID NO: 2543029 - RNA, 23 nt, Human
ugauggugcaaugaccuuucaau

SEQ ID NO: 2543030 - RNA, 17 nt, Human
ugauggugcaaugaccu

SEQ ID NO: 2543031 - RNA, 14 nt, Human
ugaugauccuaggc

SEQ ID NO: 2543032 - RNA, 15 nt, Human
ugaugaggggagggg

SEQ ID NO: 2543033 - RNA, 14 nt, Human
ugaugaggggaggg

SEQ ID NO: 2543034 - RNA, 13 nt, Human
ugaugaguuguga

SEQ ID NO: 2543035 - RNA, 14 nt, Human
ugaugaucuuuaaa

SEQ ID NO: 2543036 - RNA, 20 nt, Human
ugaugauccuaggcauuugc

SEQ ID NO: 2543037 - RNA, 22 nt, Human
agccacugcaccgggccacaga

SEQ ID NO: 2543038 - RNA, 21 nt, Human
agccacugcaccgggccacag

SEQ ID NO: 2543039 - RNA, 13 nt, Human
agccacugcaccg

SEQ ID NO: 2543040 - RNA, 20 nt, Human
agccacugcaccgggccaca

SEQ ID NO: 2543041 - RNA, 23 nt, Human
agccacuuaccuucaauaaagua

SEQ ID NO: 2543042 - RNA, 19 nt, Human
agccagaaauaaaguuggu

SEQ ID NO: 2543043 - RNA, 20 nt, Human
agccagaacguggcucugcu

SEQ ID NO: 2543044 - RNA, 14 nt, Human
agccagaaccugga

SEQ ID NO: 2543045 - RNA, 23 nt, Human
agccagaaauaaaguuggugaca

SEQ ID NO: 2543046 - RNA, 18 nt, Human
agccacugugcugaauuc

SEQ ID NO: 2543047 - RNA, 13 nt, Human
agccacuuaccuu

SEQ ID NO: 2543048 - RNA, 15 nt, Human
agccacuuaccuuca

SEQ ID NO: 2543049 - RNA, 16 nt, Human
agccacuuaccuucaa

SEQ ID NO: 2543050 - RNA, 17 nt, Human
agccacuuaccuucaau

SEQ ID NO: 2543051 - RNA, 18 nt, Human
agccacuuaccuucaaua

SEQ ID NO: 2543052 - RNA, 21 nt, Human
agccacuuaccuucaauaaag

SEQ ID NO: 2543053 - RNA, 22 nt, Human
agccacuuaccuucaauaaagu

SEQ ID NO: 2543054 - RNA, 17 nt, Human
agccacuuaaaauguuc

SEQ ID NO: 2543055 - RNA, 14 nt, Human
agccacugugcuga

SEQ ID NO: 2543056 - RNA, 12 nt, Human
ugauuaaaccaa

SEQ ID NO: 2543057 - RNA, 15 nt, Human
ugauuaauuaaaaca

SEQ ID NO: 2543058 - RNA, 20 nt, Human
ugauuaaacgugcagacuau

SEQ ID NO: 2543059 - RNA, 21 nt, Human
ugauuaauucaccuuccagug

SEQ ID NO: 2543060 - RNA, 18 nt, Human
ugauuacaccagccucgu

SEQ ID NO: 2543061 - RNA, 13 nt, Human
ugauuacacaguu

SEQ ID NO: 2543062 - RNA, 14 nt, Human
ugauuacacaguug

SEQ ID NO: 2543063 - RNA, 17 nt, Human
ugauuacacaaaacaaa

SEQ ID NO: 2543064 - RNA, 15 nt, Human
ugauuacacaaaaca

SEQ ID NO: 2543065 - RNA, 14 nt, Human
ugauuacacaaaac

SEQ ID NO: 2543066 - RNA, 13 nt, Human
agccacuccucug

SEQ ID NO: 2543067 - RNA, 14 nt, Human
agccacuccucuga

SEQ ID NO: 2543068 - RNA, 15 nt, Human
agccacuccucugac

SEQ ID NO: 2543069 - RNA, 14 nt, Human
ugauuaccagggac

SEQ ID NO: 2543070 - RNA, 19 nt, Human
agccacucgggaggcugag

SEQ ID NO: 2543071 - RNA, 15 nt, Human
agccacucgggaggc

SEQ ID NO: 2543072 - RNA, 21 nt, Human
agccacuccucugacucaggg

SEQ ID NO: 2543073 - RNA, 22 nt, Human
agccacuccucugacucagggc

SEQ ID NO: 2543074 - RNA, 12 nt, Human
agccacugaagc

SEQ ID NO: 2543075 - RNA, 13 nt, Human
agccacugaagcu

SEQ ID NO: 2543076 - RNA, 16 nt, Human
agccacugaagcuggg

SEQ ID NO: 2543077 - RNA, 23 nt, Human
agccaccaacauacucccaucug

SEQ ID NO: 2543078 - RNA, 20 nt, Human
agccaccaacauacucccau

SEQ ID NO: 2543079 - RNA, 23 nt, Human
agccacaucccuuugaaacaaga

SEQ ID NO: 2543080 - RNA, 22 nt, Human
agcauuucugaaguggacucuu

SEQ ID NO: 2543081 - RNA, 22 nt, Human
agccacaguuuccucaucuguc

SEQ ID NO: 2543082 - RNA, 15 nt, Human
agccacauuuggaau

SEQ ID NO: 2543083 - RNA, 20 nt, Human
agccacauuuggaauacuuu

SEQ ID NO: 2543084 - RNA, 19 nt, Human
agccaccaacauacuccca

SEQ ID NO: 2543085 - RNA, 11 nt, Human
agccacauccc

SEQ ID NO: 2543086 - RNA, 15 nt, Human
agcauuugaaugcau

SEQ ID NO: 2543087 - RNA, 14 nt, Human
agcauuugaaugca

SEQ ID NO: 2543088 - RNA, 13 nt, Human
agcauuugaaugc

SEQ ID NO: 2543089 - RNA, 12 nt, Human
agcauuugaaug

SEQ ID NO: 2543090 - RNA, 13 nt, Human
agcauuucugaag

SEQ ID NO: 2543091 - RNA, 11 nt, Human
agcauuugaau

SEQ ID NO: 2543092 - RNA, 18 nt, Human
agccacauuccugaugcu

SEQ ID NO: 2543093 - RNA, 14 nt, Human
agccacauuccuga

SEQ ID NO: 2543094 - RNA, 14 nt, Human
agccacggccaggc

SEQ ID NO: 2543095 - RNA, 18 nt, Human
agccaccucucuuuuuca

SEQ ID NO: 2543096 - RNA, 22 nt, Human
agccaccuuuugggaauguuuu

SEQ ID NO: 2543097 - RNA, 22 nt, Human
agccaccgaagccgccugugga

SEQ ID NO: 2543098 - RNA, 18 nt, Human
agccaccgugccuggcca

SEQ ID NO: 2543099 - RNA, 15 nt, Human
agccaccucucccuc

SEQ ID NO: 2543100 - RNA, 14 nt, Human
agccaccucucccu

SEQ ID NO: 2543101 - RNA, 12 nt, Human
agccaccucucc

SEQ ID NO: 2543102 - RNA, 22 nt, Human
agccaccucucccucaacaagg

SEQ ID NO: 2543103 - RNA, 16 nt, Human
agccaccucucccuca

SEQ ID NO: 2543104 - RNA, 14 nt, Human
agccaccucucuuu

SEQ ID NO: 2543105 - RNA, 15 nt, Human
agccaccgaagccgc

SEQ ID NO: 2543106 - RNA, 20 nt, Human
agccaccgaagccgccugug

SEQ ID NO: 2543107 - RNA, 21 nt, Human
agccaccgaagccgccugugg

SEQ ID NO: 2543108 - RNA, 21 nt, Human
agccacauuuggaauacuuuu

SEQ ID NO: 2543109 - RNA, 22 nt, Human
agccacauuuggaauacuuuuu

SEQ ID NO: 2543110 - RNA, 23 nt, Human
agccacauuuggaauacuuuuug

SEQ ID NO: 2543111 - RNA, 13 nt, Human
agccaccaacucu

SEQ ID NO: 2543112 - RNA, 17 nt, Human
agccaccaacucuugca

SEQ ID NO: 2543113 - RNA, 13 nt, Human
agccaccccugag

SEQ ID NO: 2543114 - RNA, 16 nt, Human
agccaccaacucuugc

SEQ ID NO: 2543115 - RNA, 17 nt, Human
ugauccagcccugaguu

SEQ ID NO: 2543116 - RNA, 18 nt, Human
ugauccagcccugaguuc

SEQ ID NO: 2543117 - RNA, 15 nt, Human
ugauccagcccugag

SEQ ID NO: 2543118 - RNA, 23 nt, Human
agccaccuuuugggaauguuuua

SEQ ID NO: 2543119 - RNA, 15 nt, Human
agccacggccaggcc

SEQ ID NO: 2543120 - RNA, 20 nt, Human
ugauccuuuuauguuauuua

SEQ ID NO: 2543121 - RNA, 14 nt, Human
ugauccugugaagu

SEQ ID NO: 2543122 - RNA, 15 nt, Human
ugauccuuacaaguu

SEQ ID NO: 2543123 - RNA, 18 nt, Human
ugauccuuuuggagucag

SEQ ID NO: 2543124 - RNA, 13 nt, Human
ugauccugugaag

SEQ ID NO: 2543125 - RNA, 20 nt, Human
ugauccuggaggcccaguuc

SEQ ID NO: 2543126 - RNA, 19 nt, Human
ugauccagccucuccccug

SEQ ID NO: 2543127 - RNA, 18 nt, Human
ugauccagccucuccccu

SEQ ID NO: 2543128 - RNA, 21 nt, Human
ugauccaugaguuugcccugg

SEQ ID NO: 2543129 - RNA, 17 nt, Human
ugaugaagaaguugaua

SEQ ID NO: 2543130 - RNA, 16 nt, Human
ugaucgugacgcugaa

SEQ ID NO: 2543131 - RNA, 15 nt, Human
ugaucgugacgcuga

SEQ ID NO: 2543132 - RNA, 18 nt, Human
ugaucggagccuccucuc

SEQ ID NO: 2543133 - RNA, 15 nt, Human
ugaucgccuuuccca

SEQ ID NO: 2543134 - RNA, 17 nt, Human
ugaucgccuuucccagg

SEQ ID NO: 2543135 - RNA, 23 nt, Human
ugaucgugacgcugaauaaaugu

SEQ ID NO: 2543136 - RNA, 21 nt, Human
ugaucgugacgcugaauaaau

SEQ ID NO: 2543137 - RNA, 20 nt, Human
ugaucgugacgcugaauaaa

SEQ ID NO: 2543138 - RNA, 19 nt, Human
ugaucgugacgcugaauaa

SEQ ID NO: 2543139 - RNA, 13 nt, Human
ugaugaagaggag

SEQ ID NO: 2543140 - RNA, 14 nt, Human
ugaugaagaggagu

SEQ ID NO: 2543141 - RNA, 22 nt, Human
ugaugaggccucuuggaccucu

SEQ ID NO: 2543142 - RNA, 18 nt, Human
ugaugaggccucuuggac

SEQ ID NO: 2543143 - RNA, 17 nt, Human
ugaugaggccucuugga

SEQ ID NO: 2543144 - RNA, 14 nt, Human
ugaugaauacugua

SEQ ID NO: 2543145 - RNA, 19 nt, Human
ugaugacaacuggaauagu

SEQ ID NO: 2543146 - RNA, 21 nt, Human
ugaugacaacuggaauaguuu

SEQ ID NO: 2543147 - RNA, 16 nt, Human
ugaugagcuccucuuc

SEQ ID NO: 2543148 - RNA, 15 nt, Human
ugaugagcuccucuu

SEQ ID NO: 2543149 - RNA, 18 nt, Human
agcuacuugggaggcuga

SEQ ID NO: 2543150 - RNA, 17 nt, Human
agcuacuugggaggcug

SEQ ID NO: 2543151 - RNA, 13 nt, Human
agcuacuugggcc

SEQ ID NO: 2543152 - RNA, 14 nt, Human
agcuacuugggagg

SEQ ID NO: 2543153 - RNA, 16 nt, Human
agcuacuugggaggcu

SEQ ID NO: 2543154 - RNA, 13 nt, Human
agcuacuaaugau

SEQ ID NO: 2543155 - RNA, 16 nt, Human
agcuacuaaugauguu

SEQ ID NO: 2543156 - RNA, 18 nt, Human
agcuacuaaugauguuuu

SEQ ID NO: 2543157 - RNA, 22 nt, Human
agcuacuugggccauagcuccu

SEQ ID NO: 2543158 - RNA, 15 nt, Human
agcuacuugggccau

SEQ ID NO: 2543159 - RNA, 14 nt, Human
agcuacuugggcca

SEQ ID NO: 2543160 - RNA, 11 nt, Human
agcuagaaaug

SEQ ID NO: 2543161 - RNA, 15 nt, Human
agcuagaaggccaca

SEQ ID NO: 2543162 - RNA, 14 nt, Human
agcuagaaggccac

SEQ ID NO: 2543163 - RNA, 16 nt, Human
agcuagaaggccacau

SEQ ID NO: 2543164 - RNA, 15 nt, Human
agcuagaagugggcc

SEQ ID NO: 2543165 - RNA, 19 nt, Human
agcuagaagugggccagga

SEQ ID NO: 2543166 - RNA, 21 nt, Human
agcuagaagugggccaggaca

SEQ ID NO: 2543167 - RNA, 22 nt, Human
agcuagaagugggccaggacag

SEQ ID NO: 2543168 - RNA, 24 nt, Human
agcuagaagugggccaggacaggc

SEQ ID NO: 2543169 - RNA, 19 nt, Human
agcuagaacuuugaaggac

SEQ ID NO: 2543170 - RNA, 16 nt, Human
agcuagaaccuggagg

SEQ ID NO: 2543171 - RNA, 18 nt, Human
agcuagaaccuggagagc

SEQ ID NO: 2543172 - RNA, 16 nt, Human
agcuagaaccuggaga

SEQ ID NO: 2543173 - RNA, 15 nt, Human
agcuagaaccuggag

SEQ ID NO: 2543174 - RNA, 16 nt, Human
agcuagaacccggcag

SEQ ID NO: 2543175 - RNA, 15 nt, Human
agcuagaaauaugau

SEQ ID NO: 2543176 - RNA, 19 nt, Human
agcuacuugggccauagcu

SEQ ID NO: 2543177 - RNA, 12 nt, Human
agcuagaaauga

SEQ ID NO: 2543178 - RNA, 22 nt, Human
agcuagaauucccucucucuga

SEQ ID NO: 2543179 - RNA, 18 nt, Human
agcuagacgagcaggcuu

SEQ ID NO: 2543180 - RNA, 23 nt, Human
agcuagcuccccuccucuccccu

SEQ ID NO: 2543181 - RNA, 21 nt, Human
agcuagcuccccuccucuccc

SEQ ID NO: 2543182 - RNA, 20 nt, Human
agcuagcuccccuccucucc

SEQ ID NO: 2543183 - RNA, 18 nt, Human
agcuagcuccccuccucu

SEQ ID NO: 2543184 - RNA, 17 nt, Human
agcuagcugcagagcca

SEQ ID NO: 2543185 - RNA, 17 nt, Human
agcuagcuccccuccuc

SEQ ID NO: 2543186 - RNA, 16 nt, Human
agcuagcuccccuccu

SEQ ID NO: 2543187 - RNA, 15 nt, Human
agcuagcuccccucc

SEQ ID NO: 2543188 - RNA, 14 nt, Human
agcuagcuccccuc

SEQ ID NO: 2543189 - RNA, 20 nt, Human
agcuagcgcugccgcacccc

SEQ ID NO: 2543190 - RNA, 21 nt, Human
agcuagcgcugccgcacccca

SEQ ID NO: 2543191 - RNA, 12 nt, Human
agcuagaggaac

SEQ ID NO: 2543192 - RNA, 20 nt, Human
agcuagaggaaccaaccccc

SEQ ID NO: 2543193 - RNA, 14 nt, Human
agcuagcgcugccg

SEQ ID NO: 2543194 - RNA, 16 nt, Human
agcuagcgcugccgca

SEQ ID NO: 2543195 - RNA, 18 nt, Human
agcuagcgcugccgcacc

SEQ ID NO: 2543196 - RNA, 19 nt, Human
ugccacuuugcaaaggagc

SEQ ID NO: 2543197 - RNA, 23 nt, Human
ugccacuuugguacauggccagu

SEQ ID NO: 2543198 - RNA, 23 nt, Human
ugccacacuucaggcucuucucc

SEQ ID NO: 2543199 - RNA, 22 nt, Human
ugccacacuucaggcucuucuc

SEQ ID NO: 2543200 - RNA, 17 nt, Human
ugccagacccccuggag

SEQ ID NO: 2543201 - RNA, 12 nt, Human
ugccagacaugu

SEQ ID NO: 2543202 - RNA, 13 nt, Human
ugccagacaugug

SEQ ID NO: 2543203 - RNA, 12 nt, Human
ugccacuuuuua

SEQ ID NO: 2543204 - RNA, 14 nt, Human
ugccagaacaguuu

SEQ ID NO: 2543205 - RNA, 18 nt, Human
ugccagaacaguuuguac

SEQ ID NO: 2543206 - RNA, 19 nt, Human
ugccagaacaguuuguaca

SEQ ID NO: 2543207 - RNA, 21 nt, Human
ugccagaagauccccucagga

SEQ ID NO: 2543208 - RNA, 18 nt, Human
ugccagaagauccccuca

SEQ ID NO: 2543209 - RNA, 20 nt, Human
ugccagaacaguuuguacag

SEQ ID NO: 2543210 - RNA, 22 nt, Human
ugccagagacggaagccuuuuu

SEQ ID NO: 2543211 - RNA, 21 nt, Human
ugccagagacggaagccuuuu

SEQ ID NO: 2543212 - RNA, 20 nt, Human
ugccagaagauccccucagg

SEQ ID NO: 2543213 - RNA, 21 nt, Human
ugccagacggcacccacccag

SEQ ID NO: 2543214 - RNA, 16 nt, Human
agcgggggccagggaa

SEQ ID NO: 2543215 - RNA, 21 nt, Human
agcgguggcccugucccuccc

SEQ ID NO: 2543216 - RNA, 12 nt, Human
agcgguggcccu

SEQ ID NO: 2543217 - RNA, 23 nt, Human
agcggucucaggcuggugggagg

SEQ ID NO: 2543218 - RNA, 15 nt, Human
agcgguggcccuguc

SEQ ID NO: 2543219 - RNA, 14 nt, Human
agcgguuuggggag

SEQ ID NO: 2543220 - RNA, 22 nt, Human
agcggucucaggcuggugggag

SEQ ID NO: 2543221 - RNA, 13 nt, Human
agcggucucaggc

SEQ ID NO: 2543222 - RNA, 22 nt, Human
agcggugcuguccucagguggc

SEQ ID NO: 2543223 - RNA, 22 nt, Human
agcgugagccacugcaccgggc

SEQ ID NO: 2543224 - RNA, 15 nt, Human
agcgugcauaaguua

SEQ ID NO: 2543225 - RNA, 19 nt, Human
agcgugagccacugcaccg

SEQ ID NO: 2543226 - RNA, 19 nt, Human
agcgguuuggggagcagag

SEQ ID NO: 2543227 - RNA, 14 nt, Human
agcguagccucucc

SEQ ID NO: 2543228 - RNA, 22 nt, Human
agcgguuuggggagcagagaca

SEQ ID NO: 2543229 - RNA, 18 nt, Human
agcguacucaucaucaac

SEQ ID NO: 2543230 - RNA, 19 nt, Human
agcuacuaauuuuaaaaug

SEQ ID NO: 2543231 - RNA, 21 nt, Human
agcuacccuuuuucuccagcu

SEQ ID NO: 2543232 - RNA, 19 nt, Human
agcgugcaccaucccuuuu

SEQ ID NO: 2543233 - RNA, 23 nt, Human
agcguagcuaagugaaaagguca

SEQ ID NO: 2543234 - RNA, 16 nt, Human
agcuaccucaaacuuc

SEQ ID NO: 2543235 - RNA, 14 nt, Human
agcuaccucaacca

SEQ ID NO: 2543236 - RNA, 20 nt, Human
agcuacccuuuuucuccagc

SEQ ID NO: 2543237 - RNA, 23 nt, Human
agcuaccucaaccaaugccaaaa

SEQ ID NO: 2543238 - RNA, 21 nt, Human
agcucaggugucccugcacuu

SEQ ID NO: 2543239 - RNA, 20 nt, Human
agcucaggugucccugcacu

SEQ ID NO: 2543240 - RNA, 22 nt, Human
agcucaggugucccugcacuug

SEQ ID NO: 2543241 - RNA, 22 nt, Human
agcucaguucuagucucucugg

SEQ ID NO: 2543242 - RNA, 21 nt, Human
agcucaguucuagucucucug

SEQ ID NO: 2543243 - RNA, 13 nt, Human
agcucagucccau

SEQ ID NO: 2543244 - RNA, 21 nt, Human
agcucagucccaucagagagc

SEQ ID NO: 2543245 - RNA, 13 nt, Human
agcucaggacaga

SEQ ID NO: 2543246 - RNA, 17 nt, Human
agcucaggacagaugcc

SEQ ID NO: 2543247 - RNA, 18 nt, Human
agcucaggugucccugca

SEQ ID NO: 2543248 - RNA, 20 nt, Human
agcucagcuuuuugucuuuu

SEQ ID NO: 2543249 - RNA, 22 nt, Human
agcucagcuuuuugucuuuucu

SEQ ID NO: 2543250 - RNA, 15 nt, Human
agcuaggccuggcca

SEQ ID NO: 2543251 - RNA, 14 nt, Human
agcuaggccuggcc

SEQ ID NO: 2543252 - RNA, 17 nt, Human
agcucagcgccagccug

SEQ ID NO: 2543253 - RNA, 12 nt, Human
agcucagcgcca

SEQ ID NO: 2543254 - RNA, 21 nt, Human
agcucagcuacugauuuuugu

SEQ ID NO: 2543255 - RNA, 16 nt, Human
agcuaggccuggccag

SEQ ID NO: 2543256 - RNA, 18 nt, Human
agcuaggaauuguguuua

SEQ ID NO: 2543257 - RNA, 12 nt, Human
agcuaggaauga

SEQ ID NO: 2543258 - RNA, 13 nt, Human
agcuaggaaugaa

SEQ ID NO: 2543259 - RNA, 12 nt, Human
agcuaggccugg

SEQ ID NO: 2543260 - RNA, 15 nt, Human
ugcccaagccagagg

SEQ ID NO: 2543261 - RNA, 14 nt, Human
ugcccaagccagag

SEQ ID NO: 2543262 - RNA, 13 nt, Human
ugcccaagccaga

SEQ ID NO: 2543263 - RNA, 11 nt, Human
ugcccaagcca

SEQ ID NO: 2543264 - RNA, 23 nt, Human
ugcccaagaauagaugcugacug

SEQ ID NO: 2543265 - RNA, 22 nt, Human
ugcccaagaauagaugcugacu

SEQ ID NO: 2543266 - RNA, 15 nt, Human
agcucauuucacuuu

SEQ ID NO: 2543267 - RNA, 12 nt, Human
agcucauuucac

SEQ ID NO: 2543268 - RNA, 13 nt, Human
agcuccaaccugc

SEQ ID NO: 2543269 - RNA, 14 nt, Human
agcuccaaccugca

SEQ ID NO: 2543270 - RNA, 15 nt, Human
agcuccaaccugcaa

SEQ ID NO: 2543271 - RNA, 16 nt, Human
agcuccaaccugcaaa

SEQ ID NO: 2543272 - RNA, 18 nt, Human
agcuccaaccugcaaaga

SEQ ID NO: 2543273 - RNA, 21 nt, Human
ugcccaagaauagaugcugac

SEQ ID NO: 2543274 - RNA, 20 nt, Human
agcucauucuccuuguguua

SEQ ID NO: 2543275 - RNA, 21 nt, Human
agcucauucuccuuguguuac

SEQ ID NO: 2543276 - RNA, 18 nt, Human
agcucauauuuuguauau

SEQ ID NO: 2543277 - RNA, 15 nt, Human
agcucauauuuugua

SEQ ID NO: 2543278 - RNA, 14 nt, Human
agcucauauuuugu

SEQ ID NO: 2543279 - RNA, 14 nt, Human
agcucaucucuguc

SEQ ID NO: 2543280 - RNA, 23 nt, Human
agcucaguucuagucucucuggg

SEQ ID NO: 2543281 - RNA, 19 nt, Human
agcucaguuuauccaaggu

SEQ ID NO: 2543282 - RNA, 16 nt, Human
ugcccacaggaucagu

SEQ ID NO: 2543283 - RNA, 19 nt, Human
ugcccacaggaucagucug

SEQ ID NO: 2543284 - RNA, 18 nt, Human
ugcccaagccagaggcug

SEQ ID NO: 2543285 - RNA, 16 nt, Human
ugcccaagccagaggc

SEQ ID NO: 2543286 - RNA, 20 nt, Human
ugcccaagccagaggcuggg

SEQ ID NO: 2543287 - RNA, 12 nt, Human
ugcccacaggcc

SEQ ID NO: 2543288 - RNA, 20 nt, Human
ugcccacaggaucagucuga

SEQ ID NO: 2543289 - RNA, 20 nt, Human
ugcccagccccuucugaccc

SEQ ID NO: 2543290 - RNA, 21 nt, Human
ugcccagccccuucugaccca

SEQ ID NO: 2543291 - RNA, 14 nt, Human
ugcccacaggccgc

SEQ ID NO: 2543292 - RNA, 20 nt, Human
ugcccagcccggaccuuggc

SEQ ID NO: 2543293 - RNA, 11 nt, Human
agccuggugcc

SEQ ID NO: 2543294 - RNA, 20 nt, Human
agccuggucagcccaaacca

SEQ ID NO: 2543295 - RNA, 14 nt, Human
agccuggugcugcu

SEQ ID NO: 2543296 - RNA, 15 nt, Human
agccuggugcugcug

SEQ ID NO: 2543297 - RNA, 16 nt, Human
agccuggugcugcugc

SEQ ID NO: 2543298 - RNA, 21 nt, Human
agccugugccucugggacugg

SEQ ID NO: 2543299 - RNA, 11 nt, Human
agccugguggg

SEQ ID NO: 2543300 - RNA, 14 nt, Human
agccuggugggccu

SEQ ID NO: 2543301 - RNA, 16 nt, Human
agccuggugggccucc

SEQ ID NO: 2543302 - RNA, 18 nt, Human
agccuggugggccuccuc

SEQ ID NO: 2543303 - RNA, 21 nt, Human
agccuggugggccuccucugu

SEQ ID NO: 2543304 - RNA, 22 nt, Human
agccuggugggccuccucuguc

SEQ ID NO: 2543305 - RNA, 11 nt, Human
agccuguggca

SEQ ID NO: 2543306 - RNA, 14 nt, Human
agccuguggcaucu

SEQ ID NO: 2543307 - RNA, 22 nt, Human
agccuguggcaucuuugccuug

SEQ ID NO: 2543308 - RNA, 17 nt, Human
agccuguggcggugccu

SEQ ID NO: 2543309 - RNA, 21 nt, Human
agccuguggcaucuuugccuu

SEQ ID NO: 2543310 - RNA, 22 nt, Human
agccuguggcggugccugggug

SEQ ID NO: 2543311 - RNA, 18 nt, Human
agccuguguaacagcucc

SEQ ID NO: 2543312 - RNA, 17 nt, Human
agccuguguaacagcuc

SEQ ID NO: 2543313 - RNA, 16 nt, Human
agccuguguaacagcu

SEQ ID NO: 2543314 - RNA, 15 nt, Human
agccuguguaacagc

SEQ ID NO: 2543315 - RNA, 18 nt, Human
agccuguggcggugccug

SEQ ID NO: 2543316 - RNA, 19 nt, Human
agccuguggcggugccugg

SEQ ID NO: 2543317 - RNA, 13 nt, Human
agccuguguaaca

SEQ ID NO: 2543318 - RNA, 20 nt, Human
agccuguggcggugccuggg

SEQ ID NO: 2543319 - RNA, 13 nt, Human
agccuguuuaaga

SEQ ID NO: 2543320 - RNA, 22 nt, Human
agccuuagaagucacacaguau

SEQ ID NO: 2543321 - RNA, 18 nt, Human
agccuguuccccucacug

SEQ ID NO: 2543322 - RNA, 17 nt, Human
agccuguuccccucacu

SEQ ID NO: 2543323 - RNA, 14 nt, Human
agccuguuccccuc

SEQ ID NO: 2543324 - RNA, 20 nt, Human
agccuguguaacagcuccuu

SEQ ID NO: 2543325 - RNA, 19 nt, Human
agccuguguaacagcuccu

SEQ ID NO: 2543326 - RNA, 21 nt, Human
agccuguguaacagcuccuug

SEQ ID NO: 2543327 - RNA, 22 nt, Human
agccuguuggacccgcucugga

SEQ ID NO: 2543328 - RNA, 22 nt, Human
agccuguuccccucacuggaug

SEQ ID NO: 2543329 - RNA, 20 nt, Human
agccuguuccccucacugga

SEQ ID NO: 2543330 - RNA, 14 nt, Human
agccuguuggaccc

SEQ ID NO: 2543331 - RNA, 14 nt, Human
agccuuauccucug

SEQ ID NO: 2543332 - RNA, 19 nt, Human
agccuuaucaagugucuuc

SEQ ID NO: 2543333 - RNA, 18 nt, Human
agccuuaucaagugucuu

SEQ ID NO: 2543334 - RNA, 17 nt, Human
agccuuaucaagugucu

SEQ ID NO: 2543335 - RNA, 15 nt, Human
agccuuaucaagugu

SEQ ID NO: 2543336 - RNA, 14 nt, Human
agccuuaucaagug

SEQ ID NO: 2543337 - RNA, 18 nt, Human
agccuuauccucugaucu

SEQ ID NO: 2543338 - RNA, 17 nt, Human
agccuuauccucugauc

SEQ ID NO: 2543339 - RNA, 15 nt, Human
agccuuauccucuga

SEQ ID NO: 2543340 - RNA, 23 nt, Human
agccuucagucuugaauuucuaa

SEQ ID NO: 2543341 - RNA, 21 nt, Human
agccugggugacagagugaga

SEQ ID NO: 2543342 - RNA, 20 nt, Human
agccugggguggggucaugc

SEQ ID NO: 2543343 - RNA, 19 nt, Human
agccugggguggggucaug

SEQ ID NO: 2543344 - RNA, 23 nt, Human
agccugggguggggucaugcccu

SEQ ID NO: 2543345 - RNA, 15 nt, Human
agccuggucagccca

SEQ ID NO: 2543346 - RNA, 16 nt, Human
agccuggucagcccaa

SEQ ID NO: 2543347 - RNA, 15 nt, Human
agccuggggucugga

SEQ ID NO: 2543348 - RNA, 22 nt, Human
agccugggugacagagcaagug

SEQ ID NO: 2543349 - RNA, 22 nt, Human
agccugcuccuucccaggagug

SEQ ID NO: 2543350 - RNA, 20 nt, Human
agccugcuccuucccaggag

SEQ ID NO: 2543351 - RNA, 23 nt, Human
agccugcucccccacccccuccc

SEQ ID NO: 2543352 - RNA, 19 nt, Human
agccugcucccccaccccc

SEQ ID NO: 2543353 - RNA, 21 nt, Human
agccugcucccccacccccuc

SEQ ID NO: 2543354 - RNA, 11 nt, Human
agccugcuccc

SEQ ID NO: 2543355 - RNA, 14 nt, Human
agccugcuccccca

SEQ ID NO: 2543356 - RNA, 15 nt, Human
agccugcucccccac

SEQ ID NO: 2543357 - RNA, 17 nt, Human
agccugcucccccaccc

SEQ ID NO: 2543358 - RNA, 19 nt, Human
agccugcuccagcuguuca

SEQ ID NO: 2543359 - RNA, 22 nt, Human
agccugcuccagcuguucagcu

SEQ ID NO: 2543360 - RNA, 14 nt, Human
agccugcuccagcu

SEQ ID NO: 2543361 - RNA, 15 nt, Human
agccugcuccagcug

SEQ ID NO: 2543362 - RNA, 16 nt, Human
agccugcuccagcugu

SEQ ID NO: 2543363 - RNA, 17 nt, Human
agccugcuccagcuguu

SEQ ID NO: 2543364 - RNA, 21 nt, Human
ugcauacacacacacacacag

SEQ ID NO: 2543365 - RNA, 22 nt, Human
ugcauacacacacacacacagc

SEQ ID NO: 2543366 - RNA, 23 nt, Human
ugcauacacacacacacacagcc

SEQ ID NO: 2543367 - RNA, 15 nt, Human
ugcauacacacacac

SEQ ID NO: 2543368 - RNA, 16 nt, Human
ugcauacacacacaca

SEQ ID NO: 2543369 - RNA, 14 nt, Human
ugcauacacacaca

SEQ ID NO: 2543370 - RNA, 12 nt, Human
ugcauaccacuu

SEQ ID NO: 2543371 - RNA, 12 nt, Human
ugcauaccaacc

SEQ ID NO: 2543372 - RNA, 14 nt, Human
ugcauaccaaccug

SEQ ID NO: 2543373 - RNA, 18 nt, Human
ugcauaccaaccugggca

SEQ ID NO: 2543374 - RNA, 21 nt, Human
ugcauuaucuagauacuguau

SEQ ID NO: 2543375 - RNA, 22 nt, Human
ugcauuaucuagauacuguauc

SEQ ID NO: 2543376 - RNA, 23 nt, Human
ugcauugaacacaaacuguaaau

SEQ ID NO: 2543377 - RNA, 22 nt, Human
ugcauugaacacaaacuguaaa

SEQ ID NO: 2543378 - RNA, 13 nt, Human
ugcauugaauaua

SEQ ID NO: 2543379 - RNA, 14 nt, Human
ugcauugaauauau

SEQ ID NO: 2543380 - RNA, 16 nt, Human
ugcauugaauauauua

SEQ ID NO: 2543381 - RNA, 18 nt, Human
ugcauuaucuagauacug

SEQ ID NO: 2543382 - RNA, 23 nt, Human
agcggagguugcagggagccgag

SEQ ID NO: 2543383 - RNA, 21 nt, Human
ugccaagggcuuuguuuugca

SEQ ID NO: 2543384 - RNA, 18 nt, Human
ugcauuggaagaccccac

SEQ ID NO: 2543385 - RNA, 19 nt, Human
ugcauugcugugaauuagc

SEQ ID NO: 2543386 - RNA, 22 nt, Human
ugcauugaccgcgacuaauuuc

SEQ ID NO: 2543387 - RNA, 20 nt, Human
ugcauugaccgcgacuaauu

SEQ ID NO: 2543388 - RNA, 15 nt, Human
ugcauugaauauauu

SEQ ID NO: 2543389 - RNA, 15 nt, Human
ugcauugagaacugc

SEQ ID NO: 2543390 - RNA, 17 nt, Human
ugcauugagaacugcau

SEQ ID NO: 2543391 - RNA, 21 nt, Human
ugccaauuuuugccuucauua

SEQ ID NO: 2543392 - RNA, 18 nt, Human
ugccaauuuuugccuuca

SEQ ID NO: 2543393 - RNA, 17 nt, Human
ugccaauuuuugccuuc

SEQ ID NO: 2543394 - RNA, 15 nt, Human
ugccacaaggacuuc

SEQ ID NO: 2543395 - RNA, 19 nt, Human
ugccaauuuuugccuucau

SEQ ID NO: 2543396 - RNA, 16 nt, Human
ugccacacuucaggcu

SEQ ID NO: 2543397 - RNA, 15 nt, Human
ugccacacuucaggc

SEQ ID NO: 2543398 - RNA, 14 nt, Human
ugccacacuucagg

SEQ ID NO: 2543399 - RNA, 13 nt, Human
ugccacacuucag

SEQ ID NO: 2543400 - RNA, 15 nt, Human
ugccaaguuguuuga

SEQ ID NO: 2543401 - RNA, 19 nt, Human
ugccaaguuguuugagaaa

SEQ ID NO: 2543402 - RNA, 20 nt, Human
ugccaaguuguuugagaaau

SEQ ID NO: 2543403 - RNA, 21 nt, Human
ugccaauaauaauaccucccu

SEQ ID NO: 2543404 - RNA, 22 nt, Human
ugccaauaauaauaccucccuu

SEQ ID NO: 2543405 - RNA, 13 nt, Human
ugccaauuucaag

SEQ ID NO: 2543406 - RNA, 15 nt, Human
ugccaauuagcaauu

SEQ ID NO: 2543407 - RNA, 18 nt, Human
ugccaaugggagcucaug

SEQ ID NO: 2543408 - RNA, 20 nt, Human
agcggagaaaggaagggcug

SEQ ID NO: 2543409 - RNA, 18 nt, Human
agcggagacggaguccca

SEQ ID NO: 2543410 - RNA, 20 nt, Human
ugcauuaucuagauacugua

SEQ ID NO: 2543411 - RNA, 14 nt, Human
agcggaggugugga

SEQ ID NO: 2543412 - RNA, 17 nt, Human
agcgccuuucccaacuc

SEQ ID NO: 2543413 - RNA, 20 nt, Human
agcgccuuucccaacucuag

SEQ ID NO: 2543414 - RNA, 15 nt, Human
agcgccugccccucc

SEQ ID NO: 2543415 - RNA, 18 nt, Human
agcgccugccccucccag

SEQ ID NO: 2543416 - RNA, 23 nt, Human
agcgccuccauccaaggccaggu

SEQ ID NO: 2543417 - RNA, 20 nt, Human
agcgccuccauccaaggcca

SEQ ID NO: 2543418 - RNA, 18 nt, Human
agcgccuccauccaaggc

SEQ ID NO: 2543419 - RNA, 16 nt, Human
agcggagaaaggaagg

SEQ ID NO: 2543420 - RNA, 22 nt, Human
agcgccuccauccaaggccagg

SEQ ID NO: 2543421 - RNA, 23 nt, Human
agcgccuaguggggucucccucu

SEQ ID NO: 2543422 - RNA, 12 nt, Human
agcgccugcccc

SEQ ID NO: 2543423 - RNA, 19 nt, Human
agcgccugccccucccaga

SEQ ID NO: 2543424 - RNA, 17 nt, Human
agccuuccagggguggg

SEQ ID NO: 2543425 - RNA, 16 nt, Human
agccuuccaggggugg

SEQ ID NO: 2543426 - RNA, 14 nt, Human
agccuuccaggggu

SEQ ID NO: 2543427 - RNA, 11 nt, Human
agccuuccagg

SEQ ID NO: 2543428 - RNA, 22 nt, Human
agcgccuaguggggucucccuc

SEQ ID NO: 2543429 - RNA, 16 nt, Human
agccuugugucuacag

SEQ ID NO: 2543430 - RNA, 18 nt, Human
agccuuguaauucuaaau

SEQ ID NO: 2543431 - RNA, 22 nt, Human
agccuugguguccaccuggccc

SEQ ID NO: 2543432 - RNA, 16 nt, Human
agccuuguaauucuaa

SEQ ID NO: 2543433 - RNA, 19 nt, Human
agccuugguguccaccugg

SEQ ID NO: 2543434 - RNA, 21 nt, Human
agccuugguguccaccuggcc

SEQ ID NO: 2543435 - RNA, 20 nt, Human
agccuuggggcugaugcagu

SEQ ID NO: 2543436 - RNA, 16 nt, Human
agccuugguguccacc

SEQ ID NO: 2543437 - RNA, 17 nt, Human
agccuugguguccaccu

SEQ ID NO: 2543438 - RNA, 18 nt, Human
agccuugguguccaccug

SEQ ID NO: 2543439 - RNA, 16 nt, Human
agccuuccacacucac

SEQ ID NO: 2543440 - RNA, 20 nt, Human
agccugaauuuuguugcugu

SEQ ID NO: 2543441 - RNA, 21 nt, Human
agccugaauuuuguugcuguu

SEQ ID NO: 2543442 - RNA, 20 nt, Human
agccugaccaacauggagaa

SEQ ID NO: 2543443 - RNA, 22 nt, Human
agccugaaagaggaaugaagua

SEQ ID NO: 2543444 - RNA, 22 nt, Human
agccugaaggggcgucuguucc

SEQ ID NO: 2543445 - RNA, 17 nt, Human
ugcagcccccacugccu

SEQ ID NO: 2543446 - RNA, 23 nt, Human
ugcagcccccacugccuuugacc

SEQ ID NO: 2543447 - RNA, 23 nt, Human
ugcagcccaugcccaccugccca

SEQ ID NO: 2543448 - RNA, 14 nt, Human
ugcagcccaugccc

SEQ ID NO: 2543449 - RNA, 18 nt, Human
ugcagcccaugcccaccu

SEQ ID NO: 2543450 - RNA, 19 nt, Human
ugcagcccaugcccaccug

SEQ ID NO: 2543451 - RNA, 21 nt, Human
ugcagcccaugcccaccugcc

SEQ ID NO: 2543452 - RNA, 23 nt, Human
ugcagccucaaccuccugggcua

SEQ ID NO: 2543453 - RNA, 19 nt, Human
ugcagcccguguggccccu

SEQ ID NO: 2543454 - RNA, 21 nt, Human
ugcagcccguguggccccuuc

SEQ ID NO: 2543455 - RNA, 23 nt, Human
ugcagcccguguggccccuucac

SEQ ID NO: 2543456 - RNA, 23 nt, Human
ugcagccccgccuccaggccaca

SEQ ID NO: 2543457 - RNA, 21 nt, Human
ugcagccccgccuccaggcca

SEQ ID NO: 2543458 - RNA, 20 nt, Human
ugcagccccgccuccaggcc

SEQ ID NO: 2543459 - RNA, 13 nt, Human
ugcagcccaugcc

SEQ ID NO: 2543460 - RNA, 22 nt, Human
ugcagcccggcgccaccauccu

SEQ ID NO: 2543461 - RNA, 20 nt, Human
ugcagcccggcgccaccauc

SEQ ID NO: 2543462 - RNA, 21 nt, Human
ugcagccccgcgccuccuucc

SEQ ID NO: 2543463 - RNA, 15 nt, Human
ugcagccucacaguc

SEQ ID NO: 2543464 - RNA, 13 nt, Human
ugcagccucacag

SEQ ID NO: 2543465 - RNA, 16 nt, Human
ugcagccucacagucc

SEQ ID NO: 2543466 - RNA, 11 nt, Human
ugcaggucccu

SEQ ID NO: 2543467 - RNA, 23 nt, Human
ugcagccuuugccuccccggcuc

SEQ ID NO: 2543468 - RNA, 13 nt, Human
ugcagcuaucugg

SEQ ID NO: 2543469 - RNA, 19 nt, Human
ugcagcgaaccaauauuug

SEQ ID NO: 2543470 - RNA, 20 nt, Human
ugcagccuguccugggcugg

SEQ ID NO: 2543471 - RNA, 12 nt, Human
ugcagccugggu

SEQ ID NO: 2543472 - RNA, 14 nt, Human
ugcagccuggaggc

SEQ ID NO: 2543473 - RNA, 15 nt, Human
ugcagccuggaggcc

SEQ ID NO: 2543474 - RNA, 19 nt, Human
ugcagccuccuccugacca

SEQ ID NO: 2543475 - RNA, 14 nt, Human
ugcagccugcgcca

SEQ ID NO: 2543476 - RNA, 17 nt, Human
ugcagccuccuccugac

SEQ ID NO: 2543477 - RNA, 16 nt, Human
ugcagccuccuccuga

SEQ ID NO: 2543478 - RNA, 15 nt, Human
ugcagccuccuccug

SEQ ID NO: 2543479 - RNA, 14 nt, Human
ugcagccuccuccu

SEQ ID NO: 2543480 - RNA, 23 nt, Human
ugcauaacguauaaaagccuguu

SEQ ID NO: 2543481 - RNA, 22 nt, Human
ugcauaacguauaaaagccugu

SEQ ID NO: 2543482 - RNA, 21 nt, Human
ugcagucuggcugagcccugc

SEQ ID NO: 2543483 - RNA, 20 nt, Human
ugcagucuggcugagcccug

SEQ ID NO: 2543484 - RNA, 14 nt, Human
ugcauaaguuaacu

SEQ ID NO: 2543485 - RNA, 17 nt, Human
ugcauaaguuaacuucc

SEQ ID NO: 2543486 - RNA, 14 nt, Human
ugcaguagauuuuc

SEQ ID NO: 2543487 - RNA, 14 nt, Human
ugcaguccugggau

SEQ ID NO: 2543488 - RNA, 19 nt, Human
ugcaguccugaucagagcc

SEQ ID NO: 2543489 - RNA, 22 nt, Human
ugcaguccugaucagagccgug

SEQ ID NO: 2543490 - RNA, 19 nt, Human
ugcagucuggcugagcccu

SEQ ID NO: 2543491 - RNA, 13 nt, Human
ugcaguccuggga

SEQ ID NO: 2543492 - RNA, 14 nt, Human
ugcagucuggcuga

SEQ ID NO: 2543493 - RNA, 16 nt, Human
ugcaggucccuaauaa

SEQ ID NO: 2543494 - RNA, 15 nt, Human
ugcaggucccuaaua

SEQ ID NO: 2543495 - RNA, 14 nt, Human
ugcaggucccuaau

SEQ ID NO: 2543496 - RNA, 12 nt, Human
ugcaggucccua

SEQ ID NO: 2543497 - RNA, 13 nt, Human
ugcaguaaaucuu

SEQ ID NO: 2543498 - RNA, 14 nt, Human
ugcaguaaaucuuu

SEQ ID NO: 2543499 - RNA, 15 nt, Human
ugcaguaaaucuuuu

SEQ ID NO: 2543500 - RNA, 14 nt, Human
ugcagcuaucuggu

SEQ ID NO: 2543501 - RNA, 18 nt, Human
ugcaguaaaucuuuuaca

SEQ ID NO: 2543502 - RNA, 21 nt, Human
ugcaguaaaucuuuuacaacu

SEQ ID NO: 2543503 - RNA, 18 nt, Human
ugcaguacuuuaccuccu

SEQ ID NO: 2543504 - RNA, 16 nt, Human
ugcaguagagucaucu

SEQ ID NO: 2543505 - RNA, 19 nt, Human
ugcaguagagucaucucca

SEQ ID NO: 2543506 - RNA, 22 nt, Human
ugcaguagagucaucuccauca

SEQ ID NO: 2543507 - RNA, 16 nt, Human
agccgaccucagccuu

SEQ ID NO: 2543508 - RNA, 14 nt, Human
agccgaccucagcc

SEQ ID NO: 2543509 - RNA, 15 nt, Human
agccgaccucagccu

SEQ ID NO: 2543510 - RNA, 17 nt, Human
agccgacuccacuuuca

SEQ ID NO: 2543511 - RNA, 23 nt, Human
agccgacugcacagcggccccug

SEQ ID NO: 2543512 - RNA, 13 nt, Human
agccgagagccug

SEQ ID NO: 2543513 - RNA, 14 nt, Human
agccgagagccugc

SEQ ID NO: 2543514 - RNA, 17 nt, Human
agcccuucuuuccacag

SEQ ID NO: 2543515 - RNA, 12 nt, Human
agccgaccucag

SEQ ID NO: 2543516 - RNA, 13 nt, Human
agccgaccucagc

SEQ ID NO: 2543517 - RNA, 13 nt, Human
agccguggcuucc

SEQ ID NO: 2543518 - RNA, 15 nt, Human
agccgagagccugcu

SEQ ID NO: 2543519 - RNA, 16 nt, Human
agccgagagccugcuc

SEQ ID NO: 2543520 - RNA, 17 nt, Human
agccgagagccugcucc

SEQ ID NO: 2543521 - RNA, 18 nt, Human
agccgagagccugcuccc

SEQ ID NO: 2543522 - RNA, 21 nt, Human
agccguggcuucccgcucagc

SEQ ID NO: 2543523 - RNA, 14 nt, Human
agccguggcuuccc

SEQ ID NO: 2543524 - RNA, 23 nt, Human
agccguggcuucccgcucagccc

SEQ ID NO: 2543525 - RNA, 22 nt, Human
agccguggcuucccgcucagcc

SEQ ID NO: 2543526 - RNA, 16 nt, Human
agccgugguccuuugg

SEQ ID NO: 2543527 - RNA, 16 nt, Human
agccuaccugcucucc

SEQ ID NO: 2543528 - RNA, 21 nt, Human
agccgagagccugcuccccca

SEQ ID NO: 2543529 - RNA, 22 nt, Human
agccuaccggcaauuuccggcc

SEQ ID NO: 2543530 - RNA, 23 nt, Human
agcccuucuaccuuccugcaaca

SEQ ID NO: 2543531 - RNA, 15 nt, Human
ugcacguuauggugu

SEQ ID NO: 2543532 - RNA, 17 nt, Human
ugcacguggccucuuga

SEQ ID NO: 2543533 - RNA, 23 nt, Human
ugcacuauagccuaggugacaga

SEQ ID NO: 2543534 - RNA, 15 nt, Human
ugcacuaugaggaau

SEQ ID NO: 2543535 - RNA, 19 nt, Human
ugcacguuaugguguuucu

SEQ ID NO: 2543536 - RNA, 17 nt, Human
ugcacguuaugguguuu

SEQ ID NO: 2543537 - RNA, 15 nt, Human
agccuagagugaggg

SEQ ID NO: 2543538 - RNA, 16 nt, Human
agccuacgcugaagau

SEQ ID NO: 2543539 - RNA, 15 nt, Human
agccuagacccuccu

SEQ ID NO: 2543540 - RNA, 18 nt, Human
agccuagacccuccuccu

SEQ ID NO: 2543541 - RNA, 17 nt, Human
agccuaccugcucucca

SEQ ID NO: 2543542 - RNA, 17 nt, Human
agccuagaagagcuucu

SEQ ID NO: 2543543 - RNA, 19 nt, Human
agccuagaagagcuucuga

SEQ ID NO: 2543544 - RNA, 17 nt, Human
agccuagccgaccucag

SEQ ID NO: 2543545 - RNA, 18 nt, Human
agccuagccgaccucagc

SEQ ID NO: 2543546 - RNA, 19 nt, Human
agccuagccgaccucagcc

SEQ ID NO: 2543547 - RNA, 20 nt, Human
agccuagccgaccucagccu

SEQ ID NO: 2543548 - RNA, 21 nt, Human
agccuagccgaccucagccuu

SEQ ID NO: 2543549 - RNA, 16 nt, Human
agccucagcauccugg

SEQ ID NO: 2543550 - RNA, 21 nt, Human
agccucagcauccuggcaccc

SEQ ID NO: 2543551 - RNA, 20 nt, Human
agccucagcauccuggcacc

SEQ ID NO: 2543552 - RNA, 19 nt, Human
agccucagcauccuggcac

SEQ ID NO: 2543553 - RNA, 17 nt, Human
agccucagcauccuggc

SEQ ID NO: 2543554 - RNA, 16 nt, Human
agccucccaaagugcu

SEQ ID NO: 2543555 - RNA, 20 nt, Human
agccuccauuuaguucuuug

SEQ ID NO: 2543556 - RNA, 21 nt, Human
agccuccauuuaguucuuugu

SEQ ID NO: 2543557 - RNA, 20 nt, Human
agccucauccgaggcagggu

SEQ ID NO: 2543558 - RNA, 15 nt, Human
agccuccauuuaguu

SEQ ID NO: 2543559 - RNA, 17 nt, Human
agccuccauuuaguucu

SEQ ID NO: 2543560 - RNA, 20 nt, Human
agccucauguccacugguuc

SEQ ID NO: 2543561 - RNA, 20 nt, Human
agccuccaugcugccuccag

SEQ ID NO: 2543562 - RNA, 18 nt, Human
agccuccaugcugccucc

SEQ ID NO: 2543563 - RNA, 23 nt, Human
agccucagcauccuggcacccgg

SEQ ID NO: 2543564 - RNA, 22 nt, Human
agccucagcauccuggcacccg

SEQ ID NO: 2543565 - RNA, 15 nt, Human
agccucauguccacu

SEQ ID NO: 2543566 - RNA, 19 nt, Human
agccucauccgaggcaggg

SEQ ID NO: 2543567 - RNA, 18 nt, Human
agccucauccgaggcagg

SEQ ID NO: 2543568 - RNA, 12 nt, Human
agccucaucucu

SEQ ID NO: 2543569 - RNA, 17 nt, Human
agccccuaccccacacc

SEQ ID NO: 2543570 - RNA, 16 nt, Human
agccccgcagaccucc

SEQ ID NO: 2543571 - RNA, 14 nt, Human
agccccgcagaccu

SEQ ID NO: 2543572 - RNA, 19 nt, Human
agccccuagcccaggagag

SEQ ID NO: 2543573 - RNA, 18 nt, Human
agccccuagcccaggaga

SEQ ID NO: 2543574 - RNA, 16 nt, Human
agccccuagcccagga

SEQ ID NO: 2543575 - RNA, 15 nt, Human
agccccuagcccagg

SEQ ID NO: 2543576 - RNA, 14 nt, Human
agccccuagcccag

SEQ ID NO: 2543577 - RNA, 12 nt, Human
agccccuagccc

SEQ ID NO: 2543578 - RNA, 21 nt, Human
agccccuaccccacaccaggc

SEQ ID NO: 2543579 - RNA, 18 nt, Human
agccccgcagaccucccc

SEQ ID NO: 2543580 - RNA, 23 nt, Human
agccccuagcccaggagagagaa

SEQ ID NO: 2543581 - RNA, 22 nt, Human
agccccuagcccaggagagaga

SEQ ID NO: 2543582 - RNA, 21 nt, Human
agccccuagcccaggagagag

SEQ ID NO: 2543583 - RNA, 13 nt, Human
agccccucccacc

SEQ ID NO: 2543584 - RNA, 14 nt, Human
agccccucccacca

SEQ ID NO: 2543585 - RNA, 18 nt, Human
agccccuggaugcagccu

SEQ ID NO: 2543586 - RNA, 17 nt, Human
agccccuggaugcagcc

SEQ ID NO: 2543587 - RNA, 19 nt, Human
agccccuggaugcagccuc

SEQ ID NO: 2543588 - RNA, 22 nt, Human
agccccuggaugcagccucaca

SEQ ID NO: 2543589 - RNA, 16 nt, Human
agccccucccaccaca

SEQ ID NO: 2543590 - RNA, 17 nt, Human
agccccucccaccacag

SEQ ID NO: 2543591 - RNA, 19 nt, Human
agcccccaccgugggcagg

SEQ ID NO: 2543592 - RNA, 12 nt, Human
agcccccagcua

SEQ ID NO: 2543593 - RNA, 19 nt, Human
agcccccacccacuucccu

SEQ ID NO: 2543594 - RNA, 19 nt, Human
agcccccacagugcugucu

SEQ ID NO: 2543595 - RNA, 16 nt, Human
agcccccacagugcug

SEQ ID NO: 2543596 - RNA, 24 nt, Human
agccccaaaacucuccucugcugc

SEQ ID NO: 2543597 - RNA, 19 nt, Human
agcccccagcuaagaaccu

SEQ ID NO: 2543598 - RNA, 20 nt, Human
agcccccagcuaagaaccug

SEQ ID NO: 2543599 - RNA, 22 nt, Human
agcccccagcuaagaaccugga

SEQ ID NO: 2543600 - RNA, 16 nt, Human
agccccgaggccuucu

SEQ ID NO: 2543601 - RNA, 22 nt, Human
agccccgaggccuucucugaag

SEQ ID NO: 2543602 - RNA, 17 nt, Human
agccccgaggccuucuc

SEQ ID NO: 2543603 - RNA, 18 nt, Human
agcccauggcacucuaug

SEQ ID NO: 2543604 - RNA, 20 nt, Human
agccccaaaacucuccucug

SEQ ID NO: 2543605 - RNA, 22 nt, Human
agccccaaaacucuccucugcu

SEQ ID NO: 2543606 - RNA, 21 nt, Human
agccccaaaacucuccucugc

SEQ ID NO: 2543607 - RNA, 18 nt, Human
agcccaucccugccuggu

SEQ ID NO: 2543608 - RNA, 17 nt, Human
agcccaucccugccugg

SEQ ID NO: 2543609 - RNA, 15 nt, Human
agcccaucccugccu

SEQ ID NO: 2543610 - RNA, 13 nt, Human
agcccaucccugc

SEQ ID NO: 2543611 - RNA, 20 nt, Human
agcccaucccugccugguca

SEQ ID NO: 2543612 - RNA, 13 nt, Human
agcccaucaauua

SEQ ID NO: 2543613 - RNA, 17 nt, Human
agcccaugaguccuuga

SEQ ID NO: 2543614 - RNA, 11 nt, Human
agcccaugccc

SEQ ID NO: 2543615 - RNA, 17 nt, Human
agcccauggacuucaca

SEQ ID NO: 2543616 - RNA, 22 nt, Human
agcccaugcccaccugcccauc

SEQ ID NO: 2543617 - RNA, 16 nt, Human
agcccaugcccaccug

SEQ ID NO: 2543618 - RNA, 20 nt, Human
agcccaugcccaccugccca

SEQ ID NO: 2543619 - RNA, 20 nt, Human
ugauucuccugccucagccu

SEQ ID NO: 2543620 - RNA, 19 nt, Human
ugauucucagggucucugc

SEQ ID NO: 2543621 - RNA, 15 nt, Human
ugauucucagggucu

SEQ ID NO: 2543622 - RNA, 16 nt, Human
agcccaggguuccccc

SEQ ID NO: 2543623 - RNA, 17 nt, Human
agcccaggguuccccca

SEQ ID NO: 2543624 - RNA, 18 nt, Human
agcccaguucagcuuggg

SEQ ID NO: 2543625 - RNA, 18 nt, Human
agcccaguagaccuuguu

SEQ ID NO: 2543626 - RNA, 23 nt, Human
agcccaggguucccccagcccug

SEQ ID NO: 2543627 - RNA, 23 nt, Human
agcccagguccucugauacccag

SEQ ID NO: 2543628 - RNA, 15 nt, Human
agcccaguagaccuu

SEQ ID NO: 2543629 - RNA, 18 nt, Human
agcccaggguucccccag

SEQ ID NO: 2543630 - RNA, 19 nt, Human
agcccaggguucccccagc

SEQ ID NO: 2543631 - RNA, 21 nt, Human
agcccaggguucccccagccc

SEQ ID NO: 2543632 - RNA, 22 nt, Human
agcccaggguucccccagcccu

SEQ ID NO: 2543633 - RNA, 19 nt, Human
ugauucuaaugucuucauu

SEQ ID NO: 2543634 - RNA, 17 nt, Human
ugauucuaaugucuuca

SEQ ID NO: 2543635 - RNA, 21 nt, Human
ugauucuauuuauauguacau

SEQ ID NO: 2543636 - RNA, 12 nt, Human
ugauucucaggg

SEQ ID NO: 2543637 - RNA, 11 nt, Human
ugauucucagg

SEQ ID NO: 2543638 - RNA, 22 nt, Human
ugauucuauuuauauguacaug

SEQ ID NO: 2543639 - RNA, 15 nt, Human
ugauucuaaugucuu

SEQ ID NO: 2543640 - RNA, 21 nt, Human
ugauucgcccaaagccagaca

SEQ ID NO: 2543641 - RNA, 22 nt, Human
ugauucgcccaaagccagacag

SEQ ID NO: 2543642 - RNA, 16 nt, Human
ugauucgcccaaagcc

SEQ ID NO: 2543643 - RNA, 15 nt, Human
ugauucuccugccuc

SEQ ID NO: 2543644 - RNA, 19 nt, Human
ugauucuccugccucagcc

SEQ ID NO: 2543645 - RNA, 23 nt, Human
agcccugguggcagugggagcug

SEQ ID NO: 2543646 - RNA, 22 nt, Human
agcccugguggcagugggagcu

SEQ ID NO: 2543647 - RNA, 15 nt, Human
ugcacaagcugcacc

SEQ ID NO: 2543648 - RNA, 15 nt, Human
agcccuguaauuuuu

SEQ ID NO: 2543649 - RNA, 22 nt, Human
agcccuggaggugccagcaaag

SEQ ID NO: 2543650 - RNA, 14 nt, Human
agcccugucagugc

SEQ ID NO: 2543651 - RNA, 12 nt, Human
ugcacacagcac

SEQ ID NO: 2543652 - RNA, 24 nt, Human
ugcacacagcacgggggccaagga

SEQ ID NO: 2543653 - RNA, 22 nt, Human
ugcacacaccagagcccaccuu

SEQ ID NO: 2543654 - RNA, 18 nt, Human
ugcacaagcugcacccuc

SEQ ID NO: 2543655 - RNA, 21 nt, Human
ugcacaagcugcacccucagg

SEQ ID NO: 2543656 - RNA, 22 nt, Human
agcccuggagccaacugcugcu

SEQ ID NO: 2543657 - RNA, 21 nt, Human
agcccuggagccaacugcugc

SEQ ID NO: 2543658 - RNA, 20 nt, Human
agcccuggagccaacugcug

SEQ ID NO: 2543659 - RNA, 19 nt, Human
agcccuggagccaacugcu

SEQ ID NO: 2543660 - RNA, 18 nt, Human
agcccuggagccaacugc

SEQ ID NO: 2543661 - RNA, 23 nt, Human
agccccuugcucuccccugcccu

SEQ ID NO: 2543662 - RNA, 20 nt, Human
agcccugcuuugggcugccc

SEQ ID NO: 2543663 - RNA, 23 nt, Human
agcccugcuuugggcugcccugg

SEQ ID NO: 2543664 - RNA, 22 nt, Human
agcccugcuuugggcugcccug

SEQ ID NO: 2543665 - RNA, 21 nt, Human
agcccuggaggugccagcaaa

SEQ ID NO: 2543666 - RNA, 18 nt, Human
agcccuggaggugccagc

SEQ ID NO: 2543667 - RNA, 17 nt, Human
agcccuggaggugccag

SEQ ID NO: 2543668 - RNA, 16 nt, Human
agcccuggaggugcca

SEQ ID NO: 2543669 - RNA, 15 nt, Human
agcccuggaggugcc

SEQ ID NO: 2543670 - RNA, 12 nt, Human
agcccuggaggu

SEQ ID NO: 2543671 - RNA, 11 nt, Human
agcccuggagg

SEQ ID NO: 2543672 - RNA, 23 nt, Human
agcccuggagccaacugcugcuu

SEQ ID NO: 2543673 - RNA, 21 nt, Human
agcccugguggcagugggagc

SEQ ID NO: 2543674 - RNA, 24 nt, Human
agccccuucugacccaugcugccc

SEQ ID NO: 2543675 - RNA, 20 nt, Human
agccccuucugacccaugcu

SEQ ID NO: 2543676 - RNA, 15 nt, Human
agccccuucugcuca

SEQ ID NO: 2543677 - RNA, 16 nt, Human
agccccuucugcucag

SEQ ID NO: 2543678 - RNA, 19 nt, Human
agccccuucugcucagcuc

SEQ ID NO: 2543679 - RNA, 22 nt, Human
agccccuucugcucagcucugg

SEQ ID NO: 2543680 - RNA, 21 nt, Human
agcccugcuuugggcugcccu

SEQ ID NO: 2543681 - RNA, 17 nt, Human
agccccuugagaaaccu

SEQ ID NO: 2543682 - RNA, 20 nt, Human
agccccuugcucuccccugc

SEQ ID NO: 2543683 - RNA, 15 nt, Human
ugcacgugugugcac

SEQ ID NO: 2543684 - RNA, 14 nt, Human
ugcacgugugugca

SEQ ID NO: 2543685 - RNA, 19 nt, Human
ugcacguggccucuugagc

SEQ ID NO: 2543686 - RNA, 16 nt, Human
ugcacccuccgccuuc

SEQ ID NO: 2543687 - RNA, 22 nt, Human
ugcacguggccucuugagcagu

SEQ ID NO: 2543688 - RNA, 12 nt, Human
ugcacgugugca

SEQ ID NO: 2543689 - RNA, 16 nt, Human
ugcacccuccacccug

SEQ ID NO: 2543690 - RNA, 15 nt, Human
ugcacccuccacccu

SEQ ID NO: 2543691 - RNA, 14 nt, Human
ugcacccuccaccc

SEQ ID NO: 2543692 - RNA, 16 nt, Human
ugcacccgccucuccc

SEQ ID NO: 2543693 - RNA, 18 nt, Human
ugcacccuccacccuguc

SEQ ID NO: 2543694 - RNA, 17 nt, Human
ugcacccuccacccugu

SEQ ID NO: 2543695 - RNA, 14 nt, Human
ugcacccuccgccu

SEQ ID NO: 2543696 - RNA, 14 nt, Human
ugcacccgccucuc

SEQ ID NO: 2543697 - RNA, 20 nt, Human
ugcaccccuucucuccuccc

SEQ ID NO: 2543698 - RNA, 19 nt, Human
ugcaccccuucucuccucc

SEQ ID NO: 2543699 - RNA, 15 nt, Human
ugcaccccuucucuc

SEQ ID NO: 2543700 - RNA, 22 nt, Human
ugcacccaugggcucugacaga

SEQ ID NO: 2543701 - RNA, 21 nt, Human
ugcacccaugggcucugacag

SEQ ID NO: 2543702 - RNA, 20 nt, Human
ugcacccaugggcucugaca

SEQ ID NO: 2543703 - RNA, 18 nt, Human
ugcacccaugggcucuga

SEQ ID NO: 2543704 - RNA, 15 nt, Human
ugcacccaugggcuc

SEQ ID NO: 2543705 - RNA, 15 nt, Human
ugcacccaggggugg

SEQ ID NO: 2543706 - RNA, 17 nt, Human
ugcacccagcccugguc

SEQ ID NO: 2543707 - RNA, 16 nt, Human
ugcacccagcccuggu

SEQ ID NO: 2543708 - RNA, 15 nt, Human
ugcacccagcccugg

SEQ ID NO: 2543709 - RNA, 14 nt, Human
ugcacccagcccug

SEQ ID NO: 2543710 - RNA, 13 nt, Human
ugcacccagcccu

SEQ ID NO: 2543711 - RNA, 16 nt, Human
ugcacccucaggcagg

SEQ ID NO: 2543712 - RNA, 17 nt, Human
ugcacccucaggcaggu

SEQ ID NO: 2543713 - RNA, 10 nt, Human
ugcacacauu

SEQ ID NO: 2543714 - RNA, 20 nt, Human
ugcacacauuuuuuaaaugc

SEQ ID NO: 2543715 - RNA, 18 nt, Human
ugcacacccacucagcuc

SEQ ID NO: 2543716 - RNA, 16 nt, Human
ugcacacccacucagc

SEQ ID NO: 2543717 - RNA, 17 nt, Human
ugcacacccacucagcu

SEQ ID NO: 2543718 - RNA, 14 nt, Human
ugcacacagugcuu

SEQ ID NO: 2543719 - RNA, 14 nt, Human
ugcacacccacuca

SEQ ID NO: 2543720 - RNA, 16 nt, Human
ugcaccaucccuuuuu

SEQ ID NO: 2543721 - RNA, 18 nt, Human
ugcacacuccccugcacu

SEQ ID NO: 2543722 - RNA, 21 nt, Human
ugcacacuagccucuccagga

SEQ ID NO: 2543723 - RNA, 21 nt, Human
ugcacacuccccugcacugga

SEQ ID NO: 2543724 - RNA, 19 nt, Human
ugcacacuagccucuccag

SEQ ID NO: 2543725 - RNA, 17 nt, Human
ugcacccacccaggagu

SEQ ID NO: 2543726 - RNA, 18 nt, Human
ugcacccacccaggagug

SEQ ID NO: 2543727 - RNA, 21 nt, Human
ugcacccacucugcuuugacu

SEQ ID NO: 2543728 - RNA, 22 nt, Human
ugcaccaucccuuuuugaagug

SEQ ID NO: 2543729 - RNA, 21 nt, Human
ugcaccaucccuuuuugaagu

SEQ ID NO: 2543730 - RNA, 23 nt, Human
ugcaccaucccuuuuugaagugu

SEQ ID NO: 2543731 - RNA, 23 nt, Human
ugcaccauugcgcucuagccugg

SEQ ID NO: 2543732 - RNA, 19 nt, Human
uggcacaguuuucugagaa

SEQ ID NO: 2543733 - RNA, 13 nt, Human
uggcagccuuggc

SEQ ID NO: 2543734 - RNA, 18 nt, Human
uggcacaguuuucugaga

SEQ ID NO: 2543735 - RNA, 20 nt, Human
uggcacagugucugggcuga

SEQ ID NO: 2543736 - RNA, 19 nt, Human
uggcacagugucugggcug

SEQ ID NO: 2543737 - RNA, 18 nt, Human
uggcacagugucugggcu

SEQ ID NO: 2543738 - RNA, 16 nt, Human
uggcacagugucuggg

SEQ ID NO: 2543739 - RNA, 19 nt, Human
uggcaaugccaucaucucc

SEQ ID NO: 2543740 - RNA, 14 nt, Human
uggcaauucuuuga

SEQ ID NO: 2543741 - RNA, 16 nt, Human
uggcacagggcagugg

SEQ ID NO: 2543742 - RNA, 23 nt, Human
uggcacaauggcuaauucccaga

SEQ ID NO: 2543743 - RNA, 18 nt, Human
uggcacagggcaguggga

SEQ ID NO: 2543744 - RNA, 14 nt, Human
uggcaauuuuguaa

SEQ ID NO: 2543745 - RNA, 15 nt, Human
uggcaauuuuguaac

SEQ ID NO: 2543746 - RNA, 13 nt, Human
uggcaauuuugua

SEQ ID NO: 2543747 - RNA, 23 nt, Human
uggcaauucuuugaccucaaccu

SEQ ID NO: 2543748 - RNA, 18 nt, Human
aggccacaagacccuugu

SEQ ID NO: 2543749 - RNA, 17 nt, Human
aggccacaagacccuug

SEQ ID NO: 2543750 - RNA, 19 nt, Human
aggccacaagacccuugug

SEQ ID NO: 2543751 - RNA, 14 nt, Human
aggccagagggagu

SEQ ID NO: 2543752 - RNA, 19 nt, Human
uggcagcucaccucucccu

SEQ ID NO: 2543753 - RNA, 16 nt, Human
aggccacaagacccuu

SEQ ID NO: 2543754 - RNA, 15 nt, Human
uggcagcucaccucu

SEQ ID NO: 2543755 - RNA, 17 nt, Human
uggcagccuuggcaaac

SEQ ID NO: 2543756 - RNA, 20 nt, Human
aggccagagggagugacaga

SEQ ID NO: 2543757 - RNA, 22 nt, Human
aggccagaggcccccagcccag

SEQ ID NO: 2543758 - RNA, 16 nt, Human
aggccagaguggccug

SEQ ID NO: 2543759 - RNA, 17 nt, Human
aggccagaguggccugg

SEQ ID NO: 2543760 - RNA, 13 nt, Human
aggccagccagug

SEQ ID NO: 2543761 - RNA, 22 nt, Human
aggccagccagugaccugagga

SEQ ID NO: 2543762 - RNA, 18 nt, Human
aggccagaggcccccagc

SEQ ID NO: 2543763 - RNA, 19 nt, Human
aggccagaguggccuggcc

SEQ ID NO: 2543764 - RNA, 20 nt, Human
aggccagaguggccuggcca

SEQ ID NO: 2543765 - RNA, 21 nt, Human
aggccagaguggccuggccag

SEQ ID NO: 2543766 - RNA, 22 nt, Human
aggccagaguggccuggccagg

SEQ ID NO: 2543767 - RNA, 17 nt, Human
aggccagccuccgagag

SEQ ID NO: 2543768 - RNA, 14 nt, Human
aggccagccuccga

SEQ ID NO: 2543769 - RNA, 13 nt, Human
aggccagccuccg

SEQ ID NO: 2543770 - RNA, 11 nt, Human
aggccagccuc

SEQ ID NO: 2543771 - RNA, 22 nt, Human
aggccagccuccgagagggaga

SEQ ID NO: 2543772 - RNA, 18 nt, Human
aggccagccuccgagagg

SEQ ID NO: 2543773 - RNA, 23 nt, Human
aggccagccuccgagagggagag

SEQ ID NO: 2543774 - RNA, 21 nt, Human
aggcccagagggccugcaagg

SEQ ID NO: 2543775 - RNA, 10 nt, Human
aggccagccu

SEQ ID NO: 2543776 - RNA, 21 nt, Human
aggccagccccacccaggagg

SEQ ID NO: 2543777 - RNA, 17 nt, Human
aggccagccccacccag

SEQ ID NO: 2543778 - RNA, 18 nt, Human
aggccagccccacccagg

SEQ ID NO: 2543779 - RNA, 13 nt, Human
aggccagccccac

SEQ ID NO: 2543780 - RNA, 14 nt, Human
aggccagccccacc

SEQ ID NO: 2543781 - RNA, 15 nt, Human
aggccagccccaccc

SEQ ID NO: 2543782 - RNA, 16 nt, Human
aggccagccccaccca

SEQ ID NO: 2543783 - RNA, 22 nt, Human
aggccccaaaggaaaaagcaca

SEQ ID NO: 2543784 - RNA, 21 nt, Human
aggccccaaaggaaaaagcac

SEQ ID NO: 2543785 - RNA, 13 nt, Human
aggccccaaagga

SEQ ID NO: 2543786 - RNA, 21 nt, Human
aggccccaaaaccacagcccu

SEQ ID NO: 2543787 - RNA, 23 nt, Human
aggccccaaaaccacagcccugu

SEQ ID NO: 2543788 - RNA, 13 nt, Human
aggccccacuggg

SEQ ID NO: 2543789 - RNA, 15 nt, Human
aggccccacugggga

SEQ ID NO: 2543790 - RNA, 17 nt, Human
aggccccacuggggaaa

SEQ ID NO: 2543791 - RNA, 13 nt, Human
aggccccagagac

SEQ ID NO: 2543792 - RNA, 14 nt, Human
aggccccagagacu

SEQ ID NO: 2543793 - RNA, 20 nt, Human
aggccccagagacucagagg

SEQ ID NO: 2543794 - RNA, 16 nt, Human
aggccccgcccaggcu

SEQ ID NO: 2543795 - RNA, 12 nt, Human
aggccccagccu

SEQ ID NO: 2543796 - RNA, 13 nt, Human
aggccccagccuc

SEQ ID NO: 2543797 - RNA, 14 nt, Human
aggccccagccucc

SEQ ID NO: 2543798 - RNA, 22 nt, Human
aggccccagagacucagaggga

SEQ ID NO: 2543799 - RNA, 12 nt, Human
aggccccaggaa

SEQ ID NO: 2543800 - RNA, 22 nt, Human
aggcccagcauugcugguucua

SEQ ID NO: 2543801 - RNA, 21 nt, Human
aggcccagcauugcugguucu

SEQ ID NO: 2543802 - RNA, 20 nt, Human
aggcccagcauugcugguuc

SEQ ID NO: 2543803 - RNA, 19 nt, Human
aggcccagcauugcugguu

SEQ ID NO: 2543804 - RNA, 18 nt, Human
aggcccagcauugcuggu

SEQ ID NO: 2543805 - RNA, 10 nt, Human
aggcccagca

SEQ ID NO: 2543806 - RNA, 13 nt, Human
aggcccagcauug

SEQ ID NO: 2543807 - RNA, 13 nt, Human
aggcccagugaga

SEQ ID NO: 2543808 - RNA, 17 nt, Human
aggcccaguucacccug

SEQ ID NO: 2543809 - RNA, 17 nt, Human
aggcccagugagaugca

SEQ ID NO: 2543810 - RNA, 18 nt, Human
aggcccaugguugagaaa

SEQ ID NO: 2543811 - RNA, 18 nt, Human
aggccccaaaaccacagc

SEQ ID NO: 2543812 - RNA, 18 nt, Human
uggauggccccagcacag

SEQ ID NO: 2543813 - RNA, 17 nt, Human
uggauggccccagcaca

SEQ ID NO: 2543814 - RNA, 16 nt, Human
uggauggccccagcac

SEQ ID NO: 2543815 - RNA, 15 nt, Human
uggauggccccagca

SEQ ID NO: 2543816 - RNA, 14 nt, Human
uggauggccccagc

SEQ ID NO: 2543817 - RNA, 15 nt, Human
uggauggagcccagg

SEQ ID NO: 2543818 - RNA, 15 nt, Human
uggauggaaggggcu

SEQ ID NO: 2543819 - RNA, 18 nt, Human
uggaugggggaacucaga

SEQ ID NO: 2543820 - RNA, 21 nt, Human
uggaugggggaacucagaucc

SEQ ID NO: 2543821 - RNA, 21 nt, Human
uggaugggggaaauggugccu

SEQ ID NO: 2543822 - RNA, 17 nt, Human
uggaugggagugagaca

SEQ ID NO: 2543823 - RNA, 21 nt, Human
uggauggccccagcacagcuu

SEQ ID NO: 2543824 - RNA, 13 nt, Human
uggauggcuucua

SEQ ID NO: 2543825 - RNA, 21 nt, Human
uggagguugcagugagccaag

SEQ ID NO: 2543826 - RNA, 20 nt, Human
uggagguugcagugagcuga

SEQ ID NO: 2543827 - RNA, 15 nt, Human
uggagguuucauacu

SEQ ID NO: 2543828 - RNA, 13 nt, Human
uggauggaagggg

SEQ ID NO: 2543829 - RNA, 16 nt, Human
uggaguauaauauuca

SEQ ID NO: 2543830 - RNA, 14 nt, Human
uggaguauauguca

SEQ ID NO: 2543831 - RNA, 24 nt, Human
uggagguuaaggcugaggaaaggc

SEQ ID NO: 2543832 - RNA, 22 nt, Human
uggagggucccaagcugggccc

SEQ ID NO: 2543833 - RNA, 20 nt, Human
uggagguuaaggcugaggaa

SEQ ID NO: 2543834 - RNA, 21 nt, Human
uggagguuaaggcugaggaaa

SEQ ID NO: 2543835 - RNA, 22 nt, Human
uggagguuaaggcugaggaaag

SEQ ID NO: 2543836 - RNA, 22 nt, Human
uggagguugaagccaagugggg

SEQ ID NO: 2543837 - RNA, 18 nt, Human
uggagguugaagccaagu

SEQ ID NO: 2543838 - RNA, 17 nt, Human
uggagguugaagccaag

SEQ ID NO: 2543839 - RNA, 15 nt, Human
uggagguugaagcca

SEQ ID NO: 2543840 - RNA, 17 nt, Human
uggagguugauaacuuu

SEQ ID NO: 2543841 - RNA, 14 nt, Human
uggagguugauaac

SEQ ID NO: 2543842 - RNA, 20 nt, Human
uggagguugauaacuuugcu

SEQ ID NO: 2543843 - RNA, 14 nt, Human
uggagguugcagug

SEQ ID NO: 2543844 - RNA, 16 nt, Human
uggauuauuuaauaac

SEQ ID NO: 2543845 - RNA, 23 nt, Human
uggauuggagaaguaauccuagg

SEQ ID NO: 2543846 - RNA, 14 nt, Human
uggauuauuuaaua

SEQ ID NO: 2543847 - RNA, 13 nt, Human
uggauuauuuaau

SEQ ID NO: 2543848 - RNA, 20 nt, Human
uggauuauucauuuaaaaug

SEQ ID NO: 2543849 - RNA, 19 nt, Human
uggauuauucauuuaaaau

SEQ ID NO: 2543850 - RNA, 18 nt, Human
uggauuauucauuuaaaa

SEQ ID NO: 2543851 - RNA, 17 nt, Human
uggauuauucauuuaaa

SEQ ID NO: 2543852 - RNA, 16 nt, Human
uggauuauucauuuaa

SEQ ID NO: 2543853 - RNA, 14 nt, Human
uggauuauucauuu

SEQ ID NO: 2543854 - RNA, 13 nt, Human
uggauuauucauu

SEQ ID NO: 2543855 - RNA, 17 nt, Human
uggauuaauuaaaugca

SEQ ID NO: 2543856 - RNA, 17 nt, Human
uggauuauauuaugaag

SEQ ID NO: 2543857 - RNA, 20 nt, Human
uggauuacugccauucacuu

SEQ ID NO: 2543858 - RNA, 13 nt, Human
uggauuguccccg

SEQ ID NO: 2543859 - RNA, 13 nt, Human
uggcaauauagaa

SEQ ID NO: 2543860 - RNA, 21 nt, Human
uggauuguccccgacccuugc

SEQ ID NO: 2543861 - RNA, 21 nt, Human
uggauuggauuauuuaauaac

SEQ ID NO: 2543862 - RNA, 20 nt, Human
uggauuggauuauuuaauaa

SEQ ID NO: 2543863 - RNA, 17 nt, Human
uggauuggauuauuuaa

SEQ ID NO: 2543864 - RNA, 16 nt, Human
uggauuggauuauuua

SEQ ID NO: 2543865 - RNA, 15 nt, Human
uggauuggauuauuu

SEQ ID NO: 2543866 - RNA, 21 nt, Human
uggauuggagauagggaaaga

SEQ ID NO: 2543867 - RNA, 20 nt, Human
uggauuggagauagggaaag

SEQ ID NO: 2543868 - RNA, 15 nt, Human
uggauuauuuaauaa

SEQ ID NO: 2543869 - RNA, 23 nt, Human
uggauuggauuauuuaauaacau

SEQ ID NO: 2543870 - RNA, 14 nt, Human
uggauugggguccc

SEQ ID NO: 2543871 - RNA, 18 nt, Human
uggauuggguuaugaaua

SEQ ID NO: 2543872 - RNA, 17 nt, Human
uggauugguguaaaagg

SEQ ID NO: 2543873 - RNA, 14 nt, Human
aggccaagaaucaa

SEQ ID NO: 2543874 - RNA, 19 nt, Human
aggccaaaggaagcacaug

SEQ ID NO: 2543875 - RNA, 18 nt, Human
aggccaaaggaagcacau

SEQ ID NO: 2543876 - RNA, 16 nt, Human
aggccaaaggaagcac

SEQ ID NO: 2543877 - RNA, 17 nt, Human
aggcagccccauucugc

SEQ ID NO: 2543878 - RNA, 16 nt, Human
aggcagccccauucug

SEQ ID NO: 2543879 - RNA, 18 nt, Human
aggcagccaggccacaag

SEQ ID NO: 2543880 - RNA, 22 nt, Human
aggcaccucacagaaaugagau

SEQ ID NO: 2543881 - RNA, 21 nt, Human
aggcaccuauaaaacagguca

SEQ ID NO: 2543882 - RNA, 21 nt, Human
uggagggucccaagcugggcc

SEQ ID NO: 2543883 - RNA, 19 nt, Human
uggagggucccaagcuggg

SEQ ID NO: 2543884 - RNA, 18 nt, Human
uggagggucccaagcugg

SEQ ID NO: 2543885 - RNA, 17 nt, Human
uggagggucccaagcug

SEQ ID NO: 2543886 - RNA, 16 nt, Human
uggagggucccaagcu

SEQ ID NO: 2543887 - RNA, 15 nt, Human
uggagggucccaagc

SEQ ID NO: 2543888 - RNA, 23 nt, Human
uggagggguguggcuccuuccca

SEQ ID NO: 2543889 - RNA, 20 nt, Human
uggagggugggagagcccag

SEQ ID NO: 2543890 - RNA, 14 nt, Human
uggagguacacucu

SEQ ID NO: 2543891 - RNA, 19 nt, Human
uggagggguguggcagugg

SEQ ID NO: 2543892 - RNA, 18 nt, Human
uggagggguguggcagug

SEQ ID NO: 2543893 - RNA, 17 nt, Human
uggagggguguggcagu

SEQ ID NO: 2543894 - RNA, 11 nt, Human
uggaggggugu

SEQ ID NO: 2543895 - RNA, 14 nt, Human
uggagggguguggc

SEQ ID NO: 2543896 - RNA, 13 nt, Human
uggaggggugugg

SEQ ID NO: 2543897 - RNA, 19 nt, Human
uggaggggugguccugacu

SEQ ID NO: 2543898 - RNA, 20 nt, Human
uggaggggugguccugacuc

SEQ ID NO: 2543899 - RNA, 14 nt, Human
aggccaagaggcug

SEQ ID NO: 2543900 - RNA, 14 nt, Human
aggccaagagcaga

SEQ ID NO: 2543901 - RNA, 17 nt, Human
aggccaagagcagaggc

SEQ ID NO: 2543902 - RNA, 18 nt, Human
aggccaagagcagaggca

SEQ ID NO: 2543903 - RNA, 20 nt, Human
aggccaagagcagaggcagc

SEQ ID NO: 2543904 - RNA, 16 nt, Human
aggccaaggugggagg

SEQ ID NO: 2543905 - RNA, 17 nt, Human
aggccaaggccuucucc

SEQ ID NO: 2543906 - RNA, 18 nt, Human
aggccaaggcggguggau

SEQ ID NO: 2543907 - RNA, 21 nt, Human
uggccggucugcaagucagag

SEQ ID NO: 2543908 - RNA, 20 nt, Human
uggccggucugcaagucaga

SEQ ID NO: 2543909 - RNA, 18 nt, Human
uggccggucugcaaguca

SEQ ID NO: 2543910 - RNA, 15 nt, Human
uggccggucugcaag

SEQ ID NO: 2543911 - RNA, 18 nt, Human
uggccgggugcgguggcu

SEQ ID NO: 2543912 - RNA, 17 nt, Human
uggccgggugcgguggc

SEQ ID NO: 2543913 - RNA, 15 nt, Human
uggcccugucccucc

SEQ ID NO: 2543914 - RNA, 19 nt, Human
uggcccuggggucccacga

SEQ ID NO: 2543915 - RNA, 21 nt, Human
uggccguugauguuggcuggg

SEQ ID NO: 2543916 - RNA, 19 nt, Human
uggccguugauguuggcug

SEQ ID NO: 2543917 - RNA, 14 nt, Human
uggccguuaucugg

SEQ ID NO: 2543918 - RNA, 19 nt, Human
uggccgugggccuggggua

SEQ ID NO: 2543919 - RNA, 22 nt, Human
uggccggucugcaagucagagg

SEQ ID NO: 2543920 - RNA, 14 nt, Human
uggccgugggccug

SEQ ID NO: 2543921 - RNA, 13 nt, Human
uggccucuucaga

SEQ ID NO: 2543922 - RNA, 16 nt, Human
uggccuaaaaaugcaa

SEQ ID NO: 2543923 - RNA, 16 nt, Human
uggcccugccuucuuc

SEQ ID NO: 2543924 - RNA, 11 nt, Human
uggcccugccu

SEQ ID NO: 2543925 - RNA, 12 nt, Human
uggcccugccuu

SEQ ID NO: 2543926 - RNA, 13 nt, Human
uggcccuggccug

SEQ ID NO: 2543927 - RNA, 14 nt, Human
uggcccuggccugc

SEQ ID NO: 2543928 - RNA, 15 nt, Human
uggcccuggccugcu

SEQ ID NO: 2543929 - RNA, 16 nt, Human
uggcccuggccugcug

SEQ ID NO: 2543930 - RNA, 17 nt, Human
uggcccuggccugcugg

SEQ ID NO: 2543931 - RNA, 18 nt, Human
uggcccuggccugcuggg

SEQ ID NO: 2543932 - RNA, 23 nt, Human
uggccgggcgcgguggcucacgc

SEQ ID NO: 2543933 - RNA, 13 nt, Human
uggcccugucccu

SEQ ID NO: 2543934 - RNA, 13 nt, Human
uggcccugggguc

SEQ ID NO: 2543935 - RNA, 12 nt, Human
uggcccuggggu

SEQ ID NO: 2543936 - RNA, 19 nt, Human
uggcccaaaacgucuuauu

SEQ ID NO: 2543937 - RNA, 19 nt, Human
uggccauuuagccaccauc

SEQ ID NO: 2543938 - RNA, 19 nt, Human
uggcccacagcaggugcug

SEQ ID NO: 2543939 - RNA, 21 nt, Human
uggcccaaguggcagagcuug

SEQ ID NO: 2543940 - RNA, 19 nt, Human
uggcccaaguggcagagcu

SEQ ID NO: 2543941 - RNA, 14 nt, Human
uggccauuugcuuu

SEQ ID NO: 2543942 - RNA, 15 nt, Human
uggccauuugcuuuu

SEQ ID NO: 2543943 - RNA, 17 nt, Human
uggccauucuauugugg

SEQ ID NO: 2543944 - RNA, 16 nt, Human
uggccauuuagccacc

SEQ ID NO: 2543945 - RNA, 14 nt, Human
uggcccugcccugg

SEQ ID NO: 2543946 - RNA, 13 nt, Human
uggcccacgcacu

SEQ ID NO: 2543947 - RNA, 22 nt, Human
uggccaugguacccccuucugg

SEQ ID NO: 2543948 - RNA, 18 nt, Human
uggccaugguacccccuu

SEQ ID NO: 2543949 - RNA, 16 nt, Human
uggccaugguaccccc

SEQ ID NO: 2543950 - RNA, 22 nt, Human
uggccaugccacccuguuuuca

SEQ ID NO: 2543951 - RNA, 20 nt, Human
uggccaugccucagcccuga

SEQ ID NO: 2543952 - RNA, 18 nt, Human
uggccaugccucagcccu

SEQ ID NO: 2543953 - RNA, 17 nt, Human
uggccaugccucagccc

SEQ ID NO: 2543954 - RNA, 15 nt, Human
uggccaugccucagc

SEQ ID NO: 2543955 - RNA, 14 nt, Human
uggccaugccucag

SEQ ID NO: 2543956 - RNA, 14 nt, Human
uggccuucggccuc

SEQ ID NO: 2543957 - RNA, 21 nt, Human
aggccugggccgcugccacgu

SEQ ID NO: 2543958 - RNA, 20 nt, Human
aggccugggccgcugccacg

SEQ ID NO: 2543959 - RNA, 16 nt, Human
uggccuuccugcccua

SEQ ID NO: 2543960 - RNA, 19 nt, Human
aggccugggccgcugccac

SEQ ID NO: 2543961 - RNA, 14 nt, Human
uggccuuccugccc

SEQ ID NO: 2543962 - RNA, 18 nt, Human
uggccuuccccagccucu

SEQ ID NO: 2543963 - RNA, 18 nt, Human
uggccuguuucaacacag

SEQ ID NO: 2543964 - RNA, 18 nt, Human
uggccuuccauuuauaug

SEQ ID NO: 2543965 - RNA, 16 nt, Human
uggccuuccccagccu

SEQ ID NO: 2543966 - RNA, 23 nt, Human
uggccuguuuuagaagguucucu

SEQ ID NO: 2543967 - RNA, 17 nt, Human
uggccuuccccagccuc

SEQ ID NO: 2543968 - RNA, 20 nt, Human
aggccugggggcugggcaga

SEQ ID NO: 2543969 - RNA, 23 nt, Human
aggccugugugugaaaggaagcu

SEQ ID NO: 2543970 - RNA, 12 nt, Human
aggccugugugu

SEQ ID NO: 2543971 - RNA, 17 nt, Human
aggccugggggcaggga

SEQ ID NO: 2543972 - RNA, 18 nt, Human
aggccugggggcugggca

SEQ ID NO: 2543973 - RNA, 12 nt, Human
aggccuggggac

SEQ ID NO: 2543974 - RNA, 21 nt, Human
uggccuggccccucagggucc

SEQ ID NO: 2543975 - RNA, 18 nt, Human
uggccuggccccucaggg

SEQ ID NO: 2543976 - RNA, 16 nt, Human
uggccuggccggcaac

SEQ ID NO: 2543977 - RNA, 21 nt, Human
uggccuguucuucuauggguu

SEQ ID NO: 2543978 - RNA, 16 nt, Human
uggccuggcuucuccu

SEQ ID NO: 2543979 - RNA, 13 nt, Human
uggccuggccggc

SEQ ID NO: 2543980 - RNA, 13 nt, Human
uggccugggagag

SEQ ID NO: 2543981 - RNA, 22 nt, Human
uggccucuugagcaguggcugg

SEQ ID NO: 2543982 - RNA, 20 nt, Human
uggccucuugagcaguggcu

SEQ ID NO: 2543983 - RNA, 14 nt, Human
uggccucuuugucu

SEQ ID NO: 2543984 - RNA, 14 nt, Human
uggccucuuuucag

SEQ ID NO: 2543985 - RNA, 22 nt, Human
uggccucuuugucuaaaacaau

SEQ ID NO: 2543986 - RNA, 19 nt, Human
uggccucuugagcaguggc

SEQ ID NO: 2543987 - RNA, 17 nt, Human
uggccucuugagcagug

SEQ ID NO: 2543988 - RNA, 14 nt, Human
uggccguuggccac

SEQ ID NO: 2543989 - RNA, 22 nt, Human
uggccguugauguuggcuggga

SEQ ID NO: 2543990 - RNA, 12 nt, Human
uggccuggcccc

SEQ ID NO: 2543991 - RNA, 14 nt, Human
uggccugagaagag

SEQ ID NO: 2543992 - RNA, 23 nt, Human
uggccucuuuucagaucauggca

SEQ ID NO: 2543993 - RNA, 21 nt, Human
uggccugaagaguccucugaa

SEQ ID NO: 2543994 - RNA, 13 nt, Human
uggcauccuguga

SEQ ID NO: 2543995 - RNA, 19 nt, Human
uggcauagcccagacacag

SEQ ID NO: 2543996 - RNA, 22 nt, Human
uggcauacgccuguaguccuag

SEQ ID NO: 2543997 - RNA, 17 nt, Human
uggcauagcccagacac

SEQ ID NO: 2543998 - RNA, 14 nt, Human
uggcauuggcagca

SEQ ID NO: 2543999 - RNA, 21 nt, Human
uggcaucuuugccuugggcug

SEQ ID NO: 2544000 - RNA, 23 nt, Human
uggcaucuuugccuugggcugcu

SEQ ID NO: 2544001 - RNA, 21 nt, Human
uggcauuggcagcaggugcug

SEQ ID NO: 2544002 - RNA, 20 nt, Human
uggcauuggcagcaggugcu

SEQ ID NO: 2544003 - RNA, 19 nt, Human
uggcauuggcagcaggugc

SEQ ID NO: 2544004 - RNA, 19 nt, Human
uggcauugucccugugccu

SEQ ID NO: 2544005 - RNA, 16 nt, Human
uggcauugucccugug

SEQ ID NO: 2544006 - RNA, 20 nt, Human
uggcauugucccugugccua

SEQ ID NO: 2544007 - RNA, 23 nt, Human
uggcaucgcaccauucugacucg

SEQ ID NO: 2544008 - RNA, 22 nt, Human
uggcaucgcaccauucugacuc

SEQ ID NO: 2544009 - RNA, 16 nt, Human
uggcauccugugaagu

SEQ ID NO: 2544010 - RNA, 15 nt, Human
uggcauccugugaag

SEQ ID NO: 2544011 - RNA, 21 nt, Human
uggcaucgcaccauucugacu

SEQ ID NO: 2544012 - RNA, 17 nt, Human
uggcauccugugaaguc

SEQ ID NO: 2544013 - RNA, 16 nt, Human
uggcaucuuugccuug

SEQ ID NO: 2544014 - RNA, 20 nt, Human
uggcaucuuugccuugggcu

SEQ ID NO: 2544015 - RNA, 18 nt, Human
aggccugagcgcuccugc

SEQ ID NO: 2544016 - RNA, 14 nt, Human
aggccugagcgcuc

SEQ ID NO: 2544017 - RNA, 23 nt, Human
aggccugagauuucaucugcucu

SEQ ID NO: 2544018 - RNA, 22 nt, Human
aggccugagauuucaucugcuc

SEQ ID NO: 2544019 - RNA, 21 nt, Human
aggccugagauuucaucugcu

SEQ ID NO: 2544020 - RNA, 20 nt, Human
aggccugagauuucaucugc

SEQ ID NO: 2544021 - RNA, 19 nt, Human
aggccugagauuucaucug

SEQ ID NO: 2544022 - RNA, 17 nt, Human
aggccugagauuucauc

SEQ ID NO: 2544023 - RNA, 21 nt, Human
aggccugagcgcuccugccgc

SEQ ID NO: 2544024 - RNA, 19 nt, Human
aggccugagcgcuccugcc

SEQ ID NO: 2544025 - RNA, 22 nt, Human
aggccugagcgcuccugccgca

SEQ ID NO: 2544026 - RNA, 14 nt, Human
aggccugaggauga

SEQ ID NO: 2544027 - RNA, 16 nt, Human
aggccugagauuucau

SEQ ID NO: 2544028 - RNA, 12 nt, Human
aggccccugcca

SEQ ID NO: 2544029 - RNA, 17 nt, Human
aggccccgcccaggcuu

SEQ ID NO: 2544030 - RNA, 21 nt, Human
aggccccuauguaguccgugc

SEQ ID NO: 2544031 - RNA, 22 nt, Human
aggccccgcuuguccagcgccu

SEQ ID NO: 2544032 - RNA, 20 nt, Human
aggccccgcuuguccagcgc

SEQ ID NO: 2544033 - RNA, 21 nt, Human
aggccccgcuuguccagcgcc

SEQ ID NO: 2544034 - RNA, 13 nt, Human
aggccccaggaag

SEQ ID NO: 2544035 - RNA, 15 nt, Human
aggccccgcuugucc

SEQ ID NO: 2544036 - RNA, 17 nt, Human
aggccccgcuuguccag

SEQ ID NO: 2544037 - RNA, 18 nt, Human
aggccccgcuuguccagc

SEQ ID NO: 2544038 - RNA, 20 nt, Human
uggccaccaggcuggcgcag

SEQ ID NO: 2544039 - RNA, 19 nt, Human
uggccaccaggcuggcgca

SEQ ID NO: 2544040 - RNA, 18 nt, Human
uggccaccaggcuggcgc

SEQ ID NO: 2544041 - RNA, 17 nt, Human
uggccaccaggcuggcg

SEQ ID NO: 2544042 - RNA, 16 nt, Human
uggccaccaggcuggc

SEQ ID NO: 2544043 - RNA, 15 nt, Human
uggccaccaggcugg

SEQ ID NO: 2544044 - RNA, 14 nt, Human
uggccaccaggcug

SEQ ID NO: 2544045 - RNA, 13 nt, Human
uggccaccaggcu

SEQ ID NO: 2544046 - RNA, 12 nt, Human
uggccaccaggc

SEQ ID NO: 2544047 - RNA, 23 nt, Human
uggccaccaccccccacucugug

SEQ ID NO: 2544048 - RNA, 18 nt, Human
uggccaccaccccccacu

SEQ ID NO: 2544049 - RNA, 15 nt, Human
uggccaccacccccc

SEQ ID NO: 2544050 - RNA, 13 nt, Human
uggccaccacccc

SEQ ID NO: 2544051 - RNA, 17 nt, Human
uggccacaguagucuug

SEQ ID NO: 2544052 - RNA, 15 nt, Human
uggccagguggccac

SEQ ID NO: 2544053 - RNA, 11 nt, Human
uggccaggugg

SEQ ID NO: 2544054 - RNA, 22 nt, Human
uggccaccaggcuggcgcagcc

SEQ ID NO: 2544055 - RNA, 21 nt, Human
uggccaccaggcuggcgcagc

SEQ ID NO: 2544056 - RNA, 19 nt, Human
uggccacccguucugcugg

SEQ ID NO: 2544057 - RNA, 22 nt, Human
uggccacccguucugcuggccu

SEQ ID NO: 2544058 - RNA, 23 nt, Human
uggccaccaggcuggcgcagcca

SEQ ID NO: 2544059 - RNA, 15 nt, Human
uggccaccucucucc

SEQ ID NO: 2544060 - RNA, 23 nt, Human
uggccaaagccaaagcuaggccu

SEQ ID NO: 2544061 - RNA, 21 nt, Human
uggccaaagccaaagcuaggc

SEQ ID NO: 2544062 - RNA, 15 nt, Human
uggccaguccaggcu

SEQ ID NO: 2544063 - RNA, 14 nt, Human
uggccaguccaggc

SEQ ID NO: 2544064 - RNA, 19 nt, Human
uggccagguggccacucca

SEQ ID NO: 2544065 - RNA, 17 nt, Human
uggccagguggccacuc

SEQ ID NO: 2544066 - RNA, 16 nt, Human
uggccagguggccacu

SEQ ID NO: 2544067 - RNA, 23 nt, Human
uggccagugugacaaggauugcu

SEQ ID NO: 2544068 - RNA, 14 nt, Human
uggccagugucugu

SEQ ID NO: 2544069 - RNA, 16 nt, Human
uggccagugugauccc

SEQ ID NO: 2544070 - RNA, 13 nt, Human
uggccaucccaca

SEQ ID NO: 2544071 - RNA, 16 nt, Human
uggccaguuaucccuu

SEQ ID NO: 2544072 - RNA, 16 nt, Human
uggccaucucuggaug

SEQ ID NO: 2544073 - RNA, 16 nt, Human
uggccaucuccacccc

SEQ ID NO: 2544074 - RNA, 17 nt, Human
uggccaucucuggaugc

SEQ ID NO: 2544075 - RNA, 13 nt, Human
uggccaucuccac

SEQ ID NO: 2544076 - RNA, 14 nt, Human
uggccaucucugga

SEQ ID NO: 2544077 - RNA, 14 nt, Human
uggacacagcucuu

SEQ ID NO: 2544078 - RNA, 13 nt, Human
uggacacagcucu

SEQ ID NO: 2544079 - RNA, 22 nt, Human
uggacacagcucuucuccaggc

SEQ ID NO: 2544080 - RNA, 21 nt, Human
uggacacagcucuucuccagg

SEQ ID NO: 2544081 - RNA, 18 nt, Human
uggacaauacccccaggc

SEQ ID NO: 2544082 - RNA, 17 nt, Human
uggacacacaaggugca

SEQ ID NO: 2544083 - RNA, 13 nt, Human
uggaauucuaaca

SEQ ID NO: 2544084 - RNA, 12 nt, Human
uggaauugauuu

SEQ ID NO: 2544085 - RNA, 15 nt, Human
uggaauugauuugca

SEQ ID NO: 2544086 - RNA, 16 nt, Human
uggaauugauuugcau

SEQ ID NO: 2544087 - RNA, 17 nt, Human
uggaauugauuugcauu

SEQ ID NO: 2544088 - RNA, 18 nt, Human
uggaauugauuugcauug

SEQ ID NO: 2544089 - RNA, 19 nt, Human
uggaauugauuugcauuga

SEQ ID NO: 2544090 - RNA, 20 nt, Human
uggaauugauuugcauugaa

SEQ ID NO: 2544091 - RNA, 17 nt, Human
uggacaagccaacuugu

SEQ ID NO: 2544092 - RNA, 22 nt, Human
uggaauugauuugcauugaaca

SEQ ID NO: 2544093 - RNA, 13 nt, Human
uggacaaggaggu

SEQ ID NO: 2544094 - RNA, 16 nt, Human
uggacaaggaggucug

SEQ ID NO: 2544095 - RNA, 14 nt, Human
uggacaaggagguc

SEQ ID NO: 2544096 - RNA, 16 nt, Human
uggacaaucaugaaau

SEQ ID NO: 2544097 - RNA, 12 nt, Human
aggaucucuuga

SEQ ID NO: 2544098 - RNA, 19 nt, Human
aggcaaaauugcaaaucuu

SEQ ID NO: 2544099 - RNA, 20 nt, Human
aggcaaaauugcaaaucuug

SEQ ID NO: 2544100 - RNA, 19 nt, Human
aggaucucuugagccuggg

SEQ ID NO: 2544101 - RNA, 17 nt, Human
aggaucucuugagccug

SEQ ID NO: 2544102 - RNA, 18 nt, Human
aggaucucuugagccugg

SEQ ID NO: 2544103 - RNA, 14 nt, Human
aggcaaaugacuuu

SEQ ID NO: 2544104 - RNA, 15 nt, Human
aggcaaaugacuuug

SEQ ID NO: 2544105 - RNA, 15 nt, Human
aggcaaaugcccaag

SEQ ID NO: 2544106 - RNA, 14 nt, Human
aggcaaaugcccaa

SEQ ID NO: 2544107 - RNA, 18 nt, Human
aggcaaaugacuuuggac

SEQ ID NO: 2544108 - RNA, 13 nt, Human
aggcaaaugugua

SEQ ID NO: 2544109 - RNA, 19 nt, Human
uggaauuauuuuaaaagau

SEQ ID NO: 2544110 - RNA, 20 nt, Human
uggaauuauuuuaaaagaua

SEQ ID NO: 2544111 - RNA, 22 nt, Human
aggcaaacccaucaacaaaaau

SEQ ID NO: 2544112 - RNA, 17 nt, Human
aggcaaaauugcaaauc

SEQ ID NO: 2544113 - RNA, 20 nt, Human
uggaccuugaacuggguacu

SEQ ID NO: 2544114 - RNA, 20 nt, Human
uggaccugccuccugccugc

SEQ ID NO: 2544115 - RNA, 15 nt, Human
uggaccuuaggccuu

SEQ ID NO: 2544116 - RNA, 16 nt, Human
uggaccuuaggccuuc

SEQ ID NO: 2544117 - RNA, 17 nt, Human
uggaccuuaggccuucc

SEQ ID NO: 2544118 - RNA, 19 nt, Human
uggaccuuaggccuuccuc

SEQ ID NO: 2544119 - RNA, 13 nt, Human
uggaccuuccugc

SEQ ID NO: 2544120 - RNA, 12 nt, Human
uggaccuuccug

SEQ ID NO: 2544121 - RNA, 21 nt, Human
uggaccuuaggccuuccucuc

SEQ ID NO: 2544122 - RNA, 14 nt, Human
uggacccuguugcu

SEQ ID NO: 2544123 - RNA, 13 nt, Human
uggacccuguugc

SEQ ID NO: 2544124 - RNA, 15 nt, Human
uggacccugaggccc

SEQ ID NO: 2544125 - RNA, 19 nt, Human
uggaccugccuccugccug

SEQ ID NO: 2544126 - RNA, 18 nt, Human
uggaccugccuccugccu

SEQ ID NO: 2544127 - RNA, 17 nt, Human
uggaccugccuccugcc

SEQ ID NO: 2544128 - RNA, 15 nt, Human
uggacccuguugcua

SEQ ID NO: 2544129 - RNA, 16 nt, Human
uggaccugccuccugc

SEQ ID NO: 2544130 - RNA, 20 nt, Human
uggacccugaggcccagagg

SEQ ID NO: 2544131 - RNA, 19 nt, Human
uggacccugaggcccagag

SEQ ID NO: 2544132 - RNA, 21 nt, Human
uggacccugaggcccagaggg

SEQ ID NO: 2544133 - RNA, 23 nt, Human
uggacccuguggaugauaaaaca

SEQ ID NO: 2544134 - RNA, 18 nt, Human
uggacccugaggcccaga

SEQ ID NO: 2544135 - RNA, 16 nt, Human
uggacccugaggccca

SEQ ID NO: 2544136 - RNA, 23 nt, Human
uggacacagcucuucuccaggcu

SEQ ID NO: 2544137 - RNA, 18 nt, Human
uggacaccaggagucccu

SEQ ID NO: 2544138 - RNA, 13 nt, Human
uggagaagcggcu

SEQ ID NO: 2544139 - RNA, 22 nt, Human
uggagaagcggcuggcagccca

SEQ ID NO: 2544140 - RNA, 14 nt, Human
uggagaagaacuga

SEQ ID NO: 2544141 - RNA, 13 nt, Human
uggagaagccauu

SEQ ID NO: 2544142 - RNA, 12 nt, Human
uggagaagccau

SEQ ID NO: 2544143 - RNA, 23 nt, Human
uggagaagccacaggccugagau

SEQ ID NO: 2544144 - RNA, 22 nt, Human
uggagaagccacaggccugaga

SEQ ID NO: 2544145 - RNA, 17 nt, Human
uggagaacuccuagggu

SEQ ID NO: 2544146 - RNA, 19 nt, Human
uggagaagccauugucuuc

SEQ ID NO: 2544147 - RNA, 18 nt, Human
uggagaagccauugucuu

SEQ ID NO: 2544148 - RNA, 17 nt, Human
uggagaagccauugucu

SEQ ID NO: 2544149 - RNA, 14 nt, Human
uggagaagccauug

SEQ ID NO: 2544150 - RNA, 19 nt, Human
uggagaagcucccaggaac

SEQ ID NO: 2544151 - RNA, 16 nt, Human
uggagaagcucaccca

SEQ ID NO: 2544152 - RNA, 18 nt, Human
uggagcccaggcgggagc

SEQ ID NO: 2544153 - RNA, 16 nt, Human
uggagcccaggcggga

SEQ ID NO: 2544154 - RNA, 14 nt, Human
uggagccccacacu

SEQ ID NO: 2544155 - RNA, 22 nt, Human
uggagcccaggcgggagcggug

SEQ ID NO: 2544156 - RNA, 15 nt, Human
uggagcccagggagc

SEQ ID NO: 2544157 - RNA, 15 nt, Human
uggagccccacacug

SEQ ID NO: 2544158 - RNA, 20 nt, Human
uggagcccagggagcggaaa

SEQ ID NO: 2544159 - RNA, 12 nt, Human
uggagccccagc

SEQ ID NO: 2544160 - RNA, 16 nt, Human
uggagccccagccccc

SEQ ID NO: 2544161 - RNA, 15 nt, Human
uggagccccagcccc

SEQ ID NO: 2544162 - RNA, 14 nt, Human
uggagccccagccc

SEQ ID NO: 2544163 - RNA, 13 nt, Human
uggagccccagcc

SEQ ID NO: 2544164 - RNA, 12 nt, Human
uggagccccugg

SEQ ID NO: 2544165 - RNA, 22 nt, Human
uggagccccagcccccuuuggg

SEQ ID NO: 2544166 - RNA, 14 nt, Human
uggagccccaucag

SEQ ID NO: 2544167 - RNA, 23 nt, Human
uggagccccuggguggguggugg

SEQ ID NO: 2544168 - RNA, 15 nt, Human
uggagccccugggug

SEQ ID NO: 2544169 - RNA, 14 nt, Human
uggagccccugggu

SEQ ID NO: 2544170 - RNA, 13 nt, Human
uggagccccuggg

SEQ ID NO: 2544171 - RNA, 16 nt, Human
uggagcccgcaccccc

SEQ ID NO: 2544172 - RNA, 17 nt, Human
uggagcccgcaccccca

SEQ ID NO: 2544173 - RNA, 18 nt, Human
uggagcccgcacccccac

SEQ ID NO: 2544174 - RNA, 18 nt, Human
uggacuuuccugcaacuc

SEQ ID NO: 2544175 - RNA, 14 nt, Human
uggacuuuccugca

SEQ ID NO: 2544176 - RNA, 21 nt, Human
uggagaaauuauuuaauaaaa

SEQ ID NO: 2544177 - RNA, 18 nt, Human
uggagaacuagaaccugg

SEQ ID NO: 2544178 - RNA, 19 nt, Human
uggacuuuccugcaacuca

SEQ ID NO: 2544179 - RNA, 20 nt, Human
uggacuuuccacccccuccc

SEQ ID NO: 2544180 - RNA, 13 nt, Human
uggagaagaacug

SEQ ID NO: 2544181 - RNA, 14 nt, Human
uggagaacuagaga

SEQ ID NO: 2544182 - RNA, 20 nt, Human
uggagaacuagaaccuggag

SEQ ID NO: 2544183 - RNA, 19 nt, Human
uggagaacuagaaccugga

SEQ ID NO: 2544184 - RNA, 21 nt, Human
uggagaacuagaaccuggagg

SEQ ID NO: 2544185 - RNA, 15 nt, Human
uggagaacuccuagg

SEQ ID NO: 2544186 - RNA, 15 nt, Human
uggacugugugcuca

SEQ ID NO: 2544187 - RNA, 20 nt, Human
uggacuuggucaccagcucc

SEQ ID NO: 2544188 - RNA, 18 nt, Human
uggacuugaggauuuuga

SEQ ID NO: 2544189 - RNA, 18 nt, Human
uggacuuggucaccagcu

SEQ ID NO: 2544190 - RNA, 19 nt, Human
uggaccuuccugccaccag

SEQ ID NO: 2544191 - RNA, 14 nt, Human
uggaccuuccugcc

SEQ ID NO: 2544192 - RNA, 17 nt, Human
uggacuugagcuuggca

SEQ ID NO: 2544193 - RNA, 22 nt, Human
uggacuuguauauuuguacaaa

SEQ ID NO: 2544194 - RNA, 21 nt, Human
uggacuuguauauuuguacaa

SEQ ID NO: 2544195 - RNA, 20 nt, Human
uggacuuguauauuuguaca

SEQ ID NO: 2544196 - RNA, 18 nt, Human
uggacuuguauauuugua

SEQ ID NO: 2544197 - RNA, 17 nt, Human
uggacuuguauauuugu

SEQ ID NO: 2544198 - RNA, 15 nt, Human
uggacuuguauauuu

SEQ ID NO: 2544199 - RNA, 14 nt, Human
uggacuuguauauu

SEQ ID NO: 2544200 - RNA, 13 nt, Human
uggacuuguauau

SEQ ID NO: 2544201 - RNA, 20 nt, Human
uggacuuguccucagcagcu

SEQ ID NO: 2544202 - RNA, 15 nt, Human
uggacuuguccucag

SEQ ID NO: 2544203 - RNA, 16 nt, Human
uggacuuuccaccccc

SEQ ID NO: 2544204 - RNA, 13 nt, Human
uggacuuuccugc

SEQ ID NO: 2544205 - RNA, 18 nt, Human
uggacuuuccacccccuc

SEQ ID NO: 2544206 - RNA, 19 nt, Human
uggacuuuccacccccucc

SEQ ID NO: 2544207 - RNA, 21 nt, Human
uggagcgcaccugcccccugg

SEQ ID NO: 2544208 - RNA, 22 nt, Human
uggagcgcaccugcccccuggu

SEQ ID NO: 2544209 - RNA, 18 nt, Human
uggagcucagagagggca

SEQ ID NO: 2544210 - RNA, 16 nt, Human
uggagccuguguaaca

SEQ ID NO: 2544211 - RNA, 22 nt, Human
uggagcccgcacccccacccuu

SEQ ID NO: 2544212 - RNA, 20 nt, Human
uggagccuguguaacagcuc

SEQ ID NO: 2544213 - RNA, 18 nt, Human
uggagccuguguaacagc

SEQ ID NO: 2544214 - RNA, 17 nt, Human
uggagccuguguaacag

SEQ ID NO: 2544215 - RNA, 19 nt, Human
uggagcccgcacccccacc

SEQ ID NO: 2544216 - RNA, 19 nt, Human
uggagccuuugaauaaaaa

SEQ ID NO: 2544217 - RNA, 22 nt, Human
uggagccuguguaacagcuccu

SEQ ID NO: 2544218 - RNA, 21 nt, Human
uggagccuguguaacagcucc

SEQ ID NO: 2544219 - RNA, 14 nt, Human
uggagcgcaccugc

SEQ ID NO: 2544220 - RNA, 16 nt, Human
uggagcgcaccugccc

SEQ ID NO: 2544221 - RNA, 13 nt, Human
aggcaaucauggu

SEQ ID NO: 2544222 - RNA, 18 nt, Human
aggcaaguuucuagcuag

SEQ ID NO: 2544223 - RNA, 14 nt, Human
aggcaauaaaaauc

SEQ ID NO: 2544224 - RNA, 22 nt, Human
aggcaaugauuguuaauuuaca

SEQ ID NO: 2544225 - RNA, 17 nt, Human
aggcaauaaaaaucaua

SEQ ID NO: 2544226 - RNA, 14 nt, Human
uggagcucguggaa

SEQ ID NO: 2544227 - RNA, 17 nt, Human
aggcaagugaagaaaag

SEQ ID NO: 2544228 - RNA, 15 nt, Human
aggcaaguuucuagc

SEQ ID NO: 2544229 - RNA, 13 nt, Human
aggcaaggucugg

SEQ ID NO: 2544230 - RNA, 13 nt, Human
aggcaagugaaga

SEQ ID NO: 2544231 - RNA, 22 nt, Human
aggcacccaccaucaugucugg

SEQ ID NO: 2544232 - RNA, 21 nt, Human
aggcacccaccaucaugucug

SEQ ID NO: 2544233 - RNA, 20 nt, Human
aggcacccaccaucaugucu

SEQ ID NO: 2544234 - RNA, 14 nt, Human
aggcaaugcuggcu

SEQ ID NO: 2544235 - RNA, 19 nt, Human
aggcacccccuggagagaa

SEQ ID NO: 2544236 - RNA, 17 nt, Human
aggcacccccuggagag

SEQ ID NO: 2544237 - RNA, 20 nt, Human
aggcacccccuggagagaag

SEQ ID NO: 2544238 - RNA, 20 nt, Human
aggcacccuucuuuccucuu

SEQ ID NO: 2544239 - RNA, 15 nt, Human
aggcaccgagaaugu

SEQ ID NO: 2544240 - RNA, 16 nt, Human
aggcaccgagaauguu

SEQ ID NO: 2544241 - RNA, 18 nt, Human
aggcaccgagaauguugu

SEQ ID NO: 2544242 - RNA, 15 nt, Human
aggcacccccuggag

SEQ ID NO: 2544243 - RNA, 16 nt, Human
aggcacccccuggaga

SEQ ID NO: 2544244 - RNA, 20 nt, Human
aggcaccuaccaccacgccc

SEQ ID NO: 2544245 - RNA, 20 nt, Human
aggcaccucacaggccccag

SEQ ID NO: 2544246 - RNA, 19 nt, Human
aggcaccucacagaaauga

SEQ ID NO: 2544247 - RNA, 21 nt, Human
ugcuugaggcaacucaucuua

SEQ ID NO: 2544248 - RNA, 15 nt, Human
aggacauaauggggu

SEQ ID NO: 2544249 - RNA, 14 nt, Human
ugcuugagucaggu

SEQ ID NO: 2544250 - RNA, 20 nt, Human
ugcuugagucagguuugagu

SEQ ID NO: 2544251 - RNA, 13 nt, Human
aggacauaauggg

SEQ ID NO: 2544252 - RNA, 20 nt, Human
aggacauaaauuagaggucu

SEQ ID NO: 2544253 - RNA, 23 nt, Human
ugcuugagucagguuugaguaga

SEQ ID NO: 2544254 - RNA, 17 nt, Human
ugcuugcaguagauuuu

SEQ ID NO: 2544255 - RNA, 16 nt, Human
ugcuugcaguagauuu

SEQ ID NO: 2544256 - RNA, 15 nt, Human
ugcuugcaguagauu

SEQ ID NO: 2544257 - RNA, 22 nt, Human
ugcuugcacuuuguaacauguu

SEQ ID NO: 2544258 - RNA, 12 nt, Human
ugcuugauuuuu

SEQ ID NO: 2544259 - RNA, 12 nt, Human
aggacaguauuu

SEQ ID NO: 2544260 - RNA, 19 nt, Human
aggacaguauuugugggga

SEQ ID NO: 2544261 - RNA, 23 nt, Human
aggacagcccuucuuuccacaga

SEQ ID NO: 2544262 - RNA, 15 nt, Human
aggacagugcuucag

SEQ ID NO: 2544263 - RNA, 16 nt, Human
aggacagugcuucagc

SEQ ID NO: 2544264 - RNA, 17 nt, Human
aggacagugcuucagcc

SEQ ID NO: 2544265 - RNA, 18 nt, Human
aggacagugcuucagccu

SEQ ID NO: 2544266 - RNA, 19 nt, Human
aggacagugcuucagccug

SEQ ID NO: 2544267 - RNA, 20 nt, Human
aggacagugcuucagccuga

SEQ ID NO: 2544268 - RNA, 21 nt, Human
aggacagugcuucagccugag

SEQ ID NO: 2544269 - RNA, 22 nt, Human
aggacagugcuucagccugagg

SEQ ID NO: 2544270 - RNA, 16 nt, Human
ugcuuggaggaaggaa

SEQ ID NO: 2544271 - RNA, 15 nt, Human
ugcuuggaggaagga

SEQ ID NO: 2544272 - RNA, 19 nt, Human
ugcuugcaguagauuuucu

SEQ ID NO: 2544273 - RNA, 14 nt, Human
ugcuuggaggaagg

SEQ ID NO: 2544274 - RNA, 12 nt, Human
ugcuuguacaua

SEQ ID NO: 2544275 - RNA, 13 nt, Human
ugcuuguacauaa

SEQ ID NO: 2544276 - RNA, 21 nt, Human
ugcuuggguggagaagccauu

SEQ ID NO: 2544277 - RNA, 20 nt, Human
ugcuuggguggagaagccau

SEQ ID NO: 2544278 - RNA, 14 nt, Human
ugcuuugugauuuu

SEQ ID NO: 2544279 - RNA, 16 nt, Human
ugcuuugugauuuuug

SEQ ID NO: 2544280 - RNA, 12 nt, Human
ugcuuugugauu

SEQ ID NO: 2544281 - RNA, 22 nt, Human
ugcuuggguggagaagccauug

SEQ ID NO: 2544282 - RNA, 14 nt, Human
ugcuuguacauaau

SEQ ID NO: 2544283 - RNA, 16 nt, Human
ugcuuguacauaaugc

SEQ ID NO: 2544284 - RNA, 22 nt, Human
ugcuuguacauaaugcgugcau

SEQ ID NO: 2544285 - RNA, 15 nt, Human
ugcuuguauagguuu

SEQ ID NO: 2544286 - RNA, 21 nt, Human
ugcuuuuggcaaaacucuacu

SEQ ID NO: 2544287 - RNA, 19 nt, Human
ugcuuuuggcaaaacucua

SEQ ID NO: 2544288 - RNA, 13 nt, Human
ugcuuuucugucu

SEQ ID NO: 2544289 - RNA, 17 nt, Human
ugcuuuucuguauuuua

SEQ ID NO: 2544290 - RNA, 18 nt, Human
ugcuuuucugcccuggcu

SEQ ID NO: 2544291 - RNA, 16 nt, Human
ugcuuuucugcccugg

SEQ ID NO: 2544292 - RNA, 14 nt, Human
ugcuuugugaacaa

SEQ ID NO: 2544293 - RNA, 17 nt, Human
ugcuuuuggucugugug

SEQ ID NO: 2544294 - RNA, 14 nt, Human
ugcuuuuggucugu

SEQ ID NO: 2544295 - RNA, 22 nt, Human
uggaaaggggagagccugcugg

SEQ ID NO: 2544296 - RNA, 21 nt, Human
uggaaaggggagagccugcug

SEQ ID NO: 2544297 - RNA, 19 nt, Human
uggaaaggggagagccugc

SEQ ID NO: 2544298 - RNA, 17 nt, Human
uggaaaggggagagccu

SEQ ID NO: 2544299 - RNA, 15 nt, Human
uggaaaggggagagc

SEQ ID NO: 2544300 - RNA, 14 nt, Human
uggaaaggggagag

SEQ ID NO: 2544301 - RNA, 13 nt, Human
uggaaaggggaga

SEQ ID NO: 2544302 - RNA, 19 nt, Human
uggaaaggggggagcuggg

SEQ ID NO: 2544303 - RNA, 18 nt, Human
uggaaaggggggagcugg

SEQ ID NO: 2544304 - RNA, 17 nt, Human
uggaaaggggggagcug

SEQ ID NO: 2544305 - RNA, 23 nt, Human
uggaaaggggagagccugcuggc

SEQ ID NO: 2544306 - RNA, 23 nt, Human
uggaaagggugcugcuucccucu

SEQ ID NO: 2544307 - RNA, 17 nt, Human
uggaaaggcucagucuc

SEQ ID NO: 2544308 - RNA, 20 nt, Human
uggaaaggcucagucucagg

SEQ ID NO: 2544309 - RNA, 21 nt, Human
uggaaaggcucagucucagga

SEQ ID NO: 2544310 - RNA, 23 nt, Human
uggaaaggcucagucucaggagc

SEQ ID NO: 2544311 - RNA, 13 nt, Human
uggaaaggcucag

SEQ ID NO: 2544312 - RNA, 18 nt, Human
uggaaaugggcagagcag

SEQ ID NO: 2544313 - RNA, 20 nt, Human
uggaaaugcugggcugacgg

SEQ ID NO: 2544314 - RNA, 15 nt, Human
uggaaaugcugggcu

SEQ ID NO: 2544315 - RNA, 17 nt, Human
uggaaaugggcagagca

SEQ ID NO: 2544316 - RNA, 16 nt, Human
uggaagaggggacagg

SEQ ID NO: 2544317 - RNA, 16 nt, Human
uggaaaugcugggcug

SEQ ID NO: 2544318 - RNA, 21 nt, Human
uggaagaggggacaggucccu

SEQ ID NO: 2544319 - RNA, 15 nt, Human
uggaagaggggacag

SEQ ID NO: 2544320 - RNA, 21 nt, Human
uggaagauccugcgggugggg

SEQ ID NO: 2544321 - RNA, 13 nt, Human
uggaagauccugc

SEQ ID NO: 2544322 - RNA, 18 nt, Human
uggaagcaacaggaauca

SEQ ID NO: 2544323 - RNA, 14 nt, Human
uggaagauuuuaaa

SEQ ID NO: 2544324 - RNA, 16 nt, Human
uggaagauuuuaaauu

SEQ ID NO: 2544325 - RNA, 16 nt, Human
uggaagcacagcuuca

SEQ ID NO: 2544326 - RNA, 23 nt, Human
uggaaggggacacgugacagccg

SEQ ID NO: 2544327 - RNA, 19 nt, Human
uggaaggguucuggcugcc

SEQ ID NO: 2544328 - RNA, 18 nt, Human
uggaaggguucuggcugc

SEQ ID NO: 2544329 - RNA, 15 nt, Human
uggaaggguuugugg

SEQ ID NO: 2544330 - RNA, 18 nt, Human
uggaaguacuauaauuua

SEQ ID NO: 2544331 - RNA, 21 nt, Human
uggaaggugcuguuauccaug

SEQ ID NO: 2544332 - RNA, 15 nt, Human
uggaaggugcuguua

SEQ ID NO: 2544333 - RNA, 17 nt, Human
uggaaggguuuguggcu

SEQ ID NO: 2544334 - RNA, 20 nt, Human
uggaagguuuggugugugga

SEQ ID NO: 2544335 - RNA, 13 nt, Human
uggaaggugggga

SEQ ID NO: 2544336 - RNA, 20 nt, Human
uggaaguaaccauuugcacu

SEQ ID NO: 2544337 - RNA, 21 nt, Human
uggaagguuuguauauuguca

SEQ ID NO: 2544338 - RNA, 20 nt, Human
uggaagcuucuggugaccuu

SEQ ID NO: 2544339 - RNA, 22 nt, Human
uggaaggaccacauuuuauauu

SEQ ID NO: 2544340 - RNA, 14 nt, Human
uggaagcuuccagu

SEQ ID NO: 2544341 - RNA, 19 nt, Human
uggaaggaccacauuuuau

SEQ ID NO: 2544342 - RNA, 14 nt, Human
uggaaggaggcgca

SEQ ID NO: 2544343 - RNA, 15 nt, Human
uggaagggacuagga

SEQ ID NO: 2544344 - RNA, 21 nt, Human
aggauacaugugccgaaugug

SEQ ID NO: 2544345 - RNA, 14 nt, Human
aggauacaugugcc

SEQ ID NO: 2544346 - RNA, 15 nt, Human
aggauaccauauaca

SEQ ID NO: 2544347 - RNA, 22 nt, Human
aggauaccauauacagcucaga

SEQ ID NO: 2544348 - RNA, 18 nt, Human
aggauacuauauuuuagg

SEQ ID NO: 2544349 - RNA, 13 nt, Human
aggauacucuguc

SEQ ID NO: 2544350 - RNA, 16 nt, Human
aggauacucugucaga

SEQ ID NO: 2544351 - RNA, 22 nt, Human
aggauacuguaacacuuuacaa

SEQ ID NO: 2544352 - RNA, 18 nt, Human
aggauacuguaacacuuu

SEQ ID NO: 2544353 - RNA, 23 nt, Human
aggauagaaguauaccugauuuu

SEQ ID NO: 2544354 - RNA, 14 nt, Human
aggauccugagcca

SEQ ID NO: 2544355 - RNA, 13 nt, Human
aggauccugagcc

SEQ ID NO: 2544356 - RNA, 22 nt, Human
aggauccuauucucaccaggaa

SEQ ID NO: 2544357 - RNA, 21 nt, Human
aggauccuauucucaccagga

SEQ ID NO: 2544358 - RNA, 20 nt, Human
aggauccuauucucaccagg

SEQ ID NO: 2544359 - RNA, 17 nt, Human
aggaucccucucuggau

SEQ ID NO: 2544360 - RNA, 16 nt, Human
aggaucccucucugga

SEQ ID NO: 2544361 - RNA, 19 nt, Human
aggaucccucucuggauug

SEQ ID NO: 2544362 - RNA, 15 nt, Human
aggaucccucucugg

SEQ ID NO: 2544363 - RNA, 23 nt, Human
aggagcucacuguggugucugug

SEQ ID NO: 2544364 - RNA, 17 nt, Human
aggagcucuucaggccu

SEQ ID NO: 2544365 - RNA, 19 nt, Human
aggagcucuucaggccucc

SEQ ID NO: 2544366 - RNA, 21 nt, Human
aggagcucuucaggccucccu

SEQ ID NO: 2544367 - RNA, 17 nt, Human
aggagcugcuggcuugc

SEQ ID NO: 2544368 - RNA, 12 nt, Human
aggagcugggga

SEQ ID NO: 2544369 - RNA, 20 nt, Human
aggagcuggggaucccuccc

SEQ ID NO: 2544370 - RNA, 18 nt, Human
aggagcugggauccuaag

SEQ ID NO: 2544371 - RNA, 20 nt, Human
aggagcugggcagaaggcca

SEQ ID NO: 2544372 - RNA, 21 nt, Human
aggagcugcuggcuugcagug

SEQ ID NO: 2544373 - RNA, 16 nt, Human
aggagcugggaggaaa

SEQ ID NO: 2544374 - RNA, 17 nt, Human
aggagcugggaggaaaa

SEQ ID NO: 2544375 - RNA, 21 nt, Human
aggagcuggggaucccucccc

SEQ ID NO: 2544376 - RNA, 13 nt, Human
aggagcuucucug

SEQ ID NO: 2544377 - RNA, 18 nt, Human
ugcugcccugcccaccug

SEQ ID NO: 2544378 - RNA, 17 nt, Human
ugcugcccugcccaccu

SEQ ID NO: 2544379 - RNA, 16 nt, Human
ugcugcccugcccacc

SEQ ID NO: 2544380 - RNA, 13 nt, Human
ugcugcccugccc

SEQ ID NO: 2544381 - RNA, 24 nt, Human
aggaaugccuccucccugggcaga

SEQ ID NO: 2544382 - RNA, 12 nt, Human
aggaaugcuccc

SEQ ID NO: 2544383 - RNA, 16 nt, Human
aggaaugccuguguga

SEQ ID NO: 2544384 - RNA, 13 nt, Human
aggaaugcucccc

SEQ ID NO: 2544385 - RNA, 14 nt, Human
aggaaugcuccccc

SEQ ID NO: 2544386 - RNA, 15 nt, Human
aggaaugcuccccca

SEQ ID NO: 2544387 - RNA, 19 nt, Human
aggaaggagacucaccucu

SEQ ID NO: 2544388 - RNA, 14 nt, Human
aggaaggacccuga

SEQ ID NO: 2544389 - RNA, 20 nt, Human
aggaagcucagacugguuga

SEQ ID NO: 2544390 - RNA, 21 nt, Human
aggaaggagacucaccucugc

SEQ ID NO: 2544391 - RNA, 20 nt, Human
aggaauggacagacagagga

SEQ ID NO: 2544392 - RNA, 12 nt, Human
aggaauggacag

SEQ ID NO: 2544393 - RNA, 22 nt, Human
aggaaugcucccccauccuccc

SEQ ID NO: 2544394 - RNA, 20 nt, Human
aggaaugcucccccauccuc

SEQ ID NO: 2544395 - RNA, 21 nt, Human
ugcugcccugcccaccuggcc

SEQ ID NO: 2544396 - RNA, 19 nt, Human
ugcugcccugcccaccugg

SEQ ID NO: 2544397 - RNA, 11 nt, Human
ugcugcccugu

SEQ ID NO: 2544398 - RNA, 20 nt, Human
ugcuggccccucaccugggc

SEQ ID NO: 2544399 - RNA, 22 nt, Human
ugcuggccccucaccugggcac

SEQ ID NO: 2544400 - RNA, 24 nt, Human
ugcuggccccucaccugggcaccu

SEQ ID NO: 2544401 - RNA, 18 nt, Human
ugcuggcacauuucccca

SEQ ID NO: 2544402 - RNA, 20 nt, Human
ugcuggcacauuuccccaga

SEQ ID NO: 2544403 - RNA, 22 nt, Human
ugcuggaugucugccaauuuuu

SEQ ID NO: 2544404 - RNA, 18 nt, Human
ugcuggaugucugccaau

SEQ ID NO: 2544405 - RNA, 20 nt, Human
ugcuggauggagcccaggcg

SEQ ID NO: 2544406 - RNA, 19 nt, Human
ugcuggauggagcccaggc

SEQ ID NO: 2544407 - RNA, 18 nt, Human
ugcuggauggagcccagg

SEQ ID NO: 2544408 - RNA, 23 nt, Human
ugcuggaucacagcugcuuucug

SEQ ID NO: 2544409 - RNA, 17 nt, Human
ugcuggauggagcccag

SEQ ID NO: 2544410 - RNA, 23 nt, Human
ugcuggaggugggagcaggagau

SEQ ID NO: 2544411 - RNA, 22 nt, Human
ugcuggaggugggagcaggaga

SEQ ID NO: 2544412 - RNA, 18 nt, Human
ugcuggaggugggagcag

SEQ ID NO: 2544413 - RNA, 17 nt, Human
ugcuggaggugggagca

SEQ ID NO: 2544414 - RNA, 13 nt, Human
ugcugcccugcgg

SEQ ID NO: 2544415 - RNA, 20 nt, Human
ugcuggaguuucauguacaa

SEQ ID NO: 2544416 - RNA, 15 nt, Human
ugcuggauaaaauga

SEQ ID NO: 2544417 - RNA, 17 nt, Human
ugcuggauaaaaugagg

SEQ ID NO: 2544418 - RNA, 16 nt, Human
ugcuggauauuuucaa

SEQ ID NO: 2544419 - RNA, 17 nt, Human
ugcuggauauuuucaaa

SEQ ID NO: 2544420 - RNA, 22 nt, Human
ugcuggaucacagcugcuuucu

SEQ ID NO: 2544421 - RNA, 22 nt, Human
ugcuggauauuuucaaauugua

SEQ ID NO: 2544422 - RNA, 22 nt, Human
ugcuguauuuuaaaagaaugau

SEQ ID NO: 2544423 - RNA, 21 nt, Human
ugcuguauuuuaaaagaauga

SEQ ID NO: 2544424 - RNA, 13 nt, Human
ugcuguauuuuaa

SEQ ID NO: 2544425 - RNA, 18 nt, Human
ugcuguauaaaaucagcc

SEQ ID NO: 2544426 - RNA, 17 nt, Human
ugcuguauaaaaucagc

SEQ ID NO: 2544427 - RNA, 23 nt, Human
ugcuguauccauccauggggcug

SEQ ID NO: 2544428 - RNA, 16 nt, Human
ugcuguauaaaaucag

SEQ ID NO: 2544429 - RNA, 15 nt, Human
ugcuguauaaaauca

SEQ ID NO: 2544430 - RNA, 14 nt, Human
ugcuguauaaaauc

SEQ ID NO: 2544431 - RNA, 13 nt, Human
ugcuguauaaaau

SEQ ID NO: 2544432 - RNA, 15 nt, Human
ugcuguagacauuug

SEQ ID NO: 2544433 - RNA, 17 nt, Human
ugcugggauuacaggug

SEQ ID NO: 2544434 - RNA, 21 nt, Human
ugcugggauuacaagcgugag

SEQ ID NO: 2544435 - RNA, 13 nt, Human
ugcuggccuggcc

SEQ ID NO: 2544436 - RNA, 18 nt, Human
ugcuggccuggaucuccc

SEQ ID NO: 2544437 - RNA, 16 nt, Human
ugcuggccuggaucuc

SEQ ID NO: 2544438 - RNA, 15 nt, Human
ugcuggccuggaucu

SEQ ID NO: 2544439 - RNA, 14 nt, Human
ugcuggccuggauc

SEQ ID NO: 2544440 - RNA, 12 nt, Human
ugcuggccugga

SEQ ID NO: 2544441 - RNA, 15 nt, Human
ugcuggccgccucac

SEQ ID NO: 2544442 - RNA, 17 nt, Human
ugcuggccgccucaccc

SEQ ID NO: 2544443 - RNA, 13 nt, Human
ugcuggcugccuu

SEQ ID NO: 2544444 - RNA, 15 nt, Human
ugcuggcgccucugc

SEQ ID NO: 2544445 - RNA, 14 nt, Human
ugcuggcgccucug

SEQ ID NO: 2544446 - RNA, 13 nt, Human
ugcuggcucuucu

SEQ ID NO: 2544447 - RNA, 16 nt, Human
ugcuggcgccucugca

SEQ ID NO: 2544448 - RNA, 13 nt, Human
ugcuggcugccca

SEQ ID NO: 2544449 - RNA, 14 nt, Human
ugcuggcugcccag

SEQ ID NO: 2544450 - RNA, 21 nt, Human
ugcuggcugcccagaccccuc

SEQ ID NO: 2544451 - RNA, 21 nt, Human
ugcuggcuguuggcugggggc

SEQ ID NO: 2544452 - RNA, 19 nt, Human
ugcuggcuguuggcugggg

SEQ ID NO: 2544453 - RNA, 23 nt, Human
ugcugggacucagccuucagaca

SEQ ID NO: 2544454 - RNA, 22 nt, Human
ugcugggacucagccuucagac

SEQ ID NO: 2544455 - RNA, 18 nt, Human
ugcugggacucagccuuc

SEQ ID NO: 2544456 - RNA, 16 nt, Human
ugcugggacucagccu

SEQ ID NO: 2544457 - RNA, 19 nt, Human
ugcugggauuacaagcgug

SEQ ID NO: 2544458 - RNA, 19 nt, Human
aggacagauccagggacug

SEQ ID NO: 2544459 - RNA, 17 nt, Human
aggacagccccuccucc

SEQ ID NO: 2544460 - RNA, 16 nt, Human
aggacacuuccugccu

SEQ ID NO: 2544461 - RNA, 15 nt, Human
aggacacuuccugcc

SEQ ID NO: 2544462 - RNA, 17 nt, Human
aggacacugauaugggu

SEQ ID NO: 2544463 - RNA, 14 nt, Human
aggacacuuccugc

SEQ ID NO: 2544464 - RNA, 15 nt, Human
aggacaccacaccca

SEQ ID NO: 2544465 - RNA, 16 nt, Human
ugcuuccagugaggcu

SEQ ID NO: 2544466 - RNA, 23 nt, Human
aggacaccacacccagccucagu

SEQ ID NO: 2544467 - RNA, 22 nt, Human
aggacaccacacccagccucag

SEQ ID NO: 2544468 - RNA, 21 nt, Human
aggacaccacacccagccuca

SEQ ID NO: 2544469 - RNA, 20 nt, Human
aggacaccacacccagccuc

SEQ ID NO: 2544470 - RNA, 19 nt, Human
aggacaccacacccagccu

SEQ ID NO: 2544471 - RNA, 18 nt, Human
aggacaccacacccagcc

SEQ ID NO: 2544472 - RNA, 17 nt, Human
aggacaccacacccagc

SEQ ID NO: 2544473 - RNA, 19 nt, Human
ugcuuccaggaaacuccac

SEQ ID NO: 2544474 - RNA, 18 nt, Human
aggacacuaaccacgcug

SEQ ID NO: 2544475 - RNA, 16 nt, Human
ugcuuccaccucaccc

SEQ ID NO: 2544476 - RNA, 15 nt, Human
ugcuuccaccucacc

SEQ ID NO: 2544477 - RNA, 14 nt, Human
ugcuuccaccucac

SEQ ID NO: 2544478 - RNA, 11 nt, Human
ugcuuccaccu

SEQ ID NO: 2544479 - RNA, 15 nt, Human
ugcuuccaauuuucu

SEQ ID NO: 2544480 - RNA, 20 nt, Human
ugcuuccaccucaccccacu

SEQ ID NO: 2544481 - RNA, 19 nt, Human
ugcuuccaccucaccccac

SEQ ID NO: 2544482 - RNA, 18 nt, Human
ugcuuccaccucacccca

SEQ ID NO: 2544483 - RNA, 17 nt, Human
ugcuuccaccucacccc

SEQ ID NO: 2544484 - RNA, 16 nt, Human
ugcuuccaggaaacuc

SEQ ID NO: 2544485 - RNA, 23 nt, Human
ugcuucaauuaauaaaaaaugga

SEQ ID NO: 2544486 - RNA, 14 nt, Human
ugcuucaucccuuu

SEQ ID NO: 2544487 - RNA, 16 nt, Human
ugcuucaauuaauaaa

SEQ ID NO: 2544488 - RNA, 15 nt, Human
ugcuucaauuaauaa

SEQ ID NO: 2544489 - RNA, 23 nt, Human
ugcuucaauacccaaauccucuc

SEQ ID NO: 2544490 - RNA, 17 nt, Human
ugcuucaugcucagccc

SEQ ID NO: 2544491 - RNA, 23 nt, Human
ugcuucaaggauccugagccaga

SEQ ID NO: 2544492 - RNA, 21 nt, Human
ugcuucaaggauccugagcca

SEQ ID NO: 2544493 - RNA, 20 nt, Human
ugcuucaaggauccugagcc

SEQ ID NO: 2544494 - RNA, 15 nt, Human
ugcuuauuuuaaaau

SEQ ID NO: 2544495 - RNA, 17 nt, Human
ugcuuauuuuaaaauuu

SEQ ID NO: 2544496 - RNA, 19 nt, Human
ugcuucaaauccauccaga

SEQ ID NO: 2544497 - RNA, 17 nt, Human
ugcuucaaauccaucca

SEQ ID NO: 2544498 - RNA, 17 nt, Human
ugcugucccuuuuccuu

SEQ ID NO: 2544499 - RNA, 13 nt, Human
ugcugugcaaaug

SEQ ID NO: 2544500 - RNA, 12 nt, Human
ugcuguggccag

SEQ ID NO: 2544501 - RNA, 14 nt, Human
ugcuguggccaggg

SEQ ID NO: 2544502 - RNA, 13 nt, Human
ugcuguggaagca

SEQ ID NO: 2544503 - RNA, 15 nt, Human
ugcugugccucccaa

SEQ ID NO: 2544504 - RNA, 15 nt, Human
ugcugucccuuuucc

SEQ ID NO: 2544505 - RNA, 19 nt, Human
ugcugucccuuacgugagu

SEQ ID NO: 2544506 - RNA, 23 nt, Human
ugcuguauuuuaaaagaaugauu

SEQ ID NO: 2544507 - RNA, 21 nt, Human
ugcuguauauuugugauagca

SEQ ID NO: 2544508 - RNA, 17 nt, Human
ugcugucccuuacguga

SEQ ID NO: 2544509 - RNA, 18 nt, Human
ugcuuagcucaucuuaga

SEQ ID NO: 2544510 - RNA, 19 nt, Human
ugcuuagccuccugaccug

SEQ ID NO: 2544511 - RNA, 18 nt, Human
ugcuuagccuccugaccu

SEQ ID NO: 2544512 - RNA, 15 nt, Human
ugcuuagccuccuga

SEQ ID NO: 2544513 - RNA, 14 nt, Human
ugcuuagaaaagaa

SEQ ID NO: 2544514 - RNA, 14 nt, Human
ugcuuagccuccug

SEQ ID NO: 2544515 - RNA, 19 nt, Human
ugcuuagaauccaaacuug

SEQ ID NO: 2544516 - RNA, 17 nt, Human
ugcuuagacauaacaaa

SEQ ID NO: 2544517 - RNA, 22 nt, Human
ugcuuacuuuggaauacauuuc

SEQ ID NO: 2544518 - RNA, 18 nt, Human
ugcuuacuuuggaauaca

SEQ ID NO: 2544519 - RNA, 14 nt, Human
ugcuuacuuuggaa

SEQ ID NO: 2544520 - RNA, 14 nt, Human
ugcuuacugauaua

SEQ ID NO: 2544521 - RNA, 22 nt, Human
ugcuuacugauauauuuuacaa

SEQ ID NO: 2544522 - RNA, 23 nt, Human
ugcuuacuaagcuuugccagcug

SEQ ID NO: 2544523 - RNA, 10 nt, Human
ugcuguggga

SEQ ID NO: 2544524 - RNA, 16 nt, Human
ugcuguggccugggca

SEQ ID NO: 2544525 - RNA, 23 nt, Human
ugcuguggccagggugagagcug

SEQ ID NO: 2544526 - RNA, 17 nt, Human
ugcuguggccaggguga

SEQ ID NO: 2544527 - RNA, 12 nt, Human
ugcuguggccug

SEQ ID NO: 2544528 - RNA, 14 nt, Human
ugcuguggccuggg

SEQ ID NO: 2544529 - RNA, 15 nt, Human
ugcuguggccugggc

SEQ ID NO: 2544530 - RNA, 15 nt, Human
ugcuuaguaaugcua

SEQ ID NO: 2544531 - RNA, 14 nt, Human
ugcuuaguaaugcu

SEQ ID NO: 2544532 - RNA, 13 nt, Human
ugcuuaguaaugc

SEQ ID NO: 2544533 - RNA, 14 nt, Human
ugcuuaggauguuu

SEQ ID NO: 2544534 - RNA, 23 nt, Human
ugcuuaggauguuuuucaugaaa

SEQ ID NO: 2544535 - RNA, 16 nt, Human
ugcuuaggaugugugc

SEQ ID NO: 2544536 - RNA, 14 nt, Human
ugcuuaggaugugu

SEQ ID NO: 2544537 - RNA, 16 nt, Human
ugcuuagucacugccu

SEQ ID NO: 2544538 - RNA, 15 nt, Human
ugcuuagucacugcc

SEQ ID NO: 2544539 - RNA, 14 nt, Human
ugcuuagucacugc

SEQ ID NO: 2544540 - RNA, 18 nt, Human
ugcuuaguaaugcuacgu

SEQ ID NO: 2544541 - RNA, 14 nt, Human
ugcuuauuguucca

SEQ ID NO: 2544542 - RNA, 15 nt, Human
ugcuuauuguuccaa

SEQ ID NO: 2544543 - RNA, 16 nt, Human
ugcuuauuguuccaag

SEQ ID NO: 2544544 - RNA, 23 nt, Human
ugcuuauuugacaacguuucagc

SEQ ID NO: 2544545 - RNA, 23 nt, Human
ugcuuauuguuccaagacauugu

SEQ ID NO: 2544546 - RNA, 17 nt, Human
ugcuuauuguuccaaga

SEQ ID NO: 2544547 - RNA, 21 nt, Human
ugcuuauuguuccaagacauu

SEQ ID NO: 2544548 - RNA, 21 nt, Human
ugcuucaaaaacauucuuaca

SEQ ID NO: 2544549 - RNA, 13 nt, Human
ugcuucaaaaaca

SEQ ID NO: 2544550 - RNA, 23 nt, Human
aggaagccagcaggcucucaggc

SEQ ID NO: 2544551 - RNA, 22 nt, Human
aggaagccagcaggcucucagg

SEQ ID NO: 2544552 - RNA, 21 nt, Human
aggaagccagcaggcucucag

SEQ ID NO: 2544553 - RNA, 16 nt, Human
aggaaauauugcuggg

SEQ ID NO: 2544554 - RNA, 19 nt, Human
aggaagcaacgaagggaaa

SEQ ID NO: 2544555 - RNA, 22 nt, Human
aggaagcacaugccucucucag

SEQ ID NO: 2544556 - RNA, 20 nt, Human
aggaagccgcuggggccagu

SEQ ID NO: 2544557 - RNA, 19 nt, Human
aggaagccgcuggggccag

SEQ ID NO: 2544558 - RNA, 18 nt, Human
aggaagccagcaggcucu

SEQ ID NO: 2544559 - RNA, 18 nt, Human
aggaagccgcuggggcca

SEQ ID NO: 2544560 - RNA, 19 nt, Human
aggaagccugcaguccugg

SEQ ID NO: 2544561 - RNA, 12 nt, Human
aggaagcucagg

SEQ ID NO: 2544562 - RNA, 22 nt, Human
aggaagcccccaccgugggcag

SEQ ID NO: 2544563 - RNA, 20 nt, Human
aggaagccgugcccugcccc

SEQ ID NO: 2544564 - RNA, 21 nt, Human
aggaagccgugcccugccccc

SEQ ID NO: 2544565 - RNA, 22 nt, Human
aggaaggaaacccagcucuggu

SEQ ID NO: 2544566 - RNA, 20 nt, Human
aggaaggaaacccagcucug

SEQ ID NO: 2544567 - RNA, 23 nt, Human
aggaaggaaacccagcucugguc

SEQ ID NO: 2544568 - RNA, 20 nt, Human
aggaagccugcaguccugga

SEQ ID NO: 2544569 - RNA, 14 nt, Human
aggaagcucagacu

SEQ ID NO: 2544570 - RNA, 16 nt, Human
aggaagcucagacugg

SEQ ID NO: 2544571 - RNA, 17 nt, Human
aggaagcucagacuggu

SEQ ID NO: 2544572 - RNA, 12 nt, Human
aggaaggaaaga

SEQ ID NO: 2544573 - RNA, 14 nt, Human
aggaaaggcuccag

SEQ ID NO: 2544574 - RNA, 13 nt, Human
aggaaaggcucca

SEQ ID NO: 2544575 - RNA, 22 nt, Human
ugcugacuguacuccucccagg

SEQ ID NO: 2544576 - RNA, 21 nt, Human
ugcugacuguacuccucccag

SEQ ID NO: 2544577 - RNA, 14 nt, Human
ugcucuggaauuug

SEQ ID NO: 2544578 - RNA, 16 nt, Human
ugcugacuguuuucuc

SEQ ID NO: 2544579 - RNA, 22 nt, Human
aggaaaggccagcuggcagcag

SEQ ID NO: 2544580 - RNA, 15 nt, Human
aggaaaggcuccagg

SEQ ID NO: 2544581 - RNA, 16 nt, Human
aggaaaggcuccagga

SEQ ID NO: 2544582 - RNA, 24 nt, Human
aggaaaggccagcuggcagcagag

SEQ ID NO: 2544583 - RNA, 17 nt, Human
aggaaauaaaaccuuuc

SEQ ID NO: 2544584 - RNA, 19 nt, Human
aggaaauaaaaccuuucaa

SEQ ID NO: 2544585 - RNA, 12 nt, Human
aggaaauauuua

SEQ ID NO: 2544586 - RNA, 20 nt, Human
aggaaauaaaaccuuucaaa

SEQ ID NO: 2544587 - RNA, 21 nt, Human
aggaaauaaaaccuuucaaau

SEQ ID NO: 2544588 - RNA, 18 nt, Human
aggaaauaagaaaaauca

SEQ ID NO: 2544589 - RNA, 16 nt, Human
aggaaauaagaaaaau

SEQ ID NO: 2544590 - RNA, 22 nt, Human
aggaaauaaaaccuuucaaauu

SEQ ID NO: 2544591 - RNA, 23 nt, Human
aggaaaucaaauaugcaaagcac

SEQ ID NO: 2544592 - RNA, 13 nt, Human
aggaaauauuuau

SEQ ID NO: 2544593 - RNA, 19 nt, Human
aggaaaucaccgaaaacgu

SEQ ID NO: 2544594 - RNA, 15 nt, Human
aggaaaucaccgaaa

SEQ ID NO: 2544595 - RNA, 17 nt, Human
aggaagcacaugccucu

SEQ ID NO: 2544596 - RNA, 16 nt, Human
aggaagcacaugccuc

SEQ ID NO: 2544597 - RNA, 11 nt, Human
aggaagcacau

SEQ ID NO: 2544598 - RNA, 14 nt, Human
aggaaauccagggu

SEQ ID NO: 2544599 - RNA, 20 nt, Human
aggaaauauauaugugugug

SEQ ID NO: 2544600 - RNA, 20 nt, Human
aggaaauaagaaaaaucaug

SEQ ID NO: 2544601 - RNA, 21 nt, Human
ugcuaucucugugugcacaaa

SEQ ID NO: 2544602 - RNA, 20 nt, Human
ugcuaucucugugugcacaa

SEQ ID NO: 2544603 - RNA, 16 nt, Human
ugcuaucuuaauuuug

SEQ ID NO: 2544604 - RNA, 18 nt, Human
ugcuaucuuaauuuuggu

SEQ ID NO: 2544605 - RNA, 17 nt, Human
ugcuaucuuaauuuugg

SEQ ID NO: 2544606 - RNA, 22 nt, Human
ugcuauggggagaaaagacaug

SEQ ID NO: 2544607 - RNA, 20 nt, Human
ugcuaucucccccagcccca

SEQ ID NO: 2544608 - RNA, 16 nt, Human
ugcuaucucugugugc

SEQ ID NO: 2544609 - RNA, 17 nt, Human
agcuuucaaagaaggaa

SEQ ID NO: 2544610 - RNA, 20 nt, Human
ugcuauguuuugacauuuuu

SEQ ID NO: 2544611 - RNA, 14 nt, Human
ugcuauuagacugu

SEQ ID NO: 2544612 - RNA, 15 nt, Human
ugcuauuguaaauau

SEQ ID NO: 2544613 - RNA, 13 nt, Human
ugcuauuguaaau

SEQ ID NO: 2544614 - RNA, 16 nt, Human
ugcuauugacaaguca

SEQ ID NO: 2544615 - RNA, 19 nt, Human
ugcuaucucccccagcccc

SEQ ID NO: 2544616 - RNA, 14 nt, Human
agcuuuauucuuca

SEQ ID NO: 2544617 - RNA, 16 nt, Human
agcuuuauguaauaau

SEQ ID NO: 2544618 - RNA, 19 nt, Human
agcuuuauuuuuuaaguau

SEQ ID NO: 2544619 - RNA, 22 nt, Human
agcuuuauuuuuuaaguauuua

SEQ ID NO: 2544620 - RNA, 18 nt, Human
agcuuuauacguguagcu

SEQ ID NO: 2544621 - RNA, 22 nt, Human
agcuuuagacccugggugggcu

SEQ ID NO: 2544622 - RNA, 19 nt, Human
agcuuuagacccugggugg

SEQ ID NO: 2544623 - RNA, 23 nt, Human
agcuuuaucaccagagagggacu

SEQ ID NO: 2544624 - RNA, 14 nt, Human
agcuuuauacgugu

SEQ ID NO: 2544625 - RNA, 14 nt, Human
agcuuuauguaaua

SEQ ID NO: 2544626 - RNA, 22 nt, Human
agcuuuauguaauaaugugaau

SEQ ID NO: 2544627 - RNA, 17 nt, Human
agcuuuagacccugggu

SEQ ID NO: 2544628 - RNA, 16 nt, Human
agcuuuagacccuggg

SEQ ID NO: 2544629 - RNA, 13 nt, Human
agcuuuagacccu

SEQ ID NO: 2544630 - RNA, 18 nt, Human
agcuuuacccucaggcau

SEQ ID NO: 2544631 - RNA, 15 nt, Human
agcuuuacuguuugu

SEQ ID NO: 2544632 - RNA, 13 nt, Human
agcuuuacccuca

SEQ ID NO: 2544633 - RNA, 17 nt, Human
agcuuuacccucaggca

SEQ ID NO: 2544634 - RNA, 20 nt, Human
agcuuuacccucaggcauag

SEQ ID NO: 2544635 - RNA, 19 nt, Human
agcuuuacaugcaauuuau

SEQ ID NO: 2544636 - RNA, 15 nt, Human
agcuuuacaugcaau

SEQ ID NO: 2544637 - RNA, 21 nt, Human
agcuuuacaugcaauuuauua

SEQ ID NO: 2544638 - RNA, 22 nt, Human
agcuuuaaccauuaaaacugaa

SEQ ID NO: 2544639 - RNA, 20 nt, Human
agcuuuaaccauuaaaacug

SEQ ID NO: 2544640 - RNA, 21 nt, Human
agcuuuaaacucagggacaga

SEQ ID NO: 2544641 - RNA, 20 nt, Human
agcuuuaaacucagggacag

SEQ ID NO: 2544642 - RNA, 19 nt, Human
agcuuuaaacucagggaca

SEQ ID NO: 2544643 - RNA, 15 nt, Human
agcuuuaaacaaauu

SEQ ID NO: 2544644 - RNA, 21 nt, Human
agcuugggggaugacuagagg

SEQ ID NO: 2544645 - RNA, 13 nt, Human
agcuuuaaaagaa

SEQ ID NO: 2544646 - RNA, 15 nt, Human
agcuuuaaaagaaaa

SEQ ID NO: 2544647 - RNA, 19 nt, Human
ugcugacuguacuccuccc

SEQ ID NO: 2544648 - RNA, 16 nt, Human
ugcugacuguacuccu

SEQ ID NO: 2544649 - RNA, 16 nt, Human
ugcucuggaagagagg

SEQ ID NO: 2544650 - RNA, 23 nt, Human
ugcuccucccuggcugcccuggc

SEQ ID NO: 2544651 - RNA, 19 nt, Human
ugcuccuccuuggugccug

SEQ ID NO: 2544652 - RNA, 14 nt, Human
ugcugacuguacuc

SEQ ID NO: 2544653 - RNA, 16 nt, Human
ugcucuggacaggcau

SEQ ID NO: 2544654 - RNA, 15 nt, Human
ugcucuggacaggca

SEQ ID NO: 2544655 - RNA, 22 nt, Human
ugcuccucccuggcugcccugg

SEQ ID NO: 2544656 - RNA, 20 nt, Human
ugcuccucccuggcugcccu

SEQ ID NO: 2544657 - RNA, 19 nt, Human
ugcuccucccuggcugccc

SEQ ID NO: 2544658 - RNA, 17 nt, Human
ugcuccucccuggcugc

SEQ ID NO: 2544659 - RNA, 15 nt, Human
ugcuccucccuggcu

SEQ ID NO: 2544660 - RNA, 14 nt, Human
ugcuccucccuggc

SEQ ID NO: 2544661 - RNA, 13 nt, Human
ugcuccucccugg

SEQ ID NO: 2544662 - RNA, 12 nt, Human
ugcuccucccug

SEQ ID NO: 2544663 - RNA, 14 nt, Human
ugcucuggacaggc

SEQ ID NO: 2544664 - RNA, 20 nt, Human
ugcuccuagagggaggggcc

SEQ ID NO: 2544665 - RNA, 11 nt, Human
ugcuccuccag

SEQ ID NO: 2544666 - RNA, 12 nt, Human
ugcuccuccagg

SEQ ID NO: 2544667 - RNA, 13 nt, Human
ugcuccuccaggg

SEQ ID NO: 2544668 - RNA, 16 nt, Human
ugcuccuccagggcca

SEQ ID NO: 2544669 - RNA, 21 nt, Human
ugcuccuccagggccacgugc

SEQ ID NO: 2544670 - RNA, 22 nt, Human
ugcuccuccagggccacgugcc

SEQ ID NO: 2544671 - RNA, 20 nt, Human
ugcuccgugccuccaccacc

SEQ ID NO: 2544672 - RNA, 14 nt, Human
ugcuccuagaggga

SEQ ID NO: 2544673 - RNA, 24 nt, Human
ugcuccuagagggaggggccuagg

SEQ ID NO: 2544674 - RNA, 19 nt, Human
ugcuccgugccuccaccac

SEQ ID NO: 2544675 - RNA, 18 nt, Human
ugcuccgugccuccacca

SEQ ID NO: 2544676 - RNA, 13 nt, Human
ugcuccgugcuug

SEQ ID NO: 2544677 - RNA, 22 nt, Human
ugcucccccauccuccccuucc

SEQ ID NO: 2544678 - RNA, 23 nt, Human
ugcucccccauccuccccuuccc

SEQ ID NO: 2544679 - RNA, 14 nt, Human
ugcuccccucccuc

SEQ ID NO: 2544680 - RNA, 16 nt, Human
ugcuccccucccuccu

SEQ ID NO: 2544681 - RNA, 17 nt, Human
ugcuccccucccuccuc

SEQ ID NO: 2544682 - RNA, 15 nt, Human
ugcucccucacaugu

SEQ ID NO: 2544683 - RNA, 16 nt, Human
ugcucccuaccaccuc

SEQ ID NO: 2544684 - RNA, 20 nt, Human
ugcucccuaccaccucccca

SEQ ID NO: 2544685 - RNA, 13 nt, Human
ugcucccuccccu

SEQ ID NO: 2544686 - RNA, 14 nt, Human
ugcucccuccccug

SEQ ID NO: 2544687 - RNA, 15 nt, Human
ugcucccuccccugc

SEQ ID NO: 2544688 - RNA, 17 nt, Human
ugcuccgugccuccacc

SEQ ID NO: 2544689 - RNA, 16 nt, Human
ugcuccgugccuccac

SEQ ID NO: 2544690 - RNA, 15 nt, Human
ugcuccgugccucca

SEQ ID NO: 2544691 - RNA, 17 nt, Human
ugcucccuccccugccc

SEQ ID NO: 2544692 - RNA, 18 nt, Human
ugcucccuccccugcccu

SEQ ID NO: 2544693 - RNA, 14 nt, Human
ugcuccgugccucc

SEQ ID NO: 2544694 - RNA, 14 nt, Human
ugcucauuucagga

SEQ ID NO: 2544695 - RNA, 12 nt, Human
ugcuccacagug

SEQ ID NO: 2544696 - RNA, 13 nt, Human
ugcuccacagugu

SEQ ID NO: 2544697 - RNA, 18 nt, Human
ugcucccccauccucccc

SEQ ID NO: 2544698 - RNA, 19 nt, Human
ugcucccccauccuccccu

SEQ ID NO: 2544699 - RNA, 20 nt, Human
ugcucccccauccuccccuu

SEQ ID NO: 2544700 - RNA, 21 nt, Human
ugcucccccauccuccccuuc

SEQ ID NO: 2544701 - RNA, 14 nt, Human
ugcucauggaauug

SEQ ID NO: 2544702 - RNA, 17 nt, Human
ugcuauuguaaauaugu

SEQ ID NO: 2544703 - RNA, 16 nt, Human
ugcuauuguaaauaug

SEQ ID NO: 2544704 - RNA, 21 nt, Human
ugcggcccagcccggcuccca

SEQ ID NO: 2544705 - RNA, 19 nt, Human
ugcggccgcauucccugag

SEQ ID NO: 2544706 - RNA, 17 nt, Human
ugcggccuuuggcuuca

SEQ ID NO: 2544707 - RNA, 19 nt, Human
ugcggccuuuggcuucacg

SEQ ID NO: 2544708 - RNA, 21 nt, Human
ugcggcugugcagccuguccu

SEQ ID NO: 2544709 - RNA, 20 nt, Human
ugcggcugugcagccugucc

SEQ ID NO: 2544710 - RNA, 13 nt, Human
ugcggcugugcag

SEQ ID NO: 2544711 - RNA, 17 nt, Human
ugcgggaugguccuggg

SEQ ID NO: 2544712 - RNA, 18 nt, Human
ugcgggaugguccugggg

SEQ ID NO: 2544713 - RNA, 19 nt, Human
ugcgggaugguccuggggc

SEQ ID NO: 2544714 - RNA, 20 nt, Human
ugcgggcuuccuccuggugu

SEQ ID NO: 2544715 - RNA, 16 nt, Human
ugcgggcugggcagcu

SEQ ID NO: 2544716 - RNA, 15 nt, Human
ugcgggcugggcagc

SEQ ID NO: 2544717 - RNA, 14 nt, Human
ugcgggcugggcag

SEQ ID NO: 2544718 - RNA, 13 nt, Human
ugcgggcugggca

SEQ ID NO: 2544719 - RNA, 21 nt, Human
ugcggugcuaucucccccagc

SEQ ID NO: 2544720 - RNA, 17 nt, Human
ugcggugcuaucucccc

SEQ ID NO: 2544721 - RNA, 14 nt, Human
ugcggucuagggaa

SEQ ID NO: 2544722 - RNA, 23 nt, Human
ugcggguggggcuuggggcucac

SEQ ID NO: 2544723 - RNA, 22 nt, Human
ugcgggugaacaaagcagccac

SEQ ID NO: 2544724 - RNA, 23 nt, Human
ugcgggugaacaaagcagccacg

SEQ ID NO: 2544725 - RNA, 18 nt, Human
ugcgguccacccaggagc

SEQ ID NO: 2544726 - RNA, 18 nt, Human
ugcgggugaacaaagcag

SEQ ID NO: 2544727 - RNA, 21 nt, Human
ugcgggugaacaaagcagcca

SEQ ID NO: 2544728 - RNA, 17 nt, Human
ugcgggucacaggaggg

SEQ ID NO: 2544729 - RNA, 17 nt, Human
ugcgguccacccaggag

SEQ ID NO: 2544730 - RNA, 14 nt, Human
ugcgggucacagga

SEQ ID NO: 2544731 - RNA, 16 nt, Human
ugcgggucacaggagg

SEQ ID NO: 2544732 - RNA, 21 nt, Human
ugcgggaccgguacagaaagg

SEQ ID NO: 2544733 - RNA, 17 nt, Human
ugcgggcuuuuccccgg

SEQ ID NO: 2544734 - RNA, 17 nt, Human
ugcgggcugggcagcug

SEQ ID NO: 2544735 - RNA, 22 nt, Human
ugccuuuuauagcuauuacugu

SEQ ID NO: 2544736 - RNA, 17 nt, Human
ugccuuuuauagcuauu

SEQ ID NO: 2544737 - RNA, 13 nt, Human
ugccuuuuauagc

SEQ ID NO: 2544738 - RNA, 22 nt, Human
ugcggacagccacggccaggcc

SEQ ID NO: 2544739 - RNA, 23 nt, Human
ugcggacagccacggccaggcca

SEQ ID NO: 2544740 - RNA, 13 nt, Human
ugcggaccccagc

SEQ ID NO: 2544741 - RNA, 22 nt, Human
ugcggaccccagcugugagccu

SEQ ID NO: 2544742 - RNA, 14 nt, Human
ugcggaccccagcu

SEQ ID NO: 2544743 - RNA, 13 nt, Human
ugcggagaacaaa

SEQ ID NO: 2544744 - RNA, 19 nt, Human
ugcggagaaccuugugccu

SEQ ID NO: 2544745 - RNA, 15 nt, Human
ugcggagaacaaaug

SEQ ID NO: 2544746 - RNA, 23 nt, Human
ugcggaccccagcugugagccuu

SEQ ID NO: 2544747 - RNA, 21 nt, Human
ugcggagugaagaggggcagc

SEQ ID NO: 2544748 - RNA, 16 nt, Human
ugcggagugaagaggg

SEQ ID NO: 2544749 - RNA, 15 nt, Human
ugcggagugaagagg

SEQ ID NO: 2544750 - RNA, 15 nt, Human
ugcggaucucuggag

SEQ ID NO: 2544751 - RNA, 14 nt, Human
ugcggaucucugga

SEQ ID NO: 2544752 - RNA, 20 nt, Human
ugcggagugaagaggggcag

SEQ ID NO: 2544753 - RNA, 23 nt, Human
ugcggcagguucacaggcgaggc

SEQ ID NO: 2544754 - RNA, 13 nt, Human
ugcggauggccgg

SEQ ID NO: 2544755 - RNA, 15 nt, Human
ugcggcccagcccgg

SEQ ID NO: 2544756 - RNA, 14 nt, Human
ugcggcccagcccg

SEQ ID NO: 2544757 - RNA, 13 nt, Human
ugcggcccagccc

SEQ ID NO: 2544758 - RNA, 17 nt, Human
ugcggcauuaaagccau

SEQ ID NO: 2544759 - RNA, 18 nt, Human
ugcggcccagcccggcuc

SEQ ID NO: 2544760 - RNA, 16 nt, Human
ugcggcccagcccggc

SEQ ID NO: 2544761 - RNA, 18 nt, Human
ugcggccgcauucccuga

SEQ ID NO: 2544762 - RNA, 17 nt, Human
ugccuuugaccugccuc

SEQ ID NO: 2544763 - RNA, 23 nt, Human
ugccuuugaccugccucccuuca

SEQ ID NO: 2544764 - RNA, 13 nt, Human
ugccuuugaccug

SEQ ID NO: 2544765 - RNA, 20 nt, Human
ugccuuucucgauuuuaucu

SEQ ID NO: 2544766 - RNA, 11 nt, Human
ugccuuucucg

SEQ ID NO: 2544767 - RNA, 14 nt, Human
ugccuuaucuugca

SEQ ID NO: 2544768 - RNA, 20 nt, Human
ugccuuagucucaguuugug

SEQ ID NO: 2544769 - RNA, 16 nt, Human
ugccuuagucucaguu

SEQ ID NO: 2544770 - RNA, 13 nt, Human
ugccuuucuaguc

SEQ ID NO: 2544771 - RNA, 21 nt, Human
ugccuuugagacaguuucuua

SEQ ID NO: 2544772 - RNA, 20 nt, Human
ugccuuugagacaguuucuu

SEQ ID NO: 2544773 - RNA, 19 nt, Human
ugccuuugagacaguuucu

SEQ ID NO: 2544774 - RNA, 18 nt, Human
ugccuuugagacaguuuc

SEQ ID NO: 2544775 - RNA, 17 nt, Human
ugccuuugagacaguuu

SEQ ID NO: 2544776 - RNA, 15 nt, Human
ugccuuugagacagu

SEQ ID NO: 2544777 - RNA, 13 nt, Human
ugccuuugagaca

SEQ ID NO: 2544778 - RNA, 12 nt, Human
ugccuuugagac

SEQ ID NO: 2544779 - RNA, 23 nt, Human
ugccuuugagacaguuucuuagc

SEQ ID NO: 2544780 - RNA, 18 nt, Human
ugccuuugaguuuccuca

SEQ ID NO: 2544781 - RNA, 19 nt, Human
ugccuuugaguuuccucag

SEQ ID NO: 2544782 - RNA, 21 nt, Human
ugccuuugaguuuccucaggc

SEQ ID NO: 2544783 - RNA, 22 nt, Human
ugccuuugaguuuccucaggcu

SEQ ID NO: 2544784 - RNA, 15 nt, Human
ugccuuuguuuugau

SEQ ID NO: 2544785 - RNA, 17 nt, Human
ugccuuuggcagaguuc

SEQ ID NO: 2544786 - RNA, 16 nt, Human
ugcuacaaaaacacag

SEQ ID NO: 2544787 - RNA, 17 nt, Human
ugcuacaaaaacacagc

SEQ ID NO: 2544788 - RNA, 18 nt, Human
ugcuacaaaaacacagca

SEQ ID NO: 2544789 - RNA, 19 nt, Human
ugcuacaaaaacacagcaa

SEQ ID NO: 2544790 - RNA, 20 nt, Human
ugcuaagccccagcaagcaa

SEQ ID NO: 2544791 - RNA, 16 nt, Human
ugcuaaguauuuccca

SEQ ID NO: 2544792 - RNA, 12 nt, Human
ugcuaaguauuu

SEQ ID NO: 2544793 - RNA, 13 nt, Human
ugcuacaacuuca

SEQ ID NO: 2544794 - RNA, 23 nt, Human
ugcuacaaagaagacauguuuua

SEQ ID NO: 2544795 - RNA, 21 nt, Human
ugcuacaaagaagacauguuu

SEQ ID NO: 2544796 - RNA, 20 nt, Human
ugcuacaaagaagacauguu

SEQ ID NO: 2544797 - RNA, 18 nt, Human
ugcuacaaagaagacaug

SEQ ID NO: 2544798 - RNA, 17 nt, Human
ugcuacaaagaagacau

SEQ ID NO: 2544799 - RNA, 16 nt, Human
ugcuacaaagaagaca

SEQ ID NO: 2544800 - RNA, 12 nt, Human
ugcuacaaagaa

SEQ ID NO: 2544801 - RNA, 20 nt, Human
ugcuacaaaaacacagcaag

SEQ ID NO: 2544802 - RNA, 22 nt, Human
agcuguucugucccuuggagcu

SEQ ID NO: 2544803 - RNA, 20 nt, Human
agcuguucugucccuuggag

SEQ ID NO: 2544804 - RNA, 15 nt, Human
agcuguucugucccu

SEQ ID NO: 2544805 - RNA, 19 nt, Human
ugcuacaacuucagcagua

SEQ ID NO: 2544806 - RNA, 14 nt, Human
agcuguugagcugu

SEQ ID NO: 2544807 - RNA, 13 nt, Human
agcuguugagcug

SEQ ID NO: 2544808 - RNA, 19 nt, Human
agcuuacaagccagcugga

SEQ ID NO: 2544809 - RNA, 15 nt, Human
agcuguuguacauuu

SEQ ID NO: 2544810 - RNA, 13 nt, Human
agcuguugccuca

SEQ ID NO: 2544811 - RNA, 22 nt, Human
agcuguuggccucugcaaagga

SEQ ID NO: 2544812 - RNA, 17 nt, Human
agcuguugagcuguuuu

SEQ ID NO: 2544813 - RNA, 16 nt, Human
agcuguugagcuguuu

SEQ ID NO: 2544814 - RNA, 15 nt, Human
agcuguugagcuguu

SEQ ID NO: 2544815 - RNA, 21 nt, Human
agcuugggcccagcugggcuc

SEQ ID NO: 2544816 - RNA, 20 nt, Human
agcuugggcccagcugggcu

SEQ ID NO: 2544817 - RNA, 23 nt, Human
agcuugggcccagcugggcucug

SEQ ID NO: 2544818 - RNA, 23 nt, Human
agcuuggggacaggggcaggagg

SEQ ID NO: 2544819 - RNA, 19 nt, Human
agcuugggcccagcugggc

SEQ ID NO: 2544820 - RNA, 18 nt, Human
agcuugggcccagcuggg

SEQ ID NO: 2544821 - RNA, 17 nt, Human
agcuugggcccagcugg

SEQ ID NO: 2544822 - RNA, 16 nt, Human
agcuugggcccagcug

SEQ ID NO: 2544823 - RNA, 12 nt, Human
agcuugggccca

SEQ ID NO: 2544824 - RNA, 10 nt, Human
agcuugggcc

SEQ ID NO: 2544825 - RNA, 18 nt, Human
agcuuguaaauagcucag

SEQ ID NO: 2544826 - RNA, 18 nt, Human
agcuuggguuuuuguuac

SEQ ID NO: 2544827 - RNA, 18 nt, Human
agcuugggaggcuucccc

SEQ ID NO: 2544828 - RNA, 18 nt, Human
agcuugaggguugggcug

SEQ ID NO: 2544829 - RNA, 14 nt, Human
agcuugaggguugg

SEQ ID NO: 2544830 - RNA, 15 nt, Human
agcuugagccugaaa

SEQ ID NO: 2544831 - RNA, 13 nt, Human
agcuugagccuga

SEQ ID NO: 2544832 - RNA, 24 nt, Human
agcuugagccgggccccugggcuu

SEQ ID NO: 2544833 - RNA, 23 nt, Human
agcuugagccgggccccugggcu

SEQ ID NO: 2544834 - RNA, 20 nt, Human
agcuugaccugaggcugugg

SEQ ID NO: 2544835 - RNA, 21 nt, Human
agcuugagccgggccccuggg

SEQ ID NO: 2544836 - RNA, 19 nt, Human
agcuugaaggaucuguuuu

SEQ ID NO: 2544837 - RNA, 22 nt, Human
agcuuaccagaagcuuccauag

SEQ ID NO: 2544838 - RNA, 16 nt, Human
agcuguuguacauuua

SEQ ID NO: 2544839 - RNA, 20 nt, Human
agcuuaccagaagcuuccau

SEQ ID NO: 2544840 - RNA, 10 nt, Human
agcuuagaac

SEQ ID NO: 2544841 - RNA, 18 nt, Human
ugcuaagccccagcaagc

SEQ ID NO: 2544842 - RNA, 14 nt, Human
agcuuagaccucag

SEQ ID NO: 2544843 - RNA, 15 nt, Human
agcuuagaccucagc

SEQ ID NO: 2544844 - RNA, 12 nt, Human
agcuucuuccag

SEQ ID NO: 2544845 - RNA, 15 nt, Human
agcuuagacuaaggc

SEQ ID NO: 2544846 - RNA, 20 nt, Human
agcuuagaccucagccugug

SEQ ID NO: 2544847 - RNA, 16 nt, Human
agcuuagaccucagcc

SEQ ID NO: 2544848 - RNA, 17 nt, Human
agcuuagaccucagccu

SEQ ID NO: 2544849 - RNA, 18 nt, Human
agcuuagaccucagccug

SEQ ID NO: 2544850 - RNA, 19 nt, Human
agcuuagaccucagccugu

SEQ ID NO: 2544851 - RNA, 19 nt, Human
agcuugaccgugaggccag

SEQ ID NO: 2544852 - RNA, 22 nt, Human
agcuugaagaucguuaguaucu

SEQ ID NO: 2544853 - RNA, 22 nt, Human
agcuugaaaguuuucagaaccu

SEQ ID NO: 2544854 - RNA, 16 nt, Human
agcuugaaaguuuuca

SEQ ID NO: 2544855 - RNA, 17 nt, Human
agcuugaaaguuuucag

SEQ ID NO: 2544856 - RNA, 17 nt, Human
agcuugaaacugagaug

SEQ ID NO: 2544857 - RNA, 20 nt, Human
agcuucuuccaggugcccag

SEQ ID NO: 2544858 - RNA, 22 nt, Human
agcuucuuccaggugcccagcu

SEQ ID NO: 2544859 - RNA, 16 nt, Human
agcuguucacagccag

SEQ ID NO: 2544860 - RNA, 19 nt, Human
agcuguucacagccagacu

SEQ ID NO: 2544861 - RNA, 20 nt, Human
agcugugugcucuccaagcc

SEQ ID NO: 2544862 - RNA, 20 nt, Human
ugccuguucagcuccagcuc

SEQ ID NO: 2544863 - RNA, 18 nt, Human
ugccuguucagcuccagc

SEQ ID NO: 2544864 - RNA, 13 nt, Human
agcuguucagcug

SEQ ID NO: 2544865 - RNA, 14 nt, Human
agcuguucagcugg

SEQ ID NO: 2544866 - RNA, 22 nt, Human
ugccuuaaaaccaaagagggcu

SEQ ID NO: 2544867 - RNA, 20 nt, Human
ugccuuaaaaccaaagaggg

SEQ ID NO: 2544868 - RNA, 18 nt, Human
ugccuuaaaaccaaagag

SEQ ID NO: 2544869 - RNA, 16 nt, Human
ugccuuaaaaccaaag

SEQ ID NO: 2544870 - RNA, 15 nt, Human
ugccuuaaaaccaaa

SEQ ID NO: 2544871 - RNA, 20 nt, Human
ugccuguugggccaggagcc

SEQ ID NO: 2544872 - RNA, 19 nt, Human
ugccuguugggccaggagc

SEQ ID NO: 2544873 - RNA, 21 nt, Human
ugccuguucagcuccagcuca

SEQ ID NO: 2544874 - RNA, 16 nt, Human
ugccuuauggaacacu

SEQ ID NO: 2544875 - RNA, 15 nt, Human
ugccuuauggaacac

SEQ ID NO: 2544876 - RNA, 23 nt, Human
ugccuuagagccaggcacacacu

SEQ ID NO: 2544877 - RNA, 19 nt, Human
ugccuuagagccaggcaca

SEQ ID NO: 2544878 - RNA, 18 nt, Human
ugccuuagagccaggcac

SEQ ID NO: 2544879 - RNA, 15 nt, Human
ugccuuagucucagu

SEQ ID NO: 2544880 - RNA, 17 nt, Human
ugccuuagagccaggca

SEQ ID NO: 2544881 - RNA, 15 nt, Human
ugccuuaaagaaagu

SEQ ID NO: 2544882 - RNA, 13 nt, Human
ugccuuaaagaaa

SEQ ID NO: 2544883 - RNA, 15 nt, Human
ugccuuaaaacuuua

SEQ ID NO: 2544884 - RNA, 20 nt, Human
agcugugcucuggacaggca

SEQ ID NO: 2544885 - RNA, 19 nt, Human
agcugugcucuggacaggc

SEQ ID NO: 2544886 - RNA, 20 nt, Human
agcugucuuguccuugcugg

SEQ ID NO: 2544887 - RNA, 17 nt, Human
agcugucugcucagaca

SEQ ID NO: 2544888 - RNA, 11 nt, Human
agcugucugcu

SEQ ID NO: 2544889 - RNA, 20 nt, Human
agcugucccugucaccaagc

SEQ ID NO: 2544890 - RNA, 16 nt, Human
agcuguguggcagucu

SEQ ID NO: 2544891 - RNA, 14 nt, Human
agcuguguggcagu

SEQ ID NO: 2544892 - RNA, 18 nt, Human
agcugugugcucuccaag

SEQ ID NO: 2544893 - RNA, 23 nt, Human
agcugugcucuggacaggcaugu

SEQ ID NO: 2544894 - RNA, 21 nt, Human
agcugugcucuggacaggcau

SEQ ID NO: 2544895 - RNA, 21 nt, Human
agcugucacuucgcgugcccu

SEQ ID NO: 2544896 - RNA, 14 nt, Human
agcugucccuguca

SEQ ID NO: 2544897 - RNA, 15 nt, Human
agcugucccugucac

SEQ ID NO: 2544898 - RNA, 18 nt, Human
agcugucccugucaccaa

SEQ ID NO: 2544899 - RNA, 22 nt, Human
agcugucccugucaccaagcuc

SEQ ID NO: 2544900 - RNA, 20 nt, Human
agcuggcucugagcgccucc

SEQ ID NO: 2544901 - RNA, 19 nt, Human
agcuggcucugagcgccuc

SEQ ID NO: 2544902 - RNA, 14 nt, Human
agcuggcucugagc

SEQ ID NO: 2544903 - RNA, 13 nt, Human
agcuggcucugag

SEQ ID NO: 2544904 - RNA, 23 nt, Human
agcuggcucugagcgccuccauc

SEQ ID NO: 2544905 - RNA, 18 nt, Human
agcuggcccgugacagac

SEQ ID NO: 2544906 - RNA, 21 nt, Human
agcuggccgaggguccuggcu

SEQ ID NO: 2544907 - RNA, 15 nt, Human
agcuggcccgugaca

SEQ ID NO: 2544908 - RNA, 16 nt, Human
agcuggcagcagagug

SEQ ID NO: 2544909 - RNA, 20 nt, Human
agcuggccgaggguccuggc

SEQ ID NO: 2544910 - RNA, 19 nt, Human
agcuggccccgccgccugg

SEQ ID NO: 2544911 - RNA, 18 nt, Human
agcuggccccgccgccug

SEQ ID NO: 2544912 - RNA, 15 nt, Human
agcuggccccgccgc

SEQ ID NO: 2544913 - RNA, 14 nt, Human
agcuggccccgccg

SEQ ID NO: 2544914 - RNA, 16 nt, Human
ugccugcccaggcccc

SEQ ID NO: 2544915 - RNA, 24 nt, Human
ugccugcccaggccccugccaccc

SEQ ID NO: 2544916 - RNA, 15 nt, Human
ugccugcccaggccc

SEQ ID NO: 2544917 - RNA, 14 nt, Human
ugccugcccaggcc

SEQ ID NO: 2544918 - RNA, 15 nt, Human
ugccugccugucugu

SEQ ID NO: 2544919 - RNA, 14 nt, Human
ugccugccugucug

SEQ ID NO: 2544920 - RNA, 15 nt, Human
ugccugcccuauucu

SEQ ID NO: 2544921 - RNA, 12 nt, Human
ugccugccccgc

SEQ ID NO: 2544922 - RNA, 18 nt, Human
ugccugccccccucaucu

SEQ ID NO: 2544923 - RNA, 17 nt, Human
ugccugccccgccccca

SEQ ID NO: 2544924 - RNA, 20 nt, Human
ugccugccccaaacaaauau

SEQ ID NO: 2544925 - RNA, 18 nt, Human
ugccugccccaaacaaau

SEQ ID NO: 2544926 - RNA, 15 nt, Human
ugccucugccucuga

SEQ ID NO: 2544927 - RNA, 13 nt, Human
ugccugcccaggc

SEQ ID NO: 2544928 - RNA, 14 nt, Human
ugccucugccucug

SEQ ID NO: 2544929 - RNA, 13 nt, Human
ugccucugccucu

SEQ ID NO: 2544930 - RNA, 14 nt, Human
ugcccaggcagguc

SEQ ID NO: 2544931 - RNA, 13 nt, Human
ugcccaggcaggu

SEQ ID NO: 2544932 - RNA, 12 nt, Human
ugcccaggcagg

SEQ ID NO: 2544933 - RNA, 22 nt, Human
ugcccaggagagccagcccucc

SEQ ID NO: 2544934 - RNA, 23 nt, Human
ugcccaggagagccagcccuccc

SEQ ID NO: 2544935 - RNA, 21 nt, Human
ugcccaggagagccagcccuc

SEQ ID NO: 2544936 - RNA, 20 nt, Human
agcugccuguucagcuccag

SEQ ID NO: 2544937 - RNA, 13 nt, Human
agcugccucacuu

SEQ ID NO: 2544938 - RNA, 13 nt, Human
agcugccgaccag

SEQ ID NO: 2544939 - RNA, 17 nt, Human
agcugccgaccagagcc

SEQ ID NO: 2544940 - RNA, 18 nt, Human
agcugccgaccagagccc

SEQ ID NO: 2544941 - RNA, 15 nt, Human
ugccuggauggggcu

SEQ ID NO: 2544942 - RNA, 23 nt, Human
ugccuggaguguaugacugcaca

SEQ ID NO: 2544943 - RNA, 14 nt, Human
ugccuggauggggc

SEQ ID NO: 2544944 - RNA, 20 nt, Human
ugccuggagacuuagggcac

SEQ ID NO: 2544945 - RNA, 22 nt, Human
agcugccuguucagcuccagcu

SEQ ID NO: 2544946 - RNA, 21 nt, Human
agcugccuguucagcuccagc

SEQ ID NO: 2544947 - RNA, 21 nt, Human
agcugcuugggcuucauccuc

SEQ ID NO: 2544948 - RNA, 20 nt, Human
agcugcuugugucccuccug

SEQ ID NO: 2544949 - RNA, 15 nt, Human
agcugcuuguguccc

SEQ ID NO: 2544950 - RNA, 14 nt, Human
agcugcuugugucc

SEQ ID NO: 2544951 - RNA, 19 nt, Human
agcugccuguucagcucca

SEQ ID NO: 2544952 - RNA, 20 nt, Human
agcugcuuucuguugucauu

SEQ ID NO: 2544953 - RNA, 19 nt, Human
agcugcuuucuguugucau

SEQ ID NO: 2544954 - RNA, 21 nt, Human
agcugcuugugucccuccugg

SEQ ID NO: 2544955 - RNA, 21 nt, Human
agcugcuuuugucuaugggac

SEQ ID NO: 2544956 - RNA, 14 nt, Human
agcuggaugagaau

SEQ ID NO: 2544957 - RNA, 20 nt, Human
agcuggaugauggucuucag

SEQ ID NO: 2544958 - RNA, 22 nt, Human
agcuggaucuccauucucucag

SEQ ID NO: 2544959 - RNA, 19 nt, Human
agcuggcaaagguggcucu

SEQ ID NO: 2544960 - RNA, 23 nt, Human
agcuggauuggguuaugaauauu

SEQ ID NO: 2544961 - RNA, 15 nt, Human
agcuggcauuacagc

SEQ ID NO: 2544962 - RNA, 21 nt, Human
agcuggcauuacagcuggaga

SEQ ID NO: 2544963 - RNA, 13 nt, Human
agcuggccccgcc

SEQ ID NO: 2544964 - RNA, 18 nt, Human
aggguguggcccugccau

SEQ ID NO: 2544965 - RNA, 23 nt, Human
aggguggugcugggacugagcca

SEQ ID NO: 2544966 - RNA, 17 nt, Human
aggguggugcugggacu

SEQ ID NO: 2544967 - RNA, 16 nt, Human
aggguggugcugggac

SEQ ID NO: 2544968 - RNA, 14 nt, Human
aggguggugcuggg

SEQ ID NO: 2544969 - RNA, 17 nt, Human
agggugguggagccagu

SEQ ID NO: 2544970 - RNA, 15 nt, Human
agggugguggagcca

SEQ ID NO: 2544971 - RNA, 22 nt, Human
aggguguccggucccuguccca

SEQ ID NO: 2544972 - RNA, 22 nt, Human
uggucuuuguaagaguguagaa

SEQ ID NO: 2544973 - RNA, 21 nt, Human
uggucuuuguaagaguguaga

SEQ ID NO: 2544974 - RNA, 15 nt, Human
uggucuuuguaagag

SEQ ID NO: 2544975 - RNA, 14 nt, Human
uggucuuuguaaga

SEQ ID NO: 2544976 - RNA, 21 nt, Human
aggguggugaccucugccuga

SEQ ID NO: 2544977 - RNA, 13 nt, Human
aggguuaagaaaa

SEQ ID NO: 2544978 - RNA, 14 nt, Human
aggguguuuaugua

SEQ ID NO: 2544979 - RNA, 17 nt, Human
aggguuaagaaaagaga

SEQ ID NO: 2544980 - RNA, 21 nt, Human
aggguguugggauacugcagg

SEQ ID NO: 2544981 - RNA, 22 nt, Human
aggguguggcccugccaucuuc

SEQ ID NO: 2544982 - RNA, 12 nt, Human
agggugugugcu

SEQ ID NO: 2544983 - RNA, 13 nt, Human
aggguuauaauaa

SEQ ID NO: 2544984 - RNA, 17 nt, Human
aggguuaugauuaagua

SEQ ID NO: 2544985 - RNA, 13 nt, Human
aggguuagggagg

SEQ ID NO: 2544986 - RNA, 15 nt, Human
aggguuagggagggg

SEQ ID NO: 2544987 - RNA, 16 nt, Human
aggguuagggaggggu

SEQ ID NO: 2544988 - RNA, 18 nt, Human
aggguuacuaugcacaau

SEQ ID NO: 2544989 - RNA, 15 nt, Human
aggguuauauuuuac

SEQ ID NO: 2544990 - RNA, 20 nt, Human
uggucuuucuuacaaggaag

SEQ ID NO: 2544991 - RNA, 13 nt, Human
uggucuuuguaag

SEQ ID NO: 2544992 - RNA, 14 nt, Human
uggucuuuccucug

SEQ ID NO: 2544993 - RNA, 14 nt, Human
uggucuuucuggag

SEQ ID NO: 2544994 - RNA, 15 nt, Human
uggucuuucuggaga

SEQ ID NO: 2544995 - RNA, 17 nt, Human
uggucuuucuggagagg

SEQ ID NO: 2544996 - RNA, 22 nt, Human
uggucuuuccuaucauggagug

SEQ ID NO: 2544997 - RNA, 14 nt, Human
uggucuuuaaugaa

SEQ ID NO: 2544998 - RNA, 16 nt, Human
uggucuuguggaauug

SEQ ID NO: 2544999 - RNA, 20 nt, Human
uggucuuggcagcaccuguc

SEQ ID NO: 2545000 - RNA, 17 nt, Human
uggucuucccaggcugg

SEQ ID NO: 2545001 - RNA, 14 nt, Human
uggucuucccaggc

SEQ ID NO: 2545002 - RNA, 17 nt, Human
uggucuuggcagcaccu

SEQ ID NO: 2545003 - RNA, 17 nt, Human
uggucuugagaugucuu

SEQ ID NO: 2545004 - RNA, 15 nt, Human
uggucuucagccucu

SEQ ID NO: 2545005 - RNA, 14 nt, Human
uggucuucagccuc

SEQ ID NO: 2545006 - RNA, 18 nt, Human
uggucugaauguucugac

SEQ ID NO: 2545007 - RNA, 19 nt, Human
uggucugaauguucugaca

SEQ ID NO: 2545008 - RNA, 21 nt, Human
uggucugaauguucugacauu

SEQ ID NO: 2545009 - RNA, 22 nt, Human
uggucugaauguucugacauua

SEQ ID NO: 2545010 - RNA, 17 nt, Human
uggucugacccacugcu

SEQ ID NO: 2545011 - RNA, 16 nt, Human
uggucugacccacugc

SEQ ID NO: 2545012 - RNA, 22 nt, Human
uggucuccuuggaaauccgucu

SEQ ID NO: 2545013 - RNA, 23 nt, Human
uggucuccucagccuccucaucu

SEQ ID NO: 2545014 - RNA, 13 nt, Human
uggucugaauguu

SEQ ID NO: 2545015 - RNA, 14 nt, Human
uggucugaauguuc

SEQ ID NO: 2545016 - RNA, 15 nt, Human
uggucugaauguucu

SEQ ID NO: 2545017 - RNA, 16 nt, Human
uggucugaauguucug

SEQ ID NO: 2545018 - RNA, 17 nt, Human
uggucugaauguucuga

SEQ ID NO: 2545019 - RNA, 19 nt, Human
uggucucagcagcgaccac

SEQ ID NO: 2545020 - RNA, 22 nt, Human
uggucucagcagcgaccacccc

SEQ ID NO: 2545021 - RNA, 17 nt, Human
uggucuccucagccucc

SEQ ID NO: 2545022 - RNA, 16 nt, Human
uggucuccuuggaaau

SEQ ID NO: 2545023 - RNA, 16 nt, Human
uggucccaccccacac

SEQ ID NO: 2545024 - RNA, 19 nt, Human
uggucuaucuuugagcgcc

SEQ ID NO: 2545025 - RNA, 21 nt, Human
uggucauagcccagaucagcu

SEQ ID NO: 2545026 - RNA, 16 nt, Human
uggucucaaacucuug

SEQ ID NO: 2545027 - RNA, 23 nt, Human
uggucucaaacucuugaccucag

SEQ ID NO: 2545028 - RNA, 17 nt, Human
uggucucaaacucuuga

SEQ ID NO: 2545029 - RNA, 12 nt, Human
uggucucagaaa

SEQ ID NO: 2545030 - RNA, 14 nt, Human
uggucuccacuggg

SEQ ID NO: 2545031 - RNA, 15 nt, Human
uggucuauugucugu

SEQ ID NO: 2545032 - RNA, 18 nt, Human
uggucucaaacuccugac

SEQ ID NO: 2545033 - RNA, 18 nt, Human
uggucaccaaaucagcug

SEQ ID NO: 2545034 - RNA, 22 nt, Human
uggucagauuugaacucuucaa

SEQ ID NO: 2545035 - RNA, 11 nt, Human
uggucagccca

SEQ ID NO: 2545036 - RNA, 12 nt, Human
uggucagcccaa

SEQ ID NO: 2545037 - RNA, 10 nt, Human
uggucagccc

SEQ ID NO: 2545038 - RNA, 20 nt, Human
uggucaccaaaucagcugcu

SEQ ID NO: 2545039 - RNA, 15 nt, Human
uggucccaccccaca

SEQ ID NO: 2545040 - RNA, 14 nt, Human
uggucccaccccac

SEQ ID NO: 2545041 - RNA, 15 nt, Human
uggucagcccuaggg

SEQ ID NO: 2545042 - RNA, 19 nt, Human
uggucagcccuagggugga

SEQ ID NO: 2545043 - RNA, 17 nt, Human
uggucacagggcaugcc

SEQ ID NO: 2545044 - RNA, 13 nt, Human
uggucacagggca

SEQ ID NO: 2545045 - RNA, 17 nt, Human
uggucagcguugcaugu

SEQ ID NO: 2545046 - RNA, 16 nt, Human
uggucagcguugcaug

SEQ ID NO: 2545047 - RNA, 22 nt, Human
uggucagcccuaggguggagag

SEQ ID NO: 2545048 - RNA, 19 nt, Human
uggucagcucccuucucug

SEQ ID NO: 2545049 - RNA, 13 nt, Human
uggucagcucccu

SEQ ID NO: 2545050 - RNA, 15 nt, Human
aggguugggcccaga

SEQ ID NO: 2545051 - RNA, 17 nt, Human
aggguuggccccugccc

SEQ ID NO: 2545052 - RNA, 23 nt, Human
aggguuggccccugcccggcugc

SEQ ID NO: 2545053 - RNA, 18 nt, Human
aggguuggccccugcccg

SEQ ID NO: 2545054 - RNA, 23 nt, Human
agguacuucaaauccuugaagau

SEQ ID NO: 2545055 - RNA, 17 nt, Human
agguagaaauaucugaa

SEQ ID NO: 2545056 - RNA, 19 nt, Human
agguagaaauaucugaaaa

SEQ ID NO: 2545057 - RNA, 12 nt, Human
agguaggguuua

SEQ ID NO: 2545058 - RNA, 15 nt, Human
agguaggguuuaauc

SEQ ID NO: 2545059 - RNA, 20 nt, Human
agguagguggaucaccugag

SEQ ID NO: 2545060 - RNA, 23 nt, Human
agguagaaauaucugaaaaugua

SEQ ID NO: 2545061 - RNA, 23 nt, Human
agguauaauucacauuguauuca

SEQ ID NO: 2545062 - RNA, 19 nt, Human
agguauaaguggugugugu

SEQ ID NO: 2545063 - RNA, 20 nt, Human
agguauaaguggugugugua

SEQ ID NO: 2545064 - RNA, 11 nt, Human
agguauaauuu

SEQ ID NO: 2545065 - RNA, 15 nt, Human
agguauaauuuuaug

SEQ ID NO: 2545066 - RNA, 21 nt, Human
agguaugcaaucaaaucugcu

SEQ ID NO: 2545067 - RNA, 21 nt, Human
aggucacuggcucuccaagug

SEQ ID NO: 2545068 - RNA, 20 nt, Human
aggucacuggcucuccaagu

SEQ ID NO: 2545069 - RNA, 18 nt, Human
aggucauggaauggaaac

SEQ ID NO: 2545070 - RNA, 19 nt, Human
aggucacuggcucuccaag

SEQ ID NO: 2545071 - RNA, 18 nt, Human
aggucacuggcucuccaa

SEQ ID NO: 2545072 - RNA, 17 nt, Human
aggucacuggcucucca

SEQ ID NO: 2545073 - RNA, 16 nt, Human
aggucacuggcucucc

SEQ ID NO: 2545074 - RNA, 12 nt, Human
aggucagagccu

SEQ ID NO: 2545075 - RNA, 17 nt, Human
aggucauuuuuuuuaag

SEQ ID NO: 2545076 - RNA, 20 nt, Human
aggucauuuuuuuuaagaaa

SEQ ID NO: 2545077 - RNA, 18 nt, Human
agguccagcucuggaggg

SEQ ID NO: 2545078 - RNA, 23 nt, Human
agguccagcucuggaggggaggg

SEQ ID NO: 2545079 - RNA, 11 nt, Human
aggucccaggc

SEQ ID NO: 2545080 - RNA, 12 nt, Human
aggucccaggca

SEQ ID NO: 2545081 - RNA, 13 nt, Human
aggucccaggcag

SEQ ID NO: 2545082 - RNA, 18 nt, Human
aggucaccuuuauucugg

SEQ ID NO: 2545083 - RNA, 19 nt, Human
aggucacauucaggaagau

SEQ ID NO: 2545084 - RNA, 18 nt, Human
aggucacauucaggaaga

SEQ ID NO: 2545085 - RNA, 15 nt, Human
aggucacccuuugcu

SEQ ID NO: 2545086 - RNA, 12 nt, Human
aggucaccagca

SEQ ID NO: 2545087 - RNA, 19 nt, Human
aggucaccuuuauucuggc

SEQ ID NO: 2545088 - RNA, 19 nt, Human
aggucacuagauggcgagc

SEQ ID NO: 2545089 - RNA, 14 nt, Human
aggucacuccuggg

SEQ ID NO: 2545090 - RNA, 15 nt, Human
aggucacuccugggg

SEQ ID NO: 2545091 - RNA, 18 nt, Human
aggucacuccuggggccu

SEQ ID NO: 2545092 - RNA, 15 nt, Human
aggucacuggcucuc

SEQ ID NO: 2545093 - RNA, 14 nt, Human
aggucacuggcucu

SEQ ID NO: 2545094 - RNA, 21 nt, Human
aggucacuggaaaggggagag

SEQ ID NO: 2545095 - RNA, 20 nt, Human
aggucacuggaaaggggaga

SEQ ID NO: 2545096 - RNA, 16 nt, Human
aggucacuggaaaggg

SEQ ID NO: 2545097 - RNA, 23 nt, Human
aggucacucuuccugcaaggacu

SEQ ID NO: 2545098 - RNA, 21 nt, Human
aggucacucuuccugcaagga

SEQ ID NO: 2545099 - RNA, 19 nt, Human
aggucacuccuggggccuc

SEQ ID NO: 2545100 - RNA, 19 nt, Human
aggucaaguaagaagacau

SEQ ID NO: 2545101 - RNA, 22 nt, Human
aggucaaguaagaagacaugaa

SEQ ID NO: 2545102 - RNA, 17 nt, Human
agguauucgugcagcau

SEQ ID NO: 2545103 - RNA, 18 nt, Human
aggucaauacaguacagg

SEQ ID NO: 2545104 - RNA, 15 nt, Human
aggucacauucagga

SEQ ID NO: 2545105 - RNA, 23 nt, Human
aggucacacgaggggccccgugu

SEQ ID NO: 2545106 - RNA, 23 nt, Human
aggucaauacaguacaggcagca

SEQ ID NO: 2545107 - RNA, 21 nt, Human
aggucaaugccagagacggaa

SEQ ID NO: 2545108 - RNA, 21 nt, Human
aggucaauacaguacaggcag

SEQ ID NO: 2545109 - RNA, 22 nt, Human
aggucaauacaguacaggcagc

SEQ ID NO: 2545110 - RNA, 20 nt, Human
agguauguugccuuuauggu

SEQ ID NO: 2545111 - RNA, 14 nt, Human
agguauguugccuu

SEQ ID NO: 2545112 - RNA, 20 nt, Human
agguauggaaggguuugugg

SEQ ID NO: 2545113 - RNA, 22 nt, Human
agguauggaaggguuuguggcu

SEQ ID NO: 2545114 - RNA, 22 nt, Human
agguauuccuuuuguguacagu

SEQ ID NO: 2545115 - RNA, 20 nt, Human
agguauucaauauccuuugc

SEQ ID NO: 2545116 - RNA, 20 nt, Human
agggguugccacaggccucc

SEQ ID NO: 2545117 - RNA, 16 nt, Human
agggucucuagugcug

SEQ ID NO: 2545118 - RNA, 18 nt, Human
agggucucuagugcugug

SEQ ID NO: 2545119 - RNA, 20 nt, Human
agggucucuagugcugugaa

SEQ ID NO: 2545120 - RNA, 15 nt, Human
agggucucugcugcc

SEQ ID NO: 2545121 - RNA, 14 nt, Human
agggucucugcugc

SEQ ID NO: 2545122 - RNA, 13 nt, Human
agggucucugcug

SEQ ID NO: 2545123 - RNA, 21 nt, Human
agggucucuagugcugugaaa

SEQ ID NO: 2545124 - RNA, 22 nt, Human
agggucucuagugcugugaaaa

SEQ ID NO: 2545125 - RNA, 21 nt, Human
agggucucacucugucgccca

SEQ ID NO: 2545126 - RNA, 22 nt, Human
agggucucacucugucgcccag

SEQ ID NO: 2545127 - RNA, 12 nt, Human
aggguggagacu

SEQ ID NO: 2545128 - RNA, 16 nt, Human
agggucucugcugccg

SEQ ID NO: 2545129 - RNA, 14 nt, Human
aggguggcagguga

SEQ ID NO: 2545130 - RNA, 21 nt, Human
aggguggagacuaagcccugu

SEQ ID NO: 2545131 - RNA, 15 nt, Human
aggguggcaucccag

SEQ ID NO: 2545132 - RNA, 21 nt, Human
aggguggcaucccaguggccu

SEQ ID NO: 2545133 - RNA, 21 nt, Human
aggguggcuggguccagggga

SEQ ID NO: 2545134 - RNA, 18 nt, Human
aggguggcccuugcaguu

SEQ ID NO: 2545135 - RNA, 11 nt, Human
aggguggcccu

SEQ ID NO: 2545136 - RNA, 14 nt, Human
aggguggcccuugc

SEQ ID NO: 2545137 - RNA, 16 nt, Human
agggugggagagccca

SEQ ID NO: 2545138 - RNA, 17 nt, Human
agggugggagagcccag

SEQ ID NO: 2545139 - RNA, 18 nt, Human
agggugggagagcccagc

SEQ ID NO: 2545140 - RNA, 19 nt, Human
agggugggagagcccagcc

SEQ ID NO: 2545141 - RNA, 21 nt, Human
ugggucgcccuggacugugug

SEQ ID NO: 2545142 - RNA, 23 nt, Human
ugggucuaagggguugguugagg

SEQ ID NO: 2545143 - RNA, 20 nt, Human
ugggucucgcuuuguugccc

SEQ ID NO: 2545144 - RNA, 17 nt, Human
ugggucuggcugagcug

SEQ ID NO: 2545145 - RNA, 15 nt, Human
ugggucuggcugagc

SEQ ID NO: 2545146 - RNA, 19 nt, Human
ugggucugagucauggccg

SEQ ID NO: 2545147 - RNA, 22 nt, Human
ugggucucgcuuuguugcccag

SEQ ID NO: 2545148 - RNA, 12 nt, Human
ugggucugugug

SEQ ID NO: 2545149 - RNA, 14 nt, Human
ugggucugugucuc

SEQ ID NO: 2545150 - RNA, 19 nt, Human
ugggucugugucucuuuuc

SEQ ID NO: 2545151 - RNA, 20 nt, Human
ugggucugugucucuuuucu

SEQ ID NO: 2545152 - RNA, 19 nt, Human
ugggugcuuggaggaagga

SEQ ID NO: 2545153 - RNA, 15 nt, Human
ugggugcuuggagga

SEQ ID NO: 2545154 - RNA, 22 nt, Human
ugggugcuuggaggaaggaaac

SEQ ID NO: 2545155 - RNA, 22 nt, Human
uggguggcaccagcagccugga

SEQ ID NO: 2545156 - RNA, 13 nt, Human
ugggugcucccua

SEQ ID NO: 2545157 - RNA, 22 nt, Human
ugguaggaccaagcaucuuggg

SEQ ID NO: 2545158 - RNA, 16 nt, Human
ugguaggaccaagcau

SEQ ID NO: 2545159 - RNA, 20 nt, Human
uggucacaggacucugccuc

SEQ ID NO: 2545160 - RNA, 23 nt, Human
uggucacaggacucugccuccuc

SEQ ID NO: 2545161 - RNA, 22 nt, Human
uggucacaggacucugccuccu

SEQ ID NO: 2545162 - RNA, 20 nt, Human
ugguaggaacugcugggcuu

SEQ ID NO: 2545163 - RNA, 17 nt, Human
ugguagcuuuucccuuc

SEQ ID NO: 2545164 - RNA, 19 nt, Human
ugguacuuauuacugcuaa

SEQ ID NO: 2545165 - RNA, 13 nt, Human
ugguaggaacugc

SEQ ID NO: 2545166 - RNA, 21 nt, Human
ugguagcuuuucccuucuuuu

SEQ ID NO: 2545167 - RNA, 17 nt, Human
ugguacucuccuagaga

SEQ ID NO: 2545168 - RNA, 13 nt, Human
ugguacucuccua

SEQ ID NO: 2545169 - RNA, 20 nt, Human
ugguagcuuuucccuucuuu

SEQ ID NO: 2545170 - RNA, 18 nt, Human
ugguacuuauuacugcua

SEQ ID NO: 2545171 - RNA, 17 nt, Human
ugguacuuauuacugcu

SEQ ID NO: 2545172 - RNA, 16 nt, Human
ugguacuaacuuuccu

SEQ ID NO: 2545173 - RNA, 20 nt, Human
ugguacuacuagaugucuuu

SEQ ID NO: 2545174 - RNA, 18 nt, Human
ugguacggagauguuuca

SEQ ID NO: 2545175 - RNA, 17 nt, Human
ugguacucauuaaaaaa

SEQ ID NO: 2545176 - RNA, 15 nt, Human
ugguaaucuugcucu

SEQ ID NO: 2545177 - RNA, 22 nt, Human
ugguaauuauuuugguacuuuu

SEQ ID NO: 2545178 - RNA, 21 nt, Human
ugguaauuaucauuuuagaag

SEQ ID NO: 2545179 - RNA, 14 nt, Human
ugguaauauugacu

SEQ ID NO: 2545180 - RNA, 23 nt, Human
aggggacgcugguagagauggag

SEQ ID NO: 2545181 - RNA, 20 nt, Human
ugguaaggggaauugaggac

SEQ ID NO: 2545182 - RNA, 15 nt, Human
ugguaagcucuggcu

SEQ ID NO: 2545183 - RNA, 14 nt, Human
ugguaagcucuggc

SEQ ID NO: 2545184 - RNA, 13 nt, Human
ugguaagcucugg

SEQ ID NO: 2545185 - RNA, 13 nt, Human
uggguggggcugc

SEQ ID NO: 2545186 - RNA, 12 nt, Human
ugggugggagag

SEQ ID NO: 2545187 - RNA, 16 nt, Human
ugggugggcaggaaaa

SEQ ID NO: 2545188 - RNA, 15 nt, Human
uggguggccucggga

SEQ ID NO: 2545189 - RNA, 21 nt, Human
uggguggcccauccccccuca

SEQ ID NO: 2545190 - RNA, 15 nt, Human
uggguggcccauccc

SEQ ID NO: 2545191 - RNA, 14 nt, Human
uggguggcccaucc

SEQ ID NO: 2545192 - RNA, 14 nt, Human
ugggugcuggcugc

SEQ ID NO: 2545193 - RNA, 15 nt, Human
uggguggcacugcca

SEQ ID NO: 2545194 - RNA, 18 nt, Human
ugggugcuggcugcccag

SEQ ID NO: 2545195 - RNA, 16 nt, Human
uggguggggggcuuca

SEQ ID NO: 2545196 - RNA, 19 nt, Human
ugggugggcucugugcagu

SEQ ID NO: 2545197 - RNA, 16 nt, Human
ugggugggcucugugc

SEQ ID NO: 2545198 - RNA, 15 nt, Human
ugggugggcucugug

SEQ ID NO: 2545199 - RNA, 18 nt, Human
ugggugggcaggaaaagg

SEQ ID NO: 2545200 - RNA, 21 nt, Human
uggguggggcugcuccuccag

SEQ ID NO: 2545201 - RNA, 23 nt, Human
agggucucacuauguugcccagg

SEQ ID NO: 2545202 - RNA, 22 nt, Human
agggucucacuauguugcccag

SEQ ID NO: 2545203 - RNA, 19 nt, Human
agggguugccacaggccuc

SEQ ID NO: 2545204 - RNA, 16 nt, Human
agggguugccacaggc

SEQ ID NO: 2545205 - RNA, 18 nt, Human
agggguugcagugagcgg

SEQ ID NO: 2545206 - RNA, 23 nt, Human
agggguugagcagggauccuggu

SEQ ID NO: 2545207 - RNA, 21 nt, Human
agggucucacuauguugccca

SEQ ID NO: 2545208 - RNA, 20 nt, Human
agggguucgagaccagucug

SEQ ID NO: 2545209 - RNA, 15 nt, Human
agggguucgagacca

SEQ ID NO: 2545210 - RNA, 18 nt, Human
agggguguggcagugguu

SEQ ID NO: 2545211 - RNA, 15 nt, Human
agggguguggcuccu

SEQ ID NO: 2545212 - RNA, 16 nt, Human
agggguguggcagugg

SEQ ID NO: 2545213 - RNA, 18 nt, Human
aggggugguccugacuca

SEQ ID NO: 2545214 - RNA, 24 nt, Human
agggguucccuuuuuuggcugcug

SEQ ID NO: 2545215 - RNA, 24 nt, Human
aggggugucuugggcagagcuggc

SEQ ID NO: 2545216 - RNA, 22 nt, Human
aggggugucuugggcagagcug

SEQ ID NO: 2545217 - RNA, 14 nt, Human
aggggugucuuggg

SEQ ID NO: 2545218 - RNA, 13 nt, Human
aggggugguccug

SEQ ID NO: 2545219 - RNA, 15 nt, Human
aggggugguccugac

SEQ ID NO: 2545220 - RNA, 18 nt, Human
aggggguggccucccaac

SEQ ID NO: 2545221 - RNA, 17 nt, Human
aggggguggccucccaa

SEQ ID NO: 2545222 - RNA, 20 nt, Human
agggggauccgacugcuuug

SEQ ID NO: 2545223 - RNA, 19 nt, Human
agggggauccgacugcuuu

SEQ ID NO: 2545224 - RNA, 15 nt, Human
aggggguggccuccc

SEQ ID NO: 2545225 - RNA, 23 nt, Human
agggggugauuagagggaggaga

SEQ ID NO: 2545226 - RNA, 20 nt, Human
aggggugggacacccuguga

SEQ ID NO: 2545227 - RNA, 22 nt, Human
aggggugggacacccugugaug

SEQ ID NO: 2545228 - RNA, 19 nt, Human
agggguggggguggaggcu

SEQ ID NO: 2545229 - RNA, 15 nt, Human
aggggguggaggggu

SEQ ID NO: 2545230 - RNA, 20 nt, Human
agggguggguuccucuuccc

SEQ ID NO: 2545231 - RNA, 21 nt, Human
agggguggguuccucuucccc

SEQ ID NO: 2545232 - RNA, 20 nt, Human
aggggcuagaaccuagagaa

SEQ ID NO: 2545233 - RNA, 18 nt, Human
aggggcuacaagagggaa

SEQ ID NO: 2545234 - RNA, 15 nt, Human
aggggcucaggaaaa

SEQ ID NO: 2545235 - RNA, 22 nt, Human
agggggaaggugggguccugga

SEQ ID NO: 2545236 - RNA, 15 nt, Human
agggggaaggcaggg

SEQ ID NO: 2545237 - RNA, 21 nt, Human
agggggagccccuucugcuca

SEQ ID NO: 2545238 - RNA, 22 nt, Human
agggggagccccuucugcucag

SEQ ID NO: 2545239 - RNA, 17 nt, Human
agggggauaugaaugga

SEQ ID NO: 2545240 - RNA, 18 nt, Human
aggggcgcuggcccagcc

SEQ ID NO: 2545241 - RNA, 17 nt, Human
aggggcgcuggcccagc

SEQ ID NO: 2545242 - RNA, 16 nt, Human
aggggcgcuggcccag

SEQ ID NO: 2545243 - RNA, 15 nt, Human
aggggcgcuggccca

SEQ ID NO: 2545244 - RNA, 14 nt, Human
aggggcgcuggccc

SEQ ID NO: 2545245 - RNA, 13 nt, Human
aggggcgcuggcc

SEQ ID NO: 2545246 - RNA, 20 nt, Human
aggggcgcucgcuuccgcau

SEQ ID NO: 2545247 - RNA, 16 nt, Human
aggggcgcccaccucc

SEQ ID NO: 2545248 - RNA, 22 nt, Human
aggggcgcuggcccagccggcc

SEQ ID NO: 2545249 - RNA, 21 nt, Human
aggggcgcuggcccagccggc

SEQ ID NO: 2545250 - RNA, 20 nt, Human
aggggcgcuggcccagccgg

SEQ ID NO: 2545251 - RNA, 19 nt, Human
aggggcgcuggcccagccg

SEQ ID NO: 2545252 - RNA, 18 nt, Human
aggggcgggacccaggca

SEQ ID NO: 2545253 - RNA, 23 nt, Human
aggggcgcuggcccagccggccu

SEQ ID NO: 2545254 - RNA, 17 nt, Human
aggggcuacaagaggga

SEQ ID NO: 2545255 - RNA, 15 nt, Human
aggggcuacaagagg

SEQ ID NO: 2545256 - RNA, 14 nt, Human
aggggcguguggcu

SEQ ID NO: 2545257 - RNA, 17 nt, Human
aggggcguguggcucac

SEQ ID NO: 2545258 - RNA, 19 nt, Human
aggggcgggacccaggcac

SEQ ID NO: 2545259 - RNA, 16 nt, Human
aggggcgucuguuccc

SEQ ID NO: 2545260 - RNA, 19 nt, Human
aggggcgucuguucccccu

SEQ ID NO: 2545261 - RNA, 21 nt, Human
aggggcgucuguucccccuuc

SEQ ID NO: 2545262 - RNA, 22 nt, Human
aggggcguggagggcguggagg

SEQ ID NO: 2545263 - RNA, 22 nt, Human
aggggcgucuguucccccuuca

SEQ ID NO: 2545264 - RNA, 20 nt, Human
aggggcgugggaguggccug

SEQ ID NO: 2545265 - RNA, 22 nt, Human
aggggacucagcccugagguga

SEQ ID NO: 2545266 - RNA, 14 nt, Human
aggggacucagccc

SEQ ID NO: 2545267 - RNA, 17 nt, Human
aggggacucagcccuga

SEQ ID NO: 2545268 - RNA, 19 nt, Human
uggggucacucuggcagcu

SEQ ID NO: 2545269 - RNA, 20 nt, Human
uggggucacucuggcagcuc

SEQ ID NO: 2545270 - RNA, 21 nt, Human
ugggguaggaggaugggcucg

SEQ ID NO: 2545271 - RNA, 19 nt, Human
aggggacuauuuaugaagg

SEQ ID NO: 2545272 - RNA, 17 nt, Human
aggggagagccugcugg

SEQ ID NO: 2545273 - RNA, 16 nt, Human
aggggagagccugcug

SEQ ID NO: 2545274 - RNA, 15 nt, Human
aggggagagccugcu

SEQ ID NO: 2545275 - RNA, 15 nt, Human
aggggccuggcagcc

SEQ ID NO: 2545276 - RNA, 23 nt, Human
aggggagcaaaaucgaugcagug

SEQ ID NO: 2545277 - RNA, 23 nt, Human
aggggccuggcagccgugccuuc

SEQ ID NO: 2545278 - RNA, 18 nt, Human
aggggccuggcagccgug

SEQ ID NO: 2545279 - RNA, 22 nt, Human
aggggagagccugcuggcaccc

SEQ ID NO: 2545280 - RNA, 10 nt, Human
aggggagagg

SEQ ID NO: 2545281 - RNA, 14 nt, Human
aggggcgcccaccu

SEQ ID NO: 2545282 - RNA, 17 nt, Human
aggggagagggucugga

SEQ ID NO: 2545283 - RNA, 23 nt, Human
aggggcgccgcaaaccacacugg

SEQ ID NO: 2545284 - RNA, 13 nt, Human
ugggccagacaug

SEQ ID NO: 2545285 - RNA, 18 nt, Human
ugggccagacaugccaca

SEQ ID NO: 2545286 - RNA, 18 nt, Human
ugggccagaauuucaaac

SEQ ID NO: 2545287 - RNA, 19 nt, Human
ugggccagacaugccacaa

SEQ ID NO: 2545288 - RNA, 13 nt, Human
ugggccagccccu

SEQ ID NO: 2545289 - RNA, 14 nt, Human
ugggccagccccuc

SEQ ID NO: 2545290 - RNA, 15 nt, Human
ugggccagccccucc

SEQ ID NO: 2545291 - RNA, 13 nt, Human
ugggccaggagcc

SEQ ID NO: 2545292 - RNA, 16 nt, Human
ugggccagccccuccc

SEQ ID NO: 2545293 - RNA, 18 nt, Human
ugggccagccccucccac

SEQ ID NO: 2545294 - RNA, 20 nt, Human
ugggccagccccucccacca

SEQ ID NO: 2545295 - RNA, 14 nt, Human
ugggccaggacagg

SEQ ID NO: 2545296 - RNA, 22 nt, Human
ugggccagccccucccaccaca

SEQ ID NO: 2545297 - RNA, 23 nt, Human
ugggccagccccucccaccacag

SEQ ID NO: 2545298 - RNA, 16 nt, Human
ugggccaggagccucc

SEQ ID NO: 2545299 - RNA, 14 nt, Human
ugggccaggagccu

SEQ ID NO: 2545300 - RNA, 20 nt, Human
ugggcccaaugcacuuuguu

SEQ ID NO: 2545301 - RNA, 19 nt, Human
ugggccauucuccacagca

SEQ ID NO: 2545302 - RNA, 20 nt, Human
ugggccauucuccacagcaa

SEQ ID NO: 2545303 - RNA, 17 nt, Human
ugggccaggacaggccc

SEQ ID NO: 2545304 - RNA, 18 nt, Human
ugggccaggacaggcccg

SEQ ID NO: 2545305 - RNA, 22 nt, Human
ugggccacuucuggguggggca

SEQ ID NO: 2545306 - RNA, 17 nt, Human
ugggccagaauuucaaa

SEQ ID NO: 2545307 - RNA, 16 nt, Human
ugggcacccacccugg

SEQ ID NO: 2545308 - RNA, 14 nt, Human
ugggcacccacccu

SEQ ID NO: 2545309 - RNA, 16 nt, Human
ugggcaccccacugca

SEQ ID NO: 2545310 - RNA, 21 nt, Human
ugggcacccagccucuaggga

SEQ ID NO: 2545311 - RNA, 20 nt, Human
ugggcacccacccugggacc

SEQ ID NO: 2545312 - RNA, 20 nt, Human
ugggcaacccccagccugcu

SEQ ID NO: 2545313 - RNA, 17 nt, Human
ugggcaacccccagccu

SEQ ID NO: 2545314 - RNA, 14 nt, Human
ugggcacaguuugg

SEQ ID NO: 2545315 - RNA, 22 nt, Human
ugggcacacgccucccacuggg

SEQ ID NO: 2545316 - RNA, 18 nt, Human
ugggaggucaaggcugca

SEQ ID NO: 2545317 - RNA, 19 nt, Human
ugggaggucaaggcugcag

SEQ ID NO: 2545318 - RNA, 20 nt, Human
ugggaggucaaggcugcagu

SEQ ID NO: 2545319 - RNA, 23 nt, Human
ugggaggucaaggcugcagugag

SEQ ID NO: 2545320 - RNA, 16 nt, Human
aggccuuccucucucc

SEQ ID NO: 2545321 - RNA, 18 nt, Human
aggccuuccucucuccag

SEQ ID NO: 2545322 - RNA, 22 nt, Human
aggccuucuccuccccacccgc

SEQ ID NO: 2545323 - RNA, 13 nt, Human
aggccuucuccuc

SEQ ID NO: 2545324 - RNA, 19 nt, Human
aggccuuccucucuccaga

SEQ ID NO: 2545325 - RNA, 17 nt, Human
ugggaggucaaggcugc

SEQ ID NO: 2545326 - RNA, 20 nt, Human
aggccuuaucauucauucuu

SEQ ID NO: 2545327 - RNA, 15 nt, Human
aggccuuccucucuc

SEQ ID NO: 2545328 - RNA, 19 nt, Human
aggccuuaucauucauucu

SEQ ID NO: 2545329 - RNA, 18 nt, Human
aggccuuaucauucauuc

SEQ ID NO: 2545330 - RNA, 17 nt, Human
aggccuuaucuccaaga

SEQ ID NO: 2545331 - RNA, 19 nt, Human
aggccuuaucuccaagacc

SEQ ID NO: 2545332 - RNA, 19 nt, Human
ugggauugugguacaaucu

SEQ ID NO: 2545333 - RNA, 21 nt, Human
ugggauugggggcuggugcca

SEQ ID NO: 2545334 - RNA, 19 nt, Human
ugggauugggggcuggugc

SEQ ID NO: 2545335 - RNA, 16 nt, Human
ugggcaacccccagcc

SEQ ID NO: 2545336 - RNA, 22 nt, Human
ugggauucuacuuuaagcacua

SEQ ID NO: 2545337 - RNA, 17 nt, Human
ugggauucuacuuuaag

SEQ ID NO: 2545338 - RNA, 24 nt, Human
ugggauuccugacccaggccgcag

SEQ ID NO: 2545339 - RNA, 22 nt, Human
ugggauuccugacccaggccgc

SEQ ID NO: 2545340 - RNA, 23 nt, Human
ugggauugacagaagcuucugcc

SEQ ID NO: 2545341 - RNA, 16 nt, Human
ugggauugagucugug

SEQ ID NO: 2545342 - RNA, 19 nt, Human
ugggauugagucugugcca

SEQ ID NO: 2545343 - RNA, 18 nt, Human
ugggauugggggcuggug

SEQ ID NO: 2545344 - RNA, 14 nt, Human
ugggauugggggcu

SEQ ID NO: 2545345 - RNA, 10 nt, Human
ugggauugcu

SEQ ID NO: 2545346 - RNA, 18 nt, Human
ugggagguggaagaaggg

SEQ ID NO: 2545347 - RNA, 19 nt, Human
ugggagguggaagaaggga

SEQ ID NO: 2545348 - RNA, 13 nt, Human
ugggaggucgagg

SEQ ID NO: 2545349 - RNA, 21 nt, Human
ugggauuccugacccaggccg

SEQ ID NO: 2545350 - RNA, 20 nt, Human
ugggauuccugacccaggcc

SEQ ID NO: 2545351 - RNA, 17 nt, Human
ugggauuccugacccag

SEQ ID NO: 2545352 - RNA, 16 nt, Human
ugggauuccugaccca

SEQ ID NO: 2545353 - RNA, 15 nt, Human
ugggauuccugaccc

SEQ ID NO: 2545354 - RNA, 23 nt, Human
ugggauucccaccaaggucuuca

SEQ ID NO: 2545355 - RNA, 20 nt, Human
ugggauucccaccaaggucu

SEQ ID NO: 2545356 - RNA, 17 nt, Human
ugggauucaggaaugug

SEQ ID NO: 2545357 - RNA, 22 nt, Human
ugggagguggaagaagggagaa

SEQ ID NO: 2545358 - RNA, 19 nt, Human
ugggagguugaucagaucu

SEQ ID NO: 2545359 - RNA, 20 nt, Human
ugggagguggagguugcagu

SEQ ID NO: 2545360 - RNA, 17 nt, Human
agggcagggacaggaua

SEQ ID NO: 2545361 - RNA, 16 nt, Human
agggcagcgccaggcu

SEQ ID NO: 2545362 - RNA, 22 nt, Human
agggcagggaccacacccugua

SEQ ID NO: 2545363 - RNA, 12 nt, Human
agggcagggacu

SEQ ID NO: 2545364 - RNA, 13 nt, Human
agggcagggcauc

SEQ ID NO: 2545365 - RNA, 14 nt, Human
agggcagcagggcu

SEQ ID NO: 2545366 - RNA, 15 nt, Human
agggcagcagggcua

SEQ ID NO: 2545367 - RNA, 14 nt, Human
agggcagcgccagg

SEQ ID NO: 2545368 - RNA, 22 nt, Human
agggccaggcaggugccuggac

SEQ ID NO: 2545369 - RNA, 21 nt, Human
agggccaggcaggugccugga

SEQ ID NO: 2545370 - RNA, 14 nt, Human
agggccaggcaggu

SEQ ID NO: 2545371 - RNA, 13 nt, Human
agggccaggcagg

SEQ ID NO: 2545372 - RNA, 12 nt, Human
agggccaggcag

SEQ ID NO: 2545373 - RNA, 10 nt, Human
agggccaggc

SEQ ID NO: 2545374 - RNA, 21 nt, Human
agggccaggacugagccccgc

SEQ ID NO: 2545375 - RNA, 19 nt, Human
agggccaggacugagcccc

SEQ ID NO: 2545376 - RNA, 17 nt, Human
agggccaggacugagcc

SEQ ID NO: 2545377 - RNA, 12 nt, Human
agggccaggacu

SEQ ID NO: 2545378 - RNA, 20 nt, Human
agggcagucauuggcugucu

SEQ ID NO: 2545379 - RNA, 16 nt, Human
agggccagagccaggg

SEQ ID NO: 2545380 - RNA, 16 nt, Human
agggcaggugcuucag

SEQ ID NO: 2545381 - RNA, 17 nt, Human
agggcagggccccaggc

SEQ ID NO: 2545382 - RNA, 15 nt, Human
agggcagggcucuga

SEQ ID NO: 2545383 - RNA, 16 nt, Human
agggcagggcucugau

SEQ ID NO: 2545384 - RNA, 12 nt, Human
agggcagggccc

SEQ ID NO: 2545385 - RNA, 12 nt, Human
agggcagggcca

SEQ ID NO: 2545386 - RNA, 17 nt, Human
agggcagggcaucuccu

SEQ ID NO: 2545387 - RNA, 18 nt, Human
agggcccagagagggugg

SEQ ID NO: 2545388 - RNA, 17 nt, Human
agggccaguccugccug

SEQ ID NO: 2545389 - RNA, 18 nt, Human
agggccaguccugccugg

SEQ ID NO: 2545390 - RNA, 23 nt, Human
agggcccagagaggguggugacc

SEQ ID NO: 2545391 - RNA, 12 nt, Human
agggccagggcc

SEQ ID NO: 2545392 - RNA, 14 nt, Human
agggccagggcccu

SEQ ID NO: 2545393 - RNA, 15 nt, Human
agggccagggcccug

SEQ ID NO: 2545394 - RNA, 19 nt, Human
agggccagggcccugcaga

SEQ ID NO: 2545395 - RNA, 21 nt, Human
agggccaggggucucccugga

SEQ ID NO: 2545396 - RNA, 20 nt, Human
agggccaggggucucccugg

SEQ ID NO: 2545397 - RNA, 22 nt, Human
agggccagggcccugcagaggg

SEQ ID NO: 2545398 - RNA, 13 nt, Human
agggccaguccug

SEQ ID NO: 2545399 - RNA, 16 nt, Human
agggccaguccugccu

SEQ ID NO: 2545400 - RNA, 14 nt, Human
agggcccagagcag

SEQ ID NO: 2545401 - RNA, 13 nt, Human
agggcccagagca

SEQ ID NO: 2545402 - RNA, 12 nt, Human
agggcccagagc

SEQ ID NO: 2545403 - RNA, 17 nt, Human
agggcccagagcaggaa

SEQ ID NO: 2545404 - RNA, 15 nt, Human
agggcccagagcagg

SEQ ID NO: 2545405 - RNA, 13 nt, Human
agggcccagagcc

SEQ ID NO: 2545406 - RNA, 14 nt, Human
agggcccagagccc

SEQ ID NO: 2545407 - RNA, 15 nt, Human
agggcccagagccca

SEQ ID NO: 2545408 - RNA, 15 nt, Human
agggccgagugagag

SEQ ID NO: 2545409 - RNA, 18 nt, Human
agggcccagagcaggaag

SEQ ID NO: 2545410 - RNA, 16 nt, Human
agggccguaccccacc

SEQ ID NO: 2545411 - RNA, 21 nt, Human
agggcagcagaaggggguggu

SEQ ID NO: 2545412 - RNA, 15 nt, Human
agggcagcagaaggg

SEQ ID NO: 2545413 - RNA, 19 nt, Human
agggcagagugagacccag

SEQ ID NO: 2545414 - RNA, 19 nt, Human
agggagugacagaggcagc

SEQ ID NO: 2545415 - RNA, 18 nt, Human
agggagugacagaggcag

SEQ ID NO: 2545416 - RNA, 17 nt, Human
agggagugacagaggca

SEQ ID NO: 2545417 - RNA, 20 nt, Human
agggaggucacuggaaaggg

SEQ ID NO: 2545418 - RNA, 15 nt, Human
agggaggggccuagg

SEQ ID NO: 2545419 - RNA, 19 nt, Human
agggaggggccuaggccuc

SEQ ID NO: 2545420 - RNA, 21 nt, Human
agggaggucacuggaaagggg

SEQ ID NO: 2545421 - RNA, 20 nt, Human
agggaggggccuaggccuca

SEQ ID NO: 2545422 - RNA, 17 nt, Human
agggaggugaccccagg

SEQ ID NO: 2545423 - RNA, 15 nt, Human
agggagggcuucugc

SEQ ID NO: 2545424 - RNA, 14 nt, Human
ugggccccagccca

SEQ ID NO: 2545425 - RNA, 13 nt, Human
ugggccccagccc

SEQ ID NO: 2545426 - RNA, 15 nt, Human
ugggccccagcccac

SEQ ID NO: 2545427 - RNA, 12 nt, Human
agggaggggccu

SEQ ID NO: 2545428 - RNA, 12 nt, Human
agggaggggacu

SEQ ID NO: 2545429 - RNA, 20 nt, Human
ugggcccaggaccagcuggg

SEQ ID NO: 2545430 - RNA, 19 nt, Human
ugggcccaggaccagcugg

SEQ ID NO: 2545431 - RNA, 18 nt, Human
ugggcccaggaccagcug

SEQ ID NO: 2545432 - RNA, 17 nt, Human
ugggcccaggaccagcu

SEQ ID NO: 2545433 - RNA, 22 nt, Human
ugggcccaggaccagcuggggc

SEQ ID NO: 2545434 - RNA, 21 nt, Human
ugggcccaggaccagcugggg

SEQ ID NO: 2545435 - RNA, 12 nt, Human
ugggcccaggga

SEQ ID NO: 2545436 - RNA, 22 nt, Human
ugggcccagggacaccagccag

SEQ ID NO: 2545437 - RNA, 13 nt, Human
ugggcccagggac

SEQ ID NO: 2545438 - RNA, 23 nt, Human
ugggcccaggaccagcuggggcg

SEQ ID NO: 2545439 - RNA, 19 nt, Human
ugggcccagggacaccagc

SEQ ID NO: 2545440 - RNA, 17 nt, Human
ugggccccaccaccuag

SEQ ID NO: 2545441 - RNA, 18 nt, Human
ugggccccaccaccuagg

SEQ ID NO: 2545442 - RNA, 23 nt, Human
ugggccccaccaccuaggccacu

SEQ ID NO: 2545443 - RNA, 15 nt, Human
ugggcccaggaccag

SEQ ID NO: 2545444 - RNA, 14 nt, Human
ugggcccaggacca

SEQ ID NO: 2545445 - RNA, 10 nt, Human
ugggcccagg

SEQ ID NO: 2545446 - RNA, 22 nt, Human
ugggcccagcugggcucugcca

SEQ ID NO: 2545447 - RNA, 20 nt, Human
ugggcccagcugggcucugc

SEQ ID NO: 2545448 - RNA, 19 nt, Human
ugggcccagcugggcucug

SEQ ID NO: 2545449 - RNA, 17 nt, Human
ugggcccagcugggcuc

SEQ ID NO: 2545450 - RNA, 16 nt, Human
ugggcccagcugggcu

SEQ ID NO: 2545451 - RNA, 15 nt, Human
ugggcccagcugggc

SEQ ID NO: 2545452 - RNA, 14 nt, Human
ugggcccagcuggg

SEQ ID NO: 2545453 - RNA, 13 nt, Human
ugggcccagcugg

SEQ ID NO: 2545454 - RNA, 12 nt, Human
ugggcccagcug

SEQ ID NO: 2545455 - RNA, 13 nt, Human
ugggcccagaucu

SEQ ID NO: 2545456 - RNA, 14 nt, Human
ugggcccagaucug

SEQ ID NO: 2545457 - RNA, 18 nt, Human
ugggcccaacccugucug

SEQ ID NO: 2545458 - RNA, 12 nt, Human
ugggcccagaag

SEQ ID NO: 2545459 - RNA, 16 nt, Human
ugggcccaacccuguc

SEQ ID NO: 2545460 - RNA, 14 nt, Human
ugggcccaacccug

SEQ ID NO: 2545461 - RNA, 22 nt, Human
ugggcccaagacagaugcccca

SEQ ID NO: 2545462 - RNA, 23 nt, Human
ugggcccaagacagaugccccag

SEQ ID NO: 2545463 - RNA, 23 nt, Human
ugggggaagagcacagcccuccc

SEQ ID NO: 2545464 - RNA, 22 nt, Human
ugggggaagagcacagcccucc

SEQ ID NO: 2545465 - RNA, 21 nt, Human
ugggggaagagcacagcccuc

SEQ ID NO: 2545466 - RNA, 19 nt, Human
ugggggaagagcacagccc

SEQ ID NO: 2545467 - RNA, 18 nt, Human
ugggggaagagcacagcc

SEQ ID NO: 2545468 - RNA, 17 nt, Human
ugggggaagaccuggca

SEQ ID NO: 2545469 - RNA, 20 nt, Human
ugggggaacucagauccagg

SEQ ID NO: 2545470 - RNA, 14 nt, Human
ugggguacccacug

SEQ ID NO: 2545471 - RNA, 15 nt, Human
ugggggaaagcacag

SEQ ID NO: 2545472 - RNA, 17 nt, Human
ugggggaaauggugccu

SEQ ID NO: 2545473 - RNA, 18 nt, Human
ugggggaacucagaucca

SEQ ID NO: 2545474 - RNA, 18 nt, Human
uggggcuucuccugaccc

SEQ ID NO: 2545475 - RNA, 16 nt, Human
uggggcuucuccugac

SEQ ID NO: 2545476 - RNA, 15 nt, Human
uggggcuucuccuga

SEQ ID NO: 2545477 - RNA, 20 nt, Human
uggggcugcaccggcuggcc

SEQ ID NO: 2545478 - RNA, 17 nt, Human
uggggcucugugcaggg

SEQ ID NO: 2545479 - RNA, 20 nt, Human
uggggcugaagguugaagag

SEQ ID NO: 2545480 - RNA, 11 nt, Human
uggggcugaac

SEQ ID NO: 2545481 - RNA, 23 nt, Human
uggggcugaccuuccucgcagag

SEQ ID NO: 2545482 - RNA, 18 nt, Human
uggggcugaccuuccucg

SEQ ID NO: 2545483 - RNA, 16 nt, Human
uggggcugguucugua

SEQ ID NO: 2545484 - RNA, 19 nt, Human
uggggcugguagcucaggu

SEQ ID NO: 2545485 - RNA, 14 nt, Human
uggggcugauugua

SEQ ID NO: 2545486 - RNA, 20 nt, Human
ugggguacccacugcucugg

SEQ ID NO: 2545487 - RNA, 14 nt, Human
ugggggaagcccug

SEQ ID NO: 2545488 - RNA, 21 nt, Human
ugggguaccaagagacuccuu

SEQ ID NO: 2545489 - RNA, 18 nt, Human
ugggguagcuagaggaac

SEQ ID NO: 2545490 - RNA, 20 nt, Human
ugggguagcuagaggaacca

SEQ ID NO: 2545491 - RNA, 16 nt, Human
ugggguacccacugcu

SEQ ID NO: 2545492 - RNA, 15 nt, Human
ugggguacccacugc

SEQ ID NO: 2545493 - RNA, 18 nt, Human
uggggucacucuggcagc

SEQ ID NO: 2545494 - RNA, 17 nt, Human
uggggucacucuggcag

SEQ ID NO: 2545495 - RNA, 21 nt, Human
ugggguagguugggagaaugu

SEQ ID NO: 2545496 - RNA, 15 nt, Human
ugggguaugggagag

SEQ ID NO: 2545497 - RNA, 15 nt, Human
ugggguagguuggga

SEQ ID NO: 2545498 - RNA, 13 nt, Human
ugggguagggcug

SEQ ID NO: 2545499 - RNA, 16 nt, Human
ugggguagggcugacu

SEQ ID NO: 2545500 - RNA, 14 nt, Human
uggggcguggggag

SEQ ID NO: 2545501 - RNA, 19 nt, Human
uggggcgggaaagccagug

SEQ ID NO: 2545502 - RNA, 17 nt, Human
uggggcgggaaagccag

SEQ ID NO: 2545503 - RNA, 18 nt, Human
uggggcgaggcagaggac

SEQ ID NO: 2545504 - RNA, 19 nt, Human
uggggcgaggcagaggaca

SEQ ID NO: 2545505 - RNA, 17 nt, Human
uggggcgaggcagagga

SEQ ID NO: 2545506 - RNA, 15 nt, Human
uggggcgaggcagag

SEQ ID NO: 2545507 - RNA, 18 nt, Human
uggggcggugagagggga

SEQ ID NO: 2545508 - RNA, 19 nt, Human
uggggcguggggagggccg

SEQ ID NO: 2545509 - RNA, 23 nt, Human
uggggcuaggaaauccagggugg

SEQ ID NO: 2545510 - RNA, 13 nt, Human
uggggcucucagu

SEQ ID NO: 2545511 - RNA, 13 nt, Human
uggggcucuggga

SEQ ID NO: 2545512 - RNA, 15 nt, Human
uggggcucugugcag

SEQ ID NO: 2545513 - RNA, 16 nt, Human
uggggcccugccuccu

SEQ ID NO: 2545514 - RNA, 15 nt, Human
uggggcccugccucc

SEQ ID NO: 2545515 - RNA, 14 nt, Human
uggggccuuggccu

SEQ ID NO: 2545516 - RNA, 18 nt, Human
uggggccuacagcuuuga

SEQ ID NO: 2545517 - RNA, 14 nt, Human
uggggcgaggcaga

SEQ ID NO: 2545518 - RNA, 13 nt, Human
uggggcgaggcag

SEQ ID NO: 2545519 - RNA, 12 nt, Human
uggggccuuggu

SEQ ID NO: 2545520 - RNA, 19 nt, Human
uggggccgccgccucuuuc

SEQ ID NO: 2545521 - RNA, 18 nt, Human
uggggccuagauccacac

SEQ ID NO: 2545522 - RNA, 15 nt, Human
uggggaggggcugug

SEQ ID NO: 2545523 - RNA, 21 nt, Human
uggggacguccugccaccugg

SEQ ID NO: 2545524 - RNA, 12 nt, Human
uggggagaaagu

SEQ ID NO: 2545525 - RNA, 23 nt, Human
uggggaccucaggccugggggcu

SEQ ID NO: 2545526 - RNA, 18 nt, Human
uggggaccugguacccuc

SEQ ID NO: 2545527 - RNA, 20 nt, Human
uggggacggggggccccagu

SEQ ID NO: 2545528 - RNA, 19 nt, Human
uggggacggggggccccag

SEQ ID NO: 2545529 - RNA, 22 nt, Human
uggggacggggggccccaguca

SEQ ID NO: 2545530 - RNA, 20 nt, Human
uggggacguccugccaccug

SEQ ID NO: 2545531 - RNA, 14 nt, Human
uggggcccugccuc

SEQ ID NO: 2545532 - RNA, 17 nt, Human
uggggaguuaagaccug

SEQ ID NO: 2545533 - RNA, 18 nt, Human
uggggaguuaagaccugg

SEQ ID NO: 2545534 - RNA, 19 nt, Human
uggggaguuaagaccuggc

SEQ ID NO: 2545535 - RNA, 20 nt, Human
uggggaguuaagaccuggca

SEQ ID NO: 2545536 - RNA, 16 nt, Human
uggggaguuaagaccu

SEQ ID NO: 2545537 - RNA, 16 nt, Human
uggggagugggacaga

SEQ ID NO: 2545538 - RNA, 19 nt, Human
uggggagugggacagaguc

SEQ ID NO: 2545539 - RNA, 19 nt, Human
uggggaguaggacauacca

SEQ ID NO: 2545540 - RNA, 13 nt, Human
uggggagugggac

SEQ ID NO: 2545541 - RNA, 19 nt, Human
ugggcucccuucccaccuc

SEQ ID NO: 2545542 - RNA, 18 nt, Human
ugggcucccuucccaccu

SEQ ID NO: 2545543 - RNA, 22 nt, Human
agggcuucugcacccuccaccc

SEQ ID NO: 2545544 - RNA, 19 nt, Human
agggcuucugcacccucca

SEQ ID NO: 2545545 - RNA, 18 nt, Human
agggcuucugcacccucc

SEQ ID NO: 2545546 - RNA, 17 nt, Human
agggcuucugcacccuc

SEQ ID NO: 2545547 - RNA, 16 nt, Human
agggcuucugcacccu

SEQ ID NO: 2545548 - RNA, 15 nt, Human
agggcuucugcaccc

SEQ ID NO: 2545549 - RNA, 14 nt, Human
agggcuucugcacc

SEQ ID NO: 2545550 - RNA, 13 nt, Human
agggcuucugcac

SEQ ID NO: 2545551 - RNA, 22 nt, Human
agggcuuccucuagaagccaag

SEQ ID NO: 2545552 - RNA, 21 nt, Human
agggcuuccucuagaagccaa

SEQ ID NO: 2545553 - RNA, 20 nt, Human
agggcuuccucuagaagcca

SEQ ID NO: 2545554 - RNA, 12 nt, Human
agggcuuccucu

SEQ ID NO: 2545555 - RNA, 23 nt, Human
agggcuucugccauuucugagau

SEQ ID NO: 2545556 - RNA, 19 nt, Human
agggccuagcugcuacaaa

SEQ ID NO: 2545557 - RNA, 18 nt, Human
agggccuagcugcuacaa

SEQ ID NO: 2545558 - RNA, 16 nt, Human
agggccuagcugcuac

SEQ ID NO: 2545559 - RNA, 15 nt, Human
agggccuagcugcua

SEQ ID NO: 2545560 - RNA, 20 nt, Human
agggccguaccccacccuca

SEQ ID NO: 2545561 - RNA, 19 nt, Human
agggccguaccccacccuc

SEQ ID NO: 2545562 - RNA, 18 nt, Human
agggccguaccccacccu

SEQ ID NO: 2545563 - RNA, 17 nt, Human
agggccguaccccaccc

SEQ ID NO: 2545564 - RNA, 21 nt, Human
agggccuagcugcuacaaaga

SEQ ID NO: 2545565 - RNA, 20 nt, Human
agggccuagcugcuacaaag

SEQ ID NO: 2545566 - RNA, 20 nt, Human
agggccucaaaggcccgcuc

SEQ ID NO: 2545567 - RNA, 15 nt, Human
agggccugagccugg

SEQ ID NO: 2545568 - RNA, 21 nt, Human
ugggcugcccuggugcugcca

SEQ ID NO: 2545569 - RNA, 16 nt, Human
ugggcugcccuggugc

SEQ ID NO: 2545570 - RNA, 17 nt, Human
ugggcugcuacccagaa

SEQ ID NO: 2545571 - RNA, 20 nt, Human
ugggcugcccuggugcugcc

SEQ ID NO: 2545572 - RNA, 19 nt, Human
ugggcugcccuggugcugc

SEQ ID NO: 2545573 - RNA, 17 nt, Human
ugggcugcccuggugcu

SEQ ID NO: 2545574 - RNA, 17 nt, Human
ugggcugagcccuggca

SEQ ID NO: 2545575 - RNA, 18 nt, Human
ugggcugagcccuggcag

SEQ ID NO: 2545576 - RNA, 19 nt, Human
ugggcugagccccuacccc

SEQ ID NO: 2545577 - RNA, 18 nt, Human
ugggcugagccccuaccc

SEQ ID NO: 2545578 - RNA, 17 nt, Human
ugggcugagccccuacc

SEQ ID NO: 2545579 - RNA, 14 nt, Human
ugggcugagccccu

SEQ ID NO: 2545580 - RNA, 15 nt, Human
ugggcugagcccugg

SEQ ID NO: 2545581 - RNA, 16 nt, Human
ugggcugagcccuggc

SEQ ID NO: 2545582 - RNA, 17 nt, Human
ugggcucugugcaguca

SEQ ID NO: 2545583 - RNA, 12 nt, Human
ugggcucugugc

SEQ ID NO: 2545584 - RNA, 16 nt, Human
ugggcucugggagcag

SEQ ID NO: 2545585 - RNA, 15 nt, Human
ugggcucugggagca

SEQ ID NO: 2545586 - RNA, 20 nt, Human
ugggcucccuucccaccucu

SEQ ID NO: 2545587 - RNA, 17 nt, Human
ugggcucugugggcugc

SEQ ID NO: 2545588 - RNA, 18 nt, Human
ugggcucugugcagucac

SEQ ID NO: 2545589 - RNA, 17 nt, Human
ugggcugaacacuccaa

SEQ ID NO: 2545590 - RNA, 19 nt, Human
ugggcugaacacuccaauu

SEQ ID NO: 2545591 - RNA, 21 nt, Human
ugggcucugugggcugcacuc

SEQ ID NO: 2545592 - RNA, 18 nt, Human
ugggcugacggugcaguc

SEQ ID NO: 2545593 - RNA, 14 nt, Human
ugggcugagacugg

SEQ ID NO: 2545594 - RNA, 15 nt, Human
ugggcugagacugga

SEQ ID NO: 2545595 - RNA, 23 nt, Human
ugggcugagacuggauacugccc

SEQ ID NO: 2545596 - RNA, 12 nt, Human
ugggcugagccc

SEQ ID NO: 2545597 - RNA, 18 nt, Human
uggggaccagagcugcca

SEQ ID NO: 2545598 - RNA, 17 nt, Human
uggggaccagagcugcc

SEQ ID NO: 2545599 - RNA, 13 nt, Human
uggggaccucagg

SEQ ID NO: 2545600 - RNA, 20 nt, Human
uggggacaucucuuugaauu

SEQ ID NO: 2545601 - RNA, 18 nt, Human
uggggacaucucuuugaa

SEQ ID NO: 2545602 - RNA, 15 nt, Human
uggggaccagagcug

SEQ ID NO: 2545603 - RNA, 14 nt, Human
uggggaccagagcu

SEQ ID NO: 2545604 - RNA, 20 nt, Human
uggggacaggggcaggagga

SEQ ID NO: 2545605 - RNA, 22 nt, Human
uggggacaggggcaggaggaag

SEQ ID NO: 2545606 - RNA, 13 nt, Human
uggggacagggcu

SEQ ID NO: 2545607 - RNA, 16 nt, Human
uggggaauuuccucua

SEQ ID NO: 2545608 - RNA, 14 nt, Human
uggggaauuuccuc

SEQ ID NO: 2545609 - RNA, 17 nt, Human
uggggacagagcagaac

SEQ ID NO: 2545610 - RNA, 18 nt, Human
ugggcuggggccugaugg

SEQ ID NO: 2545611 - RNA, 20 nt, Human
ugggcugggugcgaccccau

SEQ ID NO: 2545612 - RNA, 14 nt, Human
uggggaagacugug

SEQ ID NO: 2545613 - RNA, 24 nt, Human
uggggaagacuguggcugcuagca

SEQ ID NO: 2545614 - RNA, 16 nt, Human
uggggaagacuguggc

SEQ ID NO: 2545615 - RNA, 17 nt, Human
uggggaagacuguggcu

SEQ ID NO: 2545616 - RNA, 16 nt, Human
uggggaagugaggaag

SEQ ID NO: 2545617 - RNA, 13 nt, Human
uggggaaggaggc

SEQ ID NO: 2545618 - RNA, 18 nt, Human
uggggaagcuucuuaaau

SEQ ID NO: 2545619 - RNA, 19 nt, Human
ugggcuggguucuacccag

SEQ ID NO: 2545620 - RNA, 18 nt, Human
ugggcuggguucuaccca

SEQ ID NO: 2545621 - RNA, 18 nt, Human
ugggcuggaacagauuca

SEQ ID NO: 2545622 - RNA, 18 nt, Human
ugggcuggaaucaggaau

SEQ ID NO: 2545623 - RNA, 15 nt, Human
ugggcugcuccucau

SEQ ID NO: 2545624 - RNA, 16 nt, Human
ugggcugcuccucaug

SEQ ID NO: 2545625 - RNA, 19 nt, Human
ugggcuggcaguccuggaa

SEQ ID NO: 2545626 - RNA, 19 nt, Human
ugggcuggcucccucuugg

SEQ ID NO: 2545627 - RNA, 16 nt, Human
aguagaaggucggagg

SEQ ID NO: 2545628 - RNA, 20 nt, Human
aguagaagauuugaugcugg

SEQ ID NO: 2545629 - RNA, 12 nt, Human
aguagagacagg

SEQ ID NO: 2545630 - RNA, 19 nt, Human
aguagaacagauaaucagu

SEQ ID NO: 2545631 - RNA, 13 nt, Human
aguagaacagaua

SEQ ID NO: 2545632 - RNA, 18 nt, Human
aguagaaaggccuuuaaa

SEQ ID NO: 2545633 - RNA, 18 nt, Human
aguagaaauaauaugcau

SEQ ID NO: 2545634 - RNA, 19 nt, Human
aguagaaauaauaugcauu

SEQ ID NO: 2545635 - RNA, 14 nt, Human
aguagagucaucuc

SEQ ID NO: 2545636 - RNA, 16 nt, Human
aguagagucaucucca

SEQ ID NO: 2545637 - RNA, 23 nt, Human
aguagagucaucuccaucagcug

SEQ ID NO: 2545638 - RNA, 21 nt, Human
aguagaaggucggaggcuugg

SEQ ID NO: 2545639 - RNA, 15 nt, Human
aguagaggcuuagag

SEQ ID NO: 2545640 - RNA, 17 nt, Human
aguagauggugaaauuu

SEQ ID NO: 2545641 - RNA, 16 nt, Human
aguagauggugaaauu

SEQ ID NO: 2545642 - RNA, 15 nt, Human
aguagauggugaaau

SEQ ID NO: 2545643 - RNA, 18 nt, Human
uguaggaagguuaauguu

SEQ ID NO: 2545644 - RNA, 19 nt, Human
aguagauaggccaugggca

SEQ ID NO: 2545645 - RNA, 17 nt, Human
aguagagucaucuccau

SEQ ID NO: 2545646 - RNA, 20 nt, Human
uguaggaagguuaauguuca

SEQ ID NO: 2545647 - RNA, 21 nt, Human
uguaggaauucuuuuggggaa

SEQ ID NO: 2545648 - RNA, 20 nt, Human
uguaggaauucuuuugggga

SEQ ID NO: 2545649 - RNA, 21 nt, Human
aguagauggugaaauuuauua

SEQ ID NO: 2545650 - RNA, 23 nt, Human
uguaggaauucuuuuggggaagu

SEQ ID NO: 2545651 - RNA, 11 nt, Human
uguaggagaau

SEQ ID NO: 2545652 - RNA, 12 nt, Human
uguaggagcugc

SEQ ID NO: 2545653 - RNA, 15 nt, Human
uguaggagcugccuu

SEQ ID NO: 2545654 - RNA, 20 nt, Human
uguaggugucugcacccagg

SEQ ID NO: 2545655 - RNA, 19 nt, Human
uguaggugucugcacccag

SEQ ID NO: 2545656 - RNA, 22 nt, Human
uguaggagcugccuuggcucag

SEQ ID NO: 2545657 - RNA, 17 nt, Human
uguagguaugaauaagu

SEQ ID NO: 2545658 - RNA, 15 nt, Human
aguaauccaagcaaa

SEQ ID NO: 2545659 - RNA, 21 nt, Human
aguaauccaagcaaaugugaa

SEQ ID NO: 2545660 - RNA, 19 nt, Human
aguaaucccgccaccuauc

SEQ ID NO: 2545661 - RNA, 17 nt, Human
aguaaucccgccaccua

SEQ ID NO: 2545662 - RNA, 14 nt, Human
aguaaucccgccac

SEQ ID NO: 2545663 - RNA, 14 nt, Human
aguaauccaccugc

SEQ ID NO: 2545664 - RNA, 15 nt, Human
aguaauuuguagauu

SEQ ID NO: 2545665 - RNA, 15 nt, Human
aguaauuugaggaca

SEQ ID NO: 2545666 - RNA, 19 nt, Human
aguacaccacaagggucac

SEQ ID NO: 2545667 - RNA, 16 nt, Human
aguacacuguuucaaa

SEQ ID NO: 2545668 - RNA, 20 nt, Human
aguacacuguuucaaacuuu

SEQ ID NO: 2545669 - RNA, 14 nt, Human
aguacacuguuuca

SEQ ID NO: 2545670 - RNA, 22 nt, Human
aguacuuuggaggccccuaugu

SEQ ID NO: 2545671 - RNA, 17 nt, Human
aguacuuuggaggcccc

SEQ ID NO: 2545672 - RNA, 19 nt, Human
aguacuuuggaggccccua

SEQ ID NO: 2545673 - RNA, 19 nt, Human
aguacuuuuggcauuuuac

SEQ ID NO: 2545674 - RNA, 17 nt, Human
aguagaaaggccuuuaa

SEQ ID NO: 2545675 - RNA, 16 nt, Human
aguagaaaggccuuua

SEQ ID NO: 2545676 - RNA, 15 nt, Human
aguagaaaggccuuu

SEQ ID NO: 2545677 - RNA, 14 nt, Human
aguagaaaggccuu

SEQ ID NO: 2545678 - RNA, 21 nt, Human
aguagaaagacagagcuggga

SEQ ID NO: 2545679 - RNA, 20 nt, Human
aguagaaagacagagcuggg

SEQ ID NO: 2545680 - RNA, 11 nt, Human
agguuuuccug

SEQ ID NO: 2545681 - RNA, 22 nt, Human
agguuuuccucuucuauuuugu

SEQ ID NO: 2545682 - RNA, 13 nt, Human
agguuuucuccac

SEQ ID NO: 2545683 - RNA, 14 nt, Human
uguagagggcccug

SEQ ID NO: 2545684 - RNA, 14 nt, Human
agguuuucuccacu

SEQ ID NO: 2545685 - RNA, 23 nt, Human
agguuuuguuugcuaucuuaauu

SEQ ID NO: 2545686 - RNA, 22 nt, Human
agguuuuguuugcuaucuuaau

SEQ ID NO: 2545687 - RNA, 19 nt, Human
agguuuuguuugcuaucuu

SEQ ID NO: 2545688 - RNA, 18 nt, Human
agguuuuguuugcuaucu

SEQ ID NO: 2545689 - RNA, 17 nt, Human
agguuuuguuugcuauc

SEQ ID NO: 2545690 - RNA, 16 nt, Human
agguuuuguuugcuau

SEQ ID NO: 2545691 - RNA, 17 nt, Human
agguuuuguuguuuuau

SEQ ID NO: 2545692 - RNA, 12 nt, Human
agguuuuguugu

SEQ ID NO: 2545693 - RNA, 13 nt, Human
agguuuuguaaag

SEQ ID NO: 2545694 - RNA, 13 nt, Human
agguuuuguacaa

SEQ ID NO: 2545695 - RNA, 15 nt, Human
agguuuuguaaagau

SEQ ID NO: 2545696 - RNA, 15 nt, Human
aguaaaaccacagca

SEQ ID NO: 2545697 - RNA, 20 nt, Human
aguaagccgugauuuucauu

SEQ ID NO: 2545698 - RNA, 12 nt, Human
aguaaaaauaaa

SEQ ID NO: 2545699 - RNA, 15 nt, Human
aguaaaaauaaaauu

SEQ ID NO: 2545700 - RNA, 12 nt, Human
aguaaaaauaca

SEQ ID NO: 2545701 - RNA, 13 nt, Human
aguaaaaauacaa

SEQ ID NO: 2545702 - RNA, 18 nt, Human
aguaauaugcacacauuu

SEQ ID NO: 2545703 - RNA, 19 nt, Human
aguaauaugcacacauuuu

SEQ ID NO: 2545704 - RNA, 20 nt, Human
aguaauaugcacacauuuuu

SEQ ID NO: 2545705 - RNA, 17 nt, Human
aguaauaugcacacauu

SEQ ID NO: 2545706 - RNA, 18 nt, Human
aguaauauuuauauauuu

SEQ ID NO: 2545707 - RNA, 17 nt, Human
aguaaguaccacucagg

SEQ ID NO: 2545708 - RNA, 14 nt, Human
aguaaggugcaguu

SEQ ID NO: 2545709 - RNA, 17 nt, Human
aguaagggaaauagaaa

SEQ ID NO: 2545710 - RNA, 16 nt, Human
aguaagggaaauagaa

SEQ ID NO: 2545711 - RNA, 20 nt, Human
aguaagcugcucuauuguag

SEQ ID NO: 2545712 - RNA, 18 nt, Human
aguaagcugcucuauugu

SEQ ID NO: 2545713 - RNA, 13 nt, Human
aguaaggcugugu

SEQ ID NO: 2545714 - RNA, 12 nt, Human
aguaaggcugug

SEQ ID NO: 2545715 - RNA, 23 nt, Human
aguaaggaauuuuauuuuuuucu

SEQ ID NO: 2545716 - RNA, 15 nt, Human
aguaaaaauuaaaaa

SEQ ID NO: 2545717 - RNA, 19 nt, Human
aguaaaaauacaaaaauua

SEQ ID NO: 2545718 - RNA, 21 nt, Human
uguaauuuaaacaggcccagc

SEQ ID NO: 2545719 - RNA, 20 nt, Human
uguaauuuaaacaggcccag

SEQ ID NO: 2545720 - RNA, 19 nt, Human
uguaauuuaaacaggccca

SEQ ID NO: 2545721 - RNA, 16 nt, Human
uguaauuuaaacaggc

SEQ ID NO: 2545722 - RNA, 15 nt, Human
uguaauuuaaacagg

SEQ ID NO: 2545723 - RNA, 14 nt, Human
uguaauuuaaacag

SEQ ID NO: 2545724 - RNA, 15 nt, Human
uguaauuguuugucu

SEQ ID NO: 2545725 - RNA, 19 nt, Human
uguaauuguuugucuuuaa

SEQ ID NO: 2545726 - RNA, 21 nt, Human
uguaauuuaaaauugugaugu

SEQ ID NO: 2545727 - RNA, 22 nt, Human
uguaauuuaaaauugugaugug

SEQ ID NO: 2545728 - RNA, 14 nt, Human
uguaauuugugaua

SEQ ID NO: 2545729 - RNA, 18 nt, Human
uguaauuucuuugccugu

SEQ ID NO: 2545730 - RNA, 23 nt, Human
uguaauuuaaacaggcccagcau

SEQ ID NO: 2545731 - RNA, 22 nt, Human
uguaauuuaaacaggcccagca

SEQ ID NO: 2545732 - RNA, 21 nt, Human
uguaauuucuuugccuguuca

SEQ ID NO: 2545733 - RNA, 23 nt, Human
uguaauuucuuugccuguucagu

SEQ ID NO: 2545734 - RNA, 17 nt, Human
uguaccagcccagaugu

SEQ ID NO: 2545735 - RNA, 20 nt, Human
uguaccagcccagauguuuu

SEQ ID NO: 2545736 - RNA, 21 nt, Human
uguaccaugaaacaaagcugc

SEQ ID NO: 2545737 - RNA, 15 nt, Human
uguacuuuuuccaga

SEQ ID NO: 2545738 - RNA, 16 nt, Human
uguacuuuuaaggcag

SEQ ID NO: 2545739 - RNA, 17 nt, Human
uguaccauguacaugaa

SEQ ID NO: 2545740 - RNA, 12 nt, Human
uguaccauguac

SEQ ID NO: 2545741 - RNA, 13 nt, Human
uguacuuugugcu

SEQ ID NO: 2545742 - RNA, 13 nt, Human
uguagagugggag

SEQ ID NO: 2545743 - RNA, 14 nt, Human
uguagagugggagc

SEQ ID NO: 2545744 - RNA, 18 nt, Human
uguagaggagaaacugga

SEQ ID NO: 2545745 - RNA, 17 nt, Human
uguaauuuaaaauugug

SEQ ID NO: 2545746 - RNA, 20 nt, Human
uguaauuguuguuuguaugu

SEQ ID NO: 2545747 - RNA, 23 nt, Human
uguaauuguuguuuguauguaua

SEQ ID NO: 2545748 - RNA, 18 nt, Human
uguaauuuaaaauuguga

SEQ ID NO: 2545749 - RNA, 20 nt, Human
uguaauuuaaaauugugaug

SEQ ID NO: 2545750 - RNA, 14 nt, Human
uguaauuauuguga

SEQ ID NO: 2545751 - RNA, 12 nt, Human
uguaauuauugu

SEQ ID NO: 2545752 - RNA, 11 nt, Human
uguaauuauug

SEQ ID NO: 2545753 - RNA, 17 nt, Human
uguaauuguuguuugua

SEQ ID NO: 2545754 - RNA, 19 nt, Human
uguaauuguuguuuguaug

SEQ ID NO: 2545755 - RNA, 13 nt, Human
uguaaguuucagg

SEQ ID NO: 2545756 - RNA, 20 nt, Human
uguaaguuuaugucuaaaga

SEQ ID NO: 2545757 - RNA, 19 nt, Human
uguaaguuuaugucuaaag

SEQ ID NO: 2545758 - RNA, 20 nt, Human
uguaaguuuaccuauguaac

SEQ ID NO: 2545759 - RNA, 23 nt, Human
uguaauuaaguacuauguaucaa

SEQ ID NO: 2545760 - RNA, 15 nt, Human
uguaagugugugugu

SEQ ID NO: 2545761 - RNA, 12 nt, Human
uguaagugugag

SEQ ID NO: 2545762 - RNA, 14 nt, Human
uguaagugugagua

SEQ ID NO: 2545763 - RNA, 17 nt, Human
uguaagugugaguaaga

SEQ ID NO: 2545764 - RNA, 21 nt, Human
uguaagugugaguaagagcug

SEQ ID NO: 2545765 - RNA, 14 nt, Human
uguaaguaauuauc

SEQ ID NO: 2545766 - RNA, 17 nt, Human
uguaagaugcuggguug

SEQ ID NO: 2545767 - RNA, 15 nt, Human
uguaagaugcugggu

SEQ ID NO: 2545768 - RNA, 14 nt, Human
uguaagaugcuggg

SEQ ID NO: 2545769 - RNA, 12 nt, Human
uguaagaugcug

SEQ ID NO: 2545770 - RNA, 21 nt, Human
uguaagaguguagaagcauuc

SEQ ID NO: 2545771 - RNA, 20 nt, Human
uguaagaguguagaagcauu

SEQ ID NO: 2545772 - RNA, 19 nt, Human
uguaagaguguagaagcau

SEQ ID NO: 2545773 - RNA, 18 nt, Human
uguaagaguguagaagca

SEQ ID NO: 2545774 - RNA, 22 nt, Human
uguaagagcaccuuccucacuu

SEQ ID NO: 2545775 - RNA, 19 nt, Human
uguaagagcaccuuccuca

SEQ ID NO: 2545776 - RNA, 15 nt, Human
uguaagaguguagaa

SEQ ID NO: 2545777 - RNA, 20 nt, Human
uguaagaucguucucugccu

SEQ ID NO: 2545778 - RNA, 19 nt, Human
uguaagaucguucucugcc

SEQ ID NO: 2545779 - RNA, 21 nt, Human
agguugacaauaaaugugcuu

SEQ ID NO: 2545780 - RNA, 17 nt, Human
aggugguuauggagagg

SEQ ID NO: 2545781 - RNA, 15 nt, Human
agguugauaacuuug

SEQ ID NO: 2545782 - RNA, 14 nt, Human
agguugauaacuuu

SEQ ID NO: 2545783 - RNA, 12 nt, Human
agguugauaacu

SEQ ID NO: 2545784 - RNA, 11 nt, Human
agguugauaac

SEQ ID NO: 2545785 - RNA, 24 nt, Human
agguugagcucuucuuaaaguauu

SEQ ID NO: 2545786 - RNA, 17 nt, Human
agguugagcucuucuua

SEQ ID NO: 2545787 - RNA, 17 nt, Human
agguugaggggcuccug

SEQ ID NO: 2545788 - RNA, 20 nt, Human
agguugaggggcuccuggaa

SEQ ID NO: 2545789 - RNA, 23 nt, Human
agguugggagaaugucaguaugu

SEQ ID NO: 2545790 - RNA, 21 nt, Human
agguugggccauacuggccuc

SEQ ID NO: 2545791 - RNA, 20 nt, Human
agguugggccauacuggccu

SEQ ID NO: 2545792 - RNA, 22 nt, Human
agguugggccauacuggccucg

SEQ ID NO: 2545793 - RNA, 16 nt, Human
agguugggguguacua

SEQ ID NO: 2545794 - RNA, 20 nt, Human
agguugggaaugaggcuugc

SEQ ID NO: 2545795 - RNA, 22 nt, Human
agguugggaaugaggcuugcug

SEQ ID NO: 2545796 - RNA, 19 nt, Human
agguugauaacuuugcuug

SEQ ID NO: 2545797 - RNA, 18 nt, Human
agguugauaacuuugcuu

SEQ ID NO: 2545798 - RNA, 17 nt, Human
agguugauaacuuugcu

SEQ ID NO: 2545799 - RNA, 16 nt, Human
agguugauaacuuugc

SEQ ID NO: 2545800 - RNA, 20 nt, Human
agguugauaacuuugcuugc

SEQ ID NO: 2545801 - RNA, 16 nt, Human
agguugaucagaucug

SEQ ID NO: 2545802 - RNA, 18 nt, Human
agguugcagggagccgag

SEQ ID NO: 2545803 - RNA, 12 nt, Human
agguugcaggga

SEQ ID NO: 2545804 - RNA, 15 nt, Human
uguaacuuuuguaag

SEQ ID NO: 2545805 - RNA, 16 nt, Human
uguaacuuuuguaaga

SEQ ID NO: 2545806 - RNA, 18 nt, Human
uguaacuuucucuaugaa

SEQ ID NO: 2545807 - RNA, 17 nt, Human
uguaacuuucucuauga

SEQ ID NO: 2545808 - RNA, 20 nt, Human
uguaacuuuuguaagacaaa

SEQ ID NO: 2545809 - RNA, 19 nt, Human
uguaagaacuacaaacaaa

SEQ ID NO: 2545810 - RNA, 18 nt, Human
uguaagaacuacaaacaa

SEQ ID NO: 2545811 - RNA, 18 nt, Human
uguaagagcaccuuccuc

SEQ ID NO: 2545812 - RNA, 21 nt, Human
uguaagacaaagguuuuccuc

SEQ ID NO: 2545813 - RNA, 19 nt, Human
uguaagacaauccauguaa

SEQ ID NO: 2545814 - RNA, 17 nt, Human
uguaagaagagacuggg

SEQ ID NO: 2545815 - RNA, 21 nt, Human
uguaagaagagacugggaaga

SEQ ID NO: 2545816 - RNA, 20 nt, Human
uguaagacaaagguuuuccu

SEQ ID NO: 2545817 - RNA, 19 nt, Human
uguaagaagagacugggaa

SEQ ID NO: 2545818 - RNA, 19 nt, Human
agguugggguguacuaguu

SEQ ID NO: 2545819 - RNA, 14 nt, Human
agguuggugggggc

SEQ ID NO: 2545820 - RNA, 17 nt, Human
uguaacuuucugaaaua

SEQ ID NO: 2545821 - RNA, 17 nt, Human
agguuguaaauguguuu

SEQ ID NO: 2545822 - RNA, 21 nt, Human
aggugcacaagcuccaagcuc

SEQ ID NO: 2545823 - RNA, 22 nt, Human
aggugcacagacgucccuccac

SEQ ID NO: 2545824 - RNA, 23 nt, Human
aggugcacagacgucccuccacg

SEQ ID NO: 2545825 - RNA, 17 nt, Human
aggugcagagugcccag

SEQ ID NO: 2545826 - RNA, 18 nt, Human
aggugcagagugcccaga

SEQ ID NO: 2545827 - RNA, 19 nt, Human
aggugcagagugcccagaa

SEQ ID NO: 2545828 - RNA, 20 nt, Human
aggugcagagugcccagaac

SEQ ID NO: 2545829 - RNA, 23 nt, Human
aggugcaguucccccaaccucag

SEQ ID NO: 2545830 - RNA, 16 nt, Human
aggugcaguuccccca

SEQ ID NO: 2545831 - RNA, 15 nt, Human
agguggcaucucuaa

SEQ ID NO: 2545832 - RNA, 14 nt, Human
agguggccacucca

SEQ ID NO: 2545833 - RNA, 17 nt, Human
agguggccacuccagac

SEQ ID NO: 2545834 - RNA, 12 nt, Human
agguggccaugc

SEQ ID NO: 2545835 - RNA, 11 nt, Human
aggugcagugg

SEQ ID NO: 2545836 - RNA, 16 nt, Human
aggugcaguggcucac

SEQ ID NO: 2545837 - RNA, 16 nt, Human
aggugggcccaggacc

SEQ ID NO: 2545838 - RNA, 14 nt, Human
aggugggcccagga

SEQ ID NO: 2545839 - RNA, 13 nt, Human
aggugggcccagg

SEQ ID NO: 2545840 - RNA, 12 nt, Human
aggugggcccag

SEQ ID NO: 2545841 - RNA, 22 nt, Human
aggugggcccaggaccagcugg

SEQ ID NO: 2545842 - RNA, 18 nt, Human
aggugggcccaggaccag

SEQ ID NO: 2545843 - RNA, 23 nt, Human
aggugggcccaggaccagcuggg

SEQ ID NO: 2545844 - RNA, 14 nt, Human
aggugggccagccc

SEQ ID NO: 2545845 - RNA, 15 nt, Human
aggugggccagcccc

SEQ ID NO: 2545846 - RNA, 16 nt, Human
aggugggccagccccu

SEQ ID NO: 2545847 - RNA, 17 nt, Human
aggugggccagccccuc

SEQ ID NO: 2545848 - RNA, 18 nt, Human
aggugggccagccccucc

SEQ ID NO: 2545849 - RNA, 19 nt, Human
aggugggccagccccuccc

SEQ ID NO: 2545850 - RNA, 21 nt, Human
aggugggccagccccucccac

SEQ ID NO: 2545851 - RNA, 22 nt, Human
aggugggccagccccucccacc

SEQ ID NO: 2545852 - RNA, 20 nt, Human
aggugguggcacugagcccc

SEQ ID NO: 2545853 - RNA, 19 nt, Human
aggugguggcacugagccc

SEQ ID NO: 2545854 - RNA, 15 nt, Human
agguggugcuuacau

SEQ ID NO: 2545855 - RNA, 22 nt, Human
agguggucugcucgggcccagg

SEQ ID NO: 2545856 - RNA, 23 nt, Human
aggugggccgcaggcgggaaaag

SEQ ID NO: 2545857 - RNA, 18 nt, Human
agguggucugaauguucu

SEQ ID NO: 2545858 - RNA, 19 nt, Human
agguggucugaauguucug

SEQ ID NO: 2545859 - RNA, 20 nt, Human
agguggucugaauguucuga

SEQ ID NO: 2545860 - RNA, 21 nt, Human
agguggucugaauguucugac

SEQ ID NO: 2545861 - RNA, 21 nt, Human
agguggucugcucgggcccag

SEQ ID NO: 2545862 - RNA, 20 nt, Human
agguggucugcucgggccca

SEQ ID NO: 2545863 - RNA, 22 nt, Human
agguggucugaauguucugaca

SEQ ID NO: 2545864 - RNA, 23 nt, Human
agguggucugaauguucugacau

SEQ ID NO: 2545865 - RNA, 20 nt, Human
aggugggauccuccaggugc

SEQ ID NO: 2545866 - RNA, 13 nt, Human
aggugggcaggug

SEQ ID NO: 2545867 - RNA, 22 nt, Human
aggugggcaggugguggcacug

SEQ ID NO: 2545868 - RNA, 21 nt, Human
agguggcugacccagucccug

SEQ ID NO: 2545869 - RNA, 17 nt, Human
agguggcucuccaguua

SEQ ID NO: 2545870 - RNA, 15 nt, Human
agguggcucuccagu

SEQ ID NO: 2545871 - RNA, 14 nt, Human
agguggcucuccag

SEQ ID NO: 2545872 - RNA, 17 nt, Human
agguggcuauggccacc

SEQ ID NO: 2545873 - RNA, 19 nt, Human
agguggcugacccaguccc

SEQ ID NO: 2545874 - RNA, 19 nt, Human
agguggcucuccaguuagu

SEQ ID NO: 2545875 - RNA, 20 nt, Human
agguggcugacccagucccu

SEQ ID NO: 2545876 - RNA, 23 nt, Human
agguggccucuccuuguggccug

SEQ ID NO: 2545877 - RNA, 19 nt, Human
agguggccaugccucagcc

SEQ ID NO: 2545878 - RNA, 18 nt, Human
agguggccaugccucagc

SEQ ID NO: 2545879 - RNA, 11 nt, Human
agguccccaga

SEQ ID NO: 2545880 - RNA, 17 nt, Human
agguccccagcuuuggc

SEQ ID NO: 2545881 - RNA, 10 nt, Human
aggucccuaa

SEQ ID NO: 2545882 - RNA, 23 nt, Human
aggucuugaacuccuggccucaa

SEQ ID NO: 2545883 - RNA, 18 nt, Human
agguccccagcuuuggcu

SEQ ID NO: 2545884 - RNA, 14 nt, Human
aggucccaggcaga

SEQ ID NO: 2545885 - RNA, 18 nt, Human
aggucuuugguucagcua

SEQ ID NO: 2545886 - RNA, 11 nt, Human
aggucuuuccu

SEQ ID NO: 2545887 - RNA, 22 nt, Human
aggucuuggagcugagccucuc

SEQ ID NO: 2545888 - RNA, 21 nt, Human
aggucuuggagcugagccucu

SEQ ID NO: 2545889 - RNA, 19 nt, Human
aggucuuggagcugagccu

SEQ ID NO: 2545890 - RNA, 14 nt, Human
aggucuuuugacau

SEQ ID NO: 2545891 - RNA, 15 nt, Human
aggucuuuugacaug

SEQ ID NO: 2545892 - RNA, 16 nt, Human
aggucuuuugacaugu

SEQ ID NO: 2545893 - RNA, 18 nt, Human
aggucuuuugacaugugg

SEQ ID NO: 2545894 - RNA, 20 nt, Human
aggugcacaagcuccaagcu

SEQ ID NO: 2545895 - RNA, 18 nt, Human
aggugcacaagcuccaag

SEQ ID NO: 2545896 - RNA, 17 nt, Human
aggugcacaagcuccaa

SEQ ID NO: 2545897 - RNA, 16 nt, Human
aggugcacaagcucca

SEQ ID NO: 2545898 - RNA, 19 nt, Human
aggucuuuugacaugugga

SEQ ID NO: 2545899 - RNA, 12 nt, Human
uguaaauccuuu

SEQ ID NO: 2545900 - RNA, 19 nt, Human
uguaaauccuuuuucuuua

SEQ ID NO: 2545901 - RNA, 15 nt, Human
aggugcacaagcucc

SEQ ID NO: 2545902 - RNA, 20 nt, Human
uguaaauccuuuuucuuuau

SEQ ID NO: 2545903 - RNA, 22 nt, Human
aggugcaacaagguccucuguc

SEQ ID NO: 2545904 - RNA, 22 nt, Human
uguaaauccuuuuucuuuauaa

SEQ ID NO: 2545905 - RNA, 13 nt, Human
aguauaaaaacaa

SEQ ID NO: 2545906 - RNA, 13 nt, Human
aguauaaacaaag

SEQ ID NO: 2545907 - RNA, 16 nt, Human
aguauaaacaaaguua

SEQ ID NO: 2545908 - RNA, 17 nt, Human
aguauaaacaaaguuac

SEQ ID NO: 2545909 - RNA, 19 nt, Human
aguauaaacaaaguuacua

SEQ ID NO: 2545910 - RNA, 17 nt, Human
aguaguuuguauaacuu

SEQ ID NO: 2545911 - RNA, 12 nt, Human
aguaguuuguau

SEQ ID NO: 2545912 - RNA, 16 nt, Human
aguauguaaaguaugu

SEQ ID NO: 2545913 - RNA, 15 nt, Human
aguauguaaaguaug

SEQ ID NO: 2545914 - RNA, 18 nt, Human
aguauaaaugguugucug

SEQ ID NO: 2545915 - RNA, 15 nt, Human
aguauguggaagugu

SEQ ID NO: 2545916 - RNA, 17 nt, Human
aguauguggaagugugg

SEQ ID NO: 2545917 - RNA, 15 nt, Human
aguauuucuaugaaa

SEQ ID NO: 2545918 - RNA, 13 nt, Human
aguauuucuauga

SEQ ID NO: 2545919 - RNA, 16 nt, Human
aguauuucaugcuggg

SEQ ID NO: 2545920 - RNA, 14 nt, Human
aguauguguaaaau

SEQ ID NO: 2545921 - RNA, 21 nt, Human
aguauguaaaguauguaaaca

SEQ ID NO: 2545922 - RNA, 20 nt, Human
aguauuucaaauuggagcuu

SEQ ID NO: 2545923 - RNA, 23 nt, Human
aguaugugggcagauuuucagca

SEQ ID NO: 2545924 - RNA, 19 nt, Human
aguauguggaagugugggu

SEQ ID NO: 2545925 - RNA, 14 nt, Human
agucaccaagccca

SEQ ID NO: 2545926 - RNA, 13 nt, Human
agucaccaagccc

SEQ ID NO: 2545927 - RNA, 22 nt, Human
aguauuucuaugaaauauuaug

SEQ ID NO: 2545928 - RNA, 13 nt, Human
aguauuucccagc

SEQ ID NO: 2545929 - RNA, 23 nt, Human
aguauuugaaacugaauguuuau

SEQ ID NO: 2545930 - RNA, 16 nt, Human
aguauuugagaguucu

SEQ ID NO: 2545931 - RNA, 17 nt, Human
aguauuugggaagugaa

SEQ ID NO: 2545932 - RNA, 16 nt, Human
aguauuugcauauucu

SEQ ID NO: 2545933 - RNA, 16 nt, Human
ugucaggagagcagcg

SEQ ID NO: 2545934 - RNA, 14 nt, Human
ugucaggagagcag

SEQ ID NO: 2545935 - RNA, 17 nt, Human
ugucaggaagaaaucac

SEQ ID NO: 2545936 - RNA, 18 nt, Human
ugucaggaacagaaggau

SEQ ID NO: 2545937 - RNA, 20 nt, Human
ugucaggaacagaaggauga

SEQ ID NO: 2545938 - RNA, 18 nt, Human
ugucagcuuuugcuucau

SEQ ID NO: 2545939 - RNA, 16 nt, Human
ugucaggaacagaagg

SEQ ID NO: 2545940 - RNA, 17 nt, Human
ugucaggaacagaagga

SEQ ID NO: 2545941 - RNA, 19 nt, Human
ugucagcugaaccugggua

SEQ ID NO: 2545942 - RNA, 11 nt, Human
agucacugccu

SEQ ID NO: 2545943 - RNA, 14 nt, Human
agucacugccucuc

SEQ ID NO: 2545944 - RNA, 17 nt, Human
agucacugccucucccu

SEQ ID NO: 2545945 - RNA, 20 nt, Human
agucacugccucucccuggc

SEQ ID NO: 2545946 - RNA, 18 nt, Human
agucacugagacagcccg

SEQ ID NO: 2545947 - RNA, 19 nt, Human
agucacugagacagcccgg

SEQ ID NO: 2545948 - RNA, 13 nt, Human
agucacugcacag

SEQ ID NO: 2545949 - RNA, 16 nt, Human
ugucagcugaaccugg

SEQ ID NO: 2545950 - RNA, 19 nt, Human
ugucaguauguggaagugu

SEQ ID NO: 2545951 - RNA, 20 nt, Human
ugucaguauguggaagugug

SEQ ID NO: 2545952 - RNA, 18 nt, Human
ugucaguauguggaagug

SEQ ID NO: 2545953 - RNA, 20 nt, Human
ugucaguaccuucaaacuag

SEQ ID NO: 2545954 - RNA, 22 nt, Human
ugucaguauguggaaguguggg

SEQ ID NO: 2545955 - RNA, 20 nt, Human
ugucaguaucuguaucucuc

SEQ ID NO: 2545956 - RNA, 23 nt, Human
ugucauuugcuggagcucugccc

SEQ ID NO: 2545957 - RNA, 19 nt, Human
ugucaggcugcuggcgccu

SEQ ID NO: 2545958 - RNA, 17 nt, Human
ugucaggcugcuggcgc

SEQ ID NO: 2545959 - RNA, 16 nt, Human
ugucaggcugcuggcg

SEQ ID NO: 2545960 - RNA, 15 nt, Human
ugucaggcugcuggc

SEQ ID NO: 2545961 - RNA, 14 nt, Human
ugucaggccugugu

SEQ ID NO: 2545962 - RNA, 21 nt, Human
ugucaggccugacggggagga

SEQ ID NO: 2545963 - RNA, 16 nt, Human
ugucagguggggcagc

SEQ ID NO: 2545964 - RNA, 24 nt, Human
ugucaggcugcuggcgccucugca

SEQ ID NO: 2545965 - RNA, 23 nt, Human
ugucaggcugcuggcgccucugc

SEQ ID NO: 2545966 - RNA, 22 nt, Human
ugucaggcugcuggcgccucug

SEQ ID NO: 2545967 - RNA, 20 nt, Human
ugucaggcugcuggcgccuc

SEQ ID NO: 2545968 - RNA, 22 nt, Human
ugucaggggcggggagggugac

SEQ ID NO: 2545969 - RNA, 22 nt, Human
aguaggaagacuuuggaaagac

SEQ ID NO: 2545970 - RNA, 19 nt, Human
aguaggaagacuuuggaaa

SEQ ID NO: 2545971 - RNA, 18 nt, Human
aguaggaagacuuuggaa

SEQ ID NO: 2545972 - RNA, 17 nt, Human
aguaggaagacuuugga

SEQ ID NO: 2545973 - RNA, 16 nt, Human
aguaggaagacuuugg

SEQ ID NO: 2545974 - RNA, 17 nt, Human
ugucaauauuuaaacau

SEQ ID NO: 2545975 - RNA, 20 nt, Human
ugucaaucagccuaguugau

SEQ ID NO: 2545976 - RNA, 23 nt, Human
ugucaauauuaaauacagacacu

SEQ ID NO: 2545977 - RNA, 21 nt, Human
ugucaauauuaaauacagaca

SEQ ID NO: 2545978 - RNA, 19 nt, Human
ugucaauauuaaauacaga

SEQ ID NO: 2545979 - RNA, 18 nt, Human
ugucaauauuaaauacag

SEQ ID NO: 2545980 - RNA, 17 nt, Human
ugucaauauuaaauaca

SEQ ID NO: 2545981 - RNA, 14 nt, Human
ugucaauauuaaau

SEQ ID NO: 2545982 - RNA, 13 nt, Human
ugucaauauuaaa

SEQ ID NO: 2545983 - RNA, 14 nt, Human
aguaguuccugcua

SEQ ID NO: 2545984 - RNA, 14 nt, Human
aguaguuaauucug

SEQ ID NO: 2545985 - RNA, 15 nt, Human
aguaguuaauucugu

SEQ ID NO: 2545986 - RNA, 13 nt, Human
aguaguccuguga

SEQ ID NO: 2545987 - RNA, 12 nt, Human
aguaguccugug

SEQ ID NO: 2545988 - RNA, 14 nt, Human
aguaguccugugaa

SEQ ID NO: 2545989 - RNA, 13 nt, Human
aguagucucugug

SEQ ID NO: 2545990 - RNA, 13 nt, Human
aguagggggucua

SEQ ID NO: 2545991 - RNA, 14 nt, Human
aguagucauuucau

SEQ ID NO: 2545992 - RNA, 12 nt, Human
aguagucauuuc

SEQ ID NO: 2545993 - RNA, 13 nt, Human
aguagucauuuca

SEQ ID NO: 2545994 - RNA, 13 nt, Human
aguaggagcccag

SEQ ID NO: 2545995 - RNA, 20 nt, Human
aguagcuugggacaaaucaa

SEQ ID NO: 2545996 - RNA, 13 nt, Human
uguauuccaagac

SEQ ID NO: 2545997 - RNA, 15 nt, Human
uguauuccaagacau

SEQ ID NO: 2545998 - RNA, 20 nt, Human
uguauuccaagacaugucug

SEQ ID NO: 2545999 - RNA, 22 nt, Human
uguauucauugaagucagaugu

SEQ ID NO: 2546000 - RNA, 20 nt, Human
uguauuauuucauuauguaa

SEQ ID NO: 2546001 - RNA, 13 nt, Human
uguauuauuucau

SEQ ID NO: 2546002 - RNA, 21 nt, Human
uguauuauuucauuauguaaa

SEQ ID NO: 2546003 - RNA, 21 nt, Human
uguauucacccguccagaccu

SEQ ID NO: 2546004 - RNA, 15 nt, Human
uguagguaucauuuu

SEQ ID NO: 2546005 - RNA, 17 nt, Human
uguauucaucuuuugua

SEQ ID NO: 2546006 - RNA, 14 nt, Human
uguauucagcuuua

SEQ ID NO: 2546007 - RNA, 17 nt, Human
uguauucagugaggguc

SEQ ID NO: 2546008 - RNA, 14 nt, Human
uguaguaauugaca

SEQ ID NO: 2546009 - RNA, 15 nt, Human
uguaguaauugacau

SEQ ID NO: 2546010 - RNA, 16 nt, Human
uguaguaauugacaug

SEQ ID NO: 2546011 - RNA, 16 nt, Human
uguauuauucugcagc

SEQ ID NO: 2546012 - RNA, 22 nt, Human
uguaguaaagccguuguuuacu

SEQ ID NO: 2546013 - RNA, 19 nt, Human
uguaguaaacuauuuaucu

SEQ ID NO: 2546014 - RNA, 20 nt, Human
uguaguaaagccguuguuua

SEQ ID NO: 2546015 - RNA, 19 nt, Human
uguaguaaagccguuguuu

SEQ ID NO: 2546016 - RNA, 13 nt, Human
uguaguaaagaaa

SEQ ID NO: 2546017 - RNA, 15 nt, Human
uguaguaaagaaauu

SEQ ID NO: 2546018 - RNA, 19 nt, Human
ugucaagagggucugagga

SEQ ID NO: 2546019 - RNA, 15 nt, Human
ugucaagccauaauu

SEQ ID NO: 2546020 - RNA, 21 nt, Human
ugucaauaaaauccauacauu

SEQ ID NO: 2546021 - RNA, 19 nt, Human
uguauuuuucaauaaagca

SEQ ID NO: 2546022 - RNA, 14 nt, Human
uguauuuuuaaugg

SEQ ID NO: 2546023 - RNA, 14 nt, Human
uguauuuuuuuacu

SEQ ID NO: 2546024 - RNA, 19 nt, Human
ugucaagaagaugaucaga

SEQ ID NO: 2546025 - RNA, 14 nt, Human
ugucaagaaagagc

SEQ ID NO: 2546026 - RNA, 16 nt, Human
uguauuuuuuuacuaa

SEQ ID NO: 2546027 - RNA, 15 nt, Human
ugucgcccaggcugg

SEQ ID NO: 2546028 - RNA, 16 nt, Human
ugucgcccaggcugga

SEQ ID NO: 2546029 - RNA, 15 nt, Human
ugucgagacacuugc

SEQ ID NO: 2546030 - RNA, 13 nt, Human
ugucgagacacuu

SEQ ID NO: 2546031 - RNA, 22 nt, Human
ugucgauguaggcauucuggag

SEQ ID NO: 2546032 - RNA, 21 nt, Human
ugucgaauuuuuauuauuugu

SEQ ID NO: 2546033 - RNA, 17 nt, Human
uguccuuuuuguuauua

SEQ ID NO: 2546034 - RNA, 23 nt, Human
uguccuuucccuucaguacccuc

SEQ ID NO: 2546035 - RNA, 16 nt, Human
uguccuuuuuguuauu

SEQ ID NO: 2546036 - RNA, 20 nt, Human
uguccuaaggacacacuaau

SEQ ID NO: 2546037 - RNA, 18 nt, Human
uguccuaaggacacacua

SEQ ID NO: 2546038 - RNA, 16 nt, Human
uguccuaaggacacac

SEQ ID NO: 2546039 - RNA, 15 nt, Human
uguccuaaggacaca

SEQ ID NO: 2546040 - RNA, 16 nt, Human
uguccuacccacccuc

SEQ ID NO: 2546041 - RNA, 14 nt, Human
uguccuuucccuuc

SEQ ID NO: 2546042 - RNA, 13 nt, Human
uguccuuucccuu

SEQ ID NO: 2546043 - RNA, 17 nt, Human
uguccuuucccuccacu

SEQ ID NO: 2546044 - RNA, 18 nt, Human
uguccuuucccuccacuc

SEQ ID NO: 2546045 - RNA, 13 nt, Human
uguccgagcuuug

SEQ ID NO: 2546046 - RNA, 14 nt, Human
uguccgagcuuuga

SEQ ID NO: 2546047 - RNA, 23 nt, Human
uguccgcugggugguacccucug

SEQ ID NO: 2546048 - RNA, 22 nt, Human
uguccgcugggugguacccucu

SEQ ID NO: 2546049 - RNA, 22 nt, Human
uguccuaaaacaccugguagga

SEQ ID NO: 2546050 - RNA, 20 nt, Human
uguccgcugggugguacccu

SEQ ID NO: 2546051 - RNA, 15 nt, Human
uguccgcuggguggu

SEQ ID NO: 2546052 - RNA, 15 nt, Human
uguccgacucuucug

SEQ ID NO: 2546053 - RNA, 17 nt, Human
ugucccuuuuccuuuuu

SEQ ID NO: 2546054 - RNA, 12 nt, Human
ugucauuugcuu

SEQ ID NO: 2546055 - RNA, 14 nt, Human
ugucauuuucucca

SEQ ID NO: 2546056 - RNA, 15 nt, Human
ugucauuuuugcagu

SEQ ID NO: 2546057 - RNA, 15 nt, Human
ugucauuuucuccau

SEQ ID NO: 2546058 - RNA, 18 nt, Human
ugucauuuuugcaguaga

SEQ ID NO: 2546059 - RNA, 15 nt, Human
ugucgcccagucugg

SEQ ID NO: 2546060 - RNA, 14 nt, Human
ugucgcccagucug

SEQ ID NO: 2546061 - RNA, 12 nt, Human
ugucgggcauga

SEQ ID NO: 2546062 - RNA, 23 nt, Human
ugucggccucuaaccccaggccc

SEQ ID NO: 2546063 - RNA, 15 nt, Human
ugucgggcaugacac

SEQ ID NO: 2546064 - RNA, 14 nt, Human
ugucgggcaugaca

SEQ ID NO: 2546065 - RNA, 19 nt, Human
ugucggccugguguucugu

SEQ ID NO: 2546066 - RNA, 23 nt, Human
ugucgguuuuuuuuaaauaaaag

SEQ ID NO: 2546067 - RNA, 23 nt, Human
ugucguagccaaggugggcugag

SEQ ID NO: 2546068 - RNA, 21 nt, Human
ugucguggguguguguagcca

SEQ ID NO: 2546069 - RNA, 15 nt, Human
agucaggaaagagaa

SEQ ID NO: 2546070 - RNA, 16 nt, Human
agucaggaaagagaac

SEQ ID NO: 2546071 - RNA, 20 nt, Human
agucagaggauggccagugu

SEQ ID NO: 2546072 - RNA, 19 nt, Human
agucagaggauggccagug

SEQ ID NO: 2546073 - RNA, 18 nt, Human
agucagaggauggccagu

SEQ ID NO: 2546074 - RNA, 17 nt, Human
agucagaggauggccag

SEQ ID NO: 2546075 - RNA, 14 nt, Human
agucagaggauggc

SEQ ID NO: 2546076 - RNA, 17 nt, Human
agucagagagaguguuu

SEQ ID NO: 2546077 - RNA, 14 nt, Human
agucagagagaauc

SEQ ID NO: 2546078 - RNA, 20 nt, Human
ugucuaaacaaugcugauuu

SEQ ID NO: 2546079 - RNA, 21 nt, Human
ugucuaaacaaugcugauuug

SEQ ID NO: 2546080 - RNA, 22 nt, Human
agucagaaguuucugccgcagc

SEQ ID NO: 2546081 - RNA, 16 nt, Human
agucagacagaugugg

SEQ ID NO: 2546082 - RNA, 22 nt, Human
ugucuaaaaugccucaguguau

SEQ ID NO: 2546083 - RNA, 22 nt, Human
ugucuaaacaaugcugauuugg

SEQ ID NO: 2546084 - RNA, 15 nt, Human
agucagacugcuggg

SEQ ID NO: 2546085 - RNA, 22 nt, Human
ugucguugacuuuagggacuca

SEQ ID NO: 2546086 - RNA, 20 nt, Human
ugucguugacuuuagggacu

SEQ ID NO: 2546087 - RNA, 13 nt, Human
ugucuaaaaacac

SEQ ID NO: 2546088 - RNA, 16 nt, Human
ugucuaaacaaugcug

SEQ ID NO: 2546089 - RNA, 17 nt, Human
ugucuaaacaaugcuga

SEQ ID NO: 2546090 - RNA, 15 nt, Human
ugucuaaaacaauaa

SEQ ID NO: 2546091 - RNA, 17 nt, Human
ugucuaaaacaauaaaa

SEQ ID NO: 2546092 - RNA, 13 nt, Human
ugucuaaaacaau

SEQ ID NO: 2546093 - RNA, 18 nt, Human
agucuacucuuaagccau

SEQ ID NO: 2546094 - RNA, 13 nt, Human
agucuacucuuaa

SEQ ID NO: 2546095 - RNA, 20 nt, Human
agucuacgcucuccuuucuu

SEQ ID NO: 2546096 - RNA, 14 nt, Human
agucguugugaggg

SEQ ID NO: 2546097 - RNA, 21 nt, Human
agucguggggugugcugggag

SEQ ID NO: 2546098 - RNA, 20 nt, Human
agucguggggugugcuggga

SEQ ID NO: 2546099 - RNA, 19 nt, Human
agucguggggugugcuggg

SEQ ID NO: 2546100 - RNA, 18 nt, Human
agucguggggugugcugg

SEQ ID NO: 2546101 - RNA, 14 nt, Human
agucuagaaguugu

SEQ ID NO: 2546102 - RNA, 21 nt, Human
agucuacucuuaagccaucuu

SEQ ID NO: 2546103 - RNA, 20 nt, Human
agucuacucuuaagccaucu

SEQ ID NO: 2546104 - RNA, 19 nt, Human
agucuacucuuaagccauc

SEQ ID NO: 2546105 - RNA, 17 nt, Human
agucuagauggcuccuc

SEQ ID NO: 2546106 - RNA, 18 nt, Human
agucuagauggcuccucu

SEQ ID NO: 2546107 - RNA, 19 nt, Human
agucuagauggcuccucuc

SEQ ID NO: 2546108 - RNA, 20 nt, Human
agucuagauggcuccucuca

SEQ ID NO: 2546109 - RNA, 16 nt, Human
agucuaggagcuggga

SEQ ID NO: 2546110 - RNA, 17 nt, Human
agucucacuguugccca

SEQ ID NO: 2546111 - RNA, 16 nt, Human
agucucacuguugccc

SEQ ID NO: 2546112 - RNA, 21 nt, Human
agucguggagaugucuucgua

SEQ ID NO: 2546113 - RNA, 19 nt, Human
agucguggagaugucuucg

SEQ ID NO: 2546114 - RNA, 17 nt, Human
agucguggggugugcug

SEQ ID NO: 2546115 - RNA, 18 nt, Human
agucguggagaugucuuc

SEQ ID NO: 2546116 - RNA, 15 nt, Human
agucgugccuguguc

SEQ ID NO: 2546117 - RNA, 14 nt, Human
agucgugccugugu

SEQ ID NO: 2546118 - RNA, 13 nt, Human
agucgugccugug

SEQ ID NO: 2546119 - RNA, 12 nt, Human
agucgugccugu

SEQ ID NO: 2546120 - RNA, 21 nt, Human
agucgugagcucuugugagga

SEQ ID NO: 2546121 - RNA, 18 nt, Human
agucgucgcacagucucu

SEQ ID NO: 2546122 - RNA, 18 nt, Human
agucgugagcucuuguga

SEQ ID NO: 2546123 - RNA, 22 nt, Human
aguccgugcugacagcugcucc

SEQ ID NO: 2546124 - RNA, 23 nt, Human
aguccgugcugacagcugcuccu

SEQ ID NO: 2546125 - RNA, 21 nt, Human
aguccgugcugacagcugcuc

SEQ ID NO: 2546126 - RNA, 20 nt, Human
aguccgugcugacagcugcu

SEQ ID NO: 2546127 - RNA, 17 nt, Human
aguccgaggggcgggac

SEQ ID NO: 2546128 - RNA, 19 nt, Human
agucccuuccacaccccca

SEQ ID NO: 2546129 - RNA, 23 nt, Human
agucccuuccccucccuggcucc

SEQ ID NO: 2546130 - RNA, 23 nt, Human
aguccgaaagggacuuggaagcu

SEQ ID NO: 2546131 - RNA, 13 nt, Human
agucccuuccccu

SEQ ID NO: 2546132 - RNA, 14 nt, Human
agucccuuccccuc

SEQ ID NO: 2546133 - RNA, 15 nt, Human
agucccuuccccucc

SEQ ID NO: 2546134 - RNA, 17 nt, Human
agucccuuccccucccu

SEQ ID NO: 2546135 - RNA, 19 nt, Human
agucccuuccccucccugg

SEQ ID NO: 2546136 - RNA, 20 nt, Human
agucccuuccccucccuggc

SEQ ID NO: 2546137 - RNA, 21 nt, Human
agucccuuccccucccuggcu

SEQ ID NO: 2546138 - RNA, 22 nt, Human
agucccuuccccucccuggcuc

SEQ ID NO: 2546139 - RNA, 16 nt, Human
agucccuguaauuguu

SEQ ID NO: 2546140 - RNA, 18 nt, Human
agucccuguaauuguugu

SEQ ID NO: 2546141 - RNA, 14 nt, Human
agucccugggggaa

SEQ ID NO: 2546142 - RNA, 17 nt, Human
agucccugggggaagcc

SEQ ID NO: 2546143 - RNA, 20 nt, Human
agucccugggggaagcccug

SEQ ID NO: 2546144 - RNA, 21 nt, Human
agucccugggggaagcccugg

SEQ ID NO: 2546145 - RNA, 20 nt, Human
agucccuguaauuguuguuu

SEQ ID NO: 2546146 - RNA, 23 nt, Human
agucccuguaauuguuguuugua

SEQ ID NO: 2546147 - RNA, 13 nt, Human
agucccuguuuuc

SEQ ID NO: 2546148 - RNA, 15 nt, Human
agucccuuccacacc

SEQ ID NO: 2546149 - RNA, 22 nt, Human
agucccuguuuucugagcccgg

SEQ ID NO: 2546150 - RNA, 21 nt, Human
agucccuguuuucugagcccg

SEQ ID NO: 2546151 - RNA, 20 nt, Human
agucccuguuuucugagccc

SEQ ID NO: 2546152 - RNA, 19 nt, Human
agucccuguuuucugagcc

SEQ ID NO: 2546153 - RNA, 18 nt, Human
agucccuguuuucugagc

SEQ ID NO: 2546154 - RNA, 17 nt, Human
agucccuguuuucugag

SEQ ID NO: 2546155 - RNA, 22 nt, Human
agucccugggggaagcccugga

SEQ ID NO: 2546156 - RNA, 22 nt, Human
agucccugaggcagguccccag

SEQ ID NO: 2546157 - RNA, 23 nt, Human
agucccugaggcagguccccaga

SEQ ID NO: 2546158 - RNA, 12 nt, Human
agucccugccaa

SEQ ID NO: 2546159 - RNA, 21 nt, Human
agucccugacucucugugacc

SEQ ID NO: 2546160 - RNA, 22 nt, Human
aguccaggcuuuuuuaucaugu

SEQ ID NO: 2546161 - RNA, 18 nt, Human
aguccaggcugccguggg

SEQ ID NO: 2546162 - RNA, 17 nt, Human
aguccaggcugccgugg

SEQ ID NO: 2546163 - RNA, 14 nt, Human
aguccaggcugccg

SEQ ID NO: 2546164 - RNA, 13 nt, Human
aguccaggcccca

SEQ ID NO: 2546165 - RNA, 18 nt, Human
aguccaggccccaaaacc

SEQ ID NO: 2546166 - RNA, 19 nt, Human
agucccugaggcagguccc

SEQ ID NO: 2546167 - RNA, 20 nt, Human
agucccugaggcaggucccc

SEQ ID NO: 2546168 - RNA, 20 nt, Human
agucccuauguauuugcagu

SEQ ID NO: 2546169 - RNA, 19 nt, Human
agucccugacucucuguga

SEQ ID NO: 2546170 - RNA, 13 nt, Human
agucccgucagga

SEQ ID NO: 2546171 - RNA, 23 nt, Human
aguccaggccccaaaaccacagc

SEQ ID NO: 2546172 - RNA, 15 nt, Human
agucccuauguauuu

SEQ ID NO: 2546173 - RNA, 15 nt, Human
agucccgucaggacg

SEQ ID NO: 2546174 - RNA, 15 nt, Human
aguccagccuggaga

SEQ ID NO: 2546175 - RNA, 23 nt, Human
aguccagauuuacacugggagag

SEQ ID NO: 2546176 - RNA, 22 nt, Human
aguccagauuuacacugggaga

SEQ ID NO: 2546177 - RNA, 18 nt, Human
aguccagauuuacacugg

SEQ ID NO: 2546178 - RNA, 16 nt, Human
aguccagauuuacacu

SEQ ID NO: 2546179 - RNA, 15 nt, Human
aguccagauuuacac

SEQ ID NO: 2546180 - RNA, 17 nt, Human
agucaggggcagcugac

SEQ ID NO: 2546181 - RNA, 22 nt, Human
aguccaggaugcuaacaucuaa

SEQ ID NO: 2546182 - RNA, 13 nt, Human
aguccagccugga

SEQ ID NO: 2546183 - RNA, 19 nt, Human
aguccaggccauggaggca

SEQ ID NO: 2546184 - RNA, 12 nt, Human
aguccaggcccc

SEQ ID NO: 2546185 - RNA, 22 nt, Human
agucagaggauggccagugucu

SEQ ID NO: 2546186 - RNA, 12 nt, Human
agucaggaaagg

SEQ ID NO: 2546187 - RNA, 11 nt, Human
agucaggauga

SEQ ID NO: 2546188 - RNA, 22 nt, Human
agucaggccuuaauuuucagua

SEQ ID NO: 2546189 - RNA, 19 nt, Human
agucagggaccccugcccu

SEQ ID NO: 2546190 - RNA, 14 nt, Human
agucaggggcagcu

SEQ ID NO: 2546191 - RNA, 16 nt, Human
agucagggaccccugc

SEQ ID NO: 2546192 - RNA, 20 nt, Human
aguccagaaacuguucccac

SEQ ID NO: 2546193 - RNA, 21 nt, Human
agugccuguaaucacagcuac

SEQ ID NO: 2546194 - RNA, 15 nt, Human
agugccuuacacaau

SEQ ID NO: 2546195 - RNA, 17 nt, Human
agugccuuacacaaugg

SEQ ID NO: 2546196 - RNA, 20 nt, Human
agugcugcauuuaaaagaua

SEQ ID NO: 2546197 - RNA, 22 nt, Human
agugccgccgccucgcccaccg

SEQ ID NO: 2546198 - RNA, 20 nt, Human
agugccgccgccucgcccac

SEQ ID NO: 2546199 - RNA, 19 nt, Human
agugccgccgccucgccca

SEQ ID NO: 2546200 - RNA, 17 nt, Human
agugccgccgccucgcc

SEQ ID NO: 2546201 - RNA, 16 nt, Human
agugccgccgccucgc

SEQ ID NO: 2546202 - RNA, 23 nt, Human
agugccgccgccucgcccaccgc

SEQ ID NO: 2546203 - RNA, 14 nt, Human
agugccucuggucu

SEQ ID NO: 2546204 - RNA, 12 nt, Human
agugccucuggu

SEQ ID NO: 2546205 - RNA, 12 nt, Human
agugccugcuga

SEQ ID NO: 2546206 - RNA, 18 nt, Human
agugccucuuucauccac

SEQ ID NO: 2546207 - RNA, 13 nt, Human
agugccugggaau

SEQ ID NO: 2546208 - RNA, 20 nt, Human
agugcugggauuacaagcgu

SEQ ID NO: 2546209 - RNA, 22 nt, Human
agugcugcauuuaaaagauaca

SEQ ID NO: 2546210 - RNA, 15 nt, Human
agugcugcugaagau

SEQ ID NO: 2546211 - RNA, 17 nt, Human
agugccugggaauguau

SEQ ID NO: 2546212 - RNA, 18 nt, Human
agugccugggaauguauu

SEQ ID NO: 2546213 - RNA, 20 nt, Human
agugccuuaauaguagggua

SEQ ID NO: 2546214 - RNA, 22 nt, Human
agugccugggaauguauuauuc

SEQ ID NO: 2546215 - RNA, 22 nt, Human
agugcugggauuacaggcauga

SEQ ID NO: 2546216 - RNA, 19 nt, Human
agugcugggauuacaggcu

SEQ ID NO: 2546217 - RNA, 20 nt, Human
agugcugggauuacaggcau

SEQ ID NO: 2546218 - RNA, 16 nt, Human
agugcuuaaaaaucau

SEQ ID NO: 2546219 - RNA, 17 nt, Human
agugcuuaaaaaucauu

SEQ ID NO: 2546220 - RNA, 19 nt, Human
agugcuuaaaaaucauuga

SEQ ID NO: 2546221 - RNA, 14 nt, Human
agugcuucagccug

SEQ ID NO: 2546222 - RNA, 19 nt, Human
agugcugggauuacaggug

SEQ ID NO: 2546223 - RNA, 20 nt, Human
agugcugggauuacaggcgu

SEQ ID NO: 2546224 - RNA, 17 nt, Human
agugcugggauuacagg

SEQ ID NO: 2546225 - RNA, 16 nt, Human
uguggucccaccccac

SEQ ID NO: 2546226 - RNA, 16 nt, Human
agugcuuccaaggaug

SEQ ID NO: 2546227 - RNA, 15 nt, Human
agugcuucagccuga

SEQ ID NO: 2546228 - RNA, 16 nt, Human
agugcuucagccugag

SEQ ID NO: 2546229 - RNA, 17 nt, Human
agugcuucagccugagg

SEQ ID NO: 2546230 - RNA, 18 nt, Human
agugcuucagccugaggc

SEQ ID NO: 2546231 - RNA, 19 nt, Human
agugcuugccacagagcgg

SEQ ID NO: 2546232 - RNA, 17 nt, Human
agugcuugccacagagc

SEQ ID NO: 2546233 - RNA, 16 nt, Human
agugcuugccacagag

SEQ ID NO: 2546234 - RNA, 15 nt, Human
agugcuugccacaga

SEQ ID NO: 2546235 - RNA, 19 nt, Human
agugcuugaguuuggggaa

SEQ ID NO: 2546236 - RNA, 19 nt, Human
agugcuucagccugaggcu

SEQ ID NO: 2546237 - RNA, 20 nt, Human
agugcuucagccugaggcug

SEQ ID NO: 2546238 - RNA, 17 nt, Human
agugcuuccaaggcaga

SEQ ID NO: 2546239 - RNA, 16 nt, Human
agugcuuccaaggcag

SEQ ID NO: 2546240 - RNA, 14 nt, Human
agugcuucucuaca

SEQ ID NO: 2546241 - RNA, 21 nt, Human
agugcuucuuaaagaguucuu

SEQ ID NO: 2546242 - RNA, 13 nt, Human
uguggucuccacu

SEQ ID NO: 2546243 - RNA, 13 nt, Human
uguggugaugaaa

SEQ ID NO: 2546244 - RNA, 16 nt, Human
uguggugcugacaaag

SEQ ID NO: 2546245 - RNA, 19 nt, Human
uguggugccugaggucugu

SEQ ID NO: 2546246 - RNA, 15 nt, Human
uguggugccugaggu

SEQ ID NO: 2546247 - RNA, 17 nt, Human
uguggucuccuuggaaa

SEQ ID NO: 2546248 - RNA, 16 nt, Human
uguggugcagugugaa

SEQ ID NO: 2546249 - RNA, 17 nt, Human
uguggugcagugugaaa

SEQ ID NO: 2546250 - RNA, 22 nt, Human
ugugguggguucuuuggaagga

SEQ ID NO: 2546251 - RNA, 13 nt, Human
uguggugcugaca

SEQ ID NO: 2546252 - RNA, 14 nt, Human
ugugguuaaugcca

SEQ ID NO: 2546253 - RNA, 19 nt, Human
ugugucagcauagaaguaa

SEQ ID NO: 2546254 - RNA, 12 nt, Human
ugugguuucauu

SEQ ID NO: 2546255 - RNA, 18 nt, Human
ugugguuuacuagcagga

SEQ ID NO: 2546256 - RNA, 17 nt, Human
ugugguuauuucucuga

SEQ ID NO: 2546257 - RNA, 23 nt, Human
ugugguggguucuuuggaaggag

SEQ ID NO: 2546258 - RNA, 15 nt, Human
ugugguuaaugccau

SEQ ID NO: 2546259 - RNA, 20 nt, Human
ugugguuaaugccauggaca

SEQ ID NO: 2546260 - RNA, 13 nt, Human
uguguugccaagc

SEQ ID NO: 2546261 - RNA, 19 nt, Human
uguguuccaacugccccca

SEQ ID NO: 2546262 - RNA, 16 nt, Human
uguguucccauuucag

SEQ ID NO: 2546263 - RNA, 15 nt, Human
uguguuccaaccacu

SEQ ID NO: 2546264 - RNA, 16 nt, Human
uguguuccaaccacug

SEQ ID NO: 2546265 - RNA, 13 nt, Human
uguguuauuuaaa

SEQ ID NO: 2546266 - RNA, 14 nt, Human
uguguuauuuaaau

SEQ ID NO: 2546267 - RNA, 16 nt, Human
uguguuauuuaaauga

SEQ ID NO: 2546268 - RNA, 14 nt, Human
uguguuaugaagca

SEQ ID NO: 2546269 - RNA, 13 nt, Human
uguguguguguau

SEQ ID NO: 2546270 - RNA, 16 nt, Human
uguguguguguaugug

SEQ ID NO: 2546271 - RNA, 23 nt, Human
uguguuaucacccagaagaaaau

SEQ ID NO: 2546272 - RNA, 15 nt, Human
ugugugugugugucc

SEQ ID NO: 2546273 - RNA, 13 nt, Human
ugugugugugugu

SEQ ID NO: 2546274 - RNA, 12 nt, Human
ugugugugugug

SEQ ID NO: 2546275 - RNA, 15 nt, Human
uguguguguguauga

SEQ ID NO: 2546276 - RNA, 14 nt, Human
ugugguuuauguca

SEQ ID NO: 2546277 - RNA, 19 nt, Human
ugugucagguggggcagcu

SEQ ID NO: 2546278 - RNA, 17 nt, Human
ugugucagguggggcag

SEQ ID NO: 2546279 - RNA, 11 nt, Human
ugugugugugc

SEQ ID NO: 2546280 - RNA, 12 nt, Human
ugugugugugca

SEQ ID NO: 2546281 - RNA, 14 nt, Human
ugugugugugcgug

SEQ ID NO: 2546282 - RNA, 11 nt, Human
ugugugugugu

SEQ ID NO: 2546283 - RNA, 16 nt, Human
ugugucucuugguccu

SEQ ID NO: 2546284 - RNA, 20 nt, Human
ugugucuaggcaggaccugu

SEQ ID NO: 2546285 - RNA, 13 nt, Human
ugugucucuuggu

SEQ ID NO: 2546286 - RNA, 21 nt, Human
ugugucuacagagaaccugga

SEQ ID NO: 2546287 - RNA, 14 nt, Human
ugugucuacagaga

SEQ ID NO: 2546288 - RNA, 13 nt, Human
ugugucuacagag

SEQ ID NO: 2546289 - RNA, 19 nt, Human
ugugucuaggcaggaccug

SEQ ID NO: 2546290 - RNA, 11 nt, Human
aguggaaaaau

SEQ ID NO: 2546291 - RNA, 22 nt, Human
agugcuuuccuuuuuuaaaaau

SEQ ID NO: 2546292 - RNA, 19 nt, Human
agugcuuuccuuuuuuaaa

SEQ ID NO: 2546293 - RNA, 20 nt, Human
uguuaauggugcaaauccua

SEQ ID NO: 2546294 - RNA, 13 nt, Human
agugcuuuguaau

SEQ ID NO: 2546295 - RNA, 18 nt, Human
aguggaaaaauagccugc

SEQ ID NO: 2546296 - RNA, 19 nt, Human
aguggaaaaauagccugcc

SEQ ID NO: 2546297 - RNA, 19 nt, Human
uguuaaugauagcuacugu

SEQ ID NO: 2546298 - RNA, 22 nt, Human
uguuaaucaauuuaaacccauu

SEQ ID NO: 2546299 - RNA, 20 nt, Human
uguuaaucaauuuaaaccca

SEQ ID NO: 2546300 - RNA, 17 nt, Human
uguuaaucaauuuaaac

SEQ ID NO: 2546301 - RNA, 14 nt, Human
uguuaaucaauuua

SEQ ID NO: 2546302 - RNA, 23 nt, Human
uguuaaucuuaggggagagcuuu

SEQ ID NO: 2546303 - RNA, 14 nt, Human
uguuaaugaaaaug

SEQ ID NO: 2546304 - RNA, 17 nt, Human
uguuaaugaaaauguca

SEQ ID NO: 2546305 - RNA, 19 nt, Human
uguuaaugaaaaugucaga

SEQ ID NO: 2546306 - RNA, 17 nt, Human
uguuaaugguuugaaua

SEQ ID NO: 2546307 - RNA, 19 nt, Human
agugcuuguccccuaagag

SEQ ID NO: 2546308 - RNA, 14 nt, Human
uguguugucuugaa

SEQ ID NO: 2546309 - RNA, 19 nt, Human
uguguugucucuugaguuu

SEQ ID NO: 2546310 - RNA, 19 nt, Human
uguguuggggccuuggccu

SEQ ID NO: 2546311 - RNA, 13 nt, Human
uguguugucucua

SEQ ID NO: 2546312 - RNA, 13 nt, Human
uguuaacacauuu

SEQ ID NO: 2546313 - RNA, 18 nt, Human
uguguugucuugaaagau

SEQ ID NO: 2546314 - RNA, 13 nt, Human
uguguugugaaug

SEQ ID NO: 2546315 - RNA, 15 nt, Human
uguguugcuauccug

SEQ ID NO: 2546316 - RNA, 22 nt, Human
uguguugggauugagucugugc

SEQ ID NO: 2546317 - RNA, 12 nt, Human
uguguuggcuug

SEQ ID NO: 2546318 - RNA, 16 nt, Human
uguguugccaagcucc

SEQ ID NO: 2546319 - RNA, 18 nt, Human
uguguugccacaggacac

SEQ ID NO: 2546320 - RNA, 23 nt, Human
uguguugccacaggacacaguca

SEQ ID NO: 2546321 - RNA, 18 nt, Human
uguguugccaugugugcu

SEQ ID NO: 2546322 - RNA, 22 nt, Human
uguuaacacauuuuguauaauu

SEQ ID NO: 2546323 - RNA, 21 nt, Human
uguuaacacauuuuguauaau

SEQ ID NO: 2546324 - RNA, 20 nt, Human
uguuaacacauuuuguauaa

SEQ ID NO: 2546325 - RNA, 18 nt, Human
uguuaacacauuuuguau

SEQ ID NO: 2546326 - RNA, 21 nt, Human
uguuaacauggacaugaucuu

SEQ ID NO: 2546327 - RNA, 13 nt, Human
uguuaaucaauuu

SEQ ID NO: 2546328 - RNA, 12 nt, Human
uguuaaucaauu

SEQ ID NO: 2546329 - RNA, 19 nt, Human
uguuaacucuugucuauuu

SEQ ID NO: 2546330 - RNA, 19 nt, Human
uguuaaccucagugucauu

SEQ ID NO: 2546331 - RNA, 17 nt, Human
uguuaacucuugucuau

SEQ ID NO: 2546332 - RNA, 17 nt, Human
uguuaaccucaguguca

SEQ ID NO: 2546333 - RNA, 16 nt, Human
uguuaaccagaauaaa

SEQ ID NO: 2546334 - RNA, 15 nt, Human
uguuaaccucagugu

SEQ ID NO: 2546335 - RNA, 16 nt, Human
agugagucgaggacag

SEQ ID NO: 2546336 - RNA, 17 nt, Human
uguggcccuggccugcu

SEQ ID NO: 2546337 - RNA, 23 nt, Human
uguggcccugccaucuucccagc

SEQ ID NO: 2546338 - RNA, 14 nt, Human
uguggcccuggccu

SEQ ID NO: 2546339 - RNA, 20 nt, Human
uguggcccuggccugcuggg

SEQ ID NO: 2546340 - RNA, 23 nt, Human
uguggccccacccugggcccugg

SEQ ID NO: 2546341 - RNA, 17 nt, Human
uguggccccugaacaag

SEQ ID NO: 2546342 - RNA, 22 nt, Human
uguggccccugaacaagaauug

SEQ ID NO: 2546343 - RNA, 12 nt, Human
uguggccccuuc

SEQ ID NO: 2546344 - RNA, 14 nt, Human
uguggcccugccau

SEQ ID NO: 2546345 - RNA, 13 nt, Human
uguggcccugcca

SEQ ID NO: 2546346 - RNA, 13 nt, Human
uguggccccuuca

SEQ ID NO: 2546347 - RNA, 22 nt, Human
uguggcccugccaucuucccag

SEQ ID NO: 2546348 - RNA, 21 nt, Human
uguggcccugccaucuuccca

SEQ ID NO: 2546349 - RNA, 12 nt, Human
uguggcccuggc

SEQ ID NO: 2546350 - RNA, 13 nt, Human
agugagugagccu

SEQ ID NO: 2546351 - RNA, 15 nt, Human
agugagucugucagc

SEQ ID NO: 2546352 - RNA, 14 nt, Human
agugagucugucag

SEQ ID NO: 2546353 - RNA, 16 nt, Human
agugagucucuucaga

SEQ ID NO: 2546354 - RNA, 16 nt, Human
agugagugagccuggc

SEQ ID NO: 2546355 - RNA, 14 nt, Human
agugagugagccug

SEQ ID NO: 2546356 - RNA, 23 nt, Human
agugagugcaaaaagcugaguau

SEQ ID NO: 2546357 - RNA, 16 nt, Human
agugaguguggcuccc

SEQ ID NO: 2546358 - RNA, 18 nt, Human
agugaguguggcuccccu

SEQ ID NO: 2546359 - RNA, 19 nt, Human
agugaguguggcuccccuc

SEQ ID NO: 2546360 - RNA, 24 nt, Human
agugauucuccugccucagccucc

SEQ ID NO: 2546361 - RNA, 22 nt, Human
agugauucuccugccucagccu

SEQ ID NO: 2546362 - RNA, 21 nt, Human
agugcaaauugucacaggaca

SEQ ID NO: 2546363 - RNA, 18 nt, Human
agugcaaauugucacagg

SEQ ID NO: 2546364 - RNA, 17 nt, Human
agugauugggacagagg

SEQ ID NO: 2546365 - RNA, 15 nt, Human
agugauuguuggcac

SEQ ID NO: 2546366 - RNA, 22 nt, Human
agugaguuacagcgagaggcag

SEQ ID NO: 2546367 - RNA, 16 nt, Human
agugauuguaugaauu

SEQ ID NO: 2546368 - RNA, 21 nt, Human
agugaguguggcuccccucua

SEQ ID NO: 2546369 - RNA, 22 nt, Human
agugcaaauugucacaggacag

SEQ ID NO: 2546370 - RNA, 15 nt, Human
agugauuucuagaaa

SEQ ID NO: 2546371 - RNA, 13 nt, Human
agugauuucuaga

SEQ ID NO: 2546372 - RNA, 16 nt, Human
agugcaaugacacagu

SEQ ID NO: 2546373 - RNA, 22 nt, Human
agugcaaugguauaaauuucaa

SEQ ID NO: 2546374 - RNA, 23 nt, Human
agugcaauggcgugaucucggcu

SEQ ID NO: 2546375 - RNA, 18 nt, Human
agugcaaugacacagucu

SEQ ID NO: 2546376 - RNA, 17 nt, Human
agugcaucucagcccac

SEQ ID NO: 2546377 - RNA, 16 nt, Human
agugcaucucagccca

SEQ ID NO: 2546378 - RNA, 15 nt, Human
agugcaugcucucug

SEQ ID NO: 2546379 - RNA, 16 nt, Human
agugcaugcucucugc

SEQ ID NO: 2546380 - RNA, 17 nt, Human
agugcaugcucucugca

SEQ ID NO: 2546381 - RNA, 20 nt, Human
agugcaugcucucugcagcc

SEQ ID NO: 2546382 - RNA, 22 nt, Human
agugcaugcucucugcagccag

SEQ ID NO: 2546383 - RNA, 14 nt, Human
agugcaucucagcc

SEQ ID NO: 2546384 - RNA, 15 nt, Human
agugcaucucagccc

SEQ ID NO: 2546385 - RNA, 16 nt, Human
agugcaguccugauca

SEQ ID NO: 2546386 - RNA, 22 nt, Human
agugcaguccugaucagagccg

SEQ ID NO: 2546387 - RNA, 11 nt, Human
agugcaggcug

SEQ ID NO: 2546388 - RNA, 13 nt, Human
agugcaggcuggc

SEQ ID NO: 2546389 - RNA, 15 nt, Human
agugcaggcuggcac

SEQ ID NO: 2546390 - RNA, 18 nt, Human
agugcagcugauuuuaac

SEQ ID NO: 2546391 - RNA, 20 nt, Human
agugcagcugauuuuaacaa

SEQ ID NO: 2546392 - RNA, 14 nt, Human
agugcagcugauuu

SEQ ID NO: 2546393 - RNA, 15 nt, Human
agugcagcugauuuu

SEQ ID NO: 2546394 - RNA, 16 nt, Human
agugcagcugauuuua

SEQ ID NO: 2546395 - RNA, 17 nt, Human
agugcagcugauuuuaa

SEQ ID NO: 2546396 - RNA, 17 nt, Human
agugcagccguuugaga

SEQ ID NO: 2546397 - RNA, 18 nt, Human
agugcagccguuugagaa

SEQ ID NO: 2546398 - RNA, 17 nt, Human
agugcacccacucugcu

SEQ ID NO: 2546399 - RNA, 23 nt, Human
agugcagcccguguggccccuuc

SEQ ID NO: 2546400 - RNA, 24 nt, Human
agugcagcccguguggccccuuca

SEQ ID NO: 2546401 - RNA, 13 nt, Human
agugcacccacuc

SEQ ID NO: 2546402 - RNA, 21 nt, Human
agugcagcccguguggccccu

SEQ ID NO: 2546403 - RNA, 16 nt, Human
agugccaacaauccua

SEQ ID NO: 2546404 - RNA, 16 nt, Human
agugccaaaaacaaca

SEQ ID NO: 2546405 - RNA, 15 nt, Human
agugcccaacuguua

SEQ ID NO: 2546406 - RNA, 21 nt, Human
agugccacugcccgagcuggu

SEQ ID NO: 2546407 - RNA, 22 nt, Human
agugccacugcccgagcuggug

SEQ ID NO: 2546408 - RNA, 21 nt, Human
agugccaacaauccuagugcu

SEQ ID NO: 2546409 - RNA, 19 nt, Human
agugccaagcacagugccu

SEQ ID NO: 2546410 - RNA, 14 nt, Human
agugccaagcacag

SEQ ID NO: 2546411 - RNA, 20 nt, Human
agugccacugcccgagcugg

SEQ ID NO: 2546412 - RNA, 19 nt, Human
agugccacucauuccugua

SEQ ID NO: 2546413 - RNA, 14 nt, Human
agugcccacaggau

SEQ ID NO: 2546414 - RNA, 16 nt, Human
agugcccaccaacauc

SEQ ID NO: 2546415 - RNA, 17 nt, Human
agugcccaacuguuaua

SEQ ID NO: 2546416 - RNA, 20 nt, Human
agugcccaccaacaucccau

SEQ ID NO: 2546417 - RNA, 13 nt, Human
agugcccauuccu

SEQ ID NO: 2546418 - RNA, 19 nt, Human
agugcccaccaacauccca

SEQ ID NO: 2546419 - RNA, 23 nt, Human
agugcccagaacuggacucagga

SEQ ID NO: 2546420 - RNA, 19 nt, Human
agugccccauucuuuugua

SEQ ID NO: 2546421 - RNA, 17 nt, Human
agugcccauuccucacc

SEQ ID NO: 2546422 - RNA, 16 nt, Human
agugcccccacugacc

SEQ ID NO: 2546423 - RNA, 14 nt, Human
agugcccccacuga

SEQ ID NO: 2546424 - RNA, 20 nt, Human
agugccccauucuuuuguaa

SEQ ID NO: 2546425 - RNA, 19 nt, Human
uguggccccacccugggcc

SEQ ID NO: 2546426 - RNA, 17 nt, Human
uguggccccacccuggg

SEQ ID NO: 2546427 - RNA, 13 nt, Human
uguggccccaccc

SEQ ID NO: 2546428 - RNA, 12 nt, Human
uguggccccacc

SEQ ID NO: 2546429 - RNA, 19 nt, Human
uguggcaauagugggcccu

SEQ ID NO: 2546430 - RNA, 17 nt, Human
uguggcaaggaaaaaca

SEQ ID NO: 2546431 - RNA, 14 nt, Human
uguggcacauucuu

SEQ ID NO: 2546432 - RNA, 13 nt, Human
uguggagacuggg

SEQ ID NO: 2546433 - RNA, 19 nt, Human
uguggagagugcaacagua

SEQ ID NO: 2546434 - RNA, 19 nt, Human
uguggagccgaggccuacc

SEQ ID NO: 2546435 - RNA, 16 nt, Human
uguggagccgaggccu

SEQ ID NO: 2546436 - RNA, 16 nt, Human
uguggagcccgcaccc

SEQ ID NO: 2546437 - RNA, 18 nt, Human
uguggagcccgcaccccc

SEQ ID NO: 2546438 - RNA, 19 nt, Human
uguggagcccgcaccccca

SEQ ID NO: 2546439 - RNA, 17 nt, Human
uguggaggaaggauugu

SEQ ID NO: 2546440 - RNA, 16 nt, Human
uguggaggaaggauug

SEQ ID NO: 2546441 - RNA, 15 nt, Human
uguggaggaaggauu

SEQ ID NO: 2546442 - RNA, 14 nt, Human
uguggaggaaggau

SEQ ID NO: 2546443 - RNA, 12 nt, Human
uguggaggaagg

SEQ ID NO: 2546444 - RNA, 20 nt, Human
uguggagccgaggccuaccc

SEQ ID NO: 2546445 - RNA, 21 nt, Human
uguggauuuuugugguaguga

SEQ ID NO: 2546446 - RNA, 22 nt, Human
uguggcaaagccuucauugccu

SEQ ID NO: 2546447 - RNA, 18 nt, Human
uguggcaagccccugccc

SEQ ID NO: 2546448 - RNA, 15 nt, Human
ugugcugcccugccc

SEQ ID NO: 2546449 - RNA, 14 nt, Human
ugugcugcccugcc

SEQ ID NO: 2546450 - RNA, 13 nt, Human
ugugcugcccugc

SEQ ID NO: 2546451 - RNA, 18 nt, Human
ugugcucuggacaggcau

SEQ ID NO: 2546452 - RNA, 16 nt, Human
ugugcucuggacaggc

SEQ ID NO: 2546453 - RNA, 19 nt, Human
ugugcucuggacaggcaug

SEQ ID NO: 2546454 - RNA, 12 nt, Human
ugugcugcccug

SEQ ID NO: 2546455 - RNA, 23 nt, Human
ugugccccccauccuggcccauc

SEQ ID NO: 2546456 - RNA, 22 nt, Human
ugugccccccauccuggcccau

SEQ ID NO: 2546457 - RNA, 21 nt, Human
ugugccccccauccuggccca

SEQ ID NO: 2546458 - RNA, 20 nt, Human
ugugccccccauccuggccc

SEQ ID NO: 2546459 - RNA, 19 nt, Human
ugugccccccauccuggcc

SEQ ID NO: 2546460 - RNA, 18 nt, Human
ugugccccccauccuggc

SEQ ID NO: 2546461 - RNA, 16 nt, Human
ugugccccccauccug

SEQ ID NO: 2546462 - RNA, 15 nt, Human
ugugccccccauccu

SEQ ID NO: 2546463 - RNA, 20 nt, Human
ugugcccuaaaguguauuuu

SEQ ID NO: 2546464 - RNA, 14 nt, Human
ugugcccccucuac

SEQ ID NO: 2546465 - RNA, 21 nt, Human
ugugcccuaaaguguauuuuu

SEQ ID NO: 2546466 - RNA, 19 nt, Human
agucucacuguugcccagg

SEQ ID NO: 2546467 - RNA, 18 nt, Human
agucucacuguugcccag

SEQ ID NO: 2546468 - RNA, 20 nt, Human
agucucacuguugcccaggc

SEQ ID NO: 2546469 - RNA, 13 nt, Human
ugugccccccauc

SEQ ID NO: 2546470 - RNA, 21 nt, Human
agucucacuguugcccaggcu

SEQ ID NO: 2546471 - RNA, 15 nt, Human
ugugcucuggacagg

SEQ ID NO: 2546472 - RNA, 23 nt, Human
ugugcucugaucauccacugugc

SEQ ID NO: 2546473 - RNA, 12 nt, Human
ugugcucugauc

SEQ ID NO: 2546474 - RNA, 22 nt, Human
ugugcucugaucauccacugug

SEQ ID NO: 2546475 - RNA, 12 nt, Human
ugugccucggcu

SEQ ID NO: 2546476 - RNA, 21 nt, Human
ugugccucggcuuuucucagc

SEQ ID NO: 2546477 - RNA, 12 nt, Human
ugugccucugcc

SEQ ID NO: 2546478 - RNA, 14 nt, Human
ugugccuccucacc

SEQ ID NO: 2546479 - RNA, 15 nt, Human
ugugccuccucaccc

SEQ ID NO: 2546480 - RNA, 14 nt, Human
ugugccucccaaaa

SEQ ID NO: 2546481 - RNA, 16 nt, Human
ugugccuccucacccc

SEQ ID NO: 2546482 - RNA, 19 nt, Human
aguguuaggccuggcacag

SEQ ID NO: 2546483 - RNA, 17 nt, Human
aguguuaggccuggcac

SEQ ID NO: 2546484 - RNA, 15 nt, Human
aguguuagggaaggg

SEQ ID NO: 2546485 - RNA, 18 nt, Human
aguguuagggaagggccu

SEQ ID NO: 2546486 - RNA, 19 nt, Human
aguguuagggaagggccug

SEQ ID NO: 2546487 - RNA, 23 nt, Human
aguguuagggaagggccugccac

SEQ ID NO: 2546488 - RNA, 20 nt, Human
aguguuaggccuggcacagu

SEQ ID NO: 2546489 - RNA, 23 nt, Human
aguguuaucagucauaacuaaau

SEQ ID NO: 2546490 - RNA, 16 nt, Human
aguguuaucagucaua

SEQ ID NO: 2546491 - RNA, 19 nt, Human
aguguuaugcggucuaggg

SEQ ID NO: 2546492 - RNA, 22 nt, Human
aguguuauuaguguaugcuuug

SEQ ID NO: 2546493 - RNA, 17 nt, Human
aguguugaaaauguuca

SEQ ID NO: 2546494 - RNA, 22 nt, Human
aguguuauuuucuuugaaauug

SEQ ID NO: 2546495 - RNA, 19 nt, Human
aguguguguuuuucauaaa

SEQ ID NO: 2546496 - RNA, 12 nt, Human
aguguguucuga

SEQ ID NO: 2546497 - RNA, 13 nt, Human
aguguguucugau

SEQ ID NO: 2546498 - RNA, 17 nt, Human
aguguguucugauuaga

SEQ ID NO: 2546499 - RNA, 20 nt, Human
aguguguucugauuagaaau

SEQ ID NO: 2546500 - RNA, 15 nt, Human
aguguguuguugcuu

SEQ ID NO: 2546501 - RNA, 21 nt, Human
aguguguucugauuagaaaug

SEQ ID NO: 2546502 - RNA, 19 nt, Human
aguguguuuccuucagugc

SEQ ID NO: 2546503 - RNA, 20 nt, Human
aguguguuuccuucagugca

SEQ ID NO: 2546504 - RNA, 16 nt, Human
aguguuaggccuggca

SEQ ID NO: 2546505 - RNA, 15 nt, Human
aguguuaggccuggc

SEQ ID NO: 2546506 - RNA, 15 nt, Human
aguguuaaucaauuu

SEQ ID NO: 2546507 - RNA, 12 nt, Human
aguguuaaucaa

SEQ ID NO: 2546508 - RNA, 20 nt, Human
aguguuaaucaauuuaaacc

SEQ ID NO: 2546509 - RNA, 20 nt, Human
aguguuaauacuaguuguga

SEQ ID NO: 2546510 - RNA, 19 nt, Human
aguguuaauacuaguugug

SEQ ID NO: 2546511 - RNA, 16 nt, Human
aguguuaauacuaguu

SEQ ID NO: 2546512 - RNA, 15 nt, Human
aguguuaauacuagu

SEQ ID NO: 2546513 - RNA, 15 nt, Human
aguguuaaaugugau

SEQ ID NO: 2546514 - RNA, 22 nt, Human
aguguguuguugcuuuaggcuc

SEQ ID NO: 2546515 - RNA, 22 nt, Human
uguucuugguuuguaaauuaac

SEQ ID NO: 2546516 - RNA, 20 nt, Human
uguucuugaagcaguagccu

SEQ ID NO: 2546517 - RNA, 15 nt, Human
uguucuuuaggagau

SEQ ID NO: 2546518 - RNA, 20 nt, Human
uguucuugguuuguaaauua

SEQ ID NO: 2546519 - RNA, 13 nt, Human
uguucuugaauuu

SEQ ID NO: 2546520 - RNA, 23 nt, Human
uguucuugaauuuaauaaucugu

SEQ ID NO: 2546521 - RNA, 19 nt, Human
uguucuuucacccuuuucu

SEQ ID NO: 2546522 - RNA, 13 nt, Human
uguugcccaggcu

SEQ ID NO: 2546523 - RNA, 21 nt, Human
uguugcccaggcuggagugca

SEQ ID NO: 2546524 - RNA, 14 nt, Human
uguugcccaggcug

SEQ ID NO: 2546525 - RNA, 15 nt, Human
uguugcccaggcugg

SEQ ID NO: 2546526 - RNA, 16 nt, Human
aguguuggagaagaac

SEQ ID NO: 2546527 - RNA, 14 nt, Human
aguguuggagaaga

SEQ ID NO: 2546528 - RNA, 16 nt, Human
aguguugcauggaugu

SEQ ID NO: 2546529 - RNA, 17 nt, Human
aguguugagccuuuucc

SEQ ID NO: 2546530 - RNA, 18 nt, Human
aguguuggagaagaacug

SEQ ID NO: 2546531 - RNA, 17 nt, Human
aguguuggagaagaacu

SEQ ID NO: 2546532 - RNA, 23 nt, Human
aguguuggagaagaacugaaauc

SEQ ID NO: 2546533 - RNA, 21 nt, Human
aguuacucuucaguuaagccu

SEQ ID NO: 2546534 - RNA, 17 nt, Human
aguuacuccagugccaa

SEQ ID NO: 2546535 - RNA, 15 nt, Human
aguuacucugaaggg

SEQ ID NO: 2546536 - RNA, 18 nt, Human
aguuacugauucacugca

SEQ ID NO: 2546537 - RNA, 14 nt, Human
aguuacugaaugca

SEQ ID NO: 2546538 - RNA, 13 nt, Human
aguuacugaaugc

SEQ ID NO: 2546539 - RNA, 12 nt, Human
aguuacugaaug

SEQ ID NO: 2546540 - RNA, 21 nt, Human
aguuacuccagugccaacaau

SEQ ID NO: 2546541 - RNA, 16 nt, Human
aguuacucugaagggc

SEQ ID NO: 2546542 - RNA, 13 nt, Human
aguuacuguugug

SEQ ID NO: 2546543 - RNA, 17 nt, Human
aguuacuguuauagagg

SEQ ID NO: 2546544 - RNA, 22 nt, Human
aguuacuucacuuuaauucuca

SEQ ID NO: 2546545 - RNA, 17 nt, Human
aguuacuguugugaccu

SEQ ID NO: 2546546 - RNA, 14 nt, Human
aguuacuuccuauc

SEQ ID NO: 2546547 - RNA, 15 nt, Human
aguuacuuccuauca

SEQ ID NO: 2546548 - RNA, 19 nt, Human
aguuacuuugucagaggca

SEQ ID NO: 2546549 - RNA, 23 nt, Human
aguuacucagcccugggccccac

SEQ ID NO: 2546550 - RNA, 13 nt, Human
aguuauaguuuca

SEQ ID NO: 2546551 - RNA, 21 nt, Human
aguuagaauuccuucagggug

SEQ ID NO: 2546552 - RNA, 12 nt, Human
aguuagacuguu

SEQ ID NO: 2546553 - RNA, 19 nt, Human
aguuauaguauaucuggac

SEQ ID NO: 2546554 - RNA, 19 nt, Human
aguuagaauuccuucaggg

SEQ ID NO: 2546555 - RNA, 15 nt, Human
aguuagaauuccuuc

SEQ ID NO: 2546556 - RNA, 14 nt, Human
aguuagaauuccuu

SEQ ID NO: 2546557 - RNA, 23 nt, Human
aguggagguuaaggcugaggaaa

SEQ ID NO: 2546558 - RNA, 22 nt, Human
aguggagguuaaggcugaggaa

SEQ ID NO: 2546559 - RNA, 14 nt, Human
aguggaggcacuuu

SEQ ID NO: 2546560 - RNA, 17 nt, Human
aguggaggcacuuuagg

SEQ ID NO: 2546561 - RNA, 16 nt, Human
agugugggucugugug

SEQ ID NO: 2546562 - RNA, 17 nt, Human
agugugggucugugugu

SEQ ID NO: 2546563 - RNA, 15 nt, Human
agugugggucugugu

SEQ ID NO: 2546564 - RNA, 14 nt, Human
aguggaucuccaag

SEQ ID NO: 2546565 - RNA, 15 nt, Human
aguggaaauguucua

SEQ ID NO: 2546566 - RNA, 22 nt, Human
aguggaaagacagcuucucauc

SEQ ID NO: 2546567 - RNA, 17 nt, Human
aguggaagaagagggag

SEQ ID NO: 2546568 - RNA, 16 nt, Human
aguggaagaagaggga

SEQ ID NO: 2546569 - RNA, 17 nt, Human
aguggaagaagcagaug

SEQ ID NO: 2546570 - RNA, 15 nt, Human
aguggacuuuccacc

SEQ ID NO: 2546571 - RNA, 17 nt, Human
aguggacuuuccacccc

SEQ ID NO: 2546572 - RNA, 18 nt, Human
aguggacuuuccaccccc

SEQ ID NO: 2546573 - RNA, 19 nt, Human
aguggacuuuccacccccu

SEQ ID NO: 2546574 - RNA, 20 nt, Human
aguggacuuuccacccccuc

SEQ ID NO: 2546575 - RNA, 22 nt, Human
aguggacuuuccacccccuccc

SEQ ID NO: 2546576 - RNA, 16 nt, Human
aguggagaauuauaua

SEQ ID NO: 2546577 - RNA, 13 nt, Human
uguuaucaaacuu

SEQ ID NO: 2546578 - RNA, 19 nt, Human
uguuaucaccgugggcucc

SEQ ID NO: 2546579 - RNA, 21 nt, Human
uguuaucagucaauauuuuua

SEQ ID NO: 2546580 - RNA, 20 nt, Human
uguuaucaaaacuuucuuuu

SEQ ID NO: 2546581 - RNA, 19 nt, Human
agugugggucugugugugu

SEQ ID NO: 2546582 - RNA, 23 nt, Human
agugugggucuguguguguguau

SEQ ID NO: 2546583 - RNA, 17 nt, Human
aguguggucccaacagg

SEQ ID NO: 2546584 - RNA, 18 nt, Human
aguggaucuccaaggacc

SEQ ID NO: 2546585 - RNA, 21 nt, Human
agugugguagggacuuaaaaa

SEQ ID NO: 2546586 - RNA, 21 nt, Human
uguuauugggcaagugauuga

SEQ ID NO: 2546587 - RNA, 22 nt, Human
uguuauuauuacuuauuuuuga

SEQ ID NO: 2546588 - RNA, 12 nt, Human
uguuauuauaua

SEQ ID NO: 2546589 - RNA, 21 nt, Human
uguuauuagagauuaccuccu

SEQ ID NO: 2546590 - RNA, 23 nt, Human
uguuauuagagauuaccuccuga

SEQ ID NO: 2546591 - RNA, 13 nt, Human
uguuauuucucag

SEQ ID NO: 2546592 - RNA, 22 nt, Human
uguuauuucuauuuuuguagaa

SEQ ID NO: 2546593 - RNA, 21 nt, Human
uguuauuucuauuuuuguaga

SEQ ID NO: 2546594 - RNA, 14 nt, Human
uguuauuuauauau

SEQ ID NO: 2546595 - RNA, 17 nt, Human
uguuauuuagacucauc

SEQ ID NO: 2546596 - RNA, 21 nt, Human
uguuauuuauaaucacuuuuu

SEQ ID NO: 2546597 - RNA, 18 nt, Human
uguuauuuauaaucacuu

SEQ ID NO: 2546598 - RNA, 18 nt, Human
uguuauuuaacagcugaa

SEQ ID NO: 2546599 - RNA, 22 nt, Human
uguuauugggcaagugauugaa

SEQ ID NO: 2546600 - RNA, 14 nt, Human
uguuauuuaaagaa

SEQ ID NO: 2546601 - RNA, 15 nt, Human
uguuauuuaaaugag

SEQ ID NO: 2546602 - RNA, 17 nt, Human
uguuauuucucagacuu

SEQ ID NO: 2546603 - RNA, 12 nt, Human
uguuccccuccu

SEQ ID NO: 2546604 - RNA, 15 nt, Human
uguuccccuccucca

SEQ ID NO: 2546605 - RNA, 13 nt, Human
uguuccccuccuc

SEQ ID NO: 2546606 - RNA, 23 nt, Human
uguuccccuccuccacucucccc

SEQ ID NO: 2546607 - RNA, 14 nt, Human
uguuccccuuccac

SEQ ID NO: 2546608 - RNA, 17 nt, Human
uguuccccuuccacuga

SEQ ID NO: 2546609 - RNA, 19 nt, Human
uguuccccuccuccacucu

SEQ ID NO: 2546610 - RNA, 17 nt, Human
uguuccccuccuccacu

SEQ ID NO: 2546611 - RNA, 20 nt, Human
uguuccccuuccacugaggg

SEQ ID NO: 2546612 - RNA, 21 nt, Human
uguuccccuuccacugagggc

SEQ ID NO: 2546613 - RNA, 23 nt, Human
uguuccccuuccacugagggcag

SEQ ID NO: 2546614 - RNA, 22 nt, Human
uguucuaauuaauaaauuauuu

SEQ ID NO: 2546615 - RNA, 18 nt, Human
uguucuagcauggcugcc

SEQ ID NO: 2546616 - RNA, 17 nt, Human
uguucuaagucuuucca

SEQ ID NO: 2546617 - RNA, 21 nt, Human
uguuccccucacuggaugaaa

SEQ ID NO: 2546618 - RNA, 18 nt, Human
uguucccucucccuguug

SEQ ID NO: 2546619 - RNA, 13 nt, Human
uguucuugaagca

SEQ ID NO: 2546620 - RNA, 18 nt, Human
uguucuuaguuugcaguu

SEQ ID NO: 2546621 - RNA, 15 nt, Human
uguucuaguuuucag

SEQ ID NO: 2546622 - RNA, 18 nt, Human
uguucuacucauauauau

SEQ ID NO: 2546623 - RNA, 12 nt, Human
aguucaaugauc

SEQ ID NO: 2546624 - RNA, 11 nt, Human
aguucaaugau

SEQ ID NO: 2546625 - RNA, 10 nt, Human
aguucaauga

SEQ ID NO: 2546626 - RNA, 22 nt, Human
aguucaaucucccgcugcugcu

SEQ ID NO: 2546627 - RNA, 15 nt, Human
aguucaaucucccgc

SEQ ID NO: 2546628 - RNA, 13 nt, Human
aguucaauccuac

SEQ ID NO: 2546629 - RNA, 21 nt, Human
aguucaauaaaugucuguuga

SEQ ID NO: 2546630 - RNA, 19 nt, Human
aguucaauaaaugucuguu

SEQ ID NO: 2546631 - RNA, 18 nt, Human
aguucaauaaaugucugu

SEQ ID NO: 2546632 - RNA, 23 nt, Human
aguucaaugaucuagguuuaacu

SEQ ID NO: 2546633 - RNA, 22 nt, Human
aguucaaugaucuagguuuaac

SEQ ID NO: 2546634 - RNA, 21 nt, Human
aguucaaugaucuagguuuaa

SEQ ID NO: 2546635 - RNA, 20 nt, Human
aguucaaugaucuagguuua

SEQ ID NO: 2546636 - RNA, 16 nt, Human
aguucaaugaucuagg

SEQ ID NO: 2546637 - RNA, 15 nt, Human
aguucaaugaucuag

SEQ ID NO: 2546638 - RNA, 14 nt, Human
aguucaaugaucua

SEQ ID NO: 2546639 - RNA, 13 nt, Human
aguucaaugaucu

SEQ ID NO: 2546640 - RNA, 16 nt, Human
aguucaauucucauuu

SEQ ID NO: 2546641 - RNA, 23 nt, Human
aguuaucagacacucuggcuggu

SEQ ID NO: 2546642 - RNA, 18 nt, Human
aguuaucaugcauguuau

SEQ ID NO: 2546643 - RNA, 21 nt, Human
aguuaucagacacucuggcug

SEQ ID NO: 2546644 - RNA, 22 nt, Human
aguuauauagguuuuguuugcu

SEQ ID NO: 2546645 - RNA, 23 nt, Human
aguuauauagguuuuguuugcua

SEQ ID NO: 2546646 - RNA, 21 nt, Human
aguuauauagguuuuguuugc

SEQ ID NO: 2546647 - RNA, 18 nt, Human
aguuauaguuucagauau

SEQ ID NO: 2546648 - RNA, 16 nt, Human
aguuauaguuucagau

SEQ ID NO: 2546649 - RNA, 15 nt, Human
aguuauaguuucaga

SEQ ID NO: 2546650 - RNA, 16 nt, Human
aguuaucuaaaagaaa

SEQ ID NO: 2546651 - RNA, 16 nt, Human
aguucccagaaucaaa

SEQ ID NO: 2546652 - RNA, 15 nt, Human
aguucccagaaucaa

SEQ ID NO: 2546653 - RNA, 15 nt, Human
aguucccccaaccuc

SEQ ID NO: 2546654 - RNA, 17 nt, Human
aguuccccaugcagaca

SEQ ID NO: 2546655 - RNA, 18 nt, Human
aguucccccaaccucaga

SEQ ID NO: 2546656 - RNA, 16 nt, Human
aguuccccaugcagac

SEQ ID NO: 2546657 - RNA, 14 nt, Human
aguuccccaugcag

SEQ ID NO: 2546658 - RNA, 15 nt, Human
aguucccauguuaaa

SEQ ID NO: 2546659 - RNA, 23 nt, Human
aguuccucauuagcauuuugcua

SEQ ID NO: 2546660 - RNA, 14 nt, Human
aguucaccauuaaa

SEQ ID NO: 2546661 - RNA, 18 nt, Human
aguucaauggcugcugaa

SEQ ID NO: 2546662 - RNA, 17 nt, Human
aguucaauggcugcuga

SEQ ID NO: 2546663 - RNA, 14 nt, Human
aguucaauggcugc

SEQ ID NO: 2546664 - RNA, 14 nt, Human
aguucccagaauca

SEQ ID NO: 2546665 - RNA, 13 nt, Human
aguucccagaauc

SEQ ID NO: 2546666 - RNA, 12 nt, Human
aguucccagaau

SEQ ID NO: 2546667 - RNA, 22 nt, Human
aguucacuucaucuucucagcu

SEQ ID NO: 2546668 - RNA, 16 nt, Human
aguucacuauaaaugg

SEQ ID NO: 2546669 - RNA, 15 nt, Human
aguucacuucaucuu

SEQ ID NO: 2546670 - RNA, 21 nt, Human
aguucacuauaaaugguguuu

SEQ ID NO: 2546671 - RNA, 14 nt, Human
aguucuagagaaga

SEQ ID NO: 2546672 - RNA, 13 nt, Human
aguucuagagaag

SEQ ID NO: 2546673 - RNA, 23 nt, Human
aguucuaccucaggcagcucaag

SEQ ID NO: 2546674 - RNA, 22 nt, Human
aguucuaccucaggcagcucaa

SEQ ID NO: 2546675 - RNA, 20 nt, Human
aguucuagagaagaggcugg

SEQ ID NO: 2546676 - RNA, 17 nt, Human
aguucuagagaagaggc

SEQ ID NO: 2546677 - RNA, 16 nt, Human
aguucuagagaagagg

SEQ ID NO: 2546678 - RNA, 15 nt, Human
aguucuagagaagag

SEQ ID NO: 2546679 - RNA, 19 nt, Human
aguucuagucucucugggg

SEQ ID NO: 2546680 - RNA, 17 nt, Human
aguucuagucucucugg

SEQ ID NO: 2546681 - RNA, 23 nt, Human
aguucucagggcuccugccuucu

SEQ ID NO: 2546682 - RNA, 19 nt, Human
aguucucagggcuccugcc

SEQ ID NO: 2546683 - RNA, 18 nt, Human
aguucucagggcuccugc

SEQ ID NO: 2546684 - RNA, 17 nt, Human
aguucucagggcuccug

SEQ ID NO: 2546685 - RNA, 15 nt, Human
uguuggggcaguggu

SEQ ID NO: 2546686 - RNA, 20 nt, Human
uguugggguggguauaaaag

SEQ ID NO: 2546687 - RNA, 18 nt, Human
uguugggguggguauaaa

SEQ ID NO: 2546688 - RNA, 17 nt, Human
uguugggguggguauaa

SEQ ID NO: 2546689 - RNA, 16 nt, Human
aguucuaguuugcauu

SEQ ID NO: 2546690 - RNA, 15 nt, Human
aguucuaguuugcau

SEQ ID NO: 2546691 - RNA, 15 nt, Human
aguucuaguugcuug

SEQ ID NO: 2546692 - RNA, 17 nt, Human
aguucuaguuugcauuc

SEQ ID NO: 2546693 - RNA, 15 nt, Human
aguucucagggcucc

SEQ ID NO: 2546694 - RNA, 14 nt, Human
aguucucagggcuc

SEQ ID NO: 2546695 - RNA, 12 nt, Human
aguucucagggc

SEQ ID NO: 2546696 - RNA, 20 nt, Human
aguucucacuguucccucug

SEQ ID NO: 2546697 - RNA, 19 nt, Human
aguucucacuguucccucu

SEQ ID NO: 2546698 - RNA, 18 nt, Human
aguucucacuguucccuc

SEQ ID NO: 2546699 - RNA, 12 nt, Human
aguucucacugu

SEQ ID NO: 2546700 - RNA, 19 nt, Human
aguucggugagcuacaaau

SEQ ID NO: 2546701 - RNA, 12 nt, Human
aguuccucgccc

SEQ ID NO: 2546702 - RNA, 13 nt, Human
aguuccucgcccu

SEQ ID NO: 2546703 - RNA, 14 nt, Human
aguuccucgcccug

SEQ ID NO: 2546704 - RNA, 15 nt, Human
aguuccucgcccugg

SEQ ID NO: 2546705 - RNA, 21 nt, Human
aguuccucuuugcauggaauu

SEQ ID NO: 2546706 - RNA, 15 nt, Human
aguuccucuuugcau

SEQ ID NO: 2546707 - RNA, 18 nt, Human
aguuccucuagugcccuc

SEQ ID NO: 2546708 - RNA, 16 nt, Human
aguuccucgcccuggg

SEQ ID NO: 2546709 - RNA, 17 nt, Human
aguuccucgcccugggu

SEQ ID NO: 2546710 - RNA, 20 nt, Human
aguucggugagcuacaaaug

SEQ ID NO: 2546711 - RNA, 21 nt, Human
aguuccugcggagugaagagg

SEQ ID NO: 2546712 - RNA, 19 nt, Human
aguuccugaaccugaugcu

SEQ ID NO: 2546713 - RNA, 23 nt, Human
aguuccugcuacaacuucagcag

SEQ ID NO: 2546714 - RNA, 18 nt, Human
aguuccugaaccugaugc

SEQ ID NO: 2546715 - RNA, 16 nt, Human
aguuccucuuugcaug

SEQ ID NO: 2546716 - RNA, 20 nt, Human
aguuccugcggagugaagag

SEQ ID NO: 2546717 - RNA, 20 nt, Human
aguucuaccucaggcagcuc

SEQ ID NO: 2546718 - RNA, 15 nt, Human
aguucuacauaagua

SEQ ID NO: 2546719 - RNA, 21 nt, Human
aguucgaugggcccaauucuu

SEQ ID NO: 2546720 - RNA, 17 nt, Human
uguuuaguaaucauauu

SEQ ID NO: 2546721 - RNA, 14 nt, Human
uguuuaguaaucau

SEQ ID NO: 2546722 - RNA, 17 nt, Human
uguuuagcagcagccuu

SEQ ID NO: 2546723 - RNA, 22 nt, Human
uguuuagcagcagccuuuaaug

SEQ ID NO: 2546724 - RNA, 16 nt, Human
uguuuagcaaauacau

SEQ ID NO: 2546725 - RNA, 19 nt, Human
uguuuaguaaacucaauaa

SEQ ID NO: 2546726 - RNA, 13 nt, Human
uguuuaguaauca

SEQ ID NO: 2546727 - RNA, 13 nt, Human
uguuuauuccuga

SEQ ID NO: 2546728 - RNA, 13 nt, Human
uguuuauuccuug

SEQ ID NO: 2546729 - RNA, 18 nt, Human
uguuuauuccugauaaua

SEQ ID NO: 2546730 - RNA, 14 nt, Human
uguuuauugucaaa

SEQ ID NO: 2546731 - RNA, 16 nt, Human
uguuuauuuuauauua

SEQ ID NO: 2546732 - RNA, 13 nt, Human
uguuuauggccuc

SEQ ID NO: 2546733 - RNA, 14 nt, Human
uguuuauggccuca

SEQ ID NO: 2546734 - RNA, 15 nt, Human
uguuuauggccucag

SEQ ID NO: 2546735 - RNA, 23 nt, Human
uguuuauggccucagcugccuca

SEQ ID NO: 2546736 - RNA, 14 nt, Human
uguuuaugagccag

SEQ ID NO: 2546737 - RNA, 16 nt, Human
uguuuaugagccagac

SEQ ID NO: 2546738 - RNA, 21 nt, Human
uguuuaugagccagacaaaug

SEQ ID NO: 2546739 - RNA, 21 nt, Human
uguuuaugcaaggaaggaaag

SEQ ID NO: 2546740 - RNA, 24 nt, Human
uguuuauggccucagcugccucac

SEQ ID NO: 2546741 - RNA, 20 nt, Human
uguugugauguauucuagcu

SEQ ID NO: 2546742 - RNA, 14 nt, Human
uguugugauguauu

SEQ ID NO: 2546743 - RNA, 13 nt, Human
uguugugaauguu

SEQ ID NO: 2546744 - RNA, 12 nt, Human
uguugugaaugu

SEQ ID NO: 2546745 - RNA, 12 nt, Human
uguugucuugaa

SEQ ID NO: 2546746 - RNA, 17 nt, Human
uguugucuguuuguucu

SEQ ID NO: 2546747 - RNA, 16 nt, Human
uguugucuugaaagau

SEQ ID NO: 2546748 - RNA, 19 nt, Human
uguugguuccaagcccugg

SEQ ID NO: 2546749 - RNA, 16 nt, Human
uguugguuccaagccc

SEQ ID NO: 2546750 - RNA, 15 nt, Human
uguugucucuugagu

SEQ ID NO: 2546751 - RNA, 17 nt, Human
uguugguuuugacugga

SEQ ID NO: 2546752 - RNA, 14 nt, Human
uguugguuuugacu

SEQ ID NO: 2546753 - RNA, 23 nt, Human
uguugggguggguauaaaagaug

SEQ ID NO: 2546754 - RNA, 22 nt, Human
uguugggguggguauaaaagau

SEQ ID NO: 2546755 - RNA, 14 nt, Human
uguuggucauuuua

SEQ ID NO: 2546756 - RNA, 21 nt, Human
uguugguaauuauuuugguac

SEQ ID NO: 2546757 - RNA, 14 nt, Human
uguugguuccaagc

SEQ ID NO: 2546758 - RNA, 16 nt, Human
uguugugugugggagu

SEQ ID NO: 2546759 - RNA, 14 nt, Human
uguuguguuucugu

SEQ ID NO: 2546760 - RNA, 20 nt, Human
uguuguuaaugaaaauguca

SEQ ID NO: 2546761 - RNA, 21 nt, Human
uguuguuaaugaaaaugucag

SEQ ID NO: 2546762 - RNA, 14 nt, Human
uguuguuaaauauc

SEQ ID NO: 2546763 - RNA, 17 nt, Human
uguuguuaaugaaaaug

SEQ ID NO: 2546764 - RNA, 18 nt, Human
uguuguuaaugaaaaugu

SEQ ID NO: 2546765 - RNA, 14 nt, Human
uguuguguguggga

SEQ ID NO: 2546766 - RNA, 15 nt, Human
uguugugugugggag

SEQ ID NO: 2546767 - RNA, 13 nt, Human
uguugugaauguc

SEQ ID NO: 2546768 - RNA, 21 nt, Human
uguuguguacguggagaggga

SEQ ID NO: 2546769 - RNA, 20 nt, Human
uguuuagauaauacaccacu

SEQ ID NO: 2546770 - RNA, 13 nt, Human
uguuguuauuuaa

SEQ ID NO: 2546771 - RNA, 11 nt, Human
uguuguuauuu

SEQ ID NO: 2546772 - RNA, 17 nt, Human
aguuuugaaaagcuauu

SEQ ID NO: 2546773 - RNA, 16 nt, Human
aguuuugaaaagcuau

SEQ ID NO: 2546774 - RNA, 15 nt, Human
aguuuugaaaagcua

SEQ ID NO: 2546775 - RNA, 14 nt, Human
aguuuugaaaagcu

SEQ ID NO: 2546776 - RNA, 12 nt, Human
aguuuugaaaag

SEQ ID NO: 2546777 - RNA, 23 nt, Human
aguuuucugagaaagacuauuca

SEQ ID NO: 2546778 - RNA, 14 nt, Human
aguuuucuucugug

SEQ ID NO: 2546779 - RNA, 19 nt, Human
aguuuucuggcuggagccu

SEQ ID NO: 2546780 - RNA, 18 nt, Human
aguuuucuggcuggagcc

SEQ ID NO: 2546781 - RNA, 13 nt, Human
aguuuucuggcug

SEQ ID NO: 2546782 - RNA, 13 nt, Human
aguuuccucaggc

SEQ ID NO: 2546783 - RNA, 16 nt, Human
aguuuccaaaaccaga

SEQ ID NO: 2546784 - RNA, 20 nt, Human
aguuucauucuccugccugu

SEQ ID NO: 2546785 - RNA, 17 nt, Human
aguuucauucuccugcc

SEQ ID NO: 2546786 - RNA, 15 nt, Human
aguuuccaaaaccag

SEQ ID NO: 2546787 - RNA, 19 nt, Human
aguuuucugagaaagacua

SEQ ID NO: 2546788 - RNA, 17 nt, Human
aguuuccucaggcugcu

SEQ ID NO: 2546789 - RNA, 18 nt, Human
aguuuucugagaaagacu

SEQ ID NO: 2546790 - RNA, 15 nt, Human
aguuuugguugcuuu

SEQ ID NO: 2546791 - RNA, 21 nt, Human
aguuuugguugcuuuaauauc

SEQ ID NO: 2546792 - RNA, 22 nt, Human
aguuuugguugcuuuaauauca

SEQ ID NO: 2546793 - RNA, 19 nt, Human
aguuuuggaugcagugcuc

SEQ ID NO: 2546794 - RNA, 18 nt, Human
aguuuuggaugcagugcu

SEQ ID NO: 2546795 - RNA, 17 nt, Human
aguuuuggaugcagugc

SEQ ID NO: 2546796 - RNA, 15 nt, Human
aguuuuggaugcagu

SEQ ID NO: 2546797 - RNA, 19 nt, Human
aguuuugccagaacaguuu

SEQ ID NO: 2546798 - RNA, 16 nt, Human
aguuuugcauuuaugg

SEQ ID NO: 2546799 - RNA, 23 nt, Human
aguuuuuauggcuuuugugcauu

SEQ ID NO: 2546800 - RNA, 17 nt, Human
aguuuuuaccuaccaca

SEQ ID NO: 2546801 - RNA, 21 nt, Human
aguuuuuaccuaccacagugu

SEQ ID NO: 2546802 - RNA, 22 nt, Human
aguuuuuaccuaccacaguguc

SEQ ID NO: 2546803 - RNA, 15 nt, Human
aguuuuuacugaaca

SEQ ID NO: 2546804 - RNA, 23 nt, Human
aguuuuuaccuaccacagugucu

SEQ ID NO: 2546805 - RNA, 16 nt, Human
aguuuuuacuuucugu

SEQ ID NO: 2546806 - RNA, 13 nt, Human
aguuuugucuuga

SEQ ID NO: 2546807 - RNA, 12 nt, Human
aguuuugucuug

SEQ ID NO: 2546808 - RNA, 14 nt, Human
aguuuugucuugaa

SEQ ID NO: 2546809 - RNA, 19 nt, Human
aguuuuuaagguuauuuau

SEQ ID NO: 2546810 - RNA, 14 nt, Human
aguuuuguauucau

SEQ ID NO: 2546811 - RNA, 20 nt, Human
uuaagaaaaaggaugcacag

SEQ ID NO: 2546812 - RNA, 11 nt, Human
auaaaaucagc

SEQ ID NO: 2546813 - RNA, 19 nt, Human
uuaagaaaaaggaugcaca

SEQ ID NO: 2546814 - RNA, 21 nt, Human
uuaagaaaaaggaugcacaga

SEQ ID NO: 2546815 - RNA, 14 nt, Human
uuaagaaaagagau

SEQ ID NO: 2546816 - RNA, 15 nt, Human
auaaaaucagccaau

SEQ ID NO: 2546817 - RNA, 11 nt, Human
uuaagaaaauc

SEQ ID NO: 2546818 - RNA, 19 nt, Human
auaaaauacuauuuuuacu

SEQ ID NO: 2546819 - RNA, 16 nt, Human
auaaaauacuauuuuu

SEQ ID NO: 2546820 - RNA, 18 nt, Human
auaaaauaauucuaaagg

SEQ ID NO: 2546821 - RNA, 17 nt, Human
auaaaauaauucuaaag

SEQ ID NO: 2546822 - RNA, 16 nt, Human
auaaaauaauucuaaa

SEQ ID NO: 2546823 - RNA, 15 nt, Human
auaaaauaauuuuua

SEQ ID NO: 2546824 - RNA, 19 nt, Human
auaaaauauuuucauacag

SEQ ID NO: 2546825 - RNA, 21 nt, Human
auaaaauaugaagacauaaac

SEQ ID NO: 2546826 - RNA, 20 nt, Human
auaaaauagcaauccuaaag

SEQ ID NO: 2546827 - RNA, 18 nt, Human
auaaaagccuguuuaaga

SEQ ID NO: 2546828 - RNA, 13 nt, Human
auaaaauaaauau

SEQ ID NO: 2546829 - RNA, 14 nt, Human
auaaaauaaauaua

SEQ ID NO: 2546830 - RNA, 18 nt, Human
auaaaagcauaaaugcaa

SEQ ID NO: 2546831 - RNA, 20 nt, Human
auaaaagcauaaaugcaaac

SEQ ID NO: 2546832 - RNA, 12 nt, Human
auaaaauaauuu

SEQ ID NO: 2546833 - RNA, 21 nt, Human
auaaaauaaauauauauaaac

SEQ ID NO: 2546834 - RNA, 16 nt, Human
auaaaauaaauauaua

SEQ ID NO: 2546835 - RNA, 15 nt, Human
auaaaauaaauauau

SEQ ID NO: 2546836 - RNA, 23 nt, Human
auaaaauaaugggauuuucuuuu

SEQ ID NO: 2546837 - RNA, 15 nt, Human
auaaaauaauucuaa

SEQ ID NO: 2546838 - RNA, 13 nt, Human
auaaaagccuguu

SEQ ID NO: 2546839 - RNA, 19 nt, Human
auaaaagcaauuccaaccu

SEQ ID NO: 2546840 - RNA, 17 nt, Human
auaaaagcaauuccaac

SEQ ID NO: 2546841 - RNA, 22 nt, Human
auaaaagauggggucuguaaaa

SEQ ID NO: 2546842 - RNA, 20 nt, Human
auaaaagcaauuccaaccuu

SEQ ID NO: 2546843 - RNA, 16 nt, Human
auaaaagcagcaucug

SEQ ID NO: 2546844 - RNA, 20 nt, Human
auaaaagcagcaucugcuaa

SEQ ID NO: 2546845 - RNA, 15 nt, Human
auaaaagcauaaaug

SEQ ID NO: 2546846 - RNA, 21 nt, Human
auaaaagauggggucuguaaa

SEQ ID NO: 2546847 - RNA, 19 nt, Human
auaaaagauggggucugua

SEQ ID NO: 2546848 - RNA, 18 nt, Human
aguuuuuauuccuuguga

SEQ ID NO: 2546849 - RNA, 17 nt, Human
aguuuuuauggggcuga

SEQ ID NO: 2546850 - RNA, 15 nt, Human
aguuuuuauugcuug

SEQ ID NO: 2546851 - RNA, 22 nt, Human
uuaaucauuaggugugacugaa

SEQ ID NO: 2546852 - RNA, 23 nt, Human
uuaaucauuaggugugacugaau

SEQ ID NO: 2546853 - RNA, 21 nt, Human
uuaaucugggccagaauuuca

SEQ ID NO: 2546854 - RNA, 18 nt, Human
uuaaucaugaauguguaa

SEQ ID NO: 2546855 - RNA, 13 nt, Human
uuaaucauugccu

SEQ ID NO: 2546856 - RNA, 17 nt, Human
uuaaucaugaaugugua

SEQ ID NO: 2546857 - RNA, 13 nt, Human
uuaaucaugaaau

SEQ ID NO: 2546858 - RNA, 17 nt, Human
uuaaucaaguugaauug

SEQ ID NO: 2546859 - RNA, 21 nt, Human
uuaaucaucuauaaagaagaa

SEQ ID NO: 2546860 - RNA, 14 nt, Human
uuaaucaaguugaa

SEQ ID NO: 2546861 - RNA, 13 nt, Human
uuaaucauuaggu

SEQ ID NO: 2546862 - RNA, 22 nt, Human
uuaauauuuaaacagcaguguu

SEQ ID NO: 2546863 - RNA, 21 nt, Human
uuaauauuuaaacagcagugu

SEQ ID NO: 2546864 - RNA, 18 nt, Human
uuaauauuuaaacagcag

SEQ ID NO: 2546865 - RNA, 22 nt, Human
uuaauauuuauaggucacuuug

SEQ ID NO: 2546866 - RNA, 12 nt, Human
uuaauauuugcu

SEQ ID NO: 2546867 - RNA, 19 nt, Human
uuaauauuugcugacagcu

SEQ ID NO: 2546868 - RNA, 20 nt, Human
uuaauauuugcugacagcug

SEQ ID NO: 2546869 - RNA, 19 nt, Human
uuaaugaaagacuguacaa

SEQ ID NO: 2546870 - RNA, 15 nt, Human
uuaaugaaaauaaga

SEQ ID NO: 2546871 - RNA, 14 nt, Human
uuaaugaaaauguc

SEQ ID NO: 2546872 - RNA, 15 nt, Human
uuaaugaaaauguca

SEQ ID NO: 2546873 - RNA, 16 nt, Human
uuaaugaaaaugucag

SEQ ID NO: 2546874 - RNA, 22 nt, Human
uuaauugauuauucugauucca

SEQ ID NO: 2546875 - RNA, 12 nt, Human
uuaauugcuuug

SEQ ID NO: 2546876 - RNA, 13 nt, Human
uuaauugcuuuga

SEQ ID NO: 2546877 - RNA, 13 nt, Human
uuaauugaaauuu

SEQ ID NO: 2546878 - RNA, 21 nt, Human
uuaauugacuuauuuauauaa

SEQ ID NO: 2546879 - RNA, 16 nt, Human
uuaaucuguauuuccc

SEQ ID NO: 2546880 - RNA, 22 nt, Human
uuaaucugguuuauuuuuguuc

SEQ ID NO: 2546881 - RNA, 18 nt, Human
uuaaugaaagacuguaca

SEQ ID NO: 2546882 - RNA, 20 nt, Human
uuaaucuuuucacaaauaaa

SEQ ID NO: 2546883 - RNA, 19 nt, Human
uuaaucuuuucacaaauaa

SEQ ID NO: 2546884 - RNA, 18 nt, Human
uuaaucuuuucacaaaua

SEQ ID NO: 2546885 - RNA, 17 nt, Human
uuaaucuuuucacaaau

SEQ ID NO: 2546886 - RNA, 15 nt, Human
uuaagugcugcauuu

SEQ ID NO: 2546887 - RNA, 16 nt, Human
uuaagugcugcauuua

SEQ ID NO: 2546888 - RNA, 17 nt, Human
uuaauauuuaaacagca

SEQ ID NO: 2546889 - RNA, 16 nt, Human
uuaauauuuaaacagc

SEQ ID NO: 2546890 - RNA, 15 nt, Human
uuaauauuuaaacag

SEQ ID NO: 2546891 - RNA, 12 nt, Human
uuaauauuuaaa

SEQ ID NO: 2546892 - RNA, 19 nt, Human
uuaagugcugcauuuaaaa

SEQ ID NO: 2546893 - RNA, 14 nt, Human
uuaagucuguuuua

SEQ ID NO: 2546894 - RNA, 15 nt, Human
uuaagucuguuuuau

SEQ ID NO: 2546895 - RNA, 14 nt, Human
uuaagugcugcauu

SEQ ID NO: 2546896 - RNA, 19 nt, Human
uuaagucuaaauauuuccu

SEQ ID NO: 2546897 - RNA, 17 nt, Human
uuaaguauuuauauauu

SEQ ID NO: 2546898 - RNA, 19 nt, Human
uuaaguauuuauauauuua

SEQ ID NO: 2546899 - RNA, 14 nt, Human
uuaaguauguguaa

SEQ ID NO: 2546900 - RNA, 19 nt, Human
uuaaguaucuuuuuucaaa

SEQ ID NO: 2546901 - RNA, 14 nt, Human
uuaaguaucuuuuu

SEQ ID NO: 2546902 - RNA, 13 nt, Human
uuaaguauugcau

SEQ ID NO: 2546903 - RNA, 21 nt, Human
uuaaguauugcaucuguauaa

SEQ ID NO: 2546904 - RNA, 20 nt, Human
uuaaguauugcaucuguaua

SEQ ID NO: 2546905 - RNA, 19 nt, Human
uuaaguauugcaucuguau

SEQ ID NO: 2546906 - RNA, 15 nt, Human
uuaaguauugcaucu

SEQ ID NO: 2546907 - RNA, 11 nt, Human
uuaaguauuua

SEQ ID NO: 2546908 - RNA, 16 nt, Human
uuaaguauuuauauau

SEQ ID NO: 2546909 - RNA, 20 nt, Human
uuaagaagacugcauuauau

SEQ ID NO: 2546910 - RNA, 13 nt, Human
uuaagaagaaacu

SEQ ID NO: 2546911 - RNA, 14 nt, Human
uuaagaaaaucaua

SEQ ID NO: 2546912 - RNA, 22 nt, Human
uuaagaaaaucauauugcuucu

SEQ ID NO: 2546913 - RNA, 22 nt, Human
uuaagaaagacuaucuaaaugu

SEQ ID NO: 2546914 - RNA, 17 nt, Human
uuaaguaucugacaucu

SEQ ID NO: 2546915 - RNA, 14 nt, Human
uuaagguuauuuau

SEQ ID NO: 2546916 - RNA, 18 nt, Human
uuaaggugauauauuuaa

SEQ ID NO: 2546917 - RNA, 15 nt, Human
uuaaggguuaagaaa

SEQ ID NO: 2546918 - RNA, 9 nt, Human
uuaaggugg

SEQ ID NO: 2546919 - RNA, 21 nt, Human
uuaagggauggaaaaggaaga

SEQ ID NO: 2546920 - RNA, 18 nt, Human
uuaagggaagaauuccag

SEQ ID NO: 2546921 - RNA, 14 nt, Human
aguuggaaauauuc

SEQ ID NO: 2546922 - RNA, 14 nt, Human
aguugcuuguaaaa

SEQ ID NO: 2546923 - RNA, 14 nt, Human
aguugcugucauaa

SEQ ID NO: 2546924 - RNA, 19 nt, Human
aguuggagugaguguggcu

SEQ ID NO: 2546925 - RNA, 13 nt, Human
aguugggcuuccu

SEQ ID NO: 2546926 - RNA, 15 nt, Human
aguugggugagaaca

SEQ ID NO: 2546927 - RNA, 17 nt, Human
aguuggggucuggcagc

SEQ ID NO: 2546928 - RNA, 21 nt, Human
aguuggggucuggcagccucc

SEQ ID NO: 2546929 - RNA, 19 nt, Human
aguugggcuuccucauagu

SEQ ID NO: 2546930 - RNA, 17 nt, Human
aguugcugggagcugaa

SEQ ID NO: 2546931 - RNA, 19 nt, Human
uguuucaaacacaaaugca

SEQ ID NO: 2546932 - RNA, 18 nt, Human
uguuuauuuuucauauug

SEQ ID NO: 2546933 - RNA, 16 nt, Human
uguuuauuuuucauau

SEQ ID NO: 2546934 - RNA, 19 nt, Human
uguuuauuuuucauauugu

SEQ ID NO: 2546935 - RNA, 15 nt, Human
uguuuauuuuucaua

SEQ ID NO: 2546936 - RNA, 14 nt, Human
uguuuauuuuucau

SEQ ID NO: 2546937 - RNA, 12 nt, Human
uguuuauuuuuc

SEQ ID NO: 2546938 - RNA, 13 nt, Human
uguuucaaacaua

SEQ ID NO: 2546939 - RNA, 23 nt, Human
aguugccagucaccccggccacc

SEQ ID NO: 2546940 - RNA, 18 nt, Human
uguuucaaacacaaaugc

SEQ ID NO: 2546941 - RNA, 17 nt, Human
uguuucaaacacaaaug

SEQ ID NO: 2546942 - RNA, 16 nt, Human
uguuucaaaauaaaaa

SEQ ID NO: 2546943 - RNA, 14 nt, Human
aguuuaaauuguaa

SEQ ID NO: 2546944 - RNA, 18 nt, Human
aguuuaaaacagaagccu

SEQ ID NO: 2546945 - RNA, 22 nt, Human
aguuuaauggugccuucauuug

SEQ ID NO: 2546946 - RNA, 21 nt, Human
aguuuaaagcucgaaaacaau

SEQ ID NO: 2546947 - RNA, 12 nt, Human
aguuuaaagcaa

SEQ ID NO: 2546948 - RNA, 13 nt, Human
aguuggucccccu

SEQ ID NO: 2546949 - RNA, 11 nt, Human
aguuggucccc

SEQ ID NO: 2546950 - RNA, 17 nt, Human
aguuggucccccuucca

SEQ ID NO: 2546951 - RNA, 14 nt, Human
aguuuaaaaaaauu

SEQ ID NO: 2546952 - RNA, 15 nt, Human
aguuuaaaaaaauug

SEQ ID NO: 2546953 - RNA, 16 nt, Human
aguuuacaguaaauaa

SEQ ID NO: 2546954 - RNA, 14 nt, Human
aguuuacaguaaau

SEQ ID NO: 2546955 - RNA, 13 nt, Human
aguuuacaguaaa

SEQ ID NO: 2546956 - RNA, 23 nt, Human
aguuuacaaguguauaucagaaa

SEQ ID NO: 2546957 - RNA, 21 nt, Human
aguuuacaaguguauaucaga

SEQ ID NO: 2546958 - RNA, 19 nt, Human
aguuuacaaguguauauca

SEQ ID NO: 2546959 - RNA, 22 nt, Human
aguuuacaucauuuuuguaucu

SEQ ID NO: 2546960 - RNA, 22 nt, Human
aguuuacaguaaauaaauuguu

SEQ ID NO: 2546961 - RNA, 20 nt, Human
aguuuacaguaaauaaauug

SEQ ID NO: 2546962 - RNA, 18 nt, Human
aguuuacaguaaauaaau

SEQ ID NO: 2546963 - RNA, 23 nt, Human
uuaaaaaaaacaaaaagaacaaa

SEQ ID NO: 2546964 - RNA, 15 nt, Human
aguuuaauugacuua

SEQ ID NO: 2546965 - RNA, 14 nt, Human
aguuuaauugacuu

SEQ ID NO: 2546966 - RNA, 17 nt, Human
aguuuacaaguguauau

SEQ ID NO: 2546967 - RNA, 16 nt, Human
aguuuacaaguguaua

SEQ ID NO: 2546968 - RNA, 15 nt, Human
aguuuacaaguguau

SEQ ID NO: 2546969 - RNA, 18 nt, Human
aguuuaauugacuuauuu

SEQ ID NO: 2546970 - RNA, 14 nt, Human
uuaaaaaaaugaca

SEQ ID NO: 2546971 - RNA, 21 nt, Human
uuaaaaaucuaccuucuguag

SEQ ID NO: 2546972 - RNA, 23 nt, Human
uuaaaaaaauaaaacauuuuaaa

SEQ ID NO: 2546973 - RNA, 19 nt, Human
uuaaaaaaauaaaacauuu

SEQ ID NO: 2546974 - RNA, 18 nt, Human
uuaaaaaaauaaaacauu

SEQ ID NO: 2546975 - RNA, 21 nt, Human
uuaaaaaaaggcauuguuuga

SEQ ID NO: 2546976 - RNA, 17 nt, Human
uuaaaaaaauaaaacau

SEQ ID NO: 2546977 - RNA, 19 nt, Human
uuaaaaaaaggcauuguuu

SEQ ID NO: 2546978 - RNA, 13 nt, Human
uuaaaaaaaaucc

SEQ ID NO: 2546979 - RNA, 15 nt, Human
uuaaauacaaaacuu

SEQ ID NO: 2546980 - RNA, 21 nt, Human
uuaaaguguccauugacaugu

SEQ ID NO: 2546981 - RNA, 16 nt, Human
uuaaauacaaaacuuc

SEQ ID NO: 2546982 - RNA, 16 nt, Human
uuaaauacagacacua

SEQ ID NO: 2546983 - RNA, 17 nt, Human
uuaaauacagacacuaa

SEQ ID NO: 2546984 - RNA, 18 nt, Human
uuaaauacaaaacuucca

SEQ ID NO: 2546985 - RNA, 13 nt, Human
uuaaauaauguga

SEQ ID NO: 2546986 - RNA, 16 nt, Human
uuaaauaaugugaaac

SEQ ID NO: 2546987 - RNA, 18 nt, Human
uuaaauaaugugaaacug

SEQ ID NO: 2546988 - RNA, 19 nt, Human
uuaaauacagacacuaagu

SEQ ID NO: 2546989 - RNA, 18 nt, Human
uuaaauacagacacuaag

SEQ ID NO: 2546990 - RNA, 20 nt, Human
uuaaauacagacacuaaguu

SEQ ID NO: 2546991 - RNA, 18 nt, Human
uuaaauagaguuugcuau

SEQ ID NO: 2546992 - RNA, 13 nt, Human
uuaaauacagucu

SEQ ID NO: 2546993 - RNA, 19 nt, Human
uuaacaagcucccaggccg

SEQ ID NO: 2546994 - RNA, 19 nt, Human
uuaaauacgcacuacaugu

SEQ ID NO: 2546995 - RNA, 19 nt, Human
uuaaauagaguauaugcac

SEQ ID NO: 2546996 - RNA, 18 nt, Human
uuaacaauaacuacugug

SEQ ID NO: 2546997 - RNA, 19 nt, Human
uuaacaauaacuacugugu

SEQ ID NO: 2546998 - RNA, 20 nt, Human
uuaacaauaacuacuguguu

SEQ ID NO: 2546999 - RNA, 21 nt, Human
uuaacaauaacuacuguguuc

SEQ ID NO: 2547000 - RNA, 17 nt, Human
uuaacaaugauauaugg

SEQ ID NO: 2547001 - RNA, 23 nt, Human
uuaacaauaacuacuguguuccu

SEQ ID NO: 2547002 - RNA, 20 nt, Human
uuaacagaaauguacagcaa

SEQ ID NO: 2547003 - RNA, 13 nt, Human
uuaacacugagcu

SEQ ID NO: 2547004 - RNA, 18 nt, Human
aguuucauagcuaagaaa

SEQ ID NO: 2547005 - RNA, 15 nt, Human
aguuucauguacaag

SEQ ID NO: 2547006 - RNA, 18 nt, Human
aguuucauguacaagaug

SEQ ID NO: 2547007 - RNA, 21 nt, Human
aguuucauguacaagaugaag

SEQ ID NO: 2547008 - RNA, 14 nt, Human
uuaacagagacaga

SEQ ID NO: 2547009 - RNA, 18 nt, Human
aguuucagguguuuaguu

SEQ ID NO: 2547010 - RNA, 19 nt, Human
uuaacagaaauguacagca

SEQ ID NO: 2547011 - RNA, 18 nt, Human
uuaacaccuuuaaagugu

SEQ ID NO: 2547012 - RNA, 20 nt, Human
uuaacaccugauguguacau

SEQ ID NO: 2547013 - RNA, 19 nt, Human
uuaacaccugauguguaca

SEQ ID NO: 2547014 - RNA, 17 nt, Human
uuaacaccugaugugua

SEQ ID NO: 2547015 - RNA, 16 nt, Human
uuaacaccugaugugu

SEQ ID NO: 2547016 - RNA, 15 nt, Human
uuaacaccugaugug

SEQ ID NO: 2547017 - RNA, 22 nt, Human
uuaacacauuuuguauaauugu

SEQ ID NO: 2547018 - RNA, 17 nt, Human
uuaacacauuuuguaua

SEQ ID NO: 2547019 - RNA, 14 nt, Human
uuaacacauuuugu

SEQ ID NO: 2547020 - RNA, 12 nt, Human
uuaacacauuuu

SEQ ID NO: 2547021 - RNA, 23 nt, Human
uuaacaauuucuguccuucagau

SEQ ID NO: 2547022 - RNA, 15 nt, Human
uuaacaauuucuguc

SEQ ID NO: 2547023 - RNA, 16 nt, Human
uuaacaauuccaaagg

SEQ ID NO: 2547024 - RNA, 11 nt, Human
uuaacacauuu

SEQ ID NO: 2547025 - RNA, 16 nt, Human
uuaacacaaguccugu

SEQ ID NO: 2547026 - RNA, 13 nt, Human
uuaaacauaaaua

SEQ ID NO: 2547027 - RNA, 17 nt, Human
uuaaaggugucuuccuc

SEQ ID NO: 2547028 - RNA, 15 nt, Human
uuaaaggugucuucc

SEQ ID NO: 2547029 - RNA, 13 nt, Human
uuaaaguauauau

SEQ ID NO: 2547030 - RNA, 15 nt, Human
uuaaaguaugaaucu

SEQ ID NO: 2547031 - RNA, 16 nt, Human
uuaaaguauauauuua

SEQ ID NO: 2547032 - RNA, 13 nt, Human
uuaaacauugaag

SEQ ID NO: 2547033 - RNA, 15 nt, Human
uuaaacauugaagua

SEQ ID NO: 2547034 - RNA, 15 nt, Human
uuaaauaaugugaaa

SEQ ID NO: 2547035 - RNA, 22 nt, Human
uuaaaguguccauugacaugua

SEQ ID NO: 2547036 - RNA, 19 nt, Human
uuaaaguguccauugacau

SEQ ID NO: 2547037 - RNA, 19 nt, Human
uuaaagucgagcuuuucua

SEQ ID NO: 2547038 - RNA, 12 nt, Human
uuaaagugauua

SEQ ID NO: 2547039 - RNA, 17 nt, Human
uuaaagugauacugaaa

SEQ ID NO: 2547040 - RNA, 23 nt, Human
uuaaaguauguuauugcauaauu

SEQ ID NO: 2547041 - RNA, 18 nt, Human
uuaaaguauguuauugca

SEQ ID NO: 2547042 - RNA, 18 nt, Human
uuaaaguaugaaucuaug

SEQ ID NO: 2547043 - RNA, 13 nt, Human
uuaaaguauucuu

SEQ ID NO: 2547044 - RNA, 18 nt, Human
uuaaagucagguccaauu

SEQ ID NO: 2547045 - RNA, 14 nt, Human
uuaaaaaucucaaa

SEQ ID NO: 2547046 - RNA, 15 nt, Human
uuaaaaaucucaaau

SEQ ID NO: 2547047 - RNA, 16 nt, Human
uuaaaaaucucaaauu

SEQ ID NO: 2547048 - RNA, 20 nt, Human
uuaaacaaaauagaagcugu

SEQ ID NO: 2547049 - RNA, 18 nt, Human
uuaaaauuuuuuuagaaa

SEQ ID NO: 2547050 - RNA, 21 nt, Human
uuaaacagggcaucuccagga

SEQ ID NO: 2547051 - RNA, 16 nt, Human
uuaaacaggcccagca

SEQ ID NO: 2547052 - RNA, 15 nt, Human
uuaaacaggcccagc

SEQ ID NO: 2547053 - RNA, 18 nt, Human
uuaaacagugagccugaa

SEQ ID NO: 2547054 - RNA, 23 nt, Human
uuaaacagugagccugaauuuug

SEQ ID NO: 2547055 - RNA, 14 nt, Human
uuaaacagcagugu

SEQ ID NO: 2547056 - RNA, 12 nt, Human
uuaaacagcagu

SEQ ID NO: 2547057 - RNA, 16 nt, Human
uuaaacagauuuuuac

SEQ ID NO: 2547058 - RNA, 14 nt, Human
uuaaacaaagguug

SEQ ID NO: 2547059 - RNA, 16 nt, Human
uuaaacaccuccucau

SEQ ID NO: 2547060 - RNA, 13 nt, Human
uuaaacaccuccu

SEQ ID NO: 2547061 - RNA, 22 nt, Human
uuaaacaaauguaugauuacau

SEQ ID NO: 2547062 - RNA, 21 nt, Human
uuagccuucucuguucauuuc

SEQ ID NO: 2547063 - RNA, 14 nt, Human
uuagcggagacgga

SEQ ID NO: 2547064 - RNA, 15 nt, Human
uuagccuucucuguu

SEQ ID NO: 2547065 - RNA, 17 nt, Human
uuagccuucucuguuca

SEQ ID NO: 2547066 - RNA, 16 nt, Human
uuagccuuugucccag

SEQ ID NO: 2547067 - RNA, 12 nt, Human
uuagccuucucu

SEQ ID NO: 2547068 - RNA, 14 nt, Human
uuagccuucucugu

SEQ ID NO: 2547069 - RNA, 21 nt, Human
uuagcaugacaagccccaggc

SEQ ID NO: 2547070 - RNA, 22 nt, Human
uuagcaugacaagccccaggca

SEQ ID NO: 2547071 - RNA, 24 nt, Human
uuagcaugacaagccccaggcagg

SEQ ID NO: 2547072 - RNA, 18 nt, Human
uuagccaagugugguaga

SEQ ID NO: 2547073 - RNA, 17 nt, Human
uuagccaggaucauggu

SEQ ID NO: 2547074 - RNA, 15 nt, Human
uuagccaggaucaug

SEQ ID NO: 2547075 - RNA, 23 nt, Human
uuagccaggaucaugguguaaua

SEQ ID NO: 2547076 - RNA, 19 nt, Human
uuagccagguaaugugaau

SEQ ID NO: 2547077 - RNA, 16 nt, Human
uuagcauguuugcuga

SEQ ID NO: 2547078 - RNA, 17 nt, Human
uuagcauguguugaaaa

SEQ ID NO: 2547079 - RNA, 22 nt, Human
uuagcauuuaguccaaugucuu

SEQ ID NO: 2547080 - RNA, 13 nt, Human
uuagccacaaaau

SEQ ID NO: 2547081 - RNA, 15 nt, Human
auaauuuaaugcaug

SEQ ID NO: 2547082 - RNA, 22 nt, Human
uuagcaaagauaucucaucucu

SEQ ID NO: 2547083 - RNA, 20 nt, Human
uuagcaaagaguuaauauau

SEQ ID NO: 2547084 - RNA, 13 nt, Human
uuagcaaagaguu

SEQ ID NO: 2547085 - RNA, 19 nt, Human
uuagcaaagaguuaauaua

SEQ ID NO: 2547086 - RNA, 15 nt, Human
uuagcaaauacauau

SEQ ID NO: 2547087 - RNA, 14 nt, Human
uuagcaaacuuugu

SEQ ID NO: 2547088 - RNA, 18 nt, Human
uuagcaaauucuguuuuu

SEQ ID NO: 2547089 - RNA, 13 nt, Human
uuagggagaaaau

SEQ ID NO: 2547090 - RNA, 17 nt, Human
uuagggagaaaauucaa

SEQ ID NO: 2547091 - RNA, 18 nt, Human
uuagguuggcaaaaaggc

SEQ ID NO: 2547092 - RNA, 21 nt, Human
uuaggugugacugaauuucuu

SEQ ID NO: 2547093 - RNA, 16 nt, Human
uuaggugaggaagcaa

SEQ ID NO: 2547094 - RNA, 16 nt, Human
uuaggugugacugaau

SEQ ID NO: 2547095 - RNA, 15 nt, Human
uuaggugaggaagca

SEQ ID NO: 2547096 - RNA, 14 nt, Human
uuagggagagaaga

SEQ ID NO: 2547097 - RNA, 14 nt, Human
uuagggaagggccu

SEQ ID NO: 2547098 - RNA, 23 nt, Human
uuagggacucaauuucuccccag

SEQ ID NO: 2547099 - RNA, 20 nt, Human
uuagggaaggauacaaaagc

SEQ ID NO: 2547100 - RNA, 15 nt, Human
uuagggaaaacauuc

SEQ ID NO: 2547101 - RNA, 17 nt, Human
uuagggaaaacauucca

SEQ ID NO: 2547102 - RNA, 15 nt, Human
uuaguuucuccaagc

SEQ ID NO: 2547103 - RNA, 19 nt, Human
uuaguuucuguucugugga

SEQ ID NO: 2547104 - RNA, 15 nt, Human
uuaguuucuguucug

SEQ ID NO: 2547105 - RNA, 21 nt, Human
uuaguuucuguucuguggaaa

SEQ ID NO: 2547106 - RNA, 20 nt, Human
uuaguuucuguucuguggaa

SEQ ID NO: 2547107 - RNA, 14 nt, Human
uuaguuucuuuggg

SEQ ID NO: 2547108 - RNA, 22 nt, Human
uuaguuugcaguuacacuaaaa

SEQ ID NO: 2547109 - RNA, 14 nt, Human
uuaguuuggauucu

SEQ ID NO: 2547110 - RNA, 14 nt, Human
uuagggaaaacauu

SEQ ID NO: 2547111 - RNA, 18 nt, Human
uuaguuuggauucuuaug

SEQ ID NO: 2547112 - RNA, 15 nt, Human
uuaguuuguguguug

SEQ ID NO: 2547113 - RNA, 22 nt, Human
uuaguuuguaugccaagugaga

SEQ ID NO: 2547114 - RNA, 12 nt, Human
uuaguaacaugu

SEQ ID NO: 2547115 - RNA, 24 nt, Human
uuaguaacaugaggggacauuuug

SEQ ID NO: 2547116 - RNA, 15 nt, Human
uuaguaaagaaauga

SEQ ID NO: 2547117 - RNA, 14 nt, Human
uuaguaaagaaaug

SEQ ID NO: 2547118 - RNA, 18 nt, Human
uuagguggcaagcuguga

SEQ ID NO: 2547119 - RNA, 16 nt, Human
uuagguuuuguacaau

SEQ ID NO: 2547120 - RNA, 19 nt, Human
uuagguuuuuuuguauagu

SEQ ID NO: 2547121 - RNA, 14 nt, Human
uuagguuuuguaca

SEQ ID NO: 2547122 - RNA, 22 nt, Human
uuagguuuuguacaauugaacu

SEQ ID NO: 2547123 - RNA, 15 nt, Human
auaaugcgugcauac

SEQ ID NO: 2547124 - RNA, 17 nt, Human
auaaugccggugagaau

SEQ ID NO: 2547125 - RNA, 11 nt, Human
auaauucugua

SEQ ID NO: 2547126 - RNA, 22 nt, Human
auaaugaugaugggaauugugu

SEQ ID NO: 2547127 - RNA, 22 nt, Human
auaaugaggaugauuauuuuca

SEQ ID NO: 2547128 - RNA, 13 nt, Human
auaaucugauuug

SEQ ID NO: 2547129 - RNA, 15 nt, Human
auaaugaaugaaaca

SEQ ID NO: 2547130 - RNA, 22 nt, Human
auaauugacaggauuauuggaa

SEQ ID NO: 2547131 - RNA, 22 nt, Human
auaauucuguacauagccuaua

SEQ ID NO: 2547132 - RNA, 14 nt, Human
auaauucuguacau

SEQ ID NO: 2547133 - RNA, 13 nt, Human
auaauucuguaca

SEQ ID NO: 2547134 - RNA, 14 nt, Human
auaauucuguaaau

SEQ ID NO: 2547135 - RNA, 13 nt, Human
auaauucuguaaa

SEQ ID NO: 2547136 - RNA, 12 nt, Human
auaauucuguaa

SEQ ID NO: 2547137 - RNA, 18 nt, Human
auaaugccggugagaaua

SEQ ID NO: 2547138 - RNA, 17 nt, Human
auaauucuguacugauu

SEQ ID NO: 2547139 - RNA, 15 nt, Human
auaauucuguacuga

SEQ ID NO: 2547140 - RNA, 23 nt, Human
auaauucuguacauagccuauau

SEQ ID NO: 2547141 - RNA, 14 nt, Human
auaauucuuguaua

SEQ ID NO: 2547142 - RNA, 19 nt, Human
auaauucuuguauauuaug

SEQ ID NO: 2547143 - RNA, 18 nt, Human
auaauccuaaacauauga

SEQ ID NO: 2547144 - RNA, 17 nt, Human
auaaucccagcacuuug

SEQ ID NO: 2547145 - RNA, 16 nt, Human
auaaucccagcacuuu

SEQ ID NO: 2547146 - RNA, 20 nt, Human
auaauaguuuacauguagua

SEQ ID NO: 2547147 - RNA, 14 nt, Human
auaauaguuuacau

SEQ ID NO: 2547148 - RNA, 20 nt, Human
auaaucuggacuccucuguc

SEQ ID NO: 2547149 - RNA, 19 nt, Human
auaaucuggacuccucugu

SEQ ID NO: 2547150 - RNA, 18 nt, Human
auaaucuggacuccucug

SEQ ID NO: 2547151 - RNA, 15 nt, Human
auaaucuagaacaca

SEQ ID NO: 2547152 - RNA, 12 nt, Human
auaaucuagaac

SEQ ID NO: 2547153 - RNA, 22 nt, Human
auaaucggcccacagcucccac

SEQ ID NO: 2547154 - RNA, 18 nt, Human
auaaucucuccauucccg

SEQ ID NO: 2547155 - RNA, 21 nt, Human
auaaucuauuucuaugagaaa

SEQ ID NO: 2547156 - RNA, 17 nt, Human
auaaucuauuucuauga

SEQ ID NO: 2547157 - RNA, 14 nt, Human
auaaucuauuucua

SEQ ID NO: 2547158 - RNA, 14 nt, Human
auaauaaaguguuu

SEQ ID NO: 2547159 - RNA, 18 nt, Human
auaagagaaagaaaauga

SEQ ID NO: 2547160 - RNA, 14 nt, Human
auaagagaaagaaa

SEQ ID NO: 2547161 - RNA, 15 nt, Human
auaagagaaucaaca

SEQ ID NO: 2547162 - RNA, 19 nt, Human
auaagagagucauaaaccu

SEQ ID NO: 2547163 - RNA, 20 nt, Human
auaagagagaacaacuacug

SEQ ID NO: 2547164 - RNA, 16 nt, Human
auaagagagucauaaa

SEQ ID NO: 2547165 - RNA, 20 nt, Human
auaauaaaaggaaaagcaaa

SEQ ID NO: 2547166 - RNA, 15 nt, Human
auaauaaaaggaaaa

SEQ ID NO: 2547167 - RNA, 14 nt, Human
auaauaaaaggaaa

SEQ ID NO: 2547168 - RNA, 12 nt, Human
auaauaaacuuu

SEQ ID NO: 2547169 - RNA, 19 nt, Human
auaauaaacuuuuuugaaa

SEQ ID NO: 2547170 - RNA, 22 nt, Human
auaagaccaccaccucagagua

SEQ ID NO: 2547171 - RNA, 17 nt, Human
auaagacauaacguuuu

SEQ ID NO: 2547172 - RNA, 23 nt, Human
auaagacauaacguuuuuccuuu

SEQ ID NO: 2547173 - RNA, 21 nt, Human
auaagacggauuuauuuuucc

SEQ ID NO: 2547174 - RNA, 17 nt, Human
auaagacggauuuauuu

SEQ ID NO: 2547175 - RNA, 17 nt, Human
auaagaauuauuuugau

SEQ ID NO: 2547176 - RNA, 14 nt, Human
auaagacauaacgu

SEQ ID NO: 2547177 - RNA, 16 nt, Human
auaagaaugcugguuu

SEQ ID NO: 2547178 - RNA, 19 nt, Human
auaagaaugcugguuuucc

SEQ ID NO: 2547179 - RNA, 22 nt, Human
auaagaaugcugguuuuccuaa

SEQ ID NO: 2547180 - RNA, 18 nt, Human
auaagaaugguugccuua

SEQ ID NO: 2547181 - RNA, 21 nt, Human
auaagaaugcugguuuuccua

SEQ ID NO: 2547182 - RNA, 21 nt, Human
auaagaauaaaauguugaaaa

SEQ ID NO: 2547183 - RNA, 23 nt, Human
uuagacagucaaggaguggcuua

SEQ ID NO: 2547184 - RNA, 18 nt, Human
auaauacaccacuacauu

SEQ ID NO: 2547185 - RNA, 20 nt, Human
auaauacaccacuacauucu

SEQ ID NO: 2547186 - RNA, 16 nt, Human
auaauaaagcuacuga

SEQ ID NO: 2547187 - RNA, 15 nt, Human
auaauaaauguacau

SEQ ID NO: 2547188 - RNA, 12 nt, Human
auaauacaccac

SEQ ID NO: 2547189 - RNA, 19 nt, Human
auaauacuugcuuuggaaa

SEQ ID NO: 2547190 - RNA, 12 nt, Human
auaauagaagaa

SEQ ID NO: 2547191 - RNA, 13 nt, Human
auaauagaagaac

SEQ ID NO: 2547192 - RNA, 22 nt, Human
auaauacuauauuuauacugua

SEQ ID NO: 2547193 - RNA, 16 nt, Human
uuagaaacauaaauaa

SEQ ID NO: 2547194 - RNA, 13 nt, Human
uuagaaacauaaa

SEQ ID NO: 2547195 - RNA, 14 nt, Human
uuagaaaccuuaau

SEQ ID NO: 2547196 - RNA, 17 nt, Human
uuagaaacaugguuuug

SEQ ID NO: 2547197 - RNA, 18 nt, Human
uuagaaaccuuaauaugu

SEQ ID NO: 2547198 - RNA, 18 nt, Human
uuacugaagguaaaauug

SEQ ID NO: 2547199 - RNA, 19 nt, Human
uuacugaagguaaaauuga

SEQ ID NO: 2547200 - RNA, 12 nt, Human
uuacugaaugca

SEQ ID NO: 2547201 - RNA, 20 nt, Human
uuacugaagguaaaauugaa

SEQ ID NO: 2547202 - RNA, 16 nt, Human
uuagaaagcauuugaa

SEQ ID NO: 2547203 - RNA, 15 nt, Human
uuagaaagcauuuga

SEQ ID NO: 2547204 - RNA, 14 nt, Human
uuagaaagcauuug

SEQ ID NO: 2547205 - RNA, 13 nt, Human
uuagaaagcauuu

SEQ ID NO: 2547206 - RNA, 12 nt, Human
uuagaaagcauu

SEQ ID NO: 2547207 - RNA, 22 nt, Human
uuagaaagaagcccaauauuau

SEQ ID NO: 2547208 - RNA, 16 nt, Human
uuaccuuguauacugu

SEQ ID NO: 2547209 - RNA, 16 nt, Human
uuacucuccaaccugg

SEQ ID NO: 2547210 - RNA, 22 nt, Human
uuacucugaagggcaucaugca

SEQ ID NO: 2547211 - RNA, 19 nt, Human
uuacucuccaaccuggaca

SEQ ID NO: 2547212 - RNA, 13 nt, Human
uuacucugaaggg

SEQ ID NO: 2547213 - RNA, 23 nt, Human
uuacucuucaguuaagccuuugg

SEQ ID NO: 2547214 - RNA, 23 nt, Human
uuacugaacaaucaaagcacuug

SEQ ID NO: 2547215 - RNA, 16 nt, Human
uuacugaagccuuucu

SEQ ID NO: 2547216 - RNA, 17 nt, Human
uuagaaauugcauuucc

SEQ ID NO: 2547217 - RNA, 16 nt, Human
uuagaaaugcagaauc

SEQ ID NO: 2547218 - RNA, 18 nt, Human
uuagaaaugaccaauauu

SEQ ID NO: 2547219 - RNA, 21 nt, Human
uuagaaagcauuugaaugcau

SEQ ID NO: 2547220 - RNA, 19 nt, Human
uuagaaagcauuugaaugc

SEQ ID NO: 2547221 - RNA, 18 nt, Human
uuagaaagcauuugaaug

SEQ ID NO: 2547222 - RNA, 17 nt, Human
uuagaaagcauuugaau

SEQ ID NO: 2547223 - RNA, 21 nt, Human
uuagaaaguagccacguaugg

SEQ ID NO: 2547224 - RNA, 23 nt, Human
uuagaaagcauuugaaugcauuu

SEQ ID NO: 2547225 - RNA, 17 nt, Human
uuagaaaugaccaauau

SEQ ID NO: 2547226 - RNA, 13 nt, Human
uuagacagucccu

SEQ ID NO: 2547227 - RNA, 20 nt, Human
uuagacagagucucacuguu

SEQ ID NO: 2547228 - RNA, 13 nt, Human
uuagacagagucu

SEQ ID NO: 2547229 - RNA, 22 nt, Human
uuagaacaggcaagugaagaaa

SEQ ID NO: 2547230 - RNA, 20 nt, Human
uuagaacaggcaagugaaga

SEQ ID NO: 2547231 - RNA, 18 nt, Human
uuagaacaggcaagugaa

SEQ ID NO: 2547232 - RNA, 17 nt, Human
uuagaaauuuauuuccu

SEQ ID NO: 2547233 - RNA, 15 nt, Human
auaacuuauauugua

SEQ ID NO: 2547234 - RNA, 17 nt, Human
uuacaggcacaaaauga

SEQ ID NO: 2547235 - RNA, 15 nt, Human
uuacaggcaccgaga

SEQ ID NO: 2547236 - RNA, 17 nt, Human
uuacaggcaccgagaau

SEQ ID NO: 2547237 - RNA, 20 nt, Human
auaacuuaaaaauguaaaua

SEQ ID NO: 2547238 - RNA, 19 nt, Human
auaacuuaaaaauguaaau

SEQ ID NO: 2547239 - RNA, 21 nt, Human
auaacuuaaaaauguaaauau

SEQ ID NO: 2547240 - RNA, 12 nt, Human
auaacuuaaaau

SEQ ID NO: 2547241 - RNA, 16 nt, Human
auaacuuaaaauauuu

SEQ ID NO: 2547242 - RNA, 16 nt, Human
uuacaggcuccugcca

SEQ ID NO: 2547243 - RNA, 18 nt, Human
uuacaggcuccugccacc

SEQ ID NO: 2547244 - RNA, 24 nt, Human
uuacaggcgugagccaccgugccu

SEQ ID NO: 2547245 - RNA, 18 nt, Human
uuacaggcaccgagaaug

SEQ ID NO: 2547246 - RNA, 24 nt, Human
uuacaggcaccgagaauguuguau

SEQ ID NO: 2547247 - RNA, 19 nt, Human
uuacccucauguucuuaau

SEQ ID NO: 2547248 - RNA, 20 nt, Human
uuacccauauccccucuccc

SEQ ID NO: 2547249 - RNA, 14 nt, Human
uuaccccuuagccu

SEQ ID NO: 2547250 - RNA, 19 nt, Human
uuacagggagccuccugcc

SEQ ID NO: 2547251 - RNA, 18 nt, Human
uuacagggagccuccugc

SEQ ID NO: 2547252 - RNA, 17 nt, Human
uuacagggagccuccug

SEQ ID NO: 2547253 - RNA, 16 nt, Human
uuacagggagccuccu

SEQ ID NO: 2547254 - RNA, 15 nt, Human
uuacagggagccucc

SEQ ID NO: 2547255 - RNA, 14 nt, Human
uuacagggagccuc

SEQ ID NO: 2547256 - RNA, 18 nt, Human
uuacccauauccccucuc

SEQ ID NO: 2547257 - RNA, 17 nt, Human
uuacccauauccccucu

SEQ ID NO: 2547258 - RNA, 16 nt, Human
uuacccauauccccuc

SEQ ID NO: 2547259 - RNA, 13 nt, Human
uuacccauauccc

SEQ ID NO: 2547260 - RNA, 16 nt, Human
uuacccagaguuuuua

SEQ ID NO: 2547261 - RNA, 22 nt, Human
uuacccagagaauauauacauu

SEQ ID NO: 2547262 - RNA, 21 nt, Human
uuacccagagaauauauacau

SEQ ID NO: 2547263 - RNA, 20 nt, Human
uuaccuuugacaaagguaaa

SEQ ID NO: 2547264 - RNA, 13 nt, Human
uuaccuuugacaa

SEQ ID NO: 2547265 - RNA, 15 nt, Human
uuaccuuauugcacu

SEQ ID NO: 2547266 - RNA, 14 nt, Human
uuaccuucaauaaa

SEQ ID NO: 2547267 - RNA, 15 nt, Human
uuaccuucaauaaag

SEQ ID NO: 2547268 - RNA, 16 nt, Human
uuaccuucaauaaagu

SEQ ID NO: 2547269 - RNA, 17 nt, Human
uuaccuucaauaaagua

SEQ ID NO: 2547270 - RNA, 18 nt, Human
uuaccuucaauaaaguau

SEQ ID NO: 2547271 - RNA, 19 nt, Human
uuaccuucaauaaaguauc

SEQ ID NO: 2547272 - RNA, 22 nt, Human
uuaccuuagauuagcucuggac

SEQ ID NO: 2547273 - RNA, 12 nt, Human
uuaccuccugcc

SEQ ID NO: 2547274 - RNA, 13 nt, Human
uuaccuccugccc

SEQ ID NO: 2547275 - RNA, 14 nt, Human
uuaccuccugccca

SEQ ID NO: 2547276 - RNA, 15 nt, Human
uuaccuccugcccag

SEQ ID NO: 2547277 - RNA, 11 nt, Human
uuaccuccuga

SEQ ID NO: 2547278 - RNA, 19 nt, Human
uuaccuccugagaaaaaag

SEQ ID NO: 2547279 - RNA, 20 nt, Human
uuaccuaguagucauuucau

SEQ ID NO: 2547280 - RNA, 13 nt, Human
uuaccuacuuuga

SEQ ID NO: 2547281 - RNA, 23 nt, Human
uuaccuacuuugacuuuuugcau

SEQ ID NO: 2547282 - RNA, 17 nt, Human
uuaccuaccacaguguc

SEQ ID NO: 2547283 - RNA, 18 nt, Human
uuaccuaccacagugucu

SEQ ID NO: 2547284 - RNA, 19 nt, Human
uuaccuaccacaugccaag

SEQ ID NO: 2547285 - RNA, 21 nt, Human
uuaccuaccacagugucugua

SEQ ID NO: 2547286 - RNA, 22 nt, Human
uuacccucaggcauaggccugg

SEQ ID NO: 2547287 - RNA, 16 nt, Human
uuaccccuuagccucc

SEQ ID NO: 2547288 - RNA, 16 nt, Human
uuaccuaccacagugu

SEQ ID NO: 2547289 - RNA, 16 nt, Human
uuacccuccuguaaau

SEQ ID NO: 2547290 - RNA, 22 nt, Human
auaacgauaaaagacagugaaa

SEQ ID NO: 2547291 - RNA, 14 nt, Human
auaacguauaaaag

SEQ ID NO: 2547292 - RNA, 21 nt, Human
auaacgccccagauaccagcc

SEQ ID NO: 2547293 - RNA, 13 nt, Human
auaacgccccaga

SEQ ID NO: 2547294 - RNA, 23 nt, Human
auaaccuauuuugaaaaauuccu

SEQ ID NO: 2547295 - RNA, 21 nt, Human
auaacggaucagaaauacaga

SEQ ID NO: 2547296 - RNA, 20 nt, Human
auaacggaucagaaauacag

SEQ ID NO: 2547297 - RNA, 19 nt, Human
auaaaggccccaaauacca

SEQ ID NO: 2547298 - RNA, 13 nt, Human
auaacguuuuucc

SEQ ID NO: 2547299 - RNA, 15 nt, Human
auaacguuuuuccuu

SEQ ID NO: 2547300 - RNA, 18 nt, Human
auaacguuuuuccuuuaa

SEQ ID NO: 2547301 - RNA, 17 nt, Human
auaacguuuuuccuuua

SEQ ID NO: 2547302 - RNA, 13 nt, Human
auaacugugaagu

SEQ ID NO: 2547303 - RNA, 18 nt, Human
auaacuguuauuuauaau

SEQ ID NO: 2547304 - RNA, 20 nt, Human
auaacuguuauuuauaauca

SEQ ID NO: 2547305 - RNA, 22 nt, Human
auaacuguuauuuauaaucacu

SEQ ID NO: 2547306 - RNA, 12 nt, Human
auaacuuaaaaa

SEQ ID NO: 2547307 - RNA, 16 nt, Human
auaacuuaaaaaaaug

SEQ ID NO: 2547308 - RNA, 19 nt, Human
auaacuuaaaaaaaugaca

SEQ ID NO: 2547309 - RNA, 15 nt, Human
auaaaucaaugucac

SEQ ID NO: 2547310 - RNA, 19 nt, Human
auaaauucaccuagucuaa

SEQ ID NO: 2547311 - RNA, 15 nt, Human
auaaauucaccuagu

SEQ ID NO: 2547312 - RNA, 14 nt, Human
auaaauuauuuauu

SEQ ID NO: 2547313 - RNA, 11 nt, Human
auaaauuauuu

SEQ ID NO: 2547314 - RNA, 20 nt, Human
auaaauuccucuuugcuuug

SEQ ID NO: 2547315 - RNA, 22 nt, Human
auaaauucccuggccuuucaua

SEQ ID NO: 2547316 - RNA, 13 nt, Human
auaaauuccucuu

SEQ ID NO: 2547317 - RNA, 22 nt, Human
auaaauucagauauauuuuuca

SEQ ID NO: 2547318 - RNA, 12 nt, Human
auaaauucagau

SEQ ID NO: 2547319 - RNA, 13 nt, Human
auaaauucagaua

SEQ ID NO: 2547320 - RNA, 16 nt, Human
auaaauucagauauau

SEQ ID NO: 2547321 - RNA, 21 nt, Human
auaaauucccuggccuuucau

SEQ ID NO: 2547322 - RNA, 15 nt, Human
auaaauuccacugga

SEQ ID NO: 2547323 - RNA, 23 nt, Human
auaaccguuuccuuucauuuacu

SEQ ID NO: 2547324 - RNA, 18 nt, Human
auaaccuauaugauuuau

SEQ ID NO: 2547325 - RNA, 13 nt, Human
auaaccuauauga

SEQ ID NO: 2547326 - RNA, 12 nt, Human
auaaccccaccc

SEQ ID NO: 2547327 - RNA, 20 nt, Human
auaaccccagcucccuagga

SEQ ID NO: 2547328 - RNA, 13 nt, Human
auaaauaaaaaua

SEQ ID NO: 2547329 - RNA, 17 nt, Human
auaaagguucaugcaaa

SEQ ID NO: 2547330 - RNA, 17 nt, Human
auaaaguaaagcuaaaa

SEQ ID NO: 2547331 - RNA, 13 nt, Human
auaaaguaguaaa

SEQ ID NO: 2547332 - RNA, 16 nt, Human
auaaagguugacaaua

SEQ ID NO: 2547333 - RNA, 21 nt, Human
auaaagguugacaauaaaugu

SEQ ID NO: 2547334 - RNA, 14 nt, Human
auaaaguaaagcua

SEQ ID NO: 2547335 - RNA, 22 nt, Human
auaaagguugacaauaaaugug

SEQ ID NO: 2547336 - RNA, 19 nt, Human
uuaauuggcagcagauuuu

SEQ ID NO: 2547337 - RNA, 18 nt, Human
uuaauuggcagcagauuu

SEQ ID NO: 2547338 - RNA, 16 nt, Human
uuaauuggcagcagau

SEQ ID NO: 2547339 - RNA, 15 nt, Human
auaaagguucaugca

SEQ ID NO: 2547340 - RNA, 20 nt, Human
auaaaggugguaugugugug

SEQ ID NO: 2547341 - RNA, 21 nt, Human
auaaaggugguaugugugugu

SEQ ID NO: 2547342 - RNA, 14 nt, Human
auaaaggccuuuuu

SEQ ID NO: 2547343 - RNA, 19 nt, Human
auaaaggugguaugugugu

SEQ ID NO: 2547344 - RNA, 14 nt, Human
auaaauaaaaauaa

SEQ ID NO: 2547345 - RNA, 16 nt, Human
auaaaguaguaaaaau

SEQ ID NO: 2547346 - RNA, 14 nt, Human
auaaauagcuauau

SEQ ID NO: 2547347 - RNA, 15 nt, Human
auaaauagcuauauc

SEQ ID NO: 2547348 - RNA, 21 nt, Human
auaaauagcuauauccaugua

SEQ ID NO: 2547349 - RNA, 15 nt, Human
auaaauaguuuauga

SEQ ID NO: 2547350 - RNA, 21 nt, Human
auaaauauauauaaaccuaaa

SEQ ID NO: 2547351 - RNA, 16 nt, Human
auaaauauauauaaac

SEQ ID NO: 2547352 - RNA, 15 nt, Human
auaaauauauauaaa

SEQ ID NO: 2547353 - RNA, 12 nt, Human
auaaauauauau

SEQ ID NO: 2547354 - RNA, 23 nt, Human
auaaauauauaaaaagaaaagau

SEQ ID NO: 2547355 - RNA, 16 nt, Human
auaaauaggagaggau

SEQ ID NO: 2547356 - RNA, 18 nt, Human
auaaauauuuuugccaua

SEQ ID NO: 2547357 - RNA, 20 nt, Human
auaaauauuuauguagaugu

SEQ ID NO: 2547358 - RNA, 14 nt, Human
auaaauauuuaugu

SEQ ID NO: 2547359 - RNA, 14 nt, Human
auaaaucaauguca

SEQ ID NO: 2547360 - RNA, 22 nt, Human
auaaauauauauaaaccuaaaa

SEQ ID NO: 2547361 - RNA, 15 nt, Human
auggcuauaaauaua

SEQ ID NO: 2547362 - RNA, 14 nt, Human
auggcuauaaauau

SEQ ID NO: 2547363 - RNA, 13 nt, Human
auggcuauaaaua

SEQ ID NO: 2547364 - RNA, 22 nt, Human
auggcuagaauauccuacuucu

SEQ ID NO: 2547365 - RNA, 21 nt, Human
auggcuauaaauauauaaaaa

SEQ ID NO: 2547366 - RNA, 16 nt, Human
auggcuauaaauauau

SEQ ID NO: 2547367 - RNA, 17 nt, Human
uuugcaagucauggcug

SEQ ID NO: 2547368 - RNA, 15 nt, Human
auggcuauaggugcu

SEQ ID NO: 2547369 - RNA, 22 nt, Human
uuugcaagugaagguuuacaau

SEQ ID NO: 2547370 - RNA, 21 nt, Human
uuugcaagugaagguuuacaa

SEQ ID NO: 2547371 - RNA, 16 nt, Human
uuugcaagugaagguu

SEQ ID NO: 2547372 - RNA, 15 nt, Human
uuugcaagugaaggu

SEQ ID NO: 2547373 - RNA, 13 nt, Human
uuugcaagugaag

SEQ ID NO: 2547374 - RNA, 21 nt, Human
uuugcaagucauggcugugcc

SEQ ID NO: 2547375 - RNA, 18 nt, Human
uuugcaagucauggcugu

SEQ ID NO: 2547376 - RNA, 19 nt, Human
uuugcaauggcuauauggc

SEQ ID NO: 2547377 - RNA, 19 nt, Human
uuugcacauguuuccucua

SEQ ID NO: 2547378 - RNA, 12 nt, Human
uuugcacagcuc

SEQ ID NO: 2547379 - RNA, 16 nt, Human
uuugcacagcucuccg

SEQ ID NO: 2547380 - RNA, 22 nt, Human
uuugccauguuggccaggcugg

SEQ ID NO: 2547381 - RNA, 21 nt, Human
uuugcccaacaccagccccug

SEQ ID NO: 2547382 - RNA, 18 nt, Human
uuugcccaacaccagccc

SEQ ID NO: 2547383 - RNA, 16 nt, Human
uuugcccaacaccagc

SEQ ID NO: 2547384 - RNA, 14 nt, Human
uuugcccaacacca

SEQ ID NO: 2547385 - RNA, 18 nt, Human
uuugcccagaaagaagau

SEQ ID NO: 2547386 - RNA, 23 nt, Human
uuugcccaacaccagccccugcc

SEQ ID NO: 2547387 - RNA, 18 nt, Human
uuugcuaucuuaauuuug

SEQ ID NO: 2547388 - RNA, 13 nt, Human
uuugcuaguuuuu

SEQ ID NO: 2547389 - RNA, 13 nt, Human
uuugcccucccau

SEQ ID NO: 2547390 - RNA, 15 nt, Human
uuugcccuuaaggac

SEQ ID NO: 2547391 - RNA, 21 nt, Human
uuugcccugguagggcaguaa

SEQ ID NO: 2547392 - RNA, 19 nt, Human
uuugcccugguagggcagu

SEQ ID NO: 2547393 - RNA, 19 nt, Human
uuugcccugguuucacugg

SEQ ID NO: 2547394 - RNA, 12 nt, Human
uuugcucaugga

SEQ ID NO: 2547395 - RNA, 11 nt, Human
uuugcucaugg

SEQ ID NO: 2547396 - RNA, 19 nt, Human
uuugcuaugagcuggggau

SEQ ID NO: 2547397 - RNA, 19 nt, Human
uuugcuaucuuaauuuugg

SEQ ID NO: 2547398 - RNA, 13 nt, Human
uuugcuauugaca

SEQ ID NO: 2547399 - RNA, 20 nt, Human
uuugcuauugacaagucauu

SEQ ID NO: 2547400 - RNA, 23 nt, Human
uuugcuauugacaagucauuuua

SEQ ID NO: 2547401 - RNA, 23 nt, Human
uuugcucagugucuggcugcaga

SEQ ID NO: 2547402 - RNA, 23 nt, Human
uuugcucacacgggguauuuuag

SEQ ID NO: 2547403 - RNA, 16 nt, Human
uuugcuauuguaaaua

SEQ ID NO: 2547404 - RNA, 16 nt, Human
uuugcucaccuggggu

SEQ ID NO: 2547405 - RNA, 13 nt, Human
uuugcucauggaa

SEQ ID NO: 2547406 - RNA, 21 nt, Human
uuugcuguagaagauggcacu

SEQ ID NO: 2547407 - RNA, 21 nt, Human
uuugcugugaggcuguccugu

SEQ ID NO: 2547408 - RNA, 19 nt, Human
uuugcugugaggcuguccu

SEQ ID NO: 2547409 - RNA, 12 nt, Human
uuugcuuagaaa

SEQ ID NO: 2547410 - RNA, 16 nt, Human
uuugcuuagaaaagaa

SEQ ID NO: 2547411 - RNA, 17 nt, Human
uuugcugugaggcuguc

SEQ ID NO: 2547412 - RNA, 18 nt, Human
uuugcuguauauuuguga

SEQ ID NO: 2547413 - RNA, 13 nt, Human
uuugcuguagaag

SEQ ID NO: 2547414 - RNA, 23 nt, Human
uuuggccaucucuggaugccuga

SEQ ID NO: 2547415 - RNA, 13 nt, Human
uuuggccaucucu

SEQ ID NO: 2547416 - RNA, 12 nt, Human
uuuggcccccga

SEQ ID NO: 2547417 - RNA, 20 nt, Human
uuuggcccccgagcuggggg

SEQ ID NO: 2547418 - RNA, 21 nt, Human
uuuggcccuucuccuuuugaa

SEQ ID NO: 2547419 - RNA, 21 nt, Human
uuuggcccccgagcugggggc

SEQ ID NO: 2547420 - RNA, 13 nt, Human
uuugcuucauaaa

SEQ ID NO: 2547421 - RNA, 20 nt, Human
uuugcuucauaaaugaagca

SEQ ID NO: 2547422 - RNA, 20 nt, Human
uuuggcaucuguuuaaagua

SEQ ID NO: 2547423 - RNA, 15 nt, Human
uuugcuuauuguucc

SEQ ID NO: 2547424 - RNA, 16 nt, Human
uuugcuuauuguucca

SEQ ID NO: 2547425 - RNA, 17 nt, Human
uuugcuuauuguuccaa

SEQ ID NO: 2547426 - RNA, 19 nt, Human
uuugcuuauuguuccaaga

SEQ ID NO: 2547427 - RNA, 15 nt, Human
uuugcuucaaaaaca

SEQ ID NO: 2547428 - RNA, 14 nt, Human
uuuggggauauuuu

SEQ ID NO: 2547429 - RNA, 19 nt, Human
uuuggggcgaggcagagga

SEQ ID NO: 2547430 - RNA, 18 nt, Human
uuuggggcgaggcagagg

SEQ ID NO: 2547431 - RNA, 14 nt, Human
uuuggggcgaggca

SEQ ID NO: 2547432 - RNA, 13 nt, Human
uuuggggccggga

SEQ ID NO: 2547433 - RNA, 22 nt, Human
uuugggaggccaaggugggagg

SEQ ID NO: 2547434 - RNA, 16 nt, Human
uuuggggauaugcuua

SEQ ID NO: 2547435 - RNA, 20 nt, Human
uuuggggagcagagacacua

SEQ ID NO: 2547436 - RNA, 18 nt, Human
uuugggagacaugugaca

SEQ ID NO: 2547437 - RNA, 16 nt, Human
uuugggagacauguga

SEQ ID NO: 2547438 - RNA, 21 nt, Human
uuugggagacaugugacauuu

SEQ ID NO: 2547439 - RNA, 17 nt, Human
uuugggaauguuugucu

SEQ ID NO: 2547440 - RNA, 17 nt, Human
uuugggaauauuugaau

SEQ ID NO: 2547441 - RNA, 16 nt, Human
uuugggaauauuugaa

SEQ ID NO: 2547442 - RNA, 18 nt, Human
uuuggccucauuacuuua

SEQ ID NO: 2547443 - RNA, 17 nt, Human
uuuggccugcacuaauu

SEQ ID NO: 2547444 - RNA, 14 nt, Human
uuuggcgggccaag

SEQ ID NO: 2547445 - RNA, 17 nt, Human
uuuggcgggccaaggac

SEQ ID NO: 2547446 - RNA, 20 nt, Human
uuugggaagugaagacugga

SEQ ID NO: 2547447 - RNA, 22 nt, Human
uuugggaagugaagacuggaag

SEQ ID NO: 2547448 - RNA, 12 nt, Human
uuugggaagggg

SEQ ID NO: 2547449 - RNA, 19 nt, Human
uuuggcgggccaaggacug

SEQ ID NO: 2547450 - RNA, 18 nt, Human
auguccccaaaccugcaa

SEQ ID NO: 2547451 - RNA, 16 nt, Human
auguccccaaaccugc

SEQ ID NO: 2547452 - RNA, 19 nt, Human
auguccccaaaccugcaag

SEQ ID NO: 2547453 - RNA, 21 nt, Human
augucccuacaccccuccccu

SEQ ID NO: 2547454 - RNA, 24 nt, Human
augucccuaccgagucucuucucc

SEQ ID NO: 2547455 - RNA, 18 nt, Human
augucccaccucucugag

SEQ ID NO: 2547456 - RNA, 20 nt, Human
augucccaacuuguaaaaau

SEQ ID NO: 2547457 - RNA, 21 nt, Human
augucuaauguauuuuauugu

SEQ ID NO: 2547458 - RNA, 19 nt, Human
augucuaauguauuuuauu

SEQ ID NO: 2547459 - RNA, 18 nt, Human
augucuaauguauuuuau

SEQ ID NO: 2547460 - RNA, 17 nt, Human
augucuaauguauuuua

SEQ ID NO: 2547461 - RNA, 21 nt, Human
augucccuucacauaguuuuu

SEQ ID NO: 2547462 - RNA, 14 nt, Human
augucccuucucau

SEQ ID NO: 2547463 - RNA, 19 nt, Human
augucuaaaugcugaaaaa

SEQ ID NO: 2547464 - RNA, 22 nt, Human
augucuauaaucccagcacuuu

SEQ ID NO: 2547465 - RNA, 14 nt, Human
augucuauucagcu

SEQ ID NO: 2547466 - RNA, 15 nt, Human
augucuauucagcuu

SEQ ID NO: 2547467 - RNA, 16 nt, Human
augucuauucagcuuc

SEQ ID NO: 2547468 - RNA, 14 nt, Human
augucuauuuaagc

SEQ ID NO: 2547469 - RNA, 13 nt, Human
augucuauuuaag

SEQ ID NO: 2547470 - RNA, 12 nt, Human
augucuauuuaa

SEQ ID NO: 2547471 - RNA, 17 nt, Human
augucuauuaaggugau

SEQ ID NO: 2547472 - RNA, 20 nt, Human
augucucaauaguaaaagau

SEQ ID NO: 2547473 - RNA, 16 nt, Human
augucagugugacuga

SEQ ID NO: 2547474 - RNA, 15 nt, Human
augucagugugacug

SEQ ID NO: 2547475 - RNA, 17 nt, Human
augucaguaccuucaaa

SEQ ID NO: 2547476 - RNA, 14 nt, Human
augucaguaugugg

SEQ ID NO: 2547477 - RNA, 21 nt, Human
augucagugugacugaucucu

SEQ ID NO: 2547478 - RNA, 18 nt, Human
auguccaagaagcccagg

SEQ ID NO: 2547479 - RNA, 19 nt, Human
auguccaagaagcccagga

SEQ ID NO: 2547480 - RNA, 23 nt, Human
auguccaagaagcccaggaaagg

SEQ ID NO: 2547481 - RNA, 16 nt, Human
auguccacagaugccu

SEQ ID NO: 2547482 - RNA, 20 nt, Human
auguccacagaugccuccac

SEQ ID NO: 2547483 - RNA, 17 nt, Human
auguaugcuucauacag

SEQ ID NO: 2547484 - RNA, 15 nt, Human
auguaucuaccucac

SEQ ID NO: 2547485 - RNA, 15 nt, Human
auguaucugagcagg

SEQ ID NO: 2547486 - RNA, 20 nt, Human
auguaugcuucauacaggga

SEQ ID NO: 2547487 - RNA, 18 nt, Human
auguauggaauacagugu

SEQ ID NO: 2547488 - RNA, 20 nt, Human
auguauggaauacaguguua

SEQ ID NO: 2547489 - RNA, 21 nt, Human
auguauggaauacaguguuau

SEQ ID NO: 2547490 - RNA, 17 nt, Human
auguaugugcacuguca

SEQ ID NO: 2547491 - RNA, 16 nt, Human
auguaugugcacuguc

SEQ ID NO: 2547492 - RNA, 15 nt, Human
auguaugugcacugu

SEQ ID NO: 2547493 - RNA, 20 nt, Human
auguaugugcacugucacuu

SEQ ID NO: 2547494 - RNA, 23 nt, Human
augucagccgagccgggccuggg

SEQ ID NO: 2547495 - RNA, 19 nt, Human
augucagccgagccgggcc

SEQ ID NO: 2547496 - RNA, 12 nt, Human
auguauguguaa

SEQ ID NO: 2547497 - RNA, 15 nt, Human
augucaggaacagaa

SEQ ID NO: 2547498 - RNA, 17 nt, Human
augucaggaacagaagg

SEQ ID NO: 2547499 - RNA, 19 nt, Human
augucaggaacagaaggau

SEQ ID NO: 2547500 - RNA, 20 nt, Human
augucaggaacagaaggaug

SEQ ID NO: 2547501 - RNA, 13 nt, Human
augucaguaugug

SEQ ID NO: 2547502 - RNA, 16 nt, Human
augucaggccugugug

SEQ ID NO: 2547503 - RNA, 12 nt, Human
augucaggccug

SEQ ID NO: 2547504 - RNA, 23 nt, Human
augucaggggcggggagggugac

SEQ ID NO: 2547505 - RNA, 15 nt, Human
auguaucaaugagua

SEQ ID NO: 2547506 - RNA, 22 nt, Human
auguauaaagcaacuguuauga

SEQ ID NO: 2547507 - RNA, 21 nt, Human
auguauaaagcaacuguuaug

SEQ ID NO: 2547508 - RNA, 17 nt, Human
auguauaaagaacaagg

SEQ ID NO: 2547509 - RNA, 17 nt, Human
auguaucauagaaaugu

SEQ ID NO: 2547510 - RNA, 12 nt, Human
auguaucaucug

SEQ ID NO: 2547511 - RNA, 20 nt, Human
auguauccaugggggcaggg

SEQ ID NO: 2547512 - RNA, 16 nt, Human
auguaucauagaaaug

SEQ ID NO: 2547513 - RNA, 21 nt, Human
auguaucaggaaauauauaug

SEQ ID NO: 2547514 - RNA, 13 nt, Human
auguaucaggaaa

SEQ ID NO: 2547515 - RNA, 22 nt, Human
uuugggggaaaauuuagaaaua

SEQ ID NO: 2547516 - RNA, 16 nt, Human
auguagugccucuuuc

SEQ ID NO: 2547517 - RNA, 14 nt, Human
auguagugccucuu

SEQ ID NO: 2547518 - RNA, 13 nt, Human
uuuguuugaacug

SEQ ID NO: 2547519 - RNA, 14 nt, Human
uuuguuugaacuga

SEQ ID NO: 2547520 - RNA, 12 nt, Human
uuuguuugaacu

SEQ ID NO: 2547521 - RNA, 16 nt, Human
uuuguuucuuccaaag

SEQ ID NO: 2547522 - RNA, 19 nt, Human
uuugugaggaagccgcugg

SEQ ID NO: 2547523 - RNA, 18 nt, Human
uuugugaggaagccgcug

SEQ ID NO: 2547524 - RNA, 23 nt, Human
uuugugacuauauagagauguuu

SEQ ID NO: 2547525 - RNA, 15 nt, Human
uuugucuaaaaugcc

SEQ ID NO: 2547526 - RNA, 19 nt, Human
uuugucucaucccauucug

SEQ ID NO: 2547527 - RNA, 14 nt, Human
uuugucucauccca

SEQ ID NO: 2547528 - RNA, 14 nt, Human
uuugucugaaaaau

SEQ ID NO: 2547529 - RNA, 16 nt, Human
uuugugagcaggcugu

SEQ ID NO: 2547530 - RNA, 22 nt, Human
uuugugacuauauagagauguu

SEQ ID NO: 2547531 - RNA, 20 nt, Human
uuugugacuauauagagaug

SEQ ID NO: 2547532 - RNA, 17 nt, Human
uuugucugucuucauag

SEQ ID NO: 2547533 - RNA, 11 nt, Human
uuugucuaaaa

SEQ ID NO: 2547534 - RNA, 14 nt, Human
uuugucuaaaacaa

SEQ ID NO: 2547535 - RNA, 16 nt, Human
uuugucuaaaacaaua

SEQ ID NO: 2547536 - RNA, 19 nt, Human
uuugucuaaaacaauaaaa

SEQ ID NO: 2547537 - RNA, 19 nt, Human
uuugucgcucaugugugca

SEQ ID NO: 2547538 - RNA, 20 nt, Human
uuugucgaauuuuuauuauu

SEQ ID NO: 2547539 - RNA, 16 nt, Human
uuugucgaauuuuuau

SEQ ID NO: 2547540 - RNA, 23 nt, Human
uuuguaggggucaaagaaaugcu

SEQ ID NO: 2547541 - RNA, 21 nt, Human
uuuguaggggucaaagaaaug

SEQ ID NO: 2547542 - RNA, 20 nt, Human
uuuguaggggucaaagaaau

SEQ ID NO: 2547543 - RNA, 19 nt, Human
uuuguaggggucaaagaaa

SEQ ID NO: 2547544 - RNA, 17 nt, Human
uuuguagccuuccucca

SEQ ID NO: 2547545 - RNA, 20 nt, Human
uuuguaccccccaaccccug

SEQ ID NO: 2547546 - RNA, 19 nt, Human
uuuguaccccccaaccccu

SEQ ID NO: 2547547 - RNA, 14 nt, Human
uuuguacugaaaaa

SEQ ID NO: 2547548 - RNA, 15 nt, Human
uuuguacugaaaaau

SEQ ID NO: 2547549 - RNA, 18 nt, Human
uuuguaccccccaacccc

SEQ ID NO: 2547550 - RNA, 17 nt, Human
uuuguaccaugguguga

SEQ ID NO: 2547551 - RNA, 20 nt, Human
uuuguacuguaaagagaccu

SEQ ID NO: 2547552 - RNA, 15 nt, Human
uuuguacuguaaaga

SEQ ID NO: 2547553 - RNA, 13 nt, Human
uuuguacuguaaa

SEQ ID NO: 2547554 - RNA, 16 nt, Human
uuuguacuguaaagag

SEQ ID NO: 2547555 - RNA, 13 nt, Human
uuuguagagccag

SEQ ID NO: 2547556 - RNA, 17 nt, Human
uuuguaaauuuauguga

SEQ ID NO: 2547557 - RNA, 20 nt, Human
uuuguaacccagauuuugcu

SEQ ID NO: 2547558 - RNA, 13 nt, Human
uuuguaaauuguc

SEQ ID NO: 2547559 - RNA, 16 nt, Human
uuuguaaccucagcuc

SEQ ID NO: 2547560 - RNA, 15 nt, Human
uuuguaaccucagcu

SEQ ID NO: 2547561 - RNA, 21 nt, Human
uuuguaacccagauuuugcug

SEQ ID NO: 2547562 - RNA, 19 nt, Human
uuuguaaccucagcucugg

SEQ ID NO: 2547563 - RNA, 18 nt, Human
uuuguaaccucagcucug

SEQ ID NO: 2547564 - RNA, 19 nt, Human
uuuguacauauguaaaaua

SEQ ID NO: 2547565 - RNA, 14 nt, Human
uuuguaccauggug

SEQ ID NO: 2547566 - RNA, 21 nt, Human
augucugccaauuuuugccuu

SEQ ID NO: 2547567 - RNA, 16 nt, Human
augucugccaauuuuu

SEQ ID NO: 2547568 - RNA, 14 nt, Human
augucugccaauuu

SEQ ID NO: 2547569 - RNA, 13 nt, Human
augucugccaauu

SEQ ID NO: 2547570 - RNA, 14 nt, Human
augucugcauuucg

SEQ ID NO: 2547571 - RNA, 15 nt, Human
augucugagugaacc

SEQ ID NO: 2547572 - RNA, 16 nt, Human
augucugagugaaccu

SEQ ID NO: 2547573 - RNA, 17 nt, Human
augucugaacucuccag

SEQ ID NO: 2547574 - RNA, 23 nt, Human
augucuauuuaagccucauauuu

SEQ ID NO: 2547575 - RNA, 15 nt, Human
augucuauuuaagcc

SEQ ID NO: 2547576 - RNA, 22 nt, Human
augucugagugaaccuguauaa

SEQ ID NO: 2547577 - RNA, 15 nt, Human
augucugccacacaa

SEQ ID NO: 2547578 - RNA, 23 nt, Human
augucugccaauuuuugccuuca

SEQ ID NO: 2547579 - RNA, 20 nt, Human
augucugcugaauaauaaac

SEQ ID NO: 2547580 - RNA, 18 nt, Human
augucuuaaugaaguuug

SEQ ID NO: 2547581 - RNA, 16 nt, Human
augucuuaaugaaguu

SEQ ID NO: 2547582 - RNA, 13 nt, Human
augucuuaaugaa

SEQ ID NO: 2547583 - RNA, 16 nt, Human
augucuguucuacaua

SEQ ID NO: 2547584 - RNA, 12 nt, Human
augucuuaauga

SEQ ID NO: 2547585 - RNA, 16 nt, Human
augucuguugaugacu

SEQ ID NO: 2547586 - RNA, 23 nt, Human
augucuguuaccaugucacugug

SEQ ID NO: 2547587 - RNA, 20 nt, Human
augucuguuaccaugucacu

SEQ ID NO: 2547588 - RNA, 14 nt, Human
augucuguucuaca

SEQ ID NO: 2547589 - RNA, 20 nt, Human
augucugugcuagggaaacu

SEQ ID NO: 2547590 - RNA, 12 nt, Human
augucugugcua

SEQ ID NO: 2547591 - RNA, 13 nt, Human
augucuguuacca

SEQ ID NO: 2547592 - RNA, 16 nt, Human
augucuguagcuccuc

SEQ ID NO: 2547593 - RNA, 18 nt, Human
augucuguagcuccucaa

SEQ ID NO: 2547594 - RNA, 19 nt, Human
augucuguagcuccucaac

SEQ ID NO: 2547595 - RNA, 11 nt, Human
augucugugcu

SEQ ID NO: 2547596 - RNA, 21 nt, Human
uuuuaagauuuuucucaaagu

SEQ ID NO: 2547597 - RNA, 23 nt, Human
uuuuaagcccaucaauuauagaa

SEQ ID NO: 2547598 - RNA, 15 nt, Human
uuuuaagcaaaauau

SEQ ID NO: 2547599 - RNA, 19 nt, Human
uuuuaagauuuuucucaaa

SEQ ID NO: 2547600 - RNA, 18 nt, Human
uuuuaagauuuuucucaa

SEQ ID NO: 2547601 - RNA, 17 nt, Human
uuuuaagauuuuucuca

SEQ ID NO: 2547602 - RNA, 21 nt, Human
uuuuaagauaauaauauaugu

SEQ ID NO: 2547603 - RNA, 12 nt, Human
uuuuaagauuuu

SEQ ID NO: 2547604 - RNA, 20 nt, Human
uuuuaaggguuuguggaaaa

SEQ ID NO: 2547605 - RNA, 22 nt, Human
uuuuaagcuguaaaaagagaga

SEQ ID NO: 2547606 - RNA, 21 nt, Human
uuuuaagcguaauuuugccaa

SEQ ID NO: 2547607 - RNA, 12 nt, Human
uuuuaaggaaac

SEQ ID NO: 2547608 - RNA, 12 nt, Human
uuuuaagcuguu

SEQ ID NO: 2547609 - RNA, 16 nt, Human
uuuuaaguaaggaauu

SEQ ID NO: 2547610 - RNA, 23 nt, Human
uuuuaaggguuuguggaaaauga

SEQ ID NO: 2547611 - RNA, 15 nt, Human
uuuuaagugcugcau

SEQ ID NO: 2547612 - RNA, 21 nt, Human
uuuuaaguauugcaucuguau

SEQ ID NO: 2547613 - RNA, 15 nt, Human
uuuuaaguauuuagg

SEQ ID NO: 2547614 - RNA, 17 nt, Human
uuuuaaguauuuauaua

SEQ ID NO: 2547615 - RNA, 18 nt, Human
uuuuaaguauuuauauau

SEQ ID NO: 2547616 - RNA, 19 nt, Human
uuuuaacuuuaaguuucag

SEQ ID NO: 2547617 - RNA, 16 nt, Human
uuuuaacuuuaaguuu

SEQ ID NO: 2547618 - RNA, 14 nt, Human
uuuuaacucugucu

SEQ ID NO: 2547619 - RNA, 12 nt, Human
uuuuaacucacc

SEQ ID NO: 2547620 - RNA, 16 nt, Human
uuuuaacuagaauuua

SEQ ID NO: 2547621 - RNA, 13 nt, Human
uuuuaacucaaua

SEQ ID NO: 2547622 - RNA, 12 nt, Human
uuuuaacuagaa

SEQ ID NO: 2547623 - RNA, 21 nt, Human
uuuuaaccaaaggugaaggaa

SEQ ID NO: 2547624 - RNA, 16 nt, Human
uuuuaaccaaagguga

SEQ ID NO: 2547625 - RNA, 15 nt, Human
uuuuaaccaaaggug

SEQ ID NO: 2547626 - RNA, 14 nt, Human
uuuuaaccaaaggu

SEQ ID NO: 2547627 - RNA, 21 nt, Human
uuuuaaccauugucuuguucu

SEQ ID NO: 2547628 - RNA, 11 nt, Human
uuuuaagaaau

SEQ ID NO: 2547629 - RNA, 15 nt, Human
uuuuaagaggcaggg

SEQ ID NO: 2547630 - RNA, 16 nt, Human
uuuuaagaggcagggu

SEQ ID NO: 2547631 - RNA, 22 nt, Human
uuuuaagauaaauuauaaguua

SEQ ID NO: 2547632 - RNA, 19 nt, Human
uuuuaagacguguuugugu

SEQ ID NO: 2547633 - RNA, 15 nt, Human
uuuuaaaagaaugau

SEQ ID NO: 2547634 - RNA, 14 nt, Human
uuuuaaaagaauga

SEQ ID NO: 2547635 - RNA, 21 nt, Human
uuuuaacaauaacuacugugu

SEQ ID NO: 2547636 - RNA, 22 nt, Human
uuuuaacaauaacuacuguguu

SEQ ID NO: 2547637 - RNA, 19 nt, Human
uuuuaacaauaacuacugu

SEQ ID NO: 2547638 - RNA, 12 nt, Human
uuuuaaccaaag

SEQ ID NO: 2547639 - RNA, 20 nt, Human
uuuuaacaccugauguguac

SEQ ID NO: 2547640 - RNA, 19 nt, Human
uuuuaacaccugaugugua

SEQ ID NO: 2547641 - RNA, 17 nt, Human
uuuuaacaccugaugug

SEQ ID NO: 2547642 - RNA, 13 nt, Human
uuuuaaaacccag

SEQ ID NO: 2547643 - RNA, 22 nt, Human
uuuuaaaacacuuccauaaucu

SEQ ID NO: 2547644 - RNA, 16 nt, Human
uuuuaaaacacuucca

SEQ ID NO: 2547645 - RNA, 15 nt, Human
uuuuaaaaaugaauc

SEQ ID NO: 2547646 - RNA, 20 nt, Human
uuuuaaaaauuguuaauuuu

SEQ ID NO: 2547647 - RNA, 22 nt, Human
uuuuaaaaauuaaaucaaccuu

SEQ ID NO: 2547648 - RNA, 14 nt, Human
uuuuaaaaaugaau

SEQ ID NO: 2547649 - RNA, 16 nt, Human
uuuuaaaaaugaaauu

SEQ ID NO: 2547650 - RNA, 14 nt, Human
uuuuaaaaaugcaa

SEQ ID NO: 2547651 - RNA, 17 nt, Human
uuuuaaaaauagacacu

SEQ ID NO: 2547652 - RNA, 15 nt, Human
uuuuaaaaaucauaa

SEQ ID NO: 2547653 - RNA, 22 nt, Human
uuuuaaaaaucauaaacugugu

SEQ ID NO: 2547654 - RNA, 12 nt, Human
uuuuaaaaauga

SEQ ID NO: 2547655 - RNA, 22 nt, Human
uuuuaaaaaucuaccuucugua

SEQ ID NO: 2547656 - RNA, 23 nt, Human
uuuuaaaaaucauaaacugugug

SEQ ID NO: 2547657 - RNA, 22 nt, Human
uuuuaaaaagaaacaagaugcu

SEQ ID NO: 2547658 - RNA, 21 nt, Human
uuuuaaaaaacugcugacugu

SEQ ID NO: 2547659 - RNA, 18 nt, Human
uuuguuugguauuguauu

SEQ ID NO: 2547660 - RNA, 16 nt, Human
uuuguuugguauugua

SEQ ID NO: 2547661 - RNA, 13 nt, Human
uuuguuugcuauc

SEQ ID NO: 2547662 - RNA, 15 nt, Human
uuuguuugguauugu

SEQ ID NO: 2547663 - RNA, 18 nt, Human
uuuguuugaacugauaaa

SEQ ID NO: 2547664 - RNA, 13 nt, Human
uuuuaaaaaagaa

SEQ ID NO: 2547665 - RNA, 16 nt, Human
uuuguuugugcuucua

SEQ ID NO: 2547666 - RNA, 15 nt, Human
uuuguuugugcuucu

SEQ ID NO: 2547667 - RNA, 12 nt, Human
uuuguuugugcu

SEQ ID NO: 2547668 - RNA, 15 nt, Human
uuuguuugcuaucuu

SEQ ID NO: 2547669 - RNA, 13 nt, Human
uuuguuugugcau

SEQ ID NO: 2547670 - RNA, 17 nt, Human
auguuauauauuuuuug

SEQ ID NO: 2547671 - RNA, 13 nt, Human
auguuauauauuu

SEQ ID NO: 2547672 - RNA, 19 nt, Human
auguucaucaaugaaugaa

SEQ ID NO: 2547673 - RNA, 21 nt, Human
auguucaucauccuaagcuau

SEQ ID NO: 2547674 - RNA, 15 nt, Human
auguugacaugggac

SEQ ID NO: 2547675 - RNA, 18 nt, Human
auguuccaauaaacagga

SEQ ID NO: 2547676 - RNA, 16 nt, Human
auguuccaauaaacag

SEQ ID NO: 2547677 - RNA, 14 nt, Human
auguugaauacuuu

SEQ ID NO: 2547678 - RNA, 15 nt, Human
auguugaauacuuuu

SEQ ID NO: 2547679 - RNA, 19 nt, Human
auguugaauacuuuuuaca

SEQ ID NO: 2547680 - RNA, 16 nt, Human
auguugaagccuuugu

SEQ ID NO: 2547681 - RNA, 15 nt, Human
auguugaagccuuug

SEQ ID NO: 2547682 - RNA, 19 nt, Human
auguucaucccaugaugua

SEQ ID NO: 2547683 - RNA, 14 nt, Human
auguucauuguaau

SEQ ID NO: 2547684 - RNA, 21 nt, Human
auguucauuguaauguuacug

SEQ ID NO: 2547685 - RNA, 22 nt, Human
auguucauuguaauguuacuga

SEQ ID NO: 2547686 - RNA, 11 nt, Human
auguucauuua

SEQ ID NO: 2547687 - RNA, 15 nt, Human
auguuccaauaaaca

SEQ ID NO: 2547688 - RNA, 23 nt, Human
auguucauuguaauguuacugau

SEQ ID NO: 2547689 - RNA, 16 nt, Human
uuuuaagugcugcauu

SEQ ID NO: 2547690 - RNA, 17 nt, Human
uuuuaagugcugcauuu

SEQ ID NO: 2547691 - RNA, 21 nt, Human
uuuuaagugcugcauuuaaaa

SEQ ID NO: 2547692 - RNA, 17 nt, Human
uuuuaagugcuuuguaa

SEQ ID NO: 2547693 - RNA, 19 nt, Human
uuuuaagugcuuuguaaug

SEQ ID NO: 2547694 - RNA, 19 nt, Human
uuuuaaguauuuauauauu

SEQ ID NO: 2547695 - RNA, 22 nt, Human
uuuuaaguuacacauuuuucag

SEQ ID NO: 2547696 - RNA, 21 nt, Human
uuuuaaguuacacauuuuuca

SEQ ID NO: 2547697 - RNA, 14 nt, Human
auguuggccaggcu

SEQ ID NO: 2547698 - RNA, 13 nt, Human
auguuggccaggc

SEQ ID NO: 2547699 - RNA, 21 nt, Human
auguugcacacccacucagcu

SEQ ID NO: 2547700 - RNA, 22 nt, Human
auguugcacacccacucagcuc

SEQ ID NO: 2547701 - RNA, 16 nt, Human
auguuggccaggcugc

SEQ ID NO: 2547702 - RNA, 16 nt, Human
auguuggccaggcugg

SEQ ID NO: 2547703 - RNA, 22 nt, Human
auguugaaugcccacaggcaaa

SEQ ID NO: 2547704 - RNA, 16 nt, Human
auguugagaaucccaa

SEQ ID NO: 2547705 - RNA, 22 nt, Human
auguugagaaucccaaauuuga

SEQ ID NO: 2547706 - RNA, 18 nt, Human
auguugagccaggccugg

SEQ ID NO: 2547707 - RNA, 14 nt, Human
auguugagggaaca

SEQ ID NO: 2547708 - RNA, 20 nt, Human
auguugagggaacagacagg

SEQ ID NO: 2547709 - RNA, 12 nt, Human
uuuuauaaacuu

SEQ ID NO: 2547710 - RNA, 13 nt, Human
uuuuauaaacuuu

SEQ ID NO: 2547711 - RNA, 19 nt, Human
uuuuaguuucuguucugug

SEQ ID NO: 2547712 - RNA, 18 nt, Human
uuuuaguuucuguucugu

SEQ ID NO: 2547713 - RNA, 20 nt, Human
uuuuaguuuaaaaaccuugu

SEQ ID NO: 2547714 - RNA, 19 nt, Human
uuuuaguugcaacuuugua

SEQ ID NO: 2547715 - RNA, 21 nt, Human
uuuuaguuucuguucugugga

SEQ ID NO: 2547716 - RNA, 20 nt, Human
uuuuaguuucuguucugugg

SEQ ID NO: 2547717 - RNA, 22 nt, Human
uuuuaguuucuguucuguggaa

SEQ ID NO: 2547718 - RNA, 13 nt, Human
uuuuaguuuuagu

SEQ ID NO: 2547719 - RNA, 11 nt, Human
uuuuagcaugu

SEQ ID NO: 2547720 - RNA, 23 nt, Human
uuuuagcaaagauaucucaucuc

SEQ ID NO: 2547721 - RNA, 21 nt, Human
uuuuagcaauuuauacaauau

SEQ ID NO: 2547722 - RNA, 20 nt, Human
uuuuagcugaugaacuuauu

SEQ ID NO: 2547723 - RNA, 19 nt, Human
uuuuagcuccuugacuccu

SEQ ID NO: 2547724 - RNA, 23 nt, Human
uuuuagccuucucuguucauuuc

SEQ ID NO: 2547725 - RNA, 16 nt, Human
uuuuagccuucucugu

SEQ ID NO: 2547726 - RNA, 22 nt, Human
uuuuagcauguguuugguucug

SEQ ID NO: 2547727 - RNA, 19 nt, Human
uuuuagccuaguucaucca

SEQ ID NO: 2547728 - RNA, 19 nt, Human
uuuuagaugagauuguuuu

SEQ ID NO: 2547729 - RNA, 19 nt, Human
uuuuagaucaaauacuuua

SEQ ID NO: 2547730 - RNA, 17 nt, Human
uuuuagaucaaauacuu

SEQ ID NO: 2547731 - RNA, 20 nt, Human
uuuuagaugagauuguuuua

SEQ ID NO: 2547732 - RNA, 23 nt, Human
uuuuagaguugauacuacaguuu

SEQ ID NO: 2547733 - RNA, 16 nt, Human
uuuuagaucaaauacu

SEQ ID NO: 2547734 - RNA, 16 nt, Human
uuuuauuauuacuguu

SEQ ID NO: 2547735 - RNA, 21 nt, Human
uuuuauucagcucauggacuu

SEQ ID NO: 2547736 - RNA, 18 nt, Human
uuuuauucauaagccaau

SEQ ID NO: 2547737 - RNA, 13 nt, Human
uuuuauuauuugu

SEQ ID NO: 2547738 - RNA, 14 nt, Human
uuuuauucaaguua

SEQ ID NO: 2547739 - RNA, 17 nt, Human
uuuucagauauaaaaga

SEQ ID NO: 2547740 - RNA, 21 nt, Human
uuuucagauauaaaagacuga

SEQ ID NO: 2547741 - RNA, 19 nt, Human
uuuucagauauaaaagacu

SEQ ID NO: 2547742 - RNA, 22 nt, Human
uuuucagauauaaaagacugac

SEQ ID NO: 2547743 - RNA, 18 nt, Human
uuuucagcaaacucuuuu

SEQ ID NO: 2547744 - RNA, 18 nt, Human
uuuucagcgauguaugca

SEQ ID NO: 2547745 - RNA, 18 nt, Human
uuuucauggugaaaaugu

SEQ ID NO: 2547746 - RNA, 19 nt, Human
uuuucagcaaacucuuuuc

SEQ ID NO: 2547747 - RNA, 19 nt, Human
uuuucagcccauauuucau

SEQ ID NO: 2547748 - RNA, 19 nt, Human
uuuucauguuuuaacaaaa

SEQ ID NO: 2547749 - RNA, 20 nt, Human
uuuucauguuuuaacaaaaa

SEQ ID NO: 2547750 - RNA, 12 nt, Human
uuuucauguuuu

SEQ ID NO: 2547751 - RNA, 16 nt, Human
uuuucauguuuuaaca

SEQ ID NO: 2547752 - RNA, 21 nt, Human
uuuucauggugaaaauguacu

SEQ ID NO: 2547753 - RNA, 14 nt, Human
uuuucaugugugau

SEQ ID NO: 2547754 - RNA, 21 nt, Human
uuuucauucagguauuuguaa

SEQ ID NO: 2547755 - RNA, 13 nt, Human
uuuuccaggcugg

SEQ ID NO: 2547756 - RNA, 19 nt, Human
uuuuccagguuuaagcugu

SEQ ID NO: 2547757 - RNA, 14 nt, Human
uuuuccauaaagaa

SEQ ID NO: 2547758 - RNA, 11 nt, Human
uuuuccaugaa

SEQ ID NO: 2547759 - RNA, 14 nt, Human
uuuuccaugaaaac

SEQ ID NO: 2547760 - RNA, 16 nt, Human
uuuuccaugaaaacgu

SEQ ID NO: 2547761 - RNA, 19 nt, Human
uuuuccaugaaaaugcaac

SEQ ID NO: 2547762 - RNA, 18 nt, Human
uuuuccaugaaaaugcaa

SEQ ID NO: 2547763 - RNA, 22 nt, Human
uuuuauguugcauagaauaaaa

SEQ ID NO: 2547764 - RNA, 19 nt, Human
uuuuaugugaaacauguuu

SEQ ID NO: 2547765 - RNA, 19 nt, Human
uuuuauguaguaauugaca

SEQ ID NO: 2547766 - RNA, 18 nt, Human
uuuuaugugagagaaagu

SEQ ID NO: 2547767 - RNA, 23 nt, Human
uuuuauggaggcuuugcauagau

SEQ ID NO: 2547768 - RNA, 19 nt, Human
uuuuauggcacuaguauuu

SEQ ID NO: 2547769 - RNA, 18 nt, Human
uuuuaugugaaacauguu

SEQ ID NO: 2547770 - RNA, 23 nt, Human
uuuuauaauaaaaggaaaagcaa

SEQ ID NO: 2547771 - RNA, 14 nt, Human
uuuuauaaacuuua

SEQ ID NO: 2547772 - RNA, 17 nt, Human
uuuuauaaacuuuaccu

SEQ ID NO: 2547773 - RNA, 19 nt, Human
uuuuauaaacuuuaccuuu

SEQ ID NO: 2547774 - RNA, 16 nt, Human
uuuuauaaaaaauggu

SEQ ID NO: 2547775 - RNA, 20 nt, Human
uuuuauaacuaguccuuuac

SEQ ID NO: 2547776 - RNA, 19 nt, Human
uuuuauaaaccucuaauuu

SEQ ID NO: 2547777 - RNA, 12 nt, Human
uuuuauaaaucg

SEQ ID NO: 2547778 - RNA, 20 nt, Human
uuuuauaaaucgcuuuugau

SEQ ID NO: 2547779 - RNA, 14 nt, Human
uuuuauaauuuugu

SEQ ID NO: 2547780 - RNA, 18 nt, Human
uuuuaugcuuuaaacauu

SEQ ID NO: 2547781 - RNA, 19 nt, Human
uuuuaugccuuuuauuucu

SEQ ID NO: 2547782 - RNA, 13 nt, Human
auuaaccucugca

SEQ ID NO: 2547783 - RNA, 13 nt, Human
auuaaccucucac

SEQ ID NO: 2547784 - RNA, 19 nt, Human
auuaaccaaaaaaguuaca

SEQ ID NO: 2547785 - RNA, 17 nt, Human
auuaaccaaaaaaguua

SEQ ID NO: 2547786 - RNA, 22 nt, Human
auuaacauugggaaaucuuaua

SEQ ID NO: 2547787 - RNA, 18 nt, Human
auuaaccagaaauccagu

SEQ ID NO: 2547788 - RNA, 15 nt, Human
auuaaccauagaugu

SEQ ID NO: 2547789 - RNA, 18 nt, Human
auuaaccacuucagcuga

SEQ ID NO: 2547790 - RNA, 20 nt, Human
auuaaccacuucagcugacu

SEQ ID NO: 2547791 - RNA, 17 nt, Human
auuaaccacuucagcug

SEQ ID NO: 2547792 - RNA, 19 nt, Human
auuaaaggcuucucucuca

SEQ ID NO: 2547793 - RNA, 19 nt, Human
auuaacauugggaaaucuu

SEQ ID NO: 2547794 - RNA, 21 nt, Human
auuaacauugggaaaucuuau

SEQ ID NO: 2547795 - RNA, 17 nt, Human
auuaaacuuaaucuaaa

SEQ ID NO: 2547796 - RNA, 16 nt, Human
auuaaacuuaaucuaa

SEQ ID NO: 2547797 - RNA, 19 nt, Human
auuaaacuuaaucuaaaug

SEQ ID NO: 2547798 - RNA, 21 nt, Human
auuaaacuuaaucuaaaugga

SEQ ID NO: 2547799 - RNA, 18 nt, Human
auuaaagugauacugaaa

SEQ ID NO: 2547800 - RNA, 20 nt, Human
auuaaaggcuucucucucac

SEQ ID NO: 2547801 - RNA, 16 nt, Human
auuaaaggcuucucuc

SEQ ID NO: 2547802 - RNA, 17 nt, Human
auuaaagcuaaaguauc

SEQ ID NO: 2547803 - RNA, 14 nt, Human
auuaaaggaauaaa

SEQ ID NO: 2547804 - RNA, 18 nt, Human
auuaaagcuaaaguaucu

SEQ ID NO: 2547805 - RNA, 16 nt, Human
auuaacuuuuauaaac

SEQ ID NO: 2547806 - RNA, 17 nt, Human
auuaacuuuuauaaacu

SEQ ID NO: 2547807 - RNA, 19 nt, Human
auuaacuuuuauaaacuuu

SEQ ID NO: 2547808 - RNA, 20 nt, Human
auuaacuuuuauaaacuuua

SEQ ID NO: 2547809 - RNA, 16 nt, Human
auuaaccuggugcugg

SEQ ID NO: 2547810 - RNA, 17 nt, Human
auuaacuaaucuauugg

SEQ ID NO: 2547811 - RNA, 14 nt, Human
auuaaccucugcac

SEQ ID NO: 2547812 - RNA, 22 nt, Human
auuaaccugccagggagacaga

SEQ ID NO: 2547813 - RNA, 14 nt, Human
auuaaccuggugcu

SEQ ID NO: 2547814 - RNA, 17 nt, Human
auuaaccuggugcugga

SEQ ID NO: 2547815 - RNA, 12 nt, Human
auuaacuuuuau

SEQ ID NO: 2547816 - RNA, 15 nt, Human
auuaacuuagcaugu

SEQ ID NO: 2547817 - RNA, 16 nt, Human
auuaagaaugaaauac

SEQ ID NO: 2547818 - RNA, 20 nt, Human
auuaagaaugaaauacuguu

SEQ ID NO: 2547819 - RNA, 21 nt, Human
auuaagaaugaaauacuguuu

SEQ ID NO: 2547820 - RNA, 22 nt, Human
auuaagaaugaaauacuguuug

SEQ ID NO: 2547821 - RNA, 15 nt, Human
auuaagaaggcaaaa

SEQ ID NO: 2547822 - RNA, 19 nt, Human
auuaagaaggcaaaaaugu

SEQ ID NO: 2547823 - RNA, 22 nt, Human
auuaagaaggcaaaaauguaaa

SEQ ID NO: 2547824 - RNA, 20 nt, Human
auuaagaaaaucauauugcu

SEQ ID NO: 2547825 - RNA, 16 nt, Human
auuaagaaaaucauau

SEQ ID NO: 2547826 - RNA, 15 nt, Human
auuaagaaaaucaua

SEQ ID NO: 2547827 - RNA, 15 nt, Human
auuaagaaaaucuau

SEQ ID NO: 2547828 - RNA, 20 nt, Human
auuaagaacacuuuuaauaa

SEQ ID NO: 2547829 - RNA, 14 nt, Human
auuaagaagaaacu

SEQ ID NO: 2547830 - RNA, 23 nt, Human
auuaacuuuuauaaacuuuaccu

SEQ ID NO: 2547831 - RNA, 14 nt, Human
auuaagaaaaucau

SEQ ID NO: 2547832 - RNA, 13 nt, Human
auuaagaaaauca

SEQ ID NO: 2547833 - RNA, 12 nt, Human
auuaagaaaauc

SEQ ID NO: 2547834 - RNA, 18 nt, Human
auuaacuucucuggaaag

SEQ ID NO: 2547835 - RNA, 13 nt, Human
auuaagaaagacu

SEQ ID NO: 2547836 - RNA, 14 nt, Human
auuaagaaagacua

SEQ ID NO: 2547837 - RNA, 17 nt, Human
auuaaaaauauaaaacu

SEQ ID NO: 2547838 - RNA, 16 nt, Human
auuaaaaauauaaaac

SEQ ID NO: 2547839 - RNA, 14 nt, Human
auuaaaaauaugga

SEQ ID NO: 2547840 - RNA, 15 nt, Human
auuaaaaauauaaaa

SEQ ID NO: 2547841 - RNA, 13 nt, Human
auuaaaaauauaa

SEQ ID NO: 2547842 - RNA, 12 nt, Human
auuaaaaauaua

SEQ ID NO: 2547843 - RNA, 17 nt, Human
auuaaaaaauuuccagu

SEQ ID NO: 2547844 - RNA, 12 nt, Human
auuaaaaaauuu

SEQ ID NO: 2547845 - RNA, 16 nt, Human
auuaaaagaauauuuu

SEQ ID NO: 2547846 - RNA, 14 nt, Human
auuaaaagaauuuu

SEQ ID NO: 2547847 - RNA, 21 nt, Human
auuaaaaauauggaacuucua

SEQ ID NO: 2547848 - RNA, 22 nt, Human
auuaaaagggauuacccaagca

SEQ ID NO: 2547849 - RNA, 19 nt, Human
auuaaaauaaauaaaugca

SEQ ID NO: 2547850 - RNA, 21 nt, Human
auguuuucugaaaauauaacc

SEQ ID NO: 2547851 - RNA, 20 nt, Human
auguuuucugaaaauauaac

SEQ ID NO: 2547852 - RNA, 18 nt, Human
auguuuucugaaaauaua

SEQ ID NO: 2547853 - RNA, 20 nt, Human
auguuuuccauuguuugaaa

SEQ ID NO: 2547854 - RNA, 16 nt, Human
auguuuuccauuguuu

SEQ ID NO: 2547855 - RNA, 19 nt, Human
auguuuuccagcuccucau

SEQ ID NO: 2547856 - RNA, 18 nt, Human
auguuuuccagcuccuca

SEQ ID NO: 2547857 - RNA, 23 nt, Human
auguuuuccuuugucaucauugu

SEQ ID NO: 2547858 - RNA, 17 nt, Human
auguuuuucuucucccu

SEQ ID NO: 2547859 - RNA, 16 nt, Human
auguuuugacauuuuu

SEQ ID NO: 2547860 - RNA, 14 nt, Human
auguuuugacauuu

SEQ ID NO: 2547861 - RNA, 12 nt, Human
auguuuugacau

SEQ ID NO: 2547862 - RNA, 18 nt, Human
auguuuucuuugcuuuaa

SEQ ID NO: 2547863 - RNA, 17 nt, Human
auguuuuugaaacagaa

SEQ ID NO: 2547864 - RNA, 20 nt, Human
auguuuugauaaaguaguaa

SEQ ID NO: 2547865 - RNA, 18 nt, Human
auguuuugauaaaguagu

SEQ ID NO: 2547866 - RNA, 12 nt, Human
auguuuugauaa

SEQ ID NO: 2547867 - RNA, 12 nt, Human
auguuuuugaag

SEQ ID NO: 2547868 - RNA, 14 nt, Human
auguuuuugaaggc

SEQ ID NO: 2547869 - RNA, 18 nt, Human
auguuuuucuucucccuc

SEQ ID NO: 2547870 - RNA, 21 nt, Human
auguuuuugaaggcagaaagc

SEQ ID NO: 2547871 - RNA, 15 nt, Human
auguuuuugaaggca

SEQ ID NO: 2547872 - RNA, 19 nt, Human
auguuuuugaaggcagaaa

SEQ ID NO: 2547873 - RNA, 19 nt, Human
auguuuuuguucaaagcca

SEQ ID NO: 2547874 - RNA, 17 nt, Human
auguuuuuguguauuug

SEQ ID NO: 2547875 - RNA, 23 nt, Human
uuuucuauuguuacucugguucu

SEQ ID NO: 2547876 - RNA, 23 nt, Human
uuuucucaaaguuuugaaaagcu

SEQ ID NO: 2547877 - RNA, 15 nt, Human
uuuucucaaaguuuu

SEQ ID NO: 2547878 - RNA, 20 nt, Human
uuuucucaaaguuuugaaaa

SEQ ID NO: 2547879 - RNA, 19 nt, Human
uuuucucaaaguuuugaaa

SEQ ID NO: 2547880 - RNA, 12 nt, Human
uuuucucagcug

SEQ ID NO: 2547881 - RNA, 21 nt, Human
uuuucuccaauaucagugcuc

SEQ ID NO: 2547882 - RNA, 20 nt, Human
uuuucuccaauaucagugcu

SEQ ID NO: 2547883 - RNA, 13 nt, Human
auguugucaaaga

SEQ ID NO: 2547884 - RNA, 15 nt, Human
auguugucaaagaga

SEQ ID NO: 2547885 - RNA, 14 nt, Human
auguugucaaagag

SEQ ID NO: 2547886 - RNA, 22 nt, Human
auguuguccaauuguugacagu

SEQ ID NO: 2547887 - RNA, 18 nt, Human
auguuguaaacaggaagc

SEQ ID NO: 2547888 - RNA, 15 nt, Human
auguugugauguauu

SEQ ID NO: 2547889 - RNA, 16 nt, Human
auguuguguucuaaua

SEQ ID NO: 2547890 - RNA, 21 nt, Human
auguuguguuucuguucaccu

SEQ ID NO: 2547891 - RNA, 15 nt, Human
auguuuaccuuuuaa

SEQ ID NO: 2547892 - RNA, 20 nt, Human
auguuuacauaucaccucau

SEQ ID NO: 2547893 - RNA, 13 nt, Human
auguuuacauauc

SEQ ID NO: 2547894 - RNA, 21 nt, Human
auguuuacagggagccuccug

SEQ ID NO: 2547895 - RNA, 19 nt, Human
auguuuaccuuuuaauuaa

SEQ ID NO: 2547896 - RNA, 18 nt, Human
auguuuaccuuuuaauua

SEQ ID NO: 2547897 - RNA, 14 nt, Human
auguuuaguaaacu

SEQ ID NO: 2547898 - RNA, 15 nt, Human
auguuuacagaggac

SEQ ID NO: 2547899 - RNA, 17 nt, Human
auguuuacagaggacag

SEQ ID NO: 2547900 - RNA, 19 nt, Human
auguuuacagaggacagua

SEQ ID NO: 2547901 - RNA, 22 nt, Human
auguuuacacucuuuguaagag

SEQ ID NO: 2547902 - RNA, 22 nt, Human
auguuuacagguggacacacaa

SEQ ID NO: 2547903 - RNA, 21 nt, Human
auguuucaaacauauauaaca

SEQ ID NO: 2547904 - RNA, 14 nt, Human
auguuuuccaugag

SEQ ID NO: 2547905 - RNA, 18 nt, Human
auguuucaaacauauaua

SEQ ID NO: 2547906 - RNA, 17 nt, Human
auguuuauuuacuaauu

SEQ ID NO: 2547907 - RNA, 21 nt, Human
auguuuauuuauucugcauuu

SEQ ID NO: 2547908 - RNA, 13 nt, Human
auguuuauuuaua

SEQ ID NO: 2547909 - RNA, 20 nt, Human
auuauuaccuuacagaaguu

SEQ ID NO: 2547910 - RNA, 22 nt, Human
auuauuaaugaaaauaagaauu

SEQ ID NO: 2547911 - RNA, 19 nt, Human
auuauucauuuaaaaugau

SEQ ID NO: 2547912 - RNA, 18 nt, Human
auuauucauuuaaaauga

SEQ ID NO: 2547913 - RNA, 16 nt, Human
auuauucauuuaaaau

SEQ ID NO: 2547914 - RNA, 15 nt, Human
auuauucauuuaaaa

SEQ ID NO: 2547915 - RNA, 14 nt, Human
auuauucauuuaaa

SEQ ID NO: 2547916 - RNA, 13 nt, Human
auuauucauuuaa

SEQ ID NO: 2547917 - RNA, 15 nt, Human
auuauuccagaucug

SEQ ID NO: 2547918 - RNA, 20 nt, Human
auuauucauuuaaaaugauu

SEQ ID NO: 2547919 - RNA, 21 nt, Human
auuauucauuuaaaaugauua

SEQ ID NO: 2547920 - RNA, 12 nt, Human
auuauucccucu

SEQ ID NO: 2547921 - RNA, 17 nt, Human
auuauucccuguacaau

SEQ ID NO: 2547922 - RNA, 21 nt, Human
auuauucccuguacaauauuu

SEQ ID NO: 2547923 - RNA, 22 nt, Human
auuauucccuguacaauauuua

SEQ ID NO: 2547924 - RNA, 22 nt, Human
auuauuuaauaacauuaccuua

SEQ ID NO: 2547925 - RNA, 21 nt, Human
auuauuuaauaacauuaccuu

SEQ ID NO: 2547926 - RNA, 16 nt, Human
auuauuuauauaugua

SEQ ID NO: 2547927 - RNA, 18 nt, Human
auuauuuaauaacauuac

SEQ ID NO: 2547928 - RNA, 15 nt, Human
auuauuuaauaacau

SEQ ID NO: 2547929 - RNA, 14 nt, Human
auuauuuaauaaca

SEQ ID NO: 2547930 - RNA, 13 nt, Human
auuauuuaauaac

SEQ ID NO: 2547931 - RNA, 21 nt, Human
auuauuuaauaaaaaaacaau

SEQ ID NO: 2547932 - RNA, 12 nt, Human
auuauugaaauu

SEQ ID NO: 2547933 - RNA, 13 nt, Human
auuauucuuguag

SEQ ID NO: 2547934 - RNA, 12 nt, Human
auuauucuugua

SEQ ID NO: 2547935 - RNA, 16 nt, Human
auuauucugauuccac

SEQ ID NO: 2547936 - RNA, 13 nt, Human
auuauucugcagc

SEQ ID NO: 2547937 - RNA, 23 nt, Human
auuauuuauuaaaugcccagccc

SEQ ID NO: 2547938 - RNA, 22 nt, Human
auuauuuguguuuuaauuuaaa

SEQ ID NO: 2547939 - RNA, 15 nt, Human
auuauuuguguuuua

SEQ ID NO: 2547940 - RNA, 13 nt, Human
auuauuuuaaaag

SEQ ID NO: 2547941 - RNA, 23 nt, Human
auuauuuguguaauagaaaacug

SEQ ID NO: 2547942 - RNA, 20 nt, Human
auuauuuguguaauagaaaa

SEQ ID NO: 2547943 - RNA, 12 nt, Human
auuauuuguguu

SEQ ID NO: 2547944 - RNA, 13 nt, Human
auuauuuauuauu

SEQ ID NO: 2547945 - RNA, 18 nt, Human
auuauuuguguaauagaa

SEQ ID NO: 2547946 - RNA, 14 nt, Human
auuauuuuaaacaa

SEQ ID NO: 2547947 - RNA, 13 nt, Human
auuauuuuaaaca

SEQ ID NO: 2547948 - RNA, 14 nt, Human
auuauuuguuuucc

SEQ ID NO: 2547949 - RNA, 22 nt, Human
auuauuuguuauuuguacaguu

SEQ ID NO: 2547950 - RNA, 14 nt, Human
auuauuuuaaaaga

SEQ ID NO: 2547951 - RNA, 16 nt, Human
auuauuuuauguugca

SEQ ID NO: 2547952 - RNA, 18 nt, Human
auuauuuuauguugcaua

SEQ ID NO: 2547953 - RNA, 14 nt, Human
auuauuaaugaaaa

SEQ ID NO: 2547954 - RNA, 20 nt, Human
auuauguuuuuuaaaauauu

SEQ ID NO: 2547955 - RNA, 16 nt, Human
auuauguuuuuuaaaa

SEQ ID NO: 2547956 - RNA, 20 nt, Human
auuauguuuauauaaaugcu

SEQ ID NO: 2547957 - RNA, 16 nt, Human
auuauguuuauauaaa

SEQ ID NO: 2547958 - RNA, 12 nt, Human
auuauguuuaua

SEQ ID NO: 2547959 - RNA, 17 nt, Human
auuaucucacuugugcc

SEQ ID NO: 2547960 - RNA, 18 nt, Human
auuaucuuggaaagaaac

SEQ ID NO: 2547961 - RNA, 18 nt, Human
auuaucucaaaacugcac

SEQ ID NO: 2547962 - RNA, 23 nt, Human
auuaucucaaaacugcacuguca

SEQ ID NO: 2547963 - RNA, 22 nt, Human
auuaucuauacauaucuuuauu

SEQ ID NO: 2547964 - RNA, 20 nt, Human
auuaucgggagcagugucuu

SEQ ID NO: 2547965 - RNA, 21 nt, Human
auuaucgggagcagugucuuc

SEQ ID NO: 2547966 - RNA, 22 nt, Human
auuaucgggaacaguguuuccc

SEQ ID NO: 2547967 - RNA, 16 nt, Human
auuaucgggagcagug

SEQ ID NO: 2547968 - RNA, 17 nt, Human
auuaucgggagcagugu

SEQ ID NO: 2547969 - RNA, 19 nt, Human
auuaucgggagcagugucu

SEQ ID NO: 2547970 - RNA, 17 nt, Human
auuaucggaagcagugc

SEQ ID NO: 2547971 - RNA, 19 nt, Human
auuaucggaagcagugccu

SEQ ID NO: 2547972 - RNA, 21 nt, Human
auuaucggaagcagugccuuc

SEQ ID NO: 2547973 - RNA, 16 nt, Human
auuaucgggaacagug

SEQ ID NO: 2547974 - RNA, 17 nt, Human
auuaucgggaacagugu

SEQ ID NO: 2547975 - RNA, 18 nt, Human
auuaucgggaacaguguu

SEQ ID NO: 2547976 - RNA, 19 nt, Human
auuaucgggaacaguguuu

SEQ ID NO: 2547977 - RNA, 20 nt, Human
auuaucgggaacaguguuuc

SEQ ID NO: 2547978 - RNA, 17 nt, Human
auuauauuuacaaaugg

SEQ ID NO: 2547979 - RNA, 22 nt, Human
auuaucauguguaaucaauaaa

SEQ ID NO: 2547980 - RNA, 21 nt, Human
auuaucauguguaaucaauaa

SEQ ID NO: 2547981 - RNA, 17 nt, Human
auuauccagguaaucca

SEQ ID NO: 2547982 - RNA, 14 nt, Human
auuauccauauuga

SEQ ID NO: 2547983 - RNA, 17 nt, Human
auuauccauauugaguc

SEQ ID NO: 2547984 - RNA, 12 nt, Human
auuaucccugaa

SEQ ID NO: 2547985 - RNA, 16 nt, Human
auuauccuugcuauga

SEQ ID NO: 2547986 - RNA, 23 nt, Human
auuaucauuuuagaagacucuac

SEQ ID NO: 2547987 - RNA, 16 nt, Human
auuaucggaagcagug

SEQ ID NO: 2547988 - RNA, 12 nt, Human
auuaucagaugc

SEQ ID NO: 2547989 - RNA, 15 nt, Human
auuaucaugcaaaug

SEQ ID NO: 2547990 - RNA, 19 nt, Human
auuaucauguguaaucaau

SEQ ID NO: 2547991 - RNA, 17 nt, Human
auuaucauguguaauca

SEQ ID NO: 2547992 - RNA, 16 nt, Human
auuaucauguguaauc

SEQ ID NO: 2547993 - RNA, 14 nt, Human
auuaucauguguaa

SEQ ID NO: 2547994 - RNA, 13 nt, Human
auuaucaugugua

SEQ ID NO: 2547995 - RNA, 12 nt, Human
auuaucaugugu

SEQ ID NO: 2547996 - RNA, 17 nt, Human
auuaucaugcaaaugcu

SEQ ID NO: 2547997 - RNA, 21 nt, Human
auuauagaugggaaugaagcu

SEQ ID NO: 2547998 - RNA, 15 nt, Human
auuauaauuuaaugc

SEQ ID NO: 2547999 - RNA, 23 nt, Human
auuauaauuguaucagaggccua

SEQ ID NO: 2548000 - RNA, 15 nt, Human
auuauaauuguauca

SEQ ID NO: 2548001 - RNA, 13 nt, Human
auuauaauuguau

SEQ ID NO: 2548002 - RNA, 13 nt, Human
auuauaaugaauu

SEQ ID NO: 2548003 - RNA, 16 nt, Human
auuauauuuacaaaug

SEQ ID NO: 2548004 - RNA, 17 nt, Human
auuauaggaucauuugu

SEQ ID NO: 2548005 - RNA, 16 nt, Human
auuauaggccaaacug

SEQ ID NO: 2548006 - RNA, 23 nt, Human
auuacuuuaccacccccacaccu

SEQ ID NO: 2548007 - RNA, 12 nt, Human
auuacuuuacca

SEQ ID NO: 2548008 - RNA, 14 nt, Human
auuacuuugugaau

SEQ ID NO: 2548009 - RNA, 21 nt, Human
auuacuuuuccacaaaucagu

SEQ ID NO: 2548010 - RNA, 23 nt, Human
auuacugcuaaguauuucccagc

SEQ ID NO: 2548011 - RNA, 21 nt, Human
auuacugcuaaguauuuccca

SEQ ID NO: 2548012 - RNA, 19 nt, Human
auuacugcuaaguauuucc

SEQ ID NO: 2548013 - RNA, 13 nt, Human
auuagaagacauu

SEQ ID NO: 2548014 - RNA, 19 nt, Human
auuagaacaggcaagugaa

SEQ ID NO: 2548015 - RNA, 18 nt, Human
auuagaacaggcaaguga

SEQ ID NO: 2548016 - RNA, 23 nt, Human
auuagaacaggcaagugaagaaa

SEQ ID NO: 2548017 - RNA, 15 nt, Human
auuagaaauuagcug

SEQ ID NO: 2548018 - RNA, 20 nt, Human
auuagaaauuagcuguguga

SEQ ID NO: 2548019 - RNA, 23 nt, Human
auuagaaauuagcugugugaaau

SEQ ID NO: 2548020 - RNA, 17 nt, Human
auuagaaauuggcugga

SEQ ID NO: 2548021 - RNA, 13 nt, Human
auuagaaaauguu

SEQ ID NO: 2548022 - RNA, 18 nt, Human
auuagaaaauguuauuua

SEQ ID NO: 2548023 - RNA, 19 nt, Human
auuagaaaauguuauuuaa

SEQ ID NO: 2548024 - RNA, 22 nt, Human
auuagaaaauguuauuuaacag

SEQ ID NO: 2548025 - RNA, 16 nt, Human
auuagaaauagacagu

SEQ ID NO: 2548026 - RNA, 17 nt, Human
auuagaaacauaaauaa

SEQ ID NO: 2548027 - RNA, 22 nt, Human
auuagaaauagacaguauauuu

SEQ ID NO: 2548028 - RNA, 11 nt, Human
auuagaaauga

SEQ ID NO: 2548029 - RNA, 14 nt, Human
auuagaaugaaaau

SEQ ID NO: 2548030 - RNA, 13 nt, Human
auuagaauagugu

SEQ ID NO: 2548031 - RNA, 22 nt, Human
auuagaauaguguucugcaaaa

SEQ ID NO: 2548032 - RNA, 21 nt, Human
auuagaagauauuagucuugg

SEQ ID NO: 2548033 - RNA, 14 nt, Human
auuagaaguguuaa

SEQ ID NO: 2548034 - RNA, 18 nt, Human
auuagaaguguuaacuua

SEQ ID NO: 2548035 - RNA, 20 nt, Human
auuagaaguguuaacuuagc

SEQ ID NO: 2548036 - RNA, 22 nt, Human
auuauaauauacuauauuuaug

SEQ ID NO: 2548037 - RNA, 20 nt, Human
auuauaagaggcugauaauu

SEQ ID NO: 2548038 - RNA, 22 nt, Human
auuauaacuugucuaaauaagu

SEQ ID NO: 2548039 - RNA, 20 nt, Human
auuauaacuuaaaauauuuu

SEQ ID NO: 2548040 - RNA, 13 nt, Human
auuagaauuauuu

SEQ ID NO: 2548041 - RNA, 20 nt, Human
auuagagauuaccuccugag

SEQ ID NO: 2548042 - RNA, 16 nt, Human
auuauaacuuaaaaua

SEQ ID NO: 2548043 - RNA, 14 nt, Human
auuagagcauugaa

SEQ ID NO: 2548044 - RNA, 13 nt, Human
auuagagcaggcg

SEQ ID NO: 2548045 - RNA, 21 nt, Human
auuagagcagaugaccccucc

SEQ ID NO: 2548046 - RNA, 16 nt, Human
auuacauuuguauaaa

SEQ ID NO: 2548047 - RNA, 15 nt, Human
auuacauuuguauaa

SEQ ID NO: 2548048 - RNA, 19 nt, Human
auuaccacagacauacuaa

SEQ ID NO: 2548049 - RNA, 16 nt, Human
auuaccaaccuguuac

SEQ ID NO: 2548050 - RNA, 18 nt, Human
auuaccaaaaaucuuggg

SEQ ID NO: 2548051 - RNA, 13 nt, Human
auuacauuuguau

SEQ ID NO: 2548052 - RNA, 22 nt, Human
auuacauuuccaaaugaaugac

SEQ ID NO: 2548053 - RNA, 18 nt, Human
auuacauuuccaaaugaa

SEQ ID NO: 2548054 - RNA, 11 nt, Human
auuaaugcacu

SEQ ID NO: 2548055 - RNA, 12 nt, Human
auuaaugaaaua

SEQ ID NO: 2548056 - RNA, 17 nt, Human
auuaaucuuuuauauug

SEQ ID NO: 2548057 - RNA, 19 nt, Human
auuaaugaaaauaagaauu

SEQ ID NO: 2548058 - RNA, 23 nt, Human
auuaaucuuucuuuaccugagac

SEQ ID NO: 2548059 - RNA, 18 nt, Human
auuaaucuuucuuuaccu

SEQ ID NO: 2548060 - RNA, 17 nt, Human
auuaaugaaaauaagaa

SEQ ID NO: 2548061 - RNA, 18 nt, Human
auuaaugaaauaucugua

SEQ ID NO: 2548062 - RNA, 17 nt, Human
auuaaugaaauaucugu

SEQ ID NO: 2548063 - RNA, 15 nt, Human
auuaaugaaauaucu

SEQ ID NO: 2548064 - RNA, 13 nt, Human
auuaaugaaauau

SEQ ID NO: 2548065 - RNA, 19 nt, Human
auuaaugaaauaucuguau

SEQ ID NO: 2548066 - RNA, 16 nt, Human
auuaaugacacuuguc

SEQ ID NO: 2548067 - RNA, 20 nt, Human
auuaaugacacuugucccca

SEQ ID NO: 2548068 - RNA, 16 nt, Human
auuaaugacagagcca

SEQ ID NO: 2548069 - RNA, 21 nt, Human
auuaccgcguuguaaaauaua

SEQ ID NO: 2548070 - RNA, 12 nt, Human
auuaccuccuga

SEQ ID NO: 2548071 - RNA, 13 nt, Human
auuaccuccugag

SEQ ID NO: 2548072 - RNA, 17 nt, Human
auuaccuccugagaaaa

SEQ ID NO: 2548073 - RNA, 22 nt, Human
auuaccugaauuuuggcugugu

SEQ ID NO: 2548074 - RNA, 14 nt, Human
auuaccaaccuguu

SEQ ID NO: 2548075 - RNA, 20 nt, Human
auuaccagacgguucaccag

SEQ ID NO: 2548076 - RNA, 20 nt, Human
auuaccgcguuguaaaauau

SEQ ID NO: 2548077 - RNA, 19 nt, Human
auuaccgcguuguaaaaua

SEQ ID NO: 2548078 - RNA, 17 nt, Human
auuaccagaguuguucu

SEQ ID NO: 2548079 - RNA, 23 nt, Human
auuaccagacgguucaccagccu

SEQ ID NO: 2548080 - RNA, 18 nt, Human
auuaccgcguuguaaaau

SEQ ID NO: 2548081 - RNA, 21 nt, Human
auuaccuaguagucauuucau

SEQ ID NO: 2548082 - RNA, 13 nt, Human
auuaccucugaua

SEQ ID NO: 2548083 - RNA, 21 nt, Human
auuaccuuagauuagcucugg

SEQ ID NO: 2548084 - RNA, 13 nt, Human
auuaccuuacugu

SEQ ID NO: 2548085 - RNA, 12 nt, Human
auuaccuucucc

SEQ ID NO: 2548086 - RNA, 14 nt, Human
auuacugcaugcac

SEQ ID NO: 2548087 - RNA, 17 nt, Human
auuacugcaugcacuuc

SEQ ID NO: 2548088 - RNA, 13 nt, Human
auuacugccauuc

SEQ ID NO: 2548089 - RNA, 20 nt, Human
auuacugccauucacuucau

SEQ ID NO: 2548090 - RNA, 17 nt, Human
auuacugcuaaguauuu

SEQ ID NO: 2548091 - RNA, 16 nt, Human
auuacugcuaaguauu

SEQ ID NO: 2548092 - RNA, 12 nt, Human
auuacugcuaag

SEQ ID NO: 2548093 - RNA, 15 nt, Human
auuaaguaaugauaa

SEQ ID NO: 2548094 - RNA, 13 nt, Human
auuaaguaaugau

SEQ ID NO: 2548095 - RNA, 23 nt, Human
auuaauagcuuuuauuguauaaa

SEQ ID NO: 2548096 - RNA, 19 nt, Human
auuaauagcuuuuauugua

SEQ ID NO: 2548097 - RNA, 18 nt, Human
auuaauagcuuuuauugu

SEQ ID NO: 2548098 - RNA, 14 nt, Human
auuaauccagaaua

SEQ ID NO: 2548099 - RNA, 20 nt, Human
auuaauaucccuacauguau

SEQ ID NO: 2548100 - RNA, 19 nt, Human
auuaauaucccuacaugua

SEQ ID NO: 2548101 - RNA, 18 nt, Human
auuaauaucccuacaugu

SEQ ID NO: 2548102 - RNA, 12 nt, Human
auuaauaugaaa

SEQ ID NO: 2548103 - RNA, 14 nt, Human
auuaauaugaaaac

SEQ ID NO: 2548104 - RNA, 15 nt, Human
auuaauaugaaaacu

SEQ ID NO: 2548105 - RNA, 19 nt, Human
auuaaucaugaauguguaa

SEQ ID NO: 2548106 - RNA, 20 nt, Human
auuaauauggggaugcagca

SEQ ID NO: 2548107 - RNA, 22 nt, Human
uuuuuguuccacaaguuaaaua

SEQ ID NO: 2548108 - RNA, 16 nt, Human
auuaagaucucagugg

SEQ ID NO: 2548109 - RNA, 15 nt, Human
auuaagauggauucu

SEQ ID NO: 2548110 - RNA, 20 nt, Human
auuaagauggauucucagau

SEQ ID NO: 2548111 - RNA, 23 nt, Human
auuaagauggauucucagauauu

SEQ ID NO: 2548112 - RNA, 21 nt, Human
auuaagauaugggacauuuuu

SEQ ID NO: 2548113 - RNA, 17 nt, Human
auuaagaggcagaaaau

SEQ ID NO: 2548114 - RNA, 23 nt, Human
uuuuuuaaaaaagaaacauuugg

SEQ ID NO: 2548115 - RNA, 20 nt, Human
uuuuuguucuuaauugcacu

SEQ ID NO: 2548116 - RNA, 22 nt, Human
uuuuuguucuuaauugcacucu

SEQ ID NO: 2548117 - RNA, 14 nt, Human
auucaaacagucuc

SEQ ID NO: 2548118 - RNA, 15 nt, Human
auucaaacagucuca

SEQ ID NO: 2548119 - RNA, 14 nt, Human
auucagcucaugga

SEQ ID NO: 2548120 - RNA, 22 nt, Human
auucaaaauugacauugcuuua

SEQ ID NO: 2548121 - RNA, 17 nt, Human
auucagcggaauauuga

SEQ ID NO: 2548122 - RNA, 13 nt, Human
auuauuuucaagg

SEQ ID NO: 2548123 - RNA, 21 nt, Human
auuauuuuaaacaaaauagaa

SEQ ID NO: 2548124 - RNA, 15 nt, Human
auuauuuuaaacaaa

SEQ ID NO: 2548125 - RNA, 13 nt, Human
auuauuuuccaaa

SEQ ID NO: 2548126 - RNA, 21 nt, Human
auucaaaauugacauugcuuu

SEQ ID NO: 2548127 - RNA, 19 nt, Human
auucaaaauugacauugcu

SEQ ID NO: 2548128 - RNA, 16 nt, Human
auucaaaaugauguau

SEQ ID NO: 2548129 - RNA, 14 nt, Human
auuauuuuccaaaa

SEQ ID NO: 2548130 - RNA, 16 nt, Human
auucaaaaguugaaau

SEQ ID NO: 2548131 - RNA, 16 nt, Human
auucaguuguuagugu

SEQ ID NO: 2548132 - RNA, 23 nt, Human
auucaggaagcucagggccuggc

SEQ ID NO: 2548133 - RNA, 22 nt, Human
auucagcuagaacuuugaagga

SEQ ID NO: 2548134 - RNA, 21 nt, Human
auucaggaauguguggccugc

SEQ ID NO: 2548135 - RNA, 21 nt, Human
auucaguuguuagugugucuu

SEQ ID NO: 2548136 - RNA, 22 nt, Human
auucaggaagcucagggccugg

SEQ ID NO: 2548137 - RNA, 21 nt, Human
auucaggaagcucagggccug

SEQ ID NO: 2548138 - RNA, 14 nt, Human
auucagcucugcaa

SEQ ID NO: 2548139 - RNA, 18 nt, Human
auucagcucugcaagaau

SEQ ID NO: 2548140 - RNA, 23 nt, Human
auuccaugaauguaucaggaaau

SEQ ID NO: 2548141 - RNA, 17 nt, Human
auuccaugaauguauca

SEQ ID NO: 2548142 - RNA, 18 nt, Human
auuccaugaauguaucag

SEQ ID NO: 2548143 - RNA, 13 nt, Human
auuccaugaaugu

SEQ ID NO: 2548144 - RNA, 18 nt, Human
auuccacugcguugucca

SEQ ID NO: 2548145 - RNA, 15 nt, Human
auuccaugaauguau

SEQ ID NO: 2548146 - RNA, 16 nt, Human
auuccaugaauguauc

SEQ ID NO: 2548147 - RNA, 22 nt, Human
auuccacuacaccuggcugagg

SEQ ID NO: 2548148 - RNA, 19 nt, Human
auuccacuacaccuggcug

SEQ ID NO: 2548149 - RNA, 18 nt, Human
auuccacuacaccuggcu

SEQ ID NO: 2548150 - RNA, 17 nt, Human
auuccacuacaccuggc

SEQ ID NO: 2548151 - RNA, 12 nt, Human
auuccacuggac

SEQ ID NO: 2548152 - RNA, 16 nt, Human
auuccauucuggauuu

SEQ ID NO: 2548153 - RNA, 21 nt, Human
auuccauucuggaagugacuu

SEQ ID NO: 2548154 - RNA, 13 nt, Human
auucaguuuucau

SEQ ID NO: 2548155 - RNA, 15 nt, Human
auucaguuuucauuu

SEQ ID NO: 2548156 - RNA, 12 nt, Human
auucauaaaucu

SEQ ID NO: 2548157 - RNA, 14 nt, Human
auucaguuuucauu

SEQ ID NO: 2548158 - RNA, 23 nt, Human
auucauaagccaauuuuucugca

SEQ ID NO: 2548159 - RNA, 21 nt, Human
auucauaagccaauuuuucug

SEQ ID NO: 2548160 - RNA, 13 nt, Human
auuccacagcugc

SEQ ID NO: 2548161 - RNA, 20 nt, Human
auuccacuuauaggaauuga

SEQ ID NO: 2548162 - RNA, 16 nt, Human
auuccaccugcaauca

SEQ ID NO: 2548163 - RNA, 12 nt, Human
auuccacaucua

SEQ ID NO: 2548164 - RNA, 11 nt, Human
auucauaauaa

SEQ ID NO: 2548165 - RNA, 16 nt, Human
auuccacuacaccugg

SEQ ID NO: 2548166 - RNA, 22 nt, Human
auuccccacccugaaagcccug

SEQ ID NO: 2548167 - RNA, 20 nt, Human
auuccccagauugcaacagg

SEQ ID NO: 2548168 - RNA, 16 nt, Human
auuccccaggaggcca

SEQ ID NO: 2548169 - RNA, 15 nt, Human
auuccauuuaucuuu

SEQ ID NO: 2548170 - RNA, 15 nt, Human
auuccauugugugag

SEQ ID NO: 2548171 - RNA, 16 nt, Human
auuccauugugugagu

SEQ ID NO: 2548172 - RNA, 18 nt, Human
auuccauuuaucuuucua

SEQ ID NO: 2548173 - RNA, 17 nt, Human
auuccauuuaucuuucu

SEQ ID NO: 2548174 - RNA, 16 nt, Human
auuccguagccagcug

SEQ ID NO: 2548175 - RNA, 23 nt, Human
auuccguagccagcugcucccca

SEQ ID NO: 2548176 - RNA, 21 nt, Human
auuccgacaaccgaugcucca

SEQ ID NO: 2548177 - RNA, 19 nt, Human
auuccccaggaggccagcc

SEQ ID NO: 2548178 - RNA, 21 nt, Human
auucccuggccuuucauauuu

SEQ ID NO: 2548179 - RNA, 19 nt, Human
auucccuguacaauauuua

SEQ ID NO: 2548180 - RNA, 21 nt, Human
auucccuguacaauauuuaaa

SEQ ID NO: 2548181 - RNA, 16 nt, Human
auucccuucaucugga

SEQ ID NO: 2548182 - RNA, 19 nt, Human
auucccuucaucuggaacc

SEQ ID NO: 2548183 - RNA, 14 nt, Human
auuuacaaagugug

SEQ ID NO: 2548184 - RNA, 13 nt, Human
auuuacaaagugu

SEQ ID NO: 2548185 - RNA, 23 nt, Human
auuuacaaaaauauaaaauauga

SEQ ID NO: 2548186 - RNA, 20 nt, Human
auuuacaaaaauauaaaaua

SEQ ID NO: 2548187 - RNA, 18 nt, Human
auuuaauuuugacacuau

SEQ ID NO: 2548188 - RNA, 16 nt, Human
auuuaauuuugacacu

SEQ ID NO: 2548189 - RNA, 14 nt, Human
auuuaauuuugaca

SEQ ID NO: 2548190 - RNA, 22 nt, Human
auuuaauuugauaucacagucu

SEQ ID NO: 2548191 - RNA, 19 nt, Human
auuuaauuuugacacuaua

SEQ ID NO: 2548192 - RNA, 19 nt, Human
auuuacaaaaauauaaaau

SEQ ID NO: 2548193 - RNA, 16 nt, Human
auuuacaaaugggaaa

SEQ ID NO: 2548194 - RNA, 18 nt, Human
auuuacaaaguguguauu

SEQ ID NO: 2548195 - RNA, 17 nt, Human
auuuacaaaguguguau

SEQ ID NO: 2548196 - RNA, 16 nt, Human
auuuacaaagugugua

SEQ ID NO: 2548197 - RNA, 15 nt, Human
auuuacaaagugugu

SEQ ID NO: 2548198 - RNA, 20 nt, Human
auuuacaaaguguguauuaa

SEQ ID NO: 2548199 - RNA, 19 nt, Human
auuuacaaaguguguauua

SEQ ID NO: 2548200 - RNA, 22 nt, Human
auuuacaacugggggaggguga

SEQ ID NO: 2548201 - RNA, 23 nt, Human
auuuaccagccuccguauuucag

SEQ ID NO: 2548202 - RNA, 19 nt, Human
auuuacccuucuuuucuga

SEQ ID NO: 2548203 - RNA, 23 nt, Human
auuuaauuuuuuugagacagagu

SEQ ID NO: 2548204 - RNA, 19 nt, Human
auuuaauuuuuuugagaca

SEQ ID NO: 2548205 - RNA, 13 nt, Human
auuuaacugccuu

SEQ ID NO: 2548206 - RNA, 20 nt, Human
auuuaacuuaacauucugua

SEQ ID NO: 2548207 - RNA, 13 nt, Human
auuuaacuggcuu

SEQ ID NO: 2548208 - RNA, 13 nt, Human
auuuaacuugagc

SEQ ID NO: 2548209 - RNA, 17 nt, Human
auuuaacuugagcuuua

SEQ ID NO: 2548210 - RNA, 21 nt, Human
auuuaacuuaacauucuguaa

SEQ ID NO: 2548211 - RNA, 18 nt, Human
auuuaauuugauaucaca

SEQ ID NO: 2548212 - RNA, 13 nt, Human
auuuaauuuugac

SEQ ID NO: 2548213 - RNA, 18 nt, Human
auuuaacagucauuuaaa

SEQ ID NO: 2548214 - RNA, 17 nt, Human
auuuaacagucauuuaa

SEQ ID NO: 2548215 - RNA, 16 nt, Human
auuuaacagucauuua

SEQ ID NO: 2548216 - RNA, 15 nt, Human
auuuaacagucauuu

SEQ ID NO: 2548217 - RNA, 22 nt, Human
auuuaacagcugaauuaucuau

SEQ ID NO: 2548218 - RNA, 22 nt, Human
auuuaacagggucucuagugcu

SEQ ID NO: 2548219 - RNA, 17 nt, Human
auuuaacagggagggga

SEQ ID NO: 2548220 - RNA, 15 nt, Human
auuuaacagcugaau

SEQ ID NO: 2548221 - RNA, 21 nt, Human
auuuaacagcugaauuaucua

SEQ ID NO: 2548222 - RNA, 20 nt, Human
auuuaacagaaauguacagc

SEQ ID NO: 2548223 - RNA, 17 nt, Human
auuuaacagaaauguac

SEQ ID NO: 2548224 - RNA, 19 nt, Human
auuuaacagaaauguacag

SEQ ID NO: 2548225 - RNA, 15 nt, Human
auuuaacagaaaugu

SEQ ID NO: 2548226 - RNA, 16 nt, Human
auuuaacagaaaugua

SEQ ID NO: 2548227 - RNA, 18 nt, Human
auuuaaaggcccuaucug

SEQ ID NO: 2548228 - RNA, 20 nt, Human
auuuaaaggcccuaucuguu

SEQ ID NO: 2548229 - RNA, 21 nt, Human
auuuaaaggcccuaucuguuu

SEQ ID NO: 2548230 - RNA, 20 nt, Human
auuuaaaggguguacuuaua

SEQ ID NO: 2548231 - RNA, 11 nt, Human
auuuaaaacuu

SEQ ID NO: 2548232 - RNA, 15 nt, Human
auuuaaaacauguaa

SEQ ID NO: 2548233 - RNA, 14 nt, Human
auuuaaaacaugua

SEQ ID NO: 2548234 - RNA, 13 nt, Human
auuuaaaacaugu

SEQ ID NO: 2548235 - RNA, 20 nt, Human
auuuaaaauugugauguguc

SEQ ID NO: 2548236 - RNA, 19 nt, Human
auuuaaacaauaaaugugc

SEQ ID NO: 2548237 - RNA, 19 nt, Human
auuuaaaauugugaugugu

SEQ ID NO: 2548238 - RNA, 15 nt, Human
auuuaaaagacacug

SEQ ID NO: 2548239 - RNA, 15 nt, Human
auuuaaagccuccuc

SEQ ID NO: 2548240 - RNA, 19 nt, Human
auuuaaagcuuauuaaaac

SEQ ID NO: 2548241 - RNA, 15 nt, Human
auuuaaacaggccca

SEQ ID NO: 2548242 - RNA, 20 nt, Human
auuuaaacagcaguguuccc

SEQ ID NO: 2548243 - RNA, 16 nt, Human
auuuaaacagcagugu

SEQ ID NO: 2548244 - RNA, 15 nt, Human
auuuaaacagcagug

SEQ ID NO: 2548245 - RNA, 18 nt, Human
auuuaaacaggcccagca

SEQ ID NO: 2548246 - RNA, 17 nt, Human
auuuaaacaggcccagc

SEQ ID NO: 2548247 - RNA, 19 nt, Human
auuuaaacaggcccagcau

SEQ ID NO: 2548248 - RNA, 14 nt, Human
auuuaaacagcagu

SEQ ID NO: 2548249 - RNA, 17 nt, Human
auuggcuuguguguuuc

SEQ ID NO: 2548250 - RNA, 14 nt, Human
auuggcugagagac

SEQ ID NO: 2548251 - RNA, 22 nt, Human
auuggcugaacucaugagaagu

SEQ ID NO: 2548252 - RNA, 21 nt, Human
auuggcucacccaagcaaggc

SEQ ID NO: 2548253 - RNA, 17 nt, Human
auuggcugggaguggug

SEQ ID NO: 2548254 - RNA, 21 nt, Human
auuggcuuuauccucuuuaga

SEQ ID NO: 2548255 - RNA, 17 nt, Human
auuggcuuuauccucuu

SEQ ID NO: 2548256 - RNA, 22 nt, Human
auuggcuuguguguuucacuuu

SEQ ID NO: 2548257 - RNA, 18 nt, Human
auuggcuuguguguuuca

SEQ ID NO: 2548258 - RNA, 14 nt, Human
auuggcuuuauccu

SEQ ID NO: 2548259 - RNA, 23 nt, Human
auuggcuuuggguugcaggaccu

SEQ ID NO: 2548260 - RNA, 22 nt, Human
auuguauaaacuaucaguuugu

SEQ ID NO: 2548261 - RNA, 21 nt, Human
auuguauaaacuaucaguuug

SEQ ID NO: 2548262 - RNA, 17 nt, Human
auuguauaaacuaucag

SEQ ID NO: 2548263 - RNA, 13 nt, Human
auuguauaaacua

SEQ ID NO: 2548264 - RNA, 21 nt, Human
auuguauaaaaauagaagaau

SEQ ID NO: 2548265 - RNA, 23 nt, Human
auuggcuuuaaacacccuucaca

SEQ ID NO: 2548266 - RNA, 21 nt, Human
auugcuaaucaccaaaggcuc

SEQ ID NO: 2548267 - RNA, 21 nt, Human
auugcuacuacuuaccuacca

SEQ ID NO: 2548268 - RNA, 15 nt, Human
auugcuaagaugcuc

SEQ ID NO: 2548269 - RNA, 21 nt, Human
auuggcucacacugagaaugu

SEQ ID NO: 2548270 - RNA, 21 nt, Human
auuggcucuugaacugagcuu

SEQ ID NO: 2548271 - RNA, 18 nt, Human
auugcuaaauguaacagu

SEQ ID NO: 2548272 - RNA, 17 nt, Human
auugcuaaauguaacag

SEQ ID NO: 2548273 - RNA, 16 nt, Human
auugcuaaauguaaca

SEQ ID NO: 2548274 - RNA, 14 nt, Human
auugcuaaauguaa

SEQ ID NO: 2548275 - RNA, 13 nt, Human
auugcuaaaugua

SEQ ID NO: 2548276 - RNA, 21 nt, Human
auugcguuugaccuuuuaugu

SEQ ID NO: 2548277 - RNA, 20 nt, Human
auugcguuugaccuuuuaug

SEQ ID NO: 2548278 - RNA, 19 nt, Human
auugcgccauugcacucca

SEQ ID NO: 2548279 - RNA, 22 nt, Human
auuguauaagauuagaaugaaa

SEQ ID NO: 2548280 - RNA, 21 nt, Human
auuguauaagauuagaaugaa

SEQ ID NO: 2548281 - RNA, 18 nt, Human
auuguauaacagguuauu

SEQ ID NO: 2548282 - RNA, 17 nt, Human
auuguauaacagguuau

SEQ ID NO: 2548283 - RNA, 16 nt, Human
auuguauaacagguua

SEQ ID NO: 2548284 - RNA, 15 nt, Human
auuguauaacagguu

SEQ ID NO: 2548285 - RNA, 14 nt, Human
auuguauaacaggu

SEQ ID NO: 2548286 - RNA, 13 nt, Human
auuguauaacagg

SEQ ID NO: 2548287 - RNA, 11 nt, Human
auuguauauau

SEQ ID NO: 2548288 - RNA, 22 nt, Human
auuguauagagauaugcagaag

SEQ ID NO: 2548289 - RNA, 21 nt, Human
auuguauagagauaugcagaa

SEQ ID NO: 2548290 - RNA, 15 nt, Human
auuguauagagauau

SEQ ID NO: 2548291 - RNA, 15 nt, Human
auuguauauaugugu

SEQ ID NO: 2548292 - RNA, 13 nt, Human
auuguauauaugu

SEQ ID NO: 2548293 - RNA, 14 nt, Human
auuguauauucacu

SEQ ID NO: 2548294 - RNA, 13 nt, Human
auuguauauucac

SEQ ID NO: 2548295 - RNA, 22 nt, Human
auuguauauauguguguuuaaa

SEQ ID NO: 2548296 - RNA, 15 nt, Human
auuguauauucacuu

SEQ ID NO: 2548297 - RNA, 21 nt, Human
auuguaucagaggccuauaau

SEQ ID NO: 2548298 - RNA, 20 nt, Human
auuguaucagaggccuauaa

SEQ ID NO: 2548299 - RNA, 19 nt, Human
auuguaucagaggccuaua

SEQ ID NO: 2548300 - RNA, 17 nt, Human
auuguaucagaggccua

SEQ ID NO: 2548301 - RNA, 17 nt, Human
auuguaucguauagcug

SEQ ID NO: 2548302 - RNA, 16 nt, Human
auuguaucguauagcu

SEQ ID NO: 2548303 - RNA, 14 nt, Human
auuguauccugagg

SEQ ID NO: 2548304 - RNA, 15 nt, Human
auuguaucgauguua

SEQ ID NO: 2548305 - RNA, 15 nt, Human
auuguaucagaggcc

SEQ ID NO: 2548306 - RNA, 14 nt, Human
auuguaucagaggc

SEQ ID NO: 2548307 - RNA, 17 nt, Human
auuguauauuguguuug

SEQ ID NO: 2548308 - RNA, 15 nt, Human
auuguaugauguguu

SEQ ID NO: 2548309 - RNA, 14 nt, Human
auuguaugaugugu

SEQ ID NO: 2548310 - RNA, 21 nt, Human
auuguaugauguguugugaua

SEQ ID NO: 2548311 - RNA, 12 nt, Human
auuguaugaugu

SEQ ID NO: 2548312 - RNA, 13 nt, Human
auuguaugaugug

SEQ ID NO: 2548313 - RNA, 24 nt, Human
auuguaucguauagcuguauugaa

SEQ ID NO: 2548314 - RNA, 14 nt, Human
auuguaucuagugc

SEQ ID NO: 2548315 - RNA, 15 nt, Human
auuguaucuagugca

SEQ ID NO: 2548316 - RNA, 16 nt, Human
auuguaucuagugcag

SEQ ID NO: 2548317 - RNA, 18 nt, Human
auuguaucuagugcagcu

SEQ ID NO: 2548318 - RNA, 19 nt, Human
auuguaucuagugcagcug

SEQ ID NO: 2548319 - RNA, 21 nt, Human
auuguaucuagugcagcugau

SEQ ID NO: 2548320 - RNA, 23 nt, Human
auugugaaauaaaacuggcuuug

SEQ ID NO: 2548321 - RNA, 19 nt, Human
auugugccaauauguauug

SEQ ID NO: 2548322 - RNA, 15 nt, Human
auugugcuucuuucu

SEQ ID NO: 2548323 - RNA, 22 nt, Human
auuguuucaauugcaucuccca

SEQ ID NO: 2548324 - RNA, 13 nt, Human
auuguuucaauug

SEQ ID NO: 2548325 - RNA, 22 nt, Human
auuguuucauugcgaaucuuuu

SEQ ID NO: 2548326 - RNA, 16 nt, Human
auuuaaaacagacacu

SEQ ID NO: 2548327 - RNA, 17 nt, Human
auuuaaaacagacacug

SEQ ID NO: 2548328 - RNA, 18 nt, Human
auuuaaaacagacacugg

SEQ ID NO: 2548329 - RNA, 23 nt, Human
auuuaaaacagacacuggcaugg

SEQ ID NO: 2548330 - RNA, 19 nt, Human
auuguuugcuuauuguucc

SEQ ID NO: 2548331 - RNA, 21 nt, Human
auuguuugcuuauuguuccaa

SEQ ID NO: 2548332 - RNA, 23 nt, Human
auuguuugcuuauuguuccaaga

SEQ ID NO: 2548333 - RNA, 15 nt, Human
auuuaaaacagacac

SEQ ID NO: 2548334 - RNA, 22 nt, Human
auuguuugcuuauuguuccaag

SEQ ID NO: 2548335 - RNA, 19 nt, Human
auuguuugaaacaaagaag

SEQ ID NO: 2548336 - RNA, 18 nt, Human
auuguuugaaacaaagaa

SEQ ID NO: 2548337 - RNA, 17 nt, Human
auuguuugaaacaaaga

SEQ ID NO: 2548338 - RNA, 13 nt, Human
auuguuugaaaca

SEQ ID NO: 2548339 - RNA, 20 nt, Human
auuguuucuuuaagaaagua

SEQ ID NO: 2548340 - RNA, 19 nt, Human
auuguuucuuuaagaaagu

SEQ ID NO: 2548341 - RNA, 14 nt, Human
auuguuugcuuauu

SEQ ID NO: 2548342 - RNA, 15 nt, Human
auuguuugcuuauug

SEQ ID NO: 2548343 - RNA, 16 nt, Human
auuguuugcuuauugu

SEQ ID NO: 2548344 - RNA, 18 nt, Human
auuguuugcuuauuguuc

SEQ ID NO: 2548345 - RNA, 20 nt, Human
auuguuugaaacaaagaagg

SEQ ID NO: 2548346 - RNA, 13 nt, Human
auuguuugcuuau

SEQ ID NO: 2548347 - RNA, 14 nt, Human
auuguauuacaaau

SEQ ID NO: 2548348 - RNA, 18 nt, Human
auugucucuaaauugugg

SEQ ID NO: 2548349 - RNA, 15 nt, Human
auugucuccuugagu

SEQ ID NO: 2548350 - RNA, 15 nt, Human
auuguauuacaaauc

SEQ ID NO: 2548351 - RNA, 13 nt, Human
auugugccccugc

SEQ ID NO: 2548352 - RNA, 15 nt, Human
auugugaaauuauuc

SEQ ID NO: 2548353 - RNA, 14 nt, Human
auugucuuguucug

SEQ ID NO: 2548354 - RNA, 20 nt, Human
auugucuucggaaaccuugg

SEQ ID NO: 2548355 - RNA, 18 nt, Human
auugucuucggaaaccuu

SEQ ID NO: 2548356 - RNA, 23 nt, Human
auugucuucggaaaccuuggugu

SEQ ID NO: 2548357 - RNA, 14 nt, Human
auugcuacuguccu

SEQ ID NO: 2548358 - RNA, 19 nt, Human
auugcaguuuaucauucaa

SEQ ID NO: 2548359 - RNA, 18 nt, Human
auugcaguuuaucauuca

SEQ ID NO: 2548360 - RNA, 17 nt, Human
auugcaguuuaucauuc

SEQ ID NO: 2548361 - RNA, 14 nt, Human
auugcaguuuauca

SEQ ID NO: 2548362 - RNA, 17 nt, Human
auugcauuuccugacag

SEQ ID NO: 2548363 - RNA, 23 nt, Human
auugcaguuuaucauucaagugu

SEQ ID NO: 2548364 - RNA, 16 nt, Human
auugcauuuccugaca

SEQ ID NO: 2548365 - RNA, 17 nt, Human
auugccauauugcacau

SEQ ID NO: 2548366 - RNA, 16 nt, Human
auugccauauugcaca

SEQ ID NO: 2548367 - RNA, 15 nt, Human
auugccauauugcac

SEQ ID NO: 2548368 - RNA, 12 nt, Human
auugccauauug

SEQ ID NO: 2548369 - RNA, 23 nt, Human
auugccauuucuuccacaagagc

SEQ ID NO: 2548370 - RNA, 14 nt, Human
auugccaagggcuu

SEQ ID NO: 2548371 - RNA, 14 nt, Human
auugccaccaggag

SEQ ID NO: 2548372 - RNA, 15 nt, Human
auugccaccaggaga

SEQ ID NO: 2548373 - RNA, 22 nt, Human
auugccaagcucaggaccaggc

SEQ ID NO: 2548374 - RNA, 21 nt, Human
auugccaccaggagaaccacu

SEQ ID NO: 2548375 - RNA, 15 nt, Human
auugcccccagggca

SEQ ID NO: 2548376 - RNA, 18 nt, Human
auugccauucccugccug

SEQ ID NO: 2548377 - RNA, 18 nt, Human
auugcccauccaucugcu

SEQ ID NO: 2548378 - RNA, 22 nt, Human
auugcccccagggcacuucaca

SEQ ID NO: 2548379 - RNA, 16 nt, Human
auugcccccagggcac

SEQ ID NO: 2548380 - RNA, 13 nt, Human
auugccuauuuca

SEQ ID NO: 2548381 - RNA, 22 nt, Human
auugccauauugcacaugucuu

SEQ ID NO: 2548382 - RNA, 19 nt, Human
auugccauauugcacaugu

SEQ ID NO: 2548383 - RNA, 18 nt, Human
auugccauauugcacaug

SEQ ID NO: 2548384 - RNA, 21 nt, Human
auugcccacgcuggagugcag

SEQ ID NO: 2548385 - RNA, 17 nt, Human
auugcccacgcuggagu

SEQ ID NO: 2548386 - RNA, 19 nt, Human
auugcggacagccacggcc

SEQ ID NO: 2548387 - RNA, 18 nt, Human
auugcggacagccacggc

SEQ ID NO: 2548388 - RNA, 16 nt, Human
auugcggacagccacg

SEQ ID NO: 2548389 - RNA, 18 nt, Human
auugccuauuucaguggc

SEQ ID NO: 2548390 - RNA, 14 nt, Human
auugccugcagaga

SEQ ID NO: 2548391 - RNA, 13 nt, Human
auugccuccuccu

SEQ ID NO: 2548392 - RNA, 14 nt, Human
auugccuauuucag

SEQ ID NO: 2548393 - RNA, 11 nt, Human
auugcccuggu

SEQ ID NO: 2548394 - RNA, 13 nt, Human
auugaccugaggc

SEQ ID NO: 2548395 - RNA, 23 nt, Human
auugcaaagguuccaacuguaua

SEQ ID NO: 2548396 - RNA, 19 nt, Human
auugcaaaauagcauuugu

SEQ ID NO: 2548397 - RNA, 12 nt, Human
auugcaaaucuu

SEQ ID NO: 2548398 - RNA, 16 nt, Human
auugcaaaucuugaaa

SEQ ID NO: 2548399 - RNA, 17 nt, Human
auugcaaaucuugaaau

SEQ ID NO: 2548400 - RNA, 19 nt, Human
auugcaaaucuugaaauua

SEQ ID NO: 2548401 - RNA, 15 nt, Human
auugcaacaggcugg

SEQ ID NO: 2548402 - RNA, 17 nt, Human
auugaccgcgacuaauu

SEQ ID NO: 2548403 - RNA, 20 nt, Human
auugaccgcgacuaauuuca

SEQ ID NO: 2548404 - RNA, 23 nt, Human
auugaccgcgacuaauuucaaaa

SEQ ID NO: 2548405 - RNA, 21 nt, Human
auugacccacaagaaaugaaa

SEQ ID NO: 2548406 - RNA, 18 nt, Human
auugacagaucaagcugu

SEQ ID NO: 2548407 - RNA, 16 nt, Human
auucuccacagcaacc

SEQ ID NO: 2548408 - RNA, 13 nt, Human
auugacagcuuug

SEQ ID NO: 2548409 - RNA, 14 nt, Human
auugacagcuuugc

SEQ ID NO: 2548410 - RNA, 15 nt, Human
auugacagcuuugcu

SEQ ID NO: 2548411 - RNA, 16 nt, Human
auugacagcuuugcug

SEQ ID NO: 2548412 - RNA, 18 nt, Human
auugacagcuuugcugcu

SEQ ID NO: 2548413 - RNA, 19 nt, Human
auugacagcuuugcugcug

SEQ ID NO: 2548414 - RNA, 18 nt, Human
auugacaggauuauugga

SEQ ID NO: 2548415 - RNA, 20 nt, Human
auugcacaugucuuaaugaa

SEQ ID NO: 2548416 - RNA, 18 nt, Human
auugcacaugucuuaaug

SEQ ID NO: 2548417 - RNA, 22 nt, Human
auugcacaauauugaacuuuuu

SEQ ID NO: 2548418 - RNA, 16 nt, Human
auugcacaugucuuaa

SEQ ID NO: 2548419 - RNA, 13 nt, Human
auugcacuuuuaa

SEQ ID NO: 2548420 - RNA, 14 nt, Human
auugcacagggaga

SEQ ID NO: 2548421 - RNA, 23 nt, Human
auugcacucuaaaagguucaggg

SEQ ID NO: 2548422 - RNA, 20 nt, Human
auugcagaacuaaacucauu

SEQ ID NO: 2548423 - RNA, 22 nt, Human
auugcagaacuaaacucauuua

SEQ ID NO: 2548424 - RNA, 23 nt, Human
auugcaggagucccugccaucau

SEQ ID NO: 2548425 - RNA, 17 nt, Human
auugcagguggaacuca

SEQ ID NO: 2548426 - RNA, 16 nt, Human
auugcagguggaacuc

SEQ ID NO: 2548427 - RNA, 21 nt, Human
auugcaacaggcugggcuuca

SEQ ID NO: 2548428 - RNA, 16 nt, Human
auugcaacaggcuggg

SEQ ID NO: 2548429 - RNA, 11 nt, Human
auugcacaaua

SEQ ID NO: 2548430 - RNA, 13 nt, Human
auugcacaauauu

SEQ ID NO: 2548431 - RNA, 18 nt, Human
auucuccaccugccaggg

SEQ ID NO: 2548432 - RNA, 17 nt, Human
auucuccaccugccagg

SEQ ID NO: 2548433 - RNA, 16 nt, Human
auucuccaccugccag

SEQ ID NO: 2548434 - RNA, 21 nt, Human
auugacagaucaagcugugag

SEQ ID NO: 2548435 - RNA, 13 nt, Human
auugacagaagcu

SEQ ID NO: 2548436 - RNA, 20 nt, Human
auugacacuuaaaaaugguu

SEQ ID NO: 2548437 - RNA, 18 nt, Human
auucucagaaucucaaau

SEQ ID NO: 2548438 - RNA, 20 nt, Human
auucucagaaucucaaauaa

SEQ ID NO: 2548439 - RNA, 13 nt, Human
auucuccaccugc

SEQ ID NO: 2548440 - RNA, 23 nt, Human
auucucagauauuuauauuuuua

SEQ ID NO: 2548441 - RNA, 17 nt, Human
auucucacuccaccacc

SEQ ID NO: 2548442 - RNA, 16 nt, Human
auucucagauauuuau

SEQ ID NO: 2548443 - RNA, 13 nt, Human
auucuacuuugag

SEQ ID NO: 2548444 - RNA, 16 nt, Human
auucuacuuugagugc

SEQ ID NO: 2548445 - RNA, 13 nt, Human
auucuacacagag

SEQ ID NO: 2548446 - RNA, 18 nt, Human
auucuaaugucuucauuu

SEQ ID NO: 2548447 - RNA, 17 nt, Human
auucuacuuuaagcacu

SEQ ID NO: 2548448 - RNA, 14 nt, Human
auucucaccaggaa

SEQ ID NO: 2548449 - RNA, 13 nt, Human
auucucaccagga

SEQ ID NO: 2548450 - RNA, 16 nt, Human
auucucaccaggaagg

SEQ ID NO: 2548451 - RNA, 14 nt, Human
auucucacuccacc

SEQ ID NO: 2548452 - RNA, 15 nt, Human
auucucacuccacca

SEQ ID NO: 2548453 - RNA, 16 nt, Human
auucucacuccaccac

SEQ ID NO: 2548454 - RNA, 14 nt, Human
auucucagaaucuc

SEQ ID NO: 2548455 - RNA, 23 nt, Human
auuucuuuugccguuauuaaaaa

SEQ ID NO: 2548456 - RNA, 13 nt, Human
auuuuacaauuga

SEQ ID NO: 2548457 - RNA, 18 nt, Human
auuuuaauuuuaaccaaa

SEQ ID NO: 2548458 - RNA, 21 nt, Human
auuuguaucugaaggagauuu

SEQ ID NO: 2548459 - RNA, 18 nt, Human
auuuuaauuuaugaguuu

SEQ ID NO: 2548460 - RNA, 12 nt, Human
auuuuacaauuu

SEQ ID NO: 2548461 - RNA, 17 nt, Human
auuuuacaauugaaaug

SEQ ID NO: 2548462 - RNA, 21 nt, Human
auuuuacaauugaaaugacua

SEQ ID NO: 2548463 - RNA, 17 nt, Human
auuuuaccuuugacaaa

SEQ ID NO: 2548464 - RNA, 20 nt, Human
auuuuacuguacagacagaa

SEQ ID NO: 2548465 - RNA, 22 nt, Human
auuuuacuguacagacagaaaa

SEQ ID NO: 2548466 - RNA, 17 nt, Human
auuuuacuacuguggaa

SEQ ID NO: 2548467 - RNA, 22 nt, Human
auuuuacuacuguggaaaaaua

SEQ ID NO: 2548468 - RNA, 18 nt, Human
auuuuacuucuagagaua

SEQ ID NO: 2548469 - RNA, 16 nt, Human
auuuuaauaauguuuc

SEQ ID NO: 2548470 - RNA, 15 nt, Human
auuuuaauaauguuu

SEQ ID NO: 2548471 - RNA, 17 nt, Human
auuuguaucugaaggag

SEQ ID NO: 2548472 - RNA, 14 nt, Human
auuuguaucugaag

SEQ ID NO: 2548473 - RNA, 23 nt, Human
auuuguaucucugaagcauguuu

SEQ ID NO: 2548474 - RNA, 22 nt, Human
auuuguaucucugaagcauguu

SEQ ID NO: 2548475 - RNA, 14 nt, Human
auuuuaauaauguu

SEQ ID NO: 2548476 - RNA, 15 nt, Human
auuuguaucacaaau

SEQ ID NO: 2548477 - RNA, 21 nt, Human
auuuguauaguugcuugccug

SEQ ID NO: 2548478 - RNA, 18 nt, Human
auuuguauaguugcuugc

SEQ ID NO: 2548479 - RNA, 21 nt, Human
auuuguaucucugaagcaugu

SEQ ID NO: 2548480 - RNA, 20 nt, Human
auuuguaucucugaagcaug

SEQ ID NO: 2548481 - RNA, 19 nt, Human
auuuguaucucugaagcau

SEQ ID NO: 2548482 - RNA, 21 nt, Human
auuuguauaaaauaauuuuua

SEQ ID NO: 2548483 - RNA, 16 nt, Human
auuuguauaguugcuu

SEQ ID NO: 2548484 - RNA, 20 nt, Human
auuuguagaaggguuauauu

SEQ ID NO: 2548485 - RNA, 13 nt, Human
auuuuauuaugca

SEQ ID NO: 2548486 - RNA, 18 nt, Human
auuuuauguugcauagaa

SEQ ID NO: 2548487 - RNA, 21 nt, Human
auuuuacuuuaaaaggagcca

SEQ ID NO: 2548488 - RNA, 21 nt, Human
auuuuauguugcauagaauaa

SEQ ID NO: 2548489 - RNA, 14 nt, Human
auuuuauguugcau

SEQ ID NO: 2548490 - RNA, 18 nt, Human
auuuuacuacuguggaaa

SEQ ID NO: 2548491 - RNA, 20 nt, Human
auuuuauuacaucuuucaca

SEQ ID NO: 2548492 - RNA, 17 nt, Human
auuuuauuaugcaugaa

SEQ ID NO: 2548493 - RNA, 14 nt, Human
auuuuauuaugcau

SEQ ID NO: 2548494 - RNA, 15 nt, Human
auuuuauuaugcaug

SEQ ID NO: 2548495 - RNA, 18 nt, Human
auuuuauuguaacagaca

SEQ ID NO: 2548496 - RNA, 16 nt, Human
auuuuauuguaacaga

SEQ ID NO: 2548497 - RNA, 15 nt, Human
auuuuauuguaacag

SEQ ID NO: 2548498 - RNA, 14 nt, Human
auuuuauuguaaca

SEQ ID NO: 2548499 - RNA, 14 nt, Human
auuuuauugcuuga

SEQ ID NO: 2548500 - RNA, 22 nt, Human
auuuuauuuagacaagagaugg

SEQ ID NO: 2548501 - RNA, 21 nt, Human
auuuuauuguaacagacauug

SEQ ID NO: 2548502 - RNA, 20 nt, Human
auuuuauuguaacagacauu

SEQ ID NO: 2548503 - RNA, 17 nt, Human
auuuuauuuagacaaga

SEQ ID NO: 2548504 - RNA, 23 nt, Human
auuuuauuuccuggacauccucu

SEQ ID NO: 2548505 - RNA, 19 nt, Human
auuuuauuuagacaagaga

SEQ ID NO: 2548506 - RNA, 22 nt, Human
auuuuauuguaacagacauugu

SEQ ID NO: 2548507 - RNA, 14 nt, Human
auuuuauuugacaa

SEQ ID NO: 2548508 - RNA, 16 nt, Human
auuuauuauggcacau

SEQ ID NO: 2548509 - RNA, 23 nt, Human
auuuccuguuggauuuguuuaaa

SEQ ID NO: 2548510 - RNA, 22 nt, Human
auuuccuguuggauuuguuuaa

SEQ ID NO: 2548511 - RNA, 21 nt, Human
auuuccuguuggauuuguuua

SEQ ID NO: 2548512 - RNA, 16 nt, Human
auuuccuguuggauuu

SEQ ID NO: 2548513 - RNA, 21 nt, Human
auuuccuggugugaagguccu

SEQ ID NO: 2548514 - RNA, 17 nt, Human
auuuccuggugugaagg

SEQ ID NO: 2548515 - RNA, 12 nt, Human
auuuauuauuga

SEQ ID NO: 2548516 - RNA, 14 nt, Human
auuuccugugucuu

SEQ ID NO: 2548517 - RNA, 12 nt, Human
auuucuaaaucu

SEQ ID NO: 2548518 - RNA, 13 nt, Human
auuucuaaaucuc

SEQ ID NO: 2548519 - RNA, 21 nt, Human
auuucuaaaucuccaaaauaa

SEQ ID NO: 2548520 - RNA, 14 nt, Human
auuuccuugaaugu

SEQ ID NO: 2548521 - RNA, 18 nt, Human
auuuccuuaaacugugug

SEQ ID NO: 2548522 - RNA, 23 nt, Human
auuuauuaaacagauuuuuacaa

SEQ ID NO: 2548523 - RNA, 22 nt, Human
auuuauuaaacagauuuuuaca

SEQ ID NO: 2548524 - RNA, 23 nt, Human
auuuauuaaaaugauuguaaaau

SEQ ID NO: 2548525 - RNA, 21 nt, Human
auuuauuaaaaugauuguaaa

SEQ ID NO: 2548526 - RNA, 19 nt, Human
auuuauuaaaaugauugua

SEQ ID NO: 2548527 - RNA, 22 nt, Human
auuuauguuugcacuugugauu

SEQ ID NO: 2548528 - RNA, 23 nt, Human
auuuagguuuuuguuuguuuccu

SEQ ID NO: 2548529 - RNA, 18 nt, Human
auuuagguuuuuauuagu

SEQ ID NO: 2548530 - RNA, 19 nt, Human
auuuagguuuuuauuagua

SEQ ID NO: 2548531 - RNA, 23 nt, Human
auuuagguuucugaguuccugca

SEQ ID NO: 2548532 - RNA, 17 nt, Human
auuuagguuuuuauuag

SEQ ID NO: 2548533 - RNA, 22 nt, Human
auuuauuacuguaagaaaauau

SEQ ID NO: 2548534 - RNA, 20 nt, Human
auuuauuaaaugcccagccc

SEQ ID NO: 2548535 - RNA, 16 nt, Human
auuuauuaguuaauau

SEQ ID NO: 2548536 - RNA, 13 nt, Human
auuuauuauggca

SEQ ID NO: 2548537 - RNA, 17 nt, Human
auuuagccaaugcuuac

SEQ ID NO: 2548538 - RNA, 18 nt, Human
auuuagccaccaucuuug

SEQ ID NO: 2548539 - RNA, 21 nt, Human
auuuagcuaaacggauuccaa

SEQ ID NO: 2548540 - RNA, 22 nt, Human
auuuagcuaaacggauuccaaa

SEQ ID NO: 2548541 - RNA, 18 nt, Human
auuuagcguagcuaagug

SEQ ID NO: 2548542 - RNA, 16 nt, Human
auuuacguuuuuguaa

SEQ ID NO: 2548543 - RNA, 19 nt, Human
auuuacgcuuugauucaua

SEQ ID NO: 2548544 - RNA, 15 nt, Human
auuuacgcuuugauu

SEQ ID NO: 2548545 - RNA, 17 nt, Human
auuuacgcuuugauuca

SEQ ID NO: 2548546 - RNA, 22 nt, Human
auuuagggagaaauguuguuca

SEQ ID NO: 2548547 - RNA, 20 nt, Human
auuuagggagaaauguuguu

SEQ ID NO: 2548548 - RNA, 18 nt, Human
auuuagggaacugcuuga

SEQ ID NO: 2548549 - RNA, 17 nt, Human
auuuagguuucugaguu

SEQ ID NO: 2548550 - RNA, 21 nt, Human
auuuagguuucugaguuccug

SEQ ID NO: 2548551 - RNA, 14 nt, Human
auuuagguuucuga

SEQ ID NO: 2548552 - RNA, 15 nt, Human
auuuagggcaaggag

SEQ ID NO: 2548553 - RNA, 14 nt, Human
auuuaggagaagcc

SEQ ID NO: 2548554 - RNA, 17 nt, Human
auuuaggagaagccagg

SEQ ID NO: 2548555 - RNA, 21 nt, Human
auuuagggaaagguaguguau

SEQ ID NO: 2548556 - RNA, 22 nt, Human
auuuaggcagauugaaaaggac

SEQ ID NO: 2548557 - RNA, 16 nt, Human
auuuagggaacugcuu

SEQ ID NO: 2548558 - RNA, 23 nt, Human
auuuagcuaaacggauuccaaag

SEQ ID NO: 2548559 - RNA, 18 nt, Human
auuugagguuaagacaaa

SEQ ID NO: 2548560 - RNA, 18 nt, Human
auuugagugauuauuugu

SEQ ID NO: 2548561 - RNA, 22 nt, Human
auuugaggucuguucuuuccaa

SEQ ID NO: 2548562 - RNA, 19 nt, Human
auuugaguguuuuaagaua

SEQ ID NO: 2548563 - RNA, 14 nt, Human
auuugagugcucug

SEQ ID NO: 2548564 - RNA, 16 nt, Human
auuugagugcucugau

SEQ ID NO: 2548565 - RNA, 12 nt, Human
auuugaguguuu

SEQ ID NO: 2548566 - RNA, 23 nt, Human
auuugaggagcagcuucaguugu

SEQ ID NO: 2548567 - RNA, 22 nt, Human
auuugaggagcagcuucaguug

SEQ ID NO: 2548568 - RNA, 19 nt, Human
auuugaggagcagcuucag

SEQ ID NO: 2548569 - RNA, 22 nt, Human
auuugaggacaaccauuccaga

SEQ ID NO: 2548570 - RNA, 17 nt, Human
auuugagcagggcucag

SEQ ID NO: 2548571 - RNA, 23 nt, Human
auuugaggucuguucuuuccaaa

SEQ ID NO: 2548572 - RNA, 15 nt, Human
auuugaggucuguuc

SEQ ID NO: 2548573 - RNA, 22 nt, Human
auuugaggggaaaacaccauaa

SEQ ID NO: 2548574 - RNA, 17 nt, Human
auuugaggggaaaacac

SEQ ID NO: 2548575 - RNA, 13 nt, Human
auuugaggucaag

SEQ ID NO: 2548576 - RNA, 22 nt, Human
auuugaggucaaguaagaagac

SEQ ID NO: 2548577 - RNA, 21 nt, Human
auuucuuugccuguucaguua

SEQ ID NO: 2548578 - RNA, 20 nt, Human
auuucuuugccuguucaguu

SEQ ID NO: 2548579 - RNA, 19 nt, Human
auuucuuugccuguucagu

SEQ ID NO: 2548580 - RNA, 17 nt, Human
auuucuuugccuguuca

SEQ ID NO: 2548581 - RNA, 23 nt, Human
auuucuuuguuaucaaacuucag

SEQ ID NO: 2548582 - RNA, 22 nt, Human
auuucuuuguuaucaaacuuca

SEQ ID NO: 2548583 - RNA, 23 nt, Human
auuucuuugccuguucaguuaca

SEQ ID NO: 2548584 - RNA, 21 nt, Human
auuucuuuguuaucaaacuuc

SEQ ID NO: 2548585 - RNA, 19 nt, Human
auuucuuugugcuuuggcu

SEQ ID NO: 2548586 - RNA, 20 nt, Human
auuucuuuugccguuauuaa

SEQ ID NO: 2548587 - RNA, 14 nt, Human
auuugaaugcauuu

SEQ ID NO: 2548588 - RNA, 12 nt, Human
auuugaaugcau

SEQ ID NO: 2548589 - RNA, 19 nt, Human
auuugaaugaaaaauuuaa

SEQ ID NO: 2548590 - RNA, 20 nt, Human
auuugaauguaugcuucaua

SEQ ID NO: 2548591 - RNA, 21 nt, Human
auuugaauguaugcuucauac

SEQ ID NO: 2548592 - RNA, 22 nt, Human
auuugaauguaugcuucauaca

SEQ ID NO: 2548593 - RNA, 17 nt, Human
auuugaauguaugcuuc

SEQ ID NO: 2548594 - RNA, 18 nt, Human
auuugaauguaugcuuca

SEQ ID NO: 2548595 - RNA, 16 nt, Human
auuugaaugcauuuug

SEQ ID NO: 2548596 - RNA, 15 nt, Human
auuugaaugcauuuu

SEQ ID NO: 2548597 - RNA, 18 nt, Human
auuugaaugcauuuuguu

SEQ ID NO: 2548598 - RNA, 17 nt, Human
auuugaauggguccauu

SEQ ID NO: 2548599 - RNA, 18 nt, Human
auuugaauggguccauuu

SEQ ID NO: 2548600 - RNA, 17 nt, Human
auuuggugguuucagaa

SEQ ID NO: 2548601 - RNA, 23 nt, Human
auuuggucaagauuuugaaugcu

SEQ ID NO: 2548602 - RNA, 17 nt, Human
auuuggguucugccugc

SEQ ID NO: 2548603 - RNA, 21 nt, Human
auuugguaaauuaguauuuau

SEQ ID NO: 2548604 - RNA, 23 nt, Human
auuugguaaggggaauugaggac

SEQ ID NO: 2548605 - RNA, 21 nt, Human
auuuggagacacaacuauuuu

SEQ ID NO: 2548606 - RNA, 12 nt, Human
auuuggggugga

SEQ ID NO: 2548607 - RNA, 23 nt, Human
auuugggguagcuagaggaacca

SEQ ID NO: 2548608 - RNA, 21 nt, Human
auuuggggcuugcaugccaaa

SEQ ID NO: 2548609 - RNA, 16 nt, Human
auuuggggcuuauuuu

SEQ ID NO: 2548610 - RNA, 21 nt, Human
auuugggguagcuagaggaac

SEQ ID NO: 2548611 - RNA, 14 nt, Human
auuuggaauacuuu

SEQ ID NO: 2548612 - RNA, 15 nt, Human
auuuggaauacuuuu

SEQ ID NO: 2548613 - RNA, 13 nt, Human
auuuggaauacuu

SEQ ID NO: 2548614 - RNA, 20 nt, Human
auuuggagacacaacuauuu

SEQ ID NO: 2548615 - RNA, 18 nt, Human
auuuggaauuuauauaca

SEQ ID NO: 2548616 - RNA, 18 nt, Human
auuuggugguuucagaaa

SEQ ID NO: 2548617 - RNA, 20 nt, Human
auuuggugguuucagaaaug

SEQ ID NO: 2548618 - RNA, 18 nt, Human
auuuguaguguuggagaa

SEQ ID NO: 2548619 - RNA, 23 nt, Human
auuuguacugaaaaaugguaauu

SEQ ID NO: 2548620 - RNA, 23 nt, Human
auuuguaaaagaacaguaaacau

SEQ ID NO: 2548621 - RNA, 23 nt, Human
auuuguaaaaacagcauugcuuu

SEQ ID NO: 2548622 - RNA, 22 nt, Human
auuuguaaaaacagcauugcuu

SEQ ID NO: 2548623 - RNA, 20 nt, Human
auauauaaguguacauaugu

SEQ ID NO: 2548624 - RNA, 16 nt, Human
auauauaaguguacau

SEQ ID NO: 2548625 - RNA, 15 nt, Human
auauauaaguguaca

SEQ ID NO: 2548626 - RNA, 13 nt, Human
auauauaaccagu

SEQ ID NO: 2548627 - RNA, 18 nt, Human
auauauaaauauauauaa

SEQ ID NO: 2548628 - RNA, 14 nt, Human
auauauaaauauau

SEQ ID NO: 2548629 - RNA, 12 nt, Human
auauauaaccag

SEQ ID NO: 2548630 - RNA, 17 nt, Human
auauauaaauaaauaua

SEQ ID NO: 2548631 - RNA, 16 nt, Human
auauauaaauaaauau

SEQ ID NO: 2548632 - RNA, 13 nt, Human
auauauaaauaua

SEQ ID NO: 2548633 - RNA, 13 nt, Human
auauauaaauaaa

SEQ ID NO: 2548634 - RNA, 12 nt, Human
auauauaaauaa

SEQ ID NO: 2548635 - RNA, 11 nt, Human
auauauaaaua

SEQ ID NO: 2548636 - RNA, 14 nt, Human
auauauaacaaugc

SEQ ID NO: 2548637 - RNA, 21 nt, Human
auauauaaaccuaaaaaagau

SEQ ID NO: 2548638 - RNA, 20 nt, Human
auauauaaaauaaauauaua

SEQ ID NO: 2548639 - RNA, 18 nt, Human
auauauaaaauaaauaua

SEQ ID NO: 2548640 - RNA, 10 nt, Human
auauauaaau

SEQ ID NO: 2548641 - RNA, 16 nt, Human
auauauaaaauaaaua

SEQ ID NO: 2548642 - RNA, 14 nt, Human
auauauaaaauaaa

SEQ ID NO: 2548643 - RNA, 13 nt, Human
auauauaaaauaa

SEQ ID NO: 2548644 - RNA, 21 nt, Human
auauauaaaaagaaaagauaa

SEQ ID NO: 2548645 - RNA, 22 nt, Human
auauaacuuauauuguaagaaa

SEQ ID NO: 2548646 - RNA, 13 nt, Human
auauaaauauaua

SEQ ID NO: 2548647 - RNA, 12 nt, Human
auauaaauauau

SEQ ID NO: 2548648 - RNA, 11 nt, Human
auauaaauaua

SEQ ID NO: 2548649 - RNA, 23 nt, Human
auauaaccacaaagcacaguuug

SEQ ID NO: 2548650 - RNA, 21 nt, Human
auauaacuuaaaaauguaaau

SEQ ID NO: 2548651 - RNA, 16 nt, Human
auauaacuuauauugu

SEQ ID NO: 2548652 - RNA, 20 nt, Human
auauaacuuauauuguaaga

SEQ ID NO: 2548653 - RNA, 21 nt, Human
auauaacuuauauuguaagaa

SEQ ID NO: 2548654 - RNA, 14 nt, Human
auauaaauauauau

SEQ ID NO: 2548655 - RNA, 20 nt, Human
auauaacugccuuaaaacuu

SEQ ID NO: 2548656 - RNA, 18 nt, Human
auauaacuauugcccagg

SEQ ID NO: 2548657 - RNA, 13 nt, Human
auauaacugccuu

SEQ ID NO: 2548658 - RNA, 19 nt, Human
auauaaaguaguccuguga

SEQ ID NO: 2548659 - RNA, 20 nt, Human
auauaaaaggcaaaugugua

SEQ ID NO: 2548660 - RNA, 22 nt, Human
auauaaaacuguacuucacugu

SEQ ID NO: 2548661 - RNA, 13 nt, Human
auauaaaggaaaa

SEQ ID NO: 2548662 - RNA, 14 nt, Human
auauaaagauguua

SEQ ID NO: 2548663 - RNA, 16 nt, Human
auauaaaagacugacc

SEQ ID NO: 2548664 - RNA, 19 nt, Human
auauaaauaaauauauaua

SEQ ID NO: 2548665 - RNA, 17 nt, Human
auauaaauaaauauaua

SEQ ID NO: 2548666 - RNA, 16 nt, Human
auauaaauaaauauau

SEQ ID NO: 2548667 - RNA, 15 nt, Human
auauaaauaaauaua

SEQ ID NO: 2548668 - RNA, 22 nt, Human
auauaaauaaauauauauaucc

SEQ ID NO: 2548669 - RNA, 15 nt, Human
auauaaauaaaacau

SEQ ID NO: 2548670 - RNA, 14 nt, Human
auauaaauaaauau

SEQ ID NO: 2548671 - RNA, 18 nt, Human
auauaaauaaaacauuuu

SEQ ID NO: 2548672 - RNA, 16 nt, Human
auauauauauauauaa

SEQ ID NO: 2548673 - RNA, 15 nt, Human
auauauauauauauu

SEQ ID NO: 2548674 - RNA, 14 nt, Human
auauauauccucug

SEQ ID NO: 2548675 - RNA, 13 nt, Human
auauauauauaaa

SEQ ID NO: 2548676 - RNA, 14 nt, Human
auauauauaaauaa

SEQ ID NO: 2548677 - RNA, 19 nt, Human
auauauaauucuguacaua

SEQ ID NO: 2548678 - RNA, 14 nt, Human
auauauauauauaa

SEQ ID NO: 2548679 - RNA, 15 nt, Human
auauauaauucugua

SEQ ID NO: 2548680 - RNA, 22 nt, Human
auauauaagauggaagcuucca

SEQ ID NO: 2548681 - RNA, 12 nt, Human
auauauauaaau

SEQ ID NO: 2548682 - RNA, 16 nt, Human
auauauaugccaugau

SEQ ID NO: 2548683 - RNA, 21 nt, Human
auauauaucugcuguccagac

SEQ ID NO: 2548684 - RNA, 20 nt, Human
auauauauguguguguaugu

SEQ ID NO: 2548685 - RNA, 20 nt, Human
auauaucauauugguauuca

SEQ ID NO: 2548686 - RNA, 13 nt, Human
auauaucauauug

SEQ ID NO: 2548687 - RNA, 15 nt, Human
auauaucaugaguga

SEQ ID NO: 2548688 - RNA, 10 nt, Human
auauauauuu

SEQ ID NO: 2548689 - RNA, 13 nt, Human
auauauauuuuaa

SEQ ID NO: 2548690 - RNA, 18 nt, Human
auauaucugcuucagugg

SEQ ID NO: 2548691 - RNA, 17 nt, Human
auauaucugcuucagug

SEQ ID NO: 2548692 - RNA, 15 nt, Human
auauaucugcuucag

SEQ ID NO: 2548693 - RNA, 20 nt, Human
auauaucugcuguccagaca

SEQ ID NO: 2548694 - RNA, 19 nt, Human
auauaucugcuguccagac

SEQ ID NO: 2548695 - RNA, 15 nt, Human
auauaucuaucuuau

SEQ ID NO: 2548696 - RNA, 16 nt, Human
auauaucccagaaauu

SEQ ID NO: 2548697 - RNA, 12 nt, Human
auauauccucug

SEQ ID NO: 2548698 - RNA, 19 nt, Human
auauaucuaaauugaauaa

SEQ ID NO: 2548699 - RNA, 18 nt, Human
auauaucuaaauugaaua

SEQ ID NO: 2548700 - RNA, 17 nt, Human
auauaucuaaauuuaga

SEQ ID NO: 2548701 - RNA, 14 nt, Human
auauaucuaucuua

SEQ ID NO: 2548702 - RNA, 21 nt, Human
uucacuguugaaaauuauuuu

SEQ ID NO: 2548703 - RNA, 15 nt, Human
uucacuuacagcacc

SEQ ID NO: 2548704 - RNA, 15 nt, Human
uucacuuauauguuc

SEQ ID NO: 2548705 - RNA, 23 nt, Human
uucacuguauaaauaggagagga

SEQ ID NO: 2548706 - RNA, 22 nt, Human
uucacuguauaaauaggagagg

SEQ ID NO: 2548707 - RNA, 21 nt, Human
uucacugucaggaagaaauca

SEQ ID NO: 2548708 - RNA, 13 nt, Human
auauaugaggacu

SEQ ID NO: 2548709 - RNA, 22 nt, Human
uucacugucaggaagaaaucac

SEQ ID NO: 2548710 - RNA, 22 nt, Human
uucacuguccuccaagccagcg

SEQ ID NO: 2548711 - RNA, 15 nt, Human
auaguuagaaccugg

SEQ ID NO: 2548712 - RNA, 12 nt, Human
auaguuacuguu

SEQ ID NO: 2548713 - RNA, 20 nt, Human
auaguuacuccagugccaac

SEQ ID NO: 2548714 - RNA, 22 nt, Human
auaguuaagcgugcauaaguua

SEQ ID NO: 2548715 - RNA, 23 nt, Human
auaguuaggauagcauuuuugau

SEQ ID NO: 2548716 - RNA, 16 nt, Human
auaguuacuguuguga

SEQ ID NO: 2548717 - RNA, 15 nt, Human
auaguucaaagccaa

SEQ ID NO: 2548718 - RNA, 17 nt, Human
auaguucccauguuaaa

SEQ ID NO: 2548719 - RNA, 22 nt, Human
auaguucccuagucuauucauu

SEQ ID NO: 2548720 - RNA, 18 nt, Human
auaguugagccagcagac

SEQ ID NO: 2548721 - RNA, 17 nt, Human
auaguugagccagcaga

SEQ ID NO: 2548722 - RNA, 14 nt, Human
auaguuuacaugua

SEQ ID NO: 2548723 - RNA, 18 nt, Human
auaguugugggugggaga

SEQ ID NO: 2548724 - RNA, 17 nt, Human
auaguuguggacauuua

SEQ ID NO: 2548725 - RNA, 13 nt, Human
auaguuguaacua

SEQ ID NO: 2548726 - RNA, 20 nt, Human
auaguuguaccgcaauguga

SEQ ID NO: 2548727 - RNA, 22 nt, Human
auaguuggcuaggaccccucca

SEQ ID NO: 2548728 - RNA, 23 nt, Human
auaguugagccagcagacauugu

SEQ ID NO: 2548729 - RNA, 22 nt, Human
auaguugagccagcagacauug

SEQ ID NO: 2548730 - RNA, 21 nt, Human
auaguugagccagcagacauu

SEQ ID NO: 2548731 - RNA, 20 nt, Human
auaguugagccagcagacau

SEQ ID NO: 2548732 - RNA, 13 nt, Human
auaguugagcccc

SEQ ID NO: 2548733 - RNA, 19 nt, Human
auaguugcuccgccucugc

SEQ ID NO: 2548734 - RNA, 18 nt, Human
auaguuuuuaagguuauu

SEQ ID NO: 2548735 - RNA, 14 nt, Human
auaguuuauugaca

SEQ ID NO: 2548736 - RNA, 13 nt, Human
auaguuuauugac

SEQ ID NO: 2548737 - RNA, 17 nt, Human
auaguuuaccugaauaa

SEQ ID NO: 2548738 - RNA, 15 nt, Human
auaguuuacuauuuu

SEQ ID NO: 2548739 - RNA, 16 nt, Human
auaguuuacuauuuua

SEQ ID NO: 2548740 - RNA, 22 nt, Human
auaguuuacuauuuuacuucua

SEQ ID NO: 2548741 - RNA, 17 nt, Human
auauaaaacuguacuuc

SEQ ID NO: 2548742 - RNA, 22 nt, Human
auauaaaacugcguuaaaggcu

SEQ ID NO: 2548743 - RNA, 13 nt, Human
auauaaaacugcg

SEQ ID NO: 2548744 - RNA, 22 nt, Human
auauaaaaagaaaagauaaaga

SEQ ID NO: 2548745 - RNA, 23 nt, Human
auauaaaaagaaaagauaaagau

SEQ ID NO: 2548746 - RNA, 20 nt, Human
auauaaaaagaaaagauaaa

SEQ ID NO: 2548747 - RNA, 18 nt, Human
auauaaaaagaaaagaua

SEQ ID NO: 2548748 - RNA, 17 nt, Human
auauaaaaagaaaagau

SEQ ID NO: 2548749 - RNA, 23 nt, Human
auauaaaaaccccaaacuguuga

SEQ ID NO: 2548750 - RNA, 20 nt, Human
auaguuuuuaagguuauuua

SEQ ID NO: 2548751 - RNA, 19 nt, Human
auaguuuuuaagguuauuu

SEQ ID NO: 2548752 - RNA, 14 nt, Human
auauaaaaaacuuu

SEQ ID NO: 2548753 - RNA, 21 nt, Human
auagugaggcaucgcaaugua

SEQ ID NO: 2548754 - RNA, 20 nt, Human
auagugauguaaucuugaau

SEQ ID NO: 2548755 - RNA, 18 nt, Human
auagugacuaugaacuuc

SEQ ID NO: 2548756 - RNA, 17 nt, Human
auagucuuuugcuuuug

SEQ ID NO: 2548757 - RNA, 16 nt, Human
auagucuuuugcuuuu

SEQ ID NO: 2548758 - RNA, 14 nt, Human
auagucuuuugcuu

SEQ ID NO: 2548759 - RNA, 13 nt, Human
auagucuguguga

SEQ ID NO: 2548760 - RNA, 13 nt, Human
auagucuuucagu

SEQ ID NO: 2548761 - RNA, 20 nt, Human
auagucuagauggcuccucu

SEQ ID NO: 2548762 - RNA, 21 nt, Human
auaggcgaucacaacgugcau

SEQ ID NO: 2548763 - RNA, 11 nt, Human
auaggcucugc

SEQ ID NO: 2548764 - RNA, 12 nt, Human
auaggcucugca

SEQ ID NO: 2548765 - RNA, 13 nt, Human
auaggcucugcac

SEQ ID NO: 2548766 - RNA, 14 nt, Human
auaggcucugcaca

SEQ ID NO: 2548767 - RNA, 15 nt, Human
auaggcucugcacag

SEQ ID NO: 2548768 - RNA, 19 nt, Human
auaggcucugcacagaugg

SEQ ID NO: 2548769 - RNA, 23 nt, Human
auaguguggaaauuaagaagaaa

SEQ ID NO: 2548770 - RNA, 12 nt, Human
auaguguguucu

SEQ ID NO: 2548771 - RNA, 13 nt, Human
auaguguguucug

SEQ ID NO: 2548772 - RNA, 14 nt, Human
auaguguguucuga

SEQ ID NO: 2548773 - RNA, 14 nt, Human
auaguguaaaauaa

SEQ ID NO: 2548774 - RNA, 22 nt, Human
auagugggcccuccgacagccc

SEQ ID NO: 2548775 - RNA, 13 nt, Human
auaguguaaaaua

SEQ ID NO: 2548776 - RNA, 21 nt, Human
auaguguuaaucaauuuaaac

SEQ ID NO: 2548777 - RNA, 20 nt, Human
auaguguuaaucaauuuaaa

SEQ ID NO: 2548778 - RNA, 18 nt, Human
auaguguuaaucaauuua

SEQ ID NO: 2548779 - RNA, 16 nt, Human
auaguguuaaucaauu

SEQ ID NO: 2548780 - RNA, 22 nt, Human
auaguguucugcaaaaauauuu

SEQ ID NO: 2548781 - RNA, 15 nt, Human
auaguguguucugau

SEQ ID NO: 2548782 - RNA, 17 nt, Human
auaguguguucugauua

SEQ ID NO: 2548783 - RNA, 19 nt, Human
auaguguguucugauuaga

SEQ ID NO: 2548784 - RNA, 21 nt, Human
auaguguguucugauuagaaa

SEQ ID NO: 2548785 - RNA, 15 nt, Human
auaguguuaaucaau

SEQ ID NO: 2548786 - RNA, 12 nt, Human
auaguguuaauc

SEQ ID NO: 2548787 - RNA, 23 nt, Human
auaguguguucugauuagaaaug

SEQ ID NO: 2548788 - RNA, 23 nt, Human
auagugcucgcuuucuauguagu

SEQ ID NO: 2548789 - RNA, 20 nt, Human
auagugcucgcuuucuaugu

SEQ ID NO: 2548790 - RNA, 17 nt, Human
auaguggcuuaaaacaa

SEQ ID NO: 2548791 - RNA, 15 nt, Human
auaguggugugauuu

SEQ ID NO: 2548792 - RNA, 17 nt, Human
auagugcuuaaaaauca

SEQ ID NO: 2548793 - RNA, 22 nt, Human
auaguggacauuguuggcagca

SEQ ID NO: 2548794 - RNA, 20 nt, Human
auagugggcaccccacugca

SEQ ID NO: 2548795 - RNA, 16 nt, Human
auaguggggagacuuc

SEQ ID NO: 2548796 - RNA, 22 nt, Human
uuauuuuucuaagguucucaua

SEQ ID NO: 2548797 - RNA, 14 nt, Human
uuauuuuucuaaaa

SEQ ID NO: 2548798 - RNA, 23 nt, Human
uuauuuuugacaguguugaaaau

SEQ ID NO: 2548799 - RNA, 10 nt, Human
uuauuuuucu

SEQ ID NO: 2548800 - RNA, 19 nt, Human
uuauuuuucauauugugcc

SEQ ID NO: 2548801 - RNA, 16 nt, Human
uuauuuuucauauugu

SEQ ID NO: 2548802 - RNA, 14 nt, Human
uuauuuuucauauu

SEQ ID NO: 2548803 - RNA, 16 nt, Human
uuauuuuuuaauuauu

SEQ ID NO: 2548804 - RNA, 14 nt, Human
uuauuuuuuaauua

SEQ ID NO: 2548805 - RNA, 23 nt, Human
uuauuuuuguuucuuccaaagca

SEQ ID NO: 2548806 - RNA, 18 nt, Human
uuauuuuuuaaguauuua

SEQ ID NO: 2548807 - RNA, 18 nt, Human
uuauuuuuuacauuauua

SEQ ID NO: 2548808 - RNA, 14 nt, Human
uuauuuuuuacauu

SEQ ID NO: 2548809 - RNA, 13 nt, Human
uuauuuuuucaga

SEQ ID NO: 2548810 - RNA, 12 nt, Human
uuauuuuuucag

SEQ ID NO: 2548811 - RNA, 13 nt, Human
uuauuuuuuauug

SEQ ID NO: 2548812 - RNA, 20 nt, Human
uuauuuuuuuaagcuguaaa

SEQ ID NO: 2548813 - RNA, 20 nt, Human
uuauuuuuucagaccgaaaa

SEQ ID NO: 2548814 - RNA, 13 nt, Human
uuauuuuuuccca

SEQ ID NO: 2548815 - RNA, 19 nt, Human
uuauuuuuucagaccgaaa

SEQ ID NO: 2548816 - RNA, 16 nt, Human
uuauuuuuucagaccg

SEQ ID NO: 2548817 - RNA, 15 nt, Human
uuauuuuuucagacc

SEQ ID NO: 2548818 - RNA, 14 nt, Human
uuauuuuuucagac

SEQ ID NO: 2548819 - RNA, 13 nt, Human
uuauuuuuuucug

SEQ ID NO: 2548820 - RNA, 17 nt, Human
uuauuuuuuucugaauu

SEQ ID NO: 2548821 - RNA, 17 nt, Human
uucaaaaccuuuugaaa

SEQ ID NO: 2548822 - RNA, 14 nt, Human
uuauuuuuuucuac

SEQ ID NO: 2548823 - RNA, 20 nt, Human
uuaguuuuuaaaauaucuuu

SEQ ID NO: 2548824 - RNA, 12 nt, Human
uuaguuuugauu

SEQ ID NO: 2548825 - RNA, 16 nt, Human
uuaguuuugaugaguu

SEQ ID NO: 2548826 - RNA, 16 nt, Human
uuaguuuguguguugu

SEQ ID NO: 2548827 - RNA, 15 nt, Human
uuaguuuuaguugca

SEQ ID NO: 2548828 - RNA, 17 nt, Human
uuaguuuuaguugcaga

SEQ ID NO: 2548829 - RNA, 17 nt, Human
uuaguuuuuguaauuua

SEQ ID NO: 2548830 - RNA, 18 nt, Human
uuaguuuuuguaauuuau

SEQ ID NO: 2548831 - RNA, 13 nt, Human
uuauuuuuaaaau

SEQ ID NO: 2548832 - RNA, 19 nt, Human
uuaguuuuuguaauuuauu

SEQ ID NO: 2548833 - RNA, 17 nt, Human
uuauuuuuagacagagu

SEQ ID NO: 2548834 - RNA, 18 nt, Human
uuauuuuuacauucugaa

SEQ ID NO: 2548835 - RNA, 20 nt, Human
uuauuuuuauaucagccuga

SEQ ID NO: 2548836 - RNA, 18 nt, Human
uuauuuuuagacagaguc

SEQ ID NO: 2548837 - RNA, 18 nt, Human
uucaagagauuuaauuaa

SEQ ID NO: 2548838 - RNA, 18 nt, Human
uucaagacauuaaaucua

SEQ ID NO: 2548839 - RNA, 18 nt, Human
uucaagaccuucucccca

SEQ ID NO: 2548840 - RNA, 23 nt, Human
uucaagcagucgugccugugucc

SEQ ID NO: 2548841 - RNA, 15 nt, Human
uucaagcauuaagaa

SEQ ID NO: 2548842 - RNA, 22 nt, Human
uucaagcagucgugccuguguc

SEQ ID NO: 2548843 - RNA, 18 nt, Human
uucaagcagucgugccug

SEQ ID NO: 2548844 - RNA, 17 nt, Human
uucaagcagucgugccu

SEQ ID NO: 2548845 - RNA, 17 nt, Human
uucaagcagauuggaga

SEQ ID NO: 2548846 - RNA, 20 nt, Human
uucaagcgauucuucugccu

SEQ ID NO: 2548847 - RNA, 21 nt, Human
uucaagcgauucuucugcuuc

SEQ ID NO: 2548848 - RNA, 19 nt, Human
uucaagguaauuucuugug

SEQ ID NO: 2548849 - RNA, 20 nt, Human
uucaagguggccaaauuauu

SEQ ID NO: 2548850 - RNA, 18 nt, Human
uucaagguggccaaauua

SEQ ID NO: 2548851 - RNA, 22 nt, Human
uucaagguggccaaauuauuug

SEQ ID NO: 2548852 - RNA, 17 nt, Human
uucaagguggccaaauu

SEQ ID NO: 2548853 - RNA, 18 nt, Human
uucaaacagucucaggaa

SEQ ID NO: 2548854 - RNA, 14 nt, Human
uucaaacauauaua

SEQ ID NO: 2548855 - RNA, 23 nt, Human
uucaagaauaaucacgcuuuccu

SEQ ID NO: 2548856 - RNA, 14 nt, Human
uucaaacacaaaug

SEQ ID NO: 2548857 - RNA, 16 nt, Human
uucaaaauuguuacaa

SEQ ID NO: 2548858 - RNA, 17 nt, Human
uucaaacacaaaugcag

SEQ ID NO: 2548859 - RNA, 15 nt, Human
uucaaacacaaaugc

SEQ ID NO: 2548860 - RNA, 21 nt, Human
uucaaaauuguuacaaauugu

SEQ ID NO: 2548861 - RNA, 14 nt, Human
uucaaaauaaaaac

SEQ ID NO: 2548862 - RNA, 20 nt, Human
uucaaaaguauuuuccugua

SEQ ID NO: 2548863 - RNA, 21 nt, Human
uucaaaagaaucagaaacagg

SEQ ID NO: 2548864 - RNA, 21 nt, Human
uucaaaaguauuuuccuguaa

SEQ ID NO: 2548865 - RNA, 16 nt, Human
uucaaaaguugaaauu

SEQ ID NO: 2548866 - RNA, 17 nt, Human
uucaaaaguugaaauua

SEQ ID NO: 2548867 - RNA, 20 nt, Human
uucacaguucucuccuucuu

SEQ ID NO: 2548868 - RNA, 15 nt, Human
uucacaguucucucc

SEQ ID NO: 2548869 - RNA, 20 nt, Human
uucacagaugggugcuugga

SEQ ID NO: 2548870 - RNA, 12 nt, Human
uucacagagugu

SEQ ID NO: 2548871 - RNA, 21 nt, Human
uucacagagugugcuggagga

SEQ ID NO: 2548872 - RNA, 20 nt, Human
uucacacuuccaccagccug

SEQ ID NO: 2548873 - RNA, 18 nt, Human
uucacacuuccaccagcc

SEQ ID NO: 2548874 - RNA, 19 nt, Human
uucacacuuccaccagccu

SEQ ID NO: 2548875 - RNA, 13 nt, Human
uucacaugaacau

SEQ ID NO: 2548876 - RNA, 20 nt, Human
uucacaucuaaccucaucuu

SEQ ID NO: 2548877 - RNA, 19 nt, Human
uucacaugagcuauuucca

SEQ ID NO: 2548878 - RNA, 14 nt, Human
uucacaugaacaua

SEQ ID NO: 2548879 - RNA, 18 nt, Human
uucacaugcaucaaguua

SEQ ID NO: 2548880 - RNA, 18 nt, Human
uucacaucuaaccucauc

SEQ ID NO: 2548881 - RNA, 19 nt, Human
uucacaucuaaccucaucu

SEQ ID NO: 2548882 - RNA, 21 nt, Human
uucacauccuguguuucuagg

SEQ ID NO: 2548883 - RNA, 12 nt, Human
uucacagcuccu

SEQ ID NO: 2548884 - RNA, 20 nt, Human
uucacaguucuuugggccag

SEQ ID NO: 2548885 - RNA, 13 nt, Human
uucacaguucucu

SEQ ID NO: 2548886 - RNA, 23 nt, Human
uucacaguuggcuggaugaaauu

SEQ ID NO: 2548887 - RNA, 21 nt, Human
uucacaguucuuugggccaga

SEQ ID NO: 2548888 - RNA, 19 nt, Human
uucacauccuguguuucua

SEQ ID NO: 2548889 - RNA, 23 nt, Human
uucacaagacccaaaaggcagaa

SEQ ID NO: 2548890 - RNA, 17 nt, Human
uucaagugauucucaug

SEQ ID NO: 2548891 - RNA, 21 nt, Human
uucaaguacuguaacuguguc

SEQ ID NO: 2548892 - RNA, 18 nt, Human
uucaaguaauucugcugu

SEQ ID NO: 2548893 - RNA, 15 nt, Human
uucaaguaauucugc

SEQ ID NO: 2548894 - RNA, 16 nt, Human
uucaaguaauugugaa

SEQ ID NO: 2548895 - RNA, 21 nt, Human
uucaaguauuagggguaauau

SEQ ID NO: 2548896 - RNA, 17 nt, Human
uucaagugaaucuaaaa

SEQ ID NO: 2548897 - RNA, 21 nt, Human
uucacaccugacucugaaauc

SEQ ID NO: 2548898 - RNA, 19 nt, Human
uucacaccugacucugaaa

SEQ ID NO: 2548899 - RNA, 14 nt, Human
uucacaccugacuc

SEQ ID NO: 2548900 - RNA, 22 nt, Human
uucacacucucacauguuuaga

SEQ ID NO: 2548901 - RNA, 14 nt, Human
uucacacucucaca

SEQ ID NO: 2548902 - RNA, 13 nt, Human
uucacacugucug

SEQ ID NO: 2548903 - RNA, 21 nt, Human
uucacacugcaagagccuugg

SEQ ID NO: 2548904 - RNA, 12 nt, Human
uucacacuucca

SEQ ID NO: 2548905 - RNA, 15 nt, Human
uucacacuuccacca

SEQ ID NO: 2548906 - RNA, 16 nt, Human
uucaagucaccuccuu

SEQ ID NO: 2548907 - RNA, 13 nt, Human
uucacaauagaaa

SEQ ID NO: 2548908 - RNA, 20 nt, Human
uucacaaugaaaugcucucc

SEQ ID NO: 2548909 - RNA, 21 nt, Human
uucacacacaggcaacugagg

SEQ ID NO: 2548910 - RNA, 17 nt, Human
auaggaaaaacugauuu

SEQ ID NO: 2548911 - RNA, 16 nt, Human
auaggaaaaacugauu

SEQ ID NO: 2548912 - RNA, 14 nt, Human
auaggaaaaacuga

SEQ ID NO: 2548913 - RNA, 12 nt, Human
auaggaaaaacu

SEQ ID NO: 2548914 - RNA, 15 nt, Human
auagcuuuuauugua

SEQ ID NO: 2548915 - RNA, 19 nt, Human
uucacauucuuauaaauau

SEQ ID NO: 2548916 - RNA, 14 nt, Human
auagcuuuuauugu

SEQ ID NO: 2548917 - RNA, 22 nt, Human
auagcuuuucccuuuuuuuaag

SEQ ID NO: 2548918 - RNA, 20 nt, Human
uucacauucuuauaaauaug

SEQ ID NO: 2548919 - RNA, 16 nt, Human
uucacauucuuauaaa

SEQ ID NO: 2548920 - RNA, 13 nt, Human
uucacauucuuau

SEQ ID NO: 2548921 - RNA, 12 nt, Human
uucacauucuua

SEQ ID NO: 2548922 - RNA, 22 nt, Human
uucacauuaauauuugcugaca

SEQ ID NO: 2548923 - RNA, 17 nt, Human
auaggcguaacuaauuu

SEQ ID NO: 2548924 - RNA, 13 nt, Human
auaggagccugcu

SEQ ID NO: 2548925 - RNA, 12 nt, Human
auaggagccugc

SEQ ID NO: 2548926 - RNA, 24 nt, Human
auaggagaggaugagagcccagag

SEQ ID NO: 2548927 - RNA, 23 nt, Human
auaggagaggaugagagcccaga

SEQ ID NO: 2548928 - RNA, 16 nt, Human
auaggagccugcuggu

SEQ ID NO: 2548929 - RNA, 15 nt, Human
auaggagccugcugg

SEQ ID NO: 2548930 - RNA, 14 nt, Human
auaggccugggugc

SEQ ID NO: 2548931 - RNA, 21 nt, Human
auaggagaggaugagagccca

SEQ ID NO: 2548932 - RNA, 20 nt, Human
auaggagaggaugagagccc

SEQ ID NO: 2548933 - RNA, 19 nt, Human
auaggagaggaugagagcc

SEQ ID NO: 2548934 - RNA, 14 nt, Human
auaggagaggauga

SEQ ID NO: 2548935 - RNA, 20 nt, Human
auaggaccuuuccaccacag

SEQ ID NO: 2548936 - RNA, 14 nt, Human
auaggaccuuucca

SEQ ID NO: 2548937 - RNA, 23 nt, Human
auaggaccuuuccaccacagcca

SEQ ID NO: 2548938 - RNA, 22 nt, Human
auaggacucaaaguuucagaga

SEQ ID NO: 2548939 - RNA, 22 nt, Human
auaggaauugacccacaagaaa

SEQ ID NO: 2548940 - RNA, 15 nt, Human
auaggaacauaugaa

SEQ ID NO: 2548941 - RNA, 16 nt, Human
auaggaacauaugaaa

SEQ ID NO: 2548942 - RNA, 18 nt, Human
auaggaacauaugaaaau

SEQ ID NO: 2548943 - RNA, 21 nt, Human
auaggaacauaugaaaauaca

SEQ ID NO: 2548944 - RNA, 19 nt, Human
auaggaaaaguacauuuaa

SEQ ID NO: 2548945 - RNA, 21 nt, Human
auaggaaaguauuuuuuuaag

SEQ ID NO: 2548946 - RNA, 18 nt, Human
auagcuuuuauuguauaa

SEQ ID NO: 2548947 - RNA, 17 nt, Human
auagcuuuuauuguaua

SEQ ID NO: 2548948 - RNA, 18 nt, Human
auaggaaaaguacauuua

SEQ ID NO: 2548949 - RNA, 16 nt, Human
uucccaagcucugcuc

SEQ ID NO: 2548950 - RNA, 15 nt, Human
uucccaagcucugcu

SEQ ID NO: 2548951 - RNA, 14 nt, Human
uucccaagcucugc

SEQ ID NO: 2548952 - RNA, 13 nt, Human
uucccaagcucug

SEQ ID NO: 2548953 - RNA, 12 nt, Human
uucccaaauuuc

SEQ ID NO: 2548954 - RNA, 18 nt, Human
uucccaacuccagaaagu

SEQ ID NO: 2548955 - RNA, 17 nt, Human
uucccaacucuagcugg

SEQ ID NO: 2548956 - RNA, 18 nt, Human
uucccaacucuagcuggg

SEQ ID NO: 2548957 - RNA, 15 nt, Human
uucccaacucuagcu

SEQ ID NO: 2548958 - RNA, 18 nt, Human
uucccaagcucugcuccu

SEQ ID NO: 2548959 - RNA, 11 nt, Human
uucccaagcuc

SEQ ID NO: 2548960 - RNA, 20 nt, Human
uucccaauagcaacguagcu

SEQ ID NO: 2548961 - RNA, 17 nt, Human
uucccacaccuccacag

SEQ ID NO: 2548962 - RNA, 16 nt, Human
uucccacaccuccaca

SEQ ID NO: 2548963 - RNA, 13 nt, Human
uucccaauugcuu

SEQ ID NO: 2548964 - RNA, 21 nt, Human
uucccacaccuccacaguuca

SEQ ID NO: 2548965 - RNA, 18 nt, Human
uucccacaggacauuucu

SEQ ID NO: 2548966 - RNA, 14 nt, Human
uucccaauucacau

SEQ ID NO: 2548967 - RNA, 23 nt, Human
uucccaauagcaacguagcuucu

SEQ ID NO: 2548968 - RNA, 14 nt, Human
uucccaauuaggaa

SEQ ID NO: 2548969 - RNA, 15 nt, Human
uucccacccaucgcu

SEQ ID NO: 2548970 - RNA, 22 nt, Human
uucccaccucucucacuccuug

SEQ ID NO: 2548971 - RNA, 12 nt, Human
uucccaccucuc

SEQ ID NO: 2548972 - RNA, 15 nt, Human
uucccaccaaggucu

SEQ ID NO: 2548973 - RNA, 18 nt, Human
uucccaccaggcugcuca

SEQ ID NO: 2548974 - RNA, 22 nt, Human
uuccagugaggcucugcccuug

SEQ ID NO: 2548975 - RNA, 21 nt, Human
uuccagugaggcucugcccuu

SEQ ID NO: 2548976 - RNA, 20 nt, Human
uuccagugaggcucugcccu

SEQ ID NO: 2548977 - RNA, 19 nt, Human
uuccagugaggcucugccc

SEQ ID NO: 2548978 - RNA, 19 nt, Human
uuccagggucccucugugu

SEQ ID NO: 2548979 - RNA, 18 nt, Human
uuccagggucccucugug

SEQ ID NO: 2548980 - RNA, 16 nt, Human
uuccagggucccucug

SEQ ID NO: 2548981 - RNA, 21 nt, Human
uuccaggggugggacacccug

SEQ ID NO: 2548982 - RNA, 17 nt, Human
uuccagugaggcucugc

SEQ ID NO: 2548983 - RNA, 20 nt, Human
uuccagggucccucugugua

SEQ ID NO: 2548984 - RNA, 17 nt, Human
uuccagguaucuccagg

SEQ ID NO: 2548985 - RNA, 15 nt, Human
uuccaggugggguga

SEQ ID NO: 2548986 - RNA, 19 nt, Human
uuccagguaucuccaggau

SEQ ID NO: 2548987 - RNA, 18 nt, Human
uuccagguaucuccagga

SEQ ID NO: 2548988 - RNA, 23 nt, Human
uucccaaagcagugcaugcuguc

SEQ ID NO: 2548989 - RNA, 20 nt, Human
uucccaaaggacuccaccca

SEQ ID NO: 2548990 - RNA, 19 nt, Human
uucccaaaggacuccaccc

SEQ ID NO: 2548991 - RNA, 17 nt, Human
uucccaaaggacuccac

SEQ ID NO: 2548992 - RNA, 16 nt, Human
uucccaaaggacucca

SEQ ID NO: 2548993 - RNA, 15 nt, Human
uuccauacagcucua

SEQ ID NO: 2548994 - RNA, 18 nt, Human
uuccauaauuaugacagu

SEQ ID NO: 2548995 - RNA, 22 nt, Human
uuccauaauuaugacaguuaua

SEQ ID NO: 2548996 - RNA, 17 nt, Human
uuccauaaggaauguag

SEQ ID NO: 2548997 - RNA, 19 nt, Human
uuccauaaggaauguagcu

SEQ ID NO: 2548998 - RNA, 16 nt, Human
uuccauaauguauaaa

SEQ ID NO: 2548999 - RNA, 19 nt, Human
uuccauaauguauaaagaa

SEQ ID NO: 2549000 - RNA, 12 nt, Human
uuccauaauuau

SEQ ID NO: 2549001 - RNA, 13 nt, Human
uuccauaauuaug

SEQ ID NO: 2549002 - RNA, 14 nt, Human
uuccauaauuauga

SEQ ID NO: 2549003 - RNA, 16 nt, Human
uuccauaauuaugaca

SEQ ID NO: 2549004 - RNA, 23 nt, Human
uuccauaaucuggacuccucugu

SEQ ID NO: 2549005 - RNA, 22 nt, Human
uuccauaaucuggacuccucug

SEQ ID NO: 2549006 - RNA, 19 nt, Human
uuccauaaucuggacuccu

SEQ ID NO: 2549007 - RNA, 22 nt, Human
uuccauaaagaagauguuuaac

SEQ ID NO: 2549008 - RNA, 18 nt, Human
uuccauaaagaagauguu

SEQ ID NO: 2549009 - RNA, 11 nt, Human
uuccaguuccc

SEQ ID NO: 2549010 - RNA, 15 nt, Human
uuccauaaacaccca

SEQ ID NO: 2549011 - RNA, 18 nt, Human
uuccaguguccuuagaac

SEQ ID NO: 2549012 - RNA, 23 nt, Human
uuccagugguccauggaaugcuu

SEQ ID NO: 2549013 - RNA, 15 nt, Human
uuccagugcaacacu

SEQ ID NO: 2549014 - RNA, 19 nt, Human
uuccagugcaacacugaag

SEQ ID NO: 2549015 - RNA, 21 nt, Human
uuccagugcaacacugaagcu

SEQ ID NO: 2549016 - RNA, 17 nt, Human
uuccaggggugggacac

SEQ ID NO: 2549017 - RNA, 23 nt, Human
uuccaggaaacuccacaucugcc

SEQ ID NO: 2549018 - RNA, 21 nt, Human
uuccaggcuaaacauccaaua

SEQ ID NO: 2549019 - RNA, 14 nt, Human
uuccagcuccugua

SEQ ID NO: 2549020 - RNA, 11 nt, Human
uuccagcuccu

SEQ ID NO: 2549021 - RNA, 18 nt, Human
uuccagcuggaugagaau

SEQ ID NO: 2549022 - RNA, 24 nt, Human
uuccaggaaacuccacaucugccu

SEQ ID NO: 2549023 - RNA, 22 nt, Human
uuccaggaaacuccacaucugc

SEQ ID NO: 2549024 - RNA, 13 nt, Human
uuccagcuccuca

SEQ ID NO: 2549025 - RNA, 21 nt, Human
uuccaggaaacuccacaucug

SEQ ID NO: 2549026 - RNA, 21 nt, Human
uuccacaccuggcacugcugu

SEQ ID NO: 2549027 - RNA, 18 nt, Human
uuccaccaucaagccacc

SEQ ID NO: 2549028 - RNA, 12 nt, Human
uuccacccccuc

SEQ ID NO: 2549029 - RNA, 13 nt, Human
uuccacccccucc

SEQ ID NO: 2549030 - RNA, 12 nt, Human
uuccaccucccu

SEQ ID NO: 2549031 - RNA, 15 nt, Human
uuccaccucacccca

SEQ ID NO: 2549032 - RNA, 13 nt, Human
uuccaccucaccc

SEQ ID NO: 2549033 - RNA, 23 nt, Human
uuccagcucaccccccacacuca

SEQ ID NO: 2549034 - RNA, 20 nt, Human
uuccagcucaccccccacac

SEQ ID NO: 2549035 - RNA, 14 nt, Human
uuccacccccuccc

SEQ ID NO: 2549036 - RNA, 15 nt, Human
uuccacccccucccu

SEQ ID NO: 2549037 - RNA, 18 nt, Human
uuccacccccucccuggc

SEQ ID NO: 2549038 - RNA, 20 nt, Human
uuccacccccucccuggccu

SEQ ID NO: 2549039 - RNA, 11 nt, Human
uuccacccugg

SEQ ID NO: 2549040 - RNA, 13 nt, Human
uuccacccuggaa

SEQ ID NO: 2549041 - RNA, 22 nt, Human
uuccacaagagcccaggccucc

SEQ ID NO: 2549042 - RNA, 21 nt, Human
uuccaauaaaccagguuuaga

SEQ ID NO: 2549043 - RNA, 13 nt, Human
uuccaauaaacca

SEQ ID NO: 2549044 - RNA, 13 nt, Human
uuccaauaaacag

SEQ ID NO: 2549045 - RNA, 22 nt, Human
uuccaagugugcauauuguaca

SEQ ID NO: 2549046 - RNA, 16 nt, Human
uuccaauaugaugacu

SEQ ID NO: 2549047 - RNA, 20 nt, Human
uuccaagugugcauauugua

SEQ ID NO: 2549048 - RNA, 14 nt, Human
uuccaagugugcau

SEQ ID NO: 2549049 - RNA, 16 nt, Human
uuccaaguugcuaaua

SEQ ID NO: 2549050 - RNA, 12 nt, Human
uuccaagugugc

SEQ ID NO: 2549051 - RNA, 20 nt, Human
uuccaagguggucugcucgg

SEQ ID NO: 2549052 - RNA, 13 nt, Human
uuccaaggcuucu

SEQ ID NO: 2549053 - RNA, 16 nt, Human
uuccaaggaguuccau

SEQ ID NO: 2549054 - RNA, 13 nt, Human
uuccaaugucugc

SEQ ID NO: 2549055 - RNA, 19 nt, Human
uuccacaagauucccagag

SEQ ID NO: 2549056 - RNA, 20 nt, Human
uuccacaagauucccagaga

SEQ ID NO: 2549057 - RNA, 21 nt, Human
uuccacaagauucccagagac

SEQ ID NO: 2549058 - RNA, 15 nt, Human
uuccacacccccacc

SEQ ID NO: 2549059 - RNA, 13 nt, Human
uuccacaccccca

SEQ ID NO: 2549060 - RNA, 18 nt, Human
uuccacaccaagcagcaa

SEQ ID NO: 2549061 - RNA, 17 nt, Human
uuccacacccccacccc

SEQ ID NO: 2549062 - RNA, 16 nt, Human
uuccacacccccaccc

SEQ ID NO: 2549063 - RNA, 19 nt, Human
uuccacaccuagcaucuca

SEQ ID NO: 2549064 - RNA, 19 nt, Human
uuccaccaucaagccacca

SEQ ID NO: 2549065 - RNA, 19 nt, Human
uuccacaccuggcacugcu

SEQ ID NO: 2549066 - RNA, 22 nt, Human
uuccacacccccaccccuugcu

SEQ ID NO: 2549067 - RNA, 15 nt, Human
uuccacaccuuuuau

SEQ ID NO: 2549068 - RNA, 22 nt, Human
uuccacaccuuuuauugacaca

SEQ ID NO: 2549069 - RNA, 18 nt, Human
uuccacacucaccucuaa

SEQ ID NO: 2549070 - RNA, 16 nt, Human
uucauuccauucugga

SEQ ID NO: 2549071 - RNA, 22 nt, Human
uucauucaugucauguguacaa

SEQ ID NO: 2549072 - RNA, 18 nt, Human
uucauuccuaacacagca

SEQ ID NO: 2549073 - RNA, 15 nt, Human
uucauucuccugccu

SEQ ID NO: 2549074 - RNA, 13 nt, Human
uucauucuccugc

SEQ ID NO: 2549075 - RNA, 17 nt, Human
uucauuguaauguuacu

SEQ ID NO: 2549076 - RNA, 18 nt, Human
uucauuguaauguuacug

SEQ ID NO: 2549077 - RNA, 20 nt, Human
uucauuguaauguuacugau

SEQ ID NO: 2549078 - RNA, 15 nt, Human
auauguggaguucau

SEQ ID NO: 2549079 - RNA, 21 nt, Human
auaugugaauccucuucuuua

SEQ ID NO: 2549080 - RNA, 18 nt, Human
auaugugcuggaauucua

SEQ ID NO: 2549081 - RNA, 16 nt, Human
auauguggaguucauc

SEQ ID NO: 2549082 - RNA, 9 nt, Human
uucauucag

SEQ ID NO: 2549083 - RNA, 19 nt, Human
auaugugcuggaauucuaa

SEQ ID NO: 2549084 - RNA, 18 nt, Human
auaugugcuugccucagu

SEQ ID NO: 2549085 - RNA, 19 nt, Human
uucauuuacuguggcuucu

SEQ ID NO: 2549086 - RNA, 16 nt, Human
uucauuuacuguggcu

SEQ ID NO: 2549087 - RNA, 18 nt, Human
uucauuuaggugaggaag

SEQ ID NO: 2549088 - RNA, 13 nt, Human
uuccaagagccug

SEQ ID NO: 2549089 - RNA, 21 nt, Human
uucauuuagcuaaacggauuc

SEQ ID NO: 2549090 - RNA, 16 nt, Human
uucauuuaaaaugauu

SEQ ID NO: 2549091 - RNA, 15 nt, Human
uucauuuaaaaugau

SEQ ID NO: 2549092 - RNA, 14 nt, Human
uucauuuaaaauga

SEQ ID NO: 2549093 - RNA, 13 nt, Human
uucauuuaaaaug

SEQ ID NO: 2549094 - RNA, 14 nt, Human
uucauuguaugaug

SEQ ID NO: 2549095 - RNA, 17 nt, Human
uucauuuaaaaugauua

SEQ ID NO: 2549096 - RNA, 13 nt, Human
uucauuuacugug

SEQ ID NO: 2549097 - RNA, 16 nt, Human
uucauuguaugaugug

SEQ ID NO: 2549098 - RNA, 13 nt, Human
uucauuguauaaa

SEQ ID NO: 2549099 - RNA, 17 nt, Human
uucauuguauaaaaaua

SEQ ID NO: 2549100 - RNA, 15 nt, Human
uuccaaggguacuaa

SEQ ID NO: 2549101 - RNA, 17 nt, Human
uuccaaggguacuaagg

SEQ ID NO: 2549102 - RNA, 14 nt, Human
uuccaagagccuga

SEQ ID NO: 2549103 - RNA, 22 nt, Human
uuccaagagccugagagugagg

SEQ ID NO: 2549104 - RNA, 13 nt, Human
uuccaagagcuga

SEQ ID NO: 2549105 - RNA, 12 nt, Human
uuccaagagcug

SEQ ID NO: 2549106 - RNA, 14 nt, Human
auauguacaugaga

SEQ ID NO: 2549107 - RNA, 14 nt, Human
auauguaccaugua

SEQ ID NO: 2549108 - RNA, 19 nt, Human
auauguaccauguacauga

SEQ ID NO: 2549109 - RNA, 19 nt, Human
auaugugaacauuuaucaa

SEQ ID NO: 2549110 - RNA, 11 nt, Human
auaugugaauc

SEQ ID NO: 2549111 - RNA, 20 nt, Human
auauguaaaauaaaauuaug

SEQ ID NO: 2549112 - RNA, 17 nt, Human
auauguaacaagccacc

SEQ ID NO: 2549113 - RNA, 21 nt, Human
auaugauuaguaaagaaauga

SEQ ID NO: 2549114 - RNA, 12 nt, Human
auauguaaaaua

SEQ ID NO: 2549115 - RNA, 16 nt, Human
auauguaacaagccac

SEQ ID NO: 2549116 - RNA, 13 nt, Human
auauguaaaauaa

SEQ ID NO: 2549117 - RNA, 14 nt, Human
auauguaaaauaaa

SEQ ID NO: 2549118 - RNA, 15 nt, Human
auauguaaaauaaaa

SEQ ID NO: 2549119 - RNA, 16 nt, Human
auauguaaaauaaaau

SEQ ID NO: 2549120 - RNA, 15 nt, Human
auaugauauugcaua

SEQ ID NO: 2549121 - RNA, 16 nt, Human
auaugauauugcauau

SEQ ID NO: 2549122 - RNA, 13 nt, Human
auaugcacacauu

SEQ ID NO: 2549123 - RNA, 19 nt, Human
auaugaguuucauagcuaa

SEQ ID NO: 2549124 - RNA, 17 nt, Human
auaugaguuucauagcu

SEQ ID NO: 2549125 - RNA, 23 nt, Human
auaugaguguggaagccggaggg

SEQ ID NO: 2549126 - RNA, 20 nt, Human
auaugaguguggaagccgga

SEQ ID NO: 2549127 - RNA, 14 nt, Human
auaugauauguaaa

SEQ ID NO: 2549128 - RNA, 21 nt, Human
auaugaguuucauagcuaaga

SEQ ID NO: 2549129 - RNA, 16 nt, Human
auaugauauguaaaca

SEQ ID NO: 2549130 - RNA, 20 nt, Human
auaugagcuuuauguaauaa

SEQ ID NO: 2549131 - RNA, 23 nt, Human
auaugaaaauacaacuuaaauaa

SEQ ID NO: 2549132 - RNA, 23 nt, Human
auaugaggaugcagagucagcag

SEQ ID NO: 2549133 - RNA, 14 nt, Human
auaugcacacauuu

SEQ ID NO: 2549134 - RNA, 15 nt, Human
auaugcacacauuuu

SEQ ID NO: 2549135 - RNA, 16 nt, Human
auaugcacacauuuuu

SEQ ID NO: 2549136 - RNA, 22 nt, Human
auauggguugcauuuggucaag

SEQ ID NO: 2549137 - RNA, 12 nt, Human
auaucucaucuc

SEQ ID NO: 2549138 - RNA, 16 nt, Human
auaucugaaaauguau

SEQ ID NO: 2549139 - RNA, 17 nt, Human
auaucugaaaauguaug

SEQ ID NO: 2549140 - RNA, 20 nt, Human
auaucugaaaauguaugugu

SEQ ID NO: 2549141 - RNA, 13 nt, Human
auaucuuuauuaa

SEQ ID NO: 2549142 - RNA, 16 nt, Human
auaucuuuauuaauca

SEQ ID NO: 2549143 - RNA, 16 nt, Human
auaugaaaauacaacu

SEQ ID NO: 2549144 - RNA, 18 nt, Human
auaugaaaaauaugauau

SEQ ID NO: 2549145 - RNA, 19 nt, Human
auaugaaaaauaugauauu

SEQ ID NO: 2549146 - RNA, 20 nt, Human
auaugaaaaaaaugcauuuu

SEQ ID NO: 2549147 - RNA, 14 nt, Human
auaucuuuugaccu

SEQ ID NO: 2549148 - RNA, 13 nt, Human
auaugaaaaauau

SEQ ID NO: 2549149 - RNA, 14 nt, Human
auaugaaaaauaug

SEQ ID NO: 2549150 - RNA, 17 nt, Human
auaugaaaaauaugaua

SEQ ID NO: 2549151 - RNA, 23 nt, Human
auaucuauauauaauucuguaca

SEQ ID NO: 2549152 - RNA, 20 nt, Human
auaucuauauauaauucugu

SEQ ID NO: 2549153 - RNA, 17 nt, Human
auaucuauauauaauuc

SEQ ID NO: 2549154 - RNA, 17 nt, Human
auaucuauauguacuug

SEQ ID NO: 2549155 - RNA, 21 nt, Human
auaucuauauauaauucugua

SEQ ID NO: 2549156 - RNA, 16 nt, Human
auaucuauauauaauu

SEQ ID NO: 2549157 - RNA, 14 nt, Human
auaucuauauauaa

SEQ ID NO: 2549158 - RNA, 14 nt, Human
auauauuuuaagac

SEQ ID NO: 2549159 - RNA, 21 nt, Human
auauauuuguguauuuaacag

SEQ ID NO: 2549160 - RNA, 17 nt, Human
auauauuuguguauuua

SEQ ID NO: 2549161 - RNA, 22 nt, Human
auauauuuguguauuuaacagg

SEQ ID NO: 2549162 - RNA, 15 nt, Human
auauauguguaugua

SEQ ID NO: 2549163 - RNA, 13 nt, Human
auauauguguaug

SEQ ID NO: 2549164 - RNA, 14 nt, Human
auauaugugaugau

SEQ ID NO: 2549165 - RNA, 19 nt, Human
auauauguguguguauguu

SEQ ID NO: 2549166 - RNA, 16 nt, Human
auauauguguguguau

SEQ ID NO: 2549167 - RNA, 21 nt, Human
auauauguguguuuaaauaaa

SEQ ID NO: 2549168 - RNA, 20 nt, Human
auauauguguguuuaaauaa

SEQ ID NO: 2549169 - RNA, 18 nt, Human
auauauguguguuuaaau

SEQ ID NO: 2549170 - RNA, 16 nt, Human
auauauguguguuuaa

SEQ ID NO: 2549171 - RNA, 12 nt, Human
auauauugcugc

SEQ ID NO: 2549172 - RNA, 15 nt, Human
auauauucccaauag

SEQ ID NO: 2549173 - RNA, 14 nt, Human
auauauugaauuaa

SEQ ID NO: 2549174 - RNA, 13 nt, Human
auauauugaauua

SEQ ID NO: 2549175 - RNA, 21 nt, Human
auauauugguaacauccuuuc

SEQ ID NO: 2549176 - RNA, 19 nt, Human
auauauugguaacauccuu

SEQ ID NO: 2549177 - RNA, 12 nt, Human
auauauuuaaaa

SEQ ID NO: 2549178 - RNA, 13 nt, Human
auauauuuuaaga

SEQ ID NO: 2549179 - RNA, 12 nt, Human
auauauuuuaag

SEQ ID NO: 2549180 - RNA, 13 nt, Human
auauauuuaauga

SEQ ID NO: 2549181 - RNA, 15 nt, Human
auauauuuaaugaua

SEQ ID NO: 2549182 - RNA, 13 nt, Human
auauauuugugua

SEQ ID NO: 2549183 - RNA, 14 nt, Human
auauauuucuuugu

SEQ ID NO: 2549184 - RNA, 23 nt, Human
uucauccacucugccugcuuaca

SEQ ID NO: 2549185 - RNA, 20 nt, Human
uucauauuguggcacaagca

SEQ ID NO: 2549186 - RNA, 15 nt, Human
uucauccacuagugc

SEQ ID NO: 2549187 - RNA, 19 nt, Human
uucaucccaacugucuuuu

SEQ ID NO: 2549188 - RNA, 22 nt, Human
uucauauugugccaauauguau

SEQ ID NO: 2549189 - RNA, 16 nt, Human
uucauauugugccaau

SEQ ID NO: 2549190 - RNA, 14 nt, Human
uucauauugugcca

SEQ ID NO: 2549191 - RNA, 12 nt, Human
uucauauugugc

SEQ ID NO: 2549192 - RNA, 17 nt, Human
uucaucccucuggggcu

SEQ ID NO: 2549193 - RNA, 21 nt, Human
uucaucccaugauguagugcc

SEQ ID NO: 2549194 - RNA, 19 nt, Human
uucaucccaugauguagug

SEQ ID NO: 2549195 - RNA, 18 nt, Human
uucaucccaugauguagu

SEQ ID NO: 2549196 - RNA, 16 nt, Human
uucaucccaugaugua

SEQ ID NO: 2549197 - RNA, 12 nt, Human
auauauguguau

SEQ ID NO: 2549198 - RNA, 18 nt, Human
auauaugugaacauuuau

SEQ ID NO: 2549199 - RNA, 12 nt, Human
auauaugugaac

SEQ ID NO: 2549200 - RNA, 12 nt, Human
auauauguauuu

SEQ ID NO: 2549201 - RNA, 21 nt, Human
uucaucccucuggggcuguuc

SEQ ID NO: 2549202 - RNA, 13 nt, Human
uucagugccuuau

SEQ ID NO: 2549203 - RNA, 12 nt, Human
uucagugccuua

SEQ ID NO: 2549204 - RNA, 16 nt, Human
uucagugccaaaaaca

SEQ ID NO: 2549205 - RNA, 21 nt, Human
uucagaaaugcugccugccug

SEQ ID NO: 2549206 - RNA, 20 nt, Human
uucagaaaugcugccugccu

SEQ ID NO: 2549207 - RNA, 19 nt, Human
uucagaaaugcugccugcc

SEQ ID NO: 2549208 - RNA, 18 nt, Human
uucagaaaugcugccugc

SEQ ID NO: 2549209 - RNA, 13 nt, Human
uucagugccaaua

SEQ ID NO: 2549210 - RNA, 22 nt, Human
uucagaaaugcugccugccugu

SEQ ID NO: 2549211 - RNA, 10 nt, Human
uucagugccc

SEQ ID NO: 2549212 - RNA, 14 nt, Human
uucagugcccacca

SEQ ID NO: 2549213 - RNA, 11 nt, Human
uucagaaaugu

SEQ ID NO: 2549214 - RNA, 13 nt, Human
uucagaaaugugu

SEQ ID NO: 2549215 - RNA, 16 nt, Human
uucagaaagugugcuu

SEQ ID NO: 2549216 - RNA, 18 nt, Human
uucagaaagugugcuuua

SEQ ID NO: 2549217 - RNA, 20 nt, Human
uucagaaagcauuacauuuc

SEQ ID NO: 2549218 - RNA, 17 nt, Human
uucagaaaugcugccug

SEQ ID NO: 2549219 - RNA, 16 nt, Human
uucagaaaugcugccu

SEQ ID NO: 2549220 - RNA, 15 nt, Human
uucagaaaugcugcc

SEQ ID NO: 2549221 - RNA, 13 nt, Human
uucagaaauaugu

SEQ ID NO: 2549222 - RNA, 18 nt, Human
uucagugccuuauggaac

SEQ ID NO: 2549223 - RNA, 19 nt, Human
uucauaauuauuauuuggc

SEQ ID NO: 2549224 - RNA, 21 nt, Human
uucauacagggaugguguuca

SEQ ID NO: 2549225 - RNA, 12 nt, Human
uucauacaaggc

SEQ ID NO: 2549226 - RNA, 18 nt, Human
uucauacacagccugggc

SEQ ID NO: 2549227 - RNA, 13 nt, Human
uucauaugcugua

SEQ ID NO: 2549228 - RNA, 13 nt, Human
uucauauguugcu

SEQ ID NO: 2549229 - RNA, 20 nt, Human
uucauauguaccauguacau

SEQ ID NO: 2549230 - RNA, 16 nt, Human
uucauauguugcucag

SEQ ID NO: 2549231 - RNA, 14 nt, Human
uucauauguugcuc

SEQ ID NO: 2549232 - RNA, 18 nt, Human
uucauauguugcucaguc

SEQ ID NO: 2549233 - RNA, 18 nt, Human
uucauauugcugagagaa

SEQ ID NO: 2549234 - RNA, 14 nt, Human
uucauauugaauau

SEQ ID NO: 2549235 - RNA, 19 nt, Human
uugaaauauugacuuuuua

SEQ ID NO: 2549236 - RNA, 20 nt, Human
uugaaauauaggaacuuaaa

SEQ ID NO: 2549237 - RNA, 11 nt, Human
uugaaaucuuu

SEQ ID NO: 2549238 - RNA, 13 nt, Human
uugaaaucuuuua

SEQ ID NO: 2549239 - RNA, 15 nt, Human
uugaaaucuguaucu

SEQ ID NO: 2549240 - RNA, 21 nt, Human
uugaaaugaaaguauaacuga

SEQ ID NO: 2549241 - RNA, 21 nt, Human
uugaaauuuuuauuaaauuau

SEQ ID NO: 2549242 - RNA, 12 nt, Human
uugaaauuuuaa

SEQ ID NO: 2549243 - RNA, 19 nt, Human
uugaaauuguuuaaguguu

SEQ ID NO: 2549244 - RNA, 15 nt, Human
uugaacacaaacugu

SEQ ID NO: 2549245 - RNA, 18 nt, Human
uugaacacaaacuguaaa

SEQ ID NO: 2549246 - RNA, 14 nt, Human
uugaacacaaacug

SEQ ID NO: 2549247 - RNA, 20 nt, Human
uugaacaaguuguuucauug

SEQ ID NO: 2549248 - RNA, 17 nt, Human
uugaaaguuuucagaac

SEQ ID NO: 2549249 - RNA, 15 nt, Human
uugaaauaauaaauc

SEQ ID NO: 2549250 - RNA, 18 nt, Human
uucuuuuucuucuucccu

SEQ ID NO: 2549251 - RNA, 16 nt, Human
uucuuuuuauuuucuu

SEQ ID NO: 2549252 - RNA, 16 nt, Human
uugaaaguuuacagga

SEQ ID NO: 2549253 - RNA, 12 nt, Human
uucuuuuaucac

SEQ ID NO: 2549254 - RNA, 17 nt, Human
uucuuuucacauucuua

SEQ ID NO: 2549255 - RNA, 15 nt, Human
uucuuuucacauucu

SEQ ID NO: 2549256 - RNA, 12 nt, Human
uucuuuucacau

SEQ ID NO: 2549257 - RNA, 19 nt, Human
uucuuuuacucaugaucuu

SEQ ID NO: 2549258 - RNA, 20 nt, Human
uucuuuucacauucuuauaa

SEQ ID NO: 2549259 - RNA, 19 nt, Human
uucuuuucacauucuuaua

SEQ ID NO: 2549260 - RNA, 18 nt, Human
uucuuuuguauguaaaug

SEQ ID NO: 2549261 - RNA, 14 nt, Human
uucuuuuguaugua

SEQ ID NO: 2549262 - RNA, 13 nt, Human
uucuuuuguaauu

SEQ ID NO: 2549263 - RNA, 20 nt, Human
uucuuuuguauguaaaugug

SEQ ID NO: 2549264 - RNA, 15 nt, Human
uucuuuuuauuuucu

SEQ ID NO: 2549265 - RNA, 15 nt, Human
uucuuuuuauugaau

SEQ ID NO: 2549266 - RNA, 19 nt, Human
auccuaauuucuccucccu

SEQ ID NO: 2549267 - RNA, 18 nt, Human
auccuaauuucuccuccc

SEQ ID NO: 2549268 - RNA, 16 nt, Human
auccuaauuucuccuc

SEQ ID NO: 2549269 - RNA, 15 nt, Human
auccuaauuucuccu

SEQ ID NO: 2549270 - RNA, 19 nt, Human
auccuaaugaaugcauaaa

SEQ ID NO: 2549271 - RNA, 21 nt, Human
auccuaaugacuucuaaaaau

SEQ ID NO: 2549272 - RNA, 19 nt, Human
auccuaaucauccaaugcu

SEQ ID NO: 2549273 - RNA, 13 nt, Human
auccuaaugaaug

SEQ ID NO: 2549274 - RNA, 12 nt, Human
auccuaaugaau

SEQ ID NO: 2549275 - RNA, 23 nt, Human
auccuagucucuaucauuaaagu

SEQ ID NO: 2549276 - RNA, 20 nt, Human
auccuagucucuaucauuaa

SEQ ID NO: 2549277 - RNA, 13 nt, Human
auccuaguuccac

SEQ ID NO: 2549278 - RNA, 23 nt, Human
auccuaauuucuccucccuuccu

SEQ ID NO: 2549279 - RNA, 20 nt, Human
auccuaauuucuccucccuu

SEQ ID NO: 2549280 - RNA, 13 nt, Human
auccuagggccug

SEQ ID NO: 2549281 - RNA, 17 nt, Human
auccuagggccuggguu

SEQ ID NO: 2549282 - RNA, 20 nt, Human
auccuagguaggguuuaauc

SEQ ID NO: 2549283 - RNA, 21 nt, Human
auccuaggcauuugcugaaua

SEQ ID NO: 2549284 - RNA, 18 nt, Human
uugaacccgggaggcaga

SEQ ID NO: 2549285 - RNA, 16 nt, Human
uugaaccacuucccuc

SEQ ID NO: 2549286 - RNA, 20 nt, Human
uugaacacucaugcugaaag

SEQ ID NO: 2549287 - RNA, 13 nt, Human
uugaacacugggg

SEQ ID NO: 2549288 - RNA, 20 nt, Human
uugaacacaaacuguaaaua

SEQ ID NO: 2549289 - RNA, 21 nt, Human
uugaacacaaacuguaaauaa

SEQ ID NO: 2549290 - RNA, 19 nt, Human
uugaacacucaugcugaaa

SEQ ID NO: 2549291 - RNA, 18 nt, Human
uugaacacucaugcugaa

SEQ ID NO: 2549292 - RNA, 13 nt, Human
uugaacccaggag

SEQ ID NO: 2549293 - RNA, 21 nt, Human
auccuaagcuauucaguaaua

SEQ ID NO: 2549294 - RNA, 12 nt, Human
uugaacccagga

SEQ ID NO: 2549295 - RNA, 17 nt, Human
uugaacccaggaguuca

SEQ ID NO: 2549296 - RNA, 12 nt, Human
uucuugcaaagu

SEQ ID NO: 2549297 - RNA, 16 nt, Human
uucuugauguugcuua

SEQ ID NO: 2549298 - RNA, 21 nt, Human
uucuugaucaacaucuuuucu

SEQ ID NO: 2549299 - RNA, 21 nt, Human
uucuugaauuuaauaaucugu

SEQ ID NO: 2549300 - RNA, 22 nt, Human
uucuuccuuaauucacucccac

SEQ ID NO: 2549301 - RNA, 18 nt, Human
uucuuggagucuuccaaa

SEQ ID NO: 2549302 - RNA, 14 nt, Human
uucuugcugguugu

SEQ ID NO: 2549303 - RNA, 20 nt, Human
uucuuggggcccuacaccuu

SEQ ID NO: 2549304 - RNA, 14 nt, Human
uucuugggcccucc

SEQ ID NO: 2549305 - RNA, 13 nt, Human
uucuugcaaagua

SEQ ID NO: 2549306 - RNA, 23 nt, Human
uucuugcugguugucauuuuugc

SEQ ID NO: 2549307 - RNA, 18 nt, Human
uucuugguucauaaauga

SEQ ID NO: 2549308 - RNA, 17 nt, Human
uucuugguucauaaaug

SEQ ID NO: 2549309 - RNA, 21 nt, Human
uucuuggugcuuacacaucuc

SEQ ID NO: 2549310 - RNA, 15 nt, Human
uucuugguagagauu

SEQ ID NO: 2549311 - RNA, 16 nt, Human
uucuugguagagauuc

SEQ ID NO: 2549312 - RNA, 14 nt, Human
uucuugguagagau

SEQ ID NO: 2549313 - RNA, 18 nt, Human
uucuuggggcccuacacc

SEQ ID NO: 2549314 - RNA, 22 nt, Human
uucuuucuggcuaugcauuuga

SEQ ID NO: 2549315 - RNA, 15 nt, Human
uucuuucuuagaaau

SEQ ID NO: 2549316 - RNA, 14 nt, Human
uucuuucuuagaaa

SEQ ID NO: 2549317 - RNA, 19 nt, Human
uucuugguucauaaaugaa

SEQ ID NO: 2549318 - RNA, 13 nt, Human
uucuuucuuagaa

SEQ ID NO: 2549319 - RNA, 15 nt, Human
uucuuucuuccucug

SEQ ID NO: 2549320 - RNA, 13 nt, Human
uucuuucuuccuc

SEQ ID NO: 2549321 - RNA, 16 nt, Human
uucuuuguaaugaaaa

SEQ ID NO: 2549322 - RNA, 16 nt, Human
uucuuucuuugggaau

SEQ ID NO: 2549323 - RNA, 20 nt, Human
uucuuucuuagaaauuuauu

SEQ ID NO: 2549324 - RNA, 15 nt, Human
uucuuugaaauuguu

SEQ ID NO: 2549325 - RNA, 21 nt, Human
uucuuuuaaaggggcagaaaa

SEQ ID NO: 2549326 - RNA, 16 nt, Human
uucuuuguuacaggca

SEQ ID NO: 2549327 - RNA, 12 nt, Human
uucuuuguguag

SEQ ID NO: 2549328 - RNA, 19 nt, Human
uucuuuguguagcuuugcu

SEQ ID NO: 2549329 - RNA, 18 nt, Human
uucuguucuuucuggcua

SEQ ID NO: 2549330 - RNA, 15 nt, Human
uucuguugcugccuc

SEQ ID NO: 2549331 - RNA, 16 nt, Human
uucuguugcugccuca

SEQ ID NO: 2549332 - RNA, 23 nt, Human
aucccacccacaugugacacaua

SEQ ID NO: 2549333 - RNA, 20 nt, Human
aucccacccacaugugacac

SEQ ID NO: 2549334 - RNA, 18 nt, Human
aucccacccacaugugac

SEQ ID NO: 2549335 - RNA, 15 nt, Human
aucccacccacaugu

SEQ ID NO: 2549336 - RNA, 18 nt, Human
aucccacgcuucucuuug

SEQ ID NO: 2549337 - RNA, 16 nt, Human
aucccacgcacuccau

SEQ ID NO: 2549338 - RNA, 21 nt, Human
uucuguuuugccugaaguugg

SEQ ID NO: 2549339 - RNA, 18 nt, Human
aucccacgcacuccauga

SEQ ID NO: 2549340 - RNA, 17 nt, Human
aucccacgcacuccaug

SEQ ID NO: 2549341 - RNA, 16 nt, Human
aucccacgcuucucuu

SEQ ID NO: 2549342 - RNA, 17 nt, Human
uucuguuuugccugaag

SEQ ID NO: 2549343 - RNA, 17 nt, Human
uucuguugcugccucau

SEQ ID NO: 2549344 - RNA, 16 nt, Human
uucuguuuugccugaa

SEQ ID NO: 2549345 - RNA, 21 nt, Human
uucuuaaaauauauuucagau

SEQ ID NO: 2549346 - RNA, 20 nt, Human
uucuguuuuucuaggccugg

SEQ ID NO: 2549347 - RNA, 13 nt, Human
uucuuccucugcu

SEQ ID NO: 2549348 - RNA, 12 nt, Human
uucuuccucugc

SEQ ID NO: 2549349 - RNA, 11 nt, Human
uucuuccucug

SEQ ID NO: 2549350 - RNA, 16 nt, Human
uucuuacauaauuuuu

SEQ ID NO: 2549351 - RNA, 13 nt, Human
uucuuacauaauu

SEQ ID NO: 2549352 - RNA, 13 nt, Human
uucuuacagacug

SEQ ID NO: 2549353 - RNA, 14 nt, Human
uucuuaauugcacu

SEQ ID NO: 2549354 - RNA, 12 nt, Human
uucuuacaagga

SEQ ID NO: 2549355 - RNA, 23 nt, Human
uucuuccucccucccucuuuccc

SEQ ID NO: 2549356 - RNA, 23 nt, Human
uucuuaaucuuuucacaaauaaa

SEQ ID NO: 2549357 - RNA, 22 nt, Human
uucuuaaucuuuucacaaauaa

SEQ ID NO: 2549358 - RNA, 17 nt, Human
uucuuaaagucaagauu

SEQ ID NO: 2549359 - RNA, 13 nt, Human
uucuuaaagaguu

SEQ ID NO: 2549360 - RNA, 15 nt, Human
uucuuaaaauauauu

SEQ ID NO: 2549361 - RNA, 17 nt, Human
uucuuaaacaaauguau

SEQ ID NO: 2549362 - RNA, 13 nt, Human
uucuuaauucuua

SEQ ID NO: 2549363 - RNA, 20 nt, Human
uucuuaauugcacucuaaaa

SEQ ID NO: 2549364 - RNA, 15 nt, Human
uucuuacaaacaugu

SEQ ID NO: 2549365 - RNA, 23 nt, Human
auccauuugcguuccaugaugcu

SEQ ID NO: 2549366 - RNA, 14 nt, Human
aucccacccacaug

SEQ ID NO: 2549367 - RNA, 15 nt, Human
aucccaccaacccuc

SEQ ID NO: 2549368 - RNA, 14 nt, Human
aucccacacccugg

SEQ ID NO: 2549369 - RNA, 15 nt, Human
aucccaagugccagu

SEQ ID NO: 2549370 - RNA, 14 nt, Human
auccauacauuugu

SEQ ID NO: 2549371 - RNA, 21 nt, Human
auccauaaagaagcaauaaag

SEQ ID NO: 2549372 - RNA, 17 nt, Human
auccauaaagaagcaau

SEQ ID NO: 2549373 - RNA, 16 nt, Human
auccauaaagaagcaa

SEQ ID NO: 2549374 - RNA, 14 nt, Human
auccauaaagaagc

SEQ ID NO: 2549375 - RNA, 13 nt, Human
auccauaaagaag

SEQ ID NO: 2549376 - RNA, 23 nt, Human
uucucuaaaugaggggccucagg

SEQ ID NO: 2549377 - RNA, 13 nt, Human
auccauucuuucu

SEQ ID NO: 2549378 - RNA, 15 nt, Human
auccauucuuucuga

SEQ ID NO: 2549379 - RNA, 16 nt, Human
auccauucuuucugau

SEQ ID NO: 2549380 - RNA, 18 nt, Human
auccauuucaucuauuuc

SEQ ID NO: 2549381 - RNA, 20 nt, Human
auccauuucaucuauuucug

SEQ ID NO: 2549382 - RNA, 21 nt, Human
auccauuucaucuauuucuga

SEQ ID NO: 2549383 - RNA, 22 nt, Human
auccauuucaucuauuucugag

SEQ ID NO: 2549384 - RNA, 23 nt, Human
auccauuucaucuauuucugaga

SEQ ID NO: 2549385 - RNA, 13 nt, Human
auccaaaagcuuu

SEQ ID NO: 2549386 - RNA, 22 nt, Human
auccaaaagaagcccccagcua

SEQ ID NO: 2549387 - RNA, 18 nt, Human
auccaaaagaagccccca

SEQ ID NO: 2549388 - RNA, 19 nt, Human
auccaaaagaagcccccag

SEQ ID NO: 2549389 - RNA, 13 nt, Human
auccaaaagaagc

SEQ ID NO: 2549390 - RNA, 12 nt, Human
auccaagugaac

SEQ ID NO: 2549391 - RNA, 19 nt, Human
auccaaggagaaacagaga

SEQ ID NO: 2549392 - RNA, 22 nt, Human
auccaaggagaaacagagacag

SEQ ID NO: 2549393 - RNA, 20 nt, Human
auccaaacuuggauuuuuga

SEQ ID NO: 2549394 - RNA, 23 nt, Human
auccaagcuuuuuuaaaguaaaa

SEQ ID NO: 2549395 - RNA, 13 nt, Human
auccaaggagaaa

SEQ ID NO: 2549396 - RNA, 14 nt, Human
auccaaggagaaac

SEQ ID NO: 2549397 - RNA, 24 nt, Human
auccaauauuuucuuuaaugcuuu

SEQ ID NO: 2549398 - RNA, 19 nt, Human
auccaauauuuucuuuaau

SEQ ID NO: 2549399 - RNA, 22 nt, Human
auccaauauuuucuuuaaugcu

SEQ ID NO: 2549400 - RNA, 14 nt, Human
auccaauccucacu

SEQ ID NO: 2549401 - RNA, 17 nt, Human
auccaauccucacuggg

SEQ ID NO: 2549402 - RNA, 18 nt, Human
auccaauccucacugggu

SEQ ID NO: 2549403 - RNA, 19 nt, Human
auccaauccucacugggug

SEQ ID NO: 2549404 - RNA, 20 nt, Human
auccaaucuaaccacaucaa

SEQ ID NO: 2549405 - RNA, 20 nt, Human
auccaauccucacugggugg

SEQ ID NO: 2549406 - RNA, 22 nt, Human
auccaaugcucaagaaacaacu

SEQ ID NO: 2549407 - RNA, 16 nt, Human
aucauuuuuguacagu

SEQ ID NO: 2549408 - RNA, 15 nt, Human
aucauuuuuguacag

SEQ ID NO: 2549409 - RNA, 14 nt, Human
aucauuuuuguaca

SEQ ID NO: 2549410 - RNA, 13 nt, Human
aucauuuuuguac

SEQ ID NO: 2549411 - RNA, 22 nt, Human
aucauuuuuguacaguuugcug

SEQ ID NO: 2549412 - RNA, 20 nt, Human
aucauuuuuguacaguuugc

SEQ ID NO: 2549413 - RNA, 14 nt, Human
aucauuuuuguauc

SEQ ID NO: 2549414 - RNA, 22 nt, Human
uucuguagaaaugguuguauua

SEQ ID NO: 2549415 - RNA, 21 nt, Human
uucuguagaaaugguuguauu

SEQ ID NO: 2549416 - RNA, 20 nt, Human
uucuguagaaaugguuguau

SEQ ID NO: 2549417 - RNA, 18 nt, Human
uucuguagaaaugguugu

SEQ ID NO: 2549418 - RNA, 16 nt, Human
uucuguagguucugug

SEQ ID NO: 2549419 - RNA, 23 nt, Human
uucuguaaacucaaaacuuaaca

SEQ ID NO: 2549420 - RNA, 13 nt, Human
uucuguagauucu

SEQ ID NO: 2549421 - RNA, 21 nt, Human
uucuguauaaagccuguauuc

SEQ ID NO: 2549422 - RNA, 11 nt, Human
uucuguauaaa

SEQ ID NO: 2549423 - RNA, 15 nt, Human
uucuguagaaauggu

SEQ ID NO: 2549424 - RNA, 14 nt, Human
uucuguagaaaugg

SEQ ID NO: 2549425 - RNA, 20 nt, Human
uucuguaaacucaaaacuua

SEQ ID NO: 2549426 - RNA, 19 nt, Human
uucuguaaacucaaaacuu

SEQ ID NO: 2549427 - RNA, 13 nt, Human
uucuguagaaaug

SEQ ID NO: 2549428 - RNA, 17 nt, Human
uucuguaaaaugucugu

SEQ ID NO: 2549429 - RNA, 22 nt, Human
uucugguugaugccugugaacu

SEQ ID NO: 2549430 - RNA, 15 nt, Human
uucugccgcagcccu

SEQ ID NO: 2549431 - RNA, 14 nt, Human
uucugccgcagccc

SEQ ID NO: 2549432 - RNA, 18 nt, Human
uucuggcuaugcauuuga

SEQ ID NO: 2549433 - RNA, 20 nt, Human
uucuggcuaugcauuugaaa

SEQ ID NO: 2549434 - RNA, 17 nt, Human
uucuggcuccucaaaca

SEQ ID NO: 2549435 - RNA, 17 nt, Human
uucuggcucagggaggu

SEQ ID NO: 2549436 - RNA, 16 nt, Human
uucuggcucucccauu

SEQ ID NO: 2549437 - RNA, 20 nt, Human
uucugcccuggcugcugccc

SEQ ID NO: 2549438 - RNA, 10 nt, Human
uucuggcuca

SEQ ID NO: 2549439 - RNA, 21 nt, Human
uucuggugugaacuaaacuuu

SEQ ID NO: 2549440 - RNA, 14 nt, Human
uucuggugugaacu

SEQ ID NO: 2549441 - RNA, 22 nt, Human
uucuggcucucccauuuccuga

SEQ ID NO: 2549442 - RNA, 17 nt, Human
uucugguuccagggucc

SEQ ID NO: 2549443 - RNA, 15 nt, Human
uucugguuccagggu

SEQ ID NO: 2549444 - RNA, 20 nt, Human
uucuggugugaacuaaacuu

SEQ ID NO: 2549445 - RNA, 20 nt, Human
aucaggccaggcccucugcc

SEQ ID NO: 2549446 - RNA, 20 nt, Human
aucauugaaaucuuuuugcu

SEQ ID NO: 2549447 - RNA, 23 nt, Human
aucaggccaggcccucugcccac

SEQ ID NO: 2549448 - RNA, 22 nt, Human
aucaggccaggcccucugccca

SEQ ID NO: 2549449 - RNA, 21 nt, Human
aucaggccaggcccucugccc

SEQ ID NO: 2549450 - RNA, 21 nt, Human
aucauugaaaucuuuuugcuu

SEQ ID NO: 2549451 - RNA, 13 nt, Human
aucauugccuggu

SEQ ID NO: 2549452 - RNA, 22 nt, Human
aucauugcacucuagccugggc

SEQ ID NO: 2549453 - RNA, 21 nt, Human
aucauugcacucuagccuggg

SEQ ID NO: 2549454 - RNA, 18 nt, Human
aucauugauugucagcua

SEQ ID NO: 2549455 - RNA, 21 nt, Human
aucauuggauucugagagcug

SEQ ID NO: 2549456 - RNA, 22 nt, Human
aucauuggauucugagagcugu

SEQ ID NO: 2549457 - RNA, 13 nt, Human
aucauuuaauaau

SEQ ID NO: 2549458 - RNA, 12 nt, Human
aucauuuaauaa

SEQ ID NO: 2549459 - RNA, 23 nt, Human
aucauugcuuugaagcaguugug

SEQ ID NO: 2549460 - RNA, 13 nt, Human
aucauuguacagu

SEQ ID NO: 2549461 - RNA, 20 nt, Human
aucauuucugcaucagcugc

SEQ ID NO: 2549462 - RNA, 13 nt, Human
uucuccucccagg

SEQ ID NO: 2549463 - RNA, 15 nt, Human
aucauuucuauuucu

SEQ ID NO: 2549464 - RNA, 22 nt, Human
aucauuuauuuuuuacauuauu

SEQ ID NO: 2549465 - RNA, 19 nt, Human
aucauuuaauaauauacuu

SEQ ID NO: 2549466 - RNA, 18 nt, Human
aucauuuaauaauauacu

SEQ ID NO: 2549467 - RNA, 17 nt, Human
aucauuuaauaauauac

SEQ ID NO: 2549468 - RNA, 14 nt, Human
aucauuuaauaaua

SEQ ID NO: 2549469 - RNA, 21 nt, Human
aucauuuaauaauauacuugu

SEQ ID NO: 2549470 - RNA, 18 nt, Human
aucauugcuuugaagcag

SEQ ID NO: 2549471 - RNA, 19 nt, Human
aucauuuauuuuuuacauu

SEQ ID NO: 2549472 - RNA, 12 nt, Human
uucuccugccuc

SEQ ID NO: 2549473 - RNA, 13 nt, Human
uucuccugccuca

SEQ ID NO: 2549474 - RNA, 14 nt, Human
uucuccugccucag

SEQ ID NO: 2549475 - RNA, 19 nt, Human
uucucuaagagaacaaugu

SEQ ID NO: 2549476 - RNA, 21 nt, Human
uucucuaacuucaaggcccau

SEQ ID NO: 2549477 - RNA, 19 nt, Human
uucuccucccuuccuuuuc

SEQ ID NO: 2549478 - RNA, 11 nt, Human
uucuccucccc

SEQ ID NO: 2549479 - RNA, 20 nt, Human
uucuccucccuuccuuuucc

SEQ ID NO: 2549480 - RNA, 14 nt, Human
uucuccucuccccu

SEQ ID NO: 2549481 - RNA, 14 nt, Human
uucuccucuuguaa

SEQ ID NO: 2549482 - RNA, 13 nt, Human
uucuccucuugua

SEQ ID NO: 2549483 - RNA, 19 nt, Human
uucuccucuuguaaauaaa

SEQ ID NO: 2549484 - RNA, 17 nt, Human
uucuccucuuguaaaua

SEQ ID NO: 2549485 - RNA, 18 nt, Human
uucuccugacccaguccc

SEQ ID NO: 2549486 - RNA, 22 nt, Human
uucuccucuuguaaauaaagcc

SEQ ID NO: 2549487 - RNA, 15 nt, Human
uucugcacacagcac

SEQ ID NO: 2549488 - RNA, 12 nt, Human
uucugcacccuc

SEQ ID NO: 2549489 - RNA, 15 nt, Human
uucugcaagccugcg

SEQ ID NO: 2549490 - RNA, 13 nt, Human
uucugcaagccug

SEQ ID NO: 2549491 - RNA, 14 nt, Human
uucugaccauuuca

SEQ ID NO: 2549492 - RNA, 22 nt, Human
uucugcaagcacaucugcauuu

SEQ ID NO: 2549493 - RNA, 20 nt, Human
uucugaccacagcaucauuu

SEQ ID NO: 2549494 - RNA, 17 nt, Human
uucugaccacagcauca

SEQ ID NO: 2549495 - RNA, 14 nt, Human
uucugaccacacuu

SEQ ID NO: 2549496 - RNA, 22 nt, Human
uucugaccacacuuccugucca

SEQ ID NO: 2549497 - RNA, 14 nt, Human
uucugacccaugcu

SEQ ID NO: 2549498 - RNA, 23 nt, Human
uucugacaucuuaguauuugcau

SEQ ID NO: 2549499 - RNA, 14 nt, Human
uucugacauuaaca

SEQ ID NO: 2549500 - RNA, 15 nt, Human
uucugacauuaacag

SEQ ID NO: 2549501 - RNA, 20 nt, Human
uucugacauuaacaguuuuc

SEQ ID NO: 2549502 - RNA, 22 nt, Human
uucugacauuaacaguuuucca

SEQ ID NO: 2549503 - RNA, 23 nt, Human
uucugacauuaacaguuuuccau

SEQ ID NO: 2549504 - RNA, 13 nt, Human
uucugaccacacu

SEQ ID NO: 2549505 - RNA, 13 nt, Human
uucugccgcagcc

SEQ ID NO: 2549506 - RNA, 18 nt, Human
uucugcccuggcugcugc

SEQ ID NO: 2549507 - RNA, 21 nt, Human
uucugcagcaugaccugugac

SEQ ID NO: 2549508 - RNA, 22 nt, Human
uucugcagcaugaccugugacc

SEQ ID NO: 2549509 - RNA, 19 nt, Human
uucugcccuggcugcugcc

SEQ ID NO: 2549510 - RNA, 23 nt, Human
uucugcagcaugaccugugacca

SEQ ID NO: 2549511 - RNA, 19 nt, Human
uucugcacccuccacccug

SEQ ID NO: 2549512 - RNA, 17 nt, Human
uucugcacccuccaccc

SEQ ID NO: 2549513 - RNA, 16 nt, Human
uucugcacccuccacc

SEQ ID NO: 2549514 - RNA, 13 nt, Human
uucugcacccucc

SEQ ID NO: 2549515 - RNA, 23 nt, Human
uucugcacccuccacccuguccc

SEQ ID NO: 2549516 - RNA, 22 nt, Human
uucugcacccuccacccugucc

SEQ ID NO: 2549517 - RNA, 23 nt, Human
uucugcagaguuuccaaaaccag

SEQ ID NO: 2549518 - RNA, 20 nt, Human
uucugcagcaugaccuguga

SEQ ID NO: 2549519 - RNA, 20 nt, Human
uucugcacugagcagagucu

SEQ ID NO: 2549520 - RNA, 17 nt, Human
uucugcacugagcagag

SEQ ID NO: 2549521 - RNA, 15 nt, Human
uucugcacugagcag

SEQ ID NO: 2549522 - RNA, 20 nt, Human
uucucuaaguuccacugagc

SEQ ID NO: 2549523 - RNA, 18 nt, Human
uucucuaaguuccacuga

SEQ ID NO: 2549524 - RNA, 24 nt, Human
uucucuaagagaacaaugugcuau

SEQ ID NO: 2549525 - RNA, 23 nt, Human
uucucuaaguuccacugagcucc

SEQ ID NO: 2549526 - RNA, 21 nt, Human
uucucuaaguuccacugagcu

SEQ ID NO: 2549527 - RNA, 17 nt, Human
uucucuacucuagggaa

SEQ ID NO: 2549528 - RNA, 20 nt, Human
uucucuacuuugaggaaacc

SEQ ID NO: 2549529 - RNA, 19 nt, Human
uucucuacuuugaggaaac

SEQ ID NO: 2549530 - RNA, 20 nt, Human
uucucuacagacuucuccag

SEQ ID NO: 2549531 - RNA, 13 nt, Human
uucucuuuccuug

SEQ ID NO: 2549532 - RNA, 19 nt, Human
uucucuagcuggugguuuc

SEQ ID NO: 2549533 - RNA, 13 nt, Human
uucucuuucaaag

SEQ ID NO: 2549534 - RNA, 22 nt, Human
uucugacaaaaaguuuccauau

SEQ ID NO: 2549535 - RNA, 19 nt, Human
uucugacaaaaaguuucca

SEQ ID NO: 2549536 - RNA, 16 nt, Human
uucucuuuucaaaaca

SEQ ID NO: 2549537 - RNA, 14 nt, Human
uucucuuucucucc

SEQ ID NO: 2549538 - RNA, 13 nt, Human
uucucuuucucuc

SEQ ID NO: 2549539 - RNA, 22 nt, Human
uucucuuuccuuggcucccauu

SEQ ID NO: 2549540 - RNA, 16 nt, Human
uucucuuucucuccuu

SEQ ID NO: 2549541 - RNA, 19 nt, Human
aucaggaauauuuuccaaa

SEQ ID NO: 2549542 - RNA, 22 nt, Human
aucaggaauauuuuccaaagag

SEQ ID NO: 2549543 - RNA, 16 nt, Human
aucaggacccagagga

SEQ ID NO: 2549544 - RNA, 12 nt, Human
aucaggaugaac

SEQ ID NO: 2549545 - RNA, 22 nt, Human
aucaggagaaaaagccuccagu

SEQ ID NO: 2549546 - RNA, 13 nt, Human
aucaggagaaaaa

SEQ ID NO: 2549547 - RNA, 18 nt, Human
aucaggacccagaggaag

SEQ ID NO: 2549548 - RNA, 20 nt, Human
aucaggacccagaggaaggg

SEQ ID NO: 2549549 - RNA, 18 nt, Human
aucaggaugaacccagga

SEQ ID NO: 2549550 - RNA, 13 nt, Human
aucaggaugaacc

SEQ ID NO: 2549551 - RNA, 19 nt, Human
aucaggaugaacccaggac

SEQ ID NO: 2549552 - RNA, 13 nt, Human
aucaggccaggcc

SEQ ID NO: 2549553 - RNA, 19 nt, Human
aucagacuaugaaguuuuu

SEQ ID NO: 2549554 - RNA, 22 nt, Human
aucagaccuuggaucagaugaa

SEQ ID NO: 2549555 - RNA, 22 nt, Human
aucagacuagugacaagcuccu

SEQ ID NO: 2549556 - RNA, 18 nt, Human
aucagacuucacacugca

SEQ ID NO: 2549557 - RNA, 19 nt, Human
aucagacacucuggcuggu

SEQ ID NO: 2549558 - RNA, 16 nt, Human
aucagaccauaauguu

SEQ ID NO: 2549559 - RNA, 20 nt, Human
aucagaccauaauguuacau

SEQ ID NO: 2549560 - RNA, 14 nt, Human
aucagacccuaccc

SEQ ID NO: 2549561 - RNA, 15 nt, Human
aucagacccuacccc

SEQ ID NO: 2549562 - RNA, 16 nt, Human
aucagacccuacccca

SEQ ID NO: 2549563 - RNA, 18 nt, Human
aucagacccuaccccacc

SEQ ID NO: 2549564 - RNA, 19 nt, Human
aucagacccuaccccacca

SEQ ID NO: 2549565 - RNA, 20 nt, Human
aucagacccuaccccaccac

SEQ ID NO: 2549566 - RNA, 12 nt, Human
uucucagcuccc

SEQ ID NO: 2549567 - RNA, 13 nt, Human
uucucagcucccc

SEQ ID NO: 2549568 - RNA, 19 nt, Human
uucucagcucccauuucua

SEQ ID NO: 2549569 - RNA, 18 nt, Human
uucucagcucccauuucu

SEQ ID NO: 2549570 - RNA, 14 nt, Human
uucucagcucccau

SEQ ID NO: 2549571 - RNA, 13 nt, Human
uucucagcuccca

SEQ ID NO: 2549572 - RNA, 13 nt, Human
uucucagaaucuc

SEQ ID NO: 2549573 - RNA, 23 nt, Human
uucucagaaucuacccaaaggau

SEQ ID NO: 2549574 - RNA, 19 nt, Human
uucucagaaucuacccaaa

SEQ ID NO: 2549575 - RNA, 13 nt, Human
uucucagauauuu

SEQ ID NO: 2549576 - RNA, 23 nt, Human
uucucagacuuuggaaaaugcau

SEQ ID NO: 2549577 - RNA, 21 nt, Human
uucucagauggauugauaauu

SEQ ID NO: 2549578 - RNA, 19 nt, Human
uucucagauccuuguuuca

SEQ ID NO: 2549579 - RNA, 14 nt, Human
uucucagauauuua

SEQ ID NO: 2549580 - RNA, 15 nt, Human
uucucagauauuuau

SEQ ID NO: 2549581 - RNA, 15 nt, Human
uucucagauccuugu

SEQ ID NO: 2549582 - RNA, 20 nt, Human
uucucagauauuuauauuuu

SEQ ID NO: 2549583 - RNA, 16 nt, Human
aucagaaacacccuca

SEQ ID NO: 2549584 - RNA, 20 nt, Human
aucagaaacacccucacacu

SEQ ID NO: 2549585 - RNA, 14 nt, Human
aucacuuuuuucca

SEQ ID NO: 2549586 - RNA, 15 nt, Human
aucagaaaagggaag

SEQ ID NO: 2549587 - RNA, 13 nt, Human
aucagaaaaggga

SEQ ID NO: 2549588 - RNA, 15 nt, Human
uucucagcucccccu

SEQ ID NO: 2549589 - RNA, 14 nt, Human
uucucagcuccccc

SEQ ID NO: 2549590 - RNA, 18 nt, Human
aucacuuucucaguuuuc

SEQ ID NO: 2549591 - RNA, 21 nt, Human
aucacuuucucaguuuucaua

SEQ ID NO: 2549592 - RNA, 15 nt, Human
aucacuuuucaguga

SEQ ID NO: 2549593 - RNA, 14 nt, Human
aucacuuuucagug

SEQ ID NO: 2549594 - RNA, 13 nt, Human
aucacuuuucagu

SEQ ID NO: 2549595 - RNA, 16 nt, Human
uucucagcucccccug

SEQ ID NO: 2549596 - RNA, 20 nt, Human
aucacuuucucaguuuucau

SEQ ID NO: 2549597 - RNA, 19 nt, Human
uucuaguggucuuuguaag

SEQ ID NO: 2549598 - RNA, 18 nt, Human
uucuaguggucuuuguaa

SEQ ID NO: 2549599 - RNA, 17 nt, Human
uucuaguggucuuugua

SEQ ID NO: 2549600 - RNA, 15 nt, Human
uucuaguggucuuug

SEQ ID NO: 2549601 - RNA, 21 nt, Human
uucuaguggucuuuguaagag

SEQ ID NO: 2549602 - RNA, 20 nt, Human
uucuaguggucuuuguaaga

SEQ ID NO: 2549603 - RNA, 18 nt, Human
uucuagugcugcugaaga

SEQ ID NO: 2549604 - RNA, 16 nt, Human
uucuagugcugcugaa

SEQ ID NO: 2549605 - RNA, 14 nt, Human
uucuagugcugcug

SEQ ID NO: 2549606 - RNA, 13 nt, Human
uucuagugcugcu

SEQ ID NO: 2549607 - RNA, 14 nt, Human
uucuagucucucug

SEQ ID NO: 2549608 - RNA, 23 nt, Human
uucuagucuccuuugcacugagg

SEQ ID NO: 2549609 - RNA, 12 nt, Human
uucuagugcugc

SEQ ID NO: 2549610 - RNA, 22 nt, Human
uucuagucuccuuugcacugag

SEQ ID NO: 2549611 - RNA, 21 nt, Human
uucuagucuccuuugcacuga

SEQ ID NO: 2549612 - RNA, 22 nt, Human
uucuagagaagaggcuggugcu

SEQ ID NO: 2549613 - RNA, 21 nt, Human
uucuaaguaaaaccacagcag

SEQ ID NO: 2549614 - RNA, 14 nt, Human
uucuagagaagagg

SEQ ID NO: 2549615 - RNA, 12 nt, Human
uucuagagaaga

SEQ ID NO: 2549616 - RNA, 15 nt, Human
uucuagacuuucugu

SEQ ID NO: 2549617 - RNA, 21 nt, Human
uucuagaacaucccugccagc

SEQ ID NO: 2549618 - RNA, 23 nt, Human
uucuagaaagccuguuccccuca

SEQ ID NO: 2549619 - RNA, 17 nt, Human
uucuagaaagccuguuc

SEQ ID NO: 2549620 - RNA, 22 nt, Human
uucuagaacaucccugccagcu

SEQ ID NO: 2549621 - RNA, 15 nt, Human
uucuagaauuuauca

SEQ ID NO: 2549622 - RNA, 21 nt, Human
uucuagaauuuaucacacuuc

SEQ ID NO: 2549623 - RNA, 13 nt, Human
uucuauaauuuaa

SEQ ID NO: 2549624 - RNA, 14 nt, Human
uucuauaauuuaaa

SEQ ID NO: 2549625 - RNA, 22 nt, Human
uucuauaaguuuuauguuaaau

SEQ ID NO: 2549626 - RNA, 22 nt, Human
uucuaguggucuuuguaagagu

SEQ ID NO: 2549627 - RNA, 21 nt, Human
uucuauaaguuuuauguuaaa

SEQ ID NO: 2549628 - RNA, 18 nt, Human
uucucacuguucccucug

SEQ ID NO: 2549629 - RNA, 18 nt, Human
uucucagaaggcaaauga

SEQ ID NO: 2549630 - RNA, 19 nt, Human
uucucagaaggcaaaugac

SEQ ID NO: 2549631 - RNA, 21 nt, Human
uucucagaaggcaaaugacuu

SEQ ID NO: 2549632 - RNA, 15 nt, Human
uucucagaaucuacc

SEQ ID NO: 2549633 - RNA, 13 nt, Human
uucucagaaucua

SEQ ID NO: 2549634 - RNA, 22 nt, Human
uucucagaaggcaaaugacuuu

SEQ ID NO: 2549635 - RNA, 21 nt, Human
uucucacugccaugccagcuu

SEQ ID NO: 2549636 - RNA, 21 nt, Human
uucgcaucaaaagacaauucu

SEQ ID NO: 2549637 - RNA, 20 nt, Human
uucgcaucaaaagacaauuc

SEQ ID NO: 2549638 - RNA, 19 nt, Human
uucgcaucaaaagacaauu

SEQ ID NO: 2549639 - RNA, 18 nt, Human
uucgcaucaaaagacaau

SEQ ID NO: 2549640 - RNA, 14 nt, Human
uucgcaucaaaaga

SEQ ID NO: 2549641 - RNA, 14 nt, Human
uucgcauggucaca

SEQ ID NO: 2549642 - RNA, 16 nt, Human
uucgcauggucacaca

SEQ ID NO: 2549643 - RNA, 17 nt, Human
uucgcauggucacacac

SEQ ID NO: 2549644 - RNA, 18 nt, Human
uucgcauggucacacacu

SEQ ID NO: 2549645 - RNA, 19 nt, Human
uucgcauggucacacacug

SEQ ID NO: 2549646 - RNA, 20 nt, Human
uucgcauggucacacacuga

SEQ ID NO: 2549647 - RNA, 21 nt, Human
uucgcauggucacacacugau

SEQ ID NO: 2549648 - RNA, 23 nt, Human
uucgcauggucacacacugaugc

SEQ ID NO: 2549649 - RNA, 21 nt, Human
uucgccguggcugcggcaccc

SEQ ID NO: 2549650 - RNA, 20 nt, Human
uucgccguggcugcggcacc

SEQ ID NO: 2549651 - RNA, 19 nt, Human
uucgcccaaagccagacag

SEQ ID NO: 2549652 - RNA, 14 nt, Human
uucgccguggcugc

SEQ ID NO: 2549653 - RNA, 23 nt, Human
uucgcaccuaccaucagggacag

SEQ ID NO: 2549654 - RNA, 21 nt, Human
uucgcaggauucuuccucccu

SEQ ID NO: 2549655 - RNA, 20 nt, Human
uucgauacaccgggccugga

SEQ ID NO: 2549656 - RNA, 14 nt, Human
uucgcacagcaguu

SEQ ID NO: 2549657 - RNA, 20 nt, Human
uucgaugggcccaauucuua

SEQ ID NO: 2549658 - RNA, 21 nt, Human
uucgaugggcccaauucuuac

SEQ ID NO: 2549659 - RNA, 15 nt, Human
aucaauaaacgauuu

SEQ ID NO: 2549660 - RNA, 14 nt, Human
aucaauaaacgauu

SEQ ID NO: 2549661 - RNA, 19 nt, Human
aucaauaaacgauuuaauu

SEQ ID NO: 2549662 - RNA, 22 nt, Human
uucgaaaccugggauucaggaa

SEQ ID NO: 2549663 - RNA, 14 nt, Human
uucgaagcucagcc

SEQ ID NO: 2549664 - RNA, 16 nt, Human
uucgaagcucagccca

SEQ ID NO: 2549665 - RNA, 15 nt, Human
aucaauaaaauguga

SEQ ID NO: 2549666 - RNA, 16 nt, Human
aucaauaaaaugugau

SEQ ID NO: 2549667 - RNA, 17 nt, Human
aucaauaaaaugugauu

SEQ ID NO: 2549668 - RNA, 22 nt, Human
uucgaagcucagcccacccccc

SEQ ID NO: 2549669 - RNA, 17 nt, Human
uucgacucagccucagg

SEQ ID NO: 2549670 - RNA, 18 nt, Human
uucgaccugauuuacagu

SEQ ID NO: 2549671 - RNA, 19 nt, Human
uucgacugugaccuguggg

SEQ ID NO: 2549672 - RNA, 17 nt, Human
uucgaccugauuuacag

SEQ ID NO: 2549673 - RNA, 15 nt, Human
uucgagaccagccug

SEQ ID NO: 2549674 - RNA, 16 nt, Human
uucgagaccagccugg

SEQ ID NO: 2549675 - RNA, 17 nt, Human
uucgagaccagccuggc

SEQ ID NO: 2549676 - RNA, 19 nt, Human
uucgagaccagccuggcca

SEQ ID NO: 2549677 - RNA, 20 nt, Human
uucgagaagcugcucuggaa

SEQ ID NO: 2549678 - RNA, 15 nt, Human
uucgagaagcugcuc

SEQ ID NO: 2549679 - RNA, 17 nt, Human
uucgacuugcauuuuug

SEQ ID NO: 2549680 - RNA, 21 nt, Human
uucgagaagcugcucuggaau

SEQ ID NO: 2549681 - RNA, 18 nt, Human
uucgagaccaaccugacc

SEQ ID NO: 2549682 - RNA, 14 nt, Human
uucgagaccagccu

SEQ ID NO: 2549683 - RNA, 18 nt, Human
uucuaagagaaguuauuu

SEQ ID NO: 2549684 - RNA, 15 nt, Human
uucuaacuccaguga

SEQ ID NO: 2549685 - RNA, 19 nt, Human
uucuaaguaaaaccacagc

SEQ ID NO: 2549686 - RNA, 20 nt, Human
uucuaaguaaaaccacagca

SEQ ID NO: 2549687 - RNA, 17 nt, Human
uucuaaguaaaaccaca

SEQ ID NO: 2549688 - RNA, 14 nt, Human
uucuaaggaauaug

SEQ ID NO: 2549689 - RNA, 18 nt, Human
uucuaaggaauaugagcu

SEQ ID NO: 2549690 - RNA, 20 nt, Human
uucuaacaaaaaaauauauu

SEQ ID NO: 2549691 - RNA, 19 nt, Human
uucuaacaaaaaaauauau

SEQ ID NO: 2549692 - RNA, 14 nt, Human
uucuaacaagucau

SEQ ID NO: 2549693 - RNA, 19 nt, Human
uucuaaaucuccaaaauaa

SEQ ID NO: 2549694 - RNA, 13 nt, Human
uucuaaauagcaa

SEQ ID NO: 2549695 - RNA, 13 nt, Human
uucuaaaguaaaa

SEQ ID NO: 2549696 - RNA, 15 nt, Human
uucuaaaguaaaaac

SEQ ID NO: 2549697 - RNA, 13 nt, Human
uucgcuccugugu

SEQ ID NO: 2549698 - RNA, 22 nt, Human
uucgcaucaaaagacaauucuu

SEQ ID NO: 2549699 - RNA, 19 nt, Human
uucgcgugcccucgcugcu

SEQ ID NO: 2549700 - RNA, 22 nt, Human
uucgcgauggacagacucacaa

SEQ ID NO: 2549701 - RNA, 18 nt, Human
uuccucucacuaaacuuu

SEQ ID NO: 2549702 - RNA, 17 nt, Human
uuccucucacuaaacuu

SEQ ID NO: 2549703 - RNA, 23 nt, Human
uuccucuauugauguacagucug

SEQ ID NO: 2549704 - RNA, 19 nt, Human
uuccuagaaguuacugaau

SEQ ID NO: 2549705 - RNA, 21 nt, Human
uuccucuauugauguacaguc

SEQ ID NO: 2549706 - RNA, 12 nt, Human
uuccucuccacu

SEQ ID NO: 2549707 - RNA, 12 nt, Human
uuccucuccacc

SEQ ID NO: 2549708 - RNA, 19 nt, Human
uuccucucacuaaacuuua

SEQ ID NO: 2549709 - RNA, 17 nt, Human
uuccucuccacccuccc

SEQ ID NO: 2549710 - RNA, 15 nt, Human
uuccucuccacugcc

SEQ ID NO: 2549711 - RNA, 14 nt, Human
uuccucuccacugc

SEQ ID NO: 2549712 - RNA, 13 nt, Human
uuccucuccacug

SEQ ID NO: 2549713 - RNA, 23 nt, Human
uuccuguaacacaagccacagaa

SEQ ID NO: 2549714 - RNA, 22 nt, Human
uuccuguaacacaagccacaga

SEQ ID NO: 2549715 - RNA, 21 nt, Human
uuccuguaacacaagccacag

SEQ ID NO: 2549716 - RNA, 19 nt, Human
uuccuguaacacaagccac

SEQ ID NO: 2549717 - RNA, 11 nt, Human
uuccuguaaca

SEQ ID NO: 2549718 - RNA, 21 nt, Human
uuccuguaaaaaaaaaaaagu

SEQ ID NO: 2549719 - RNA, 22 nt, Human
uuccuguagccuucuguaggaa

SEQ ID NO: 2549720 - RNA, 18 nt, Human
uuccuguagcaucuucug

SEQ ID NO: 2549721 - RNA, 17 nt, Human
uuccuguagcaucuucu

SEQ ID NO: 2549722 - RNA, 15 nt, Human
uuccuguagcaucuu

SEQ ID NO: 2549723 - RNA, 16 nt, Human
uuccuguauguugucc

SEQ ID NO: 2549724 - RNA, 15 nt, Human
uuccugucccaccuc

SEQ ID NO: 2549725 - RNA, 14 nt, Human
uuccugucccaccu

SEQ ID NO: 2549726 - RNA, 22 nt, Human
uuccuguccagcuccaaccugc

SEQ ID NO: 2549727 - RNA, 16 nt, Human
uuccuguccagcucca

SEQ ID NO: 2549728 - RNA, 17 nt, Human
uuccuguccagcuccaa

SEQ ID NO: 2549729 - RNA, 15 nt, Human
uuccuguccagcucc

SEQ ID NO: 2549730 - RNA, 15 nt, Human
uuccuguccagagag

SEQ ID NO: 2549731 - RNA, 20 nt, Human
uuccuucaaagcaaaugucu

SEQ ID NO: 2549732 - RNA, 17 nt, Human
uuccuucacauccugug

SEQ ID NO: 2549733 - RNA, 21 nt, Human
uuccuuagcuuagaccucagc

SEQ ID NO: 2549734 - RNA, 20 nt, Human
uuccuuagcuuagaccucag

SEQ ID NO: 2549735 - RNA, 22 nt, Human
uuccuuagcuuagaccucagcc

SEQ ID NO: 2549736 - RNA, 23 nt, Human
uuccuuagcuuagaccucagccu

SEQ ID NO: 2549737 - RNA, 23 nt, Human
uuccuuagguuuuuuuccuucug

SEQ ID NO: 2549738 - RNA, 22 nt, Human
uuccuuagguuuuuuuccuucu

SEQ ID NO: 2549739 - RNA, 23 nt, Human
uuccuuauguauauuuaaaagaa

SEQ ID NO: 2549740 - RNA, 12 nt, Human
auauuuucuguu

SEQ ID NO: 2549741 - RNA, 13 nt, Human
auauuuucuguuu

SEQ ID NO: 2549742 - RNA, 23 nt, Human
auauuuucuuccaagcaaaggug

SEQ ID NO: 2549743 - RNA, 16 nt, Human
auauuuuccaugaaaa

SEQ ID NO: 2549744 - RNA, 18 nt, Human
auauuuuccaugaaaaug

SEQ ID NO: 2549745 - RNA, 16 nt, Human
aucaaguauuugggaa

SEQ ID NO: 2549746 - RNA, 14 nt, Human
aucaacauuucuca

SEQ ID NO: 2549747 - RNA, 22 nt, Human
aucaaccccuucgcuccugugu

SEQ ID NO: 2549748 - RNA, 20 nt, Human
aucaaccccuucgcuccugu

SEQ ID NO: 2549749 - RNA, 19 nt, Human
aucaaccccuucgcuccug

SEQ ID NO: 2549750 - RNA, 23 nt, Human
aucaaguuggcuucuaaucaaag

SEQ ID NO: 2549751 - RNA, 22 nt, Human
aucaaguuggcuucuaaucaaa

SEQ ID NO: 2549752 - RNA, 16 nt, Human
aucaagugugcuuuag

SEQ ID NO: 2549753 - RNA, 15 nt, Human
aucaagugugcuuua

SEQ ID NO: 2549754 - RNA, 15 nt, Human
aucaaguugaauuga

SEQ ID NO: 2549755 - RNA, 22 nt, Human
aucaaguuauugacaaacucuc

SEQ ID NO: 2549756 - RNA, 16 nt, Human
aucaagugucuuccau

SEQ ID NO: 2549757 - RNA, 13 nt, Human
aucaagugucuuc

SEQ ID NO: 2549758 - RNA, 21 nt, Human
aucaaguauuugggaagugaa

SEQ ID NO: 2549759 - RNA, 20 nt, Human
aucaaguauuugggaaguga

SEQ ID NO: 2549760 - RNA, 12 nt, Human
aucaagucaccg

SEQ ID NO: 2549761 - RNA, 17 nt, Human
aucaaauggaagacaca

SEQ ID NO: 2549762 - RNA, 22 nt, Human
aucaaauggaaaggagaggaaa

SEQ ID NO: 2549763 - RNA, 21 nt, Human
aucaaauggaagacacauuga

SEQ ID NO: 2549764 - RNA, 21 nt, Human
aucaaauauuagaugugauuu

SEQ ID NO: 2549765 - RNA, 19 nt, Human
aucaaauauuagaugugau

SEQ ID NO: 2549766 - RNA, 20 nt, Human
aucaaauaugcaaagcacug

SEQ ID NO: 2549767 - RNA, 18 nt, Human
aucaaauauuagauguga

SEQ ID NO: 2549768 - RNA, 16 nt, Human
aucaaauauuagaugu

SEQ ID NO: 2549769 - RNA, 15 nt, Human
aucaaauauuagaug

SEQ ID NO: 2549770 - RNA, 14 nt, Human
aucaaauauuagau

SEQ ID NO: 2549771 - RNA, 13 nt, Human
aucaaauauuaga

SEQ ID NO: 2549772 - RNA, 16 nt, Human
auauuuuuauauuuag

SEQ ID NO: 2549773 - RNA, 19 nt, Human
auauuuuuauagacaaaua

SEQ ID NO: 2549774 - RNA, 17 nt, Human
auauuuugucuaaaaug

SEQ ID NO: 2549775 - RNA, 19 nt, Human
auauuuucuuccaagcaaa

SEQ ID NO: 2549776 - RNA, 12 nt, Human
auauuuuuaaga

SEQ ID NO: 2549777 - RNA, 14 nt, Human
auauuuugucuaaa

SEQ ID NO: 2549778 - RNA, 20 nt, Human
auauuuuuaaaauauuuauu

SEQ ID NO: 2549779 - RNA, 16 nt, Human
auauuuuuaagauaau

SEQ ID NO: 2549780 - RNA, 14 nt, Human
auauuuuuaagaua

SEQ ID NO: 2549781 - RNA, 20 nt, Human
auauuuuuaagauaauaaua

SEQ ID NO: 2549782 - RNA, 13 nt, Human
auauuuuuauaga

SEQ ID NO: 2549783 - RNA, 14 nt, Human
auauuuuuauagac

SEQ ID NO: 2549784 - RNA, 13 nt, Human
auauuuuuagaua

SEQ ID NO: 2549785 - RNA, 15 nt, Human
auauuuuuaauuaaa

SEQ ID NO: 2549786 - RNA, 13 nt, Human
uucccuacuuccu

SEQ ID NO: 2549787 - RNA, 23 nt, Human
uuccccuugcccagggcucagcc

SEQ ID NO: 2549788 - RNA, 22 nt, Human
uuccccuugcccagggcucagc

SEQ ID NO: 2549789 - RNA, 16 nt, Human
uucccuacuuccugug

SEQ ID NO: 2549790 - RNA, 14 nt, Human
uucccuacuuccug

SEQ ID NO: 2549791 - RNA, 17 nt, Human
uucccuacuuccuguga

SEQ ID NO: 2549792 - RNA, 22 nt, Human
uucccuagaaacuuccaaaucc

SEQ ID NO: 2549793 - RNA, 19 nt, Human
uucccuaggggacacuucc

SEQ ID NO: 2549794 - RNA, 18 nt, Human
uucccuaggggacacuuc

SEQ ID NO: 2549795 - RNA, 16 nt, Human
uucccuaucuuugcca

SEQ ID NO: 2549796 - RNA, 19 nt, Human
uucccuagucuauucauua

SEQ ID NO: 2549797 - RNA, 21 nt, Human
uucccuaggggacacuucccu

SEQ ID NO: 2549798 - RNA, 14 nt, Human
uuccccuuccacug

SEQ ID NO: 2549799 - RNA, 15 nt, Human
uuccccuuccacuga

SEQ ID NO: 2549800 - RNA, 22 nt, Human
uuccccuuccuaauuccacagc

SEQ ID NO: 2549801 - RNA, 21 nt, Human
uuccccuuccacugagggcag

SEQ ID NO: 2549802 - RNA, 15 nt, Human
uuccccuguggggau

SEQ ID NO: 2549803 - RNA, 13 nt, Human
uuccccuguccug

SEQ ID NO: 2549804 - RNA, 22 nt, Human
uuccccuccuaccccucccagc

SEQ ID NO: 2549805 - RNA, 14 nt, Human
uuccccuguucacu

SEQ ID NO: 2549806 - RNA, 17 nt, Human
uuccccuguucacucua

SEQ ID NO: 2549807 - RNA, 21 nt, Human
uuccuacccacaccucugcca

SEQ ID NO: 2549808 - RNA, 20 nt, Human
uuccuacccacaccucugcc

SEQ ID NO: 2549809 - RNA, 17 nt, Human
uuccuacccaaccacuc

SEQ ID NO: 2549810 - RNA, 16 nt, Human
uuccuacccaaccacu

SEQ ID NO: 2549811 - RNA, 23 nt, Human
uuccuacccacaccucugccaga

SEQ ID NO: 2549812 - RNA, 13 nt, Human
uuccuaccucccu

SEQ ID NO: 2549813 - RNA, 16 nt, Human
uuccuaccucccugca

SEQ ID NO: 2549814 - RNA, 15 nt, Human
uuccuaccucccugc

SEQ ID NO: 2549815 - RNA, 14 nt, Human
uuccuacagccccu

SEQ ID NO: 2549816 - RNA, 12 nt, Human
uuccuacagccc

SEQ ID NO: 2549817 - RNA, 17 nt, Human
uuccuacagauagucaa

SEQ ID NO: 2549818 - RNA, 21 nt, Human
uuccuacacccuuggacuuga

SEQ ID NO: 2549819 - RNA, 18 nt, Human
uuccuacagccccuuuuu

SEQ ID NO: 2549820 - RNA, 18 nt, Human
uuccuacagauagucaaa

SEQ ID NO: 2549821 - RNA, 18 nt, Human
uuccuacacccuuggacu

SEQ ID NO: 2549822 - RNA, 13 nt, Human
uucccuaucuuuu

SEQ ID NO: 2549823 - RNA, 20 nt, Human
uucccuuuuuuggcugcuga

SEQ ID NO: 2549824 - RNA, 19 nt, Human
uucccuuuuuuggcugcug

SEQ ID NO: 2549825 - RNA, 18 nt, Human
uucccuuuuuuggcugcu

SEQ ID NO: 2549826 - RNA, 17 nt, Human
uucccuuuuacauacug

SEQ ID NO: 2549827 - RNA, 18 nt, Human
uucccuuuuacauacugc

SEQ ID NO: 2549828 - RNA, 19 nt, Human
uucccuuuuacauacugcu

SEQ ID NO: 2549829 - RNA, 21 nt, Human
uucccuuuuacauacugcugu

SEQ ID NO: 2549830 - RNA, 22 nt, Human
uucccccugcuuccaccucacc

SEQ ID NO: 2549831 - RNA, 20 nt, Human
uucccccuggccaccacccc

SEQ ID NO: 2549832 - RNA, 23 nt, Human
auauuuuaccucuuauugcaaaa

SEQ ID NO: 2549833 - RNA, 17 nt, Human
auauuuuaccucuuauu

SEQ ID NO: 2549834 - RNA, 23 nt, Human
auauuuuacauucuuggaaaguc

SEQ ID NO: 2549835 - RNA, 19 nt, Human
uucccccuccaaucccacc

SEQ ID NO: 2549836 - RNA, 15 nt, Human
uucccccucccaggg

SEQ ID NO: 2549837 - RNA, 17 nt, Human
uucccccuucacaaagc

SEQ ID NO: 2549838 - RNA, 22 nt, Human
uucccccuggccaccacccccc

SEQ ID NO: 2549839 - RNA, 16 nt, Human
uuccccgagggaugau

SEQ ID NO: 2549840 - RNA, 19 nt, Human
uucccccuuuucugcauuu

SEQ ID NO: 2549841 - RNA, 17 nt, Human
uuccccggucccuugag

SEQ ID NO: 2549842 - RNA, 19 nt, Human
uuccccuaaccucauuccc

SEQ ID NO: 2549843 - RNA, 23 nt, Human
uuccccgagggaugaugccacac

SEQ ID NO: 2549844 - RNA, 22 nt, Human
uuccccgagggaugaugccaca

SEQ ID NO: 2549845 - RNA, 16 nt, Human
uuccccggucccuuga

SEQ ID NO: 2549846 - RNA, 18 nt, Human
uuccccucugcugcuguc

SEQ ID NO: 2549847 - RNA, 15 nt, Human
uuccccucugcugcu

SEQ ID NO: 2549848 - RNA, 14 nt, Human
uuccccucugcugc

SEQ ID NO: 2549849 - RNA, 15 nt, Human
uuccccuccuccacu

SEQ ID NO: 2549850 - RNA, 17 nt, Human
uuccccuccuucucccu

SEQ ID NO: 2549851 - RNA, 12 nt, Human
uuccccucugcu

SEQ ID NO: 2549852 - RNA, 18 nt, Human
uuccccuccuucucccuu

SEQ ID NO: 2549853 - RNA, 21 nt, Human
uuccccuccuaccccucccag

SEQ ID NO: 2549854 - RNA, 20 nt, Human
uuccccuccuaccccuccca

SEQ ID NO: 2549855 - RNA, 19 nt, Human
uuccccuccuaccccuccc

SEQ ID NO: 2549856 - RNA, 17 nt, Human
uuccccuccuaccccuc

SEQ ID NO: 2549857 - RNA, 16 nt, Human
uuccccuccuaccccu

SEQ ID NO: 2549858 - RNA, 13 nt, Human
uuccccuccuacc

SEQ ID NO: 2549859 - RNA, 14 nt, Human
uuccccucccuggg

SEQ ID NO: 2549860 - RNA, 19 nt, Human
uuccccucacuggaugaaa

SEQ ID NO: 2549861 - RNA, 22 nt, Human
uuccccuaguaagugccuucca

SEQ ID NO: 2549862 - RNA, 21 nt, Human
uuccccuacccccuccucucu

SEQ ID NO: 2549863 - RNA, 13 nt, Human
uuccccucccugg

SEQ ID NO: 2549864 - RNA, 16 nt, Human
uuccccucccuggcuc

SEQ ID NO: 2549865 - RNA, 17 nt, Human
uuccccucccuggcucc

SEQ ID NO: 2549866 - RNA, 20 nt, Human
uucccacugcacccccuccu

SEQ ID NO: 2549867 - RNA, 19 nt, Human
uucccacugcacccccucc

SEQ ID NO: 2549868 - RNA, 18 nt, Human
uucccacugcacccccuc

SEQ ID NO: 2549869 - RNA, 13 nt, Human
uucccacugcacc

SEQ ID NO: 2549870 - RNA, 24 nt, Human
uucccacugcacccccuccugcug

SEQ ID NO: 2549871 - RNA, 23 nt, Human
uucccacugcacccccuccugcu

SEQ ID NO: 2549872 - RNA, 15 nt, Human
uucccacuguuuaag

SEQ ID NO: 2549873 - RNA, 18 nt, Human
uucccacucuagggcagu

SEQ ID NO: 2549874 - RNA, 15 nt, Human
uucccacucaccccg

SEQ ID NO: 2549875 - RNA, 11 nt, Human
uucccacugca

SEQ ID NO: 2549876 - RNA, 12 nt, Human
uucccagaauca

SEQ ID NO: 2549877 - RNA, 23 nt, Human
uucccagaaggcauaucagucuc

SEQ ID NO: 2549878 - RNA, 13 nt, Human
uucccagaaggca

SEQ ID NO: 2549879 - RNA, 18 nt, Human
uucccagagcaaaauaau

SEQ ID NO: 2549880 - RNA, 19 nt, Human
uucccagagacaggaaaau

SEQ ID NO: 2549881 - RNA, 22 nt, Human
uucccagagacaggaaaauccu

SEQ ID NO: 2549882 - RNA, 15 nt, Human
uucccagaaucaaag

SEQ ID NO: 2549883 - RNA, 13 nt, Human
uucccagaaucaa

SEQ ID NO: 2549884 - RNA, 23 nt, Human
uucccagaaucaaagcaaugcau

SEQ ID NO: 2549885 - RNA, 15 nt, Human
uucccagagacagga

SEQ ID NO: 2549886 - RNA, 21 nt, Human
uucccagagugugaaacuucc

SEQ ID NO: 2549887 - RNA, 23 nt, Human
uucccagagcaaaauaauuuuaa

SEQ ID NO: 2549888 - RNA, 23 nt, Human
uucccagcagggccacucccggc

SEQ ID NO: 2549889 - RNA, 14 nt, Human
uucccagcacauga

SEQ ID NO: 2549890 - RNA, 14 nt, Human
uucccagauacuuc

SEQ ID NO: 2549891 - RNA, 11 nt, Human
auauuuuaauu

SEQ ID NO: 2549892 - RNA, 12 nt, Human
augauucccagc

SEQ ID NO: 2549893 - RNA, 15 nt, Human
augauuccagguggc

SEQ ID NO: 2549894 - RNA, 16 nt, Human
augauuccagguggca

SEQ ID NO: 2549895 - RNA, 13 nt, Human
augauuccuuccu

SEQ ID NO: 2549896 - RNA, 17 nt, Human
augauuucagcucacug

SEQ ID NO: 2549897 - RNA, 14 nt, Human
augauucagaaauu

SEQ ID NO: 2549898 - RNA, 17 nt, Human
augauucagaaauugga

SEQ ID NO: 2549899 - RNA, 16 nt, Human
augauucaguguuaaa

SEQ ID NO: 2549900 - RNA, 13 nt, Human
augauucauuuua

SEQ ID NO: 2549901 - RNA, 21 nt, Human
augauucaacagguuuuccug

SEQ ID NO: 2549902 - RNA, 14 nt, Human
augauuauuuucaa

SEQ ID NO: 2549903 - RNA, 15 nt, Human
augauuaguaaagaa

SEQ ID NO: 2549904 - RNA, 14 nt, Human
augauuagcaaguu

SEQ ID NO: 2549905 - RNA, 23 nt, Human
augauuagcaaguuacagugaug

SEQ ID NO: 2549906 - RNA, 22 nt, Human
augauuaugaauuacauuugua

SEQ ID NO: 2549907 - RNA, 20 nt, Human
augauuaaccacuucagcug

SEQ ID NO: 2549908 - RNA, 21 nt, Human
augauuaaccacuucagcuga

SEQ ID NO: 2549909 - RNA, 21 nt, Human
uuguugggauuccugacccag

SEQ ID NO: 2549910 - RNA, 20 nt, Human
uuguugggauuccugaccca

SEQ ID NO: 2549911 - RNA, 22 nt, Human
uuguugggauuccugacccagg

SEQ ID NO: 2549912 - RNA, 19 nt, Human
uuguugggauuccugaccc

SEQ ID NO: 2549913 - RNA, 23 nt, Human
uuguuggcuuucccuuaucaaac

SEQ ID NO: 2549914 - RNA, 19 nt, Human
augauuaaccacuucagcu

SEQ ID NO: 2549915 - RNA, 21 nt, Human
augauuuccuugaauguggcu

SEQ ID NO: 2549916 - RNA, 20 nt, Human
augauuucaugcuaucucug

SEQ ID NO: 2549917 - RNA, 21 nt, Human
augauuucaugcuaucucugu

SEQ ID NO: 2549918 - RNA, 20 nt, Human
augauuuccuugaauguggc

SEQ ID NO: 2549919 - RNA, 19 nt, Human
augauuucagcucacugca

SEQ ID NO: 2549920 - RNA, 18 nt, Human
augcaaauauuuuuuugu

SEQ ID NO: 2549921 - RNA, 14 nt, Human
augcaaaggcuggg

SEQ ID NO: 2549922 - RNA, 15 nt, Human
augcaaaggcuggga

SEQ ID NO: 2549923 - RNA, 13 nt, Human
augcaaaggcugg

SEQ ID NO: 2549924 - RNA, 13 nt, Human
augauuuuuagau

SEQ ID NO: 2549925 - RNA, 23 nt, Human
augauuuuauuugacaaaauuug

SEQ ID NO: 2549926 - RNA, 11 nt, Human
augauuuuuag

SEQ ID NO: 2549927 - RNA, 15 nt, Human
augcaaagcacugac

SEQ ID NO: 2549928 - RNA, 18 nt, Human
augauuuuauuugacaaa

SEQ ID NO: 2549929 - RNA, 16 nt, Human
augauuuuauuugaca

SEQ ID NO: 2549930 - RNA, 18 nt, Human
augcaccaccaagccaag

SEQ ID NO: 2549931 - RNA, 15 nt, Human
augcaccaccaagcc

SEQ ID NO: 2549932 - RNA, 21 nt, Human
augcaccaccaagccaaggga

SEQ ID NO: 2549933 - RNA, 19 nt, Human
augcacuuauaauuuuccu

SEQ ID NO: 2549934 - RNA, 14 nt, Human
augcaccagcccuu

SEQ ID NO: 2549935 - RNA, 12 nt, Human
augcacuuuguu

SEQ ID NO: 2549936 - RNA, 22 nt, Human
augcacuuucuauccucuguaa

SEQ ID NO: 2549937 - RNA, 13 nt, Human
augcaccagcccu

SEQ ID NO: 2549938 - RNA, 21 nt, Human
augcacauauggacucugcac

SEQ ID NO: 2549939 - RNA, 14 nt, Human
augcaccaccaagc

SEQ ID NO: 2549940 - RNA, 18 nt, Human
augcaaaucaauuacugg

SEQ ID NO: 2549941 - RNA, 11 nt, Human
augcaaauccu

SEQ ID NO: 2549942 - RNA, 18 nt, Human
augcaaauccuaugugau

SEQ ID NO: 2549943 - RNA, 19 nt, Human
augcaaauccuaugugauu

SEQ ID NO: 2549944 - RNA, 19 nt, Human
augcacauauggacucugc

SEQ ID NO: 2549945 - RNA, 16 nt, Human
augcaacaacauguau

SEQ ID NO: 2549946 - RNA, 14 nt, Human
augcaacaacaugu

SEQ ID NO: 2549947 - RNA, 14 nt, Human
uugugugauuuaag

SEQ ID NO: 2549948 - RNA, 13 nt, Human
uugugugauugaa

SEQ ID NO: 2549949 - RNA, 15 nt, Human
uuguguguuauuuaa

SEQ ID NO: 2549950 - RNA, 16 nt, Human
uuguguguuauuuaaa

SEQ ID NO: 2549951 - RNA, 10 nt, Human
uugugugugu

SEQ ID NO: 2549952 - RNA, 18 nt, Human
uugugucuuuugcaugau

SEQ ID NO: 2549953 - RNA, 15 nt, Human
uugugucuuuugcau

SEQ ID NO: 2549954 - RNA, 23 nt, Human
uugugugaaagguacuucaaauc

SEQ ID NO: 2549955 - RNA, 22 nt, Human
uuguguaacaauuuuaaugcua

SEQ ID NO: 2549956 - RNA, 13 nt, Human
uugugguuaaucu

SEQ ID NO: 2549957 - RNA, 14 nt, Human
uugugguuuauguc

SEQ ID NO: 2549958 - RNA, 17 nt, Human
uuguguguugucucuug

SEQ ID NO: 2549959 - RNA, 15 nt, Human
uuguguguugucucu

SEQ ID NO: 2549960 - RNA, 20 nt, Human
uuguguuaaguauguguaaa

SEQ ID NO: 2549961 - RNA, 19 nt, Human
uuguucuggcucuuccagg

SEQ ID NO: 2549962 - RNA, 17 nt, Human
uuguguguuuauuguca

SEQ ID NO: 2549963 - RNA, 13 nt, Human
uuguguguugucu

SEQ ID NO: 2549964 - RNA, 12 nt, Human
uugugugugugc

SEQ ID NO: 2549965 - RNA, 20 nt, Human
uuguguguuauuuaaaugag

SEQ ID NO: 2549966 - RNA, 21 nt, Human
uuguguguuauuuaaaugagu

SEQ ID NO: 2549967 - RNA, 22 nt, Human
uuguucuggcucuuccaggcug

SEQ ID NO: 2549968 - RNA, 20 nt, Human
uuguucuggcucuuccaggc

SEQ ID NO: 2549969 - RNA, 21 nt, Human
uuguuggccuccggccucccc

SEQ ID NO: 2549970 - RNA, 18 nt, Human
uuguuggccuccggccuc

SEQ ID NO: 2549971 - RNA, 12 nt, Human
uuguuggccucc

SEQ ID NO: 2549972 - RNA, 20 nt, Human
uuguuggcagcauaaaggcc

SEQ ID NO: 2549973 - RNA, 13 nt, Human
uuguguguuucac

SEQ ID NO: 2549974 - RNA, 23 nt, Human
uuguucugugguuuuccccuccc

SEQ ID NO: 2549975 - RNA, 21 nt, Human
augagagacacacugaagaag

SEQ ID NO: 2549976 - RNA, 20 nt, Human
augagagacacacugaagaa

SEQ ID NO: 2549977 - RNA, 23 nt, Human
augagagacacacugaagaagca

SEQ ID NO: 2549978 - RNA, 16 nt, Human
uugugaccuuaguguu

SEQ ID NO: 2549979 - RNA, 20 nt, Human
uugugaccugaaguucacca

SEQ ID NO: 2549980 - RNA, 15 nt, Human
augagacuugcucuc

SEQ ID NO: 2549981 - RNA, 23 nt, Human
augagacuuccaaaccugacaga

SEQ ID NO: 2549982 - RNA, 21 nt, Human
uugugaggaagccgcuggggc

SEQ ID NO: 2549983 - RNA, 22 nt, Human
uugugacuguauauaaaggaaa

SEQ ID NO: 2549984 - RNA, 16 nt, Human
uugugacuguauauaa

SEQ ID NO: 2549985 - RNA, 22 nt, Human
uugugacuauauagagauguuu

SEQ ID NO: 2549986 - RNA, 21 nt, Human
uugugacuauauagagauguu

SEQ ID NO: 2549987 - RNA, 23 nt, Human
uugugacuguauauaaaggaaaa

SEQ ID NO: 2549988 - RNA, 12 nt, Human
uugugagauggg

SEQ ID NO: 2549989 - RNA, 23 nt, Human
uugugacuaauuguauaacaggu

SEQ ID NO: 2549990 - RNA, 22 nt, Human
uugugacuaauuguauaacagg

SEQ ID NO: 2549991 - RNA, 20 nt, Human
uugugacuaauuguauaaca

SEQ ID NO: 2549992 - RNA, 16 nt, Human
uugugacuaauuguau

SEQ ID NO: 2549993 - RNA, 14 nt, Human
uugugacuaauugu

SEQ ID NO: 2549994 - RNA, 20 nt, Human
uugugaccuuaguguuucug

SEQ ID NO: 2549995 - RNA, 19 nt, Human
uugugaccuuaguguuucu

SEQ ID NO: 2549996 - RNA, 17 nt, Human
uugugaccuuaguguuu

SEQ ID NO: 2549997 - RNA, 15 nt, Human
uugugacuauauaga

SEQ ID NO: 2549998 - RNA, 19 nt, Human
uugugacuauauagagaug

SEQ ID NO: 2549999 - RNA, 19 nt, Human
uugugauacaaugcugugc

SEQ ID NO: 2550000 - RNA, 22 nt, Human
uugugauaaguucuaguugcuu

SEQ ID NO: 2550001 - RNA, 18 nt, Human
uuguggccaaggagcugc

SEQ ID NO: 2550002 - RNA, 19 nt, Human
uuguggccaaggagcugcu

SEQ ID NO: 2550003 - RNA, 11 nt, Human
uuguggccuca

SEQ ID NO: 2550004 - RNA, 12 nt, Human
uuguggccucag

SEQ ID NO: 2550005 - RNA, 18 nt, Human
uugugauacaaugcugug

SEQ ID NO: 2550006 - RNA, 22 nt, Human
uugugaguuuaccuuguauacu

SEQ ID NO: 2550007 - RNA, 22 nt, Human
uugugaguuuaguaaggcugug

SEQ ID NO: 2550008 - RNA, 20 nt, Human
uugugaggcccaugguugag

SEQ ID NO: 2550009 - RNA, 17 nt, Human
uuguggggaugaugaaa

SEQ ID NO: 2550010 - RNA, 13 nt, Human
uugugggugggag

SEQ ID NO: 2550011 - RNA, 15 nt, Human
uuguggcugucagca

SEQ ID NO: 2550012 - RNA, 20 nt, Human
uuguggcugucagcaggaag

SEQ ID NO: 2550013 - RNA, 19 nt, Human
uuguggcuccuaucugugu

SEQ ID NO: 2550014 - RNA, 18 nt, Human
uuguggcuccuaucugug

SEQ ID NO: 2550015 - RNA, 14 nt, Human
uuguggcugggggc

SEQ ID NO: 2550016 - RNA, 20 nt, Human
uuguggccaaggagcugcua

SEQ ID NO: 2550017 - RNA, 13 nt, Human
uuguggccuggga

SEQ ID NO: 2550018 - RNA, 13 nt, Human
uuguggccucaga

SEQ ID NO: 2550019 - RNA, 21 nt, Human
uuguggccugggccuccucac

SEQ ID NO: 2550020 - RNA, 19 nt, Human
uuuaaauucacaauagaaa

SEQ ID NO: 2550021 - RNA, 21 nt, Human
uuuaaauucacaauagaaacu

SEQ ID NO: 2550022 - RNA, 20 nt, Human
uuuaaauuauaacuuaaaau

SEQ ID NO: 2550023 - RNA, 18 nt, Human
uuuaaauguuuuucuaug

SEQ ID NO: 2550024 - RNA, 18 nt, Human
uuuaaaugucuaauguau

SEQ ID NO: 2550025 - RNA, 20 nt, Human
uuuaagauaauaguuuacau

SEQ ID NO: 2550026 - RNA, 15 nt, Human
uuuaagauaauaguu

SEQ ID NO: 2550027 - RNA, 23 nt, Human
uuuaagauaauaauauauguuua

SEQ ID NO: 2550028 - RNA, 18 nt, Human
uuuaagauaauaauauau

SEQ ID NO: 2550029 - RNA, 15 nt, Human
uuuaagauaauuaua

SEQ ID NO: 2550030 - RNA, 15 nt, Human
uuuaagauaaauuau

SEQ ID NO: 2550031 - RNA, 23 nt, Human
uuuaagcacuacauaaacugacu

SEQ ID NO: 2550032 - RNA, 17 nt, Human
uuuaagauuuuucucaa

SEQ ID NO: 2550033 - RNA, 13 nt, Human
uuuaagcauuguu

SEQ ID NO: 2550034 - RNA, 20 nt, Human
uuuaagcagcucuugcuaau

SEQ ID NO: 2550035 - RNA, 13 nt, Human
uuuaagcagcucu

SEQ ID NO: 2550036 - RNA, 14 nt, Human
uuuaagcauuguuu

SEQ ID NO: 2550037 - RNA, 21 nt, Human
uuuaagcauuguuugcuuauu

SEQ ID NO: 2550038 - RNA, 20 nt, Human
uuuaagcacuacauaaacug

SEQ ID NO: 2550039 - RNA, 18 nt, Human
uuuaagauuuuucucaaa

SEQ ID NO: 2550040 - RNA, 16 nt, Human
uuuaagauuuuucuca

SEQ ID NO: 2550041 - RNA, 14 nt, Human
uuuaagauuuuucu

SEQ ID NO: 2550042 - RNA, 14 nt, Human
uuuaagauaauuau

SEQ ID NO: 2550043 - RNA, 12 nt, Human
uuuaagauuuuu

SEQ ID NO: 2550044 - RNA, 14 nt, Human
uuuaaauguuuuuu

SEQ ID NO: 2550045 - RNA, 16 nt, Human
uuuaaaugucuaaugu

SEQ ID NO: 2550046 - RNA, 15 nt, Human
uuuaaaugucuaaug

SEQ ID NO: 2550047 - RNA, 19 nt, Human
uuguuuuaucaugacaugu

SEQ ID NO: 2550048 - RNA, 14 nt, Human
uuguuuucauuauc

SEQ ID NO: 2550049 - RNA, 17 nt, Human
uuguuuucccgccaagc

SEQ ID NO: 2550050 - RNA, 15 nt, Human
uuguuuuacugucuu

SEQ ID NO: 2550051 - RNA, 15 nt, Human
augcacuuuguucug

SEQ ID NO: 2550052 - RNA, 13 nt, Human
uuguuuucagugu

SEQ ID NO: 2550053 - RNA, 16 nt, Human
uuguuuucaguguaca

SEQ ID NO: 2550054 - RNA, 22 nt, Human
uuuaauuccaugaaucgcuucu

SEQ ID NO: 2550055 - RNA, 13 nt, Human
uuuaauuccauga

SEQ ID NO: 2550056 - RNA, 11 nt, Human
uuuaauuccau

SEQ ID NO: 2550057 - RNA, 21 nt, Human
uuuaauuccaauaugaugacu

SEQ ID NO: 2550058 - RNA, 11 nt, Human
uuuaauucucu

SEQ ID NO: 2550059 - RNA, 13 nt, Human
uuuaauucucuug

SEQ ID NO: 2550060 - RNA, 14 nt, Human
uuuaauugauuauu

SEQ ID NO: 2550061 - RNA, 12 nt, Human
uuuaauuuuaca

SEQ ID NO: 2550062 - RNA, 21 nt, Human
uuuaauggacaugagauaaug

SEQ ID NO: 2550063 - RNA, 22 nt, Human
uuuaauggggguagcagcugga

SEQ ID NO: 2550064 - RNA, 21 nt, Human
uuuaauggggguagcagcugg

SEQ ID NO: 2550065 - RNA, 20 nt, Human
uuuaauggggguagcagcug

SEQ ID NO: 2550066 - RNA, 22 nt, Human
uuuaauggccggcuggaaaugc

SEQ ID NO: 2550067 - RNA, 23 nt, Human
uuuaaugccgauauacucuagau

SEQ ID NO: 2550068 - RNA, 20 nt, Human
uuuaauggccggcuggaaau

SEQ ID NO: 2550069 - RNA, 16 nt, Human
uuuaauuccaauauga

SEQ ID NO: 2550070 - RNA, 23 nt, Human
uuuaauucaucccaacugucuuu

SEQ ID NO: 2550071 - RNA, 23 nt, Human
uuuaauucauguuucuuaaaugg

SEQ ID NO: 2550072 - RNA, 14 nt, Human
uuuaauucauguuu

SEQ ID NO: 2550073 - RNA, 16 nt, Human
uuuaauucauguuucu

SEQ ID NO: 2550074 - RNA, 14 nt, Human
uuuaauguagccau

SEQ ID NO: 2550075 - RNA, 12 nt, Human
uuuaauucaguu

SEQ ID NO: 2550076 - RNA, 17 nt, Human
uuuaagugcugcauuua

SEQ ID NO: 2550077 - RNA, 19 nt, Human
uuuaagugcugcauuuaaa

SEQ ID NO: 2550078 - RNA, 13 nt, Human
uuuaagcuguaaa

SEQ ID NO: 2550079 - RNA, 14 nt, Human
uuuaaugagauaau

SEQ ID NO: 2550080 - RNA, 15 nt, Human
uuuaagugcugcauu

SEQ ID NO: 2550081 - RNA, 16 nt, Human
uuuaagugcugcauuu

SEQ ID NO: 2550082 - RNA, 19 nt, Human
uuuaagccucauauuuaaa

SEQ ID NO: 2550083 - RNA, 20 nt, Human
uuuaagcccaucaauuauag

SEQ ID NO: 2550084 - RNA, 23 nt, Human
uuuaagcauuguuugcuuauugu

SEQ ID NO: 2550085 - RNA, 15 nt, Human
augccacuaaauuga

SEQ ID NO: 2550086 - RNA, 17 nt, Human
augccacuaaauugaca

SEQ ID NO: 2550087 - RNA, 18 nt, Human
augcccacccccugcccu

SEQ ID NO: 2550088 - RNA, 17 nt, Human
augcccacccccugccc

SEQ ID NO: 2550089 - RNA, 16 nt, Human
augcccacccccugcc

SEQ ID NO: 2550090 - RNA, 15 nt, Human
augcccacccccugc

SEQ ID NO: 2550091 - RNA, 12 nt, Human
augcccaccccc

SEQ ID NO: 2550092 - RNA, 14 nt, Human
augccacugccuuc

SEQ ID NO: 2550093 - RNA, 23 nt, Human
augccaaguuguuugagaaauua

SEQ ID NO: 2550094 - RNA, 19 nt, Human
augccacccuguuuucagc

SEQ ID NO: 2550095 - RNA, 20 nt, Human
augccacccuguuuucagcu

SEQ ID NO: 2550096 - RNA, 17 nt, Human
augccacgggaaguuua

SEQ ID NO: 2550097 - RNA, 19 nt, Human
augcccaguuucugccucu

SEQ ID NO: 2550098 - RNA, 18 nt, Human
augcccaguuucugccuc

SEQ ID NO: 2550099 - RNA, 17 nt, Human
augcccaguuucugccu

SEQ ID NO: 2550100 - RNA, 20 nt, Human
augcccagagggcccaggca

SEQ ID NO: 2550101 - RNA, 21 nt, Human
augcccagagggcccaggcag

SEQ ID NO: 2550102 - RNA, 22 nt, Human
augcccagagggcccaggcagg

SEQ ID NO: 2550103 - RNA, 23 nt, Human
augcccagagggcccaggcaggc

SEQ ID NO: 2550104 - RNA, 20 nt, Human
augcccaccugcccaucaca

SEQ ID NO: 2550105 - RNA, 21 nt, Human
augcccaccugcccaucacag

SEQ ID NO: 2550106 - RNA, 20 nt, Human
augcccacccccugcccugc

SEQ ID NO: 2550107 - RNA, 19 nt, Human
augcccacccccugcccug

SEQ ID NO: 2550108 - RNA, 15 nt, Human
augcccaccugccca

SEQ ID NO: 2550109 - RNA, 16 nt, Human
augcccaccugcccau

SEQ ID NO: 2550110 - RNA, 19 nt, Human
augcccaccugcccaucac

SEQ ID NO: 2550111 - RNA, 14 nt, Human
augccaaguuguuu

SEQ ID NO: 2550112 - RNA, 16 nt, Human
augccaaguuguuuga

SEQ ID NO: 2550113 - RNA, 19 nt, Human
augccaagcacugugcuca

SEQ ID NO: 2550114 - RNA, 18 nt, Human
augccaagcacugugcuc

SEQ ID NO: 2550115 - RNA, 21 nt, Human
augccaagcacugugcucagg

SEQ ID NO: 2550116 - RNA, 17 nt, Human
augccaagcacugugcu

SEQ ID NO: 2550117 - RNA, 16 nt, Human
augccaagcacugugc

SEQ ID NO: 2550118 - RNA, 23 nt, Human
augccaagaaguuuaaggaauau

SEQ ID NO: 2550119 - RNA, 14 nt, Human
augccaacuugucc

SEQ ID NO: 2550120 - RNA, 20 nt, Human
augccaaauuguaguucuug

SEQ ID NO: 2550121 - RNA, 17 nt, Human
augcauaaauaugcagu

SEQ ID NO: 2550122 - RNA, 16 nt, Human
augcauaaauaugcag

SEQ ID NO: 2550123 - RNA, 15 nt, Human
augcauaaauaugca

SEQ ID NO: 2550124 - RNA, 14 nt, Human
augcauaaauaugc

SEQ ID NO: 2550125 - RNA, 21 nt, Human
augcauaaauaugcagugaua

SEQ ID NO: 2550126 - RNA, 18 nt, Human
augccaaagcuagggugg

SEQ ID NO: 2550127 - RNA, 22 nt, Human
augccaaagcuaggguggcccu

SEQ ID NO: 2550128 - RNA, 19 nt, Human
augcaguucugaagaagau

SEQ ID NO: 2550129 - RNA, 18 nt, Human
augcaguucugaagaaga

SEQ ID NO: 2550130 - RNA, 22 nt, Human
augcaguuuuucagaguggaau

SEQ ID NO: 2550131 - RNA, 17 nt, Human
augcaguuuuucagagu

SEQ ID NO: 2550132 - RNA, 15 nt, Human
augcauaaagucagu

SEQ ID NO: 2550133 - RNA, 15 nt, Human
augcaguuuuccuua

SEQ ID NO: 2550134 - RNA, 11 nt, Human
uuuaauuuugu

SEQ ID NO: 2550135 - RNA, 22 nt, Human
uuuaauuuugacacuauaucug

SEQ ID NO: 2550136 - RNA, 21 nt, Human
uuuaauuugauaucacagucu

SEQ ID NO: 2550137 - RNA, 13 nt, Human
augcagccucaca

SEQ ID NO: 2550138 - RNA, 16 nt, Human
uuuaauuuuguauuuu

SEQ ID NO: 2550139 - RNA, 15 nt, Human
uuuaauuuuguauuu

SEQ ID NO: 2550140 - RNA, 21 nt, Human
augcagccgugaucaagggaa

SEQ ID NO: 2550141 - RNA, 15 nt, Human
augcagccucacagu

SEQ ID NO: 2550142 - RNA, 14 nt, Human
augcagccucacag

SEQ ID NO: 2550143 - RNA, 20 nt, Human
augcagggauugcugccacu

SEQ ID NO: 2550144 - RNA, 19 nt, Human
augcagggauugcugccac

SEQ ID NO: 2550145 - RNA, 13 nt, Human
augcagggcaguc

SEQ ID NO: 2550146 - RNA, 17 nt, Human
augcagccucacagucc

SEQ ID NO: 2550147 - RNA, 19 nt, Human
augcagggccucacacggu

SEQ ID NO: 2550148 - RNA, 22 nt, Human
augcagggauugcugccacuuu

SEQ ID NO: 2550149 - RNA, 15 nt, Human
augcagggcagucau

SEQ ID NO: 2550150 - RNA, 17 nt, Human
augcaguucugaagaag

SEQ ID NO: 2550151 - RNA, 15 nt, Human
augcaguucugaaga

SEQ ID NO: 2550152 - RNA, 23 nt, Human
augcagugauauggcagaagaca

SEQ ID NO: 2550153 - RNA, 24 nt, Human
augcagugcucgcuguugcugaau

SEQ ID NO: 2550154 - RNA, 23 nt, Human
augcagugcucgcuguugcugaa

SEQ ID NO: 2550155 - RNA, 21 nt, Human
augcagugcucgcuguugcug

SEQ ID NO: 2550156 - RNA, 20 nt, Human
augcagugcucgcuguugcu

SEQ ID NO: 2550157 - RNA, 19 nt, Human
augcagugcucgcuguugc

SEQ ID NO: 2550158 - RNA, 17 nt, Human
augcagugcucgcuguu

SEQ ID NO: 2550159 - RNA, 13 nt, Human
augcagugcucgc

SEQ ID NO: 2550160 - RNA, 22 nt, Human
augcagugauauggcagaagac

SEQ ID NO: 2550161 - RNA, 21 nt, Human
augcagugauauggcagaaga

SEQ ID NO: 2550162 - RNA, 19 nt, Human
augcagugauauggcagaa

SEQ ID NO: 2550163 - RNA, 18 nt, Human
augcagugauauggcaga

SEQ ID NO: 2550164 - RNA, 18 nt, Human
augcagugccccuagcuu

SEQ ID NO: 2550165 - RNA, 16 nt, Human
augcagugaauuguga

SEQ ID NO: 2550166 - RNA, 15 nt, Human
augcaguauugagca

SEQ ID NO: 2550167 - RNA, 13 nt, Human
augcuucauacag

SEQ ID NO: 2550168 - RNA, 15 nt, Human
augcuucauacaggg

SEQ ID NO: 2550169 - RNA, 16 nt, Human
augcuucauacaggga

SEQ ID NO: 2550170 - RNA, 19 nt, Human
augcuucauacagggaugg

SEQ ID NO: 2550171 - RNA, 11 nt, Human
augcuucauac

SEQ ID NO: 2550172 - RNA, 12 nt, Human
augcuucauaca

SEQ ID NO: 2550173 - RNA, 21 nt, Human
augcuuauuuuaaaauuuuau

SEQ ID NO: 2550174 - RNA, 10 nt, Human
augcuucaua

SEQ ID NO: 2550175 - RNA, 22 nt, Human
augcugucuacacuaagagaga

SEQ ID NO: 2550176 - RNA, 23 nt, Human
augcugucccuuacgugaguccu

SEQ ID NO: 2550177 - RNA, 12 nt, Human
augcuguacauc

SEQ ID NO: 2550178 - RNA, 16 nt, Human
augcuguacaucuauu

SEQ ID NO: 2550179 - RNA, 19 nt, Human
augcugucccuuacgugag

SEQ ID NO: 2550180 - RNA, 15 nt, Human
auggaacacucugag

SEQ ID NO: 2550181 - RNA, 14 nt, Human
auggaacacucuga

SEQ ID NO: 2550182 - RNA, 22 nt, Human
augcuguacaucuauuuuggau

SEQ ID NO: 2550183 - RNA, 22 nt, Human
augcugucaacuaugauauggu

SEQ ID NO: 2550184 - RNA, 23 nt, Human
augcuucauacagggaugguguu

SEQ ID NO: 2550185 - RNA, 11 nt, Human
auggaacacuc

SEQ ID NO: 2550186 - RNA, 15 nt, Human
auggaagacagcucu

SEQ ID NO: 2550187 - RNA, 14 nt, Human
auggaagacacauu

SEQ ID NO: 2550188 - RNA, 13 nt, Human
auggaagacacau

SEQ ID NO: 2550189 - RNA, 19 nt, Human
auggaacuucuaauauauu

SEQ ID NO: 2550190 - RNA, 18 nt, Human
auggaacuucuaauauau

SEQ ID NO: 2550191 - RNA, 22 nt, Human
auggaacucauuccugccuguc

SEQ ID NO: 2550192 - RNA, 16 nt, Human
auggaacacucugaga

SEQ ID NO: 2550193 - RNA, 19 nt, Human
auggaacucauuccugccu

SEQ ID NO: 2550194 - RNA, 22 nt, Human
augcuacuuuauuuauacacug

SEQ ID NO: 2550195 - RNA, 15 nt, Human
augcuccuugggccc

SEQ ID NO: 2550196 - RNA, 23 nt, Human
augcuacugucucacugaaacau

SEQ ID NO: 2550197 - RNA, 16 nt, Human
augcuccuugggcccu

SEQ ID NO: 2550198 - RNA, 15 nt, Human
augcuccuuguuccu

SEQ ID NO: 2550199 - RNA, 18 nt, Human
augcuccuuguuccuaga

SEQ ID NO: 2550200 - RNA, 21 nt, Human
augcucuaucuugcucuguaa

SEQ ID NO: 2550201 - RNA, 19 nt, Human
augcucuaucuugcucugu

SEQ ID NO: 2550202 - RNA, 16 nt, Human
augcucuagugccuuc

SEQ ID NO: 2550203 - RNA, 17 nt, Human
augcucuagugccuucu

SEQ ID NO: 2550204 - RNA, 16 nt, Human
augcuagaacucccuu

SEQ ID NO: 2550205 - RNA, 19 nt, Human
augcuagaacucccuuuca

SEQ ID NO: 2550206 - RNA, 15 nt, Human
augcuagaacucccu

SEQ ID NO: 2550207 - RNA, 13 nt, Human
uuuauuacugauu

SEQ ID NO: 2550208 - RNA, 20 nt, Human
uuuauuaccucugauaccuc

SEQ ID NO: 2550209 - RNA, 14 nt, Human
uuuauuaccucuga

SEQ ID NO: 2550210 - RNA, 12 nt, Human
uuuauuaccccc

SEQ ID NO: 2550211 - RNA, 17 nt, Human
uuuauuacccccuccuu

SEQ ID NO: 2550212 - RNA, 23 nt, Human
uuuauuacccccuccuucagaca

SEQ ID NO: 2550213 - RNA, 13 nt, Human
uuuauuaccucug

SEQ ID NO: 2550214 - RNA, 22 nt, Human
uuuauuaaacagauuuuuacaa

SEQ ID NO: 2550215 - RNA, 16 nt, Human
uuuauuacaucuuuca

SEQ ID NO: 2550216 - RNA, 15 nt, Human
augcucugcauguua

SEQ ID NO: 2550217 - RNA, 23 nt, Human
augcucucugcagccagcccagc

SEQ ID NO: 2550218 - RNA, 19 nt, Human
augcuggaugucugccaau

SEQ ID NO: 2550219 - RNA, 14 nt, Human
augcucuccuuucc

SEQ ID NO: 2550220 - RNA, 13 nt, Human
augcucucugcag

SEQ ID NO: 2550221 - RNA, 19 nt, Human
augcucucugcagccagcc

SEQ ID NO: 2550222 - RNA, 21 nt, Human
augcucucugcagccagccca

SEQ ID NO: 2550223 - RNA, 22 nt, Human
augcucucugcagccagcccag

SEQ ID NO: 2550224 - RNA, 13 nt, Human
augcuggcccagg

SEQ ID NO: 2550225 - RNA, 15 nt, Human
augcuggcccagggc

SEQ ID NO: 2550226 - RNA, 16 nt, Human
augcuggcccagggcc

SEQ ID NO: 2550227 - RNA, 18 nt, Human
augcuggcccagggccca

SEQ ID NO: 2550228 - RNA, 22 nt, Human
augcuggaugucugccaauuuu

SEQ ID NO: 2550229 - RNA, 12 nt, Human
augcuggcccag

SEQ ID NO: 2550230 - RNA, 23 nt, Human
augcuggcauuugcaccuaccuc

SEQ ID NO: 2550231 - RNA, 19 nt, Human
augcuggcccagggcccag

SEQ ID NO: 2550232 - RNA, 20 nt, Human
augcuggcccagggcccaga

SEQ ID NO: 2550233 - RNA, 21 nt, Human
augcuggcccagggcccagag

SEQ ID NO: 2550234 - RNA, 22 nt, Human
augcuggcccagggcccagagc

SEQ ID NO: 2550235 - RNA, 23 nt, Human
augcuggcccagggcccagagcc

SEQ ID NO: 2550236 - RNA, 21 nt, Human
augcugguuuuccuaaaugca

SEQ ID NO: 2550237 - RNA, 22 nt, Human
augcugguuuuccuaaaugcag

SEQ ID NO: 2550238 - RNA, 22 nt, Human
augcuguaacuuucugaaauaa

SEQ ID NO: 2550239 - RNA, 13 nt, Human
augcugguuuuuc

SEQ ID NO: 2550240 - RNA, 23 nt, Human
uuuauguuugcacuugugauuau

SEQ ID NO: 2550241 - RNA, 17 nt, Human
uuuauuaaacagauuuu

SEQ ID NO: 2550242 - RNA, 23 nt, Human
uuuauuaaaaugauuguaaaaua

SEQ ID NO: 2550243 - RNA, 22 nt, Human
uuuauuaaaaugauuguaaaau

SEQ ID NO: 2550244 - RNA, 21 nt, Human
uuuauuaaaaugauuguaaaa

SEQ ID NO: 2550245 - RNA, 13 nt, Human
uuuauuaaaaucu

SEQ ID NO: 2550246 - RNA, 14 nt, Human
uuuauuaaaaucuu

SEQ ID NO: 2550247 - RNA, 15 nt, Human
uuuauuaaaaucuua

SEQ ID NO: 2550248 - RNA, 14 nt, Human
uuuauuaaaaugau

SEQ ID NO: 2550249 - RNA, 16 nt, Human
uuuauuaaaaucuuaa

SEQ ID NO: 2550250 - RNA, 20 nt, Human
uuuauguuacuacaugcacu

SEQ ID NO: 2550251 - RNA, 20 nt, Human
uuuauguuaagggaagaauu

SEQ ID NO: 2550252 - RNA, 13 nt, Human
uuuauguuauuua

SEQ ID NO: 2550253 - RNA, 11 nt, Human
uuuaugugugu

SEQ ID NO: 2550254 - RNA, 13 nt, Human
uuuaugugugugu

SEQ ID NO: 2550255 - RNA, 12 nt, Human
uuuaugugaugg

SEQ ID NO: 2550256 - RNA, 18 nt, Human
uuuaugugugaggagcug

SEQ ID NO: 2550257 - RNA, 22 nt, Human
uuuaugugugaggagcugcugg

SEQ ID NO: 2550258 - RNA, 13 nt, Human
uuuauauaagcuu

SEQ ID NO: 2550259 - RNA, 16 nt, Human
uuuauagcucaguuua

SEQ ID NO: 2550260 - RNA, 20 nt, Human
uuuauggcuuuugugcauua

SEQ ID NO: 2550261 - RNA, 19 nt, Human
uuuauaguuuguacaugca

SEQ ID NO: 2550262 - RNA, 17 nt, Human
uuuauaguuuguacaug

SEQ ID NO: 2550263 - RNA, 22 nt, Human
uuuauggggcugaacggggaga

SEQ ID NO: 2550264 - RNA, 24 nt, Human
uuuauggcuuuugugcauuaucua

SEQ ID NO: 2550265 - RNA, 14 nt, Human
uuuauauaaaugcu

SEQ ID NO: 2550266 - RNA, 22 nt, Human
uuuaugggucagaguuccgacu

SEQ ID NO: 2550267 - RNA, 18 nt, Human
augccccggccaccucug

SEQ ID NO: 2550268 - RNA, 17 nt, Human
augccccggccaccucu

SEQ ID NO: 2550269 - RNA, 16 nt, Human
augccccggccaccuc

SEQ ID NO: 2550270 - RNA, 15 nt, Human
augccccggccaccu

SEQ ID NO: 2550271 - RNA, 21 nt, Human
augcccccuuucagaugucuu

SEQ ID NO: 2550272 - RNA, 19 nt, Human
augcccccuuucagauguc

SEQ ID NO: 2550273 - RNA, 18 nt, Human
augcccccuuucagaugu

SEQ ID NO: 2550274 - RNA, 13 nt, Human
augcccccuuuca

SEQ ID NO: 2550275 - RNA, 20 nt, Human
augccccggccaccucugcg

SEQ ID NO: 2550276 - RNA, 19 nt, Human
augccccggccaccucugc

SEQ ID NO: 2550277 - RNA, 17 nt, Human
augcccccucgugccag

SEQ ID NO: 2550278 - RNA, 18 nt, Human
augcccccucgugccagu

SEQ ID NO: 2550279 - RNA, 22 nt, Human
augccccccucaaaccuccucu

SEQ ID NO: 2550280 - RNA, 21 nt, Human
augccccccucaaaccuccuc

SEQ ID NO: 2550281 - RNA, 15 nt, Human
augcccccucgugcc

SEQ ID NO: 2550282 - RNA, 13 nt, Human
augccccccucaa

SEQ ID NO: 2550283 - RNA, 16 nt, Human
augcccccagcuggcc

SEQ ID NO: 2550284 - RNA, 15 nt, Human
augcccccagcuggc

SEQ ID NO: 2550285 - RNA, 14 nt, Human
augcccccagcugg

SEQ ID NO: 2550286 - RNA, 13 nt, Human
augcccccagcug

SEQ ID NO: 2550287 - RNA, 15 nt, Human
augccccagagcugu

SEQ ID NO: 2550288 - RNA, 22 nt, Human
uuuagauugaaaacuuuucuca

SEQ ID NO: 2550289 - RNA, 13 nt, Human
uuuagaugcugau

SEQ ID NO: 2550290 - RNA, 19 nt, Human
uuuagauugaaaacuuuuc

SEQ ID NO: 2550291 - RNA, 11 nt, Human
uuuagaugcug

SEQ ID NO: 2550292 - RNA, 20 nt, Human
uuuagcuggaaaaguauguu

SEQ ID NO: 2550293 - RNA, 22 nt, Human
uuuagcaauuuaauauuuugca

SEQ ID NO: 2550294 - RNA, 23 nt, Human
uuuagcaauuuaauauuuugcac

SEQ ID NO: 2550295 - RNA, 22 nt, Human
uuuagcagcagccuuuaaugca

SEQ ID NO: 2550296 - RNA, 16 nt, Human
uuuagucugcaaaaug

SEQ ID NO: 2550297 - RNA, 12 nt, Human
uuuagucacuuu

SEQ ID NO: 2550298 - RNA, 15 nt, Human
uuuagucaugugacc

SEQ ID NO: 2550299 - RNA, 20 nt, Human
uuuauagcuauuacugucug

SEQ ID NO: 2550300 - RNA, 18 nt, Human
uuuagucugcaaaaugag

SEQ ID NO: 2550301 - RNA, 17 nt, Human
uuuauagcuauuacugu

SEQ ID NO: 2550302 - RNA, 16 nt, Human
uuuaguaucuuuuuau

SEQ ID NO: 2550303 - RNA, 23 nt, Human
uuuaguagauauuaccaguuuuc

SEQ ID NO: 2550304 - RNA, 21 nt, Human
uuuaguagauauuaccaguuu

SEQ ID NO: 2550305 - RNA, 13 nt, Human
uuuaggagauuuu

SEQ ID NO: 2550306 - RNA, 15 nt, Human
uuuaguagagacagg

SEQ ID NO: 2550307 - RNA, 22 nt, Human
uuuagcuggaaaaguauguuag

SEQ ID NO: 2550308 - RNA, 18 nt, Human
uuuaggaaaugaaugugu

SEQ ID NO: 2550309 - RNA, 23 nt, Human
uuucaugugcggggaucaucugc

SEQ ID NO: 2550310 - RNA, 23 nt, Human
uuucauguugcacacccacucag

SEQ ID NO: 2550311 - RNA, 17 nt, Human
uuucauguuuuaacaaa

SEQ ID NO: 2550312 - RNA, 19 nt, Human
uuucauguuuuaacaaaaa

SEQ ID NO: 2550313 - RNA, 16 nt, Human
uuucauguuuuaacaa

SEQ ID NO: 2550314 - RNA, 23 nt, Human
uuucauuaaaggcuucucucuca

SEQ ID NO: 2550315 - RNA, 16 nt, Human
uuucauuaaaggcuuc

SEQ ID NO: 2550316 - RNA, 17 nt, Human
uuucauguuuugugacu

SEQ ID NO: 2550317 - RNA, 16 nt, Human
uuucauguuuugugac

SEQ ID NO: 2550318 - RNA, 13 nt, Human
uuucauuaaagca

SEQ ID NO: 2550319 - RNA, 18 nt, Human
uuucauguuuugugacua

SEQ ID NO: 2550320 - RNA, 14 nt, Human
uuucauuaaagcau

SEQ ID NO: 2550321 - RNA, 14 nt, Human
uuucauuaaaggcu

SEQ ID NO: 2550322 - RNA, 16 nt, Human
uuucauuaaagcauuu

SEQ ID NO: 2550323 - RNA, 16 nt, Human
uuucaugauuuugaaa

SEQ ID NO: 2550324 - RNA, 16 nt, Human
uuucaugcuaucucug

SEQ ID NO: 2550325 - RNA, 19 nt, Human
uuucaugcuaucucugugu

SEQ ID NO: 2550326 - RNA, 18 nt, Human
uuucaucugggaaagaca

SEQ ID NO: 2550327 - RNA, 16 nt, Human
uuucaucugggaaaga

SEQ ID NO: 2550328 - RNA, 19 nt, Human
uuucaucugggaaagacau

SEQ ID NO: 2550329 - RNA, 21 nt, Human
uuucaugauuagcaaguuaca

SEQ ID NO: 2550330 - RNA, 15 nt, Human
uuuccccaacagugu

SEQ ID NO: 2550331 - RNA, 14 nt, Human
uuuccccaacagug

SEQ ID NO: 2550332 - RNA, 21 nt, Human
uuuccccaaagucuuaaaaua

SEQ ID NO: 2550333 - RNA, 14 nt, Human
uuuccccaaagucu

SEQ ID NO: 2550334 - RNA, 19 nt, Human
uuuccccaacagugugaag

SEQ ID NO: 2550335 - RNA, 18 nt, Human
uuuccccaacagugugaa

SEQ ID NO: 2550336 - RNA, 16 nt, Human
uuucccauggggaggg

SEQ ID NO: 2550337 - RNA, 13 nt, Human
uuuccccagccca

SEQ ID NO: 2550338 - RNA, 11 nt, Human
uuuccccagcc

SEQ ID NO: 2550339 - RNA, 19 nt, Human
uuuccccaggggaaaauga

SEQ ID NO: 2550340 - RNA, 23 nt, Human
uuuccccauuuagguuucugagu

SEQ ID NO: 2550341 - RNA, 21 nt, Human
uuuccccaggggaaaaugaag

SEQ ID NO: 2550342 - RNA, 12 nt, Human
uuuccccccacu

SEQ ID NO: 2550343 - RNA, 13 nt, Human
uuuccccccacuc

SEQ ID NO: 2550344 - RNA, 17 nt, Human
uuuccccccacucuccc

SEQ ID NO: 2550345 - RNA, 19 nt, Human
uuuccccccacucucccca

SEQ ID NO: 2550346 - RNA, 22 nt, Human
auggacggugcuccaggcaggc

SEQ ID NO: 2550347 - RNA, 21 nt, Human
auggacggugcuccaggcagg

SEQ ID NO: 2550348 - RNA, 20 nt, Human
auggacggugcuccaggcag

SEQ ID NO: 2550349 - RNA, 14 nt, Human
auggacaugaucuu

SEQ ID NO: 2550350 - RNA, 18 nt, Human
auggacagggcaugccac

SEQ ID NO: 2550351 - RNA, 19 nt, Human
auggacaggcuggcuccag

SEQ ID NO: 2550352 - RNA, 14 nt, Human
auggacaggcuggc

SEQ ID NO: 2550353 - RNA, 20 nt, Human
auggacagaagaaggcagca

SEQ ID NO: 2550354 - RNA, 19 nt, Human
auggacagaagaaggcagc

SEQ ID NO: 2550355 - RNA, 18 nt, Human
uuucacugcuggcugccu

SEQ ID NO: 2550356 - RNA, 17 nt, Human
uuucacugcuggcugcc

SEQ ID NO: 2550357 - RNA, 13 nt, Human
uuucacugccaua

SEQ ID NO: 2550358 - RNA, 14 nt, Human
uuucacugcuggcu

SEQ ID NO: 2550359 - RNA, 13 nt, Human
uuucagaaaugug

SEQ ID NO: 2550360 - RNA, 22 nt, Human
uuucacugcuggcugccuuaga

SEQ ID NO: 2550361 - RNA, 20 nt, Human
uuucacugcuggcugccuua

SEQ ID NO: 2550362 - RNA, 16 nt, Human
auggaagacagcucuu

SEQ ID NO: 2550363 - RNA, 16 nt, Human
auggaauaacucugug

SEQ ID NO: 2550364 - RNA, 16 nt, Human
auggaagacacauuga

SEQ ID NO: 2550365 - RNA, 15 nt, Human
auggaauacaguguu

SEQ ID NO: 2550366 - RNA, 16 nt, Human
auggaauacaguguua

SEQ ID NO: 2550367 - RNA, 16 nt, Human
auggaaugcuguguua

SEQ ID NO: 2550368 - RNA, 21 nt, Human
auggaaugaugggucaguugu

SEQ ID NO: 2550369 - RNA, 20 nt, Human
auggaaucuaccaacuguuu

SEQ ID NO: 2550370 - RNA, 17 nt, Human
auggaauacaguguuau

SEQ ID NO: 2550371 - RNA, 22 nt, Human
auggaauacaguguuauuuucu

SEQ ID NO: 2550372 - RNA, 21 nt, Human
uuucagaagugagcuuugcug

SEQ ID NO: 2550373 - RNA, 20 nt, Human
uuucacugcugcaaggccuu

SEQ ID NO: 2550374 - RNA, 22 nt, Human
uuucagaagugagcuuugcugc

SEQ ID NO: 2550375 - RNA, 18 nt, Human
uuucagaaccucuucccc

SEQ ID NO: 2550376 - RNA, 19 nt, Human
uuucagaaccucuucccca

SEQ ID NO: 2550377 - RNA, 20 nt, Human
uuucagaaccucuuccccag

SEQ ID NO: 2550378 - RNA, 23 nt, Human
uuucagaaccucuuccccagaaa

SEQ ID NO: 2550379 - RNA, 22 nt, Human
uuucauauguugcucagucucc

SEQ ID NO: 2550380 - RNA, 11 nt, Human
uuucagacucc

SEQ ID NO: 2550381 - RNA, 10 nt, Human
uuucagaccc

SEQ ID NO: 2550382 - RNA, 14 nt, Human
uuucagaccccagc

SEQ ID NO: 2550383 - RNA, 15 nt, Human
uuucaucugggaaag

SEQ ID NO: 2550384 - RNA, 14 nt, Human
uuucaucugggaaa

SEQ ID NO: 2550385 - RNA, 22 nt, Human
uuucaucugcucuccuuccugg

SEQ ID NO: 2550386 - RNA, 21 nt, Human
uuucaucaaucauuguacagu

SEQ ID NO: 2550387 - RNA, 19 nt, Human
uuucaucaaucauuguaca

SEQ ID NO: 2550388 - RNA, 16 nt, Human
uuucaucauauuauac

SEQ ID NO: 2550389 - RNA, 17 nt, Human
uuucaucauauuauaca

SEQ ID NO: 2550390 - RNA, 21 nt, Human
uuucauauuuuagcuacuaua

SEQ ID NO: 2550391 - RNA, 13 nt, Human
uuucauauuuuag

SEQ ID NO: 2550392 - RNA, 15 nt, Human
uuucauauugugcca

SEQ ID NO: 2550393 - RNA, 14 nt, Human
uuucauauugugcc

SEQ ID NO: 2550394 - RNA, 12 nt, Human
uuucauauugug

SEQ ID NO: 2550395 - RNA, 15 nt, Human
uuucauauguugcuc

SEQ ID NO: 2550396 - RNA, 13 nt, Human
uuucauauuucuu

SEQ ID NO: 2550397 - RNA, 20 nt, Human
auggacguguuaugacucca

SEQ ID NO: 2550398 - RNA, 19 nt, Human
auggacguguuaugacucc

SEQ ID NO: 2550399 - RNA, 23 nt, Human
auggacguguuaugacuccagaa

SEQ ID NO: 2550400 - RNA, 18 nt, Human
auggauuuccagccaaag

SEQ ID NO: 2550401 - RNA, 14 nt, Human
auggcaacagaucu

SEQ ID NO: 2550402 - RNA, 15 nt, Human
auggcaacagaucug

SEQ ID NO: 2550403 - RNA, 18 nt, Human
auggcaaaggaaggugga

SEQ ID NO: 2550404 - RNA, 14 nt, Human
auggcaaaaauggc

SEQ ID NO: 2550405 - RNA, 19 nt, Human
auggauuugaugcuguuug

SEQ ID NO: 2550406 - RNA, 17 nt, Human
auggauuugaugcuguu

SEQ ID NO: 2550407 - RNA, 15 nt, Human
auggauuugaagcaa

SEQ ID NO: 2550408 - RNA, 14 nt, Human
auggauuugaagca

SEQ ID NO: 2550409 - RNA, 21 nt, Human
auggauuuucuauuguuacuc

SEQ ID NO: 2550410 - RNA, 20 nt, Human
auggauuuucuauuguuacu

SEQ ID NO: 2550411 - RNA, 21 nt, Human
auggauuugccugugccaccc

SEQ ID NO: 2550412 - RNA, 18 nt, Human
auggauuuucuauuguua

SEQ ID NO: 2550413 - RNA, 14 nt, Human
auggauuugccugu

SEQ ID NO: 2550414 - RNA, 17 nt, Human
auggcacaucagcacga

SEQ ID NO: 2550415 - RNA, 23 nt, Human
auggcacaucagcacgauuucug

SEQ ID NO: 2550416 - RNA, 21 nt, Human
auggcagaagacaccagagca

SEQ ID NO: 2550417 - RNA, 20 nt, Human
auggcagaagacaccagagc

SEQ ID NO: 2550418 - RNA, 19 nt, Human
auggcagaagacaccagag

SEQ ID NO: 2550419 - RNA, 17 nt, Human
auggcagaagacaccag

SEQ ID NO: 2550420 - RNA, 24 nt, Human
auggcagaagacaccagagcagau

SEQ ID NO: 2550421 - RNA, 22 nt, Human
auggcagaagacaccagagcag

SEQ ID NO: 2550422 - RNA, 13 nt, Human
auggcagaaggca

SEQ ID NO: 2550423 - RNA, 13 nt, Human
auggcagaagaca

SEQ ID NO: 2550424 - RNA, 16 nt, Human
auggcagaagacacca

SEQ ID NO: 2550425 - RNA, 19 nt, Human
auggcaccaaagccaccag

SEQ ID NO: 2550426 - RNA, 24 nt, Human
auggcaacagaucuggaaccucag

SEQ ID NO: 2550427 - RNA, 16 nt, Human
auggcaacagaucugg

SEQ ID NO: 2550428 - RNA, 17 nt, Human
auggcaacagaucugga

SEQ ID NO: 2550429 - RNA, 21 nt, Human
auggcaaggcagcccugucug

SEQ ID NO: 2550430 - RNA, 18 nt, Human
auggcaaggcagcccugu

SEQ ID NO: 2550431 - RNA, 23 nt, Human
auggcaagaaagcugguaaacua

SEQ ID NO: 2550432 - RNA, 19 nt, Human
auggcaaggacugcaggga

SEQ ID NO: 2550433 - RNA, 15 nt, Human
auggcaauuuuguaa

SEQ ID NO: 2550434 - RNA, 16 nt, Human
auggcaauuuuguaac

SEQ ID NO: 2550435 - RNA, 22 nt, Human
auggcacaaucucggcucacug

SEQ ID NO: 2550436 - RNA, 23 nt, Human
auggcaauucuuugaccucaacc

SEQ ID NO: 2550437 - RNA, 23 nt, Human
auggcacagcccaaagaaggaaa

SEQ ID NO: 2550438 - RNA, 23 nt, Human
auggcagaguuuguguguugucu

SEQ ID NO: 2550439 - RNA, 22 nt, Human
auggcagaguuuguguguuguc

SEQ ID NO: 2550440 - RNA, 20 nt, Human
auggcagaguuuguguguug

SEQ ID NO: 2550441 - RNA, 19 nt, Human
auggcagaguuuguguguu

SEQ ID NO: 2550442 - RNA, 21 nt, Human
auggcagaguuguaaauauau

SEQ ID NO: 2550443 - RNA, 20 nt, Human
auggcagaguuguaaauaua

SEQ ID NO: 2550444 - RNA, 18 nt, Human
auggcagaguuguaaaua

SEQ ID NO: 2550445 - RNA, 17 nt, Human
auggcagaguuguaaau

SEQ ID NO: 2550446 - RNA, 15 nt, Human
auggcagaaggcaaa

SEQ ID NO: 2550447 - RNA, 20 nt, Human
auggcagaaggcaaacccau

SEQ ID NO: 2550448 - RNA, 15 nt, Human
auggcagaguuguaa

SEQ ID NO: 2550449 - RNA, 19 nt, Human
auggcagaggaauaucaau

SEQ ID NO: 2550450 - RNA, 21 nt, Human
auggcagaaggcaaacccauc

SEQ ID NO: 2550451 - RNA, 17 nt, Human
auggccaccuuuucagc

SEQ ID NO: 2550452 - RNA, 16 nt, Human
auggccaccuuuucag

SEQ ID NO: 2550453 - RNA, 22 nt, Human
auggccacaguagucuugauga

SEQ ID NO: 2550454 - RNA, 16 nt, Human
auggccagguggccac

SEQ ID NO: 2550455 - RNA, 15 nt, Human
auggccagugucugu

SEQ ID NO: 2550456 - RNA, 22 nt, Human
auggccagguggccacuccaga

SEQ ID NO: 2550457 - RNA, 21 nt, Human
auggccgggcgcgguggcuca

SEQ ID NO: 2550458 - RNA, 18 nt, Human
auggcccuucccacugga

SEQ ID NO: 2550459 - RNA, 18 nt, Human
auggccggagaggaccgg

SEQ ID NO: 2550460 - RNA, 13 nt, Human
auggccggccggg

SEQ ID NO: 2550461 - RNA, 20 nt, Human
auggccuuugcuugaaagaa

SEQ ID NO: 2550462 - RNA, 16 nt, Human
auggccugggggaugu

SEQ ID NO: 2550463 - RNA, 19 nt, Human
auggccugccuugaagcca

SEQ ID NO: 2550464 - RNA, 20 nt, Human
auggccugccuugaagccac

SEQ ID NO: 2550465 - RNA, 21 nt, Human
auggccucaagaucaaugaaa

SEQ ID NO: 2550466 - RNA, 13 nt, Human
auggccucagcug

SEQ ID NO: 2550467 - RNA, 14 nt, Human
auggccucagcugc

SEQ ID NO: 2550468 - RNA, 21 nt, Human
auggccuauuauauuaaaaua

SEQ ID NO: 2550469 - RNA, 20 nt, Human
auggccuauuauauuaaaau

SEQ ID NO: 2550470 - RNA, 18 nt, Human
auggccuaugcacauaug

SEQ ID NO: 2550471 - RNA, 15 nt, Human
auggccguuggccac

SEQ ID NO: 2550472 - RNA, 19 nt, Human
auggcgcagugccucuggu

SEQ ID NO: 2550473 - RNA, 17 nt, Human
auggcgcagugccucug

SEQ ID NO: 2550474 - RNA, 16 nt, Human
auggcgcagugccucu

SEQ ID NO: 2550475 - RNA, 14 nt, Human
auggcgcagugccu

SEQ ID NO: 2550476 - RNA, 12 nt, Human
auggccuggcca

SEQ ID NO: 2550477 - RNA, 19 nt, Human
auggccuugcagcacucac

SEQ ID NO: 2550478 - RNA, 20 nt, Human
auggcuaguaucaaaagaaa

SEQ ID NO: 2550479 - RNA, 21 nt, Human
auggcuauaaacaauuacaug

SEQ ID NO: 2550480 - RNA, 16 nt, Human
auggcuaauucccaga

SEQ ID NO: 2550481 - RNA, 18 nt, Human
auggcgcagugccucugg

SEQ ID NO: 2550482 - RNA, 17 nt, Human
auggcuaauucccagag

SEQ ID NO: 2550483 - RNA, 16 nt, Human
augacuuacuguacau

SEQ ID NO: 2550484 - RNA, 17 nt, Human
augacuuacuguacaug

SEQ ID NO: 2550485 - RNA, 16 nt, Human
augacuucauuaauaa

SEQ ID NO: 2550486 - RNA, 11 nt, Human
augacuuugga

SEQ ID NO: 2550487 - RNA, 21 nt, Human
augacuuuauugcaucugggu

SEQ ID NO: 2550488 - RNA, 23 nt, Human
augacuuuauauggaugauucag

SEQ ID NO: 2550489 - RNA, 13 nt, Human
augacuuuauugc

SEQ ID NO: 2550490 - RNA, 16 nt, Human
augacuuuauugcauc

SEQ ID NO: 2550491 - RNA, 20 nt, Human
augacuuuuccauguaucua

SEQ ID NO: 2550492 - RNA, 12 nt, Human
augacuuuggac

SEQ ID NO: 2550493 - RNA, 17 nt, Human
augacuuuuccauguau

SEQ ID NO: 2550494 - RNA, 14 nt, Human
augagaaaagaggc

SEQ ID NO: 2550495 - RNA, 18 nt, Human
augacacgaauauugcug

SEQ ID NO: 2550496 - RNA, 17 nt, Human
augacacauuuggcagu

SEQ ID NO: 2550497 - RNA, 21 nt, Human
augaauuuuuuucaucuucuc

SEQ ID NO: 2550498 - RNA, 23 nt, Human
augacauugcuaagaugcucuau

SEQ ID NO: 2550499 - RNA, 20 nt, Human
augacauugcuaagaugcuc

SEQ ID NO: 2550500 - RNA, 14 nt, Human
augacauugcuaag

SEQ ID NO: 2550501 - RNA, 13 nt, Human
augacauugcuaa

SEQ ID NO: 2550502 - RNA, 18 nt, Human
augacauucaugccuggc

SEQ ID NO: 2550503 - RNA, 17 nt, Human
augacauucaugccugg

SEQ ID NO: 2550504 - RNA, 22 nt, Human
augacuuaagcacacuugacau

SEQ ID NO: 2550505 - RNA, 14 nt, Human
augacuuacuguac

SEQ ID NO: 2550506 - RNA, 15 nt, Human
augaccaaaguccuu

SEQ ID NO: 2550507 - RNA, 17 nt, Human
augacauuuugccaaaa

SEQ ID NO: 2550508 - RNA, 23 nt, Human
augaccaauauuauacuaagaaa

SEQ ID NO: 2550509 - RNA, 22 nt, Human
augacauuuauaucacauguuu

SEQ ID NO: 2550510 - RNA, 18 nt, Human
augacauuuauuuuucau

SEQ ID NO: 2550511 - RNA, 14 nt, Human
augacauuuugcca

SEQ ID NO: 2550512 - RNA, 22 nt, Human
augacauuucuuugugcuuugg

SEQ ID NO: 2550513 - RNA, 21 nt, Human
augacauuucuuugugcuuug

SEQ ID NO: 2550514 - RNA, 18 nt, Human
augagaaaucuaaaaaac

SEQ ID NO: 2550515 - RNA, 15 nt, Human
augagaaaucuaaaa

SEQ ID NO: 2550516 - RNA, 22 nt, Human
augagaaagguugaagcaccaa

SEQ ID NO: 2550517 - RNA, 21 nt, Human
augagaaagguugaagcacca

SEQ ID NO: 2550518 - RNA, 13 nt, Human
augagaacaaaca

SEQ ID NO: 2550519 - RNA, 23 nt, Human
augagaaaucuaaaaaacgaaaa

SEQ ID NO: 2550520 - RNA, 14 nt, Human
augagaacucugag

SEQ ID NO: 2550521 - RNA, 19 nt, Human
augagagacacacugaaga

SEQ ID NO: 2550522 - RNA, 17 nt, Human
augagagacacacugaa

SEQ ID NO: 2550523 - RNA, 14 nt, Human
augagagacacacu

SEQ ID NO: 2550524 - RNA, 13 nt, Human
augagagacacac

SEQ ID NO: 2550525 - RNA, 22 nt, Human
augagacauaggccaugaaaaa

SEQ ID NO: 2550526 - RNA, 20 nt, Human
augagacaggaccuaggaua

SEQ ID NO: 2550527 - RNA, 18 nt, Human
augagaccacuguuauca

SEQ ID NO: 2550528 - RNA, 21 nt, Human
augagacccauuccuauuucu

SEQ ID NO: 2550529 - RNA, 21 nt, Human
augagaauuugagugcucuga

SEQ ID NO: 2550530 - RNA, 18 nt, Human
augagacaggaccuagga

SEQ ID NO: 2550531 - RNA, 11 nt, Human
augagaaucua

SEQ ID NO: 2550532 - RNA, 23 nt, Human
augagaaucuacccccagaucca

SEQ ID NO: 2550533 - RNA, 22 nt, Human
augagaaguugauauagaacag

SEQ ID NO: 2550534 - RNA, 15 nt, Human
augagaaggcagcca

SEQ ID NO: 2550535 - RNA, 21 nt, Human
augagaagagggccuguggga

SEQ ID NO: 2550536 - RNA, 18 nt, Human
augagaaggaauuugagu

SEQ ID NO: 2550537 - RNA, 18 nt, Human
augagaagagggccugug

SEQ ID NO: 2550538 - RNA, 16 nt, Human
augagaagagggccug

SEQ ID NO: 2550539 - RNA, 16 nt, Human
augagaaggaacuucc

SEQ ID NO: 2550540 - RNA, 15 nt, Human
augagaagagggccu

SEQ ID NO: 2550541 - RNA, 14 nt, Human
augacacaugcaag

SEQ ID NO: 2550542 - RNA, 22 nt, Human
augacacaugcaaggucauuuu

SEQ ID NO: 2550543 - RNA, 23 nt, Human
augaauuuaaauauaauucugua

SEQ ID NO: 2550544 - RNA, 23 nt, Human
augaauuuuguuuggacuucuuu

SEQ ID NO: 2550545 - RNA, 22 nt, Human
augaauuuucaaguaauuguga

SEQ ID NO: 2550546 - RNA, 18 nt, Human
augaauuuucaaguaauu

SEQ ID NO: 2550547 - RNA, 16 nt, Human
uuguaucacaaaucuu

SEQ ID NO: 2550548 - RNA, 17 nt, Human
uuguauauuuguacaaa

SEQ ID NO: 2550549 - RNA, 16 nt, Human
uuguauauuuguacaa

SEQ ID NO: 2550550 - RNA, 15 nt, Human
uuguauauuuguaca

SEQ ID NO: 2550551 - RNA, 14 nt, Human
uuguauauuuguac

SEQ ID NO: 2550552 - RNA, 19 nt, Human
uuguauauuguguuugugu

SEQ ID NO: 2550553 - RNA, 13 nt, Human
uuguauauuugua

SEQ ID NO: 2550554 - RNA, 19 nt, Human
uuguauauugucagauauu

SEQ ID NO: 2550555 - RNA, 16 nt, Human
augaauuuaaauauaa

SEQ ID NO: 2550556 - RNA, 14 nt, Human
augaauuuaaauau

SEQ ID NO: 2550557 - RNA, 13 nt, Human
augaauuuaaaua

SEQ ID NO: 2550558 - RNA, 18 nt, Human
uuguauauuuguacaaaa

SEQ ID NO: 2550559 - RNA, 13 nt, Human
augaauugcauuu

SEQ ID NO: 2550560 - RNA, 11 nt, Human
augaauuuaaa

SEQ ID NO: 2550561 - RNA, 15 nt, Human
augaauuuggagacu

SEQ ID NO: 2550562 - RNA, 20 nt, Human
augaauuuggagacucugug

SEQ ID NO: 2550563 - RNA, 21 nt, Human
augaauuuggagacucugugg

SEQ ID NO: 2550564 - RNA, 15 nt, Human
uuguauaauuguauc

SEQ ID NO: 2550565 - RNA, 17 nt, Human
uuguauaaaauaauuuu

SEQ ID NO: 2550566 - RNA, 17 nt, Human
uuguauaauuguaucgu

SEQ ID NO: 2550567 - RNA, 16 nt, Human
uuguauaauuguaucg

SEQ ID NO: 2550568 - RNA, 17 nt, Human
uuguauagagauaugca

SEQ ID NO: 2550569 - RNA, 16 nt, Human
uuguauaguguaaaau

SEQ ID NO: 2550570 - RNA, 15 nt, Human
uuguauaguguaaaa

SEQ ID NO: 2550571 - RNA, 14 nt, Human
uuguauaguguaaa

SEQ ID NO: 2550572 - RNA, 18 nt, Human
uuguauagguagauguuc

SEQ ID NO: 2550573 - RNA, 14 nt, Human
uuguauaguaaagu

SEQ ID NO: 2550574 - RNA, 15 nt, Human
uuguauaguaaagug

SEQ ID NO: 2550575 - RNA, 13 nt, Human
uuguauauugugu

SEQ ID NO: 2550576 - RNA, 15 nt, Human
uuguauauuguguuu

SEQ ID NO: 2550577 - RNA, 16 nt, Human
uuguauauugucagau

SEQ ID NO: 2550578 - RNA, 23 nt, Human
uuguacaaaauaaacaaauaaca

SEQ ID NO: 2550579 - RNA, 20 nt, Human
uuguaggggucaaagaaaug

SEQ ID NO: 2550580 - RNA, 17 nt, Human
uuguaggggucaaagaa

SEQ ID NO: 2550581 - RNA, 16 nt, Human
uuguagggaugccuuu

SEQ ID NO: 2550582 - RNA, 20 nt, Human
uuguaggcgaaucauuuguu

SEQ ID NO: 2550583 - RNA, 15 nt, Human
uuguauaaaauaauu

SEQ ID NO: 2550584 - RNA, 16 nt, Human
uuguauaaaauaauuu

SEQ ID NO: 2550585 - RNA, 20 nt, Human
uuguaguagucucauuacuu

SEQ ID NO: 2550586 - RNA, 15 nt, Human
uuguaguagucucau

SEQ ID NO: 2550587 - RNA, 18 nt, Human
uuguaguaaagaaauuua

SEQ ID NO: 2550588 - RNA, 19 nt, Human
uuguaggggucaaagaaau

SEQ ID NO: 2550589 - RNA, 13 nt, Human
uugguugcuuuaa

SEQ ID NO: 2550590 - RNA, 16 nt, Human
uugguugcuuuaauau

SEQ ID NO: 2550591 - RNA, 22 nt, Human
uugguucuugguagagauucau

SEQ ID NO: 2550592 - RNA, 20 nt, Human
uugguugaaaauaaaaagau

SEQ ID NO: 2550593 - RNA, 13 nt, Human
uugguugaauaaa

SEQ ID NO: 2550594 - RNA, 16 nt, Human
uugguugaauaaacua

SEQ ID NO: 2550595 - RNA, 19 nt, Human
uugguucuaauagaacuca

SEQ ID NO: 2550596 - RNA, 15 nt, Human
uugguucuaauagaa

SEQ ID NO: 2550597 - RNA, 13 nt, Human
uugguucuguguc

SEQ ID NO: 2550598 - RNA, 14 nt, Human
uugguucuggggcc

SEQ ID NO: 2550599 - RNA, 13 nt, Human
uugguucuggggc

SEQ ID NO: 2550600 - RNA, 22 nt, Human
uugguugucaauauuaaauaca

SEQ ID NO: 2550601 - RNA, 12 nt, Human
uugguugucaau

SEQ ID NO: 2550602 - RNA, 16 nt, Human
uugguuguauucuuug

SEQ ID NO: 2550603 - RNA, 13 nt, Human
uugguuguauucu

SEQ ID NO: 2550604 - RNA, 15 nt, Human
uugguuggcuggccu

SEQ ID NO: 2550605 - RNA, 12 nt, Human
uugguuguauuc

SEQ ID NO: 2550606 - RNA, 18 nt, Human
uugguugucaauauuaaa

SEQ ID NO: 2550607 - RNA, 14 nt, Human
uuguacaaaauaaa

SEQ ID NO: 2550608 - RNA, 21 nt, Human
aucuuuaauuuuacauuuccu

SEQ ID NO: 2550609 - RNA, 16 nt, Human
aucuuuaauuuuacau

SEQ ID NO: 2550610 - RNA, 22 nt, Human
aucuuuaauuuuacauuuccua

SEQ ID NO: 2550611 - RNA, 17 nt, Human
aucuuuacaaaacuaca

SEQ ID NO: 2550612 - RNA, 21 nt, Human
aucuuuacaaaacuacaugag

SEQ ID NO: 2550613 - RNA, 14 nt, Human
aucuuugccacccu

SEQ ID NO: 2550614 - RNA, 13 nt, Human
aucuuuauuaauc

SEQ ID NO: 2550615 - RNA, 23 nt, Human
uuggcucuggagacagccccaga

SEQ ID NO: 2550616 - RNA, 18 nt, Human
aucuuugcagacaggcaa

SEQ ID NO: 2550617 - RNA, 22 nt, Human
aucuuuggacagaagcagcucu

SEQ ID NO: 2550618 - RNA, 14 nt, Human
aucuuugccuuggg

SEQ ID NO: 2550619 - RNA, 20 nt, Human
aucuuugccuugggcugcuc

SEQ ID NO: 2550620 - RNA, 16 nt, Human
aucuuugccacccuca

SEQ ID NO: 2550621 - RNA, 15 nt, Human
aucuuugccacccuc

SEQ ID NO: 2550622 - RNA, 13 nt, Human
aucuuugccuugg

SEQ ID NO: 2550623 - RNA, 15 nt, Human
augaaagcagggacu

SEQ ID NO: 2550624 - RNA, 14 nt, Human
aucuuuuucucuaa

SEQ ID NO: 2550625 - RNA, 16 nt, Human
aucuuuuuuagcauaa

SEQ ID NO: 2550626 - RNA, 18 nt, Human
aucuuuuuuagcauaaaa

SEQ ID NO: 2550627 - RNA, 19 nt, Human
aucuuuuuuagcauaaaau

SEQ ID NO: 2550628 - RNA, 23 nt, Human
aucuuuuuuagcauaaaauuuuc

SEQ ID NO: 2550629 - RNA, 22 nt, Human
augaaagcuccucgagggcagg

SEQ ID NO: 2550630 - RNA, 12 nt, Human
augaaagcaugu

SEQ ID NO: 2550631 - RNA, 18 nt, Human
augaaagcauguggcaug

SEQ ID NO: 2550632 - RNA, 13 nt, Human
aucuuuuucuaac

SEQ ID NO: 2550633 - RNA, 13 nt, Human
aucuuuuuauuca

SEQ ID NO: 2550634 - RNA, 23 nt, Human
aucuuuggacagaagcagcucuu

SEQ ID NO: 2550635 - RNA, 22 nt, Human
aucuuugccuugggcugcuccu

SEQ ID NO: 2550636 - RNA, 19 nt, Human
aucuuugcagguugcuuug

SEQ ID NO: 2550637 - RNA, 23 nt, Human
aucuuuugugagauguaauuguu

SEQ ID NO: 2550638 - RNA, 14 nt, Human
aucuuuugugagau

SEQ ID NO: 2550639 - RNA, 22 nt, Human
uuggcucuggagacagccccag

SEQ ID NO: 2550640 - RNA, 20 nt, Human
uuggcucuggagacagcccc

SEQ ID NO: 2550641 - RNA, 19 nt, Human
uuggcugaaauucuccugg

SEQ ID NO: 2550642 - RNA, 19 nt, Human
uuggcucuggagacagccc

SEQ ID NO: 2550643 - RNA, 17 nt, Human
uuggcucuggagacagc

SEQ ID NO: 2550644 - RNA, 14 nt, Human
uuggcucuggagac

SEQ ID NO: 2550645 - RNA, 21 nt, Human
uuggcugaaauucuccuggag

SEQ ID NO: 2550646 - RNA, 20 nt, Human
uuggcugaaauucuccugga

SEQ ID NO: 2550647 - RNA, 22 nt, Human
uuggcugaaauucuccuggagg

SEQ ID NO: 2550648 - RNA, 23 nt, Human
uuggcugagauaugaacauauug

SEQ ID NO: 2550649 - RNA, 22 nt, Human
uuggcucgaaucucugugccuu

SEQ ID NO: 2550650 - RNA, 13 nt, Human
uuggcucuggaga

SEQ ID NO: 2550651 - RNA, 20 nt, Human
uuggcuaacuauauuugcuu

SEQ ID NO: 2550652 - RNA, 23 nt, Human
uuggcgcugccccuggcagcccc

SEQ ID NO: 2550653 - RNA, 23 nt, Human
uuggauuauucauuuaaaaugau

SEQ ID NO: 2550654 - RNA, 20 nt, Human
uuggauuauucauuuaaaau

SEQ ID NO: 2550655 - RNA, 22 nt, Human
uuggcgcugccccuggcagccc

SEQ ID NO: 2550656 - RNA, 18 nt, Human
uuggcuagagguucaaag

SEQ ID NO: 2550657 - RNA, 15 nt, Human
uuggauuauuuaaua

SEQ ID NO: 2550658 - RNA, 14 nt, Human
uuggauuauuuaau

SEQ ID NO: 2550659 - RNA, 17 nt, Human
uuggauuauuuaauaac

SEQ ID NO: 2550660 - RNA, 14 nt, Human
uuggcgggccaagg

SEQ ID NO: 2550661 - RNA, 19 nt, Human
uuggaguguuccccuucca

SEQ ID NO: 2550662 - RNA, 22 nt, Human
uuggaguguuccccuuccacug

SEQ ID NO: 2550663 - RNA, 22 nt, Human
uuggagugaguguggcuccccu

SEQ ID NO: 2550664 - RNA, 23 nt, Human
aucuugcuucccuaaucuauggu

SEQ ID NO: 2550665 - RNA, 22 nt, Human
aucuugcucuguaaucucguuu

SEQ ID NO: 2550666 - RNA, 23 nt, Human
aucuugcuuuuuuucaccaauau

SEQ ID NO: 2550667 - RNA, 19 nt, Human
uuggaucuucaauggcuuu

SEQ ID NO: 2550668 - RNA, 22 nt, Human
uuggauaaugcuguugccucau

SEQ ID NO: 2550669 - RNA, 18 nt, Human
uuggauuauucauuuaaa

SEQ ID NO: 2550670 - RNA, 17 nt, Human
uuggauuauucauuuaa

SEQ ID NO: 2550671 - RNA, 13 nt, Human
uuggauuauucau

SEQ ID NO: 2550672 - RNA, 24 nt, Human
uuggaugcagugcucgcuguugcu

SEQ ID NO: 2550673 - RNA, 23 nt, Human
uuggaugcagugcucgcuguugc

SEQ ID NO: 2550674 - RNA, 21 nt, Human
uuggaugggagugagacagaa

SEQ ID NO: 2550675 - RNA, 21 nt, Human
uuggauggaguccagggaaga

SEQ ID NO: 2550676 - RNA, 20 nt, Human
uuggaugggagugagacaga

SEQ ID NO: 2550677 - RNA, 20 nt, Human
augaaugucagugugacuga

SEQ ID NO: 2550678 - RNA, 21 nt, Human
augaaugcccccagcuggccc

SEQ ID NO: 2550679 - RNA, 20 nt, Human
augaaugcccccagcuggcc

SEQ ID NO: 2550680 - RNA, 18 nt, Human
augaaugcccccagcugg

SEQ ID NO: 2550681 - RNA, 16 nt, Human
augaaugagaaucuac

SEQ ID NO: 2550682 - RNA, 19 nt, Human
augaaugaggucccaggca

SEQ ID NO: 2550683 - RNA, 20 nt, Human
augaaugaggucccaggcag

SEQ ID NO: 2550684 - RNA, 15 nt, Human
augaaugcacacuag

SEQ ID NO: 2550685 - RNA, 18 nt, Human
augaagauguagaggaga

SEQ ID NO: 2550686 - RNA, 13 nt, Human
augaaugaauggc

SEQ ID NO: 2550687 - RNA, 20 nt, Human
augaagaucauauacgugaa

SEQ ID NO: 2550688 - RNA, 22 nt, Human
augaagauauuuuuccauuuuu

SEQ ID NO: 2550689 - RNA, 16 nt, Human
augaacuuauucugua

SEQ ID NO: 2550690 - RNA, 17 nt, Human
augaaauauuauguuaa

SEQ ID NO: 2550691 - RNA, 13 nt, Human
augaaauauuaug

SEQ ID NO: 2550692 - RNA, 18 nt, Human
augaaauauuauguuaaa

SEQ ID NO: 2550693 - RNA, 15 nt, Human
augaaagggcccaga

SEQ ID NO: 2550694 - RNA, 17 nt, Human
augaaccuucuggccuc

SEQ ID NO: 2550695 - RNA, 20 nt, Human
augaacugaaguuucacaug

SEQ ID NO: 2550696 - RNA, 19 nt, Human
augaacugaaguuucacau

SEQ ID NO: 2550697 - RNA, 17 nt, Human
augaacugaaguuucac

SEQ ID NO: 2550698 - RNA, 16 nt, Human
augaacugaaguuuca

SEQ ID NO: 2550699 - RNA, 15 nt, Human
augaacugaaguuuc

SEQ ID NO: 2550700 - RNA, 16 nt, Human
augaacucuuaaucaa

SEQ ID NO: 2550701 - RNA, 14 nt, Human
augaacucaacuuu

SEQ ID NO: 2550702 - RNA, 20 nt, Human
augaacucuuagaaaugaag

SEQ ID NO: 2550703 - RNA, 20 nt, Human
augaacuauuccccagcagg

SEQ ID NO: 2550704 - RNA, 14 nt, Human
augaacugaaguuu

SEQ ID NO: 2550705 - RNA, 15 nt, Human
augaacggugagcau

SEQ ID NO: 2550706 - RNA, 13 nt, Human
augaacuauuccc

SEQ ID NO: 2550707 - RNA, 16 nt, Human
augaacggugagcauu

SEQ ID NO: 2550708 - RNA, 21 nt, Human
augaaccuucuggccucccac

SEQ ID NO: 2550709 - RNA, 24 nt, Human
augaaccuucuggccucccacaga

SEQ ID NO: 2550710 - RNA, 14 nt, Human
augaauuaaagugg

SEQ ID NO: 2550711 - RNA, 14 nt, Human
augaauuaaauaaa

SEQ ID NO: 2550712 - RNA, 22 nt, Human
augaauguuuacacucuuugua

SEQ ID NO: 2550713 - RNA, 11 nt, Human
augaauguuua

SEQ ID NO: 2550714 - RNA, 12 nt, Human
augaauguguaa

SEQ ID NO: 2550715 - RNA, 21 nt, Human
augaaugugugugguuuuuuu

SEQ ID NO: 2550716 - RNA, 14 nt, Human
uugggccagacaug

SEQ ID NO: 2550717 - RNA, 16 nt, Human
augaauuaaauaaacc

SEQ ID NO: 2550718 - RNA, 17 nt, Human
uugggccagacaugcca

SEQ ID NO: 2550719 - RNA, 19 nt, Human
uugggccauacuggccucg

SEQ ID NO: 2550720 - RNA, 18 nt, Human
uugggccauacuggccuc

SEQ ID NO: 2550721 - RNA, 23 nt, Human
uugggccauacuggccucgccug

SEQ ID NO: 2550722 - RNA, 16 nt, Human
uugggccauacuggcc

SEQ ID NO: 2550723 - RNA, 17 nt, Human
uugggccauacuggccu

SEQ ID NO: 2550724 - RNA, 13 nt, Human
augaauuaaauuu

SEQ ID NO: 2550725 - RNA, 16 nt, Human
uugggccugcuccaga

SEQ ID NO: 2550726 - RNA, 17 nt, Human
uugggccugcuccagac

SEQ ID NO: 2550727 - RNA, 14 nt, Human
uuggggauauuuuu

SEQ ID NO: 2550728 - RNA, 11 nt, Human
uugggcccagg

SEQ ID NO: 2550729 - RNA, 22 nt, Human
uugggcccagcugggcucugcc

SEQ ID NO: 2550730 - RNA, 18 nt, Human
uugggcccagcugggcuc

SEQ ID NO: 2550731 - RNA, 17 nt, Human
uugggcccagcugggcu

SEQ ID NO: 2550732 - RNA, 16 nt, Human
uugggcccagcugggc

SEQ ID NO: 2550733 - RNA, 12 nt, Human
uugggcccagcu

SEQ ID NO: 2550734 - RNA, 18 nt, Human
uugggccccagaggcugg

SEQ ID NO: 2550735 - RNA, 14 nt, Human
uugggccccagccu

SEQ ID NO: 2550736 - RNA, 13 nt, Human
uugggcccaggga

SEQ ID NO: 2550737 - RNA, 12 nt, Human
uugggcccuccu

SEQ ID NO: 2550738 - RNA, 19 nt, Human
uugggccugcuccagaccu

SEQ ID NO: 2550739 - RNA, 17 nt, Human
uuggggcgaggcagagg

SEQ ID NO: 2550740 - RNA, 23 nt, Human
uugggggacagggcuggcccagc

SEQ ID NO: 2550741 - RNA, 21 nt, Human
uugggggacagggcuggccca

SEQ ID NO: 2550742 - RNA, 18 nt, Human
uugggggacagggcuggc

SEQ ID NO: 2550743 - RNA, 15 nt, Human
uuggggcuuauuuuu

SEQ ID NO: 2550744 - RNA, 12 nt, Human
uugggggcuggu

SEQ ID NO: 2550745 - RNA, 21 nt, Human
uuggggcgaggcagaggacag

SEQ ID NO: 2550746 - RNA, 16 nt, Human
uuggggcuugacuuuu

SEQ ID NO: 2550747 - RNA, 13 nt, Human
uuggggggguggc

SEQ ID NO: 2550748 - RNA, 18 nt, Human
uugguucccccacugauc

SEQ ID NO: 2550749 - RNA, 20 nt, Human
uuggggggguggccgcugag

SEQ ID NO: 2550750 - RNA, 14 nt, Human
uugguucccuugug

SEQ ID NO: 2550751 - RNA, 22 nt, Human
uuggggggcugaggugggagga

SEQ ID NO: 2550752 - RNA, 16 nt, Human
uugggggcuggugcca

SEQ ID NO: 2550753 - RNA, 14 nt, Human
uugggggcuggugc

SEQ ID NO: 2550754 - RNA, 16 nt, Human
uugggggcugugggga

SEQ ID NO: 2550755 - RNA, 23 nt, Human
uuggggggggcccgccuggcaga

SEQ ID NO: 2550756 - RNA, 19 nt, Human
aucucaggccaccugcccc

SEQ ID NO: 2550757 - RNA, 20 nt, Human
aucucaggccaccugccccc

SEQ ID NO: 2550758 - RNA, 14 nt, Human
aucucaggccaccu

SEQ ID NO: 2550759 - RNA, 15 nt, Human
aucucaggccaccug

SEQ ID NO: 2550760 - RNA, 17 nt, Human
aucucaggccaccugcc

SEQ ID NO: 2550761 - RNA, 22 nt, Human
aucucagucaugcauaaauaug

SEQ ID NO: 2550762 - RNA, 20 nt, Human
aucucagaauuccuuuucua

SEQ ID NO: 2550763 - RNA, 20 nt, Human
aucucagaucaguguaccau

SEQ ID NO: 2550764 - RNA, 11 nt, Human
aucucagccca

SEQ ID NO: 2550765 - RNA, 13 nt, Human
aucucacuugugc

SEQ ID NO: 2550766 - RNA, 22 nt, Human
aucucacuugugccaacacuca

SEQ ID NO: 2550767 - RNA, 18 nt, Human
aucucacuugugccaaca

SEQ ID NO: 2550768 - RNA, 15 nt, Human
aucucacuuuucucc

SEQ ID NO: 2550769 - RNA, 19 nt, Human
aucucacuuuucuccauga

SEQ ID NO: 2550770 - RNA, 13 nt, Human
aucucaauauuuc

SEQ ID NO: 2550771 - RNA, 15 nt, Human
aucucacacaugagc

SEQ ID NO: 2550772 - RNA, 14 nt, Human
aucucaauucuucc

SEQ ID NO: 2550773 - RNA, 16 nt, Human
aucucaauucuucccu

SEQ ID NO: 2550774 - RNA, 16 nt, Human
aucucacacaugagca

SEQ ID NO: 2550775 - RNA, 19 nt, Human
auccuaguuccaccaucaa

SEQ ID NO: 2550776 - RNA, 15 nt, Human
auccuaguuccacca

SEQ ID NO: 2550777 - RNA, 19 nt, Human
auccuaucaacaacaaggu

SEQ ID NO: 2550778 - RNA, 20 nt, Human
auccuaucagccugucucuu

SEQ ID NO: 2550779 - RNA, 13 nt, Human
auccuagugcuuu

SEQ ID NO: 2550780 - RNA, 23 nt, Human
auccuaucagccugucucuucca

SEQ ID NO: 2550781 - RNA, 13 nt, Human
auccuaugcaaua

SEQ ID NO: 2550782 - RNA, 13 nt, Human
aucucccccagcc

SEQ ID NO: 2550783 - RNA, 12 nt, Human
aucucccccagc

SEQ ID NO: 2550784 - RNA, 19 nt, Human
aucucuuagcuccccucca

SEQ ID NO: 2550785 - RNA, 18 nt, Human
aucucuuagcuccccucc

SEQ ID NO: 2550786 - RNA, 16 nt, Human
aucucuuagcuccccu

SEQ ID NO: 2550787 - RNA, 13 nt, Human
aucucuuagcucc

SEQ ID NO: 2550788 - RNA, 13 nt, Human
aucuccccacucu

SEQ ID NO: 2550789 - RNA, 14 nt, Human
aucuccccacucua

SEQ ID NO: 2550790 - RNA, 18 nt, Human
aucucuuagcauuuuaau

SEQ ID NO: 2550791 - RNA, 22 nt, Human
aucuccauggcuuccuccuccc

SEQ ID NO: 2550792 - RNA, 19 nt, Human
aucuccauggcuuccuccu

SEQ ID NO: 2550793 - RNA, 18 nt, Human
aucuccauggcuuccucc

SEQ ID NO: 2550794 - RNA, 17 nt, Human
aucuccauggcuuccuc

SEQ ID NO: 2550795 - RNA, 15 nt, Human
aucuccauggcuucc

SEQ ID NO: 2550796 - RNA, 14 nt, Human
aucuccauggcuuc

SEQ ID NO: 2550797 - RNA, 18 nt, Human
aucuccaguauucuuguc

SEQ ID NO: 2550798 - RNA, 18 nt, Human
aucucccaccuagcagca

SEQ ID NO: 2550799 - RNA, 19 nt, Human
aucucccaccuagcagcac

SEQ ID NO: 2550800 - RNA, 20 nt, Human
aucucccagauaaugugaaa

SEQ ID NO: 2550801 - RNA, 19 nt, Human
aucucccagauaaugugaa

SEQ ID NO: 2550802 - RNA, 20 nt, Human
aucucccaccuagcagcacc

SEQ ID NO: 2550803 - RNA, 16 nt, Human
aucuccccaucauugg

SEQ ID NO: 2550804 - RNA, 23 nt, Human
aucucauuuccaagcaaguauua

SEQ ID NO: 2550805 - RNA, 15 nt, Human
aucucaucuaucuca

SEQ ID NO: 2550806 - RNA, 19 nt, Human
aucucauagguugccaaua

SEQ ID NO: 2550807 - RNA, 15 nt, Human
aucuccaguauucuu

SEQ ID NO: 2550808 - RNA, 21 nt, Human
aucuccagggaguccccuccc

SEQ ID NO: 2550809 - RNA, 20 nt, Human
aucuccagggaguccccucc

SEQ ID NO: 2550810 - RNA, 19 nt, Human
aucuccagggaguccccuc

SEQ ID NO: 2550811 - RNA, 12 nt, Human
aucuccaggauu

SEQ ID NO: 2550812 - RNA, 20 nt, Human
aucuccaggauugaagagca

SEQ ID NO: 2550813 - RNA, 15 nt, Human
aucuccacuccagau

SEQ ID NO: 2550814 - RNA, 23 nt, Human
aucucauagguugccaauaauac

SEQ ID NO: 2550815 - RNA, 17 nt, Human
aucucauagguugccaa

SEQ ID NO: 2550816 - RNA, 21 nt, Human
aucucauuuccaagcaaguau

SEQ ID NO: 2550817 - RNA, 23 nt, Human
aucucagugguuaagauuccuaa

SEQ ID NO: 2550818 - RNA, 17 nt, Human
aucucagugcuguaaaa

SEQ ID NO: 2550819 - RNA, 16 nt, Human
uugcacauguuuccuc

SEQ ID NO: 2550820 - RNA, 21 nt, Human
uugcacaugucuuaaugaagu

SEQ ID NO: 2550821 - RNA, 17 nt, Human
uugcacaugucuuaaug

SEQ ID NO: 2550822 - RNA, 22 nt, Human
uugcacaugucuuaaugaaguu

SEQ ID NO: 2550823 - RNA, 20 nt, Human
uugcaucucccagauaaugu

SEQ ID NO: 2550824 - RNA, 14 nt, Human
uugcaucugaaaau

SEQ ID NO: 2550825 - RNA, 15 nt, Human
uugcauguggaucaa

SEQ ID NO: 2550826 - RNA, 19 nt, Human
uugcauguuccacuaaccc

SEQ ID NO: 2550827 - RNA, 17 nt, Human
uugcauguuccacuaac

SEQ ID NO: 2550828 - RNA, 16 nt, Human
uugcaugugacucuga

SEQ ID NO: 2550829 - RNA, 17 nt, Human
uugcaugugacucugaa

SEQ ID NO: 2550830 - RNA, 14 nt, Human
uugcaugugaaaau

SEQ ID NO: 2550831 - RNA, 20 nt, Human
uugcaugugaaaaucaaaua

SEQ ID NO: 2550832 - RNA, 15 nt, Human
uugcaugugacucug

SEQ ID NO: 2550833 - RNA, 18 nt, Human
uugcauccaacuccagga

SEQ ID NO: 2550834 - RNA, 18 nt, Human
uugcaucuggguagcugu

SEQ ID NO: 2550835 - RNA, 19 nt, Human
uugcaucuggguagcugua

SEQ ID NO: 2550836 - RNA, 20 nt, Human
uugcaucuggguagcuguaa

SEQ ID NO: 2550837 - RNA, 23 nt, Human
uugcaucuguauaaguaagaaaa

SEQ ID NO: 2550838 - RNA, 19 nt, Human
uugcaucuguauaaguaag

SEQ ID NO: 2550839 - RNA, 14 nt, Human
uugcaucuguauaa

SEQ ID NO: 2550840 - RNA, 13 nt, Human
uugcaucuguaua

SEQ ID NO: 2550841 - RNA, 21 nt, Human
uugcaucuggguagcuguaag

SEQ ID NO: 2550842 - RNA, 16 nt, Human
uugcacaguuagcaaa

SEQ ID NO: 2550843 - RNA, 16 nt, Human
uugcacagcuaugaag

SEQ ID NO: 2550844 - RNA, 16 nt, Human
uugcacaugucuuaau

SEQ ID NO: 2550845 - RNA, 15 nt, Human
uugcacaugucuuaa

SEQ ID NO: 2550846 - RNA, 13 nt, Human
uugcacaugucuu

SEQ ID NO: 2550847 - RNA, 19 nt, Human
uugcacacccacucagcuc

SEQ ID NO: 2550848 - RNA, 21 nt, Human
uugcacacccacucagcuccg

SEQ ID NO: 2550849 - RNA, 17 nt, Human
uugcacacuccccugca

SEQ ID NO: 2550850 - RNA, 22 nt, Human
uugcacacuccccugcacugga

SEQ ID NO: 2550851 - RNA, 13 nt, Human
uugcacacuugug

SEQ ID NO: 2550852 - RNA, 16 nt, Human
uugauucagacagcug

SEQ ID NO: 2550853 - RNA, 15 nt, Human
uugauucagacagcu

SEQ ID NO: 2550854 - RNA, 21 nt, Human
uugcacaauauugaacuuuuu

SEQ ID NO: 2550855 - RNA, 20 nt, Human
uugcacaauauugaacuuuu

SEQ ID NO: 2550856 - RNA, 19 nt, Human
uugcacaauauugaacuuu

SEQ ID NO: 2550857 - RNA, 19 nt, Human
uugcacaaaccaauuaaac

SEQ ID NO: 2550858 - RNA, 19 nt, Human
uugauguacagucugucau

SEQ ID NO: 2550859 - RNA, 20 nt, Human
uugauguacagucugucaug

SEQ ID NO: 2550860 - RNA, 19 nt, Human
uugauggugguauguuuuc

SEQ ID NO: 2550861 - RNA, 23 nt, Human
uugauggugaugaaauguaaaua

SEQ ID NO: 2550862 - RNA, 11 nt, Human
uugauguguuu

SEQ ID NO: 2550863 - RNA, 20 nt, Human
uugauguguuuauuuauaga

SEQ ID NO: 2550864 - RNA, 16 nt, Human
uugaugugugucuagg

SEQ ID NO: 2550865 - RNA, 14 nt, Human
uugauucagacagc

SEQ ID NO: 2550866 - RNA, 12 nt, Human
uugaugccuggc

SEQ ID NO: 2550867 - RNA, 19 nt, Human
aucucuucuggguuccuuc

SEQ ID NO: 2550868 - RNA, 23 nt, Human
uugaugcauuaaaagaaaauaaa

SEQ ID NO: 2550869 - RNA, 22 nt, Human
aucucuuccuacccaaccacuc

SEQ ID NO: 2550870 - RNA, 23 nt, Human
aucucuuagcuccccuccaaccu

SEQ ID NO: 2550871 - RNA, 22 nt, Human
aucucuuagcuccccuccaacc

SEQ ID NO: 2550872 - RNA, 16 nt, Human
aucucuuauuuuacaa

SEQ ID NO: 2550873 - RNA, 19 nt, Human
aucucuuauuuuacaauaa

SEQ ID NO: 2550874 - RNA, 18 nt, Human
uugauggugguauguuuu

SEQ ID NO: 2550875 - RNA, 18 nt, Human
uugaugcuggagagguua

SEQ ID NO: 2550876 - RNA, 21 nt, Human
uugaugguaaccauaauggaa

SEQ ID NO: 2550877 - RNA, 13 nt, Human
uugauggguucua

SEQ ID NO: 2550878 - RNA, 14 nt, Human
uugauggggaagga

SEQ ID NO: 2550879 - RNA, 15 nt, Human
uugaugggauuuggu

SEQ ID NO: 2550880 - RNA, 14 nt, Human
uugauggagauauu

SEQ ID NO: 2550881 - RNA, 17 nt, Human
uugaugcuggagagguu

SEQ ID NO: 2550882 - RNA, 15 nt, Human
uugaugccaggacac

SEQ ID NO: 2550883 - RNA, 15 nt, Human
uugaugcuggagagg

SEQ ID NO: 2550884 - RNA, 17 nt, Human
aucugugugaaaauggg

SEQ ID NO: 2550885 - RNA, 15 nt, Human
aucugugugaaaaug

SEQ ID NO: 2550886 - RNA, 13 nt, Human
aucugugugaaaa

SEQ ID NO: 2550887 - RNA, 17 nt, Human
aucugugaauucagauu

SEQ ID NO: 2550888 - RNA, 14 nt, Human
aucugugucuuguu

SEQ ID NO: 2550889 - RNA, 16 nt, Human
aucugugaauucagau

SEQ ID NO: 2550890 - RNA, 15 nt, Human
aucugugucuuguuu

SEQ ID NO: 2550891 - RNA, 12 nt, Human
aucugugaauaa

SEQ ID NO: 2550892 - RNA, 13 nt, Human
aucugugaauaag

SEQ ID NO: 2550893 - RNA, 11 nt, Human
aucugugaaua

SEQ ID NO: 2550894 - RNA, 21 nt, Human
aucugugaaaugcuggcauuu

SEQ ID NO: 2550895 - RNA, 13 nt, Human
aucuguugcaaac

SEQ ID NO: 2550896 - RNA, 19 nt, Human
aucuguucuuuaauuuauu

SEQ ID NO: 2550897 - RNA, 21 nt, Human
aucuguuguguacguggagag

SEQ ID NO: 2550898 - RNA, 16 nt, Human
aucuguguuuuugaaa

SEQ ID NO: 2550899 - RNA, 18 nt, Human
aucuguguuuuugaaaua

SEQ ID NO: 2550900 - RNA, 21 nt, Human
aucuguguuuuugaaauauua

SEQ ID NO: 2550901 - RNA, 13 nt, Human
aucuuacagcugg

SEQ ID NO: 2550902 - RNA, 14 nt, Human
aucuuacugaaggu

SEQ ID NO: 2550903 - RNA, 15 nt, Human
aucuuacugaaggua

SEQ ID NO: 2550904 - RNA, 15 nt, Human
aucuguuguuuuguu

SEQ ID NO: 2550905 - RNA, 12 nt, Human
aucuguuuacag

SEQ ID NO: 2550906 - RNA, 13 nt, Human
aucuuaauuuugg

SEQ ID NO: 2550907 - RNA, 18 nt, Human
aucuguugcaaacucagc

SEQ ID NO: 2550908 - RNA, 23 nt, Human
aucuguuguguacguggagaggg

SEQ ID NO: 2550909 - RNA, 22 nt, Human
aucuuaauuuugguuguauucu

SEQ ID NO: 2550910 - RNA, 19 nt, Human
aucuuaauuuugguuguau

SEQ ID NO: 2550911 - RNA, 18 nt, Human
aucuuaauuuugguugua

SEQ ID NO: 2550912 - RNA, 21 nt, Human
aucuguuuaaaguagauuaga

SEQ ID NO: 2550913 - RNA, 23 nt, Human
aucuuaauuuugguuguauucuu

SEQ ID NO: 2550914 - RNA, 22 nt, Human
aucuugagcaaguuccuucugg

SEQ ID NO: 2550915 - RNA, 17 nt, Human
aucuugacuacagucag

SEQ ID NO: 2550916 - RNA, 17 nt, Human
aucuugacauucaaggc

SEQ ID NO: 2550917 - RNA, 17 nt, Human
aucuugaccaagcagga

SEQ ID NO: 2550918 - RNA, 19 nt, Human
aucuugaccaagcaggaag

SEQ ID NO: 2550919 - RNA, 21 nt, Human
aucuugaccaagcaggaagcu

SEQ ID NO: 2550920 - RNA, 22 nt, Human
aucuugaccaagcaggaagcuc

SEQ ID NO: 2550921 - RNA, 18 nt, Human
aucuugaauuguaaggaa

SEQ ID NO: 2550922 - RNA, 19 nt, Human
aucuugcucugcugacaga

SEQ ID NO: 2550923 - RNA, 17 nt, Human
aucuugcucugcugaca

SEQ ID NO: 2550924 - RNA, 17 nt, Human
aucuugcucuguaaucu

SEQ ID NO: 2550925 - RNA, 16 nt, Human
aucuugcucuguaauc

SEQ ID NO: 2550926 - RNA, 15 nt, Human
aucuugcucuguaau

SEQ ID NO: 2550927 - RNA, 14 nt, Human
aucuugcucuguaa

SEQ ID NO: 2550928 - RNA, 15 nt, Human
aucuugcuucccuaa

SEQ ID NO: 2550929 - RNA, 14 nt, Human
aucuugcuucccua

SEQ ID NO: 2550930 - RNA, 21 nt, Human
aucuugaucugcucagcccug

SEQ ID NO: 2550931 - RNA, 20 nt, Human
aucuugaucugcucagcccu

SEQ ID NO: 2550932 - RNA, 22 nt, Human
aucuugaucugcucagcccugg

SEQ ID NO: 2550933 - RNA, 15 nt, Human
aucuugcucugcuug

SEQ ID NO: 2550934 - RNA, 16 nt, Human
aucuugaucugcucag

SEQ ID NO: 2550935 - RNA, 23 nt, Human
aucuugaccaagcaggaagcuca

SEQ ID NO: 2550936 - RNA, 21 nt, Human
aucuugauaccaccuauauag

SEQ ID NO: 2550937 - RNA, 15 nt, Human
aucuguacaaugaac

SEQ ID NO: 2550938 - RNA, 15 nt, Human
aucugguuuugcuau

SEQ ID NO: 2550939 - RNA, 22 nt, Human
aucuguaaacuguguauuccaa

SEQ ID NO: 2550940 - RNA, 14 nt, Human
aucugguuuugcua

SEQ ID NO: 2550941 - RNA, 14 nt, Human
aucuguaaacugug

SEQ ID NO: 2550942 - RNA, 17 nt, Human
aucuguaaacuguguau

SEQ ID NO: 2550943 - RNA, 13 nt, Human
aucuguaaacugu

SEQ ID NO: 2550944 - RNA, 21 nt, Human
aucugguccuacccauccccg

SEQ ID NO: 2550945 - RNA, 14 nt, Human
aucugguccuaccc

SEQ ID NO: 2550946 - RNA, 17 nt, Human
aucugguccuacccauc

SEQ ID NO: 2550947 - RNA, 18 nt, Human
aucugguccuacccaucc

SEQ ID NO: 2550948 - RNA, 17 nt, Human
aucuggucccuugcagc

SEQ ID NO: 2550949 - RNA, 20 nt, Human
aucugguagggggaaaaugu

SEQ ID NO: 2550950 - RNA, 16 nt, Human
aucuguaccucugccu

SEQ ID NO: 2550951 - RNA, 13 nt, Human
aucuguacaauga

SEQ ID NO: 2550952 - RNA, 17 nt, Human
aucuguacuucuucgau

SEQ ID NO: 2550953 - RNA, 23 nt, Human
aucugugaaaggaaagagggagg

SEQ ID NO: 2550954 - RNA, 15 nt, Human
aucuguacguaagaa

SEQ ID NO: 2550955 - RNA, 22 nt, Human
aucugcauuuucaccccacccu

SEQ ID NO: 2550956 - RNA, 23 nt, Human
aucugcauuuucaccccacccuu

SEQ ID NO: 2550957 - RNA, 16 nt, Human
aucugcagucacuucg

SEQ ID NO: 2550958 - RNA, 13 nt, Human
aucugcagucacu

SEQ ID NO: 2550959 - RNA, 19 nt, Human
aucugcauuuucaccccac

SEQ ID NO: 2550960 - RNA, 17 nt, Human
aucuggguucacugcaa

SEQ ID NO: 2550961 - RNA, 19 nt, Human
aucuggguucacugcaacc

SEQ ID NO: 2550962 - RNA, 17 nt, Human
aucugguagauuuuuaa

SEQ ID NO: 2550963 - RNA, 18 nt, Human
uugccgucuaccugaggg

SEQ ID NO: 2550964 - RNA, 15 nt, Human
uugccgucuaccuga

SEQ ID NO: 2550965 - RNA, 19 nt, Human
uugccgucuaccugagggg

SEQ ID NO: 2550966 - RNA, 14 nt, Human
uugccguuauuaaa

SEQ ID NO: 2550967 - RNA, 19 nt, Human
uugccuaauaaacauccuu

SEQ ID NO: 2550968 - RNA, 22 nt, Human
uugccgcgucgcccucccaggc

SEQ ID NO: 2550969 - RNA, 13 nt, Human
uugcauuaaauuc

SEQ ID NO: 2550970 - RNA, 20 nt, Human
uugcauuaaauucacaaacu

SEQ ID NO: 2550971 - RNA, 21 nt, Human
uugcauuaaauucacaaacuu

SEQ ID NO: 2550972 - RNA, 12 nt, Human
uugcauucaaau

SEQ ID NO: 2550973 - RNA, 22 nt, Human
uugcauuaaauucacaaacuuu

SEQ ID NO: 2550974 - RNA, 13 nt, Human
uugcccuguuaaa

SEQ ID NO: 2550975 - RNA, 11 nt, Human
uugcauucaaa

SEQ ID NO: 2550976 - RNA, 21 nt, Human
uugcccugaccucccagcccu

SEQ ID NO: 2550977 - RNA, 18 nt, Human
uugcccugaccucccagc

SEQ ID NO: 2550978 - RNA, 10 nt, Human
uugcccuggu

SEQ ID NO: 2550979 - RNA, 18 nt, Human
uugcccuugcccugaccu

SEQ ID NO: 2550980 - RNA, 17 nt, Human
uugcccuugcccugacc

SEQ ID NO: 2550981 - RNA, 16 nt, Human
uugcccuugcccugac

SEQ ID NO: 2550982 - RNA, 15 nt, Human
uugcccuugcccuga

SEQ ID NO: 2550983 - RNA, 14 nt, Human
uugcccuugcccug

SEQ ID NO: 2550984 - RNA, 19 nt, Human
uugcccuucccugucccuc

SEQ ID NO: 2550985 - RNA, 17 nt, Human
uugcccuucccuguccc

SEQ ID NO: 2550986 - RNA, 14 nt, Human
uugcccuucccugu

SEQ ID NO: 2550987 - RNA, 23 nt, Human
uugcccugguuucacuggcccaa

SEQ ID NO: 2550988 - RNA, 14 nt, Human
uugcccuucacagu

SEQ ID NO: 2550989 - RNA, 16 nt, Human
uugcccuucacagugu

SEQ ID NO: 2550990 - RNA, 13 nt, Human
uugcccuucccug

SEQ ID NO: 2550991 - RNA, 11 nt, Human
uugcccuuccc

SEQ ID NO: 2550992 - RNA, 17 nt, Human
uugcccuucacaguguu

SEQ ID NO: 2550993 - RNA, 18 nt, Human
uugcccuucacaguguuu

SEQ ID NO: 2550994 - RNA, 13 nt, Human
uugccgucuaccu

SEQ ID NO: 2550995 - RNA, 18 nt, Human
uugccgcgucgcccuccc

SEQ ID NO: 2550996 - RNA, 21 nt, Human
uugccgcgucgcccucccagg

SEQ ID NO: 2550997 - RNA, 21 nt, Human
aucugagggaggaggccaccu

SEQ ID NO: 2550998 - RNA, 20 nt, Human
aucugagggaggaggccacc

SEQ ID NO: 2550999 - RNA, 19 nt, Human
aucugagggaggaggccac

SEQ ID NO: 2551000 - RNA, 16 nt, Human
aucugagggaggaggc

SEQ ID NO: 2551001 - RNA, 23 nt, Human
aucugagggaggaggccaccucu

SEQ ID NO: 2551002 - RNA, 22 nt, Human
aucugagggaggaggccaccuc

SEQ ID NO: 2551003 - RNA, 14 nt, Human
aucugagggaggag

SEQ ID NO: 2551004 - RNA, 24 nt, Human
uugccuauucccacaccuccacag

SEQ ID NO: 2551005 - RNA, 17 nt, Human
uugccuacuaugccaga

SEQ ID NO: 2551006 - RNA, 21 nt, Human
uugccucagucccccaacaga

SEQ ID NO: 2551007 - RNA, 20 nt, Human
uugccuccccauuucccauc

SEQ ID NO: 2551008 - RNA, 17 nt, Human
uugccuccccauuuccc

SEQ ID NO: 2551009 - RNA, 22 nt, Human
aucugagcaagagcuggcaaag

SEQ ID NO: 2551010 - RNA, 17 nt, Human
aucugagcaagagcugg

SEQ ID NO: 2551011 - RNA, 21 nt, Human
uugccuccccauuucccaucu

SEQ ID NO: 2551012 - RNA, 20 nt, Human
aucugagaggccacagugca

SEQ ID NO: 2551013 - RNA, 22 nt, Human
aucugcagaaggaaaaaugugu

SEQ ID NO: 2551014 - RNA, 20 nt, Human
aucugcagaaggaaaaaugu

SEQ ID NO: 2551015 - RNA, 14 nt, Human
aucugcagaaggaa

SEQ ID NO: 2551016 - RNA, 13 nt, Human
aucugcagaagga

SEQ ID NO: 2551017 - RNA, 11 nt, Human
aucugcagaag

SEQ ID NO: 2551018 - RNA, 23 nt, Human
aucugcaccccuucucuccuccc

SEQ ID NO: 2551019 - RNA, 22 nt, Human
aucugcaccccuucucuccucc

SEQ ID NO: 2551020 - RNA, 21 nt, Human
aucugcaccccuucucuccuc

SEQ ID NO: 2551021 - RNA, 16 nt, Human
aucugcaggcagacac

SEQ ID NO: 2551022 - RNA, 15 nt, Human
aucugcaggcagaca

SEQ ID NO: 2551023 - RNA, 14 nt, Human
aucugcaggcagac

SEQ ID NO: 2551024 - RNA, 23 nt, Human
aucugcagaaggaaaaaugugua

SEQ ID NO: 2551025 - RNA, 19 nt, Human
aucugcaggcagacacgga

SEQ ID NO: 2551026 - RNA, 17 nt, Human
aucugcaggcagacacg

SEQ ID NO: 2551027 - RNA, 20 nt, Human
aucugcagggggugugucug

SEQ ID NO: 2551028 - RNA, 10 nt, Human
aucugcaccc

SEQ ID NO: 2551029 - RNA, 15 nt, Human
aucugcaccccccug

SEQ ID NO: 2551030 - RNA, 17 nt, Human
aucugcaccccccuggg

SEQ ID NO: 2551031 - RNA, 18 nt, Human
aucugcaccccccugggc

SEQ ID NO: 2551032 - RNA, 19 nt, Human
aucugcaccccccugggcu

SEQ ID NO: 2551033 - RNA, 20 nt, Human
aucugcaccccuucucuccu

SEQ ID NO: 2551034 - RNA, 18 nt, Human
aucugcaccccuucucuc

SEQ ID NO: 2551035 - RNA, 17 nt, Human
aucugcaccccuucucu

SEQ ID NO: 2551036 - RNA, 21 nt, Human
aucugcaccccccugggcuga

SEQ ID NO: 2551037 - RNA, 21 nt, Human
aucugcacccucgaugaagcc

SEQ ID NO: 2551038 - RNA, 17 nt, Human
aucugauugugauguga

SEQ ID NO: 2551039 - RNA, 19 nt, Human
aucugauuuguuuuccucu

SEQ ID NO: 2551040 - RNA, 17 nt, Human
aucugauggcuucucca

SEQ ID NO: 2551041 - RNA, 14 nt, Human
aucugauggcuucu

SEQ ID NO: 2551042 - RNA, 19 nt, Human
aucugauuggacauuuucu

SEQ ID NO: 2551043 - RNA, 18 nt, Human
aucugauuggacauuuuc

SEQ ID NO: 2551044 - RNA, 18 nt, Human
aucugauggcuucuccag

SEQ ID NO: 2551045 - RNA, 18 nt, Human
aucugaugcaagcaagaa

SEQ ID NO: 2551046 - RNA, 13 nt, Human
caacaggcugggc

SEQ ID NO: 2551047 - RNA, 18 nt, Human
caaaaucgauuggcuuua

SEQ ID NO: 2551048 - RNA, 12 nt, Human
caaaauccccuu

SEQ ID NO: 2551049 - RNA, 20 nt, Human
caaaauccuugcuuaugaca

SEQ ID NO: 2551050 - RNA, 21 nt, Human
caaaaucgaugcagugcuucc

SEQ ID NO: 2551051 - RNA, 22 nt, Human
caaaaucauuuuauaugucaaa

SEQ ID NO: 2551052 - RNA, 23 nt, Human
caaaaucauuuuauaugucaaag

SEQ ID NO: 2551053 - RNA, 16 nt, Human
caaaauccccuucuca

SEQ ID NO: 2551054 - RNA, 16 nt, Human
caaaauccuugcuuau

SEQ ID NO: 2551055 - RNA, 23 nt, Human
caaaaucauggaaugguuauaaa

SEQ ID NO: 2551056 - RNA, 19 nt, Human
caaaaucauuuuauauguc

SEQ ID NO: 2551057 - RNA, 16 nt, Human
caaaaucauuuuaaug

SEQ ID NO: 2551058 - RNA, 12 nt, Human
caaaauauuuuc

SEQ ID NO: 2551059 - RNA, 17 nt, Human
caaaauauuuguacaua

SEQ ID NO: 2551060 - RNA, 17 nt, Human
caaaauauuuuuauaga

SEQ ID NO: 2551061 - RNA, 16 nt, Human
caaaauauuuguacau

SEQ ID NO: 2551062 - RNA, 23 nt, Human
caaaauauuaugcaaacuacugu

SEQ ID NO: 2551063 - RNA, 14 nt, Human
caaaauauguucuu

SEQ ID NO: 2551064 - RNA, 13 nt, Human
caaaauagagaau

SEQ ID NO: 2551065 - RNA, 13 nt, Human
caaaauagaagcu

SEQ ID NO: 2551066 - RNA, 16 nt, Human
caaaauagcauuuguu

SEQ ID NO: 2551067 - RNA, 15 nt, Human
caaaauagcauuugu

SEQ ID NO: 2551068 - RNA, 19 nt, Human
caaaauauguugaugaaaa

SEQ ID NO: 2551069 - RNA, 22 nt, Human
caaaauaagaaaagauguagau

SEQ ID NO: 2551070 - RNA, 22 nt, Human
caaaauaauuuuaagaaaucaa

SEQ ID NO: 2551071 - RNA, 18 nt, Human
caaaauaauuuuaagaaa

SEQ ID NO: 2551072 - RNA, 16 nt, Human
caaaauaagaaaagau

SEQ ID NO: 2551073 - RNA, 18 nt, Human
caaaauaagaaaagaugu

SEQ ID NO: 2551074 - RNA, 20 nt, Human
caaaauaaaacuuuuuaaaa

SEQ ID NO: 2551075 - RNA, 14 nt, Human
caaaauaagaaaag

SEQ ID NO: 2551076 - RNA, 15 nt, Human
caaaauaagaaaaga

SEQ ID NO: 2551077 - RNA, 14 nt, Human
caaaauaaauguug

SEQ ID NO: 2551078 - RNA, 16 nt, Human
caaaauaaaacuuuuu

SEQ ID NO: 2551079 - RNA, 17 nt, Human
caaaaguuuuccugaga

SEQ ID NO: 2551080 - RNA, 15 nt, Human
caaaaguuuuccuga

SEQ ID NO: 2551081 - RNA, 11 nt, Human
caaaauaaaaa

SEQ ID NO: 2551082 - RNA, 15 nt, Human
caaaauaaaaaccaa

SEQ ID NO: 2551083 - RNA, 17 nt, Human
caaaacugcacugucaa

SEQ ID NO: 2551084 - RNA, 18 nt, Human
caaaacugcacugucaag

SEQ ID NO: 2551085 - RNA, 14 nt, Human
caaaacugcacugu

SEQ ID NO: 2551086 - RNA, 19 nt, Human
caaaacucuacuuaaucca

SEQ ID NO: 2551087 - RNA, 11 nt, Human
caaaacucuac

SEQ ID NO: 2551088 - RNA, 19 nt, Human
caaaacucuccucugcugc

SEQ ID NO: 2551089 - RNA, 17 nt, Human
caaaaguuagcugagcg

SEQ ID NO: 2551090 - RNA, 23 nt, Human
caaaacucuccucugcugcuggc

SEQ ID NO: 2551091 - RNA, 18 nt, Human
caaaaguucugacuugac

SEQ ID NO: 2551092 - RNA, 17 nt, Human
caaaaguucugacuuga

SEQ ID NO: 2551093 - RNA, 15 nt, Human
caaaaguucugacuu

SEQ ID NO: 2551094 - RNA, 18 nt, Human
caaaaguuucauccuuuu

SEQ ID NO: 2551095 - RNA, 14 nt, Human
caaaaguuucucuu

SEQ ID NO: 2551096 - RNA, 16 nt, Human
caaaacucuccucugc

SEQ ID NO: 2551097 - RNA, 15 nt, Human
caaaacucuccucug

SEQ ID NO: 2551098 - RNA, 21 nt, Human
caaaacuccugccccuguucu

SEQ ID NO: 2551099 - RNA, 20 nt, Human
caaaacucaaaugcuuggcu

SEQ ID NO: 2551100 - RNA, 16 nt, Human
caaaacuccugucuuu

SEQ ID NO: 2551101 - RNA, 21 nt, Human
caaaacucauuuccuauguaa

SEQ ID NO: 2551102 - RNA, 15 nt, Human
caaaacgucuuauug

SEQ ID NO: 2551103 - RNA, 14 nt, Human
caaaacgucuuauu

SEQ ID NO: 2551104 - RNA, 13 nt, Human
caaaacgucuuau

SEQ ID NO: 2551105 - RNA, 13 nt, Human
caaaacggggcag

SEQ ID NO: 2551106 - RNA, 18 nt, Human
auuuuauuuuauuaugca

SEQ ID NO: 2551107 - RNA, 19 nt, Human
caaaacgcauggagugugu

SEQ ID NO: 2551108 - RNA, 23 nt, Human
caaaacgcauggaguguguauug

SEQ ID NO: 2551109 - RNA, 15 nt, Human
caaaacgguuuuacu

SEQ ID NO: 2551110 - RNA, 21 nt, Human
caaaacgguuuuacugcagcu

SEQ ID NO: 2551111 - RNA, 18 nt, Human
caaacucugcugucuaac

SEQ ID NO: 2551112 - RNA, 13 nt, Human
caaacucugcugu

SEQ ID NO: 2551113 - RNA, 12 nt, Human
caaacucugcug

SEQ ID NO: 2551114 - RNA, 17 nt, Human
caaacugaagcagccuc

SEQ ID NO: 2551115 - RNA, 21 nt, Human
caaacucuugaccucagguga

SEQ ID NO: 2551116 - RNA, 16 nt, Human
caaacugacucuuaag

SEQ ID NO: 2551117 - RNA, 23 nt, Human
caaacugaagcagccucucccca

SEQ ID NO: 2551118 - RNA, 14 nt, Human
caaacugaagccag

SEQ ID NO: 2551119 - RNA, 21 nt, Human
caaacugaaugaaacccccac

SEQ ID NO: 2551120 - RNA, 15 nt, Human
caaacugaagccaga

SEQ ID NO: 2551121 - RNA, 21 nt, Human
caaacugacucuuaagaagac

SEQ ID NO: 2551122 - RNA, 17 nt, Human
caaacugacucuuaaga

SEQ ID NO: 2551123 - RNA, 22 nt, Human
caaacugaaugaaacccccaca

SEQ ID NO: 2551124 - RNA, 15 nt, Human
caaaccugccugggu

SEQ ID NO: 2551125 - RNA, 14 nt, Human
caaaccugccuggg

SEQ ID NO: 2551126 - RNA, 13 nt, Human
caaaccugccugg

SEQ ID NO: 2551127 - RNA, 21 nt, Human
caaaccugcaagggcucccca

SEQ ID NO: 2551128 - RNA, 19 nt, Human
caaaccuguuuaaauauuu

SEQ ID NO: 2551129 - RNA, 16 nt, Human
caaaccugccuggguu

SEQ ID NO: 2551130 - RNA, 19 nt, Human
caaaccugaccccugcuca

SEQ ID NO: 2551131 - RNA, 20 nt, Human
caaaccugaccccugcucag

SEQ ID NO: 2551132 - RNA, 19 nt, Human
caaaccugcaagggcuccc

SEQ ID NO: 2551133 - RNA, 23 nt, Human
caaaccucuguucaguguaaaua

SEQ ID NO: 2551134 - RNA, 12 nt, Human
caaaccugccug

SEQ ID NO: 2551135 - RNA, 18 nt, Human
caaaccuuuauuuuagaa

SEQ ID NO: 2551136 - RNA, 20 nt, Human
caaaccuuuauuuuagaauu

SEQ ID NO: 2551137 - RNA, 22 nt, Human
caaaccuguuuaaauauuucaa

SEQ ID NO: 2551138 - RNA, 21 nt, Human
caaaccuguuuaaauauuuca

SEQ ID NO: 2551139 - RNA, 16 nt, Human
caaaccuugaugugcc

SEQ ID NO: 2551140 - RNA, 20 nt, Human
caaacucuugaccucaggug

SEQ ID NO: 2551141 - RNA, 19 nt, Human
caaacucuugaccucaggu

SEQ ID NO: 2551142 - RNA, 17 nt, Human
caaacucuugaccucag

SEQ ID NO: 2551143 - RNA, 16 nt, Human
caaacucugccagcca

SEQ ID NO: 2551144 - RNA, 14 nt, Human
caaacucucugaac

SEQ ID NO: 2551145 - RNA, 22 nt, Human
caaaaugaaacgcaaccaccac

SEQ ID NO: 2551146 - RNA, 11 nt, Human
caaaaugaaac

SEQ ID NO: 2551147 - RNA, 18 nt, Human
caaaaugaggaauguaua

SEQ ID NO: 2551148 - RNA, 17 nt, Human
caaaaugaggaauguau

SEQ ID NO: 2551149 - RNA, 22 nt, Human
caaaaugagagggcaguguuuc

SEQ ID NO: 2551150 - RNA, 21 nt, Human
caaaaugagcccuguccugcc

SEQ ID NO: 2551151 - RNA, 13 nt, Human
caaaaucugucca

SEQ ID NO: 2551152 - RNA, 21 nt, Human
caaaaucuguccaaaggaggc

SEQ ID NO: 2551153 - RNA, 14 nt, Human
caaaauuucuauua

SEQ ID NO: 2551154 - RNA, 20 nt, Human
caaaauuuccaguaccuuug

SEQ ID NO: 2551155 - RNA, 12 nt, Human
caaaauuugaaa

SEQ ID NO: 2551156 - RNA, 19 nt, Human
caaaauuugaugccaggac

SEQ ID NO: 2551157 - RNA, 11 nt, Human
caaaauuuguu

SEQ ID NO: 2551158 - RNA, 14 nt, Human
caaaauuugaaauu

SEQ ID NO: 2551159 - RNA, 20 nt, Human
caaaaugaggaauguauaug

SEQ ID NO: 2551160 - RNA, 19 nt, Human
caaaaugaggaauguauau

SEQ ID NO: 2551161 - RNA, 14 nt, Human
caaaauuuccagua

SEQ ID NO: 2551162 - RNA, 15 nt, Human
caaaauuuccaguac

SEQ ID NO: 2551163 - RNA, 17 nt, Human
caaaauuuccaguaccu

SEQ ID NO: 2551164 - RNA, 18 nt, Human
caaaauuuccaguaccuu

SEQ ID NO: 2551165 - RNA, 19 nt, Human
caaaauuuccaguaccuuu

SEQ ID NO: 2551166 - RNA, 16 nt, Human
caaacaaaaagguucu

SEQ ID NO: 2551167 - RNA, 23 nt, Human
caaaauuuuauagcucaguuuau

SEQ ID NO: 2551168 - RNA, 18 nt, Human
caaaauuuuauuccuaua

SEQ ID NO: 2551169 - RNA, 13 nt, Human
caaaauuuguuug

SEQ ID NO: 2551170 - RNA, 21 nt, Human
caaaauuuuauagcucaguuu

SEQ ID NO: 2551171 - RNA, 13 nt, Human
caaaauuuuauuc

SEQ ID NO: 2551172 - RNA, 14 nt, Human
caaaauuuuauucc

SEQ ID NO: 2551173 - RNA, 17 nt, Human
caaacaaauaugcaaaa

SEQ ID NO: 2551174 - RNA, 20 nt, Human
caaacaaagccagaagcuga

SEQ ID NO: 2551175 - RNA, 15 nt, Human
caaacaaauaugcaa

SEQ ID NO: 2551176 - RNA, 14 nt, Human
caaacaaauaugca

SEQ ID NO: 2551177 - RNA, 21 nt, Human
caaacaaaaagguucucaggu

SEQ ID NO: 2551178 - RNA, 20 nt, Human
caaacaaaaagguucucagg

SEQ ID NO: 2551179 - RNA, 14 nt, Human
caaacaaaauuucu

SEQ ID NO: 2551180 - RNA, 18 nt, Human
caaacaaaauuucuauua

SEQ ID NO: 2551181 - RNA, 15 nt, Human
caaacaaaauuucua

SEQ ID NO: 2551182 - RNA, 13 nt, Human
caaacaaagccag

SEQ ID NO: 2551183 - RNA, 14 nt, Human
caaacaaagccaga

SEQ ID NO: 2551184 - RNA, 16 nt, Human
caaacaaagccagaag

SEQ ID NO: 2551185 - RNA, 21 nt, Human
caaacaccuuccagcuccugu

SEQ ID NO: 2551186 - RNA, 14 nt, Human
caaacaccuuccag

SEQ ID NO: 2551187 - RNA, 20 nt, Human
caaacacugcaggcaucaca

SEQ ID NO: 2551188 - RNA, 14 nt, Human
caaacaccucccag

SEQ ID NO: 2551189 - RNA, 15 nt, Human
caaacaccucccagg

SEQ ID NO: 2551190 - RNA, 12 nt, Human
caaacaccuucc

SEQ ID NO: 2551191 - RNA, 15 nt, Human
caaacaccuggacuu

SEQ ID NO: 2551192 - RNA, 13 nt, Human
caaacagaggccg

SEQ ID NO: 2551193 - RNA, 15 nt, Human
caaacagaggccgcc

SEQ ID NO: 2551194 - RNA, 20 nt, Human
caaaccucuguucaguguaa

SEQ ID NO: 2551195 - RNA, 15 nt, Human
caagauauggacaca

SEQ ID NO: 2551196 - RNA, 13 nt, Human
caacuaacaagaa

SEQ ID NO: 2551197 - RNA, 17 nt, Human
caagaaaugaaagcagg

SEQ ID NO: 2551198 - RNA, 19 nt, Human
caagaaaugaaagcaggga

SEQ ID NO: 2551199 - RNA, 15 nt, Human
caagaaaugaaagca

SEQ ID NO: 2551200 - RNA, 23 nt, Human
caacuuguauuaaagacagaggc

SEQ ID NO: 2551201 - RNA, 17 nt, Human
caacuugucuuuuucug

SEQ ID NO: 2551202 - RNA, 13 nt, Human
caagaagcccagg

SEQ ID NO: 2551203 - RNA, 20 nt, Human
caagaagcaggcuacacuga

SEQ ID NO: 2551204 - RNA, 14 nt, Human
caagaagcccagga

SEQ ID NO: 2551205 - RNA, 23 nt, Human
caagaagaucacgcuccccgccu

SEQ ID NO: 2551206 - RNA, 20 nt, Human
caagaagaucacgcuccccg

SEQ ID NO: 2551207 - RNA, 19 nt, Human
caagaagaucacgcucccc

SEQ ID NO: 2551208 - RNA, 14 nt, Human
caagaagcaggcua

SEQ ID NO: 2551209 - RNA, 13 nt, Human
caagaagcaggcu

SEQ ID NO: 2551210 - RNA, 21 nt, Human
caagaagaucacgcuccccgc

SEQ ID NO: 2551211 - RNA, 18 nt, Human
caagaagaucacgcuccc

SEQ ID NO: 2551212 - RNA, 21 nt, Human
caagaagaccagacuguggag

SEQ ID NO: 2551213 - RNA, 13 nt, Human
caagaagaccaga

SEQ ID NO: 2551214 - RNA, 19 nt, Human
caacuugucuuuuucugga

SEQ ID NO: 2551215 - RNA, 22 nt, Human
caacuuguaaauacaccaccuc

SEQ ID NO: 2551216 - RNA, 16 nt, Human
caacuuguaaauacac

SEQ ID NO: 2551217 - RNA, 13 nt, Human
caacuuguaaaua

SEQ ID NO: 2551218 - RNA, 16 nt, Human
caacuuguaaaugugg

SEQ ID NO: 2551219 - RNA, 17 nt, Human
caacuuggcuuucccgg

SEQ ID NO: 2551220 - RNA, 13 nt, Human
caacuuggcuuuc

SEQ ID NO: 2551221 - RNA, 12 nt, Human
caacuuggcuuu

SEQ ID NO: 2551222 - RNA, 19 nt, Human
caacuuggcuuccuuucuu

SEQ ID NO: 2551223 - RNA, 12 nt, Human
caacuugggaac

SEQ ID NO: 2551224 - RNA, 18 nt, Human
caacuuggcuuccuuucu

SEQ ID NO: 2551225 - RNA, 18 nt, Human
caacguggggcagcacag

SEQ ID NO: 2551226 - RNA, 13 nt, Human
caacgacaaagcc

SEQ ID NO: 2551227 - RNA, 18 nt, Human
caacgugcauugugcuuc

SEQ ID NO: 2551228 - RNA, 17 nt, Human
caacgugcauugugcuu

SEQ ID NO: 2551229 - RNA, 14 nt, Human
caacguggcccaga

SEQ ID NO: 2551230 - RNA, 13 nt, Human
caacguggcccag

SEQ ID NO: 2551231 - RNA, 21 nt, Human
caacguggcccagagaagcca

SEQ ID NO: 2551232 - RNA, 20 nt, Human
caacguggcccagagaagcc

SEQ ID NO: 2551233 - RNA, 19 nt, Human
caacguggcccagagaagc

SEQ ID NO: 2551234 - RNA, 17 nt, Human
caacguggcccagagaa

SEQ ID NO: 2551235 - RNA, 17 nt, Human
caacguggggcagcaca

SEQ ID NO: 2551236 - RNA, 15 nt, Human
caacguggggcagca

SEQ ID NO: 2551237 - RNA, 12 nt, Human
caacguggggca

SEQ ID NO: 2551238 - RNA, 15 nt, Human
caagacgcugugcug

SEQ ID NO: 2551239 - RNA, 13 nt, Human
caagacgcugugc

SEQ ID NO: 2551240 - RNA, 23 nt, Human
caagaccuucuccuucaccuuug

SEQ ID NO: 2551241 - RNA, 21 nt, Human
caagaccuucuccuucaccuu

SEQ ID NO: 2551242 - RNA, 13 nt, Human
caagagagauguu

SEQ ID NO: 2551243 - RNA, 15 nt, Human
caagagagauguuuu

SEQ ID NO: 2551244 - RNA, 14 nt, Human
caagagagaaagaa

SEQ ID NO: 2551245 - RNA, 17 nt, Human
caagagagaaagaagua

SEQ ID NO: 2551246 - RNA, 16 nt, Human
caagagaugggaauga

SEQ ID NO: 2551247 - RNA, 23 nt, Human
caagagaugaagagugagagggc

SEQ ID NO: 2551248 - RNA, 13 nt, Human
caagagacaugcu

SEQ ID NO: 2551249 - RNA, 22 nt, Human
caagagaauugcuugaacccag

SEQ ID NO: 2551250 - RNA, 12 nt, Human
caagagacucug

SEQ ID NO: 2551251 - RNA, 13 nt, Human
caagagagaaaga

SEQ ID NO: 2551252 - RNA, 20 nt, Human
caagagccauguagaagcug

SEQ ID NO: 2551253 - RNA, 16 nt, Human
caagagcacacuuggc

SEQ ID NO: 2551254 - RNA, 21 nt, Human
caagagcagccuguggcaucu

SEQ ID NO: 2551255 - RNA, 18 nt, Human
caagagcagccuguggca

SEQ ID NO: 2551256 - RNA, 20 nt, Human
caagagcagccuguggcauc

SEQ ID NO: 2551257 - RNA, 14 nt, Human
caagagcacacuug

SEQ ID NO: 2551258 - RNA, 13 nt, Human
caagagcacacuu

SEQ ID NO: 2551259 - RNA, 15 nt, Human
caagagauuuaauua

SEQ ID NO: 2551260 - RNA, 15 nt, Human
caagagcagaggcag

SEQ ID NO: 2551261 - RNA, 16 nt, Human
caagagcagaggcagc

SEQ ID NO: 2551262 - RNA, 14 nt, Human
caagagcagccugu

SEQ ID NO: 2551263 - RNA, 15 nt, Human
caagagcagccugug

SEQ ID NO: 2551264 - RNA, 16 nt, Human
caagagcagccugugg

SEQ ID NO: 2551265 - RNA, 17 nt, Human
caagagcagccuguggc

SEQ ID NO: 2551266 - RNA, 18 nt, Human
caagagcugcccuccuug

SEQ ID NO: 2551267 - RNA, 16 nt, Human
caagagcugcccuccu

SEQ ID NO: 2551268 - RNA, 20 nt, Human
caagagcugcccuccuuguc

SEQ ID NO: 2551269 - RNA, 17 nt, Human
caagagcuuaacagugu

SEQ ID NO: 2551270 - RNA, 22 nt, Human
caagagccuugguguccaccug

SEQ ID NO: 2551271 - RNA, 21 nt, Human
caagagccauguagaagcugc

SEQ ID NO: 2551272 - RNA, 13 nt, Human
caagagcccagca

SEQ ID NO: 2551273 - RNA, 19 nt, Human
caagagcccagcagggccu

SEQ ID NO: 2551274 - RNA, 23 nt, Human
caagagccuugguguccaccugg

SEQ ID NO: 2551275 - RNA, 14 nt, Human
caagagcugcccuc

SEQ ID NO: 2551276 - RNA, 13 nt, Human
caagagcugcccu

SEQ ID NO: 2551277 - RNA, 18 nt, Human
caagagcgaaacuccguc

SEQ ID NO: 2551278 - RNA, 12 nt, Human
caagagcugagg

SEQ ID NO: 2551279 - RNA, 13 nt, Human
caaauaugcaaag

SEQ ID NO: 2551280 - RNA, 20 nt, Human
caaauauuuauuuucuuucu

SEQ ID NO: 2551281 - RNA, 15 nt, Human
caaauauuuuuuugu

SEQ ID NO: 2551282 - RNA, 13 nt, Human
caaauauuuggag

SEQ ID NO: 2551283 - RNA, 15 nt, Human
caaaucaaagcagau

SEQ ID NO: 2551284 - RNA, 14 nt, Human
caaaucaaagcaga

SEQ ID NO: 2551285 - RNA, 17 nt, Human
caaauauuuuuuuguag

SEQ ID NO: 2551286 - RNA, 13 nt, Human
caaaucaaagcag

SEQ ID NO: 2551287 - RNA, 15 nt, Human
caaaucaauacacua

SEQ ID NO: 2551288 - RNA, 14 nt, Human
caaaucaauacacu

SEQ ID NO: 2551289 - RNA, 15 nt, Human
caaaucaagcuucag

SEQ ID NO: 2551290 - RNA, 14 nt, Human
caaaucaagcuuca

SEQ ID NO: 2551291 - RNA, 23 nt, Human
caaauauauucagccuggcuuca

SEQ ID NO: 2551292 - RNA, 17 nt, Human
caaauaaacucuaaaca

SEQ ID NO: 2551293 - RNA, 20 nt, Human
caaauaaacacuguguaagc

SEQ ID NO: 2551294 - RNA, 18 nt, Human
caaauaaacucuaaacau

SEQ ID NO: 2551295 - RNA, 17 nt, Human
caaauaaagucccaggu

SEQ ID NO: 2551296 - RNA, 12 nt, Human
caaauaugcaaa

SEQ ID NO: 2551297 - RNA, 17 nt, Human
caaaucaauacacuagu

SEQ ID NO: 2551298 - RNA, 16 nt, Human
caaaucaauuacuggu

SEQ ID NO: 2551299 - RNA, 23 nt, Human
caaauggaaaugggcagagcaga

SEQ ID NO: 2551300 - RNA, 19 nt, Human
caaauggaagacacauuga

SEQ ID NO: 2551301 - RNA, 15 nt, Human
caaauggaagacaca

SEQ ID NO: 2551302 - RNA, 18 nt, Human
caaauggcgucuggaagu

SEQ ID NO: 2551303 - RNA, 14 nt, Human
caaauggaggaaua

SEQ ID NO: 2551304 - RNA, 14 nt, Human
caaauguucaucaa

SEQ ID NO: 2551305 - RNA, 19 nt, Human
caaauggcgucuggaaguc

SEQ ID NO: 2551306 - RNA, 21 nt, Human
caaauggcgucuggaagucca

SEQ ID NO: 2551307 - RNA, 13 nt, Human
caaauguuaugca

SEQ ID NO: 2551308 - RNA, 18 nt, Human
caaauguucaucaaugaa

SEQ ID NO: 2551309 - RNA, 22 nt, Human
caaauggcgucuggaaguccaa

SEQ ID NO: 2551310 - RNA, 21 nt, Human
caaauguuaugcauaaaguca

SEQ ID NO: 2551311 - RNA, 15 nt, Human
caaauuaauuggcag

SEQ ID NO: 2551312 - RNA, 15 nt, Human
caaaguuaacagauu

SEQ ID NO: 2551313 - RNA, 11 nt, Human
caaaguguuaa

SEQ ID NO: 2551314 - RNA, 17 nt, Human
caaaguguguauuaaaa

SEQ ID NO: 2551315 - RNA, 14 nt, Human
caaaguguguauua

SEQ ID NO: 2551316 - RNA, 13 nt, Human
caaaguguguauu

SEQ ID NO: 2551317 - RNA, 12 nt, Human
caaaguguguau

SEQ ID NO: 2551318 - RNA, 18 nt, Human
caaagugcugggauuaca

SEQ ID NO: 2551319 - RNA, 23 nt, Human
caaagugcugggauuacaagcgu

SEQ ID NO: 2551320 - RNA, 15 nt, Human
caaauaaacacugug

SEQ ID NO: 2551321 - RNA, 14 nt, Human
caaauaaacacugu

SEQ ID NO: 2551322 - RNA, 13 nt, Human
caaauaaacacug

SEQ ID NO: 2551323 - RNA, 12 nt, Human
caaauaaacacu

SEQ ID NO: 2551324 - RNA, 11 nt, Human
caaauaaacac

SEQ ID NO: 2551325 - RNA, 10 nt, Human
caaauaaaau

SEQ ID NO: 2551326 - RNA, 23 nt, Human
caaauaaaauaaaaauaaaaaca

SEQ ID NO: 2551327 - RNA, 18 nt, Human
caaauaaaaauauugugu

SEQ ID NO: 2551328 - RNA, 16 nt, Human
caaauaaaaauauugu

SEQ ID NO: 2551329 - RNA, 16 nt, Human
caaaguuaacagauuu

SEQ ID NO: 2551330 - RNA, 16 nt, Human
caaaguuacuagguaa

SEQ ID NO: 2551331 - RNA, 21 nt, Human
caaaguuacuagguaacuuca

SEQ ID NO: 2551332 - RNA, 20 nt, Human
caaaguucccuacuuccugu

SEQ ID NO: 2551333 - RNA, 15 nt, Human
caaauaaaaauauug

SEQ ID NO: 2551334 - RNA, 19 nt, Human
caaagugcugggauuacaa

SEQ ID NO: 2551335 - RNA, 13 nt, Human
caaagugcuggga

SEQ ID NO: 2551336 - RNA, 18 nt, Human
caaagagccuggagaagc

SEQ ID NO: 2551337 - RNA, 17 nt, Human
caaagagccuggagaag

SEQ ID NO: 2551338 - RNA, 16 nt, Human
caaagagccuggagaa

SEQ ID NO: 2551339 - RNA, 15 nt, Human
caaagagccuggaga

SEQ ID NO: 2551340 - RNA, 13 nt, Human
caaagagccugga

SEQ ID NO: 2551341 - RNA, 18 nt, Human
caaagagacuggagcauc

SEQ ID NO: 2551342 - RNA, 17 nt, Human
caaagagacuggagcau

SEQ ID NO: 2551343 - RNA, 16 nt, Human
caaagagacuggagca

SEQ ID NO: 2551344 - RNA, 19 nt, Human
caaagagagaaaauaaaga

SEQ ID NO: 2551345 - RNA, 15 nt, Human
caaagagaaaacuua

SEQ ID NO: 2551346 - RNA, 14 nt, Human
caaagagacuggag

SEQ ID NO: 2551347 - RNA, 16 nt, Human
caaagagagaaaauaa

SEQ ID NO: 2551348 - RNA, 20 nt, Human
caaagaagacauguuuuaga

SEQ ID NO: 2551349 - RNA, 17 nt, Human
caaagaaggaauucuag

SEQ ID NO: 2551350 - RNA, 13 nt, Human
caaagaagacaug

SEQ ID NO: 2551351 - RNA, 14 nt, Human
caaagaagacaaca

SEQ ID NO: 2551352 - RNA, 16 nt, Human
caaagaagacauguuu

SEQ ID NO: 2551353 - RNA, 14 nt, Human
caaagaagacaugu

SEQ ID NO: 2551354 - RNA, 19 nt, Human
caaagaaggaaaaggcagg

SEQ ID NO: 2551355 - RNA, 11 nt, Human
caaagaagaaa

SEQ ID NO: 2551356 - RNA, 15 nt, Human
caaagaaauuaugug

SEQ ID NO: 2551357 - RNA, 22 nt, Human
caacagcacuggcucucuccag

SEQ ID NO: 2551358 - RNA, 15 nt, Human
caacagcacuggcuc

SEQ ID NO: 2551359 - RNA, 12 nt, Human
caacagcacugg

SEQ ID NO: 2551360 - RNA, 17 nt, Human
caacagcaaaucacgac

SEQ ID NO: 2551361 - RNA, 21 nt, Human
caacagcgacauagcccaucc

SEQ ID NO: 2551362 - RNA, 23 nt, Human
caacagcgacauagcccaucccu

SEQ ID NO: 2551363 - RNA, 15 nt, Human
caacagcucaagucu

SEQ ID NO: 2551364 - RNA, 22 nt, Human
caacagcucaagucuucccuga

SEQ ID NO: 2551365 - RNA, 23 nt, Human
caacagcuccccauuacccucag

SEQ ID NO: 2551366 - RNA, 23 nt, Human
caacaggaaucaagagcugcccu

SEQ ID NO: 2551367 - RNA, 21 nt, Human
caacaggaaucaagagcugcc

SEQ ID NO: 2551368 - RNA, 19 nt, Human
caacaggaaucaagagcug

SEQ ID NO: 2551369 - RNA, 15 nt, Human
caacaggagaauuuu

SEQ ID NO: 2551370 - RNA, 14 nt, Human
caacaggagcuggg

SEQ ID NO: 2551371 - RNA, 15 nt, Human
caacaggagcuggga

SEQ ID NO: 2551372 - RNA, 21 nt, Human
caacaggagcugggauccuaa

SEQ ID NO: 2551373 - RNA, 19 nt, Human
caacauacucccaucugug

SEQ ID NO: 2551374 - RNA, 17 nt, Human
caacauacucccaucug

SEQ ID NO: 2551375 - RNA, 12 nt, Human
caacaggcuggg

SEQ ID NO: 2551376 - RNA, 23 nt, Human
caacaggaggacaauucaugaac

SEQ ID NO: 2551377 - RNA, 22 nt, Human
caacaggaggacaauucaugaa

SEQ ID NO: 2551378 - RNA, 19 nt, Human
caacaggaggacaauucau

SEQ ID NO: 2551379 - RNA, 17 nt, Human
caacaggaggacaauuc

SEQ ID NO: 2551380 - RNA, 16 nt, Human
caacaggaggacaauu

SEQ ID NO: 2551381 - RNA, 15 nt, Human
caacaggaggacaau

SEQ ID NO: 2551382 - RNA, 14 nt, Human
caacaggaggacaa

SEQ ID NO: 2551383 - RNA, 22 nt, Human
caacaggagcugggauccuaag

SEQ ID NO: 2551384 - RNA, 18 nt, Human
caaccugcucuccucuug

SEQ ID NO: 2551385 - RNA, 23 nt, Human
caaccugcucuccucuugccacu

SEQ ID NO: 2551386 - RNA, 21 nt, Human
caaccugcucuccucuugcca

SEQ ID NO: 2551387 - RNA, 20 nt, Human
caacauacucccaucuguga

SEQ ID NO: 2551388 - RNA, 20 nt, Human
caaccuggguccaaauaaaa

SEQ ID NO: 2551389 - RNA, 19 nt, Human
caaccuggguccaaauaaa

SEQ ID NO: 2551390 - RNA, 16 nt, Human
caaccuugagacagcu

SEQ ID NO: 2551391 - RNA, 20 nt, Human
caaccuucuguggcucacag

SEQ ID NO: 2551392 - RNA, 19 nt, Human
caaccuucuguggcucaca

SEQ ID NO: 2551393 - RNA, 17 nt, Human
caaccuucuguggcuca

SEQ ID NO: 2551394 - RNA, 18 nt, Human
caaccuggguccaaauaa

SEQ ID NO: 2551395 - RNA, 17 nt, Human
caaccuggguccaaaua

SEQ ID NO: 2551396 - RNA, 16 nt, Human
caaccuggguccaaau

SEQ ID NO: 2551397 - RNA, 14 nt, Human
caaccuggguccaa

SEQ ID NO: 2551398 - RNA, 13 nt, Human
caaccugggucca

SEQ ID NO: 2551399 - RNA, 11 nt, Human
caaccuggaga

SEQ ID NO: 2551400 - RNA, 20 nt, Human
caaccuggggggcaguggug

SEQ ID NO: 2551401 - RNA, 16 nt, Human
caaccuucuguggcuc

SEQ ID NO: 2551402 - RNA, 16 nt, Human
caaccuggucacagga

SEQ ID NO: 2551403 - RNA, 19 nt, Human
caacagauuugugaacuca

SEQ ID NO: 2551404 - RNA, 17 nt, Human
caacagauuugugaacu

SEQ ID NO: 2551405 - RNA, 16 nt, Human
caacagauuugugaac

SEQ ID NO: 2551406 - RNA, 15 nt, Human
caacagauuugugaa

SEQ ID NO: 2551407 - RNA, 23 nt, Human
caacagauuugugaacucagcca

SEQ ID NO: 2551408 - RNA, 20 nt, Human
caacagauuugugaacucag

SEQ ID NO: 2551409 - RNA, 21 nt, Human
caacagaugcuuuucugucuc

SEQ ID NO: 2551410 - RNA, 15 nt, Human
caacagaugcuuuuc

SEQ ID NO: 2551411 - RNA, 23 nt, Human
caacagaugcuuuucugucucug

SEQ ID NO: 2551412 - RNA, 14 nt, Human
caacagauuuguga

SEQ ID NO: 2551413 - RNA, 13 nt, Human
caacagaucugga

SEQ ID NO: 2551414 - RNA, 14 nt, Human
caacagaucuggaa

SEQ ID NO: 2551415 - RNA, 17 nt, Human
caacagaucuggaaccu

SEQ ID NO: 2551416 - RNA, 23 nt, Human
caacagaucuggaaccucagccu

SEQ ID NO: 2551417 - RNA, 17 nt, Human
caacagaucaauuugua

SEQ ID NO: 2551418 - RNA, 14 nt, Human
caacagauacugga

SEQ ID NO: 2551419 - RNA, 17 nt, Human
caacagauacuggaagu

SEQ ID NO: 2551420 - RNA, 19 nt, Human
caacagagugagacccugu

SEQ ID NO: 2551421 - RNA, 23 nt, Human
caacagagugagacccugucucu

SEQ ID NO: 2551422 - RNA, 15 nt, Human
caacagaagcuucca

SEQ ID NO: 2551423 - RNA, 20 nt, Human
caacagaagucaugaagccc

SEQ ID NO: 2551424 - RNA, 22 nt, Human
caacagaagucaugaagcccaa

SEQ ID NO: 2551425 - RNA, 23 nt, Human
caacagaagucaugaagcccaag

SEQ ID NO: 2551426 - RNA, 12 nt, Human
caacagaagugg

SEQ ID NO: 2551427 - RNA, 18 nt, Human
caacagagaaggcaggaa

SEQ ID NO: 2551428 - RNA, 17 nt, Human
caacagaagcuucagaa

SEQ ID NO: 2551429 - RNA, 17 nt, Human
caacagagaaggcagga

SEQ ID NO: 2551430 - RNA, 23 nt, Human
caacacugugcccugguggagaa

SEQ ID NO: 2551431 - RNA, 19 nt, Human
caacacugugcccuggugg

SEQ ID NO: 2551432 - RNA, 18 nt, Human
caacacugugcccuggug

SEQ ID NO: 2551433 - RNA, 22 nt, Human
caacacugugcccugguggaga

SEQ ID NO: 2551434 - RNA, 12 nt, Human
caacagaagcag

SEQ ID NO: 2551435 - RNA, 16 nt, Human
caacagaagcuucaga

SEQ ID NO: 2551436 - RNA, 15 nt, Human
caacagaagaacugu

SEQ ID NO: 2551437 - RNA, 12 nt, Human
caaauuagaaaa

SEQ ID NO: 2551438 - RNA, 13 nt, Human
caaauuagaaaau

SEQ ID NO: 2551439 - RNA, 18 nt, Human
caaauuagaaaauguuau

SEQ ID NO: 2551440 - RNA, 19 nt, Human
caaauuagaaaauguuauu

SEQ ID NO: 2551441 - RNA, 19 nt, Human
caaauuagaagacauuuau

SEQ ID NO: 2551442 - RNA, 15 nt, Human
caaauuagaagacau

SEQ ID NO: 2551443 - RNA, 22 nt, Human
caaauuagaaaauguuauuuaa

SEQ ID NO: 2551444 - RNA, 21 nt, Human
caaauuagguuuuguacaauu

SEQ ID NO: 2551445 - RNA, 18 nt, Human
caaauuagaagacauuua

SEQ ID NO: 2551446 - RNA, 18 nt, Human
caaauuagguuuuguaca

SEQ ID NO: 2551447 - RNA, 19 nt, Human
caaauuagguuuuguacaa

SEQ ID NO: 2551448 - RNA, 20 nt, Human
caaauuagguuuuguacaau

SEQ ID NO: 2551449 - RNA, 20 nt, Human
caaauuaauuggcagcagau

SEQ ID NO: 2551450 - RNA, 19 nt, Human
caaauuaauuggcagcaga

SEQ ID NO: 2551451 - RNA, 18 nt, Human
caaauuaauuggcagcag

SEQ ID NO: 2551452 - RNA, 21 nt, Human
caaauuacuuugugaauagaa

SEQ ID NO: 2551453 - RNA, 11 nt, Human
caaauuagaaa

SEQ ID NO: 2551454 - RNA, 18 nt, Human
caaauuacuuugugaaua

SEQ ID NO: 2551455 - RNA, 15 nt, Human
caaauuucuaaaucu

SEQ ID NO: 2551456 - RNA, 22 nt, Human
caaauuucuaaaucuccaaaau

SEQ ID NO: 2551457 - RNA, 14 nt, Human
caaauuugauugau

SEQ ID NO: 2551458 - RNA, 19 nt, Human
caaauuugaaaauaauugu

SEQ ID NO: 2551459 - RNA, 17 nt, Human
caaauuugauugauuug

SEQ ID NO: 2551460 - RNA, 22 nt, Human
caaauuugucuugccuuauuaa

SEQ ID NO: 2551461 - RNA, 17 nt, Human
caaauuugucuugccuu

SEQ ID NO: 2551462 - RNA, 19 nt, Human
caaauuuggggguuucuca

SEQ ID NO: 2551463 - RNA, 17 nt, Human
caacacugugcccuggu

SEQ ID NO: 2551464 - RNA, 16 nt, Human
caacacugugcccugg

SEQ ID NO: 2551465 - RNA, 18 nt, Human
caauaggaaaaacugauu

SEQ ID NO: 2551466 - RNA, 22 nt, Human
caauaaaguauuuaauuagugc

SEQ ID NO: 2551467 - RNA, 20 nt, Human
caauaaaguauuuaauuagu

SEQ ID NO: 2551468 - RNA, 23 nt, Human
caagggugaugggaaagcauugu

SEQ ID NO: 2551469 - RNA, 17 nt, Human
caagggucuagggagag

SEQ ID NO: 2551470 - RNA, 16 nt, Human
caaggguggcauccca

SEQ ID NO: 2551471 - RNA, 17 nt, Human
caauaaaguauuuaauu

SEQ ID NO: 2551472 - RNA, 16 nt, Human
caauaaaguauuuaau

SEQ ID NO: 2551473 - RNA, 21 nt, Human
caaggguggcaucccaguggc

SEQ ID NO: 2551474 - RNA, 15 nt, Human
caauaaaugucuguu

SEQ ID NO: 2551475 - RNA, 14 nt, Human
caauaaaugucugu

SEQ ID NO: 2551476 - RNA, 16 nt, Human
caauaaaugucuguug

SEQ ID NO: 2551477 - RNA, 17 nt, Human
caauaaaugugcuuaug

SEQ ID NO: 2551478 - RNA, 18 nt, Human
caauaaaugguauagcaa

SEQ ID NO: 2551479 - RNA, 23 nt, Human
caauaaaugguauagcaaauguu

SEQ ID NO: 2551480 - RNA, 20 nt, Human
caauaaaucugacccagugc

SEQ ID NO: 2551481 - RNA, 12 nt, Human
caauaaaugaau

SEQ ID NO: 2551482 - RNA, 17 nt, Human
caauaaaucugacccag

SEQ ID NO: 2551483 - RNA, 18 nt, Human
caauaaaucugacccagu

SEQ ID NO: 2551484 - RNA, 16 nt, Human
caagggaaccuguguc

SEQ ID NO: 2551485 - RNA, 15 nt, Human
caagggaaccugugu

SEQ ID NO: 2551486 - RNA, 19 nt, Human
caaggguagggugggccuu

SEQ ID NO: 2551487 - RNA, 20 nt, Human
caagggaaaggggugcuuuu

SEQ ID NO: 2551488 - RNA, 16 nt, Human
caagggaaaggggugc

SEQ ID NO: 2551489 - RNA, 14 nt, Human
caagggaaaggggu

SEQ ID NO: 2551490 - RNA, 12 nt, Human
caagggaaaggg

SEQ ID NO: 2551491 - RNA, 16 nt, Human
caagggaaaagucucu

SEQ ID NO: 2551492 - RNA, 21 nt, Human
caagggugaugggaaagcauu

SEQ ID NO: 2551493 - RNA, 16 nt, Human
caagggucuagggaga

SEQ ID NO: 2551494 - RNA, 18 nt, Human
caagggaauguaacugcu

SEQ ID NO: 2551495 - RNA, 21 nt, Human
caagggaaaggggugcuuuua

SEQ ID NO: 2551496 - RNA, 15 nt, Human
caagggaaaagucuc

SEQ ID NO: 2551497 - RNA, 14 nt, Human
caaggcugcgucug

SEQ ID NO: 2551498 - RNA, 18 nt, Human
caaggcugcgguuuguug

SEQ ID NO: 2551499 - RNA, 18 nt, Human
caaggcugcgucuggagg

SEQ ID NO: 2551500 - RNA, 17 nt, Human
caaggcugcgucuggag

SEQ ID NO: 2551501 - RNA, 16 nt, Human
caaggcugcuuagaau

SEQ ID NO: 2551502 - RNA, 18 nt, Human
caaggcugggggaagaag

SEQ ID NO: 2551503 - RNA, 19 nt, Human
caauagucaaauuguguga

SEQ ID NO: 2551504 - RNA, 17 nt, Human
caauagucaaauugugu

SEQ ID NO: 2551505 - RNA, 16 nt, Human
caauagugggcccucc

SEQ ID NO: 2551506 - RNA, 16 nt, Human
caauagucaagaaaaa

SEQ ID NO: 2551507 - RNA, 14 nt, Human
caauaguguguucu

SEQ ID NO: 2551508 - RNA, 15 nt, Human
caauaguguguucug

SEQ ID NO: 2551509 - RNA, 16 nt, Human
caauaguguguucuga

SEQ ID NO: 2551510 - RNA, 17 nt, Human
caauaguguguucugau

SEQ ID NO: 2551511 - RNA, 23 nt, Human
caauaguguguucugauuagaaa

SEQ ID NO: 2551512 - RNA, 17 nt, Human
caauaggaaaaacugau

SEQ ID NO: 2551513 - RNA, 16 nt, Human
caauaggaaaaacuga

SEQ ID NO: 2551514 - RNA, 15 nt, Human
caauaggaaaaacug

SEQ ID NO: 2551515 - RNA, 19 nt, Human
caauagcaacguagcuucu

SEQ ID NO: 2551516 - RNA, 19 nt, Human
caauagcagacaguguuuu

SEQ ID NO: 2551517 - RNA, 15 nt, Human
caauaacacacagcu

SEQ ID NO: 2551518 - RNA, 13 nt, Human
caauaacacuguc

SEQ ID NO: 2551519 - RNA, 14 nt, Human
caauaacuacugug

SEQ ID NO: 2551520 - RNA, 15 nt, Human
caauaacuacugugu

SEQ ID NO: 2551521 - RNA, 16 nt, Human
caauaacuacuguguu

SEQ ID NO: 2551522 - RNA, 17 nt, Human
caauaacuacuguguuc

SEQ ID NO: 2551523 - RNA, 18 nt, Human
caauaacuacuguguucc

SEQ ID NO: 2551524 - RNA, 19 nt, Human
caauaacuacuguguuccu

SEQ ID NO: 2551525 - RNA, 20 nt, Human
caauaacuacuguguuccug

SEQ ID NO: 2551526 - RNA, 21 nt, Human
caauaacuacuguguuccugg

SEQ ID NO: 2551527 - RNA, 20 nt, Human
caauaagaauuuagggagaa

SEQ ID NO: 2551528 - RNA, 18 nt, Human
caauaagcaucaaacucu

SEQ ID NO: 2551529 - RNA, 12 nt, Human
caauaagccuug

SEQ ID NO: 2551530 - RNA, 19 nt, Human
caauaagcaucaaacucuu

SEQ ID NO: 2551531 - RNA, 22 nt, Human
caauaacuacuguguuccuggc

SEQ ID NO: 2551532 - RNA, 18 nt, Human
caauaaggucaaugccag

SEQ ID NO: 2551533 - RNA, 17 nt, Human
caauaaggucaaugcca

SEQ ID NO: 2551534 - RNA, 13 nt, Human
caauaagccuugu

SEQ ID NO: 2551535 - RNA, 19 nt, Human
caauaauaaauauuuuugc

SEQ ID NO: 2551536 - RNA, 20 nt, Human
caauacccaaauccucucca

SEQ ID NO: 2551537 - RNA, 23 nt, Human
caauacccaaauccucuccagcu

SEQ ID NO: 2551538 - RNA, 22 nt, Human
caauacccaaauccucuccagc

SEQ ID NO: 2551539 - RNA, 23 nt, Human
caauacccuuugaauuggacaau

SEQ ID NO: 2551540 - RNA, 17 nt, Human
caauacucauaauguga

SEQ ID NO: 2551541 - RNA, 22 nt, Human
caauacucauaaugugaagugu

SEQ ID NO: 2551542 - RNA, 18 nt, Human
caauacucauaaugugaa

SEQ ID NO: 2551543 - RNA, 23 nt, Human
caauagaaggauguacauuucca

SEQ ID NO: 2551544 - RNA, 23 nt, Human
caauagaaacucaccauguaaaa

SEQ ID NO: 2551545 - RNA, 19 nt, Human
caauagauauuuaccuuuu

SEQ ID NO: 2551546 - RNA, 18 nt, Human
caagcgauucuucugcuu

SEQ ID NO: 2551547 - RNA, 21 nt, Human
caagcugcacccucaggcagg

SEQ ID NO: 2551548 - RNA, 17 nt, Human
caagcgauucuucugcu

SEQ ID NO: 2551549 - RNA, 15 nt, Human
caagcgauucuucug

SEQ ID NO: 2551550 - RNA, 21 nt, Human
caagcuggucccacucagucc

SEQ ID NO: 2551551 - RNA, 13 nt, Human
caagcuggaagca

SEQ ID NO: 2551552 - RNA, 12 nt, Human
caagcuggaagc

SEQ ID NO: 2551553 - RNA, 14 nt, Human
caagcugcaucuag

SEQ ID NO: 2551554 - RNA, 22 nt, Human
caagcugcacccucaggcaggu

SEQ ID NO: 2551555 - RNA, 16 nt, Human
caagauaccuaaaaga

SEQ ID NO: 2551556 - RNA, 16 nt, Human
caagauaacugagaau

SEQ ID NO: 2551557 - RNA, 15 nt, Human
caagauaacugagaa

SEQ ID NO: 2551558 - RNA, 22 nt, Human
caagaguuuauuuccaaauaaa

SEQ ID NO: 2551559 - RNA, 15 nt, Human
caagaggcugaggca

SEQ ID NO: 2551560 - RNA, 15 nt, Human
caagccuggucagcc

SEQ ID NO: 2551561 - RNA, 16 nt, Human
caagccuggucagccc

SEQ ID NO: 2551562 - RNA, 17 nt, Human
caagccuggucagccca

SEQ ID NO: 2551563 - RNA, 18 nt, Human
caagccuggucagcccaa

SEQ ID NO: 2551564 - RNA, 12 nt, Human
caagccugguca

SEQ ID NO: 2551565 - RNA, 18 nt, Human
caagccuguaaucccagc

SEQ ID NO: 2551566 - RNA, 21 nt, Human
caagccuguaaucccagcuac

SEQ ID NO: 2551567 - RNA, 17 nt, Human
caagccuuggcucuacc

SEQ ID NO: 2551568 - RNA, 17 nt, Human
caagcgaggucaacaga

SEQ ID NO: 2551569 - RNA, 20 nt, Human
caagcgaggucaacagagaa

SEQ ID NO: 2551570 - RNA, 20 nt, Human
caaggaaaaaauaacaauga

SEQ ID NO: 2551571 - RNA, 14 nt, Human
caagcugugagaca

SEQ ID NO: 2551572 - RNA, 14 nt, Human
caagcuggaagcac

SEQ ID NO: 2551573 - RNA, 18 nt, Human
caagcugugagacagugg

SEQ ID NO: 2551574 - RNA, 14 nt, Human
caaggagaaacaga

SEQ ID NO: 2551575 - RNA, 16 nt, Human
caaggagaaacagaga

SEQ ID NO: 2551576 - RNA, 18 nt, Human
caaggagaaacagagaca

SEQ ID NO: 2551577 - RNA, 20 nt, Human
caaggagaaacagagacagg

SEQ ID NO: 2551578 - RNA, 20 nt, Human
caaggagacacaacaacucc

SEQ ID NO: 2551579 - RNA, 19 nt, Human
caaggagaaacagagacag

SEQ ID NO: 2551580 - RNA, 18 nt, Human
caaggaaaaaauaacaau

SEQ ID NO: 2551581 - RNA, 23 nt, Human
caagcuggucccacucaguccau

SEQ ID NO: 2551582 - RNA, 22 nt, Human
caagcuggucccacucagucca

SEQ ID NO: 2551583 - RNA, 20 nt, Human
caaggauccugagccagauu

SEQ ID NO: 2551584 - RNA, 17 nt, Human
caaggcugcagugagcc

SEQ ID NO: 2551585 - RNA, 22 nt, Human
caaggcugcagugagccgagau

SEQ ID NO: 2551586 - RNA, 19 nt, Human
caaggauccugagccagau

SEQ ID NO: 2551587 - RNA, 18 nt, Human
caaggauccugagccaga

SEQ ID NO: 2551588 - RNA, 16 nt, Human
caaggagauuuacaac

SEQ ID NO: 2551589 - RNA, 18 nt, Human
caaggagaggaggcaacu

SEQ ID NO: 2551590 - RNA, 15 nt, Human
caaggagaggaggca

SEQ ID NO: 2551591 - RNA, 14 nt, Human
caaggagaggaggc

SEQ ID NO: 2551592 - RNA, 13 nt, Human
caaggagaggagg

SEQ ID NO: 2551593 - RNA, 13 nt, Human
caaggagaugaag

SEQ ID NO: 2551594 - RNA, 23 nt, Human
caaggagaugaagcaaacacauu

SEQ ID NO: 2551595 - RNA, 22 nt, Human
cacaguucaguggcagggcuca

SEQ ID NO: 2551596 - RNA, 15 nt, Human
cacacacgugagaau

SEQ ID NO: 2551597 - RNA, 16 nt, Human
cacacuccaagauaug

SEQ ID NO: 2551598 - RNA, 14 nt, Human
cacacuccagcugg

SEQ ID NO: 2551599 - RNA, 16 nt, Human
cacacucgcccgccca

SEQ ID NO: 2551600 - RNA, 17 nt, Human
cacacuccccugcacug

SEQ ID NO: 2551601 - RNA, 22 nt, Human
cacacuccaagauauggacaca

SEQ ID NO: 2551602 - RNA, 14 nt, Human
cacacuccaucagc

SEQ ID NO: 2551603 - RNA, 15 nt, Human
cacacuccaucagcu

SEQ ID NO: 2551604 - RNA, 17 nt, Human
cacacuccaucagcuua

SEQ ID NO: 2551605 - RNA, 13 nt, Human
cacacugaagaag

SEQ ID NO: 2551606 - RNA, 12 nt, Human
cacagagaaagu

SEQ ID NO: 2551607 - RNA, 17 nt, Human
cacagagcucuccagcu

SEQ ID NO: 2551608 - RNA, 16 nt, Human
cacagagcucuccagc

SEQ ID NO: 2551609 - RNA, 14 nt, Human
cacagagcucucca

SEQ ID NO: 2551610 - RNA, 21 nt, Human
cacagagcucuccagcuccaa

SEQ ID NO: 2551611 - RNA, 18 nt, Human
cacagagcucuccagcuc

SEQ ID NO: 2551612 - RNA, 13 nt, Human
cacagaggaagag

SEQ ID NO: 2551613 - RNA, 21 nt, Human
cacagagaaaguacuucucca

SEQ ID NO: 2551614 - RNA, 20 nt, Human
cacagagaaaguacuucucc

SEQ ID NO: 2551615 - RNA, 19 nt, Human
cacagagaaaguacuucuc

SEQ ID NO: 2551616 - RNA, 23 nt, Human
cacagaugggugcuuggaggaag

SEQ ID NO: 2551617 - RNA, 12 nt, Human
cacagauggauu

SEQ ID NO: 2551618 - RNA, 11 nt, Human
cacagaugccu

SEQ ID NO: 2551619 - RNA, 17 nt, Human
cacagauggauuugccu

SEQ ID NO: 2551620 - RNA, 17 nt, Human
cacagaugaaacacaaa

SEQ ID NO: 2551621 - RNA, 22 nt, Human
cacagaucacagcuucagccag

SEQ ID NO: 2551622 - RNA, 19 nt, Human
cacagaucacagcuucagc

SEQ ID NO: 2551623 - RNA, 14 nt, Human
cacagaucacagcu

SEQ ID NO: 2551624 - RNA, 22 nt, Human
cacagaguuguuacauuuuuaa

SEQ ID NO: 2551625 - RNA, 21 nt, Human
cacagaguuguuacauuuuua

SEQ ID NO: 2551626 - RNA, 18 nt, Human
cacagaggcuucuucaga

SEQ ID NO: 2551627 - RNA, 17 nt, Human
cacagaggaagagcagg

SEQ ID NO: 2551628 - RNA, 15 nt, Human
cacagaggaagagca

SEQ ID NO: 2551629 - RNA, 16 nt, Human
cacagaggaagagcag

SEQ ID NO: 2551630 - RNA, 13 nt, Human
cacagaggcugcc

SEQ ID NO: 2551631 - RNA, 21 nt, Human
cacagcaguugaaaagacucc

SEQ ID NO: 2551632 - RNA, 15 nt, Human
cacagccacacacac

SEQ ID NO: 2551633 - RNA, 17 nt, Human
cacagccacacacacag

SEQ ID NO: 2551634 - RNA, 18 nt, Human
cacagccacacacacaga

SEQ ID NO: 2551635 - RNA, 19 nt, Human
cacagccacacacacagaa

SEQ ID NO: 2551636 - RNA, 20 nt, Human
cacagccacacacacagaaa

SEQ ID NO: 2551637 - RNA, 21 nt, Human
cacagccacacacacagaaaa

SEQ ID NO: 2551638 - RNA, 22 nt, Human
cacagccacacacacagaaaau

SEQ ID NO: 2551639 - RNA, 23 nt, Human
cacagccacacacacagaaaaua

SEQ ID NO: 2551640 - RNA, 13 nt, Human
cacagccaccccu

SEQ ID NO: 2551641 - RNA, 21 nt, Human
cacagcagcuucaccagagca

SEQ ID NO: 2551642 - RNA, 22 nt, Human
cacagcagcuucaccagagcau

SEQ ID NO: 2551643 - RNA, 19 nt, Human
cacagcaguugaaaagacu

SEQ ID NO: 2551644 - RNA, 16 nt, Human
cacagauuugagcuca

SEQ ID NO: 2551645 - RNA, 17 nt, Human
cacagauuugagcucag

SEQ ID NO: 2551646 - RNA, 18 nt, Human
cacagauuugagcucagc

SEQ ID NO: 2551647 - RNA, 22 nt, Human
cacagauuugagcucagcccug

SEQ ID NO: 2551648 - RNA, 17 nt, Human
cacagccagacuggcac

SEQ ID NO: 2551649 - RNA, 18 nt, Human
cacagccagacuggcaca

SEQ ID NO: 2551650 - RNA, 20 nt, Human
cacagcccucccgccccuuc

SEQ ID NO: 2551651 - RNA, 18 nt, Human
cacagcccucccgccccu

SEQ ID NO: 2551652 - RNA, 17 nt, Human
cacagcccucccgcccc

SEQ ID NO: 2551653 - RNA, 15 nt, Human
cacagcccucccgcc

SEQ ID NO: 2551654 - RNA, 13 nt, Human
cacagcccuguca

SEQ ID NO: 2551655 - RNA, 10 nt, Human
cacagcccug

SEQ ID NO: 2551656 - RNA, 11 nt, Human
cacagcccugu

SEQ ID NO: 2551657 - RNA, 14 nt, Human
cacagcccucccgc

SEQ ID NO: 2551658 - RNA, 12 nt, Human
cacagcccuccc

SEQ ID NO: 2551659 - RNA, 11 nt, Human
cacagcccucc

SEQ ID NO: 2551660 - RNA, 20 nt, Human
cacagccgauucaccugagc

SEQ ID NO: 2551661 - RNA, 21 nt, Human
cacagccgauucaccugagca

SEQ ID NO: 2551662 - RNA, 21 nt, Human
cacagcccugucagugcagcc

SEQ ID NO: 2551663 - RNA, 14 nt, Human
cacagcccugucag

SEQ ID NO: 2551664 - RNA, 12 nt, Human
cacagcccuguc

SEQ ID NO: 2551665 - RNA, 18 nt, Human
cacagcccugucagugca

SEQ ID NO: 2551666 - RNA, 21 nt, Human
cacagcucuucuccaggcugu

SEQ ID NO: 2551667 - RNA, 18 nt, Human
cacagcugagagacuuuu

SEQ ID NO: 2551668 - RNA, 23 nt, Human
cacagcccugucagugcagcccg

SEQ ID NO: 2551669 - RNA, 19 nt, Human
cacagcugagagacuuuua

SEQ ID NO: 2551670 - RNA, 19 nt, Human
cacagcugcagagacagag

SEQ ID NO: 2551671 - RNA, 18 nt, Human
cacagcugcagagacaga

SEQ ID NO: 2551672 - RNA, 15 nt, Human
caaugugaacuuuau

SEQ ID NO: 2551673 - RNA, 18 nt, Human
caaugugaacuuuauuaa

SEQ ID NO: 2551674 - RNA, 19 nt, Human
caaugugaacuuuauuaaa

SEQ ID NO: 2551675 - RNA, 21 nt, Human
caaugugaacuuuauuaaaua

SEQ ID NO: 2551676 - RNA, 14 nt, Human
caaugugaacuuua

SEQ ID NO: 2551677 - RNA, 22 nt, Human
caaugugaaaagaaaaaugagc

SEQ ID NO: 2551678 - RNA, 13 nt, Human
caaugugcagugu

SEQ ID NO: 2551679 - RNA, 14 nt, Human
caaugugaaucaga

SEQ ID NO: 2551680 - RNA, 18 nt, Human
caaugugaaucagacccu

SEQ ID NO: 2551681 - RNA, 13 nt, Human
caaugugaccagg

SEQ ID NO: 2551682 - RNA, 19 nt, Human
caaugugaaucagacccua

SEQ ID NO: 2551683 - RNA, 13 nt, Human
caaugugcucucg

SEQ ID NO: 2551684 - RNA, 23 nt, Human
caauguggcaaggaaaaacaggu

SEQ ID NO: 2551685 - RNA, 17 nt, Human
caaugugaccaggggug

SEQ ID NO: 2551686 - RNA, 16 nt, Human
caaugugcuacugauu

SEQ ID NO: 2551687 - RNA, 13 nt, Human
caaugugccccca

SEQ ID NO: 2551688 - RNA, 21 nt, Human
caauaucuuuuuuuuaauaaa

SEQ ID NO: 2551689 - RNA, 16 nt, Human
caauaguuugcauaga

SEQ ID NO: 2551690 - RNA, 12 nt, Human
caauauccuuug

SEQ ID NO: 2551691 - RNA, 20 nt, Human
caauauccuuugccucaagg

SEQ ID NO: 2551692 - RNA, 15 nt, Human
caauauccuuugccu

SEQ ID NO: 2551693 - RNA, 13 nt, Human
caauauccuuugc

SEQ ID NO: 2551694 - RNA, 21 nt, Human
caauguggccuaaaaaugcaa

SEQ ID NO: 2551695 - RNA, 23 nt, Human
caaugugcuacugauuguuucau

SEQ ID NO: 2551696 - RNA, 21 nt, Human
caaugugguugcaaggccgcu

SEQ ID NO: 2551697 - RNA, 17 nt, Human
caauuacaggaaguacu

SEQ ID NO: 2551698 - RNA, 16 nt, Human
caauguuucuuuuauc

SEQ ID NO: 2551699 - RNA, 18 nt, Human
caauguuucuuuuaucac

SEQ ID NO: 2551700 - RNA, 20 nt, Human
caauguuuuccuuugucauc

SEQ ID NO: 2551701 - RNA, 13 nt, Human
caauguuuuccuu

SEQ ID NO: 2551702 - RNA, 22 nt, Human
caauguuuuccuuugucaucau

SEQ ID NO: 2551703 - RNA, 17 nt, Human
caauguuucuucuaggu

SEQ ID NO: 2551704 - RNA, 13 nt, Human
caauguuucuuuu

SEQ ID NO: 2551705 - RNA, 23 nt, Human
caauguuuaugcaaggaaggaaa

SEQ ID NO: 2551706 - RNA, 20 nt, Human
caauguuuaugcaaggaagg

SEQ ID NO: 2551707 - RNA, 13 nt, Human
cacaaacagaggc

SEQ ID NO: 2551708 - RNA, 15 nt, Human
cacaaaaucugucca

SEQ ID NO: 2551709 - RNA, 16 nt, Human
cacaaaauugggaaag

SEQ ID NO: 2551710 - RNA, 14 nt, Human
cacaaacagaggcc

SEQ ID NO: 2551711 - RNA, 18 nt, Human
cacaaagcccuuccaugu

SEQ ID NO: 2551712 - RNA, 22 nt, Human
caauuuuucuuauuucauuucu

SEQ ID NO: 2551713 - RNA, 16 nt, Human
caauuuuugccuucau

SEQ ID NO: 2551714 - RNA, 15 nt, Human
caauuuuugccuuca

SEQ ID NO: 2551715 - RNA, 14 nt, Human
caauuuuugccuuc

SEQ ID NO: 2551716 - RNA, 13 nt, Human
caauuuuugccuu

SEQ ID NO: 2551717 - RNA, 18 nt, Human
caauuuuugguugaauaa

SEQ ID NO: 2551718 - RNA, 19 nt, Human
caauuuuugguugaauaaa

SEQ ID NO: 2551719 - RNA, 17 nt, Human
caauuuuuuuaauuuug

SEQ ID NO: 2551720 - RNA, 21 nt, Human
caauuuuuuaucaugcauguc

SEQ ID NO: 2551721 - RNA, 22 nt, Human
caauuuuuuuaauuuuguauuu

SEQ ID NO: 2551722 - RNA, 21 nt, Human
caauuuuuuuaauuuuguauu

SEQ ID NO: 2551723 - RNA, 22 nt, Human
cacaaaauaaccaauccuggac

SEQ ID NO: 2551724 - RNA, 17 nt, Human
caauuccccucugcugc

SEQ ID NO: 2551725 - RNA, 14 nt, Human
caauuccccucugc

SEQ ID NO: 2551726 - RNA, 21 nt, Human
caauuccguagccagcugcuc

SEQ ID NO: 2551727 - RNA, 15 nt, Human
caauucccugcuguc

SEQ ID NO: 2551728 - RNA, 13 nt, Human
caauuccccucug

SEQ ID NO: 2551729 - RNA, 12 nt, Human
caauuccccucu

SEQ ID NO: 2551730 - RNA, 11 nt, Human
caauuccccuc

SEQ ID NO: 2551731 - RNA, 22 nt, Human
caauuaggaaguguaacagcug

SEQ ID NO: 2551732 - RNA, 14 nt, Human
caauuccucuggga

SEQ ID NO: 2551733 - RNA, 13 nt, Human
caauuccucuggg

SEQ ID NO: 2551734 - RNA, 15 nt, Human
caauuccucugggaa

SEQ ID NO: 2551735 - RNA, 12 nt, Human
caauuccugggc

SEQ ID NO: 2551736 - RNA, 20 nt, Human
caauuccguagccagcugcu

SEQ ID NO: 2551737 - RNA, 13 nt, Human
caauuccugggcc

SEQ ID NO: 2551738 - RNA, 21 nt, Human
caauuagcaauugacugucac

SEQ ID NO: 2551739 - RNA, 15 nt, Human
caauuaggaagugua

SEQ ID NO: 2551740 - RNA, 13 nt, Human
caauuccaccugc

SEQ ID NO: 2551741 - RNA, 16 nt, Human
caauuaggaaguguaa

SEQ ID NO: 2551742 - RNA, 20 nt, Human
caauuaggaaguguaacagc

SEQ ID NO: 2551743 - RNA, 23 nt, Human
caauuaggaaguguaacagcuga

SEQ ID NO: 2551744 - RNA, 18 nt, Human
caauuacaggaaguacug

SEQ ID NO: 2551745 - RNA, 17 nt, Human
caauuacugguccaaaa

SEQ ID NO: 2551746 - RNA, 13 nt, Human
caauuaaacggau

SEQ ID NO: 2551747 - RNA, 23 nt, Human
caauuaaaaaaaaagaucuguuu

SEQ ID NO: 2551748 - RNA, 12 nt, Human
caauuaaacgga

SEQ ID NO: 2551749 - RNA, 17 nt, Human
cacacacgcgugcacac

SEQ ID NO: 2551750 - RNA, 23 nt, Human
cacacacgcacgcacacacacaa

SEQ ID NO: 2551751 - RNA, 18 nt, Human
cacacacgcacgcacaca

SEQ ID NO: 2551752 - RNA, 17 nt, Human
cacacacgcacgcacac

SEQ ID NO: 2551753 - RNA, 19 nt, Human
cacacacgcacgcacacac

SEQ ID NO: 2551754 - RNA, 12 nt, Human
cacacacucacu

SEQ ID NO: 2551755 - RNA, 15 nt, Human
cacacacagccacac

SEQ ID NO: 2551756 - RNA, 16 nt, Human
cacacacagccacaca

SEQ ID NO: 2551757 - RNA, 13 nt, Human
cacacaccuguag

SEQ ID NO: 2551758 - RNA, 11 nt, Human
cacacaccugu

SEQ ID NO: 2551759 - RNA, 23 nt, Human
cacacacagaggaagagcaggca

SEQ ID NO: 2551760 - RNA, 15 nt, Human
cacacaccuguaguc

SEQ ID NO: 2551761 - RNA, 20 nt, Human
cacacaccuguagucccagc

SEQ ID NO: 2551762 - RNA, 16 nt, Human
cacacacgcacgcaca

SEQ ID NO: 2551763 - RNA, 15 nt, Human
cacacacgcacgcac

SEQ ID NO: 2551764 - RNA, 14 nt, Human
cacacacgcacgca

SEQ ID NO: 2551765 - RNA, 19 nt, Human
cacacaccuguagucccag

SEQ ID NO: 2551766 - RNA, 11 nt, Human
cacacacagcc

SEQ ID NO: 2551767 - RNA, 12 nt, Human
cacacacagcca

SEQ ID NO: 2551768 - RNA, 13 nt, Human
cacacacagccac

SEQ ID NO: 2551769 - RNA, 14 nt, Human
cacacacagccaca

SEQ ID NO: 2551770 - RNA, 20 nt, Human
cacacacagaaaauauacug

SEQ ID NO: 2551771 - RNA, 21 nt, Human
cacacacagaaaauauacugu

SEQ ID NO: 2551772 - RNA, 23 nt, Human
cacacacagaaaauauacuguaa

SEQ ID NO: 2551773 - RNA, 12 nt, Human
cacacacagagg

SEQ ID NO: 2551774 - RNA, 14 nt, Human
cacacacagaggaa

SEQ ID NO: 2551775 - RNA, 14 nt, Human
cacacacagaaaau

SEQ ID NO: 2551776 - RNA, 15 nt, Human
cacacacagaaaaua

SEQ ID NO: 2551777 - RNA, 16 nt, Human
cacacacagaaaauau

SEQ ID NO: 2551778 - RNA, 19 nt, Human
cacacacagaaaauauacu

SEQ ID NO: 2551779 - RNA, 11 nt, Human
cacacacagaa

SEQ ID NO: 2551780 - RNA, 13 nt, Human
cacacacagaaaa

SEQ ID NO: 2551781 - RNA, 14 nt, Human
cacacacacucacu

SEQ ID NO: 2551782 - RNA, 14 nt, Human
cacacacacgcacg

SEQ ID NO: 2551783 - RNA, 13 nt, Human
cacacacacucua

SEQ ID NO: 2551784 - RNA, 15 nt, Human
cacacacacacacau

SEQ ID NO: 2551785 - RNA, 16 nt, Human
cacacacacacacagg

SEQ ID NO: 2551786 - RNA, 16 nt, Human
cacacacacacacaug

SEQ ID NO: 2551787 - RNA, 13 nt, Human
cacacacacacag

SEQ ID NO: 2551788 - RNA, 14 nt, Human
cacacacacacagc

SEQ ID NO: 2551789 - RNA, 15 nt, Human
cacacacacacagcc

SEQ ID NO: 2551790 - RNA, 16 nt, Human
cacacacacacagcca

SEQ ID NO: 2551791 - RNA, 14 nt, Human
cacacacacacacu

SEQ ID NO: 2551792 - RNA, 14 nt, Human
cacacacacacagg

SEQ ID NO: 2551793 - RNA, 13 nt, Human
cacacacacacuc

SEQ ID NO: 2551794 - RNA, 16 nt, Human
cacacacacacaugca

SEQ ID NO: 2551795 - RNA, 11 nt, Human
cacacacacag

SEQ ID NO: 2551796 - RNA, 12 nt, Human
cacacacacaga

SEQ ID NO: 2551797 - RNA, 14 nt, Human
cacacacacacaug

SEQ ID NO: 2551798 - RNA, 15 nt, Human
cacacacacacaugc

SEQ ID NO: 2551799 - RNA, 13 nt, Human
cacacacacacau

SEQ ID NO: 2551800 - RNA, 16 nt, Human
cacacacacacaggag

SEQ ID NO: 2551801 - RNA, 13 nt, Human
cacacacacgcac

SEQ ID NO: 2551802 - RNA, 13 nt, Human
cacacacacccac

SEQ ID NO: 2551803 - RNA, 14 nt, Human
cacacacacaugca

SEQ ID NO: 2551804 - RNA, 15 nt, Human
cacacacacaugcau

SEQ ID NO: 2551805 - RNA, 12 nt, Human
cacacacacaug

SEQ ID NO: 2551806 - RNA, 13 nt, Human
cacacacacaugc

SEQ ID NO: 2551807 - RNA, 14 nt, Human
cacacacacaggag

SEQ ID NO: 2551808 - RNA, 13 nt, Human
cacacacacagaa

SEQ ID NO: 2551809 - RNA, 14 nt, Human
cacacacacagaaa

SEQ ID NO: 2551810 - RNA, 15 nt, Human
cacacacacagaaaa

SEQ ID NO: 2551811 - RNA, 12 nt, Human
cacacacacagc

SEQ ID NO: 2551812 - RNA, 13 nt, Human
cacacacacagcc

SEQ ID NO: 2551813 - RNA, 14 nt, Human
cacacacacagcca

SEQ ID NO: 2551814 - RNA, 15 nt, Human
cacacacacagccac

SEQ ID NO: 2551815 - RNA, 12 nt, Human
cacacacacagg

SEQ ID NO: 2551816 - RNA, 13 nt, Human
cacacacacagga

SEQ ID NO: 2551817 - RNA, 21 nt, Human
cacaauggcuaauucccagag

SEQ ID NO: 2551818 - RNA, 13 nt, Human
cacacaaaacaac

SEQ ID NO: 2551819 - RNA, 21 nt, Human
cacacaaaauguacccaguau

SEQ ID NO: 2551820 - RNA, 13 nt, Human
cacacaaagguau

SEQ ID NO: 2551821 - RNA, 18 nt, Human
cacacaaagguauaauuu

SEQ ID NO: 2551822 - RNA, 14 nt, Human
cacacacacacaca

SEQ ID NO: 2551823 - RNA, 13 nt, Human
cacacacacacac

SEQ ID NO: 2551824 - RNA, 15 nt, Human
cacacacacacacac

SEQ ID NO: 2551825 - RNA, 15 nt, Human
cacacacacacacaa

SEQ ID NO: 2551826 - RNA, 16 nt, Human
cacacacacacacagc

SEQ ID NO: 2551827 - RNA, 15 nt, Human
cacacacacacacag

SEQ ID NO: 2551828 - RNA, 18 nt, Human
cacaaucuuaaggggcag

SEQ ID NO: 2551829 - RNA, 19 nt, Human
cacaaucugacauucucag

SEQ ID NO: 2551830 - RNA, 15 nt, Human
cacaauauugaacuu

SEQ ID NO: 2551831 - RNA, 11 nt, Human
cacaauauuuu

SEQ ID NO: 2551832 - RNA, 20 nt, Human
cacaaucuuaaggggcagcu

SEQ ID NO: 2551833 - RNA, 19 nt, Human
cacaaucuuaaggggcagc

SEQ ID NO: 2551834 - RNA, 22 nt, Human
cacaaugaaaugcucuccuuuc

SEQ ID NO: 2551835 - RNA, 20 nt, Human
cacaauggcuaauucccaga

SEQ ID NO: 2551836 - RNA, 21 nt, Human
cacaauaaggucaaugccaga

SEQ ID NO: 2551837 - RNA, 12 nt, Human
cacaauaugaau

SEQ ID NO: 2551838 - RNA, 15 nt, Human
cacaauaauuuucua

SEQ ID NO: 2551839 - RNA, 13 nt, Human
cacaauacaauaa

SEQ ID NO: 2551840 - RNA, 20 nt, Human
cacaagaaaugaaagcaggg

SEQ ID NO: 2551841 - RNA, 21 nt, Human
cacaagaaaugaaagcaggga

SEQ ID NO: 2551842 - RNA, 21 nt, Human
cacaaguggugguaacccugg

SEQ ID NO: 2551843 - RNA, 18 nt, Human
cacaauaaaaauguuuaa

SEQ ID NO: 2551844 - RNA, 14 nt, Human
cacaaguuguguuu

SEQ ID NO: 2551845 - RNA, 14 nt, Human
cacaagugguggua

SEQ ID NO: 2551846 - RNA, 20 nt, Human
cacaaguggugguaacccug

SEQ ID NO: 2551847 - RNA, 13 nt, Human
cacaagugguggu

SEQ ID NO: 2551848 - RNA, 13 nt, Human
cacaaaggagagc

SEQ ID NO: 2551849 - RNA, 13 nt, Human
cacaaagccuuau

SEQ ID NO: 2551850 - RNA, 20 nt, Human
cacaaaauucgaccugauuu

SEQ ID NO: 2551851 - RNA, 18 nt, Human
cacaagaaaugaaagcag

SEQ ID NO: 2551852 - RNA, 18 nt, Human
cacaaaggaccucagcug

SEQ ID NO: 2551853 - RNA, 20 nt, Human
cacaaagccuuaucaagugu

SEQ ID NO: 2551854 - RNA, 21 nt, Human
cacaaaggaccucagcugcuu

SEQ ID NO: 2551855 - RNA, 21 nt, Human
cacaguucaguggcagggcuc

SEQ ID NO: 2551856 - RNA, 23 nt, Human
cacaguguuuuuguaaagugugg

SEQ ID NO: 2551857 - RNA, 20 nt, Human
cacaguucaguggcagggcu

SEQ ID NO: 2551858 - RNA, 12 nt, Human
cacagcugcuca

SEQ ID NO: 2551859 - RNA, 22 nt, Human
cacagcugcucaauaaaguaca

SEQ ID NO: 2551860 - RNA, 16 nt, Human
cacagcuuccccucuc

SEQ ID NO: 2551861 - RNA, 22 nt, Human
cacagcuuccccucucuccucc

SEQ ID NO: 2551862 - RNA, 19 nt, Human
cacagcuugaccugaggcu

SEQ ID NO: 2551863 - RNA, 18 nt, Human
cacagcuugaccugaggc

SEQ ID NO: 2551864 - RNA, 23 nt, Human
cacagcuuccccucucuccuccu

SEQ ID NO: 2551865 - RNA, 21 nt, Human
cacagcuugaccugaggcugu

SEQ ID NO: 2551866 - RNA, 20 nt, Human
cacagcuugaccugaggcug

SEQ ID NO: 2551867 - RNA, 22 nt, Human
cacagcuugaccugaggcugug

SEQ ID NO: 2551868 - RNA, 19 nt, Human
cacaggcccuuccucucca

SEQ ID NO: 2551869 - RNA, 18 nt, Human
cacaggcccuuccucucc

SEQ ID NO: 2551870 - RNA, 17 nt, Human
cacaggcccuuccucuc

SEQ ID NO: 2551871 - RNA, 16 nt, Human
cacaggcccuuccucu

SEQ ID NO: 2551872 - RNA, 13 nt, Human
cacaggaaaccag

SEQ ID NO: 2551873 - RNA, 15 nt, Human
cacaggcccuuccuc

SEQ ID NO: 2551874 - RNA, 20 nt, Human
cacagcuuuaucaccagaga

SEQ ID NO: 2551875 - RNA, 17 nt, Human
cacaguucaauucucau

SEQ ID NO: 2551876 - RNA, 22 nt, Human
cacaguguuuuuguaaagugug

SEQ ID NO: 2551877 - RNA, 19 nt, Human
cacaguguuuuuguaaagu

SEQ ID NO: 2551878 - RNA, 17 nt, Human
cacaguguuuuuguaaa

SEQ ID NO: 2551879 - RNA, 16 nt, Human
cacaguguuuuuguaa

SEQ ID NO: 2551880 - RNA, 17 nt, Human
cacaguguuggcgagag

SEQ ID NO: 2551881 - RNA, 23 nt, Human
cacaguguuaaaugaaauuguaa

SEQ ID NO: 2551882 - RNA, 10 nt, Human
cacaguguuu

SEQ ID NO: 2551883 - RNA, 13 nt, Human
cacaguguguuug

SEQ ID NO: 2551884 - RNA, 16 nt, Human
cacaguguguuuguga

SEQ ID NO: 2551885 - RNA, 14 nt, Human
cacaguguugccca

SEQ ID NO: 2551886 - RNA, 19 nt, Human
cacaguguugcccaggcug

SEQ ID NO: 2551887 - RNA, 19 nt, Human
cacagugcaucucagccca

SEQ ID NO: 2551888 - RNA, 18 nt, Human
cacagugcaucucagccc

SEQ ID NO: 2551889 - RNA, 17 nt, Human
cacagugcaucucagcc

SEQ ID NO: 2551890 - RNA, 21 nt, Human
cacaggcccuuccucuccacu

SEQ ID NO: 2551891 - RNA, 18 nt, Human
cacagugccuucaauaaa

SEQ ID NO: 2551892 - RNA, 17 nt, Human
cacagugccuucaauaa

SEQ ID NO: 2551893 - RNA, 13 nt, Human
cacagugcugucu

SEQ ID NO: 2551894 - RNA, 19 nt, Human
cacagugccuucaauaaau

SEQ ID NO: 2551895 - RNA, 22 nt, Human
cacagugcuuuccguggcacug

SEQ ID NO: 2551896 - RNA, 22 nt, Human
cacaguggaaagacagcuucuc

SEQ ID NO: 2551897 - RNA, 19 nt, Human
cauacucaauguuacuauc

SEQ ID NO: 2551898 - RNA, 20 nt, Human
cauacuaauuauacccccug

SEQ ID NO: 2551899 - RNA, 13 nt, Human
cauacguccacca

SEQ ID NO: 2551900 - RNA, 17 nt, Human
cauacguacacauuuua

SEQ ID NO: 2551901 - RNA, 18 nt, Human
cauacguacacauuuuau

SEQ ID NO: 2551902 - RNA, 14 nt, Human
cauacuaaccagca

SEQ ID NO: 2551903 - RNA, 21 nt, Human
cauacuaaccagcagaaaugc

SEQ ID NO: 2551904 - RNA, 15 nt, Human
cauacguacacauuu

SEQ ID NO: 2551905 - RNA, 16 nt, Human
cauacguacacauuuu

SEQ ID NO: 2551906 - RNA, 13 nt, Human
cauacguacacau

SEQ ID NO: 2551907 - RNA, 19 nt, Human
cauaccuuuauugugaucu

SEQ ID NO: 2551908 - RNA, 18 nt, Human
cauacgcaccacaucucu

SEQ ID NO: 2551909 - RNA, 21 nt, Human
cauacccacccccacccaagg

SEQ ID NO: 2551910 - RNA, 18 nt, Human
cauacccacccccaccca

SEQ ID NO: 2551911 - RNA, 17 nt, Human
cauacccacccccaccc

SEQ ID NO: 2551912 - RNA, 14 nt, Human
cauacccaccccca

SEQ ID NO: 2551913 - RNA, 23 nt, Human
cauaccuuccuucccugggcugu

SEQ ID NO: 2551914 - RNA, 21 nt, Human
cauaccuuccuucccugggcu

SEQ ID NO: 2551915 - RNA, 18 nt, Human
cauaccuuccuucccugg

SEQ ID NO: 2551916 - RNA, 16 nt, Human
cauaccuuccuucccu

SEQ ID NO: 2551917 - RNA, 15 nt, Human
cauaccuuccuuccc

SEQ ID NO: 2551918 - RNA, 14 nt, Human
cauaccuuccuucc

SEQ ID NO: 2551919 - RNA, 13 nt, Human
cauaccuuccuuc

SEQ ID NO: 2551920 - RNA, 18 nt, Human
cauaccugcuggugcaga

SEQ ID NO: 2551921 - RNA, 22 nt, Human
cauacccuggccgcccccugcc

SEQ ID NO: 2551922 - RNA, 15 nt, Human
cauaccuggcccugu

SEQ ID NO: 2551923 - RNA, 15 nt, Human
cauaccuacauguau

SEQ ID NO: 2551924 - RNA, 13 nt, Human
cauacccuccccc

SEQ ID NO: 2551925 - RNA, 22 nt, Human
cauaccaggccgccccagccuc

SEQ ID NO: 2551926 - RNA, 13 nt, Human
cauaccacuuuug

SEQ ID NO: 2551927 - RNA, 14 nt, Human
cauaccacuuuugu

SEQ ID NO: 2551928 - RNA, 15 nt, Human
cauaccacuuuuguu

SEQ ID NO: 2551929 - RNA, 18 nt, Human
cauaccacuuuuguucuu

SEQ ID NO: 2551930 - RNA, 12 nt, Human
cauacccacccc

SEQ ID NO: 2551931 - RNA, 11 nt, Human
cauacccaccc

SEQ ID NO: 2551932 - RNA, 19 nt, Human
cauaccacuuuuguucuug

SEQ ID NO: 2551933 - RNA, 14 nt, Human
cauaccaaugaaaa

SEQ ID NO: 2551934 - RNA, 20 nt, Human
cauaaucuaccaacgaaaga

SEQ ID NO: 2551935 - RNA, 18 nt, Human
cauaaucacaacccuuca

SEQ ID NO: 2551936 - RNA, 15 nt, Human
cauaauacuugcuuu

SEQ ID NO: 2551937 - RNA, 23 nt, Human
cauaauagacuucccacucuagg

SEQ ID NO: 2551938 - RNA, 22 nt, Human
cauaauagacuucccacucuag

SEQ ID NO: 2551939 - RNA, 17 nt, Human
cauaccaacacgagcag

SEQ ID NO: 2551940 - RNA, 17 nt, Human
cauacauuuauaauguu

SEQ ID NO: 2551941 - RNA, 21 nt, Human
cauacauuuauaauguuugcu

SEQ ID NO: 2551942 - RNA, 22 nt, Human
cauacauuuauaauguuugcua

SEQ ID NO: 2551943 - RNA, 23 nt, Human
cauacauuuauaauguuugcuau

SEQ ID NO: 2551944 - RNA, 24 nt, Human
cauacauuuauaauguuugcuauu

SEQ ID NO: 2551945 - RNA, 19 nt, Human
cauaagaaaacuaagaaau

SEQ ID NO: 2551946 - RNA, 12 nt, Human
cauaagaaugaa

SEQ ID NO: 2551947 - RNA, 21 nt, Human
cauaagaaugaauaauaauua

SEQ ID NO: 2551948 - RNA, 11 nt, Human
cauaacugaaa

SEQ ID NO: 2551949 - RNA, 14 nt, Human
cauaacugaaaaug

SEQ ID NO: 2551950 - RNA, 21 nt, Human
cauaacguuuuuccuuuaaaa

SEQ ID NO: 2551951 - RNA, 16 nt, Human
cauaacguuuuuccuu

SEQ ID NO: 2551952 - RNA, 15 nt, Human
cauaacguuuuuccu

SEQ ID NO: 2551953 - RNA, 22 nt, Human
cauaacggaucagaaauacaga

SEQ ID NO: 2551954 - RNA, 18 nt, Human
cauaacguuuuuccuuua

SEQ ID NO: 2551955 - RNA, 17 nt, Human
cauaacguuuuuccuuu

SEQ ID NO: 2551956 - RNA, 20 nt, Human
cauaacguuuuuccuuuaaa

SEQ ID NO: 2551957 - RNA, 17 nt, Human
cauaagauauuuuucau

SEQ ID NO: 2551958 - RNA, 15 nt, Human
cauaagccaauuuuu

SEQ ID NO: 2551959 - RNA, 19 nt, Human
cauaagcggcguaaguuua

SEQ ID NO: 2551960 - RNA, 20 nt, Human
cauaagccaauuuuucugca

SEQ ID NO: 2551961 - RNA, 17 nt, Human
cauaagccaauuuuucu

SEQ ID NO: 2551962 - RNA, 21 nt, Human
cauaagccuccauuuaguucu

SEQ ID NO: 2551963 - RNA, 23 nt, Human
cauaagccuccauuuaguucuuu

SEQ ID NO: 2551964 - RNA, 14 nt, Human
cauaagauaaaugu

SEQ ID NO: 2551965 - RNA, 23 nt, Human
cauaagaccauaacagccaacag

SEQ ID NO: 2551966 - RNA, 21 nt, Human
cauaagaccauaacagccaac

SEQ ID NO: 2551967 - RNA, 20 nt, Human
cauaagaccauaacagccaa

SEQ ID NO: 2551968 - RNA, 11 nt, Human
cauaagaccau

SEQ ID NO: 2551969 - RNA, 20 nt, Human
cauaagacccuaagccuccu

SEQ ID NO: 2551970 - RNA, 16 nt, Human
cauaagacccuaagcc

SEQ ID NO: 2551971 - RNA, 18 nt, Human
cauaagacuuugggauag

SEQ ID NO: 2551972 - RNA, 17 nt, Human
cauaaggaaacuggguu

SEQ ID NO: 2551973 - RNA, 22 nt, Human
cauaaggaauguagcugguuuc

SEQ ID NO: 2551974 - RNA, 16 nt, Human
cauaagcucagaaucc

SEQ ID NO: 2551975 - RNA, 14 nt, Human
cauaagcucagaau

SEQ ID NO: 2551976 - RNA, 22 nt, Human
cauaagcuauagacccgaggaa

SEQ ID NO: 2551977 - RNA, 17 nt, Human
cauaaguaauucaagaa

SEQ ID NO: 2551978 - RNA, 16 nt, Human
cauaaguaauucaaga

SEQ ID NO: 2551979 - RNA, 21 nt, Human
cauaagguuucguuucuguau

SEQ ID NO: 2551980 - RNA, 15 nt, Human
cauaagguuucguuu

SEQ ID NO: 2551981 - RNA, 22 nt, Human
cauaagguuucguuucuguaua

SEQ ID NO: 2551982 - RNA, 22 nt, Human
cauaaguaauucaagaaaacaa

SEQ ID NO: 2551983 - RNA, 18 nt, Human
cauaaguaauucaagaaa

SEQ ID NO: 2551984 - RNA, 15 nt, Human
cauaaguauuucaaa

SEQ ID NO: 2551985 - RNA, 19 nt, Human
cauaaguauuaugucucuu

SEQ ID NO: 2551986 - RNA, 12 nt, Human
cauaaguuucug

SEQ ID NO: 2551987 - RNA, 18 nt, Human
cauaauaaauaucuguac

SEQ ID NO: 2551988 - RNA, 17 nt, Human
cauaauaagcuaaagag

SEQ ID NO: 2551989 - RNA, 22 nt, Human
cauaaacaagaccacguuucua

SEQ ID NO: 2551990 - RNA, 14 nt, Human
cauaaaccuuaagu

SEQ ID NO: 2551991 - RNA, 12 nt, Human
cauaaaccuuaa

SEQ ID NO: 2551992 - RNA, 21 nt, Human
cauaaacccaguugccaucug

SEQ ID NO: 2551993 - RNA, 20 nt, Human
cauaaacaagaccacguuuc

SEQ ID NO: 2551994 - RNA, 21 nt, Human
cauaaacaagaccacguuucu

SEQ ID NO: 2551995 - RNA, 16 nt, Human
cauaaagcaggcagaa

SEQ ID NO: 2551996 - RNA, 14 nt, Human
cauaaagcaggcag

SEQ ID NO: 2551997 - RNA, 11 nt, Human
cauaaagaagc

SEQ ID NO: 2551998 - RNA, 21 nt, Human
cauaaagaagauguuuaacuu

SEQ ID NO: 2551999 - RNA, 19 nt, Human
cauaaagaagauguuuaac

SEQ ID NO: 2552000 - RNA, 18 nt, Human
cauaaagaagauguuuaa

SEQ ID NO: 2552001 - RNA, 21 nt, Human
cauaaagaagcaauaaagaag

SEQ ID NO: 2552002 - RNA, 12 nt, Human
cauaaagaagca

SEQ ID NO: 2552003 - RNA, 17 nt, Human
cauaaacugacuuuauc

SEQ ID NO: 2552004 - RNA, 15 nt, Human
cauaaacugacuuua

SEQ ID NO: 2552005 - RNA, 13 nt, Human
cauaaacugacuu

SEQ ID NO: 2552006 - RNA, 20 nt, Human
cauaaaccuuaaguaagcaa

SEQ ID NO: 2552007 - RNA, 16 nt, Human
cauaaacuucaugguc

SEQ ID NO: 2552008 - RNA, 12 nt, Human
cauaaacuucau

SEQ ID NO: 2552009 - RNA, 14 nt, Human
cauaaacugugugc

SEQ ID NO: 2552010 - RNA, 15 nt, Human
cauaaacugugugca

SEQ ID NO: 2552011 - RNA, 23 nt, Human
cauaaaaagccugcaauuucaua

SEQ ID NO: 2552012 - RNA, 23 nt, Human
cauaaaaagcaaaacaaaaauua

SEQ ID NO: 2552013 - RNA, 22 nt, Human
cauaaaauuuucuacucuuuuu

SEQ ID NO: 2552014 - RNA, 22 nt, Human
cauaaaacauuaagaaaaucau

SEQ ID NO: 2552015 - RNA, 20 nt, Human
cauaaaauaaaguauauaua

SEQ ID NO: 2552016 - RNA, 19 nt, Human
cauaaaacauuaagaaaau

SEQ ID NO: 2552017 - RNA, 18 nt, Human
cauaaaacauuaagaaaa

SEQ ID NO: 2552018 - RNA, 17 nt, Human
cauaaaacauuaagaaa

SEQ ID NO: 2552019 - RNA, 16 nt, Human
cauaaaacauuaagaa

SEQ ID NO: 2552020 - RNA, 23 nt, Human
cauaaaacauuaagaaaaucaua

SEQ ID NO: 2552021 - RNA, 19 nt, Human
cauaaaauaaaguauauau

SEQ ID NO: 2552022 - RNA, 21 nt, Human
cauaaaaauuagccaagugug

SEQ ID NO: 2552023 - RNA, 11 nt, Human
cauaaaacauu

SEQ ID NO: 2552024 - RNA, 12 nt, Human
cauaaaacaggu

SEQ ID NO: 2552025 - RNA, 13 nt, Human
cauaaaaagcuga

SEQ ID NO: 2552026 - RNA, 14 nt, Human
cauaaaugaagcag

SEQ ID NO: 2552027 - RNA, 13 nt, Human
cauaaaugaagca

SEQ ID NO: 2552028 - RNA, 13 nt, Human
cauaaaugaauuu

SEQ ID NO: 2552029 - RNA, 18 nt, Human
cauaaauaugcagugaua

SEQ ID NO: 2552030 - RNA, 14 nt, Human
cauaaaugaggaaa

SEQ ID NO: 2552031 - RNA, 20 nt, Human
cauaaauaugcagugauaug

SEQ ID NO: 2552032 - RNA, 15 nt, Human
cauaaauaugcagug

SEQ ID NO: 2552033 - RNA, 13 nt, Human
cauaaauaugcag

SEQ ID NO: 2552034 - RNA, 14 nt, Human
cauaaauaaaauga

SEQ ID NO: 2552035 - RNA, 23 nt, Human
cauaaaggugguaugugugugua

SEQ ID NO: 2552036 - RNA, 18 nt, Human
cauaaauaaaaugaccag

SEQ ID NO: 2552037 - RNA, 12 nt, Human
cauaaauaugca

SEQ ID NO: 2552038 - RNA, 20 nt, Human
cauaaaggugguaugugugu

SEQ ID NO: 2552039 - RNA, 22 nt, Human
cauaaaggugguaugugugugu

SEQ ID NO: 2552040 - RNA, 15 nt, Human
cauaaagucagugcc

SEQ ID NO: 2552041 - RNA, 21 nt, Human
cauaaagccuuggauguauau

SEQ ID NO: 2552042 - RNA, 15 nt, Human
cauaacaacuucaua

SEQ ID NO: 2552043 - RNA, 14 nt, Human
cauaacaauuccuc

SEQ ID NO: 2552044 - RNA, 15 nt, Human
cauaacaauuccucu

SEQ ID NO: 2552045 - RNA, 16 nt, Human
cauaacaauuccucua

SEQ ID NO: 2552046 - RNA, 17 nt, Human
cauaacaauuccucuac

SEQ ID NO: 2552047 - RNA, 18 nt, Human
cauaaccuuaccagauuu

SEQ ID NO: 2552048 - RNA, 21 nt, Human
cauaacggaucagaaauacag

SEQ ID NO: 2552049 - RNA, 17 nt, Human
cauaacggaucagaaau

SEQ ID NO: 2552050 - RNA, 20 nt, Human
cauaaccccacccuugccca

SEQ ID NO: 2552051 - RNA, 13 nt, Human
cauaaccccaccc

SEQ ID NO: 2552052 - RNA, 12 nt, Human
cauaaccccacc

SEQ ID NO: 2552053 - RNA, 16 nt, Human
cauaaccuagccuuag

SEQ ID NO: 2552054 - RNA, 17 nt, Human
caguugcaauaauacuu

SEQ ID NO: 2552055 - RNA, 20 nt, Human
caguugagucgucaucacuu

SEQ ID NO: 2552056 - RNA, 15 nt, Human
caguugcaauaauac

SEQ ID NO: 2552057 - RNA, 16 nt, Human
caguugcacuuggccu

SEQ ID NO: 2552058 - RNA, 13 nt, Human
caguugcacuugg

SEQ ID NO: 2552059 - RNA, 19 nt, Human
caguugcacuuggccucug

SEQ ID NO: 2552060 - RNA, 20 nt, Human
caguugcacuuggccucugg

SEQ ID NO: 2552061 - RNA, 21 nt, Human
caguugaaaagacuccaaaga

SEQ ID NO: 2552062 - RNA, 22 nt, Human
caguugaaaagacuccaaagaa

SEQ ID NO: 2552063 - RNA, 23 nt, Human
caguugaaaagacuccaaagaaa

SEQ ID NO: 2552064 - RNA, 21 nt, Human
caguugaauuuauggaaucua

SEQ ID NO: 2552065 - RNA, 21 nt, Human
caguugaaugacaacagaagc

SEQ ID NO: 2552066 - RNA, 20 nt, Human
caguugaaugacaacagaag

SEQ ID NO: 2552067 - RNA, 16 nt, Human
caguugacagcaggug

SEQ ID NO: 2552068 - RNA, 14 nt, Human
caguugacagcagg

SEQ ID NO: 2552069 - RNA, 14 nt, Human
caguugaaaagacu

SEQ ID NO: 2552070 - RNA, 18 nt, Human
caguugaaaagacuccaa

SEQ ID NO: 2552071 - RNA, 20 nt, Human
caguucuuugggccagacau

SEQ ID NO: 2552072 - RNA, 21 nt, Human
caguucuuugggccagacaug

SEQ ID NO: 2552073 - RNA, 22 nt, Human
caguucuuugggccagacaugc

SEQ ID NO: 2552074 - RNA, 18 nt, Human
caguuggaaauccaucca

SEQ ID NO: 2552075 - RNA, 16 nt, Human
caguuggccagagagc

SEQ ID NO: 2552076 - RNA, 16 nt, Human
caguuggguggaugcc

SEQ ID NO: 2552077 - RNA, 18 nt, Human
caguugggagcacuggag

SEQ ID NO: 2552078 - RNA, 17 nt, Human
caguugggagcacugga

SEQ ID NO: 2552079 - RNA, 16 nt, Human
caguugggagcacugg

SEQ ID NO: 2552080 - RNA, 15 nt, Human
caguugggagcacug

SEQ ID NO: 2552081 - RNA, 17 nt, Human
caguuggccagagagcc

SEQ ID NO: 2552082 - RNA, 16 nt, Human
caguuggccuucagaa

SEQ ID NO: 2552083 - RNA, 14 nt, Human
caguugggagcacu

SEQ ID NO: 2552084 - RNA, 23 nt, Human
caguugccagucaccccggccac

SEQ ID NO: 2552085 - RNA, 22 nt, Human
caguuggucccccuuccaugga

SEQ ID NO: 2552086 - RNA, 21 nt, Human
caguuggucccccuuccaugg

SEQ ID NO: 2552087 - RNA, 20 nt, Human
caguuggucccccuuccaug

SEQ ID NO: 2552088 - RNA, 19 nt, Human
caguuggucccccuuccau

SEQ ID NO: 2552089 - RNA, 21 nt, Human
caguugggagcacuggagugc

SEQ ID NO: 2552090 - RNA, 20 nt, Human
caguugggagcacuggagug

SEQ ID NO: 2552091 - RNA, 18 nt, Human
caguuggucccccuucca

SEQ ID NO: 2552092 - RNA, 19 nt, Human
caguuggguggaugccugg

SEQ ID NO: 2552093 - RNA, 18 nt, Human
caguuggguggaugccug

SEQ ID NO: 2552094 - RNA, 19 nt, Human
caguuuucugagaaagacu

SEQ ID NO: 2552095 - RNA, 20 nt, Human
caguuuucugagaaagacua

SEQ ID NO: 2552096 - RNA, 18 nt, Human
caguuuugguugcuuuaa

SEQ ID NO: 2552097 - RNA, 19 nt, Human
caguuuugguugcuuuaau

SEQ ID NO: 2552098 - RNA, 20 nt, Human
caguuuucuggcuggagccu

SEQ ID NO: 2552099 - RNA, 17 nt, Human
caguuuugguugcuuua

SEQ ID NO: 2552100 - RNA, 22 nt, Human
caguuuuccuucucaucuguga

SEQ ID NO: 2552101 - RNA, 16 nt, Human
caguuuuuuaugcuaa

SEQ ID NO: 2552102 - RNA, 10 nt, Human
caguuuuucu

SEQ ID NO: 2552103 - RNA, 17 nt, Human
caguuuuucuguauuuu

SEQ ID NO: 2552104 - RNA, 16 nt, Human
caguuuuucuguauuu

SEQ ID NO: 2552105 - RNA, 18 nt, Human
caguuuuucuguauuuua

SEQ ID NO: 2552106 - RNA, 22 nt, Human
caguuuuucagaguggaaugcu

SEQ ID NO: 2552107 - RNA, 15 nt, Human
caguuuuuauugcuu

SEQ ID NO: 2552108 - RNA, 14 nt, Human
caguuuucugagaa

SEQ ID NO: 2552109 - RNA, 15 nt, Human
caguuuucugagaaa

SEQ ID NO: 2552110 - RNA, 17 nt, Human
caguuguuagugugucu

SEQ ID NO: 2552111 - RNA, 21 nt, Human
caguuguagaauguauuguac

SEQ ID NO: 2552112 - RNA, 17 nt, Human
caguugggugagaacaa

SEQ ID NO: 2552113 - RNA, 19 nt, Human
caguuguagaauguauugu

SEQ ID NO: 2552114 - RNA, 18 nt, Human
caguuguagaauguauug

SEQ ID NO: 2552115 - RNA, 17 nt, Human
caguuguagaauguauu

SEQ ID NO: 2552116 - RNA, 15 nt, Human
caguuguagaaugua

SEQ ID NO: 2552117 - RNA, 14 nt, Human
caguuguagaaugu

SEQ ID NO: 2552118 - RNA, 14 nt, Human
cagugucaaugcag

SEQ ID NO: 2552119 - RNA, 20 nt, Human
cagugucaaguugugcuugu

SEQ ID NO: 2552120 - RNA, 19 nt, Human
cagugucaaguugugcuug

SEQ ID NO: 2552121 - RNA, 18 nt, Human
cagugucaaguugugcuu

SEQ ID NO: 2552122 - RNA, 21 nt, Human
cagugucaaauaaacacugug

SEQ ID NO: 2552123 - RNA, 20 nt, Human
cagugucauuuaugaaaaga

SEQ ID NO: 2552124 - RNA, 20 nt, Human
cagugucaaauaaacacugu

SEQ ID NO: 2552125 - RNA, 19 nt, Human
cagugucaaauaaacacug

SEQ ID NO: 2552126 - RNA, 18 nt, Human
cagugucaaauaaacacu

SEQ ID NO: 2552127 - RNA, 17 nt, Human
cagugucaaauaaacac

SEQ ID NO: 2552128 - RNA, 16 nt, Human
cagugucaaauaaaca

SEQ ID NO: 2552129 - RNA, 23 nt, Human
caguguauuuguauuuuuuugca

SEQ ID NO: 2552130 - RNA, 15 nt, Human
caguguauuuguauu

SEQ ID NO: 2552131 - RNA, 22 nt, Human
caguguacccccgcccaggcug

SEQ ID NO: 2552132 - RNA, 17 nt, Human
caguguauggaaauaaa

SEQ ID NO: 2552133 - RNA, 19 nt, Human
caguguagccuugcccgga

SEQ ID NO: 2552134 - RNA, 15 nt, Human
cagugucucacagcc

SEQ ID NO: 2552135 - RNA, 18 nt, Human
cagugucucacacuggcg

SEQ ID NO: 2552136 - RNA, 16 nt, Human
cagugucucacacugg

SEQ ID NO: 2552137 - RNA, 12 nt, Human
cagugucucaca

SEQ ID NO: 2552138 - RNA, 20 nt, Human
caguguccuuagaacauuuu

SEQ ID NO: 2552139 - RNA, 19 nt, Human
caguguccucuugcucaaa

SEQ ID NO: 2552140 - RNA, 16 nt, Human
caguguccuuagaaca

SEQ ID NO: 2552141 - RNA, 17 nt, Human
caguguccaaagcaggg

SEQ ID NO: 2552142 - RNA, 16 nt, Human
caguguccaaagcagg

SEQ ID NO: 2552143 - RNA, 22 nt, Human
caguguccaaagcagggucugg

SEQ ID NO: 2552144 - RNA, 15 nt, Human
caguguccccuccac

SEQ ID NO: 2552145 - RNA, 20 nt, Human
caguguccccuccacuguca

SEQ ID NO: 2552146 - RNA, 19 nt, Human
caguguccccuccacuguc

SEQ ID NO: 2552147 - RNA, 17 nt, Human
caguguccccuccacug

SEQ ID NO: 2552148 - RNA, 16 nt, Human
caguguccccuccacu

SEQ ID NO: 2552149 - RNA, 14 nt, Human
cagugucccgggcc

SEQ ID NO: 2552150 - RNA, 21 nt, Human
caguguccccuccacugucac

SEQ ID NO: 2552151 - RNA, 18 nt, Human
caguguccucuugcucaa

SEQ ID NO: 2552152 - RNA, 23 nt, Human
caguguacccccgcccaggcugg

SEQ ID NO: 2552153 - RNA, 21 nt, Human
caguguacccccgcccaggcu

SEQ ID NO: 2552154 - RNA, 20 nt, Human
caguguacccccgcccaggc

SEQ ID NO: 2552155 - RNA, 19 nt, Human
caguguacccccgcccagg

SEQ ID NO: 2552156 - RNA, 18 nt, Human
caguguacccccgcccag

SEQ ID NO: 2552157 - RNA, 17 nt, Human
caguguacccccgccca

SEQ ID NO: 2552158 - RNA, 16 nt, Human
caguguacccccgccc

SEQ ID NO: 2552159 - RNA, 20 nt, Human
caguguaauuucuuugccug

SEQ ID NO: 2552160 - RNA, 17 nt, Human
caguguaauuucuuugc

SEQ ID NO: 2552161 - RNA, 14 nt, Human
caguguacccccgc

SEQ ID NO: 2552162 - RNA, 20 nt, Human
caguguacauggaauaacau

SEQ ID NO: 2552163 - RNA, 23 nt, Human
caguguacauggaauaacaugua

SEQ ID NO: 2552164 - RNA, 16 nt, Human
caguguaauuucuuug

SEQ ID NO: 2552165 - RNA, 15 nt, Human
caguguaauuucuuu

SEQ ID NO: 2552166 - RNA, 14 nt, Human
caguguaauuucuu

SEQ ID NO: 2552167 - RNA, 12 nt, Human
caguguaauuuc

SEQ ID NO: 2552168 - RNA, 20 nt, Human
cagugguuuuauacugaagg

SEQ ID NO: 2552169 - RNA, 17 nt, Human
caguguaaauaguuacu

SEQ ID NO: 2552170 - RNA, 19 nt, Human
caguguaaauaguuacucc

SEQ ID NO: 2552171 - RNA, 15 nt, Human
caguguacagucuug

SEQ ID NO: 2552172 - RNA, 12 nt, Human
caguguacaguc

SEQ ID NO: 2552173 - RNA, 16 nt, Human
caguguacauggaaua

SEQ ID NO: 2552174 - RNA, 18 nt, Human
caguguacagucuuguau

SEQ ID NO: 2552175 - RNA, 17 nt, Human
caguguacagucuugua

SEQ ID NO: 2552176 - RNA, 12 nt, Human
cagugugacuga

SEQ ID NO: 2552177 - RNA, 14 nt, Human
cagugugacaagga

SEQ ID NO: 2552178 - RNA, 20 nt, Human
cagugugaaguuagaauucc

SEQ ID NO: 2552179 - RNA, 17 nt, Human
cagugugaaguuagaau

SEQ ID NO: 2552180 - RNA, 15 nt, Human
cagugugaaguuaga

SEQ ID NO: 2552181 - RNA, 14 nt, Human
cagugugaaguuag

SEQ ID NO: 2552182 - RNA, 13 nt, Human
cagugugaaguua

SEQ ID NO: 2552183 - RNA, 17 nt, Human
cagugucuuccuguggg

SEQ ID NO: 2552184 - RNA, 16 nt, Human
cagugucuuccugugg

SEQ ID NO: 2552185 - RNA, 15 nt, Human
cagugucuuccugug

SEQ ID NO: 2552186 - RNA, 13 nt, Human
cagugucuuccug

SEQ ID NO: 2552187 - RNA, 17 nt, Human
cagugucuggcugcaga

SEQ ID NO: 2552188 - RNA, 19 nt, Human
cagugucuggcugcagagc

SEQ ID NO: 2552189 - RNA, 13 nt, Human
cagugucugggcu

SEQ ID NO: 2552190 - RNA, 20 nt, Human
cagugucucacagcccugcu

SEQ ID NO: 2552191 - RNA, 14 nt, Human
cagugucucggagg

SEQ ID NO: 2552192 - RNA, 15 nt, Human
cagugucugggcuga

SEQ ID NO: 2552193 - RNA, 14 nt, Human
cagugucugggcug

SEQ ID NO: 2552194 - RNA, 18 nt, Human
cagugucugggcugacug

SEQ ID NO: 2552195 - RNA, 22 nt, Human
cagugucuguaucggagacagu

SEQ ID NO: 2552196 - RNA, 16 nt, Human
cagugucugucccggg

SEQ ID NO: 2552197 - RNA, 13 nt, Human
cagugucuuccau

SEQ ID NO: 2552198 - RNA, 14 nt, Human
cagugucugucccg

SEQ ID NO: 2552199 - RNA, 13 nt, Human
cagugucuguccc

SEQ ID NO: 2552200 - RNA, 23 nt, Human
cagugucuguaucggagacagug

SEQ ID NO: 2552201 - RNA, 24 nt, Human
cagugucuguaucggagacaguga

SEQ ID NO: 2552202 - RNA, 14 nt, Human
cagugucuuccaua

SEQ ID NO: 2552203 - RNA, 15 nt, Human
cagugucuuccauaa

SEQ ID NO: 2552204 - RNA, 16 nt, Human
cagugucuuccauaau

SEQ ID NO: 2552205 - RNA, 17 nt, Human
cagugucuuccauaaug

SEQ ID NO: 2552206 - RNA, 18 nt, Human
cagugucuuccauaaugu

SEQ ID NO: 2552207 - RNA, 20 nt, Human
cagugucuuccauaauguau

SEQ ID NO: 2552208 - RNA, 22 nt, Human
cagugucuuccauaauguauaa

SEQ ID NO: 2552209 - RNA, 23 nt, Human
cagugucuuccauaauguauaaa

SEQ ID NO: 2552210 - RNA, 11 nt, Human
caguguggaac

SEQ ID NO: 2552211 - RNA, 23 nt, Human
cagugugccccccauccuggccc

SEQ ID NO: 2552212 - RNA, 22 nt, Human
cagugugccccccauccuggcc

SEQ ID NO: 2552213 - RNA, 20 nt, Human
cagugugccccccauccugg

SEQ ID NO: 2552214 - RNA, 14 nt, Human
cagugugucuaaau

SEQ ID NO: 2552215 - RNA, 21 nt, Human
cagugugggaaugcggcaaga

SEQ ID NO: 2552216 - RNA, 23 nt, Human
cagugugggaaugcggcaagaag

SEQ ID NO: 2552217 - RNA, 23 nt, Human
cagugugucuaaauuugaauguu

SEQ ID NO: 2552218 - RNA, 19 nt, Human
cagugugccccccauccug

SEQ ID NO: 2552219 - RNA, 17 nt, Human
cagugugccccccaucc

SEQ ID NO: 2552220 - RNA, 15 nt, Human
cagugugccccccau

SEQ ID NO: 2552221 - RNA, 14 nt, Human
cagugugcccccca

SEQ ID NO: 2552222 - RNA, 15 nt, Human
cagugugcacuaagg

SEQ ID NO: 2552223 - RNA, 19 nt, Human
cagugugcacuaaggggcc

SEQ ID NO: 2552224 - RNA, 13 nt, Human
cagugugcccccc

SEQ ID NO: 2552225 - RNA, 23 nt, Human
cagugugcacuaaggggcccggc

SEQ ID NO: 2552226 - RNA, 22 nt, Human
cagugugaucccaagugccagu

SEQ ID NO: 2552227 - RNA, 19 nt, Human
cagugugaggccagggcag

SEQ ID NO: 2552228 - RNA, 18 nt, Human
cagugugaucccaagugc

SEQ ID NO: 2552229 - RNA, 19 nt, Human
cagugugaucccaagugcc

SEQ ID NO: 2552230 - RNA, 17 nt, Human
cagugugaggccagggc

SEQ ID NO: 2552231 - RNA, 18 nt, Human
cagugugaggccagggca

SEQ ID NO: 2552232 - RNA, 16 nt, Human
cagugugaggccaggg

SEQ ID NO: 2552233 - RNA, 21 nt, Human
cagugugaaguuagaauuccu

SEQ ID NO: 2552234 - RNA, 16 nt, Human
caguggcagcugcuuu

SEQ ID NO: 2552235 - RNA, 15 nt, Human
caguggcagcugcuu

SEQ ID NO: 2552236 - RNA, 14 nt, Human
caguggcagcugcu

SEQ ID NO: 2552237 - RNA, 13 nt, Human
caguggcagcugc

SEQ ID NO: 2552238 - RNA, 14 nt, Human
caguggagaauuau

SEQ ID NO: 2552239 - RNA, 21 nt, Human
caguggacuuuccacccccuc

SEQ ID NO: 2552240 - RNA, 22 nt, Human
caguggacuuuccacccccucc

SEQ ID NO: 2552241 - RNA, 13 nt, Human
caguggagaauua

SEQ ID NO: 2552242 - RNA, 23 nt, Human
caguggacuuuccacccccuccc

SEQ ID NO: 2552243 - RNA, 13 nt, Human
caguggaagaagc

SEQ ID NO: 2552244 - RNA, 17 nt, Human
caguggacuuuccaccc

SEQ ID NO: 2552245 - RNA, 18 nt, Human
caguggacuuuccacccc

SEQ ID NO: 2552246 - RNA, 19 nt, Human
caguggacuuuccaccccc

SEQ ID NO: 2552247 - RNA, 20 nt, Human
caguggacuuuccacccccu

SEQ ID NO: 2552248 - RNA, 20 nt, Human
caguggaggaagagggacag

SEQ ID NO: 2552249 - RNA, 15 nt, Human
caguggaggaagagg

SEQ ID NO: 2552250 - RNA, 12 nt, Human
caguggcagcug

SEQ ID NO: 2552251 - RNA, 23 nt, Human
caguggaauauaaggaaagcaau

SEQ ID NO: 2552252 - RNA, 13 nt, Human
caguggacaccag

SEQ ID NO: 2552253 - RNA, 22 nt, Human
caguggacaccaggagucccug

SEQ ID NO: 2552254 - RNA, 11 nt, Human
cagugggaacu

SEQ ID NO: 2552255 - RNA, 11 nt, Human
cagugguuaag

SEQ ID NO: 2552256 - RNA, 22 nt, Human
cagugggaacgugacugcccca

SEQ ID NO: 2552257 - RNA, 14 nt, Human
cagugguuauuuag

SEQ ID NO: 2552258 - RNA, 22 nt, Human
cagugguuccuaauccucuagg

SEQ ID NO: 2552259 - RNA, 21 nt, Human
cagugguuuuauacugaagga

SEQ ID NO: 2552260 - RNA, 15 nt, Human
cagugguuuuauacu

SEQ ID NO: 2552261 - RNA, 22 nt, Human
cagugguuugagacacugguuu

SEQ ID NO: 2552262 - RNA, 18 nt, Human
cagugguuugagacacug

SEQ ID NO: 2552263 - RNA, 14 nt, Human
cagugguugcuguu

SEQ ID NO: 2552264 - RNA, 13 nt, Human
cagugguugcugu

SEQ ID NO: 2552265 - RNA, 18 nt, Human
caguggcugcugcccagg

SEQ ID NO: 2552266 - RNA, 17 nt, Human
caguggcugcugcccag

SEQ ID NO: 2552267 - RNA, 15 nt, Human
caguggcugcugccc

SEQ ID NO: 2552268 - RNA, 14 nt, Human
caguggcugcugcc

SEQ ID NO: 2552269 - RNA, 16 nt, Human
caguggcuggaucugu

SEQ ID NO: 2552270 - RNA, 18 nt, Human
caguggcuggaucuguga

SEQ ID NO: 2552271 - RNA, 20 nt, Human
caguggcuggaucugugagg

SEQ ID NO: 2552272 - RNA, 21 nt, Human
caguggcuucaucugucaagu

SEQ ID NO: 2552273 - RNA, 12 nt, Human
cagugggaaaua

SEQ ID NO: 2552274 - RNA, 14 nt, Human
cagugggaaauauu

SEQ ID NO: 2552275 - RNA, 19 nt, Human
cagugggaacgugacugcc

SEQ ID NO: 2552276 - RNA, 20 nt, Human
cagugggaacgugacugccc

SEQ ID NO: 2552277 - RNA, 21 nt, Human
cagugggaacgugacugcccc

SEQ ID NO: 2552278 - RNA, 19 nt, Human
caguggcugguccagggcu

SEQ ID NO: 2552279 - RNA, 18 nt, Human
caguggcugguccagggc

SEQ ID NO: 2552280 - RNA, 20 nt, Human
caguggcugguccagggcua

SEQ ID NO: 2552281 - RNA, 19 nt, Human
caguggcuucaucugucaa

SEQ ID NO: 2552282 - RNA, 16 nt, Human
caguggccucaacccu

SEQ ID NO: 2552283 - RNA, 19 nt, Human
caguggccucaacccuccc

SEQ ID NO: 2552284 - RNA, 20 nt, Human
caguggccucaacccucccu

SEQ ID NO: 2552285 - RNA, 21 nt, Human
caguggccucaacccucccuc

SEQ ID NO: 2552286 - RNA, 22 nt, Human
caguggccucaacccucccuca

SEQ ID NO: 2552287 - RNA, 13 nt, Human
caguggcugcugc

SEQ ID NO: 2552288 - RNA, 20 nt, Human
caguggcucacgccuaugau

SEQ ID NO: 2552289 - RNA, 23 nt, Human
caguggccucaacccucccucag

SEQ ID NO: 2552290 - RNA, 17 nt, Human
caguggcagggcucagg

SEQ ID NO: 2552291 - RNA, 15 nt, Human
caguggcagggcuca

SEQ ID NO: 2552292 - RNA, 14 nt, Human
caguggcagggcuc

SEQ ID NO: 2552293 - RNA, 15 nt, Human
caguggcauggcucc

SEQ ID NO: 2552294 - RNA, 14 nt, Human
caguggccacucag

SEQ ID NO: 2552295 - RNA, 13 nt, Human
caguggccacuca

SEQ ID NO: 2552296 - RNA, 18 nt, Human
caguggcagggcucagga

SEQ ID NO: 2552297 - RNA, 16 nt, Human
caguggcauggcucca

SEQ ID NO: 2552298 - RNA, 17 nt, Human
caguggcauggcuccag

SEQ ID NO: 2552299 - RNA, 19 nt, Human
caguggcauggcuccaguc

SEQ ID NO: 2552300 - RNA, 16 nt, Human
caguggauugcauuuc

SEQ ID NO: 2552301 - RNA, 19 nt, Human
caguggcacucaacaugag

SEQ ID NO: 2552302 - RNA, 14 nt, Human
caguggauuaauua

SEQ ID NO: 2552303 - RNA, 16 nt, Human
caguucuuugggccag

SEQ ID NO: 2552304 - RNA, 17 nt, Human
caguucuuugggccaga

SEQ ID NO: 2552305 - RNA, 18 nt, Human
caguucuuugggccagac

SEQ ID NO: 2552306 - RNA, 19 nt, Human
caguucuuugggccagaca

SEQ ID NO: 2552307 - RNA, 12 nt, Human
caguugaaaaac

SEQ ID NO: 2552308 - RNA, 18 nt, Human
caguugaaaaacagcuga

SEQ ID NO: 2552309 - RNA, 19 nt, Human
caguugaaaaacagcugag

SEQ ID NO: 2552310 - RNA, 20 nt, Human
caguucugcuccucuccagg

SEQ ID NO: 2552311 - RNA, 19 nt, Human
caguucugcuccucuccag

SEQ ID NO: 2552312 - RNA, 18 nt, Human
caguucugcuccucucca

SEQ ID NO: 2552313 - RNA, 17 nt, Human
caguucugcuccucucc

SEQ ID NO: 2552314 - RNA, 22 nt, Human
caguucugcuccucuccaggca

SEQ ID NO: 2552315 - RNA, 21 nt, Human
caguucugcuccucuccaggc

SEQ ID NO: 2552316 - RNA, 17 nt, Human
caguucugggugcuccc

SEQ ID NO: 2552317 - RNA, 16 nt, Human
caguucugcuccucuc

SEQ ID NO: 2552318 - RNA, 15 nt, Human
caguucugcuccucu

SEQ ID NO: 2552319 - RNA, 14 nt, Human
caguucugcuccuc

SEQ ID NO: 2552320 - RNA, 13 nt, Human
caguucugcuccu

SEQ ID NO: 2552321 - RNA, 13 nt, Human
caguucugcagcu

SEQ ID NO: 2552322 - RNA, 17 nt, Human
caguucuucgggaagag

SEQ ID NO: 2552323 - RNA, 20 nt, Human
caguucugggugcucccuac

SEQ ID NO: 2552324 - RNA, 23 nt, Human
caguucuucgggaagagaggagu

SEQ ID NO: 2552325 - RNA, 22 nt, Human
caguucuucgggaagagaggag

SEQ ID NO: 2552326 - RNA, 20 nt, Human
caguucuucgggaagagagg

SEQ ID NO: 2552327 - RNA, 19 nt, Human
caguucuucgggaagagag

SEQ ID NO: 2552328 - RNA, 16 nt, Human
caguucuugugugguu

SEQ ID NO: 2552329 - RNA, 24 nt, Human
caguucuucgggaagagaggaguu

SEQ ID NO: 2552330 - RNA, 15 nt, Human
caguucuuguguggu

SEQ ID NO: 2552331 - RNA, 16 nt, Human
caguucugaagaagau

SEQ ID NO: 2552332 - RNA, 15 nt, Human
caguucugaagaaga

SEQ ID NO: 2552333 - RNA, 22 nt, Human
caguucugaagaagaugguacc

SEQ ID NO: 2552334 - RNA, 21 nt, Human
caguucugaauaugcugcuca

SEQ ID NO: 2552335 - RNA, 14 nt, Human
caguucugaagaau

SEQ ID NO: 2552336 - RNA, 16 nt, Human
caguucucuucacuca

SEQ ID NO: 2552337 - RNA, 14 nt, Human
caguucugaagaag

SEQ ID NO: 2552338 - RNA, 13 nt, Human
caguucugaagaa

SEQ ID NO: 2552339 - RNA, 12 nt, Human
caguucugaaga

SEQ ID NO: 2552340 - RNA, 22 nt, Human
caguucucuccuucuucccccc

SEQ ID NO: 2552341 - RNA, 15 nt, Human
caguucucuccuucu

SEQ ID NO: 2552342 - RNA, 14 nt, Human
caguucucuccuuc

SEQ ID NO: 2552343 - RNA, 19 nt, Human
caguucuaguuugcauucc

SEQ ID NO: 2552344 - RNA, 18 nt, Human
caguucuaguuugcauuc

SEQ ID NO: 2552345 - RNA, 17 nt, Human
caguucuaguuugcauu

SEQ ID NO: 2552346 - RNA, 17 nt, Human
caguucuagucucucug

SEQ ID NO: 2552347 - RNA, 23 nt, Human
caguucccagaaucaaagcaaug

SEQ ID NO: 2552348 - RNA, 13 nt, Human
caguucucuccuu

SEQ ID NO: 2552349 - RNA, 22 nt, Human
caguucggugagcuacaaaugc

SEQ ID NO: 2552350 - RNA, 15 nt, Human
caguuccuuucaaug

SEQ ID NO: 2552351 - RNA, 21 nt, Human
caguuaccucugccucagaaa

SEQ ID NO: 2552352 - RNA, 17 nt, Human
caguuacagaaaguggu

SEQ ID NO: 2552353 - RNA, 22 nt, Human
caguuacaugcauacuucaaaa

SEQ ID NO: 2552354 - RNA, 19 nt, Human
caguuacuaagaagaaaau

SEQ ID NO: 2552355 - RNA, 14 nt, Human
caguuacucagaau

SEQ ID NO: 2552356 - RNA, 19 nt, Human
caguucccccaaccucaga

SEQ ID NO: 2552357 - RNA, 18 nt, Human
caguucccccaaccucag

SEQ ID NO: 2552358 - RNA, 17 nt, Human
caguucccccaaccuca

SEQ ID NO: 2552359 - RNA, 22 nt, Human
caguuacuaagaagaaaauugc

SEQ ID NO: 2552360 - RNA, 13 nt, Human
caguucccuuggc

SEQ ID NO: 2552361 - RNA, 23 nt, Human
caguuccucuuugcauggaauuu

SEQ ID NO: 2552362 - RNA, 18 nt, Human
caguuccucuuugcaugg

SEQ ID NO: 2552363 - RNA, 17 nt, Human
caguuccucuuugcaug

SEQ ID NO: 2552364 - RNA, 22 nt, Human
caguuccggauuggcuugugug

SEQ ID NO: 2552365 - RNA, 20 nt, Human
caguuccggauuggcuugug

SEQ ID NO: 2552366 - RNA, 13 nt, Human
caguuccucgccc

SEQ ID NO: 2552367 - RNA, 14 nt, Human
caguuccucgcccu

SEQ ID NO: 2552368 - RNA, 17 nt, Human
caguuccucgcccuggg

SEQ ID NO: 2552369 - RNA, 15 nt, Human
caguuccucuuugca

SEQ ID NO: 2552370 - RNA, 18 nt, Human
caguuccucgcccugggu

SEQ ID NO: 2552371 - RNA, 14 nt, Human
caguucccuuggcc

SEQ ID NO: 2552372 - RNA, 15 nt, Human
caguucccuuggccu

SEQ ID NO: 2552373 - RNA, 16 nt, Human
caguucccuuggccuc

SEQ ID NO: 2552374 - RNA, 17 nt, Human
caguucccuuggccuca

SEQ ID NO: 2552375 - RNA, 18 nt, Human
caguucccuuggccucag

SEQ ID NO: 2552376 - RNA, 19 nt, Human
caguucccuuggccucaga

SEQ ID NO: 2552377 - RNA, 18 nt, Human
caguuccgauuucccagg

SEQ ID NO: 2552378 - RNA, 17 nt, Human
caguuccgauuucccag

SEQ ID NO: 2552379 - RNA, 20 nt, Human
caguucccuuggccucagaa

SEQ ID NO: 2552380 - RNA, 14 nt, Human
caguuaagagaaau

SEQ ID NO: 2552381 - RNA, 13 nt, Human
caguuaagagaaa

SEQ ID NO: 2552382 - RNA, 15 nt, Human
caguuaagccuuugg

SEQ ID NO: 2552383 - RNA, 17 nt, Human
caguuaagccuuuggaa

SEQ ID NO: 2552384 - RNA, 14 nt, Human
caguuaagccuuug

SEQ ID NO: 2552385 - RNA, 15 nt, Human
caguuacagaaagug

SEQ ID NO: 2552386 - RNA, 14 nt, Human
caguuacagaaagu

SEQ ID NO: 2552387 - RNA, 13 nt, Human
caguuacagaaag

SEQ ID NO: 2552388 - RNA, 20 nt, Human
caguuaagccuuuggaaaca

SEQ ID NO: 2552389 - RNA, 13 nt, Human
caguuaauuacau

SEQ ID NO: 2552390 - RNA, 21 nt, Human
caguguuccccaucugggucc

SEQ ID NO: 2552391 - RNA, 19 nt, Human
caguguuccccaucugggu

SEQ ID NO: 2552392 - RNA, 16 nt, Human
caguguucuguuuaau

SEQ ID NO: 2552393 - RNA, 13 nt, Human
caguguucuguuu

SEQ ID NO: 2552394 - RNA, 18 nt, Human
caguguugagccuuuucc

SEQ ID NO: 2552395 - RNA, 19 nt, Human
caguguuguggauuuaaca

SEQ ID NO: 2552396 - RNA, 20 nt, Human
caguguuguggauuuaacag

SEQ ID NO: 2552397 - RNA, 22 nt, Human
caguguuguggauuuaacagaa

SEQ ID NO: 2552398 - RNA, 23 nt, Human
caguguuaggccuggcacagugu

SEQ ID NO: 2552399 - RNA, 22 nt, Human
caguguuaggccuggcacagug

SEQ ID NO: 2552400 - RNA, 21 nt, Human
caguguuaggccuggcacagu

SEQ ID NO: 2552401 - RNA, 20 nt, Human
caguguuaggccuggcacag

SEQ ID NO: 2552402 - RNA, 19 nt, Human
caguguuaggccuggcaca

SEQ ID NO: 2552403 - RNA, 18 nt, Human
caguguuaggccuggcac

SEQ ID NO: 2552404 - RNA, 17 nt, Human
caguguuaggccuggca

SEQ ID NO: 2552405 - RNA, 18 nt, Human
caguguuccgugguuaaa

SEQ ID NO: 2552406 - RNA, 19 nt, Human
caguguuagggaagggccu

SEQ ID NO: 2552407 - RNA, 14 nt, Human
caguguuccccauc

SEQ ID NO: 2552408 - RNA, 14 nt, Human
caguguuauuuucu

SEQ ID NO: 2552409 - RNA, 16 nt, Human
caguguuaggccuggc

SEQ ID NO: 2552410 - RNA, 14 nt, Human
caguguuaaaugug

SEQ ID NO: 2552411 - RNA, 19 nt, Human
caguguuaaaugugaugaa

SEQ ID NO: 2552412 - RNA, 17 nt, Human
caguguguuugugauug

SEQ ID NO: 2552413 - RNA, 15 nt, Human
caguguuaaaugaaa

SEQ ID NO: 2552414 - RNA, 18 nt, Human
caguguuaaaugaaauug

SEQ ID NO: 2552415 - RNA, 17 nt, Human
caguguuaaaugaaauu

SEQ ID NO: 2552416 - RNA, 16 nt, Human
caguguuaaaugaaau

SEQ ID NO: 2552417 - RNA, 19 nt, Human
caguguuuuuguaaagugu

SEQ ID NO: 2552418 - RNA, 15 nt, Human
caguguuuuuguaaa

SEQ ID NO: 2552419 - RNA, 14 nt, Human
caguguuuuuguaa

SEQ ID NO: 2552420 - RNA, 22 nt, Human
caguguuuucugggauaaguaa

SEQ ID NO: 2552421 - RNA, 15 nt, Human
caguguuuucuggga

SEQ ID NO: 2552422 - RNA, 21 nt, Human
caguguuuuuguaaagugugg

SEQ ID NO: 2552423 - RNA, 20 nt, Human
caguguuuuuguaaagugug

SEQ ID NO: 2552424 - RNA, 15 nt, Human
caguuaaaaaaaauu

SEQ ID NO: 2552425 - RNA, 16 nt, Human
caguuaaaaaaaauuu

SEQ ID NO: 2552426 - RNA, 19 nt, Human
caguuaaaaaaaauuuuaa

SEQ ID NO: 2552427 - RNA, 19 nt, Human
caguuaacuuuaagacuga

SEQ ID NO: 2552428 - RNA, 16 nt, Human
caguuaacuuucagaa

SEQ ID NO: 2552429 - RNA, 20 nt, Human
caguuaacuuucagaagaga

SEQ ID NO: 2552430 - RNA, 22 nt, Human
caguuaacuuucagaagagaug

SEQ ID NO: 2552431 - RNA, 18 nt, Human
caguguuucccauaauuu

SEQ ID NO: 2552432 - RNA, 20 nt, Human
caguguuucccauaauuuuc

SEQ ID NO: 2552433 - RNA, 14 nt, Human
caguguuuccuuuu

SEQ ID NO: 2552434 - RNA, 21 nt, Human
caguguuucccauaauuuucu

SEQ ID NO: 2552435 - RNA, 14 nt, Human
caguguuucccaua

SEQ ID NO: 2552436 - RNA, 15 nt, Human
caguguuucccauaa

SEQ ID NO: 2552437 - RNA, 17 nt, Human
caguguuucccauaauu

SEQ ID NO: 2552438 - RNA, 22 nt, Human
caguguucuguuuaauacucau

SEQ ID NO: 2552439 - RNA, 14 nt, Human
caucccuccccagu

SEQ ID NO: 2552440 - RNA, 19 nt, Human
caucccucuggggcuguuc

SEQ ID NO: 2552441 - RNA, 13 nt, Human
caucccugaaggc

SEQ ID NO: 2552442 - RNA, 11 nt, Human
caucccugaag

SEQ ID NO: 2552443 - RNA, 13 nt, Human
caucccuccccag

SEQ ID NO: 2552444 - RNA, 15 nt, Human
cauccagguucagcu

SEQ ID NO: 2552445 - RNA, 19 nt, Human
cauccagggcucugaccag

SEQ ID NO: 2552446 - RNA, 22 nt, Human
caucccuacccccuaagagcca

SEQ ID NO: 2552447 - RNA, 14 nt, Human
caucccuacccccu

SEQ ID NO: 2552448 - RNA, 23 nt, Human
cauccaaggagaaacagagacag

SEQ ID NO: 2552449 - RNA, 13 nt, Human
cauccaauccuca

SEQ ID NO: 2552450 - RNA, 14 nt, Human
cauccaauccucac

SEQ ID NO: 2552451 - RNA, 15 nt, Human
cauccaauccucacu

SEQ ID NO: 2552452 - RNA, 16 nt, Human
cauccaauccucacug

SEQ ID NO: 2552453 - RNA, 17 nt, Human
cauccaauccucacugg

SEQ ID NO: 2552454 - RNA, 20 nt, Human
cauccaaucuaaccacauca

SEQ ID NO: 2552455 - RNA, 14 nt, Human
cauccaaugcucaa

SEQ ID NO: 2552456 - RNA, 18 nt, Human
cauccaauccucacuggg

SEQ ID NO: 2552457 - RNA, 19 nt, Human
cauccaauccucacugggu

SEQ ID NO: 2552458 - RNA, 19 nt, Human
cauccaaucuaaccacauc

SEQ ID NO: 2552459 - RNA, 21 nt, Human
cauccaauccucacugggugg

SEQ ID NO: 2552460 - RNA, 21 nt, Human
cauccacauuguuuuaaaaag

SEQ ID NO: 2552461 - RNA, 12 nt, Human
cauccaccccau

SEQ ID NO: 2552462 - RNA, 14 nt, Human
cauccaccccaucc

SEQ ID NO: 2552463 - RNA, 18 nt, Human
cauccacauuguuuuaaa

SEQ ID NO: 2552464 - RNA, 17 nt, Human
cauccacauuguuuuaa

SEQ ID NO: 2552465 - RNA, 17 nt, Human
cauccacaugggagccg

SEQ ID NO: 2552466 - RNA, 18 nt, Human
cauccacacacgcaggaa

SEQ ID NO: 2552467 - RNA, 23 nt, Human
cauccaaugcucaagaaacaacu

SEQ ID NO: 2552468 - RNA, 21 nt, Human
cauccagggcccccaucucau

SEQ ID NO: 2552469 - RNA, 12 nt, Human
cauccaggcagu

SEQ ID NO: 2552470 - RNA, 11 nt, Human
cauccagggcc

SEQ ID NO: 2552471 - RNA, 20 nt, Human
cauccacuagugcaaaucau

SEQ ID NO: 2552472 - RNA, 14 nt, Human
cauccacuagugca

SEQ ID NO: 2552473 - RNA, 16 nt, Human
cauccaccuccuucuc

SEQ ID NO: 2552474 - RNA, 15 nt, Human
cauccaccuccuucu

SEQ ID NO: 2552475 - RNA, 14 nt, Human
cauccaccuccuuc

SEQ ID NO: 2552476 - RNA, 13 nt, Human
cauccaccuccuu

SEQ ID NO: 2552477 - RNA, 12 nt, Human
cauccaccuccu

SEQ ID NO: 2552478 - RNA, 22 nt, Human
cauccacuagugcaaaucauag

SEQ ID NO: 2552479 - RNA, 21 nt, Human
cauccacuagugcaaaucaua

SEQ ID NO: 2552480 - RNA, 14 nt, Human
cauccacucuaccc

SEQ ID NO: 2552481 - RNA, 15 nt, Human
cauccacucuacccu

SEQ ID NO: 2552482 - RNA, 21 nt, Human
caucauugaaaucuuuuugcu

SEQ ID NO: 2552483 - RNA, 20 nt, Human
caucauugaaaucuuuuugc

SEQ ID NO: 2552484 - RNA, 15 nt, Human
caucauugaaaucuu

SEQ ID NO: 2552485 - RNA, 14 nt, Human
caucauugaaaucu

SEQ ID NO: 2552486 - RNA, 13 nt, Human
caucacauuuuug

SEQ ID NO: 2552487 - RNA, 17 nt, Human
caucauucucugucuca

SEQ ID NO: 2552488 - RNA, 21 nt, Human
caucauucucugucucaucca

SEQ ID NO: 2552489 - RNA, 22 nt, Human
caucauucucugucucauccau

SEQ ID NO: 2552490 - RNA, 13 nt, Human
caucauugaaauc

SEQ ID NO: 2552491 - RNA, 15 nt, Human
caucaccaacgucug

SEQ ID NO: 2552492 - RNA, 21 nt, Human
caucacaguuuugguugcuuu

SEQ ID NO: 2552493 - RNA, 22 nt, Human
caucacaguuuugguugcuuua

SEQ ID NO: 2552494 - RNA, 13 nt, Human
caucacaguuuug

SEQ ID NO: 2552495 - RNA, 22 nt, Human
caucacaggguugggcccagau

SEQ ID NO: 2552496 - RNA, 18 nt, Human
caucauuuuuccuucccu

SEQ ID NO: 2552497 - RNA, 22 nt, Human
caucauuuugcauucaaauuaa

SEQ ID NO: 2552498 - RNA, 17 nt, Human
caucauuuuuguaucua

SEQ ID NO: 2552499 - RNA, 20 nt, Human
caucauuuugcauucaaauu

SEQ ID NO: 2552500 - RNA, 18 nt, Human
caucauuuugcauucaaa

SEQ ID NO: 2552501 - RNA, 16 nt, Human
caucauuuugcauuca

SEQ ID NO: 2552502 - RNA, 23 nt, Human
cauccaaaauaguuaagacauga

SEQ ID NO: 2552503 - RNA, 15 nt, Human
cauccaaagcagaca

SEQ ID NO: 2552504 - RNA, 16 nt, Human
cauccaaagcagacag

SEQ ID NO: 2552505 - RNA, 19 nt, Human
caucauuguauauaugugu

SEQ ID NO: 2552506 - RNA, 14 nt, Human
caucauugcacucu

SEQ ID NO: 2552507 - RNA, 24 nt, Human
caucauucucugucucauccauca

SEQ ID NO: 2552508 - RNA, 14 nt, Human
caucauuguauaua

SEQ ID NO: 2552509 - RNA, 13 nt, Human
caucauuguauau

SEQ ID NO: 2552510 - RNA, 15 nt, Human
caucauuguauauau

SEQ ID NO: 2552511 - RNA, 18 nt, Human
cauccaaauaagaaaccu

SEQ ID NO: 2552512 - RNA, 16 nt, Human
cauccaaccuucccaa

SEQ ID NO: 2552513 - RNA, 21 nt, Human
cauccaaggccagguucuccg

SEQ ID NO: 2552514 - RNA, 21 nt, Human
cauccaaggagaaacagagac

SEQ ID NO: 2552515 - RNA, 22 nt, Human
cauccaaggagaaacagagaca

SEQ ID NO: 2552516 - RNA, 15 nt, Human
cauccaacuccagga

SEQ ID NO: 2552517 - RNA, 17 nt, Human
cauccaagagugcgccg

SEQ ID NO: 2552518 - RNA, 14 nt, Human
cauccaaggagaaa

SEQ ID NO: 2552519 - RNA, 14 nt, Human
cauccaaccuuccc

SEQ ID NO: 2552520 - RNA, 21 nt, Human
cauccaaccccccaccugcca

SEQ ID NO: 2552521 - RNA, 16 nt, Human
cauccaaccccccacc

SEQ ID NO: 2552522 - RNA, 19 nt, Human
cauccaaccccccaccugc

SEQ ID NO: 2552523 - RNA, 17 nt, Human
cauccaaagcagacagc

SEQ ID NO: 2552524 - RNA, 18 nt, Human
cauccaaagcagacagcu

SEQ ID NO: 2552525 - RNA, 21 nt, Human
cauccaaagcagacagcucca

SEQ ID NO: 2552526 - RNA, 15 nt, Human
cauccaaccccccac

SEQ ID NO: 2552527 - RNA, 21 nt, Human
caucccugaaggccccgccca

SEQ ID NO: 2552528 - RNA, 19 nt, Human
caucccugaaggccccgcc

SEQ ID NO: 2552529 - RNA, 18 nt, Human
caucccugaaggccccgc

SEQ ID NO: 2552530 - RNA, 17 nt, Human
caucccugaaggccccg

SEQ ID NO: 2552531 - RNA, 21 nt, Human
cauccuaacuccaugucucug

SEQ ID NO: 2552532 - RNA, 14 nt, Human
cauccuaacuccau

SEQ ID NO: 2552533 - RNA, 17 nt, Human
cauccguaguucccuga

SEQ ID NO: 2552534 - RNA, 18 nt, Human
cauccguaguucccugaa

SEQ ID NO: 2552535 - RNA, 21 nt, Human
cauccguaguucccugaaaac

SEQ ID NO: 2552536 - RNA, 16 nt, Human
cauccguaguucccug

SEQ ID NO: 2552537 - RNA, 14 nt, Human
caucuugguaaauu

SEQ ID NO: 2552538 - RNA, 13 nt, Human
caucuugguaaau

SEQ ID NO: 2552539 - RNA, 12 nt, Human
caucuugguaaa

SEQ ID NO: 2552540 - RNA, 11 nt, Human
caucuuggggg

SEQ ID NO: 2552541 - RNA, 20 nt, Human
caucuuggggacaucucuuu

SEQ ID NO: 2552542 - RNA, 18 nt, Human
caucuuggggacaucucu

SEQ ID NO: 2552543 - RNA, 16 nt, Human
caucuuggggacaucu

SEQ ID NO: 2552544 - RNA, 15 nt, Human
caucuuggggacauc

SEQ ID NO: 2552545 - RNA, 16 nt, Human
caucuuggagggacca

SEQ ID NO: 2552546 - RNA, 15 nt, Human
caucuugcuucccua

SEQ ID NO: 2552547 - RNA, 20 nt, Human
caucuugcucugcugacaga

SEQ ID NO: 2552548 - RNA, 14 nt, Human
caucuugcuucccu

SEQ ID NO: 2552549 - RNA, 13 nt, Human
caucuugcuuccc

SEQ ID NO: 2552550 - RNA, 14 nt, Human
caucuugcucugcu

SEQ ID NO: 2552551 - RNA, 13 nt, Human
caucuugcucugc

SEQ ID NO: 2552552 - RNA, 13 nt, Human
caucuucugccuu

SEQ ID NO: 2552553 - RNA, 15 nt, Human
caucuugaccaagca

SEQ ID NO: 2552554 - RNA, 16 nt, Human
caucuugaccaagcag

SEQ ID NO: 2552555 - RNA, 17 nt, Human
caucuugaccaagcagg

SEQ ID NO: 2552556 - RNA, 18 nt, Human
caucuugaccaagcagga

SEQ ID NO: 2552557 - RNA, 20 nt, Human
caucuugaccaagcaggaag

SEQ ID NO: 2552558 - RNA, 21 nt, Human
caucuugaccaagcaggaagc

SEQ ID NO: 2552559 - RNA, 22 nt, Human
caucuugaccaagcaggaagcu

SEQ ID NO: 2552560 - RNA, 20 nt, Human
caucuugaucugcucagccc

SEQ ID NO: 2552561 - RNA, 19 nt, Human
caucuugaucugcucagcc

SEQ ID NO: 2552562 - RNA, 23 nt, Human
caucuugaccaagcaggaagcuc

SEQ ID NO: 2552563 - RNA, 24 nt, Human
caucuugaccaagcaggaagcuca

SEQ ID NO: 2552564 - RNA, 22 nt, Human
caucuugaucugcucagcccug

SEQ ID NO: 2552565 - RNA, 21 nt, Human
caucuugaucugcucagcccu

SEQ ID NO: 2552566 - RNA, 23 nt, Human
caucuugaucugcucagcccugg

SEQ ID NO: 2552567 - RNA, 21 nt, Human
caucuucuaaacccaauccaa

SEQ ID NO: 2552568 - RNA, 12 nt, Human
caucuucucagc

SEQ ID NO: 2552569 - RNA, 22 nt, Human
caucuucccuagaggguuccug

SEQ ID NO: 2552570 - RNA, 18 nt, Human
caucuucucagcucccau

SEQ ID NO: 2552571 - RNA, 17 nt, Human
caucuucucagcuccca

SEQ ID NO: 2552572 - RNA, 14 nt, Human
caucuucucagcuc

SEQ ID NO: 2552573 - RNA, 13 nt, Human
caucuucucagcu

SEQ ID NO: 2552574 - RNA, 21 nt, Human
caucuucucagcucccauuuc

SEQ ID NO: 2552575 - RNA, 14 nt, Human
caucuucuccaucu

SEQ ID NO: 2552576 - RNA, 16 nt, Human
caucuucuccaucugg

SEQ ID NO: 2552577 - RNA, 17 nt, Human
caucuucuccaucuggc

SEQ ID NO: 2552578 - RNA, 10 nt, Human
caucuuccca

SEQ ID NO: 2552579 - RNA, 21 nt, Human
caucuuccagguggggugagg

SEQ ID NO: 2552580 - RNA, 16 nt, Human
caucuuccaggugggg

SEQ ID NO: 2552581 - RNA, 14 nt, Human
caucuuccaggugg

SEQ ID NO: 2552582 - RNA, 21 nt, Human
caucuuccagaagugugauug

SEQ ID NO: 2552583 - RNA, 20 nt, Human
caucuuccagaagugugauu

SEQ ID NO: 2552584 - RNA, 19 nt, Human
caucuuccagaagugugau

SEQ ID NO: 2552585 - RNA, 18 nt, Human
caucuuccagaaguguga

SEQ ID NO: 2552586 - RNA, 14 nt, Human
caucuucccagcag

SEQ ID NO: 2552587 - RNA, 12 nt, Human
caucuucccagc

SEQ ID NO: 2552588 - RNA, 21 nt, Human
caucuucccagcagggccacu

SEQ ID NO: 2552589 - RNA, 13 nt, Human
caucucuguccca

SEQ ID NO: 2552590 - RNA, 22 nt, Human
caucucccagauaaugugaaaa

SEQ ID NO: 2552591 - RNA, 18 nt, Human
caucucuuagcuccccuc

SEQ ID NO: 2552592 - RNA, 17 nt, Human
caucucuuagcuccccu

SEQ ID NO: 2552593 - RNA, 23 nt, Human
caucucuuacgcccaacccuucc

SEQ ID NO: 2552594 - RNA, 16 nt, Human
caucucuuagcucccc

SEQ ID NO: 2552595 - RNA, 21 nt, Human
caucucuuccuccgaggccag

SEQ ID NO: 2552596 - RNA, 23 nt, Human
caucucuuccuacccaaccacuc

SEQ ID NO: 2552597 - RNA, 23 nt, Human
caucucuuagcuccccuccaacc

SEQ ID NO: 2552598 - RNA, 21 nt, Human
caucucuuagcuccccuccaa

SEQ ID NO: 2552599 - RNA, 19 nt, Human
caucucuuagcuccccucc

SEQ ID NO: 2552600 - RNA, 22 nt, Human
caucucuucuggguuccuuccu

SEQ ID NO: 2552601 - RNA, 15 nt, Human
caucucuugaggcca

SEQ ID NO: 2552602 - RNA, 20 nt, Human
caucucuugaggccaggagu

SEQ ID NO: 2552603 - RNA, 20 nt, Human
caucuccaagaaugcugaaa

SEQ ID NO: 2552604 - RNA, 19 nt, Human
caucuccaagaaugcugaa

SEQ ID NO: 2552605 - RNA, 16 nt, Human
caucuccacccccagc

SEQ ID NO: 2552606 - RNA, 18 nt, Human
caucuccaagaaugcuga

SEQ ID NO: 2552607 - RNA, 17 nt, Human
caucuccaagaaugcug

SEQ ID NO: 2552608 - RNA, 16 nt, Human
caucuccaagaaugcu

SEQ ID NO: 2552609 - RNA, 14 nt, Human
caucuccagggagu

SEQ ID NO: 2552610 - RNA, 20 nt, Human
caucuccaccugcucccagg

SEQ ID NO: 2552611 - RNA, 16 nt, Human
caucuccaccugcucc

SEQ ID NO: 2552612 - RNA, 23 nt, Human
caucuccaagaaugcugaaacca

SEQ ID NO: 2552613 - RNA, 14 nt, Human
caucuccacuccag

SEQ ID NO: 2552614 - RNA, 17 nt, Human
caucucccagauaaugu

SEQ ID NO: 2552615 - RNA, 18 nt, Human
caucucccagauaaugug

SEQ ID NO: 2552616 - RNA, 17 nt, Human
caucuccaucuugaagg

SEQ ID NO: 2552617 - RNA, 21 nt, Human
caucucccaccuagcagcacc

SEQ ID NO: 2552618 - RNA, 21 nt, Human
caucuccagggaguccccucc

SEQ ID NO: 2552619 - RNA, 20 nt, Human
caucuccagggaguccccuc

SEQ ID NO: 2552620 - RNA, 19 nt, Human
caucuccagggaguccccu

SEQ ID NO: 2552621 - RNA, 17 nt, Human
caucuccagggaguccc

SEQ ID NO: 2552622 - RNA, 22 nt, Human
caucuccagggaguccccuccc

SEQ ID NO: 2552623 - RNA, 14 nt, Human
caucuccaucagcu

SEQ ID NO: 2552624 - RNA, 15 nt, Human
caucuccaucagcug

SEQ ID NO: 2552625 - RNA, 16 nt, Human
caucuccaucagcugu

SEQ ID NO: 2552626 - RNA, 14 nt, Human
caucugagaaaagc

SEQ ID NO: 2552627 - RNA, 23 nt, Human
caucugagaaaagcuuugaaccc

SEQ ID NO: 2552628 - RNA, 18 nt, Human
caucugagcaagagcugg

SEQ ID NO: 2552629 - RNA, 15 nt, Human
caucugagcaagagc

SEQ ID NO: 2552630 - RNA, 21 nt, Human
caucugcaccccuucucuccu

SEQ ID NO: 2552631 - RNA, 19 nt, Human
caucugcaccccuucucuc

SEQ ID NO: 2552632 - RNA, 17 nt, Human
caucugcaccccuucuc

SEQ ID NO: 2552633 - RNA, 16 nt, Human
caucugcaccccuucu

SEQ ID NO: 2552634 - RNA, 18 nt, Human
caucugcaccccccuggg

SEQ ID NO: 2552635 - RNA, 19 nt, Human
caucugcaccccccugggc

SEQ ID NO: 2552636 - RNA, 22 nt, Human
caucuuccaaggguacuaagga

SEQ ID NO: 2552637 - RNA, 13 nt, Human
caucuuccagaag

SEQ ID NO: 2552638 - RNA, 12 nt, Human
caucuuccagaa

SEQ ID NO: 2552639 - RNA, 20 nt, Human
caucuuauuuucauguauau

SEQ ID NO: 2552640 - RNA, 14 nt, Human
caucuucaaagcuu

SEQ ID NO: 2552641 - RNA, 14 nt, Human
caucuucagcuucu

SEQ ID NO: 2552642 - RNA, 13 nt, Human
caucuucagcuuc

SEQ ID NO: 2552643 - RNA, 14 nt, Human
caucuucacuucua

SEQ ID NO: 2552644 - RNA, 21 nt, Human
caucuucacuucuaaaugcau

SEQ ID NO: 2552645 - RNA, 23 nt, Human
caucugcaccccuucucuccucc

SEQ ID NO: 2552646 - RNA, 22 nt, Human
caucugcaccccuucucuccuc

SEQ ID NO: 2552647 - RNA, 20 nt, Human
caucuuaguauuugcauauu

SEQ ID NO: 2552648 - RNA, 19 nt, Human
caucuuaguauuugcauau

SEQ ID NO: 2552649 - RNA, 14 nt, Human
caucuuagugccug

SEQ ID NO: 2552650 - RNA, 22 nt, Human
cauccucauacccacccccacc

SEQ ID NO: 2552651 - RNA, 21 nt, Human
cauccucauacccacccccac

SEQ ID NO: 2552652 - RNA, 18 nt, Human
cauccucauacccacccc

SEQ ID NO: 2552653 - RNA, 17 nt, Human
cauccucauacccaccc

SEQ ID NO: 2552654 - RNA, 22 nt, Human
cauccucaaacacugcaggcau

SEQ ID NO: 2552655 - RNA, 18 nt, Human
cauccuccacguucugcu

SEQ ID NO: 2552656 - RNA, 20 nt, Human
cauccuccacguucugcuca

SEQ ID NO: 2552657 - RNA, 14 nt, Human
cauccuccaagaau

SEQ ID NO: 2552658 - RNA, 21 nt, Human
cauccuccacguucugcucau

SEQ ID NO: 2552659 - RNA, 16 nt, Human
cauccuccagcaggga

SEQ ID NO: 2552660 - RNA, 13 nt, Human
cauccuccagcag

SEQ ID NO: 2552661 - RNA, 14 nt, Human
cauccuccagcagg

SEQ ID NO: 2552662 - RNA, 17 nt, Human
cauccuccagcuucugg

SEQ ID NO: 2552663 - RNA, 15 nt, Human
cauccuccagcuucu

SEQ ID NO: 2552664 - RNA, 14 nt, Human
cauccuccagcuuc

SEQ ID NO: 2552665 - RNA, 13 nt, Human
cauccuccagcuu

SEQ ID NO: 2552666 - RNA, 12 nt, Human
cauccuccagcu

SEQ ID NO: 2552667 - RNA, 13 nt, Human
cauccucccaagg

SEQ ID NO: 2552668 - RNA, 19 nt, Human
cauccuccucagaucuucu

SEQ ID NO: 2552669 - RNA, 18 nt, Human
cauccuccucagaucuuc

SEQ ID NO: 2552670 - RNA, 16 nt, Human
cauccuccucagaucu

SEQ ID NO: 2552671 - RNA, 15 nt, Human
cauccuccucagauc

SEQ ID NO: 2552672 - RNA, 12 nt, Human
cauccuccucag

SEQ ID NO: 2552673 - RNA, 11 nt, Human
cauccuccuca

SEQ ID NO: 2552674 - RNA, 12 nt, Human
cauccuccccuu

SEQ ID NO: 2552675 - RNA, 13 nt, Human
cauccuccccuuc

SEQ ID NO: 2552676 - RNA, 14 nt, Human
cauccuccccuucc

SEQ ID NO: 2552677 - RNA, 15 nt, Human
cauccuccccuuccc

SEQ ID NO: 2552678 - RNA, 16 nt, Human
cauccuccccuucccu

SEQ ID NO: 2552679 - RNA, 19 nt, Human
cauccuccccuucccugca

SEQ ID NO: 2552680 - RNA, 20 nt, Human
cauccuccgccucccggguu

SEQ ID NO: 2552681 - RNA, 20 nt, Human
cauccuccccuucccugcaa

SEQ ID NO: 2552682 - RNA, 21 nt, Human
cauccuccccuucccugcaaa

SEQ ID NO: 2552683 - RNA, 16 nt, Human
cauccuccguccagcc

SEQ ID NO: 2552684 - RNA, 19 nt, Human
cauccucaaacacugcagg

SEQ ID NO: 2552685 - RNA, 18 nt, Human
cauccucaaacacugcag

SEQ ID NO: 2552686 - RNA, 17 nt, Human
cauccucaaacacugca

SEQ ID NO: 2552687 - RNA, 16 nt, Human
cauccucaaacacugc

SEQ ID NO: 2552688 - RNA, 15 nt, Human
cauccuaugcaauau

SEQ ID NO: 2552689 - RNA, 24 nt, Human
cauccuaucagccugucucuucca

SEQ ID NO: 2552690 - RNA, 16 nt, Human
cauccuaucagccugu

SEQ ID NO: 2552691 - RNA, 20 nt, Human
cauccuagucucuaucauua

SEQ ID NO: 2552692 - RNA, 13 nt, Human
cauccuagucucu

SEQ ID NO: 2552693 - RNA, 21 nt, Human
cauccuacccucgggcccacc

SEQ ID NO: 2552694 - RNA, 16 nt, Human
cauccucauacccacc

SEQ ID NO: 2552695 - RNA, 15 nt, Human
cauccucauacccac

SEQ ID NO: 2552696 - RNA, 16 nt, Human
cauccuacaagacaca

SEQ ID NO: 2552697 - RNA, 23 nt, Human
cauccuacccucgggcccaccug

SEQ ID NO: 2552698 - RNA, 19 nt, Human
cauccuacccucgggccca

SEQ ID NO: 2552699 - RNA, 15 nt, Human
cauccuacccucggg

SEQ ID NO: 2552700 - RNA, 13 nt, Human
cauccuacccucg

SEQ ID NO: 2552701 - RNA, 20 nt, Human
cauccuaaucauccaaugcu

SEQ ID NO: 2552702 - RNA, 20 nt, Human
caucuagaggcuuccuucau

SEQ ID NO: 2552703 - RNA, 21 nt, Human
caucuagaggcuuccuucauu

SEQ ID NO: 2552704 - RNA, 22 nt, Human
caucuagaggcuuccuucauuu

SEQ ID NO: 2552705 - RNA, 23 nt, Human
caucuagaggcuuccuucauuuc

SEQ ID NO: 2552706 - RNA, 12 nt, Human
caucuaggauuu

SEQ ID NO: 2552707 - RNA, 19 nt, Human
caucuagaggcuuccuuca

SEQ ID NO: 2552708 - RNA, 19 nt, Human
caucuacucccaaguaugg

SEQ ID NO: 2552709 - RNA, 16 nt, Human
caucuagagcuugaug

SEQ ID NO: 2552710 - RNA, 14 nt, Human
caucuacucccaag

SEQ ID NO: 2552711 - RNA, 15 nt, Human
caucuacccuccgau

SEQ ID NO: 2552712 - RNA, 14 nt, Human
caucuagugagcag

SEQ ID NO: 2552713 - RNA, 18 nt, Human
caucuagguaaauuacag

SEQ ID NO: 2552714 - RNA, 17 nt, Human
caucuagguaaauuaca

SEQ ID NO: 2552715 - RNA, 19 nt, Human
caucuagagcuugaugcca

SEQ ID NO: 2552716 - RNA, 14 nt, Human
caucuagcaaaugu

SEQ ID NO: 2552717 - RNA, 18 nt, Human
caucuagcaaauguuaug

SEQ ID NO: 2552718 - RNA, 19 nt, Human
cauccucuguacagagccc

SEQ ID NO: 2552719 - RNA, 21 nt, Human
cauccucuguacagagcccac

SEQ ID NO: 2552720 - RNA, 12 nt, Human
caucuaagccug

SEQ ID NO: 2552721 - RNA, 16 nt, Human
caucuaagccugaagg

SEQ ID NO: 2552722 - RNA, 23 nt, Human
caucuaauagcggguuacuuuca

SEQ ID NO: 2552723 - RNA, 14 nt, Human
caucuaauaaaaaa

SEQ ID NO: 2552724 - RNA, 18 nt, Human
cauccucuguacagagcc

SEQ ID NO: 2552725 - RNA, 15 nt, Human
cauccucuguacaga

SEQ ID NO: 2552726 - RNA, 20 nt, Human
cauccuccucccacccggcu

SEQ ID NO: 2552727 - RNA, 16 nt, Human
cauccuccucccaccc

SEQ ID NO: 2552728 - RNA, 13 nt, Human
cauccuccuccca

SEQ ID NO: 2552729 - RNA, 19 nt, Human
cauccuccguccagccgcc

SEQ ID NO: 2552730 - RNA, 20 nt, Human
cauccuccguccagccgcca

SEQ ID NO: 2552731 - RNA, 17 nt, Human
caucucacacaugagca

SEQ ID NO: 2552732 - RNA, 16 nt, Human
caucucacacaugagc

SEQ ID NO: 2552733 - RNA, 14 nt, Human
caucuauuuuggau

SEQ ID NO: 2552734 - RNA, 16 nt, Human
caucuauuuuggauug

SEQ ID NO: 2552735 - RNA, 16 nt, Human
caucuauuucugagaa

SEQ ID NO: 2552736 - RNA, 15 nt, Human
caucuauuucugaga

SEQ ID NO: 2552737 - RNA, 14 nt, Human
caucucaaccaucc

SEQ ID NO: 2552738 - RNA, 16 nt, Human
caucucaaccaucccc

SEQ ID NO: 2552739 - RNA, 22 nt, Human
caucuagugagcagucaggaaa

SEQ ID NO: 2552740 - RNA, 13 nt, Human
caucuaguuuuaa

SEQ ID NO: 2552741 - RNA, 14 nt, Human
caucuauaaagaag

SEQ ID NO: 2552742 - RNA, 20 nt, Human
caucuaucucaucuaucuca

SEQ ID NO: 2552743 - RNA, 15 nt, Human
caucuaucucaaucc

SEQ ID NO: 2552744 - RNA, 14 nt, Human
caucuauaaauugu

SEQ ID NO: 2552745 - RNA, 13 nt, Human
caucuauucucuc

SEQ ID NO: 2552746 - RNA, 20 nt, Human
caucuauucucuccaaaaau

SEQ ID NO: 2552747 - RNA, 13 nt, Human
caucuauuucuga

SEQ ID NO: 2552748 - RNA, 14 nt, Human
caucuauuucugag

SEQ ID NO: 2552749 - RNA, 16 nt, Human
caucuaucucaauccu

SEQ ID NO: 2552750 - RNA, 19 nt, Human
caucuaugucccuugcugu

SEQ ID NO: 2552751 - RNA, 20 nt, Human
caucucacacaugagcauca

SEQ ID NO: 2552752 - RNA, 22 nt, Human
caucucaaggaauaaugggcuu

SEQ ID NO: 2552753 - RNA, 13 nt, Human
caucucagcccac

SEQ ID NO: 2552754 - RNA, 20 nt, Human
caucucagccuaccaugaga

SEQ ID NO: 2552755 - RNA, 18 nt, Human
caucucagacccuuuagc

SEQ ID NO: 2552756 - RNA, 19 nt, Human
caucucacuggaugcaaag

SEQ ID NO: 2552757 - RNA, 14 nt, Human
caucucaggccacc

SEQ ID NO: 2552758 - RNA, 15 nt, Human
caucucaggccaccu

SEQ ID NO: 2552759 - RNA, 20 nt, Human
caucucauguaucaucugga

SEQ ID NO: 2552760 - RNA, 22 nt, Human
caucucaugccccuggcuggga

SEQ ID NO: 2552761 - RNA, 18 nt, Human
caucucagugcuguaaaa

SEQ ID NO: 2552762 - RNA, 14 nt, Human
caucuccaagaaug

SEQ ID NO: 2552763 - RNA, 22 nt, Human
caucucauucaaaccccacccu

SEQ ID NO: 2552764 - RNA, 23 nt, Human
caucucauguaucaucuggauag

SEQ ID NO: 2552765 - RNA, 17 nt, Human
caucucauuccaacuuc

SEQ ID NO: 2552766 - RNA, 18 nt, Human
caucucaggccucccuca

SEQ ID NO: 2552767 - RNA, 17 nt, Human
caucucaggccaccugc

SEQ ID NO: 2552768 - RNA, 20 nt, Human
caucucaggccaccugcccc

SEQ ID NO: 2552769 - RNA, 21 nt, Human
caucucaggccaccugccccc

SEQ ID NO: 2552770 - RNA, 22 nt, Human
caucucaggccaccugcccccu

SEQ ID NO: 2552771 - RNA, 19 nt, Human
caucucaggggccagagga

SEQ ID NO: 2552772 - RNA, 16 nt, Human
caucucaggggccaga

SEQ ID NO: 2552773 - RNA, 15 nt, Human
caucucaggggccag

SEQ ID NO: 2552774 - RNA, 12 nt, Human
caucucaggggc

SEQ ID NO: 2552775 - RNA, 14 nt, Human
cauacuugaagggc

SEQ ID NO: 2552776 - RNA, 17 nt, Human
cauacuugaagggccag

SEQ ID NO: 2552777 - RNA, 18 nt, Human
cauacuugaagggccaga

SEQ ID NO: 2552778 - RNA, 20 nt, Human
cauacuugaagggccagagc

SEQ ID NO: 2552779 - RNA, 21 nt, Human
cauacuugaagggccagagcc

SEQ ID NO: 2552780 - RNA, 22 nt, Human
cauacuugaagggccagagcca

SEQ ID NO: 2552781 - RNA, 14 nt, Human
cauacuuucauccu

SEQ ID NO: 2552782 - RNA, 23 nt, Human
cauacuugaagggccagagccag

SEQ ID NO: 2552783 - RNA, 18 nt, Human
cauacuucaaaaguauuu

SEQ ID NO: 2552784 - RNA, 17 nt, Human
cauacuucaaaaguauu

SEQ ID NO: 2552785 - RNA, 16 nt, Human
cauacuucaaaaguau

SEQ ID NO: 2552786 - RNA, 15 nt, Human
cauacuucaaaagua

SEQ ID NO: 2552787 - RNA, 14 nt, Human
cauacuucaaaagu

SEQ ID NO: 2552788 - RNA, 22 nt, Human
cauacuuaucucucugugcugu

SEQ ID NO: 2552789 - RNA, 20 nt, Human
cauacuuaucucucugugcu

SEQ ID NO: 2552790 - RNA, 18 nt, Human
cauacuuaucucucugug

SEQ ID NO: 2552791 - RNA, 13 nt, Human
cauacuugaaggg

SEQ ID NO: 2552792 - RNA, 22 nt, Human
cauacuucaaaaguauuuuccu

SEQ ID NO: 2552793 - RNA, 19 nt, Human
cauacuucaaaaguauuuu

SEQ ID NO: 2552794 - RNA, 18 nt, Human
cauacuucaugaaauccu

SEQ ID NO: 2552795 - RNA, 18 nt, Human
cauacuuugucugaaaaa

SEQ ID NO: 2552796 - RNA, 16 nt, Human
cauacuuugucugaaa

SEQ ID NO: 2552797 - RNA, 14 nt, Human
cauacuuugucuga

SEQ ID NO: 2552798 - RNA, 13 nt, Human
cauacuuugucug

SEQ ID NO: 2552799 - RNA, 16 nt, Human
cauacuuuuuaaaugu

SEQ ID NO: 2552800 - RNA, 20 nt, Human
cauacuuuuuaaauguaaag

SEQ ID NO: 2552801 - RNA, 12 nt, Human
cauacuuugucu

SEQ ID NO: 2552802 - RNA, 22 nt, Human
cauacuuucauccugacucugc

SEQ ID NO: 2552803 - RNA, 21 nt, Human
cauacuuucauccugacucug

SEQ ID NO: 2552804 - RNA, 17 nt, Human
cauacuuucauccugac

SEQ ID NO: 2552805 - RNA, 14 nt, Human
cauacuuuccugua

SEQ ID NO: 2552806 - RNA, 22 nt, Human
cauacuuuuuaaauguaaagau

SEQ ID NO: 2552807 - RNA, 20 nt, Human
cauagaauaaaauuuuuaau

SEQ ID NO: 2552808 - RNA, 16 nt, Human
cauagaaggcagguga

SEQ ID NO: 2552809 - RNA, 14 nt, Human
cauagaauaaaauu

SEQ ID NO: 2552810 - RNA, 23 nt, Human
cauagaaauguaacuuuuguaag

SEQ ID NO: 2552811 - RNA, 14 nt, Human
cauagaaggcaggu

SEQ ID NO: 2552812 - RNA, 21 nt, Human
cauagagagcaagacgcugug

SEQ ID NO: 2552813 - RNA, 19 nt, Human
cauagagagcaagacgcug

SEQ ID NO: 2552814 - RNA, 23 nt, Human
cauagagagcaagacgcugugcu

SEQ ID NO: 2552815 - RNA, 19 nt, Human
cauagagagggagaagaag

SEQ ID NO: 2552816 - RNA, 18 nt, Human
cauagagagggagaagaa

SEQ ID NO: 2552817 - RNA, 16 nt, Human
cauagacccucucaag

SEQ ID NO: 2552818 - RNA, 15 nt, Human
cauagacccucucaa

SEQ ID NO: 2552819 - RNA, 20 nt, Human
cauacucccaucugugaaag

SEQ ID NO: 2552820 - RNA, 18 nt, Human
cauacucccaucugugaa

SEQ ID NO: 2552821 - RNA, 15 nt, Human
cauacucccaucugu

SEQ ID NO: 2552822 - RNA, 16 nt, Human
cauacucccaucugug

SEQ ID NO: 2552823 - RNA, 11 nt, Human
cauacucugcu

SEQ ID NO: 2552824 - RNA, 22 nt, Human
cauacucuagauuuuguuuugc

SEQ ID NO: 2552825 - RNA, 17 nt, Human
cauacucuagauuuugu

SEQ ID NO: 2552826 - RNA, 15 nt, Human
cauacugagggacca

SEQ ID NO: 2552827 - RNA, 19 nt, Human
cauacugagggaccaacug

SEQ ID NO: 2552828 - RNA, 18 nt, Human
cauacuaucuacucuccu

SEQ ID NO: 2552829 - RNA, 23 nt, Human
cauacuccaucaguuagagcuga

SEQ ID NO: 2552830 - RNA, 20 nt, Human
cauacuccuuccaucaaaua

SEQ ID NO: 2552831 - RNA, 22 nt, Human
cauacuggccucgccuggccug

SEQ ID NO: 2552832 - RNA, 21 nt, Human
cauacuggccucgccuggccu

SEQ ID NO: 2552833 - RNA, 20 nt, Human
cauacuggccucgccuggcc

SEQ ID NO: 2552834 - RNA, 19 nt, Human
cauacuggccucgccuggc

SEQ ID NO: 2552835 - RNA, 18 nt, Human
cauacuggccucgccugg

SEQ ID NO: 2552836 - RNA, 17 nt, Human
cauacuggccucgccug

SEQ ID NO: 2552837 - RNA, 16 nt, Human
cauacuggccucgccu

SEQ ID NO: 2552838 - RNA, 15 nt, Human
cauacuggccucgcc

SEQ ID NO: 2552839 - RNA, 13 nt, Human
cauacuggccucg

SEQ ID NO: 2552840 - RNA, 12 nt, Human
cauacuggccuc

SEQ ID NO: 2552841 - RNA, 23 nt, Human
cauacucuagauuuuguuuugcu

SEQ ID NO: 2552842 - RNA, 20 nt, Human
cauacugagggaccaacugg

SEQ ID NO: 2552843 - RNA, 11 nt, Human
cauacugcugu

SEQ ID NO: 2552844 - RNA, 22 nt, Human
cauacuggccuggacuguuuuc

SEQ ID NO: 2552845 - RNA, 18 nt, Human
cauacuggccuggacugu

SEQ ID NO: 2552846 - RNA, 15 nt, Human
cauacuggccuggac

SEQ ID NO: 2552847 - RNA, 13 nt, Human
cauacuggccugg

SEQ ID NO: 2552848 - RNA, 19 nt, Human
cauacugugcuggagccac

SEQ ID NO: 2552849 - RNA, 18 nt, Human
cauacugugcuggagcca

SEQ ID NO: 2552850 - RNA, 17 nt, Human
cauacugugcuggagcc

SEQ ID NO: 2552851 - RNA, 16 nt, Human
cauacuuaucucucug

SEQ ID NO: 2552852 - RNA, 13 nt, Human
cauacuuaucucu

SEQ ID NO: 2552853 - RNA, 23 nt, Human
cauagaucagcaaaccggggccu

SEQ ID NO: 2552854 - RNA, 18 nt, Human
cauagaguuuaacacaag

SEQ ID NO: 2552855 - RNA, 15 nt, Human
cauagaguuuaacac

SEQ ID NO: 2552856 - RNA, 14 nt, Human
cauagaguuuaaca

SEQ ID NO: 2552857 - RNA, 15 nt, Human
cauagaggcuucucc

SEQ ID NO: 2552858 - RNA, 12 nt, Human
cauagaggcuuc

SEQ ID NO: 2552859 - RNA, 17 nt, Human
cauagagaucauccuuu

SEQ ID NO: 2552860 - RNA, 22 nt, Human
cauagagagggagaagaaguca

SEQ ID NO: 2552861 - RNA, 22 nt, Human
cauagaggcuucuccgccagcc

SEQ ID NO: 2552862 - RNA, 21 nt, Human
cauagaggcuucuccgccagc

SEQ ID NO: 2552863 - RNA, 20 nt, Human
cauagaggcuucuccgccag

SEQ ID NO: 2552864 - RNA, 19 nt, Human
cauagaggcuucuccgcca

SEQ ID NO: 2552865 - RNA, 21 nt, Human
cauagaggugagggaagccug

SEQ ID NO: 2552866 - RNA, 23 nt, Human
cauagaggcuucuccgccagccu

SEQ ID NO: 2552867 - RNA, 17 nt, Human
cauagaggugagggaag

SEQ ID NO: 2552868 - RNA, 22 nt, Human
cauagugaugguuccccuguuc

SEQ ID NO: 2552869 - RNA, 20 nt, Human
cauaguaugguggcuggguu

SEQ ID NO: 2552870 - RNA, 19 nt, Human
cauaguaugguggcugggu

SEQ ID NO: 2552871 - RNA, 18 nt, Human
cauaguaugguggcuggg

SEQ ID NO: 2552872 - RNA, 19 nt, Human
cauauaaacuuuuuaaaga

SEQ ID NO: 2552873 - RNA, 20 nt, Human
cauauaaacaucacacacac

SEQ ID NO: 2552874 - RNA, 21 nt, Human
cauauaaguuugaaggaaaca

SEQ ID NO: 2552875 - RNA, 20 nt, Human
cauauaaguuugaaggaaac

SEQ ID NO: 2552876 - RNA, 15 nt, Human
cauauaaguuugaag

SEQ ID NO: 2552877 - RNA, 17 nt, Human
cauaguuuuuacugaac

SEQ ID NO: 2552878 - RNA, 19 nt, Human
cauauaaacaucacacaca

SEQ ID NO: 2552879 - RNA, 15 nt, Human
cauaguggugcagag

SEQ ID NO: 2552880 - RNA, 23 nt, Human
cauaguggacauuguuggcagca

SEQ ID NO: 2552881 - RNA, 22 nt, Human
cauaguggcuuaaaacaacacu

SEQ ID NO: 2552882 - RNA, 19 nt, Human
cauaguucccauguuaaau

SEQ ID NO: 2552883 - RNA, 18 nt, Human
cauauaauguuguuauuu

SEQ ID NO: 2552884 - RNA, 17 nt, Human
cauauaauguuguuauu

SEQ ID NO: 2552885 - RNA, 23 nt, Human
cauauaaguuugaaggaaacagu

SEQ ID NO: 2552886 - RNA, 22 nt, Human
cauauaaguuugaaggaaacag

SEQ ID NO: 2552887 - RNA, 15 nt, Human
cauauaauguuguua

SEQ ID NO: 2552888 - RNA, 24 nt, Human
cauauaaguuugaaggaaacaguu

SEQ ID NO: 2552889 - RNA, 17 nt, Human
cauauacagcucagaag

SEQ ID NO: 2552890 - RNA, 20 nt, Human
cauauauaacaaugcuguau

SEQ ID NO: 2552891 - RNA, 18 nt, Human
cauauauaacuagcuaga

SEQ ID NO: 2552892 - RNA, 17 nt, Human
cauauauaucuaucuua

SEQ ID NO: 2552893 - RNA, 23 nt, Human
cauaucaaaaaguauuaaaacua

SEQ ID NO: 2552894 - RNA, 19 nt, Human
cauaucaccucauggccua

SEQ ID NO: 2552895 - RNA, 13 nt, Human
cauaucaguugag

SEQ ID NO: 2552896 - RNA, 22 nt, Human
cauauauauguuuuaagaggca

SEQ ID NO: 2552897 - RNA, 17 nt, Human
cauaugauguacaugua

SEQ ID NO: 2552898 - RNA, 15 nt, Human
cauaugauguacaug

SEQ ID NO: 2552899 - RNA, 21 nt, Human
cauaugauguacauguacuga

SEQ ID NO: 2552900 - RNA, 14 nt, Human
cauaugauucugcu

SEQ ID NO: 2552901 - RNA, 23 nt, Human
cauaugaguuucauagcuaagaa

SEQ ID NO: 2552902 - RNA, 15 nt, Human
cauaugauucugcuu

SEQ ID NO: 2552903 - RNA, 23 nt, Human
cauaugauugugcacauacuuga

SEQ ID NO: 2552904 - RNA, 19 nt, Human
cauaugaguguggaagccg

SEQ ID NO: 2552905 - RNA, 17 nt, Human
cauaugaguguggaagc

SEQ ID NO: 2552906 - RNA, 14 nt, Human
cauaugagugugga

SEQ ID NO: 2552907 - RNA, 22 nt, Human
cauaugacucacaugaugcaua

SEQ ID NO: 2552908 - RNA, 15 nt, Human
cauauccugagccau

SEQ ID NO: 2552909 - RNA, 13 nt, Human
cauaugaggaugc

SEQ ID NO: 2552910 - RNA, 20 nt, Human
cauaugacucacaugaugca

SEQ ID NO: 2552911 - RNA, 23 nt, Human
cauauccugagccaucggugaaa

SEQ ID NO: 2552912 - RNA, 18 nt, Human
cauaugaccucaugcauc

SEQ ID NO: 2552913 - RNA, 18 nt, Human
cauauccccucucccccc

SEQ ID NO: 2552914 - RNA, 14 nt, Human
cauauccugagcca

SEQ ID NO: 2552915 - RNA, 16 nt, Human
cauauccaccaccucc

SEQ ID NO: 2552916 - RNA, 18 nt, Human
cauauccaguauuguucc

SEQ ID NO: 2552917 - RNA, 18 nt, Human
cauauccccuauuuaaca

SEQ ID NO: 2552918 - RNA, 16 nt, Human
cauaucagucucugag

SEQ ID NO: 2552919 - RNA, 22 nt, Human
caucaagucuuucacauuuaaa

SEQ ID NO: 2552920 - RNA, 18 nt, Human
caucaaggcacugccuga

SEQ ID NO: 2552921 - RNA, 17 nt, Human
caucaaggcacugccug

SEQ ID NO: 2552922 - RNA, 16 nt, Human
caucaaggcacugccu

SEQ ID NO: 2552923 - RNA, 18 nt, Human
caucaagcacagaaggag

SEQ ID NO: 2552924 - RNA, 21 nt, Human
caucaagcacagaaggaggag

SEQ ID NO: 2552925 - RNA, 23 nt, Human
caucaagcacagaaggaggagga

SEQ ID NO: 2552926 - RNA, 14 nt, Human
caucaagaugugac

SEQ ID NO: 2552927 - RNA, 11 nt, Human
caucaaagagg

SEQ ID NO: 2552928 - RNA, 23 nt, Human
caucaaagaggcugaggcuggca

SEQ ID NO: 2552929 - RNA, 16 nt, Human
caucaagacuggaagg

SEQ ID NO: 2552930 - RNA, 15 nt, Human
caucaagacuggaag

SEQ ID NO: 2552931 - RNA, 22 nt, Human
caucaaaagacaauucuuuaua

SEQ ID NO: 2552932 - RNA, 19 nt, Human
caucaaaagacaauucuuu

SEQ ID NO: 2552933 - RNA, 18 nt, Human
caucaaaagacaauucuu

SEQ ID NO: 2552934 - RNA, 16 nt, Human
caucaaaagacaauuc

SEQ ID NO: 2552935 - RNA, 15 nt, Human
caucaaaagacaauu

SEQ ID NO: 2552936 - RNA, 14 nt, Human
caucaaaagacaau

SEQ ID NO: 2552937 - RNA, 12 nt, Human
caucaaaagaca

SEQ ID NO: 2552938 - RNA, 13 nt, Human
caucaaaaugcuu

SEQ ID NO: 2552939 - RNA, 15 nt, Human
caucaaaaugcuuuu

SEQ ID NO: 2552940 - RNA, 20 nt, Human
caucaaaagacaauucuuua

SEQ ID NO: 2552941 - RNA, 17 nt, Human
caucaaacucuuaguua

SEQ ID NO: 2552942 - RNA, 18 nt, Human
caucaaugaaugaaugaa

SEQ ID NO: 2552943 - RNA, 21 nt, Human
caucaaguuauugacaaacuc

SEQ ID NO: 2552944 - RNA, 22 nt, Human
caucaaguuauugacaaacucu

SEQ ID NO: 2552945 - RNA, 19 nt, Human
caucaauauugucauuccu

SEQ ID NO: 2552946 - RNA, 14 nt, Human
caucaaucauugua

SEQ ID NO: 2552947 - RNA, 23 nt, Human
caucaaguuauugacaaacucuc

SEQ ID NO: 2552948 - RNA, 16 nt, Human
caucaauuauagaaag

SEQ ID NO: 2552949 - RNA, 22 nt, Human
caucaauugaauggucagcguu

SEQ ID NO: 2552950 - RNA, 15 nt, Human
caucaauguucauug

SEQ ID NO: 2552951 - RNA, 16 nt, Human
caucaauguucauugu

SEQ ID NO: 2552952 - RNA, 20 nt, Human
caucaaucauuguacaguuu

SEQ ID NO: 2552953 - RNA, 16 nt, Human
caucaaucauuguaca

SEQ ID NO: 2552954 - RNA, 15 nt, Human
caucaaucauuguac

SEQ ID NO: 2552955 - RNA, 11 nt, Human
caucaauguuc

SEQ ID NO: 2552956 - RNA, 14 nt, Human
caucaauguucauu

SEQ ID NO: 2552957 - RNA, 18 nt, Human
caucaauguucauuguaa

SEQ ID NO: 2552958 - RNA, 11 nt, Human
caucacacaca

SEQ ID NO: 2552959 - RNA, 12 nt, Human
caucacacacac

SEQ ID NO: 2552960 - RNA, 17 nt, Human
caucacagcuaacaauu

SEQ ID NO: 2552961 - RNA, 22 nt, Human
caucacaggacacggggcagug

SEQ ID NO: 2552962 - RNA, 13 nt, Human
caucacagggcag

SEQ ID NO: 2552963 - RNA, 15 nt, Human
caucacagggcagag

SEQ ID NO: 2552964 - RNA, 20 nt, Human
caucacagggcagagccggg

SEQ ID NO: 2552965 - RNA, 19 nt, Human
caucacaggguugggccca

SEQ ID NO: 2552966 - RNA, 20 nt, Human
cauauuuugauuauuguauu

SEQ ID NO: 2552967 - RNA, 18 nt, Human
caucaaaaacuuuggagu

SEQ ID NO: 2552968 - RNA, 17 nt, Human
cauauuuuauagaacuu

SEQ ID NO: 2552969 - RNA, 18 nt, Human
cauauuuucaccauuuga

SEQ ID NO: 2552970 - RNA, 19 nt, Human
cauauuuugauuauuguau

SEQ ID NO: 2552971 - RNA, 17 nt, Human
cauauuuuauucuuuua

SEQ ID NO: 2552972 - RNA, 13 nt, Human
cauauuuuguaua

SEQ ID NO: 2552973 - RNA, 23 nt, Human
cauaugcaccuugugucuguaca

SEQ ID NO: 2552974 - RNA, 21 nt, Human
cauaugcaccuugugucugua

SEQ ID NO: 2552975 - RNA, 20 nt, Human
cauaugcaccuugugucugu

SEQ ID NO: 2552976 - RNA, 19 nt, Human
cauaugcaccuugugucug

SEQ ID NO: 2552977 - RNA, 18 nt, Human
cauaugcaccuugugucu

SEQ ID NO: 2552978 - RNA, 17 nt, Human
cauaugcaccuuguguc

SEQ ID NO: 2552979 - RNA, 16 nt, Human
cauaugcaccuugugu

SEQ ID NO: 2552980 - RNA, 13 nt, Human
cauaugccugggc

SEQ ID NO: 2552981 - RNA, 14 nt, Human
cauauuuacuucuu

SEQ ID NO: 2552982 - RNA, 12 nt, Human
cauauuuauaaa

SEQ ID NO: 2552983 - RNA, 20 nt, Human
cauauuuacuucuuauacau

SEQ ID NO: 2552984 - RNA, 16 nt, Human
cauauuuacuucuuau

SEQ ID NO: 2552985 - RNA, 17 nt, Human
cauauuuacuucuuaua

SEQ ID NO: 2552986 - RNA, 13 nt, Human
cauauuuuagcua

SEQ ID NO: 2552987 - RNA, 16 nt, Human
cauauuuuauagaacu

SEQ ID NO: 2552988 - RNA, 15 nt, Human
cauauuugagacuag

SEQ ID NO: 2552989 - RNA, 17 nt, Human
cauauuuauaaaaauaa

SEQ ID NO: 2552990 - RNA, 22 nt, Human
cauauuuauagcaauccauguu

SEQ ID NO: 2552991 - RNA, 12 nt, Human
cauauuucaauu

SEQ ID NO: 2552992 - RNA, 22 nt, Human
cauugaccugaggcccuucucu

SEQ ID NO: 2552993 - RNA, 13 nt, Human
cauugaccugagg

SEQ ID NO: 2552994 - RNA, 18 nt, Human
cauugacuaucaaacuga

SEQ ID NO: 2552995 - RNA, 19 nt, Human
cauugacuaucaaacugaa

SEQ ID NO: 2552996 - RNA, 22 nt, Human
cauugacuaucaaacugaagcc

SEQ ID NO: 2552997 - RNA, 22 nt, Human
cauugacauguacagagaacua

SEQ ID NO: 2552998 - RNA, 21 nt, Human
cauugacauguacagagaacu

SEQ ID NO: 2552999 - RNA, 19 nt, Human
cauugacauguacagagaa

SEQ ID NO: 2553000 - RNA, 17 nt, Human
cauugacauguacagag

SEQ ID NO: 2553001 - RNA, 16 nt, Human
cauugacauguacaga

SEQ ID NO: 2553002 - RNA, 15 nt, Human
cauugacauguacag

SEQ ID NO: 2553003 - RNA, 14 nt, Human
cauugacauguaca

SEQ ID NO: 2553004 - RNA, 21 nt, Human
cauugaccgcgacuaauuuca

SEQ ID NO: 2553005 - RNA, 22 nt, Human
cauugaccgcgacuaauuucaa

SEQ ID NO: 2553006 - RNA, 16 nt, Human
cauugaacacaaacug

SEQ ID NO: 2553007 - RNA, 17 nt, Human
cauugaacacaaacugu

SEQ ID NO: 2553008 - RNA, 18 nt, Human
cauugaacacaaacugua

SEQ ID NO: 2553009 - RNA, 14 nt, Human
cauugaacacaaac

SEQ ID NO: 2553010 - RNA, 15 nt, Human
cauugaacacaaacu

SEQ ID NO: 2553011 - RNA, 22 nt, Human
cauugaaagagaaccaguuuca

SEQ ID NO: 2553012 - RNA, 18 nt, Human
cauugaaauucugagaaa

SEQ ID NO: 2553013 - RNA, 19 nt, Human
cauugaaagagaaccaguu

SEQ ID NO: 2553014 - RNA, 19 nt, Human
cauugaaaucuuuuugcuu

SEQ ID NO: 2553015 - RNA, 16 nt, Human
cauugaaagagaacca

SEQ ID NO: 2553016 - RNA, 16 nt, Human
cauuuaaaaugauuag

SEQ ID NO: 2553017 - RNA, 15 nt, Human
cauuuaaaaugauua

SEQ ID NO: 2553018 - RNA, 14 nt, Human
cauuuaaaaugauu

SEQ ID NO: 2553019 - RNA, 13 nt, Human
cauuuaaaaugau

SEQ ID NO: 2553020 - RNA, 18 nt, Human
cauuuaaaaugauuagaa

SEQ ID NO: 2553021 - RNA, 17 nt, Human
cauuuaaaaugauuaga

SEQ ID NO: 2553022 - RNA, 21 nt, Human
cauuuaaaagauacaguuacu

SEQ ID NO: 2553023 - RNA, 12 nt, Human
cauuuaaaauga

SEQ ID NO: 2553024 - RNA, 20 nt, Human
cauugcacucuagccugggc

SEQ ID NO: 2553025 - RNA, 18 nt, Human
cauugcacucuagccugg

SEQ ID NO: 2553026 - RNA, 15 nt, Human
cauugcacucuagcc

SEQ ID NO: 2553027 - RNA, 16 nt, Human
cauugcauauaacuua

SEQ ID NO: 2553028 - RNA, 17 nt, Human
cauugcacuccagccug

SEQ ID NO: 2553029 - RNA, 16 nt, Human
cauugcacuccagccu

SEQ ID NO: 2553030 - RNA, 18 nt, Human
cauugcacuccagccugg

SEQ ID NO: 2553031 - RNA, 18 nt, Human
cauugagaguuuugucuu

SEQ ID NO: 2553032 - RNA, 18 nt, Human
cauugagaacugcauaug

SEQ ID NO: 2553033 - RNA, 19 nt, Human
cauugagaacugcauaugu

SEQ ID NO: 2553034 - RNA, 23 nt, Human
cauugagaacugcauauguuucg

SEQ ID NO: 2553035 - RNA, 17 nt, Human
cauugcacagggagacg

SEQ ID NO: 2553036 - RNA, 21 nt, Human
cauuuacuuuguguucaccuu

SEQ ID NO: 2553037 - RNA, 17 nt, Human
cauuuacuuuguguuca

SEQ ID NO: 2553038 - RNA, 19 nt, Human
cauuuaaagcuuauuaaaa

SEQ ID NO: 2553039 - RNA, 17 nt, Human
cauuucccaucugcacc

SEQ ID NO: 2553040 - RNA, 15 nt, Human
cauuucccaucugca

SEQ ID NO: 2553041 - RNA, 14 nt, Human
cauuucccaucugc

SEQ ID NO: 2553042 - RNA, 19 nt, Human
cauuuccacaccaagcagc

SEQ ID NO: 2553043 - RNA, 23 nt, Human
cauuuagagaacuguggccguua

SEQ ID NO: 2553044 - RNA, 21 nt, Human
cauuucucauguuuuccauug

SEQ ID NO: 2553045 - RNA, 15 nt, Human
cauuucucuaagaga

SEQ ID NO: 2553046 - RNA, 13 nt, Human
cauuucucacuga

SEQ ID NO: 2553047 - RNA, 12 nt, Human
cauuucucacug

SEQ ID NO: 2553048 - RNA, 12 nt, Human
cauuucucaugu

SEQ ID NO: 2553049 - RNA, 19 nt, Human
cauuucuauuucuccucca

SEQ ID NO: 2553050 - RNA, 20 nt, Human
cauuucccaucugcaccccu

SEQ ID NO: 2553051 - RNA, 13 nt, Human
cauuuccccagac

SEQ ID NO: 2553052 - RNA, 16 nt, Human
cauuuccccagaccug

SEQ ID NO: 2553053 - RNA, 20 nt, Human
cauuuccccagaccugagcu

SEQ ID NO: 2553054 - RNA, 23 nt, Human
cauuucuauuuauuuacugagcu

SEQ ID NO: 2553055 - RNA, 23 nt, Human
cauuucugcaucagcugcugaaa

SEQ ID NO: 2553056 - RNA, 21 nt, Human
cauuucuuccacaagagccca

SEQ ID NO: 2553057 - RNA, 22 nt, Human
cauuucugaguuucauucuccu

SEQ ID NO: 2553058 - RNA, 14 nt, Human
cauuucugaagugg

SEQ ID NO: 2553059 - RNA, 14 nt, Human
cauuucucuggggu

SEQ ID NO: 2553060 - RNA, 20 nt, Human
cauuucuccuuugauaaaau

SEQ ID NO: 2553061 - RNA, 18 nt, Human
cauuucucuuacugcaaa

SEQ ID NO: 2553062 - RNA, 15 nt, Human
cauuucucuuacugc

SEQ ID NO: 2553063 - RNA, 16 nt, Human
cauuucucugggguau

SEQ ID NO: 2553064 - RNA, 23 nt, Human
cauuucuuccacaagagcccagg

SEQ ID NO: 2553065 - RNA, 23 nt, Human
cauuugaaugcauuuuguuuggu

SEQ ID NO: 2553066 - RNA, 18 nt, Human
cauuugaaugcauuuugu

SEQ ID NO: 2553067 - RNA, 15 nt, Human
cauuugaaugcauuu

SEQ ID NO: 2553068 - RNA, 14 nt, Human
cauuugaaugcauu

SEQ ID NO: 2553069 - RNA, 12 nt, Human
cauuucuuagac

SEQ ID NO: 2553070 - RNA, 13 nt, Human
cauuugaaugcau

SEQ ID NO: 2553071 - RNA, 22 nt, Human
cauuugagaaaugcauauugua

SEQ ID NO: 2553072 - RNA, 18 nt, Human
cauuugagaaaugcauau

SEQ ID NO: 2553073 - RNA, 17 nt, Human
cauuugagaaaugcaua

SEQ ID NO: 2553074 - RNA, 15 nt, Human
cauuugagaaaugca

SEQ ID NO: 2553075 - RNA, 12 nt, Human
cauuugagaaau

SEQ ID NO: 2553076 - RNA, 12 nt, Human
cauuugaaugca

SEQ ID NO: 2553077 - RNA, 23 nt, Human
cauuugacugaagaugcagcuca

SEQ ID NO: 2553078 - RNA, 14 nt, Human
cauuugagcagggc

SEQ ID NO: 2553079 - RNA, 18 nt, Human
cauuugaggucuguucuu

SEQ ID NO: 2553080 - RNA, 19 nt, Human
cauuugaggucuguucuuu

SEQ ID NO: 2553081 - RNA, 17 nt, Human
cauuugaggucuguucu

SEQ ID NO: 2553082 - RNA, 16 nt, Human
cauuugagcagggcuc

SEQ ID NO: 2553083 - RNA, 15 nt, Human
ccaaagagugauagu

SEQ ID NO: 2553084 - RNA, 16 nt, Human
ccaaaauccccuucuc

SEQ ID NO: 2553085 - RNA, 20 nt, Human
ccaaaaucauaagauauuuu

SEQ ID NO: 2553086 - RNA, 18 nt, Human
ccaaaauaagaaaagaug

SEQ ID NO: 2553087 - RNA, 18 nt, Human
ccaaaaguuuuccugaga

SEQ ID NO: 2553088 - RNA, 17 nt, Human
ccaaaaguuuuccugag

SEQ ID NO: 2553089 - RNA, 14 nt, Human
ccaaaauaagaaaa

SEQ ID NO: 2553090 - RNA, 16 nt, Human
ccaaaauaagaaaaga

SEQ ID NO: 2553091 - RNA, 17 nt, Human
ccaaaauaagaaaagau

SEQ ID NO: 2553092 - RNA, 17 nt, Human
ccaaaccucugugagca

SEQ ID NO: 2553093 - RNA, 11 nt, Human
ccaaaccucug

SEQ ID NO: 2553094 - RNA, 12 nt, Human
ccaaaccucugu

SEQ ID NO: 2553095 - RNA, 13 nt, Human
ccaaaccucuguu

SEQ ID NO: 2553096 - RNA, 14 nt, Human
ccaaaccucuguuc

SEQ ID NO: 2553097 - RNA, 17 nt, Human
ccaaaccucuguucagu

SEQ ID NO: 2553098 - RNA, 20 nt, Human
ccaaaccucuguucagugua

SEQ ID NO: 2553099 - RNA, 19 nt, Human
ccaaaccuccaaaacuccu

SEQ ID NO: 2553100 - RNA, 17 nt, Human
ccaaaccgccagcgaac

SEQ ID NO: 2553101 - RNA, 14 nt, Human
ccaaaccuagcccc

SEQ ID NO: 2553102 - RNA, 18 nt, Human
ccaaaauaaaacuuuuua

SEQ ID NO: 2553103 - RNA, 21 nt, Human
ccaaaauaaaacuuuuuaaaa

SEQ ID NO: 2553104 - RNA, 20 nt, Human
cauuuuuaguagagacaggg

SEQ ID NO: 2553105 - RNA, 16 nt, Human
ccaaacuuggauuuuu

SEQ ID NO: 2553106 - RNA, 12 nt, Human
ccaaagagccug

SEQ ID NO: 2553107 - RNA, 20 nt, Human
ccaaagagacuggagcaucu

SEQ ID NO: 2553108 - RNA, 21 nt, Human
ccaaagagacuggagcaucug

SEQ ID NO: 2553109 - RNA, 17 nt, Human
ccaaagagacuggagca

SEQ ID NO: 2553110 - RNA, 17 nt, Human
ccaaagagccuggagaa

SEQ ID NO: 2553111 - RNA, 16 nt, Human
ccaaagagccuggaga

SEQ ID NO: 2553112 - RNA, 15 nt, Human
ccaaagagccuggag

SEQ ID NO: 2553113 - RNA, 14 nt, Human
ccaaagagccugga

SEQ ID NO: 2553114 - RNA, 20 nt, Human
ccaaagagccuggagaagcu

SEQ ID NO: 2553115 - RNA, 18 nt, Human
ccaaagagccuggagaag

SEQ ID NO: 2553116 - RNA, 17 nt, Human
ccaaagaaauguaaggg

SEQ ID NO: 2553117 - RNA, 18 nt, Human
ccaaacuuggauuuuuga

SEQ ID NO: 2553118 - RNA, 19 nt, Human
ccaaacugccuaagcccuc

SEQ ID NO: 2553119 - RNA, 14 nt, Human
ccaaacugccuaag

SEQ ID NO: 2553120 - RNA, 15 nt, Human
ccaaaccugacagau

SEQ ID NO: 2553121 - RNA, 21 nt, Human
ccaaaccucuguucaguguaa

SEQ ID NO: 2553122 - RNA, 22 nt, Human
ccaaaccugcaagggcucccca

SEQ ID NO: 2553123 - RNA, 13 nt, Human
ccaaacgccuccc

SEQ ID NO: 2553124 - RNA, 14 nt, Human
cauuugcucaugga

SEQ ID NO: 2553125 - RNA, 15 nt, Human
cauuugcucauggaa

SEQ ID NO: 2553126 - RNA, 16 nt, Human
cauuugcucauggaau

SEQ ID NO: 2553127 - RNA, 22 nt, Human
cauuugaggucuguucuuucca

SEQ ID NO: 2553128 - RNA, 15 nt, Human
cauuuuaaauggaca

SEQ ID NO: 2553129 - RNA, 14 nt, Human
cauuuuaauucauc

SEQ ID NO: 2553130 - RNA, 23 nt, Human
cauuuuaauuuauuaauugcuuu

SEQ ID NO: 2553131 - RNA, 15 nt, Human
cauuuuauauuagaa

SEQ ID NO: 2553132 - RNA, 12 nt, Human
cauuuuaaaugg

SEQ ID NO: 2553133 - RNA, 18 nt, Human
cauuuuaaauaaaagaaa

SEQ ID NO: 2553134 - RNA, 16 nt, Human
cauuuuaacaucugag

SEQ ID NO: 2553135 - RNA, 17 nt, Human
cauuuuaauuauuauuc

SEQ ID NO: 2553136 - RNA, 16 nt, Human
cauuuuaacuuuauca

SEQ ID NO: 2553137 - RNA, 23 nt, Human
cauuugagaaaugcauauuguau

SEQ ID NO: 2553138 - RNA, 13 nt, Human
cauuuuaaauaaa

SEQ ID NO: 2553139 - RNA, 17 nt, Human
cauuuuaaauggacaga

SEQ ID NO: 2553140 - RNA, 17 nt, Human
cauuuuaaauaaaagaa

SEQ ID NO: 2553141 - RNA, 16 nt, Human
cauuuuaaauaaaaga

SEQ ID NO: 2553142 - RNA, 15 nt, Human
cauuuuaaauaaaag

SEQ ID NO: 2553143 - RNA, 22 nt, Human
cauuuucuucagagagcuaaau

SEQ ID NO: 2553144 - RNA, 23 nt, Human
cauuuugagcugaaaugcugcau

SEQ ID NO: 2553145 - RNA, 22 nt, Human
cauuuugagcugaaaugcugca

SEQ ID NO: 2553146 - RNA, 21 nt, Human
cauuuugagcugaaaugcugc

SEQ ID NO: 2553147 - RNA, 14 nt, Human
cauuuugaccuacu

SEQ ID NO: 2553148 - RNA, 20 nt, Human
cauuuugagugacucgaggg

SEQ ID NO: 2553149 - RNA, 17 nt, Human
cauuuugagugacucga

SEQ ID NO: 2553150 - RNA, 12 nt, Human
cauuuugcaaaa

SEQ ID NO: 2553151 - RNA, 13 nt, Human
cauuuugcaaaau

SEQ ID NO: 2553152 - RNA, 14 nt, Human
cauuuugcaaaauu

SEQ ID NO: 2553153 - RNA, 15 nt, Human
cauuuugcaaaauuu

SEQ ID NO: 2553154 - RNA, 17 nt, Human
cauuuugcaaaauuucc

SEQ ID NO: 2553155 - RNA, 15 nt, Human
cauuuugcagcagug

SEQ ID NO: 2553156 - RNA, 15 nt, Human
cauuuugccaaaauu

SEQ ID NO: 2553157 - RNA, 13 nt, Human
cauuuugccaaaa

SEQ ID NO: 2553158 - RNA, 15 nt, Human
cauuuugcauucaaa

SEQ ID NO: 2553159 - RNA, 13 nt, Human
cauuuugcauuca

SEQ ID NO: 2553160 - RNA, 16 nt, Human
cauuuugcagcaguga

SEQ ID NO: 2553161 - RNA, 18 nt, Human
cauuuugcagcagugagu

SEQ ID NO: 2553162 - RNA, 20 nt, Human
cauuuugcagcagugagucu

SEQ ID NO: 2553163 - RNA, 22 nt, Human
cauuuugcagcagugagucucu

SEQ ID NO: 2553164 - RNA, 13 nt, Human
cauuuuauugcuu

SEQ ID NO: 2553165 - RNA, 19 nt, Human
cauuuuauaugucaaagca

SEQ ID NO: 2553166 - RNA, 16 nt, Human
cauuuuauaugucaaa

SEQ ID NO: 2553167 - RNA, 22 nt, Human
cauuuuaauuuauuaauugcuu

SEQ ID NO: 2553168 - RNA, 19 nt, Human
cauuuuauuuuauuaugca

SEQ ID NO: 2553169 - RNA, 21 nt, Human
cauuuuauuuuauuaugcaug

SEQ ID NO: 2553170 - RNA, 14 nt, Human
cauuuuauugcuug

SEQ ID NO: 2553171 - RNA, 12 nt, Human
cauuuucugugg

SEQ ID NO: 2553172 - RNA, 22 nt, Human
cauuuugggguacccacugcuc

SEQ ID NO: 2553173 - RNA, 21 nt, Human
cauuuugggguacccacugcu

SEQ ID NO: 2553174 - RNA, 20 nt, Human
cauuuugggguacccacugc

SEQ ID NO: 2553175 - RNA, 22 nt, Human
cauuuuggagaguuuccugaaa

SEQ ID NO: 2553176 - RNA, 22 nt, Human
cauuuuggaaguuuucaggacu

SEQ ID NO: 2553177 - RNA, 20 nt, Human
cauuuuggagaguuuccuga

SEQ ID NO: 2553178 - RNA, 18 nt, Human
cauuuuggaaguuuucag

SEQ ID NO: 2553179 - RNA, 20 nt, Human
cauuuuggaaguuuucagga

SEQ ID NO: 2553180 - RNA, 18 nt, Human
cauuuugcuaaaugugaa

SEQ ID NO: 2553181 - RNA, 21 nt, Human
cauuuugcuaaaugugaauga

SEQ ID NO: 2553182 - RNA, 19 nt, Human
cauuuugcuauuguaaaua

SEQ ID NO: 2553183 - RNA, 17 nt, Human
cauuuugcuauuguaaa

SEQ ID NO: 2553184 - RNA, 15 nt, Human
cauuuugcuauugua

SEQ ID NO: 2553185 - RNA, 20 nt, Human
cauuuugccaaaauuauuaa

SEQ ID NO: 2553186 - RNA, 24 nt, Human
cauuuugcuaaaugugaaugauga

SEQ ID NO: 2553187 - RNA, 15 nt, Human
cauuuuuaagugcug

SEQ ID NO: 2553188 - RNA, 20 nt, Human
cauuuuuaagugcugcauuu

SEQ ID NO: 2553189 - RNA, 18 nt, Human
cauuuuuaguagagacag

SEQ ID NO: 2553190 - RNA, 19 nt, Human
cauuuuuaguagagacagg

SEQ ID NO: 2553191 - RNA, 23 nt, Human
cauuuugggguacccacugcucu

SEQ ID NO: 2553192 - RNA, 15 nt, Human
cauuuuggugagaaa

SEQ ID NO: 2553193 - RNA, 23 nt, Human
cauuuuguuugguauuguauuua

SEQ ID NO: 2553194 - RNA, 22 nt, Human
cauuuuguuugguauuguauuu

SEQ ID NO: 2553195 - RNA, 21 nt, Human
cauuuuguuugguauuguauu

SEQ ID NO: 2553196 - RNA, 20 nt, Human
cauuuuguuugguauuguau

SEQ ID NO: 2553197 - RNA, 19 nt, Human
cauuuuguuugguauugua

SEQ ID NO: 2553198 - RNA, 20 nt, Human
ccacaaucuuaaggggcagc

SEQ ID NO: 2553199 - RNA, 23 nt, Human
ccacaauccuauucucgggcuga

SEQ ID NO: 2553200 - RNA, 20 nt, Human
ccacacaaggauagaugcug

SEQ ID NO: 2553201 - RNA, 21 nt, Human
ccacaauaaagaucgccccca

SEQ ID NO: 2553202 - RNA, 22 nt, Human
ccacaaguggugguaacccugg

SEQ ID NO: 2553203 - RNA, 20 nt, Human
ccacaauauaaaacuguacu

SEQ ID NO: 2553204 - RNA, 11 nt, Human
ccacacacaca

SEQ ID NO: 2553205 - RNA, 22 nt, Human
ccacacaaggauagaugcuggc

SEQ ID NO: 2553206 - RNA, 17 nt, Human
ccacacacacacacaug

SEQ ID NO: 2553207 - RNA, 21 nt, Human
ccacacacacacacaugcaua

SEQ ID NO: 2553208 - RNA, 24 nt, Human
ccacacacacacacaugcauacac

SEQ ID NO: 2553209 - RNA, 12 nt, Human
ccacacacacag

SEQ ID NO: 2553210 - RNA, 14 nt, Human
ccacacacacacac

SEQ ID NO: 2553211 - RNA, 15 nt, Human
ccacacacacacaca

SEQ ID NO: 2553212 - RNA, 13 nt, Human
ccacacacacaca

SEQ ID NO: 2553213 - RNA, 15 nt, Human
ccacaagugguggua

SEQ ID NO: 2553214 - RNA, 21 nt, Human
ccacaaguggugguaacccug

SEQ ID NO: 2553215 - RNA, 17 nt, Human
ccacaaggcuguugcau

SEQ ID NO: 2553216 - RNA, 17 nt, Human
ccacaaggacuuccugu

SEQ ID NO: 2553217 - RNA, 21 nt, Human
ccacaaggacuuccuguccag

SEQ ID NO: 2553218 - RNA, 15 nt, Human
ccacaaguuaaauaa

SEQ ID NO: 2553219 - RNA, 20 nt, Human
ccacaaguuaaauaaaucau

SEQ ID NO: 2553220 - RNA, 19 nt, Human
ccacaagagcccaggccuc

SEQ ID NO: 2553221 - RNA, 18 nt, Human
ccacaagagcccaggccu

SEQ ID NO: 2553222 - RNA, 17 nt, Human
ccacaagagcccaggcc

SEQ ID NO: 2553223 - RNA, 16 nt, Human
ccacaagagcccaggc

SEQ ID NO: 2553224 - RNA, 21 nt, Human
ccacaagagcccaggccuccu

SEQ ID NO: 2553225 - RNA, 20 nt, Human
ccacaagagcccaggccucc

SEQ ID NO: 2553226 - RNA, 16 nt, Human
ccacaagaaauuugau

SEQ ID NO: 2553227 - RNA, 15 nt, Human
ccacaagaaauuuga

SEQ ID NO: 2553228 - RNA, 21 nt, Human
ccacaagaaauuugauuucua

SEQ ID NO: 2553229 - RNA, 15 nt, Human
ccacaagauucccag

SEQ ID NO: 2553230 - RNA, 16 nt, Human
ccacaagauucccaga

SEQ ID NO: 2553231 - RNA, 17 nt, Human
ccacaagauucccagag

SEQ ID NO: 2553232 - RNA, 24 nt, Human
ccacaagauucccagagacaggaa

SEQ ID NO: 2553233 - RNA, 18 nt, Human
ccacaagauucccagaga

SEQ ID NO: 2553234 - RNA, 19 nt, Human
ccacaagauucccagagac

SEQ ID NO: 2553235 - RNA, 20 nt, Human
ccacaagauucccagagaca

SEQ ID NO: 2553236 - RNA, 21 nt, Human
ccacaagauucccagagacag

SEQ ID NO: 2553237 - RNA, 18 nt, Human
ccaauauuguacaguuuu

SEQ ID NO: 2553238 - RNA, 16 nt, Human
ccaauauuguacaguu

SEQ ID NO: 2553239 - RNA, 15 nt, Human
ccaauauuguacagu

SEQ ID NO: 2553240 - RNA, 14 nt, Human
ccaauauuguacag

SEQ ID NO: 2553241 - RNA, 20 nt, Human
ccaauuguugacaguucuga

SEQ ID NO: 2553242 - RNA, 13 nt, Human
ccaauuggaggaa

SEQ ID NO: 2553243 - RNA, 22 nt, Human
ccaauuguugacaguucugaag

SEQ ID NO: 2553244 - RNA, 21 nt, Human
ccaauuguugacaguucugaa

SEQ ID NO: 2553245 - RNA, 19 nt, Human
ccaauuucaaguuccaagu

SEQ ID NO: 2553246 - RNA, 22 nt, Human
ccaauauuggagcauaucaaaa

SEQ ID NO: 2553247 - RNA, 17 nt, Human
ccaagugugugugcgug

SEQ ID NO: 2553248 - RNA, 20 nt, Human
ccaaguuauaaaucaauguc

SEQ ID NO: 2553249 - RNA, 19 nt, Human
ccaauucuuacaaacaugu

SEQ ID NO: 2553250 - RNA, 18 nt, Human
ccaauucuuacaaacaug

SEQ ID NO: 2553251 - RNA, 16 nt, Human
ccaauuucagacuccc

SEQ ID NO: 2553252 - RNA, 20 nt, Human
ccaauuuguaaaaacagcau

SEQ ID NO: 2553253 - RNA, 14 nt, Human
ccacaaagccuuau

SEQ ID NO: 2553254 - RNA, 20 nt, Human
ccacaaagcacaguuugaac

SEQ ID NO: 2553255 - RNA, 13 nt, Human
ccacaaaaauuga

SEQ ID NO: 2553256 - RNA, 23 nt, Human
ccacaaaauaaccaauccuggac

SEQ ID NO: 2553257 - RNA, 14 nt, Human
ccaauuuuucugca

SEQ ID NO: 2553258 - RNA, 13 nt, Human
ccaauuuuucugc

SEQ ID NO: 2553259 - RNA, 17 nt, Human
ccaauuuuucugcacug

SEQ ID NO: 2553260 - RNA, 16 nt, Human
ccacaagaaaugaaag

SEQ ID NO: 2553261 - RNA, 22 nt, Human
ccacaagaaaugaaagcaggga

SEQ ID NO: 2553262 - RNA, 13 nt, Human
ccacaagagccca

SEQ ID NO: 2553263 - RNA, 16 nt, Human
ccacaagacccuugug

SEQ ID NO: 2553264 - RNA, 22 nt, Human
ccacaacuccugucuaacugcu

SEQ ID NO: 2553265 - RNA, 13 nt, Human
ccacaacacacag

SEQ ID NO: 2553266 - RNA, 18 nt, Human
ccacaacccuguuuuaua

SEQ ID NO: 2553267 - RNA, 18 nt, Human
ccacaaaggagagcuagc

SEQ ID NO: 2553268 - RNA, 23 nt, Human
ccacaaagccuuaucaagugucu

SEQ ID NO: 2553269 - RNA, 22 nt, Human
ccacaaagccuuaucaaguguc

SEQ ID NO: 2553270 - RNA, 23 nt, Human
ccaagugccagaggugggcaggu

SEQ ID NO: 2553271 - RNA, 20 nt, Human
ccaaguggaccuugagacca

SEQ ID NO: 2553272 - RNA, 16 nt, Human
ccaagugccagucuug

SEQ ID NO: 2553273 - RNA, 22 nt, Human
ccaagugccagucuugugucug

SEQ ID NO: 2553274 - RNA, 15 nt, Human
ccaaguggcagagcu

SEQ ID NO: 2553275 - RNA, 14 nt, Human
ccaaguggcagagc

SEQ ID NO: 2553276 - RNA, 13 nt, Human
ccaaguggcagag

SEQ ID NO: 2553277 - RNA, 13 nt, Human
ccaaguggcuccc

SEQ ID NO: 2553278 - RNA, 18 nt, Human
ccaagugaacacuagcca

SEQ ID NO: 2553279 - RNA, 14 nt, Human
ccaagugcaggcug

SEQ ID NO: 2553280 - RNA, 19 nt, Human
ccaagugcaggcuggcacc

SEQ ID NO: 2553281 - RNA, 22 nt, Human
ccaagugccagaggugggcagg

SEQ ID NO: 2553282 - RNA, 21 nt, Human
ccaagugccagaggugggcag

SEQ ID NO: 2553283 - RNA, 18 nt, Human
ccaagugccagagguggg

SEQ ID NO: 2553284 - RNA, 17 nt, Human
ccaagugccagaggugg

SEQ ID NO: 2553285 - RNA, 16 nt, Human
ccaagugccagaggug

SEQ ID NO: 2553286 - RNA, 15 nt, Human
ccaagugccagaggu

SEQ ID NO: 2553287 - RNA, 14 nt, Human
ccaagugccagagg

SEQ ID NO: 2553288 - RNA, 16 nt, Human
ccaagugcaggcuggc

SEQ ID NO: 2553289 - RNA, 16 nt, Human
ccaaguggcucccaca

SEQ ID NO: 2553290 - RNA, 18 nt, Human
ccaaguggcagagcuugg

SEQ ID NO: 2553291 - RNA, 17 nt, Human
ccaaguggcagagcuug

SEQ ID NO: 2553292 - RNA, 19 nt, Human
ccaaguggcagagcuugga

SEQ ID NO: 2553293 - RNA, 16 nt, Human
ccaagugggggcagag

SEQ ID NO: 2553294 - RNA, 19 nt, Human
ccaagugugcauauuguac

SEQ ID NO: 2553295 - RNA, 10 nt, Human
ccaagugugc

SEQ ID NO: 2553296 - RNA, 14 nt, Human
ccaagugugaacaa

SEQ ID NO: 2553297 - RNA, 14 nt, Human
ccaaguggugccua

SEQ ID NO: 2553298 - RNA, 22 nt, Human
ccaaguggggugcugggaggag

SEQ ID NO: 2553299 - RNA, 16 nt, Human
ccaaguggggugcugg

SEQ ID NO: 2553300 - RNA, 15 nt, Human
ccaaguggggugcug

SEQ ID NO: 2553301 - RNA, 18 nt, Human
ccaagugggggcagaggg

SEQ ID NO: 2553302 - RNA, 20 nt, Human
ccaauauucauagcagcuua

SEQ ID NO: 2553303 - RNA, 15 nt, Human
ccaaguuauaaauca

SEQ ID NO: 2553304 - RNA, 13 nt, Human
ccaagugugugug

SEQ ID NO: 2553305 - RNA, 14 nt, Human
ccaagugugugugc

SEQ ID NO: 2553306 - RNA, 21 nt, Human
ccaagugugcauauuguacac

SEQ ID NO: 2553307 - RNA, 20 nt, Human
ccaagugugcauauuguaca

SEQ ID NO: 2553308 - RNA, 22 nt, Human
ccaagugugcauauuguacacu

SEQ ID NO: 2553309 - RNA, 12 nt, Human
ccaagugugugu

SEQ ID NO: 2553310 - RNA, 21 nt, Human
ccaagguuuaaacuucucuga

SEQ ID NO: 2553311 - RNA, 20 nt, Human
ccaagguuuaaacuucucug

SEQ ID NO: 2553312 - RNA, 23 nt, Human
ccaagguggucugcucgggccca

SEQ ID NO: 2553313 - RNA, 15 nt, Human
ccaagguggucugcu

SEQ ID NO: 2553314 - RNA, 13 nt, Human
ccaagguggucug

SEQ ID NO: 2553315 - RNA, 20 nt, Human
ccaagguggguagaucacga

SEQ ID NO: 2553316 - RNA, 17 nt, Human
ccaaggugggcugagcc

SEQ ID NO: 2553317 - RNA, 18 nt, Human
ccaaggugggcugagccc

SEQ ID NO: 2553318 - RNA, 20 nt, Human
ccaaggugggcugagcccug

SEQ ID NO: 2553319 - RNA, 23 nt, Human
ccaaggugggcugagcccuggca

SEQ ID NO: 2553320 - RNA, 22 nt, Human
ccaaggcuucuccaauucugcc

SEQ ID NO: 2553321 - RNA, 20 nt, Human
ccaaggcugcgucuggaggg

SEQ ID NO: 2553322 - RNA, 19 nt, Human
ccaaggcugcgucuggagg

SEQ ID NO: 2553323 - RNA, 18 nt, Human
ccaaggcugcgucuggag

SEQ ID NO: 2553324 - RNA, 14 nt, Human
ccaaggcuggggga

SEQ ID NO: 2553325 - RNA, 19 nt, Human
ccaaggcugauuaaaccaa

SEQ ID NO: 2553326 - RNA, 16 nt, Human
ccaaggcucugagcaa

SEQ ID NO: 2553327 - RNA, 23 nt, Human
ccaaggcguccgcgcgccagcac

SEQ ID NO: 2553328 - RNA, 16 nt, Human
ccaaggcggccccucc

SEQ ID NO: 2553329 - RNA, 17 nt, Human
ccaaggcugcgucugga

SEQ ID NO: 2553330 - RNA, 13 nt, Human
ccaagcucccagg

SEQ ID NO: 2553331 - RNA, 12 nt, Human
ccaagcucccag

SEQ ID NO: 2553332 - RNA, 17 nt, Human
ccaagcuccaagcccca

SEQ ID NO: 2553333 - RNA, 15 nt, Human
ccaagcuccaagccc

SEQ ID NO: 2553334 - RNA, 20 nt, Human
ccaagcucaggaccaggcaa

SEQ ID NO: 2553335 - RNA, 19 nt, Human
ccaagcucaggaccaggca

SEQ ID NO: 2553336 - RNA, 13 nt, Human
ccaagcuccaagc

SEQ ID NO: 2553337 - RNA, 16 nt, Human
ccaagcucagaaggcu

SEQ ID NO: 2553338 - RNA, 14 nt, Human
ccaagcucagaagg

SEQ ID NO: 2553339 - RNA, 23 nt, Human
ccaagccguggcuucccgcucag

SEQ ID NO: 2553340 - RNA, 21 nt, Human
ccaaggcggccccucccgccc

SEQ ID NO: 2553341 - RNA, 15 nt, Human
ccaaggcggccccuc

SEQ ID NO: 2553342 - RNA, 14 nt, Human
ccaaggcggccccu

SEQ ID NO: 2553343 - RNA, 16 nt, Human
ccaaggccuucuccuc

SEQ ID NO: 2553344 - RNA, 14 nt, Human
ccaaggccuucucc

SEQ ID NO: 2553345 - RNA, 18 nt, Human
ccaaggccgaagcucugg

SEQ ID NO: 2553346 - RNA, 18 nt, Human
ccaaggcuagaaccaccu

SEQ ID NO: 2553347 - RNA, 20 nt, Human
ccaaggccgaagcucuggcu

SEQ ID NO: 2553348 - RNA, 17 nt, Human
ccaaggccgaagcucug

SEQ ID NO: 2553349 - RNA, 16 nt, Human
ccaaggccgaagcucu

SEQ ID NO: 2553350 - RNA, 13 nt, Human
ccaaggccagguu

SEQ ID NO: 2553351 - RNA, 14 nt, Human
ccaagcuccaucuc

SEQ ID NO: 2553352 - RNA, 21 nt, Human
ccaagccguggcuucccgcuc

SEQ ID NO: 2553353 - RNA, 17 nt, Human
ccaagccguggcuuccc

SEQ ID NO: 2553354 - RNA, 16 nt, Human
ccaagccguggcuucc

SEQ ID NO: 2553355 - RNA, 15 nt, Human
ccaagccguggcuuc

SEQ ID NO: 2553356 - RNA, 14 nt, Human
ccaagcaggacaug

SEQ ID NO: 2553357 - RNA, 14 nt, Human
ccaagccguggcuu

SEQ ID NO: 2553358 - RNA, 20 nt, Human
ccaagcaggaagcucagacu

SEQ ID NO: 2553359 - RNA, 23 nt, Human
ccaagcagagguugggaggccau

SEQ ID NO: 2553360 - RNA, 12 nt, Human
ccaagcagccaa

SEQ ID NO: 2553361 - RNA, 16 nt, Human
ccaagcagccaagcuc

SEQ ID NO: 2553362 - RNA, 18 nt, Human
ccaagcaggaaaugaaaa

SEQ ID NO: 2553363 - RNA, 18 nt, Human
ccaagcagccaagcuccu

SEQ ID NO: 2553364 - RNA, 12 nt, Human
ccaagcaggaag

SEQ ID NO: 2553365 - RNA, 13 nt, Human
ccaagcaggaagc

SEQ ID NO: 2553366 - RNA, 14 nt, Human
ccaagcaggaagcu

SEQ ID NO: 2553367 - RNA, 17 nt, Human
ccaagcaggaagcucag

SEQ ID NO: 2553368 - RNA, 18 nt, Human
ccaagcaggaagcucaga

SEQ ID NO: 2553369 - RNA, 12 nt, Human
ccaagaggcugc

SEQ ID NO: 2553370 - RNA, 13 nt, Human
ccaagaggcugca

SEQ ID NO: 2553371 - RNA, 16 nt, Human
ccaagagccugagagu

SEQ ID NO: 2553372 - RNA, 22 nt, Human
ccaagagcugaggcaauucuaa

SEQ ID NO: 2553373 - RNA, 16 nt, Human
ccaaagagggcuuccu

SEQ ID NO: 2553374 - RNA, 22 nt, Human
ccaaagagccuggagaagcuga

SEQ ID NO: 2553375 - RNA, 19 nt, Human
ccaaagagggcuuccucua

SEQ ID NO: 2553376 - RNA, 17 nt, Human
ccaaagagggcuuccuc

SEQ ID NO: 2553377 - RNA, 9 nt, Human
ccaaagagu

SEQ ID NO: 2553378 - RNA, 14 nt, Human
ccaaagaugcagcc

SEQ ID NO: 2553379 - RNA, 13 nt, Human
ccaaagaugcagc

SEQ ID NO: 2553380 - RNA, 17 nt, Human
ccaacaucccauugccc

SEQ ID NO: 2553381 - RNA, 16 nt, Human
ccaacaucaacaucuu

SEQ ID NO: 2553382 - RNA, 14 nt, Human
ccaacauacuccca

SEQ ID NO: 2553383 - RNA, 23 nt, Human
ccaacaguguuaggccuggcaca

SEQ ID NO: 2553384 - RNA, 12 nt, Human
ccaacaguuccu

SEQ ID NO: 2553385 - RNA, 21 nt, Human
ccaacacgagcaggcuacugu

SEQ ID NO: 2553386 - RNA, 16 nt, Human
ccaacacgcaccugcc

SEQ ID NO: 2553387 - RNA, 18 nt, Human
ccaacagguggcaggacc

SEQ ID NO: 2553388 - RNA, 18 nt, Human
ccaacacccaucuguuuu

SEQ ID NO: 2553389 - RNA, 22 nt, Human
ccaacaccagccccugccccag

SEQ ID NO: 2553390 - RNA, 12 nt, Human
ccaacaccaggg

SEQ ID NO: 2553391 - RNA, 21 nt, Human
ccaacaguguuaggccuggca

SEQ ID NO: 2553392 - RNA, 20 nt, Human
ccaacaguguuaggccuggc

SEQ ID NO: 2553393 - RNA, 22 nt, Human
ccaacagugugaaguuagaauu

SEQ ID NO: 2553394 - RNA, 19 nt, Human
ccaacagugugaaguuaga

SEQ ID NO: 2553395 - RNA, 16 nt, Human
ccaacagugugaaguu

SEQ ID NO: 2553396 - RNA, 15 nt, Human
ccaacagugugaagu

SEQ ID NO: 2553397 - RNA, 14 nt, Human
ccaacagugugaag

SEQ ID NO: 2553398 - RNA, 13 nt, Human
ccaacagugugaa

SEQ ID NO: 2553399 - RNA, 12 nt, Human
ccaacaguguga

SEQ ID NO: 2553400 - RNA, 20 nt, Human
ccaacagugagucugucagc

SEQ ID NO: 2553401 - RNA, 12 nt, Human
ccaacagugagu

SEQ ID NO: 2553402 - RNA, 23 nt, Human
ccaacagguggcaggaccaggac

SEQ ID NO: 2553403 - RNA, 19 nt, Human
ccaacagguggcaggacca

SEQ ID NO: 2553404 - RNA, 20 nt, Human
ccaacacccugucuaaaaaa

SEQ ID NO: 2553405 - RNA, 19 nt, Human
ccaacagucaaaacagaga

SEQ ID NO: 2553406 - RNA, 15 nt, Human
ccaacaccagccccu

SEQ ID NO: 2553407 - RNA, 20 nt, Human
ccaaauugcugggauuacag

SEQ ID NO: 2553408 - RNA, 22 nt, Human
ccaaauugcuccuaagcuucaa

SEQ ID NO: 2553409 - RNA, 23 nt, Human
ccaaauuccuuggcaugccuucc

SEQ ID NO: 2553410 - RNA, 20 nt, Human
ccaaauuccuuggcaugccu

SEQ ID NO: 2553411 - RNA, 14 nt, Human
ccaacacgagcagg

SEQ ID NO: 2553412 - RNA, 18 nt, Human
ccaacaccagccccugcc

SEQ ID NO: 2553413 - RNA, 17 nt, Human
ccaacaccagccccugc

SEQ ID NO: 2553414 - RNA, 16 nt, Human
ccaacaccagccccug

SEQ ID NO: 2553415 - RNA, 13 nt, Human
ccaacaccaggga

SEQ ID NO: 2553416 - RNA, 16 nt, Human
ccaaagcagggucugg

SEQ ID NO: 2553417 - RNA, 15 nt, Human
ccaaagcagggucug

SEQ ID NO: 2553418 - RNA, 12 nt, Human
ccaaagcagggu

SEQ ID NO: 2553419 - RNA, 13 nt, Human
ccaaagcagacag

SEQ ID NO: 2553420 - RNA, 14 nt, Human
ccaaagcagacagc

SEQ ID NO: 2553421 - RNA, 21 nt, Human
ccaaagauauauacacaggau

SEQ ID NO: 2553422 - RNA, 22 nt, Human
ccaaagaguagaauugcauuga

SEQ ID NO: 2553423 - RNA, 15 nt, Human
ccaaauucuuucagu

SEQ ID NO: 2553424 - RNA, 22 nt, Human
ccaaauucuuucaguggcuacc

SEQ ID NO: 2553425 - RNA, 15 nt, Human
ccaagaccuucuccu

SEQ ID NO: 2553426 - RNA, 23 nt, Human
ccaagacaugucuguucuacaua

SEQ ID NO: 2553427 - RNA, 11 nt, Human
ccaagacauug

SEQ ID NO: 2553428 - RNA, 22 nt, Human
ccaagacagaugccccagagcu

SEQ ID NO: 2553429 - RNA, 21 nt, Human
ccaagacaugucuguucuaca

SEQ ID NO: 2553430 - RNA, 24 nt, Human
ccaagacagaugccccagagcugu

SEQ ID NO: 2553431 - RNA, 23 nt, Human
ccaaccuuagauguucuaagucu

SEQ ID NO: 2553432 - RNA, 12 nt, Human
ccaaccuuccca

SEQ ID NO: 2553433 - RNA, 22 nt, Human
ccaaccuguaauaaauaugagu

SEQ ID NO: 2553434 - RNA, 23 nt, Human
ccaagacagaugccccagagcug

SEQ ID NO: 2553435 - RNA, 21 nt, Human
ccaaccuguaauaaauaugag

SEQ ID NO: 2553436 - RNA, 20 nt, Human
ccaaccuguaauaaauauga

SEQ ID NO: 2553437 - RNA, 19 nt, Human
ccaaccuguaauaaauaug

SEQ ID NO: 2553438 - RNA, 18 nt, Human
ccaaccuguaauaaauau

SEQ ID NO: 2553439 - RNA, 15 nt, Human
ccaaccuguuaccua

SEQ ID NO: 2553440 - RNA, 13 nt, Human
ccaaccucuggag

SEQ ID NO: 2553441 - RNA, 14 nt, Human
ccaaccucuggagc

SEQ ID NO: 2553442 - RNA, 12 nt, Human
ccaaccugacca

SEQ ID NO: 2553443 - RNA, 18 nt, Human
ccaaccugcaaagaucug

SEQ ID NO: 2553444 - RNA, 19 nt, Human
ccaaccugcaaagaucugu

SEQ ID NO: 2553445 - RNA, 17 nt, Human
ccaaccugcaaagaucu

SEQ ID NO: 2553446 - RNA, 13 nt, Human
ccaaccugaccaa

SEQ ID NO: 2553447 - RNA, 16 nt, Human
ccaaccugaccaacau

SEQ ID NO: 2553448 - RNA, 17 nt, Human
ccaaccuguaauaaaua

SEQ ID NO: 2553449 - RNA, 16 nt, Human
ccaaccuguaauaaau

SEQ ID NO: 2553450 - RNA, 14 nt, Human
ccaaccuggggggc

SEQ ID NO: 2553451 - RNA, 13 nt, Human
ccaaccuggacaa

SEQ ID NO: 2553452 - RNA, 17 nt, Human
ccaaccuggggagccag

SEQ ID NO: 2553453 - RNA, 14 nt, Human
ccaaccuggacaac

SEQ ID NO: 2553454 - RNA, 12 nt, Human
ccaaccugcuga

SEQ ID NO: 2553455 - RNA, 22 nt, Human
ccaaccugaccaacauggagaa

SEQ ID NO: 2553456 - RNA, 13 nt, Human
ccaacccucauca

SEQ ID NO: 2553457 - RNA, 17 nt, Human
ccaacaucgugaaaccc

SEQ ID NO: 2553458 - RNA, 16 nt, Human
ccaacaucucccuccc

SEQ ID NO: 2553459 - RNA, 20 nt, Human
ccaacaucccauugcccugg

SEQ ID NO: 2553460 - RNA, 21 nt, Human
ccaacaucccauugcccuggu

SEQ ID NO: 2553461 - RNA, 15 nt, Human
ccaacccucaucacc

SEQ ID NO: 2553462 - RNA, 15 nt, Human
ccaacauggagaaac

SEQ ID NO: 2553463 - RNA, 22 nt, Human
ccaacauggagaaacccugucu

SEQ ID NO: 2553464 - RNA, 23 nt, Human
ccaacauggagaaacccugucuc

SEQ ID NO: 2553465 - RNA, 15 nt, Human
ccaacauggugaaac

SEQ ID NO: 2553466 - RNA, 14 nt, Human
ccaacccugccccu

SEQ ID NO: 2553467 - RNA, 15 nt, Human
ccaacccugccccug

SEQ ID NO: 2553468 - RNA, 16 nt, Human
ccaacccugccccugc

SEQ ID NO: 2553469 - RNA, 12 nt, Human
ccaacccuuccc

SEQ ID NO: 2553470 - RNA, 18 nt, Human
ccaacccuguuuccugag

SEQ ID NO: 2553471 - RNA, 16 nt, Human
ccaacccuguuuccug

SEQ ID NO: 2553472 - RNA, 14 nt, Human
ccaacccugucugu

SEQ ID NO: 2553473 - RNA, 12 nt, Human
ccaacccugucu

SEQ ID NO: 2553474 - RNA, 13 nt, Human
ccaacccugucug

SEQ ID NO: 2553475 - RNA, 18 nt, Human
ccaacccuggcacccagg

SEQ ID NO: 2553476 - RNA, 17 nt, Human
ccaacccugccccugcc

SEQ ID NO: 2553477 - RNA, 14 nt, Human
ccaaccuccugacc

SEQ ID NO: 2553478 - RNA, 18 nt, Human
ccaaccuaaccccuuucc

SEQ ID NO: 2553479 - RNA, 14 nt, Human
ccaacccuucccca

SEQ ID NO: 2553480 - RNA, 21 nt, Human
ccaacccuucuccucuuguaa

SEQ ID NO: 2553481 - RNA, 13 nt, Human
ccaacccuucucc

SEQ ID NO: 2553482 - RNA, 11 nt, Human
ccaacccuucu

SEQ ID NO: 2553483 - RNA, 12 nt, Human
ccaagagccuga

SEQ ID NO: 2553484 - RNA, 12 nt, Human
ccaagagaugaa

SEQ ID NO: 2553485 - RNA, 19 nt, Human
ccaagagcagaggcagcga

SEQ ID NO: 2553486 - RNA, 23 nt, Human
ccaagacucccucgucgagcugg

SEQ ID NO: 2553487 - RNA, 14 nt, Human
ccaagagaugaaga

SEQ ID NO: 2553488 - RNA, 19 nt, Human
ccaagaccuguugguucca

SEQ ID NO: 2553489 - RNA, 12 nt, Human
ccaagacauugu

SEQ ID NO: 2553490 - RNA, 16 nt, Human
ccaagacauugucaau

SEQ ID NO: 2553491 - RNA, 17 nt, Human
ccaagacauugucaaua

SEQ ID NO: 2553492 - RNA, 16 nt, Human
cauuagacuccuccuc

SEQ ID NO: 2553493 - RNA, 15 nt, Human
cauuagacuccuccu

SEQ ID NO: 2553494 - RNA, 17 nt, Human
cauuagacuccuccucc

SEQ ID NO: 2553495 - RNA, 12 nt, Human
cauuagagcagg

SEQ ID NO: 2553496 - RNA, 11 nt, Human
cauuagagcag

SEQ ID NO: 2553497 - RNA, 19 nt, Human
cauuagagcccauuucaau

SEQ ID NO: 2553498 - RNA, 14 nt, Human
cauuagagcaggcg

SEQ ID NO: 2553499 - RNA, 13 nt, Human
cauuagagcaggc

SEQ ID NO: 2553500 - RNA, 23 nt, Human
cauuagagcaggcguucagcuca

SEQ ID NO: 2553501 - RNA, 22 nt, Human
cauuaccgcguuguaaaauaua

SEQ ID NO: 2553502 - RNA, 18 nt, Human
cauuaccgcguuguaaaa

SEQ ID NO: 2553503 - RNA, 20 nt, Human
cauuaccuuacuguggagga

SEQ ID NO: 2553504 - RNA, 13 nt, Human
cauuaccuuacug

SEQ ID NO: 2553505 - RNA, 17 nt, Human
cauuacgugagccaggu

SEQ ID NO: 2553506 - RNA, 18 nt, Human
cauuagaccaagcuuguc

SEQ ID NO: 2553507 - RNA, 16 nt, Human
cauuacgugagccagg

SEQ ID NO: 2553508 - RNA, 17 nt, Human
cauuaccuuacugugga

SEQ ID NO: 2553509 - RNA, 13 nt, Human
cauuacgugagcc

SEQ ID NO: 2553510 - RNA, 17 nt, Human
cauuagcaguuugcuuu

SEQ ID NO: 2553511 - RNA, 14 nt, Human
cauuauuugcaugu

SEQ ID NO: 2553512 - RNA, 19 nt, Human
cauuauuugcauguuaccu

SEQ ID NO: 2553513 - RNA, 13 nt, Human
cauuauuugcaug

SEQ ID NO: 2553514 - RNA, 22 nt, Human
cauuauuuauucagcuucauuu

SEQ ID NO: 2553515 - RNA, 23 nt, Human
cauuaaucaaucaucugugugaa

SEQ ID NO: 2553516 - RNA, 22 nt, Human
cauuaaucaaucaucuguguga

SEQ ID NO: 2553517 - RNA, 21 nt, Human
cauuaauguuaauucagcacu

SEQ ID NO: 2553518 - RNA, 13 nt, Human
cauuaauguuaau

SEQ ID NO: 2553519 - RNA, 23 nt, Human
cauuaauguuaauucagcacuga

SEQ ID NO: 2553520 - RNA, 19 nt, Human
cauuaauuauuauugcugu

SEQ ID NO: 2553521 - RNA, 21 nt, Human
cauuaauuauuauugcuguug

SEQ ID NO: 2553522 - RNA, 21 nt, Human
cauuaccucagugagaagcca

SEQ ID NO: 2553523 - RNA, 22 nt, Human
cauuaccucagugagaagccag

SEQ ID NO: 2553524 - RNA, 20 nt, Human
cauuaauuauuauugcuguu

SEQ ID NO: 2553525 - RNA, 20 nt, Human
cauuaccagacgguucacca

SEQ ID NO: 2553526 - RNA, 18 nt, Human
cauuaccagacgguucac

SEQ ID NO: 2553527 - RNA, 17 nt, Human
cauuaccgcguuguaaa

SEQ ID NO: 2553528 - RNA, 23 nt, Human
cauuaccagacgguucaccagcc

SEQ ID NO: 2553529 - RNA, 14 nt, Human
cauuaaauucacaa

SEQ ID NO: 2553530 - RNA, 17 nt, Human
cauuaaauucacaaacu

SEQ ID NO: 2553531 - RNA, 18 nt, Human
cauuaaauucacaaacuu

SEQ ID NO: 2553532 - RNA, 21 nt, Human
cauuaaauucacaaacuuuua

SEQ ID NO: 2553533 - RNA, 13 nt, Human
cauuaacaguuuu

SEQ ID NO: 2553534 - RNA, 16 nt, Human
cauuaacaguuuucca

SEQ ID NO: 2553535 - RNA, 17 nt, Human
cauuaacaguuuuccau

SEQ ID NO: 2553536 - RNA, 14 nt, Human
cauuaauaauaaau

SEQ ID NO: 2553537 - RNA, 20 nt, Human
cauuaacaguuuuccaugaa

SEQ ID NO: 2553538 - RNA, 16 nt, Human
cauuaauauuugcuga

SEQ ID NO: 2553539 - RNA, 18 nt, Human
cauuaaucaaucaucugu

SEQ ID NO: 2553540 - RNA, 17 nt, Human
cauuaauauuugcugac

SEQ ID NO: 2553541 - RNA, 23 nt, Human
cauguuuugugacuauauagaga

SEQ ID NO: 2553542 - RNA, 17 nt, Human
cauguuuugugacuaua

SEQ ID NO: 2553543 - RNA, 15 nt, Human
cauguuuugugacua

SEQ ID NO: 2553544 - RNA, 21 nt, Human
cauuaaagccugaguuugcuu

SEQ ID NO: 2553545 - RNA, 15 nt, Human
cauguuuuguuuacg

SEQ ID NO: 2553546 - RNA, 12 nt, Human
cauuaaaguucu

SEQ ID NO: 2553547 - RNA, 21 nt, Human
cauuaaaggcuucucucucac

SEQ ID NO: 2553548 - RNA, 13 nt, Human
cauuaaauucaca

SEQ ID NO: 2553549 - RNA, 21 nt, Human
cauuaaagucgagcuuuucua

SEQ ID NO: 2553550 - RNA, 18 nt, Human
cauuaaaggcuucucucu

SEQ ID NO: 2553551 - RNA, 17 nt, Human
cauuaaaggcuucucuc

SEQ ID NO: 2553552 - RNA, 24 nt, Human
cauuaaaggcuucucucucaccag

SEQ ID NO: 2553553 - RNA, 18 nt, Human
cauuaaagcauuuacuuu

SEQ ID NO: 2553554 - RNA, 12 nt, Human
cauuaaagccau

SEQ ID NO: 2553555 - RNA, 22 nt, Human
cauuaaagcauuuacuuugaau

SEQ ID NO: 2553556 - RNA, 18 nt, Human
cauguuuuucuucucccu

SEQ ID NO: 2553557 - RNA, 21 nt, Human
cauguuucuuuguaaugaaaa

SEQ ID NO: 2553558 - RNA, 20 nt, Human
cauguuucuuuguaaugaaa

SEQ ID NO: 2553559 - RNA, 21 nt, Human
cauguguguccacgacugucu

SEQ ID NO: 2553560 - RNA, 22 nt, Human
cauguguguccacgacugucuc

SEQ ID NO: 2553561 - RNA, 12 nt, Human
caugugugucca

SEQ ID NO: 2553562 - RNA, 14 nt, Human
cauguguggacuca

SEQ ID NO: 2553563 - RNA, 20 nt, Human
caugugugcucuucuucuuu

SEQ ID NO: 2553564 - RNA, 18 nt, Human
caugugugcucuucuucu

SEQ ID NO: 2553565 - RNA, 14 nt, Human
caugugugcugaac

SEQ ID NO: 2553566 - RNA, 23 nt, Human
cauguguguccacgacugucucc

SEQ ID NO: 2553567 - RNA, 15 nt, Human
caugugugugcaagu

SEQ ID NO: 2553568 - RNA, 15 nt, Human
caugugugugcucag

SEQ ID NO: 2553569 - RNA, 18 nt, Human
cauguuuugauaaaguag

SEQ ID NO: 2553570 - RNA, 17 nt, Human
cauguuuugauaaagua

SEQ ID NO: 2553571 - RNA, 14 nt, Human
cauguuuugauaaa

SEQ ID NO: 2553572 - RNA, 13 nt, Human
cauguuuugauaa

SEQ ID NO: 2553573 - RNA, 21 nt, Human
cauguuuucugaaaauauaac

SEQ ID NO: 2553574 - RNA, 14 nt, Human
cauguuuuccguga

SEQ ID NO: 2553575 - RNA, 12 nt, Human
cauguuuuguau

SEQ ID NO: 2553576 - RNA, 14 nt, Human
cauguuuugugacu

SEQ ID NO: 2553577 - RNA, 21 nt, Human
cauguuuuccauuguuugaaa

SEQ ID NO: 2553578 - RNA, 17 nt, Human
cauguuuuccauuguuu

SEQ ID NO: 2553579 - RNA, 15 nt, Human
cauguuuuccauugu

SEQ ID NO: 2553580 - RNA, 18 nt, Human
cauguuuuccagcuccuc

SEQ ID NO: 2553581 - RNA, 16 nt, Human
cauguuuucaacugcc

SEQ ID NO: 2553582 - RNA, 17 nt, Human
cauguuuucaacugcca

SEQ ID NO: 2553583 - RNA, 15 nt, Human
cauguuuucaacugc

SEQ ID NO: 2553584 - RNA, 15 nt, Human
cauguuuuaacaaaa

SEQ ID NO: 2553585 - RNA, 16 nt, Human
cauguuuuaacaaaaa

SEQ ID NO: 2553586 - RNA, 17 nt, Human
cauguuuuaacaaaaac

SEQ ID NO: 2553587 - RNA, 20 nt, Human
cauguuuuaacaaaaaccaa

SEQ ID NO: 2553588 - RNA, 23 nt, Human
cauguuuuagacaaauacucaug

SEQ ID NO: 2553589 - RNA, 15 nt, Human
cauguuugugauuga

SEQ ID NO: 2553590 - RNA, 21 nt, Human
caugugugugcaagugugugc

SEQ ID NO: 2553591 - RNA, 16 nt, Human
cauguuugagcucaga

SEQ ID NO: 2553592 - RNA, 18 nt, Human
cauguuugagcucagacc

SEQ ID NO: 2553593 - RNA, 13 nt, Human
cauguuuuaacaa

SEQ ID NO: 2553594 - RNA, 14 nt, Human
cauguuuuaacaaa

SEQ ID NO: 2553595 - RNA, 12 nt, Human
cauguuuuaaca

SEQ ID NO: 2553596 - RNA, 23 nt, Human
cauguuugagcucagacccccac

SEQ ID NO: 2553597 - RNA, 18 nt, Human
cauguuuuaaagcuugcu

SEQ ID NO: 2553598 - RNA, 19 nt, Human
cauguuugagcucagaccc

SEQ ID NO: 2553599 - RNA, 20 nt, Human
cauguuugagcucagacccc

SEQ ID NO: 2553600 - RNA, 22 nt, Human
cauguuucuuuguaaugaaaac

SEQ ID NO: 2553601 - RNA, 23 nt, Human
cauguuugauguaucugagcagg

SEQ ID NO: 2553602 - RNA, 15 nt, Human
caugugaacccggga

SEQ ID NO: 2553603 - RNA, 24 nt, Human
caugugaaaccuuuuuuaagauuu

SEQ ID NO: 2553604 - RNA, 22 nt, Human
caugugaaaccuuuuuuaagau

SEQ ID NO: 2553605 - RNA, 21 nt, Human
caugugaaaccuuuuuuaaga

SEQ ID NO: 2553606 - RNA, 13 nt, Human
caugugacacaua

SEQ ID NO: 2553607 - RNA, 12 nt, Human
caugugacacau

SEQ ID NO: 2553608 - RNA, 15 nt, Human
caugugacacauaug

SEQ ID NO: 2553609 - RNA, 14 nt, Human
caugugacacauau

SEQ ID NO: 2553610 - RNA, 12 nt, Human
caugugacauuu

SEQ ID NO: 2553611 - RNA, 16 nt, Human
caugugacacauaugc

SEQ ID NO: 2553612 - RNA, 16 nt, Human
caugugaccacucugu

SEQ ID NO: 2553613 - RNA, 16 nt, Human
caugugacauuuauau

SEQ ID NO: 2553614 - RNA, 14 nt, Human
caugugacauuuau

SEQ ID NO: 2553615 - RNA, 13 nt, Human
caugugacauuua

SEQ ID NO: 2553616 - RNA, 15 nt, Human
caugugcacaugcac

SEQ ID NO: 2553617 - RNA, 22 nt, Human
caugugccagggcaaugaugaa

SEQ ID NO: 2553618 - RNA, 17 nt, Human
cauguggaaagugaauu

SEQ ID NO: 2553619 - RNA, 16 nt, Human
cauguggaaagugaau

SEQ ID NO: 2553620 - RNA, 24 nt, Human
caugugccagggcaaugaugaaug

SEQ ID NO: 2553621 - RNA, 21 nt, Human
caugugccagguuuuuggucu

SEQ ID NO: 2553622 - RNA, 18 nt, Human
caugugaccacucugucu

SEQ ID NO: 2553623 - RNA, 21 nt, Human
caugugacuccuaugaucuca

SEQ ID NO: 2553624 - RNA, 13 nt, Human
caugugaagaggg

SEQ ID NO: 2553625 - RNA, 12 nt, Human
cauguggcugga

SEQ ID NO: 2553626 - RNA, 14 nt, Human
cauguggccugugg

SEQ ID NO: 2553627 - RNA, 19 nt, Human
cauguggagaaaggaguga

SEQ ID NO: 2553628 - RNA, 15 nt, Human
cauguggagaaagga

SEQ ID NO: 2553629 - RNA, 18 nt, Human
cauguggaaagugaauuu

SEQ ID NO: 2553630 - RNA, 20 nt, Human
cauguggaaagugaauuuga

SEQ ID NO: 2553631 - RNA, 21 nt, Human
cauguggaaagugaauuugaa

SEQ ID NO: 2553632 - RNA, 22 nt, Human
cauguggaaagugaauuugaau

SEQ ID NO: 2553633 - RNA, 23 nt, Human
cauguggaaagugaauuugaaug

SEQ ID NO: 2553634 - RNA, 17 nt, Human
cauguggaauauaaaga

SEQ ID NO: 2553635 - RNA, 17 nt, Human
cauguggggccagguca

SEQ ID NO: 2553636 - RNA, 15 nt, Human
cauguggggccaggu

SEQ ID NO: 2553637 - RNA, 14 nt, Human
cauguggggccagg

SEQ ID NO: 2553638 - RNA, 15 nt, Human
cauguggcuggaaga

SEQ ID NO: 2553639 - RNA, 13 nt, Human
cauguggcuggaa

SEQ ID NO: 2553640 - RNA, 12 nt, Human
caugugggagcu

SEQ ID NO: 2553641 - RNA, 21 nt, Human
caugugugagugugugcaagu

SEQ ID NO: 2553642 - RNA, 16 nt, Human
cauguguaaucaauaa

SEQ ID NO: 2553643 - RNA, 18 nt, Human
caugugugcaacagggua

SEQ ID NO: 2553644 - RNA, 17 nt, Human
caugugugcgagugugu

SEQ ID NO: 2553645 - RNA, 19 nt, Human
caugugugcgagugugugc

SEQ ID NO: 2553646 - RNA, 17 nt, Human
caugugugcucuucuuc

SEQ ID NO: 2553647 - RNA, 13 nt, Human
caugugugcgugu

SEQ ID NO: 2553648 - RNA, 22 nt, Human
caugugguuaaugccauggaca

SEQ ID NO: 2553649 - RNA, 15 nt, Human
caugugguuuauaga

SEQ ID NO: 2553650 - RNA, 20 nt, Human
caugugguuuauagagggcc

SEQ ID NO: 2553651 - RNA, 22 nt, Human
caugugguggcacaggcccccu

SEQ ID NO: 2553652 - RNA, 18 nt, Human
cauguggggccaggucac

SEQ ID NO: 2553653 - RNA, 23 nt, Human
cauguggggccaggucacccuuu

SEQ ID NO: 2553654 - RNA, 23 nt, Human
caugugguggcacaggcccccuu

SEQ ID NO: 2553655 - RNA, 12 nt, Human
caugugguggga

SEQ ID NO: 2553656 - RNA, 21 nt, Human
cauguggugggacagggaccc

SEQ ID NO: 2553657 - RNA, 17 nt, Human
caugugguuaaugccau

SEQ ID NO: 2553658 - RNA, 17 nt, Human
cauguaacagaaagggc

SEQ ID NO: 2553659 - RNA, 15 nt, Human
cauguaacagaaagg

SEQ ID NO: 2553660 - RNA, 14 nt, Human
cauguaacagaaag

SEQ ID NO: 2553661 - RNA, 13 nt, Human
cauguaacagaaa

SEQ ID NO: 2553662 - RNA, 16 nt, Human
caugguugagaaauga

SEQ ID NO: 2553663 - RNA, 16 nt, Human
cauguaaauuuuguau

SEQ ID NO: 2553664 - RNA, 17 nt, Human
cauguaagcugaaaaua

SEQ ID NO: 2553665 - RNA, 23 nt, Human
cauguaagcugaaaauauggcaa

SEQ ID NO: 2553666 - RNA, 18 nt, Human
cauguaagcugaaaauau

SEQ ID NO: 2553667 - RNA, 14 nt, Human
cauguaauccucaa

SEQ ID NO: 2553668 - RNA, 21 nt, Human
cauguaaugguaucuuaaagu

SEQ ID NO: 2553669 - RNA, 12 nt, Human
cauguaauaaaa

SEQ ID NO: 2553670 - RNA, 21 nt, Human
cauguaauaaaaaguauaugu

SEQ ID NO: 2553671 - RNA, 23 nt, Human
cauguaauauaaagauguuaaaa

SEQ ID NO: 2553672 - RNA, 22 nt, Human
cauguaauaaaaaguauauguu

SEQ ID NO: 2553673 - RNA, 22 nt, Human
caugguguaauaagacauaacg

SEQ ID NO: 2553674 - RNA, 21 nt, Human
caugguuacaaucauugcuga

SEQ ID NO: 2553675 - RNA, 19 nt, Human
caugguuaagguaaaguaa

SEQ ID NO: 2553676 - RNA, 14 nt, Human
caugguugagaaau

SEQ ID NO: 2553677 - RNA, 21 nt, Human
caugguguaauaagacauaac

SEQ ID NO: 2553678 - RNA, 19 nt, Human
caugguguaauaagacaua

SEQ ID NO: 2553679 - RNA, 18 nt, Human
caugguguaauaagacau

SEQ ID NO: 2553680 - RNA, 16 nt, Human
caugguguaauaagac

SEQ ID NO: 2553681 - RNA, 15 nt, Human
caugguguaauaaga

SEQ ID NO: 2553682 - RNA, 17 nt, Human
cauggugccugagaggc

SEQ ID NO: 2553683 - RNA, 16 nt, Human
cauggugccugagagg

SEQ ID NO: 2553684 - RNA, 15 nt, Human
cauggugccugagag

SEQ ID NO: 2553685 - RNA, 18 nt, Human
cauggugugaucgucuga

SEQ ID NO: 2553686 - RNA, 23 nt, Human
cauggugugaaagucagaugccc

SEQ ID NO: 2553687 - RNA, 12 nt, Human
cauggugucugg

SEQ ID NO: 2553688 - RNA, 22 nt, Human
cauggugugaaagucagaugcc

SEQ ID NO: 2553689 - RNA, 16 nt, Human
cauggucggaaaacau

SEQ ID NO: 2553690 - RNA, 20 nt, Human
cauggugacuuuugaaaaga

SEQ ID NO: 2553691 - RNA, 15 nt, Human
cauggugccccagga

SEQ ID NO: 2553692 - RNA, 21 nt, Human
cauggugcaguugacagcagg

SEQ ID NO: 2553693 - RNA, 19 nt, Human
cauggugcaguugacagca

SEQ ID NO: 2553694 - RNA, 17 nt, Human
caugguccgguguccuu

SEQ ID NO: 2553695 - RNA, 16 nt, Human
cauggugaauuaauca

SEQ ID NO: 2553696 - RNA, 20 nt, Human
caugguccgguguccuuuuc

SEQ ID NO: 2553697 - RNA, 21 nt, Human
cauggugaaaauguacugaga

SEQ ID NO: 2553698 - RNA, 16 nt, Human
cauggugccccaggac

SEQ ID NO: 2553699 - RNA, 17 nt, Human
cauggugccccaggacc

SEQ ID NO: 2553700 - RNA, 18 nt, Human
cauggugccccaggacca

SEQ ID NO: 2553701 - RNA, 19 nt, Human
cauggugccccaggaccag

SEQ ID NO: 2553702 - RNA, 20 nt, Human
cauggugccccaggaccagc

SEQ ID NO: 2553703 - RNA, 22 nt, Human
cauggugccccaggaccagcuc

SEQ ID NO: 2553704 - RNA, 13 nt, Human
cauggugccugag

SEQ ID NO: 2553705 - RNA, 14 nt, Human
cauggugccugaga

SEQ ID NO: 2553706 - RNA, 19 nt, Human
cauguccuuguguguuuug

SEQ ID NO: 2553707 - RNA, 15 nt, Human
caugucgccucugca

SEQ ID NO: 2553708 - RNA, 14 nt, Human
caugucgccucugc

SEQ ID NO: 2553709 - RNA, 17 nt, Human
caugucgcgcucagcau

SEQ ID NO: 2553710 - RNA, 21 nt, Human
cauguccuuagcacagggggg

SEQ ID NO: 2553711 - RNA, 22 nt, Human
cauguccuuguguguuuugaga

SEQ ID NO: 2553712 - RNA, 19 nt, Human
caugucgcgcucagcaugc

SEQ ID NO: 2553713 - RNA, 23 nt, Human
caugucuuguacauguguagccu

SEQ ID NO: 2553714 - RNA, 20 nt, Human
caugucgccucugcauucag

SEQ ID NO: 2553715 - RNA, 18 nt, Human
caugucgccucugcauuc

SEQ ID NO: 2553716 - RNA, 22 nt, Human
cauguacaguguucuguuuaau

SEQ ID NO: 2553717 - RNA, 21 nt, Human
cauguacaguguucuguuuaa

SEQ ID NO: 2553718 - RNA, 20 nt, Human
cauguacaguguucuguuua

SEQ ID NO: 2553719 - RNA, 19 nt, Human
cauguacaguguucuguuu

SEQ ID NO: 2553720 - RNA, 15 nt, Human
cauguacaguguucu

SEQ ID NO: 2553721 - RNA, 11 nt, Human
cauguacagug

SEQ ID NO: 2553722 - RNA, 10 nt, Human
cauguacagu

SEQ ID NO: 2553723 - RNA, 22 nt, Human
cauguacagagaacuaacacua

SEQ ID NO: 2553724 - RNA, 13 nt, Human
cauguacagagaa

SEQ ID NO: 2553725 - RNA, 21 nt, Human
cauguacaaaaucgauuggcu

SEQ ID NO: 2553726 - RNA, 23 nt, Human
cauguacaaaaucgauuggcuuu

SEQ ID NO: 2553727 - RNA, 14 nt, Human
cauguaaucaguuu

SEQ ID NO: 2553728 - RNA, 15 nt, Human
cauguacaaaaccau

SEQ ID NO: 2553729 - RNA, 18 nt, Human
cauguaauuaaguacuau

SEQ ID NO: 2553730 - RNA, 21 nt, Human
cauguaauuaaguacuaugua

SEQ ID NO: 2553731 - RNA, 23 nt, Human
caugucuuuucuugcaugaggcu

SEQ ID NO: 2553732 - RNA, 21 nt, Human
caugucuuuucuugcaugagg

SEQ ID NO: 2553733 - RNA, 19 nt, Human
caugucuuuucuugcauga

SEQ ID NO: 2553734 - RNA, 14 nt, Human
caugucuuuucuug

SEQ ID NO: 2553735 - RNA, 17 nt, Human
caugugaaaucauucau

SEQ ID NO: 2553736 - RNA, 16 nt, Human
caugugaaaucauuca

SEQ ID NO: 2553737 - RNA, 15 nt, Human
caugugaaaucauuc

SEQ ID NO: 2553738 - RNA, 18 nt, Human
caugugaaaccuuuuuua

SEQ ID NO: 2553739 - RNA, 14 nt, Human
caugugaaaccuuu

SEQ ID NO: 2553740 - RNA, 13 nt, Human
caugugaaaccuu

SEQ ID NO: 2553741 - RNA, 12 nt, Human
caugugaaaccu

SEQ ID NO: 2553742 - RNA, 19 nt, Human
caugugaaaaucaaauaca

SEQ ID NO: 2553743 - RNA, 17 nt, Human
caugugaaaaucaaaua

SEQ ID NO: 2553744 - RNA, 19 nt, Human
caugccagcuuaucucagg

SEQ ID NO: 2553745 - RNA, 20 nt, Human
caugccagcuuaucucaggg

SEQ ID NO: 2553746 - RNA, 17 nt, Human
caugccacaaggacuuc

SEQ ID NO: 2553747 - RNA, 21 nt, Human
caugccacaaggacuuccugu

SEQ ID NO: 2553748 - RNA, 17 nt, Human
caugcauuugaggucaa

SEQ ID NO: 2553749 - RNA, 14 nt, Human
caugcauuuugcag

SEQ ID NO: 2553750 - RNA, 18 nt, Human
caugccaagcacugugcu

SEQ ID NO: 2553751 - RNA, 21 nt, Human
caugccagcuacuuccuccuc

SEQ ID NO: 2553752 - RNA, 21 nt, Human
caugccaccauggccagccaa

SEQ ID NO: 2553753 - RNA, 19 nt, Human
caugccacuacacuccagc

SEQ ID NO: 2553754 - RNA, 17 nt, Human
caugcauguccuguaaa

SEQ ID NO: 2553755 - RNA, 18 nt, Human
caugcauguccuguaaag

SEQ ID NO: 2553756 - RNA, 18 nt, Human
caugcauguuaugcuuua

SEQ ID NO: 2553757 - RNA, 14 nt, Human
caugcaugugcuug

SEQ ID NO: 2553758 - RNA, 21 nt, Human
caugcauguccuguaaagguu

SEQ ID NO: 2553759 - RNA, 15 nt, Human
caugcauggaaauuc

SEQ ID NO: 2553760 - RNA, 16 nt, Human
caugcauguccuguaa

SEQ ID NO: 2553761 - RNA, 17 nt, Human
caugcauggaaauuccc

SEQ ID NO: 2553762 - RNA, 15 nt, Human
caugcauuacugcau

SEQ ID NO: 2553763 - RNA, 17 nt, Human
caugcauuacugcaugc

SEQ ID NO: 2553764 - RNA, 20 nt, Human
caugcauuacugcaugcacu

SEQ ID NO: 2553765 - RNA, 11 nt, Human
caugcauuguu

SEQ ID NO: 2553766 - RNA, 14 nt, Human
caugcauucauaca

SEQ ID NO: 2553767 - RNA, 17 nt, Human
caugcauuguugaggug

SEQ ID NO: 2553768 - RNA, 20 nt, Human
caugcauuguugaggugguc

SEQ ID NO: 2553769 - RNA, 22 nt, Human
caugcauuguugagguggucug

SEQ ID NO: 2553770 - RNA, 20 nt, Human
caugcauuuugcagcaguga

SEQ ID NO: 2553771 - RNA, 13 nt, Human
caugcccaccccc

SEQ ID NO: 2553772 - RNA, 17 nt, Human
caugccagugacacuuc

SEQ ID NO: 2553773 - RNA, 19 nt, Human
caugcauuuugcagcagug

SEQ ID NO: 2553774 - RNA, 22 nt, Human
caugcccacccccugcccugca

SEQ ID NO: 2553775 - RNA, 21 nt, Human
caugcccacccccugcccugc

SEQ ID NO: 2553776 - RNA, 20 nt, Human
caugcccacccccugcccug

SEQ ID NO: 2553777 - RNA, 19 nt, Human
caugcccacccccugcccu

SEQ ID NO: 2553778 - RNA, 18 nt, Human
caugcccacccccugccc

SEQ ID NO: 2553779 - RNA, 17 nt, Human
caugcccacccccugcc

SEQ ID NO: 2553780 - RNA, 16 nt, Human
caugcccacccccugc

SEQ ID NO: 2553781 - RNA, 15 nt, Human
caugcccacccccug

SEQ ID NO: 2553782 - RNA, 13 nt, Human
caugcccaccugc

SEQ ID NO: 2553783 - RNA, 14 nt, Human
caugcccaccugcc

SEQ ID NO: 2553784 - RNA, 16 nt, Human
caugcccaccugccca

SEQ ID NO: 2553785 - RNA, 17 nt, Human
caugcccaccugcccau

SEQ ID NO: 2553786 - RNA, 18 nt, Human
caugccccggccaccucu

SEQ ID NO: 2553787 - RNA, 17 nt, Human
caugccccggccaccuc

SEQ ID NO: 2553788 - RNA, 16 nt, Human
caugccccggccaccu

SEQ ID NO: 2553789 - RNA, 15 nt, Human
caugcccccuuucag

SEQ ID NO: 2553790 - RNA, 19 nt, Human
caugcccccucgugccagu

SEQ ID NO: 2553791 - RNA, 17 nt, Human
caugcccccucgugcca

SEQ ID NO: 2553792 - RNA, 16 nt, Human
caugcccccucgugcc

SEQ ID NO: 2553793 - RNA, 13 nt, Human
caugccccugaac

SEQ ID NO: 2553794 - RNA, 15 nt, Human
caugcccccucgugc

SEQ ID NO: 2553795 - RNA, 23 nt, Human
caugccccccucaaaccuccucu

SEQ ID NO: 2553796 - RNA, 21 nt, Human
caugccccccucaaaccuccu

SEQ ID NO: 2553797 - RNA, 19 nt, Human
caugccccccucaaaccuc

SEQ ID NO: 2553798 - RNA, 14 nt, Human
caugccccccucaa

SEQ ID NO: 2553799 - RNA, 13 nt, Human
caugccccccuca

SEQ ID NO: 2553800 - RNA, 22 nt, Human
caugcccagucgauaucucacu

SEQ ID NO: 2553801 - RNA, 23 nt, Human
caugcccacccccugcccugcac

SEQ ID NO: 2553802 - RNA, 21 nt, Human
caugcccaccugcccaucaca

SEQ ID NO: 2553803 - RNA, 14 nt, Human
caugcaucuuacug

SEQ ID NO: 2553804 - RNA, 16 nt, Human
caugcaucuuacugaa

SEQ ID NO: 2553805 - RNA, 17 nt, Human
caugcaucuuacugaag

SEQ ID NO: 2553806 - RNA, 21 nt, Human
caugcauacuucaaaaguauu

SEQ ID NO: 2553807 - RNA, 15 nt, Human
caugcaucuccaccu

SEQ ID NO: 2553808 - RNA, 18 nt, Human
caugcaucuccaccugcu

SEQ ID NO: 2553809 - RNA, 17 nt, Human
caugcaucuccaccugc

SEQ ID NO: 2553810 - RNA, 16 nt, Human
caugcaucuccaccug

SEQ ID NO: 2553811 - RNA, 14 nt, Human
caugcaucaaguua

SEQ ID NO: 2553812 - RNA, 15 nt, Human
caugcauacacacac

SEQ ID NO: 2553813 - RNA, 16 nt, Human
caugcauacacacaca

SEQ ID NO: 2553814 - RNA, 23 nt, Human
caugcauacacacacacacacag

SEQ ID NO: 2553815 - RNA, 15 nt, Human
caugcauacuucaaa

SEQ ID NO: 2553816 - RNA, 20 nt, Human
caugcauacuucaaaaguau

SEQ ID NO: 2553817 - RNA, 17 nt, Human
caugcauacuucaaaag

SEQ ID NO: 2553818 - RNA, 16 nt, Human
caugcauacuucaaaa

SEQ ID NO: 2553819 - RNA, 22 nt, Human
caugcauaaauaugcagugaua

SEQ ID NO: 2553820 - RNA, 11 nt, Human
caugcauacac

SEQ ID NO: 2553821 - RNA, 12 nt, Human
caugcauacaca

SEQ ID NO: 2553822 - RNA, 13 nt, Human
caugcauacacac

SEQ ID NO: 2553823 - RNA, 14 nt, Human
caugcauacacaca

SEQ ID NO: 2553824 - RNA, 19 nt, Human
caugcauaaauaugcagug

SEQ ID NO: 2553825 - RNA, 18 nt, Human
caugcauaaauaugcagu

SEQ ID NO: 2553826 - RNA, 17 nt, Human
caugcauaaauaugcag

SEQ ID NO: 2553827 - RNA, 16 nt, Human
caugcauaaauaugca

SEQ ID NO: 2553828 - RNA, 15 nt, Human
caugcauaaauaugc

SEQ ID NO: 2553829 - RNA, 13 nt, Human
caugcauaaauau

SEQ ID NO: 2553830 - RNA, 20 nt, Human
caugcagcugcacccucccu

SEQ ID NO: 2553831 - RNA, 12 nt, Human
caugcauaaaua

SEQ ID NO: 2553832 - RNA, 21 nt, Human
caugcagcugcacccucccuc

SEQ ID NO: 2553833 - RNA, 15 nt, Human
caugcagcugcaccc

SEQ ID NO: 2553834 - RNA, 20 nt, Human
caugcccuccucucccauug

SEQ ID NO: 2553835 - RNA, 13 nt, Human
caugcccuccucu

SEQ ID NO: 2553836 - RNA, 14 nt, Human
caugcccuccucuc

SEQ ID NO: 2553837 - RNA, 15 nt, Human
caugcccuccucucc

SEQ ID NO: 2553838 - RNA, 17 nt, Human
caugcccuccucuccca

SEQ ID NO: 2553839 - RNA, 14 nt, Human
caugcccugugcaa

SEQ ID NO: 2553840 - RNA, 18 nt, Human
caugcccugugcaaccuc

SEQ ID NO: 2553841 - RNA, 19 nt, Human
caugcccugugcaaccucu

SEQ ID NO: 2553842 - RNA, 14 nt, Human
caugccccuggcug

SEQ ID NO: 2553843 - RNA, 21 nt, Human
caugccccggccaccucugcg

SEQ ID NO: 2553844 - RNA, 20 nt, Human
caugccccggccaccucugc

SEQ ID NO: 2553845 - RNA, 19 nt, Human
caugccccggccaccucug

SEQ ID NO: 2553846 - RNA, 15 nt, Human
caugccccuggcugg

SEQ ID NO: 2553847 - RNA, 16 nt, Human
caugccccuggcuggg

SEQ ID NO: 2553848 - RNA, 21 nt, Human
caugcccggcuaauuuuugua

SEQ ID NO: 2553849 - RNA, 15 nt, Human
caugccucucucagg

SEQ ID NO: 2553850 - RNA, 14 nt, Human
caugccucucucag

SEQ ID NO: 2553851 - RNA, 20 nt, Human
caugcccuguucagcuacuc

SEQ ID NO: 2553852 - RNA, 23 nt, Human
caugcccugugcaaccucuuggc

SEQ ID NO: 2553853 - RNA, 14 nt, Human
caugccgggcgcag

SEQ ID NO: 2553854 - RNA, 16 nt, Human
caugccucagcccuga

SEQ ID NO: 2553855 - RNA, 14 nt, Human
caugccucagcccu

SEQ ID NO: 2553856 - RNA, 11 nt, Human
caugccucagc

SEQ ID NO: 2553857 - RNA, 19 nt, Human
caugccucucucaggccaa

SEQ ID NO: 2553858 - RNA, 18 nt, Human
caugccucucucaggcca

SEQ ID NO: 2553859 - RNA, 17 nt, Human
caugccucucucaggcc

SEQ ID NO: 2553860 - RNA, 16 nt, Human
caugccucucucaggc

SEQ ID NO: 2553861 - RNA, 15 nt, Human
caugccugagggugg

SEQ ID NO: 2553862 - RNA, 13 nt, Human
caugccugagggu

SEQ ID NO: 2553863 - RNA, 11 nt, Human
caugccugagg

SEQ ID NO: 2553864 - RNA, 13 nt, Human
caugccuggaugg

SEQ ID NO: 2553865 - RNA, 20 nt, Human
caugccucagcccugacccu

SEQ ID NO: 2553866 - RNA, 19 nt, Human
caugccucagcccugaccc

SEQ ID NO: 2553867 - RNA, 17 nt, Human
caugggacagggaggac

SEQ ID NO: 2553868 - RNA, 22 nt, Human
caugggaaugaaugucagugug

SEQ ID NO: 2553869 - RNA, 15 nt, Human
caugggccuccugug

SEQ ID NO: 2553870 - RNA, 17 nt, Human
caugggcccaggaaugc

SEQ ID NO: 2553871 - RNA, 21 nt, Human
cauggcagaauaaucuuuggg

SEQ ID NO: 2553872 - RNA, 22 nt, Human
cauggcagaauaaucuuugggu

SEQ ID NO: 2553873 - RNA, 17 nt, Human
caugggccuccugugug

SEQ ID NO: 2553874 - RNA, 16 nt, Human
caugggccuccugugu

SEQ ID NO: 2553875 - RNA, 17 nt, Human
cauggggcugggcagcu

SEQ ID NO: 2553876 - RNA, 23 nt, Human
cauggggagggauucugguucca

SEQ ID NO: 2553877 - RNA, 19 nt, Human
cauggggcugauuguauuu

SEQ ID NO: 2553878 - RNA, 20 nt, Human
cauggggagggauucugguu

SEQ ID NO: 2553879 - RNA, 11 nt, Human
cauggggaggg

SEQ ID NO: 2553880 - RNA, 19 nt, Human
cauggcacuugcaucugug

SEQ ID NO: 2553881 - RNA, 15 nt, Human
cauggggugggccuc

SEQ ID NO: 2553882 - RNA, 13 nt, Human
cauggggugggcc

SEQ ID NO: 2553883 - RNA, 19 nt, Human
cauggggugaugcugggcu

SEQ ID NO: 2553884 - RNA, 15 nt, Human
caugggguaggagga

SEQ ID NO: 2553885 - RNA, 13 nt, Human
caugggggcaggg

SEQ ID NO: 2553886 - RNA, 14 nt, Human
caugggggcagggc

SEQ ID NO: 2553887 - RNA, 19 nt, Human
caugggggcagggcaugac

SEQ ID NO: 2553888 - RNA, 19 nt, Human
cauggggugggccucuggu

SEQ ID NO: 2553889 - RNA, 18 nt, Human
cauggggugggccucugg

SEQ ID NO: 2553890 - RNA, 17 nt, Human
cauggggugggccucug

SEQ ID NO: 2553891 - RNA, 16 nt, Human
cauggggugggccucu

SEQ ID NO: 2553892 - RNA, 17 nt, Human
cauggucacacacugau

SEQ ID NO: 2553893 - RNA, 21 nt, Human
cauggucacacacugaugcuu

SEQ ID NO: 2553894 - RNA, 19 nt, Human
cauggucagcccuagggug

SEQ ID NO: 2553895 - RNA, 16 nt, Human
cauggucagcccuagg

SEQ ID NO: 2553896 - RNA, 13 nt, Human
cauggacuuuguu

SEQ ID NO: 2553897 - RNA, 11 nt, Human
cauggacuuug

SEQ ID NO: 2553898 - RNA, 17 nt, Human
cauggacuuguauauuu

SEQ ID NO: 2553899 - RNA, 11 nt, Human
cauggagaaac

SEQ ID NO: 2553900 - RNA, 14 nt, Human
cauggagaaacccu

SEQ ID NO: 2553901 - RNA, 15 nt, Human
cauggagaaacccug

SEQ ID NO: 2553902 - RNA, 16 nt, Human
cauggagaaacccugu

SEQ ID NO: 2553903 - RNA, 17 nt, Human
cauggagaaacccuguc

SEQ ID NO: 2553904 - RNA, 20 nt, Human
cauggagaaacccugucucu

SEQ ID NO: 2553905 - RNA, 10 nt, Human
cauggagcca

SEQ ID NO: 2553906 - RNA, 21 nt, Human
cauggagauagccccacagga

SEQ ID NO: 2553907 - RNA, 17 nt, Human
cauggagguuugaagau

SEQ ID NO: 2553908 - RNA, 17 nt, Human
cauggagagcuggagcc

SEQ ID NO: 2553909 - RNA, 16 nt, Human
cauggagagcuggagc

SEQ ID NO: 2553910 - RNA, 14 nt, Human
cauggagagcugga

SEQ ID NO: 2553911 - RNA, 13 nt, Human
cauggagagcugg

SEQ ID NO: 2553912 - RNA, 14 nt, Human
cauggagagcuaga

SEQ ID NO: 2553913 - RNA, 21 nt, Human
cauggagacuccugcccuguu

SEQ ID NO: 2553914 - RNA, 20 nt, Human
cauggagacuccugcccugu

SEQ ID NO: 2553915 - RNA, 19 nt, Human
cauggagacuccugcccug

SEQ ID NO: 2553916 - RNA, 16 nt, Human
cauggagacuccugcc

SEQ ID NO: 2553917 - RNA, 15 nt, Human
cauggagacuccugc

SEQ ID NO: 2553918 - RNA, 17 nt, Human
cauggagaaguuaucag

SEQ ID NO: 2553919 - RNA, 12 nt, Human
cauggagaaguu

SEQ ID NO: 2553920 - RNA, 15 nt, Human
cauggagaagcagaa

SEQ ID NO: 2553921 - RNA, 21 nt, Human
cauggagagcuggagccuggu

SEQ ID NO: 2553922 - RNA, 20 nt, Human
cauggagagcuggagccugg

SEQ ID NO: 2553923 - RNA, 16 nt, Human
cauggaguauauguca

SEQ ID NO: 2553924 - RNA, 18 nt, Human
cauggauauaguuuuacu

SEQ ID NO: 2553925 - RNA, 15 nt, Human
cauggaugagagucc

SEQ ID NO: 2553926 - RNA, 21 nt, Human
cauggaguguguauuguuccc

SEQ ID NO: 2553927 - RNA, 18 nt, Human
cauggaguguguauuguu

SEQ ID NO: 2553928 - RNA, 20 nt, Human
cauggaguguguauuguucc

SEQ ID NO: 2553929 - RNA, 22 nt, Human
cauggaguguguauuguuccca

SEQ ID NO: 2553930 - RNA, 14 nt, Human
cauggaguguguau

SEQ ID NO: 2553931 - RNA, 17 nt, Human
cauggaguguguauugu

SEQ ID NO: 2553932 - RNA, 23 nt, Human
cauggcaccuucagacuuugcuu

SEQ ID NO: 2553933 - RNA, 18 nt, Human
cauggcacuugcaucugu

SEQ ID NO: 2553934 - RNA, 16 nt, Human
cauggcacuugcaucu

SEQ ID NO: 2553935 - RNA, 13 nt, Human
cauggcagaaggc

SEQ ID NO: 2553936 - RNA, 18 nt, Human
caugggaaugaaugucag

SEQ ID NO: 2553937 - RNA, 19 nt, Human
cauggcaccaaagccacca

SEQ ID NO: 2553938 - RNA, 20 nt, Human
cauggcaccaaagccaccag

SEQ ID NO: 2553939 - RNA, 22 nt, Human
cauggcaccuucagacuuugcu

SEQ ID NO: 2553940 - RNA, 22 nt, Human
cauggauguuuuagccauuguu

SEQ ID NO: 2553941 - RNA, 19 nt, Human
cauggaugggggaacucag

SEQ ID NO: 2553942 - RNA, 12 nt, Human
cauggauguuuu

SEQ ID NO: 2553943 - RNA, 22 nt, Human
cauggaaguacuauaauuuacc

SEQ ID NO: 2553944 - RNA, 20 nt, Human
cauggaaguacuauaauuua

SEQ ID NO: 2553945 - RNA, 16 nt, Human
cauggaacucauuccu

SEQ ID NO: 2553946 - RNA, 19 nt, Human
caugcuuagucacugccug

SEQ ID NO: 2553947 - RNA, 18 nt, Human
caugcuuagucacugccu

SEQ ID NO: 2553948 - RNA, 21 nt, Human
caugcuuagucacugccugca

SEQ ID NO: 2553949 - RNA, 17 nt, Human
caugcuuagucacugcc

SEQ ID NO: 2553950 - RNA, 16 nt, Human
caugcuuagucacugc

SEQ ID NO: 2553951 - RNA, 15 nt, Human
caugcuuagucacug

SEQ ID NO: 2553952 - RNA, 23 nt, Human
caugcuguugauugcuaaaugua

SEQ ID NO: 2553953 - RNA, 22 nt, Human
caugcuguugauugcuaaaugu

SEQ ID NO: 2553954 - RNA, 21 nt, Human
caugcuguugauugcuaaaug

SEQ ID NO: 2553955 - RNA, 20 nt, Human
caugcuguugauugcuaaau

SEQ ID NO: 2553956 - RNA, 19 nt, Human
caugcuguugauugcuaaa

SEQ ID NO: 2553957 - RNA, 18 nt, Human
caugcuguugauugcuaa

SEQ ID NO: 2553958 - RNA, 17 nt, Human
caugcuguugauugcua

SEQ ID NO: 2553959 - RNA, 16 nt, Human
caugcuguugauugcu

SEQ ID NO: 2553960 - RNA, 19 nt, Human
caugcugugauugugccua

SEQ ID NO: 2553961 - RNA, 17 nt, Human
cauggaaugguuauaaa

SEQ ID NO: 2553962 - RNA, 15 nt, Human
cauggaaugguuaua

SEQ ID NO: 2553963 - RNA, 14 nt, Human
cauggaaugguuau

SEQ ID NO: 2553964 - RNA, 20 nt, Human
cauggaaugcuugaaaaaug

SEQ ID NO: 2553965 - RNA, 21 nt, Human
cauggaaugcuugaaaaaugu

SEQ ID NO: 2553966 - RNA, 18 nt, Human
cauggaaugcuugaaaaa

SEQ ID NO: 2553967 - RNA, 15 nt, Human
cauggaaugcuugaa

SEQ ID NO: 2553968 - RNA, 22 nt, Human
cauggaaugguuauaaaaguga

SEQ ID NO: 2553969 - RNA, 21 nt, Human
cauggaaugguuauaaaagug

SEQ ID NO: 2553970 - RNA, 12 nt, Human
cauggacacucc

SEQ ID NO: 2553971 - RNA, 16 nt, Human
cauggaauaacaugua

SEQ ID NO: 2553972 - RNA, 13 nt, Human
cauggaagauuga

SEQ ID NO: 2553973 - RNA, 21 nt, Human
cauggaacucauuccugccug

SEQ ID NO: 2553974 - RNA, 17 nt, Human
cauggaacucauuccug

SEQ ID NO: 2553975 - RNA, 19 nt, Human
cauggaacucauuccugcc

SEQ ID NO: 2553976 - RNA, 22 nt, Human
cauggacuuguauauuuguaca

SEQ ID NO: 2553977 - RNA, 16 nt, Human
cauggacuuguauauu

SEQ ID NO: 2553978 - RNA, 13 nt, Human
cauggacuuguau

SEQ ID NO: 2553979 - RNA, 12 nt, Human
cauggacuugua

SEQ ID NO: 2553980 - RNA, 18 nt, Human
cauggacaugaucuucuu

SEQ ID NO: 2553981 - RNA, 14 nt, Human
cauggacaggcugg

SEQ ID NO: 2553982 - RNA, 15 nt, Human
cauggacaggcuggc

SEQ ID NO: 2553983 - RNA, 16 nt, Human
cauggacaggcuggcu

SEQ ID NO: 2553984 - RNA, 18 nt, Human
cauggacaggcuggcucc

SEQ ID NO: 2553985 - RNA, 19 nt, Human
cauggacacuccagugcca

SEQ ID NO: 2553986 - RNA, 18 nt, Human
cauggacacuccagugcc

SEQ ID NO: 2553987 - RNA, 14 nt, Human
cauggacacuccag

SEQ ID NO: 2553988 - RNA, 21 nt, Human
cauggacagaagaaggcagca

SEQ ID NO: 2553989 - RNA, 15 nt, Human
cauggacagaagaag

SEQ ID NO: 2553990 - RNA, 17 nt, Human
caugcugucccuuacgu

SEQ ID NO: 2553991 - RNA, 23 nt, Human
caugcugucuacacuaagagaga

SEQ ID NO: 2553992 - RNA, 22 nt, Human
caugcugucccuuacgugaguc

SEQ ID NO: 2553993 - RNA, 15 nt, Human
caugcgcucagggcc

SEQ ID NO: 2553994 - RNA, 13 nt, Human
caugcgguagcca

SEQ ID NO: 2553995 - RNA, 17 nt, Human
caugcgggcuuccuccu

SEQ ID NO: 2553996 - RNA, 14 nt, Human
caugcgguagccag

SEQ ID NO: 2553997 - RNA, 15 nt, Human
caugcgguagccagc

SEQ ID NO: 2553998 - RNA, 16 nt, Human
caugcgguagccagca

SEQ ID NO: 2553999 - RNA, 17 nt, Human
caugcgguagccagcac

SEQ ID NO: 2554000 - RNA, 19 nt, Human
caugcgguagccagcacac

SEQ ID NO: 2554001 - RNA, 21 nt, Human
caugcgguagccagcacacag

SEQ ID NO: 2554002 - RNA, 16 nt, Human
caugcguguuucugac

SEQ ID NO: 2554003 - RNA, 13 nt, Human
caugcgcacaagg

SEQ ID NO: 2554004 - RNA, 17 nt, Human
caugcguguuucugacu

SEQ ID NO: 2554005 - RNA, 21 nt, Human
caugccuggauggggcugcac

SEQ ID NO: 2554006 - RNA, 18 nt, Human
caugccuggauggggcug

SEQ ID NO: 2554007 - RNA, 23 nt, Human
caugccuggauggggcugcaccg

SEQ ID NO: 2554008 - RNA, 20 nt, Human
caugccugaggguggagacu

SEQ ID NO: 2554009 - RNA, 16 nt, Human
caugccugagggugga

SEQ ID NO: 2554010 - RNA, 20 nt, Human
caugccugccccaaacaaau

SEQ ID NO: 2554011 - RNA, 13 nt, Human
caugccuggcuuc

SEQ ID NO: 2554012 - RNA, 20 nt, Human
caugccugccccccucaucu

SEQ ID NO: 2554013 - RNA, 16 nt, Human
caugccuguccagccu

SEQ ID NO: 2554014 - RNA, 17 nt, Human
caugccuguccagccug

SEQ ID NO: 2554015 - RNA, 18 nt, Human
caugccuguccagccugg

SEQ ID NO: 2554016 - RNA, 20 nt, Human
caugccuguccagccugggc

SEQ ID NO: 2554017 - RNA, 23 nt, Human
caugccuguccagccugggcagc

SEQ ID NO: 2554018 - RNA, 21 nt, Human
caugccuguccagccugggca

SEQ ID NO: 2554019 - RNA, 14 nt, Human
caugccuggcuucg

SEQ ID NO: 2554020 - RNA, 23 nt, Human
caugccugugugacaucaguggc

SEQ ID NO: 2554021 - RNA, 13 nt, Human
caugccuuccagc

SEQ ID NO: 2554022 - RNA, 15 nt, Human
caugccuuccagcac

SEQ ID NO: 2554023 - RNA, 19 nt, Human
caugccuuccagcacccug

SEQ ID NO: 2554024 - RNA, 21 nt, Human
caugccuuccagcacccugca

SEQ ID NO: 2554025 - RNA, 20 nt, Human
caugccuuccagcacccugc

SEQ ID NO: 2554026 - RNA, 14 nt, Human
caugcgcucagggc

SEQ ID NO: 2554027 - RNA, 23 nt, Human
caugcgcccccuccgcccugcca

SEQ ID NO: 2554028 - RNA, 21 nt, Human
caugcgcccccuccgcccugc

SEQ ID NO: 2554029 - RNA, 23 nt, Human
ccauguuggccaggcuggucuca

SEQ ID NO: 2554030 - RNA, 16 nt, Human
ccauagcuccugcucc

SEQ ID NO: 2554031 - RNA, 18 nt, Human
ccauauucuguuggccag

SEQ ID NO: 2554032 - RNA, 15 nt, Human
ccauauucuguuggc

SEQ ID NO: 2554033 - RNA, 19 nt, Human
ccauauuaccacagacaua

SEQ ID NO: 2554034 - RNA, 15 nt, Human
ccauagcuccugcuc

SEQ ID NO: 2554035 - RNA, 21 nt, Human
ccauagaugggucuggcugag

SEQ ID NO: 2554036 - RNA, 18 nt, Human
ccauagccaccccagaaa

SEQ ID NO: 2554037 - RNA, 23 nt, Human
ccauagagagcaagacgcugugc

SEQ ID NO: 2554038 - RNA, 13 nt, Human
ccaguggucucac

SEQ ID NO: 2554039 - RNA, 15 nt, Human
ccagugguauccugu

SEQ ID NO: 2554040 - RNA, 13 nt, Human
ccauagaguuuaa

SEQ ID NO: 2554041 - RNA, 17 nt, Human
ccaguggucucacaugg

SEQ ID NO: 2554042 - RNA, 17 nt, Human
ccauagaguuuaacaca

SEQ ID NO: 2554043 - RNA, 16 nt, Human
ccauagaguuuaacac

SEQ ID NO: 2554044 - RNA, 18 nt, Human
ccauagcaagauugcuua

SEQ ID NO: 2554045 - RNA, 21 nt, Human
ccauagcaagauugcuuaaaa

SEQ ID NO: 2554046 - RNA, 19 nt, Human
ccaucacgcggccgagaca

SEQ ID NO: 2554047 - RNA, 16 nt, Human
ccaucacgccugugca

SEQ ID NO: 2554048 - RNA, 12 nt, Human
ccaucacccgcu

SEQ ID NO: 2554049 - RNA, 18 nt, Human
ccaucaacaaaaauuguc

SEQ ID NO: 2554050 - RNA, 16 nt, Human
ccaucaaaaugcuuuu

SEQ ID NO: 2554051 - RNA, 19 nt, Human
ccaucaaaaugcuuuuuau

SEQ ID NO: 2554052 - RNA, 17 nt, Human
ccaucaacaaaaauugu

SEQ ID NO: 2554053 - RNA, 15 nt, Human
ccaucaaaaauauuc

SEQ ID NO: 2554054 - RNA, 12 nt, Human
ccauauuuauuc

SEQ ID NO: 2554055 - RNA, 22 nt, Human
ccauauucagugcuguggccug

SEQ ID NO: 2554056 - RNA, 16 nt, Human
ccaucgcugucaucuc

SEQ ID NO: 2554057 - RNA, 12 nt, Human
ccaucgccggga

SEQ ID NO: 2554058 - RNA, 14 nt, Human
ccaucgcugugugu

SEQ ID NO: 2554059 - RNA, 22 nt, Human
ccaucgccgggacuccagaacc

SEQ ID NO: 2554060 - RNA, 17 nt, Human
ccauccugucccaccau

SEQ ID NO: 2554061 - RNA, 16 nt, Human
ccauccugucccacca

SEQ ID NO: 2554062 - RNA, 14 nt, Human
ccauccugucccac

SEQ ID NO: 2554063 - RNA, 17 nt, Human
ccauccuggcccaucag

SEQ ID NO: 2554064 - RNA, 16 nt, Human
ccauccuggcccauca

SEQ ID NO: 2554065 - RNA, 14 nt, Human
ccauccuggcccau

SEQ ID NO: 2554066 - RNA, 17 nt, Human
ccauccuuucugccucu

SEQ ID NO: 2554067 - RNA, 16 nt, Human
ccauccuuucugccuc

SEQ ID NO: 2554068 - RNA, 20 nt, Human
ccauccuuucugccucucaa

SEQ ID NO: 2554069 - RNA, 20 nt, Human
ccauccuucccugucugcca

SEQ ID NO: 2554070 - RNA, 20 nt, Human
ccaucucaugccccuggcug

SEQ ID NO: 2554071 - RNA, 21 nt, Human
ccaucucaugccccuggcugg

SEQ ID NO: 2554072 - RNA, 22 nt, Human
ccaucucaggccaccugccccc

SEQ ID NO: 2554073 - RNA, 23 nt, Human
ccaucucaggccaccugcccccu

SEQ ID NO: 2554074 - RNA, 16 nt, Human
ccaucucaggccaccu

SEQ ID NO: 2554075 - RNA, 17 nt, Human
ccaucucaggccaccug

SEQ ID NO: 2554076 - RNA, 18 nt, Human
ccaucucaggccaccugc

SEQ ID NO: 2554077 - RNA, 20 nt, Human
ccaucucaggccaccugccc

SEQ ID NO: 2554078 - RNA, 21 nt, Human
ccaucucaggccaccugcccc

SEQ ID NO: 2554079 - RNA, 18 nt, Human
ccaucuccacccccagcu

SEQ ID NO: 2554080 - RNA, 13 nt, Human
ccaucuugguaaa

SEQ ID NO: 2554081 - RNA, 21 nt, Human
ccaucuccaagaaugcugaaa

SEQ ID NO: 2554082 - RNA, 19 nt, Human
ccaucuccaagaaugcuga

SEQ ID NO: 2554083 - RNA, 18 nt, Human
ccaucuccaagaaugcug

SEQ ID NO: 2554084 - RNA, 16 nt, Human
ccaucuccaagaaugc

SEQ ID NO: 2554085 - RNA, 20 nt, Human
ccaucucauguaucaucugg

SEQ ID NO: 2554086 - RNA, 17 nt, Human
ccaucuugguaaauuuc

SEQ ID NO: 2554087 - RNA, 14 nt, Human
ccaucuugguaaau

SEQ ID NO: 2554088 - RNA, 22 nt, Human
ccaucuccaagaaugcugaaac

SEQ ID NO: 2554089 - RNA, 18 nt, Human
ccaucuuugcagguugcu

SEQ ID NO: 2554090 - RNA, 16 nt, Human
ccaucaugucuggcua

SEQ ID NO: 2554091 - RNA, 14 nt, Human
ccaucaugucuggc

SEQ ID NO: 2554092 - RNA, 20 nt, Human
ccaucagaaacacccucaca

SEQ ID NO: 2554093 - RNA, 22 nt, Human
ccaucauguuuacagaggacag

SEQ ID NO: 2554094 - RNA, 20 nt, Human
ccaucauguuuacagaggac

SEQ ID NO: 2554095 - RNA, 18 nt, Human
ccaucagaaacacccuca

SEQ ID NO: 2554096 - RNA, 14 nt, Human
ccaucacuggagca

SEQ ID NO: 2554097 - RNA, 18 nt, Human
ccaucacuggagcaccag

SEQ ID NO: 2554098 - RNA, 15 nt, Human
ccauccugaggcucc

SEQ ID NO: 2554099 - RNA, 21 nt, Human
ccauccucuguacagagccca

SEQ ID NO: 2554100 - RNA, 16 nt, Human
ccauccugaggcucca

SEQ ID NO: 2554101 - RNA, 19 nt, Human
ccaggccugaaagaggcug

SEQ ID NO: 2554102 - RNA, 12 nt, Human
ccaggccugccu

SEQ ID NO: 2554103 - RNA, 18 nt, Human
ccaggccucuguguccuu

SEQ ID NO: 2554104 - RNA, 17 nt, Human
ccaggccucuguguccu

SEQ ID NO: 2554105 - RNA, 16 nt, Human
ccaggccucugugucc

SEQ ID NO: 2554106 - RNA, 15 nt, Human
ccaggccucuguguc

SEQ ID NO: 2554107 - RNA, 13 nt, Human
ccaggccucugug

SEQ ID NO: 2554108 - RNA, 19 nt, Human
ccaggccucuuggcaguca

SEQ ID NO: 2554109 - RNA, 18 nt, Human
ccaggccucuuggcaguc

SEQ ID NO: 2554110 - RNA, 16 nt, Human
ccaggccucuuggcag

SEQ ID NO: 2554111 - RNA, 17 nt, Human
ccaggccugggccagag

SEQ ID NO: 2554112 - RNA, 13 nt, Human
ccaggccugggcc

SEQ ID NO: 2554113 - RNA, 16 nt, Human
ccaggccugggucugu

SEQ ID NO: 2554114 - RNA, 17 nt, Human
ccaggccugggucugug

SEQ ID NO: 2554115 - RNA, 18 nt, Human
ccaggccugggucugugu

SEQ ID NO: 2554116 - RNA, 19 nt, Human
ccaggccugggucuguguc

SEQ ID NO: 2554117 - RNA, 20 nt, Human
ccaggccugggucugugucu

SEQ ID NO: 2554118 - RNA, 22 nt, Human
ccaggcgagagacuuguggccu

SEQ ID NO: 2554119 - RNA, 18 nt, Human
ccaggccuuaucuccaag

SEQ ID NO: 2554120 - RNA, 21 nt, Human
ccagugggaggggcaggcuga

SEQ ID NO: 2554121 - RNA, 20 nt, Human
ccagugggaggggcaggcug

SEQ ID NO: 2554122 - RNA, 19 nt, Human
ccagugggaggggcaggcu

SEQ ID NO: 2554123 - RNA, 18 nt, Human
ccagugggaggggcaggc

SEQ ID NO: 2554124 - RNA, 17 nt, Human
ccagugggaggggcagg

SEQ ID NO: 2554125 - RNA, 16 nt, Human
ccagugggaggggcag

SEQ ID NO: 2554126 - RNA, 15 nt, Human
ccagugggaggggca

SEQ ID NO: 2554127 - RNA, 14 nt, Human
ccagugggaggggc

SEQ ID NO: 2554128 - RNA, 23 nt, Human
ccagugggaggggcaggcugaca

SEQ ID NO: 2554129 - RNA, 22 nt, Human
ccagugggaggggcaggcugac

SEQ ID NO: 2554130 - RNA, 15 nt, Human
ccagugcggcagguu

SEQ ID NO: 2554131 - RNA, 19 nt, Human
ccaguggcugcugcccagg

SEQ ID NO: 2554132 - RNA, 13 nt, Human
ccagugggagggg

SEQ ID NO: 2554133 - RNA, 12 nt, Human
ccagugggaggg

SEQ ID NO: 2554134 - RNA, 14 nt, Human
ccagugggaggcgc

SEQ ID NO: 2554135 - RNA, 11 nt, Human
ccagugggagg

SEQ ID NO: 2554136 - RNA, 17 nt, Human
ccaguggcuguucugga

SEQ ID NO: 2554137 - RNA, 21 nt, Human
ccaguggcugcugcccaggcc

SEQ ID NO: 2554138 - RNA, 13 nt, Human
ccagugggaagau

SEQ ID NO: 2554139 - RNA, 14 nt, Human
ccagugcggcaggu

SEQ ID NO: 2554140 - RNA, 16 nt, Human
ccagugcgauucugga

SEQ ID NO: 2554141 - RNA, 21 nt, Human
ccagugccuuaccuccugccc

SEQ ID NO: 2554142 - RNA, 22 nt, Human
ccagugccuuaccuccugccca

SEQ ID NO: 2554143 - RNA, 15 nt, Human
ccagugcgauucugg

SEQ ID NO: 2554144 - RNA, 23 nt, Human
ccagugccuuaccuccugcccag

SEQ ID NO: 2554145 - RNA, 17 nt, Human
ccagugccuuaccuccu

SEQ ID NO: 2554146 - RNA, 18 nt, Human
ccagugccuuaccuccug

SEQ ID NO: 2554147 - RNA, 19 nt, Human
ccagugccuuaccuccugc

SEQ ID NO: 2554148 - RNA, 20 nt, Human
ccagugccuuaccuccugcc

SEQ ID NO: 2554149 - RNA, 13 nt, Human
ccagggagaccga

SEQ ID NO: 2554150 - RNA, 22 nt, Human
ccagggacaccagccaggcucu

SEQ ID NO: 2554151 - RNA, 21 nt, Human
ccagggacaccagccaggcuc

SEQ ID NO: 2554152 - RNA, 20 nt, Human
ccagggacaccagccaggcu

SEQ ID NO: 2554153 - RNA, 18 nt, Human
ccagggacaccagccagg

SEQ ID NO: 2554154 - RNA, 17 nt, Human
ccagggacaccagccag

SEQ ID NO: 2554155 - RNA, 16 nt, Human
ccagggacaccagcca

SEQ ID NO: 2554156 - RNA, 15 nt, Human
ccagggacaccagcc

SEQ ID NO: 2554157 - RNA, 14 nt, Human
ccagggacaccagc

SEQ ID NO: 2554158 - RNA, 18 nt, Human
ccagggaagugcucugau

SEQ ID NO: 2554159 - RNA, 17 nt, Human
ccagggaagugcucuga

SEQ ID NO: 2554160 - RNA, 16 nt, Human
ccagggaaguccccga

SEQ ID NO: 2554161 - RNA, 23 nt, Human
ccagggacaccagccaggcucug

SEQ ID NO: 2554162 - RNA, 13 nt, Human
ccagggacagagg

SEQ ID NO: 2554163 - RNA, 18 nt, Human
ccagggacagaggcccca

SEQ ID NO: 2554164 - RNA, 20 nt, Human
ccagggacagaggccccagc

SEQ ID NO: 2554165 - RNA, 23 nt, Human
ccagggacagaggccccagccuc

SEQ ID NO: 2554166 - RNA, 21 nt, Human
ccagggacagaggccccagcc

SEQ ID NO: 2554167 - RNA, 22 nt, Human
ccagggacagaggccccagccu

SEQ ID NO: 2554168 - RNA, 23 nt, Human
ccagggacagaggggguggccuc

SEQ ID NO: 2554169 - RNA, 21 nt, Human
ccagggagacagagcucacaa

SEQ ID NO: 2554170 - RNA, 15 nt, Human
ccagggagaagcucc

SEQ ID NO: 2554171 - RNA, 13 nt, Human
ccagggagaagcu

SEQ ID NO: 2554172 - RNA, 14 nt, Human
ccagggagaagcuc

SEQ ID NO: 2554173 - RNA, 19 nt, Human
ccaggcccucugcccacuc

SEQ ID NO: 2554174 - RNA, 18 nt, Human
ccaggcccucugcccacu

SEQ ID NO: 2554175 - RNA, 17 nt, Human
ccaggcccucugcccac

SEQ ID NO: 2554176 - RNA, 16 nt, Human
ccaggcccucugccca

SEQ ID NO: 2554177 - RNA, 15 nt, Human
ccaggcccggggcug

SEQ ID NO: 2554178 - RNA, 20 nt, Human
ccaggccagccuccgagagg

SEQ ID NO: 2554179 - RNA, 16 nt, Human
ccaggcccggggcugg

SEQ ID NO: 2554180 - RNA, 19 nt, Human
ccaggccuccuacagcuug

SEQ ID NO: 2554181 - RNA, 18 nt, Human
ccaggccuccuacagcuu

SEQ ID NO: 2554182 - RNA, 13 nt, Human
ccaggccuccuac

SEQ ID NO: 2554183 - RNA, 21 nt, Human
ccaggccucagucucccuucu

SEQ ID NO: 2554184 - RNA, 20 nt, Human
ccaggcccggggcuggcggc

SEQ ID NO: 2554185 - RNA, 19 nt, Human
ccaggccagccuccgagag

SEQ ID NO: 2554186 - RNA, 16 nt, Human
ccaggccagccuccga

SEQ ID NO: 2554187 - RNA, 15 nt, Human
ccaggccagccuccg

SEQ ID NO: 2554188 - RNA, 14 nt, Human
ccaggccagccucc

SEQ ID NO: 2554189 - RNA, 13 nt, Human
ccaggccagccuc

SEQ ID NO: 2554190 - RNA, 12 nt, Human
ccaggccagccu

SEQ ID NO: 2554191 - RNA, 11 nt, Human
ccaggccagcc

SEQ ID NO: 2554192 - RNA, 19 nt, Human
ccaggccccugccacccug

SEQ ID NO: 2554193 - RNA, 23 nt, Human
ccaggccccugccacccugggga

SEQ ID NO: 2554194 - RNA, 21 nt, Human
ccaggccccugccacccuggg

SEQ ID NO: 2554195 - RNA, 14 nt, Human
ccaggagcagccac

SEQ ID NO: 2554196 - RNA, 21 nt, Human
ccaggccagagggagugacag

SEQ ID NO: 2554197 - RNA, 14 nt, Human
ccaggccagaggga

SEQ ID NO: 2554198 - RNA, 23 nt, Human
ccaggaccagucaaccugggcaa

SEQ ID NO: 2554199 - RNA, 18 nt, Human
ccaggaccagcuggggcg

SEQ ID NO: 2554200 - RNA, 15 nt, Human
ccaggaccaucaucc

SEQ ID NO: 2554201 - RNA, 14 nt, Human
ccaggacccugaag

SEQ ID NO: 2554202 - RNA, 16 nt, Human
ccaggacccugaaggg

SEQ ID NO: 2554203 - RNA, 16 nt, Human
ccaggaccagcugggg

SEQ ID NO: 2554204 - RNA, 15 nt, Human
ccaggaccagcuggg

SEQ ID NO: 2554205 - RNA, 14 nt, Human
ccaggaccagcugg

SEQ ID NO: 2554206 - RNA, 17 nt, Human
ccaggaccagcucagga

SEQ ID NO: 2554207 - RNA, 20 nt, Human
ccaggaccagcucaggacag

SEQ ID NO: 2554208 - RNA, 13 nt, Human
ccaggaccagcuc

SEQ ID NO: 2554209 - RNA, 14 nt, Human
ccaggaccagcuca

SEQ ID NO: 2554210 - RNA, 15 nt, Human
ccaggaccagcucag

SEQ ID NO: 2554211 - RNA, 16 nt, Human
ccaggaccagcucagg

SEQ ID NO: 2554212 - RNA, 18 nt, Human
ccaggacgcuucugaaug

SEQ ID NO: 2554213 - RNA, 17 nt, Human
ccaggacgcuucugaau

SEQ ID NO: 2554214 - RNA, 16 nt, Human
ccaggacgcuucugaa

SEQ ID NO: 2554215 - RNA, 15 nt, Human
ccaggacgcuucuga

SEQ ID NO: 2554216 - RNA, 18 nt, Human
ccaggaccuggcugccau

SEQ ID NO: 2554217 - RNA, 15 nt, Human
ccaggaccuggcugc

SEQ ID NO: 2554218 - RNA, 17 nt, Human
ccaggaccuggcugcca

SEQ ID NO: 2554219 - RNA, 18 nt, Human
ccaggacccugaaggggc

SEQ ID NO: 2554220 - RNA, 19 nt, Human
ccaggacccugaaggggcc

SEQ ID NO: 2554221 - RNA, 23 nt, Human
ccaggacccugaaggggccauga

SEQ ID NO: 2554222 - RNA, 19 nt, Human
ccaggaagccagcaggcuc

SEQ ID NO: 2554223 - RNA, 17 nt, Human
ccaggaagccagcaggc

SEQ ID NO: 2554224 - RNA, 15 nt, Human
ccaggaagccagcag

SEQ ID NO: 2554225 - RNA, 14 nt, Human
ccaggaagccagca

SEQ ID NO: 2554226 - RNA, 23 nt, Human
ccagcugugcucuggacaggcau

SEQ ID NO: 2554227 - RNA, 22 nt, Human
ccagcugugcucuggacaggca

SEQ ID NO: 2554228 - RNA, 18 nt, Human
ccagcugugagccuuggc

SEQ ID NO: 2554229 - RNA, 17 nt, Human
ccagcugugagccuugg

SEQ ID NO: 2554230 - RNA, 16 nt, Human
ccagcugugagccuug

SEQ ID NO: 2554231 - RNA, 15 nt, Human
ccagcugugagccuu

SEQ ID NO: 2554232 - RNA, 20 nt, Human
ccagcugugagccuuggcug

SEQ ID NO: 2554233 - RNA, 19 nt, Human
ccagcugugagccuuggcu

SEQ ID NO: 2554234 - RNA, 22 nt, Human
ccagcuguggguacagagaggu

SEQ ID NO: 2554235 - RNA, 23 nt, Human
ccagcuguggguacagagagguc

SEQ ID NO: 2554236 - RNA, 13 nt, Human
ccaggagcagcca

SEQ ID NO: 2554237 - RNA, 12 nt, Human
ccaggagcagcc

SEQ ID NO: 2554238 - RNA, 23 nt, Human
ccaggagcaaauguuucugcagu

SEQ ID NO: 2554239 - RNA, 19 nt, Human
ccaggagcaaauguuucug

SEQ ID NO: 2554240 - RNA, 15 nt, Human
ccaggagcaaauguu

SEQ ID NO: 2554241 - RNA, 12 nt, Human
ccaggagaacug

SEQ ID NO: 2554242 - RNA, 21 nt, Human
ccaggagaaccacuacaugca

SEQ ID NO: 2554243 - RNA, 23 nt, Human
ccaggagaaccacuacaugcagc

SEQ ID NO: 2554244 - RNA, 13 nt, Human
ccaggacugagcc

SEQ ID NO: 2554245 - RNA, 23 nt, Human
ccaggacgcuucugaaugcugcu

SEQ ID NO: 2554246 - RNA, 22 nt, Human
ccaggacgcuucugaaugcugc

SEQ ID NO: 2554247 - RNA, 20 nt, Human
ccaggacgcuucugaaugcu

SEQ ID NO: 2554248 - RNA, 19 nt, Human
ccaggacgcuucugaaugc

SEQ ID NO: 2554249 - RNA, 18 nt, Human
ccaggacggggccggcca

SEQ ID NO: 2554250 - RNA, 16 nt, Human
ccaggacggggccggc

SEQ ID NO: 2554251 - RNA, 19 nt, Human
ccaggacggggccggccag

SEQ ID NO: 2554252 - RNA, 19 nt, Human
ccaggacugagccccgcag

SEQ ID NO: 2554253 - RNA, 16 nt, Human
ccaggacugagccccg

SEQ ID NO: 2554254 - RNA, 15 nt, Human
ccaggacugagcccc

SEQ ID NO: 2554255 - RNA, 14 nt, Human
ccaggacugagccc

SEQ ID NO: 2554256 - RNA, 13 nt, Human
ccaggacugggcc

SEQ ID NO: 2554257 - RNA, 12 nt, Human
ccaggacugggc

SEQ ID NO: 2554258 - RNA, 17 nt, Human
ccaggacugggccacuu

SEQ ID NO: 2554259 - RNA, 14 nt, Human
ccaggacugggcca

SEQ ID NO: 2554260 - RNA, 21 nt, Human
ccaggacuuauuuaaacucug

SEQ ID NO: 2554261 - RNA, 19 nt, Human
ccaggagaaccacuacaug

SEQ ID NO: 2554262 - RNA, 13 nt, Human
ccacacacacaga

SEQ ID NO: 2554263 - RNA, 14 nt, Human
ccacacacacagaa

SEQ ID NO: 2554264 - RNA, 15 nt, Human
ccacacacacagaaa

SEQ ID NO: 2554265 - RNA, 16 nt, Human
ccacacacacagaaaa

SEQ ID NO: 2554266 - RNA, 23 nt, Human
ccagccuccucuggacggcaggc

SEQ ID NO: 2554267 - RNA, 15 nt, Human
ccagccucuagggac

SEQ ID NO: 2554268 - RNA, 16 nt, Human
ccagccucgucuucau

SEQ ID NO: 2554269 - RNA, 15 nt, Human
ccagccucuguuccc

SEQ ID NO: 2554270 - RNA, 11 nt, Human
ccagccucugu

SEQ ID NO: 2554271 - RNA, 15 nt, Human
ccagccucuggcauu

SEQ ID NO: 2554272 - RNA, 22 nt, Human
ccagccucucuugguuuccuuc

SEQ ID NO: 2554273 - RNA, 19 nt, Human
ccagccucugagccccugg

SEQ ID NO: 2554274 - RNA, 21 nt, Human
ccagccucugagccccuggga

SEQ ID NO: 2554275 - RNA, 24 nt, Human
ccagccucugagccccugggacug

SEQ ID NO: 2554276 - RNA, 14 nt, Human
ccagccucuccccu

SEQ ID NO: 2554277 - RNA, 13 nt, Human
ccagccucucccc

SEQ ID NO: 2554278 - RNA, 20 nt, Human
ccagccucuagggaccccuc

SEQ ID NO: 2554279 - RNA, 17 nt, Human
ccagccucuagggaccc

SEQ ID NO: 2554280 - RNA, 22 nt, Human
ccagccucuccccugauuacac

SEQ ID NO: 2554281 - RNA, 15 nt, Human
ccagccucuccccug

SEQ ID NO: 2554282 - RNA, 21 nt, Human
ccagccucucuugguuuccuu

SEQ ID NO: 2554283 - RNA, 21 nt, Human
ccagcugugcucuggacaggc

SEQ ID NO: 2554284 - RNA, 20 nt, Human
ccagcugugcucuggacagg

SEQ ID NO: 2554285 - RNA, 18 nt, Human
ccagcugugcucuggaca

SEQ ID NO: 2554286 - RNA, 21 nt, Human
ccagcuggugagugaugcggc

SEQ ID NO: 2554287 - RNA, 22 nt, Human
ccagcuggggcguggggagggc

SEQ ID NO: 2554288 - RNA, 18 nt, Human
ccagcugggucaggcagg

SEQ ID NO: 2554289 - RNA, 14 nt, Human
ccagcugugagccu

SEQ ID NO: 2554290 - RNA, 21 nt, Human
ccagcuggggcguggggaggg

SEQ ID NO: 2554291 - RNA, 20 nt, Human
ccagcuggggcguggggagg

SEQ ID NO: 2554292 - RNA, 14 nt, Human
ccagcugggcucug

SEQ ID NO: 2554293 - RNA, 16 nt, Human
ccagcugggucaggca

SEQ ID NO: 2554294 - RNA, 17 nt, Human
ccagcugggucaggcag

SEQ ID NO: 2554295 - RNA, 17 nt, Human
ccagcuggguuggaaaa

SEQ ID NO: 2554296 - RNA, 16 nt, Human
ccagcuggguuggaaa

SEQ ID NO: 2554297 - RNA, 12 nt, Human
ccagcugggagg

SEQ ID NO: 2554298 - RNA, 21 nt, Human
ccagcugggaggcaagagggg

SEQ ID NO: 2554299 - RNA, 19 nt, Human
ccagcugggaggcaagagg

SEQ ID NO: 2554300 - RNA, 16 nt, Human
ccagcugggaggcaag

SEQ ID NO: 2554301 - RNA, 14 nt, Human
ccagcugggaggca

SEQ ID NO: 2554302 - RNA, 12 nt, Human
ccagcugggcuc

SEQ ID NO: 2554303 - RNA, 11 nt, Human
ccagcugggcu

SEQ ID NO: 2554304 - RNA, 22 nt, Human
ccagcugggaggcaagaggggu

SEQ ID NO: 2554305 - RNA, 18 nt, Human
ccagcugcuugggcuuca

SEQ ID NO: 2554306 - RNA, 16 nt, Human
ccagcugcuugggcuu

SEQ ID NO: 2554307 - RNA, 19 nt, Human
ccagcuggcccgugacaga

SEQ ID NO: 2554308 - RNA, 13 nt, Human
ccagcugcacuga

SEQ ID NO: 2554309 - RNA, 12 nt, Human
ccagcuggccgg

SEQ ID NO: 2554310 - RNA, 14 nt, Human
ccagcuggccggga

SEQ ID NO: 2554311 - RNA, 20 nt, Human
ccagcuggccgggagccuga

SEQ ID NO: 2554312 - RNA, 15 nt, Human
ccagcugcuugggcu

SEQ ID NO: 2554313 - RNA, 13 nt, Human
ccagcugcuuggg

SEQ ID NO: 2554314 - RNA, 17 nt, Human
ccagcugcaccugccag

SEQ ID NO: 2554315 - RNA, 18 nt, Human
ccagcugcaccugccagc

SEQ ID NO: 2554316 - RNA, 19 nt, Human
ccagcugcaccugccagcc

SEQ ID NO: 2554317 - RNA, 20 nt, Human
ccagcugcaccugccagccu

SEQ ID NO: 2554318 - RNA, 22 nt, Human
ccagcugcaccugccagccugg

SEQ ID NO: 2554319 - RNA, 23 nt, Human
ccagcugcaccugccagccuggc

SEQ ID NO: 2554320 - RNA, 19 nt, Human
ccagcucuucuccccaggu

SEQ ID NO: 2554321 - RNA, 14 nt, Human
ccagcucuuuccuc

SEQ ID NO: 2554322 - RNA, 16 nt, Human
ccagcucuuuccuccu

SEQ ID NO: 2554323 - RNA, 17 nt, Human
ccagcucuuuccuccuu

SEQ ID NO: 2554324 - RNA, 21 nt, Human
ccagcugaaauacugaggggu

SEQ ID NO: 2554325 - RNA, 14 nt, Human
ccagcucuguauca

SEQ ID NO: 2554326 - RNA, 18 nt, Human
ccagcucuguaucaggac

SEQ ID NO: 2554327 - RNA, 21 nt, Human
ccagcucuguaucaggaccca

SEQ ID NO: 2554328 - RNA, 20 nt, Human
ccagcucugaaaccaguguu

SEQ ID NO: 2554329 - RNA, 21 nt, Human
ccagcucugaaaccaguguua

SEQ ID NO: 2554330 - RNA, 22 nt, Human
ccagcugacaguccucuccacc

SEQ ID NO: 2554331 - RNA, 21 nt, Human
ccagcugacaguccucuccac

SEQ ID NO: 2554332 - RNA, 20 nt, Human
ccagcugacaguccucucca

SEQ ID NO: 2554333 - RNA, 15 nt, Human
ccagcugacaguccu

SEQ ID NO: 2554334 - RNA, 23 nt, Human
ccagcugacaguccucuccaccu

SEQ ID NO: 2554335 - RNA, 15 nt, Human
ccagcugagcgccag

SEQ ID NO: 2554336 - RNA, 17 nt, Human
ccagcugagcgccagga

SEQ ID NO: 2554337 - RNA, 20 nt, Human
ccagcugagcgccaggaugg

SEQ ID NO: 2554338 - RNA, 22 nt, Human
ccagcugacccugguucucucu

SEQ ID NO: 2554339 - RNA, 15 nt, Human
ccagcucugaaacca

SEQ ID NO: 2554340 - RNA, 22 nt, Human
ccagcucucccucuggcccugc

SEQ ID NO: 2554341 - RNA, 23 nt, Human
ccagcucucccucuggcccugcc

SEQ ID NO: 2554342 - RNA, 17 nt, Human
ccagcucucccucuggc

SEQ ID NO: 2554343 - RNA, 18 nt, Human
ccagcucucccucuggcc

SEQ ID NO: 2554344 - RNA, 20 nt, Human
ccagcucucccucuggcccu

SEQ ID NO: 2554345 - RNA, 21 nt, Human
ccagcucucccucuggcccug

SEQ ID NO: 2554346 - RNA, 13 nt, Human
ccagcucucagcc

SEQ ID NO: 2554347 - RNA, 14 nt, Human
ccagcucucagcca

SEQ ID NO: 2554348 - RNA, 15 nt, Human
ccagcucucagccaa

SEQ ID NO: 2554349 - RNA, 14 nt, Human
ccagcucucccucu

SEQ ID NO: 2554350 - RNA, 16 nt, Human
ccagcucucccucugg

SEQ ID NO: 2554351 - RNA, 19 nt, Human
ccagccuggcccagcuccc

SEQ ID NO: 2554352 - RNA, 18 nt, Human
ccagccuggcccagcucc

SEQ ID NO: 2554353 - RNA, 17 nt, Human
ccagccuggcccagcuc

SEQ ID NO: 2554354 - RNA, 16 nt, Human
ccagccuggcccagcu

SEQ ID NO: 2554355 - RNA, 20 nt, Human
ccagccuggcccagcucccc

SEQ ID NO: 2554356 - RNA, 12 nt, Human
ccagcucucagc

SEQ ID NO: 2554357 - RNA, 22 nt, Human
ccagcucuagacaacccugcaa

SEQ ID NO: 2554358 - RNA, 13 nt, Human
ccagccuggagau

SEQ ID NO: 2554359 - RNA, 20 nt, Human
ccagccuggagaugaaaucu

SEQ ID NO: 2554360 - RNA, 18 nt, Human
ccagccuggacccccagc

SEQ ID NO: 2554361 - RNA, 19 nt, Human
ccagccuggacccccagcu

SEQ ID NO: 2554362 - RNA, 19 nt, Human
ccagccucuguuccccuag

SEQ ID NO: 2554363 - RNA, 11 nt, Human
ccagccugagc

SEQ ID NO: 2554364 - RNA, 12 nt, Human
ccagccugagca

SEQ ID NO: 2554365 - RNA, 15 nt, Human
ccagccuggcccagc

SEQ ID NO: 2554366 - RNA, 14 nt, Human
ccagccuggcccag

SEQ ID NO: 2554367 - RNA, 13 nt, Human
ccagccuggccca

SEQ ID NO: 2554368 - RNA, 12 nt, Human
ccagccuggccc

SEQ ID NO: 2554369 - RNA, 12 nt, Human
ccagccuggcca

SEQ ID NO: 2554370 - RNA, 10 nt, Human
ccagccuggc

SEQ ID NO: 2554371 - RNA, 11 nt, Human
ccagccuggcc

SEQ ID NO: 2554372 - RNA, 20 nt, Human
cccagagcuguuuauggccu

SEQ ID NO: 2554373 - RNA, 14 nt, Human
ccauggacacucca

SEQ ID NO: 2554374 - RNA, 14 nt, Human
ccauggaaugcuug

SEQ ID NO: 2554375 - RNA, 15 nt, Human
ccauggaaugcuuga

SEQ ID NO: 2554376 - RNA, 12 nt, Human
ccauggaaccug

SEQ ID NO: 2554377 - RNA, 19 nt, Human
ccauggacacuccagugcc

SEQ ID NO: 2554378 - RNA, 17 nt, Human
ccauggacacuccagug

SEQ ID NO: 2554379 - RNA, 15 nt, Human
ccauggacacuccag

SEQ ID NO: 2554380 - RNA, 18 nt, Human
ccauggaaugcuugaaaa

SEQ ID NO: 2554381 - RNA, 14 nt, Human
ccauggacaggcug

SEQ ID NO: 2554382 - RNA, 21 nt, Human
ccauggacacuccagugccag

SEQ ID NO: 2554383 - RNA, 18 nt, Human
ccauggagagcuggagcc

SEQ ID NO: 2554384 - RNA, 15 nt, Human
ccauggagagcugga

SEQ ID NO: 2554385 - RNA, 17 nt, Human
ccauggagacaagaagg

SEQ ID NO: 2554386 - RNA, 22 nt, Human
ccauggagagcuggagccuggu

SEQ ID NO: 2554387 - RNA, 19 nt, Human
ccauggagagcuggagccu

SEQ ID NO: 2554388 - RNA, 14 nt, Human
ccauggagccagcu

SEQ ID NO: 2554389 - RNA, 17 nt, Human
ccauggagccagcuccc

SEQ ID NO: 2554390 - RNA, 18 nt, Human
ccauggagccagcucccu

SEQ ID NO: 2554391 - RNA, 16 nt, Human
ccauggagccccagcc

SEQ ID NO: 2554392 - RNA, 15 nt, Human
ccauggagccccagc

SEQ ID NO: 2554393 - RNA, 14 nt, Human
ccauggagccccag

SEQ ID NO: 2554394 - RNA, 13 nt, Human
ccauggagcccca

SEQ ID NO: 2554395 - RNA, 12 nt, Human
ccauggagcccc

SEQ ID NO: 2554396 - RNA, 22 nt, Human
ccauggagccagcucccucuau

SEQ ID NO: 2554397 - RNA, 20 nt, Human
ccauggaggcacacagcugc

SEQ ID NO: 2554398 - RNA, 17 nt, Human
ccauggaggcacacagc

SEQ ID NO: 2554399 - RNA, 21 nt, Human
ccauggaggcacacagcugca

SEQ ID NO: 2554400 - RNA, 20 nt, Human
ccauggagccccagcccccu

SEQ ID NO: 2554401 - RNA, 19 nt, Human
ccauggagccccagccccc

SEQ ID NO: 2554402 - RNA, 18 nt, Human
ccauggagccccagcccc

SEQ ID NO: 2554403 - RNA, 17 nt, Human
ccauggagccccagccc

SEQ ID NO: 2554404 - RNA, 13 nt, Human
ccauggaggcaca

SEQ ID NO: 2554405 - RNA, 14 nt, Human
ccauguuggccagg

SEQ ID NO: 2554406 - RNA, 13 nt, Human
ccauguuggccag

SEQ ID NO: 2554407 - RNA, 21 nt, Human
ccaugugccugauccagccuc

SEQ ID NO: 2554408 - RNA, 16 nt, Human
ccaugugccugaucca

SEQ ID NO: 2554409 - RNA, 13 nt, Human
ccaugugccaggu

SEQ ID NO: 2554410 - RNA, 23 nt, Human
ccauggcacucuauguucuaaga

SEQ ID NO: 2554411 - RNA, 23 nt, Human
ccauggcaccuucagacuuugcu

SEQ ID NO: 2554412 - RNA, 17 nt, Human
ccaugcugcccugugag

SEQ ID NO: 2554413 - RNA, 16 nt, Human
ccaugcugcccuguga

SEQ ID NO: 2554414 - RNA, 16 nt, Human
ccaugcugaagggacc

SEQ ID NO: 2554415 - RNA, 14 nt, Human
ccaugcugccucca

SEQ ID NO: 2554416 - RNA, 20 nt, Human
ccaugcuuagucacugccug

SEQ ID NO: 2554417 - RNA, 19 nt, Human
ccaugcuuagucacugccu

SEQ ID NO: 2554418 - RNA, 18 nt, Human
ccaugcuuagucacugcc

SEQ ID NO: 2554419 - RNA, 22 nt, Human
ccaugcuuagucacugccugca

SEQ ID NO: 2554420 - RNA, 21 nt, Human
ccaugcuuagucacugccugc

SEQ ID NO: 2554421 - RNA, 15 nt, Human
ccaugcuugggugua

SEQ ID NO: 2554422 - RNA, 17 nt, Human
ccaugcugaggccuggg

SEQ ID NO: 2554423 - RNA, 16 nt, Human
ccaugcugaggccugg

SEQ ID NO: 2554424 - RNA, 13 nt, Human
ccaugcugaaggg

SEQ ID NO: 2554425 - RNA, 22 nt, Human
ccaugccugccccccucaucuc

SEQ ID NO: 2554426 - RNA, 15 nt, Human
ccaugcugaggccug

SEQ ID NO: 2554427 - RNA, 15 nt, Human
ccaugcugcccugug

SEQ ID NO: 2554428 - RNA, 15 nt, Human
ccaugcuccuggccc

SEQ ID NO: 2554429 - RNA, 18 nt, Human
ccaugcuccuggcccacu

SEQ ID NO: 2554430 - RNA, 16 nt, Human
ccaugccugagggugg

SEQ ID NO: 2554431 - RNA, 15 nt, Human
ccaugccugagggug

SEQ ID NO: 2554432 - RNA, 14 nt, Human
ccaugccugagggu

SEQ ID NO: 2554433 - RNA, 13 nt, Human
ccaugccugaggg

SEQ ID NO: 2554434 - RNA, 12 nt, Human
ccaugccugagg

SEQ ID NO: 2554435 - RNA, 22 nt, Human
ccaugaacagaaaacauucuga

SEQ ID NO: 2554436 - RNA, 16 nt, Human
ccaugaacagaaaaca

SEQ ID NO: 2554437 - RNA, 15 nt, Human
ccaugaaccaagacc

SEQ ID NO: 2554438 - RNA, 22 nt, Human
ccaugaacacacuguguccugg

SEQ ID NO: 2554439 - RNA, 21 nt, Human
ccaugaacacacuguguccug

SEQ ID NO: 2554440 - RNA, 17 nt, Human
ccaugaacacacugugu

SEQ ID NO: 2554441 - RNA, 16 nt, Human
ccaugaacacacugug

SEQ ID NO: 2554442 - RNA, 12 nt, Human
ccaugaacacac

SEQ ID NO: 2554443 - RNA, 13 nt, Human
ccaugaaacaaag

SEQ ID NO: 2554444 - RNA, 21 nt, Human
ccaugaaaaaaaugaucccca

SEQ ID NO: 2554445 - RNA, 19 nt, Human
ccaugaaaacguuuuauug

SEQ ID NO: 2554446 - RNA, 20 nt, Human
ccaugaaaacguuuuauugu

SEQ ID NO: 2554447 - RNA, 21 nt, Human
ccaugaaaacguuuuauugug

SEQ ID NO: 2554448 - RNA, 23 nt, Human
ccaugaaaacguuuuauuguguu

SEQ ID NO: 2554449 - RNA, 22 nt, Human
ccaugaaaaugcaacaacaugu

SEQ ID NO: 2554450 - RNA, 18 nt, Human
ccaugccugaggguggag

SEQ ID NO: 2554451 - RNA, 17 nt, Human
ccaugccugagggugga

SEQ ID NO: 2554452 - RNA, 13 nt, Human
ccaugccugucca

SEQ ID NO: 2554453 - RNA, 14 nt, Human
ccaugccuguccag

SEQ ID NO: 2554454 - RNA, 17 nt, Human
ccaugccuguccagccu

SEQ ID NO: 2554455 - RNA, 19 nt, Human
ccaugccuguccagccugg

SEQ ID NO: 2554456 - RNA, 18 nt, Human
ccaugccuguccagccug

SEQ ID NO: 2554457 - RNA, 13 nt, Human
ccaugcuccuggc

SEQ ID NO: 2554458 - RNA, 20 nt, Human
ccaugcgcccccuccgcccu

SEQ ID NO: 2554459 - RNA, 14 nt, Human
ccaugcgcccccuc

SEQ ID NO: 2554460 - RNA, 20 nt, Human
cccaccuuggcugcagggag

SEQ ID NO: 2554461 - RNA, 19 nt, Human
cccaccuuggcugcaggga

SEQ ID NO: 2554462 - RNA, 17 nt, Human
cccaccuuggcugcagg

SEQ ID NO: 2554463 - RNA, 16 nt, Human
cccaccuuggcugcag

SEQ ID NO: 2554464 - RNA, 15 nt, Human
cccaccuggccucug

SEQ ID NO: 2554465 - RNA, 12 nt, Human
cccaccuggccu

SEQ ID NO: 2554466 - RNA, 16 nt, Human
cccaccuggccaccug

SEQ ID NO: 2554467 - RNA, 15 nt, Human
cccaccuggccaccu

SEQ ID NO: 2554468 - RNA, 13 nt, Human
cccaccuggccac

SEQ ID NO: 2554469 - RNA, 12 nt, Human
cccaccuggcca

SEQ ID NO: 2554470 - RNA, 12 nt, Human
cccaccugcuga

SEQ ID NO: 2554471 - RNA, 13 nt, Human
cccaccugcugag

SEQ ID NO: 2554472 - RNA, 19 nt, Human
cccaccugcugagagaccc

SEQ ID NO: 2554473 - RNA, 20 nt, Human
ccauuccugguacccagcca

SEQ ID NO: 2554474 - RNA, 17 nt, Human
ccauuccugguacccag

SEQ ID NO: 2554475 - RNA, 22 nt, Human
ccauuccugggaaauauucccu

SEQ ID NO: 2554476 - RNA, 22 nt, Human
ccauuccuggaaaccacagucc

SEQ ID NO: 2554477 - RNA, 21 nt, Human
ccauguuggccaggcuggucu

SEQ ID NO: 2554478 - RNA, 19 nt, Human
ccauguuggccaggcuggu

SEQ ID NO: 2554479 - RNA, 15 nt, Human
ccauguuggccaggc

SEQ ID NO: 2554480 - RNA, 18 nt, Human
ccauguuggccaggcugg

SEQ ID NO: 2554481 - RNA, 18 nt, Human
ccaugugguggcacaggc

SEQ ID NO: 2554482 - RNA, 17 nt, Human
ccaugugguggcacagg

SEQ ID NO: 2554483 - RNA, 18 nt, Human
ccauucauuccauucugg

SEQ ID NO: 2554484 - RNA, 15 nt, Human
ccauguugcugccaa

SEQ ID NO: 2554485 - RNA, 20 nt, Human
ccauucauuccauucuggaa

SEQ ID NO: 2554486 - RNA, 16 nt, Human
ccauuccagaauaucu

SEQ ID NO: 2554487 - RNA, 13 nt, Human
ccauuccugaaga

SEQ ID NO: 2554488 - RNA, 16 nt, Human
ccauuccugaagaacc

SEQ ID NO: 2554489 - RNA, 22 nt, Human
ccauuccucaccuuuucccggg

SEQ ID NO: 2554490 - RNA, 12 nt, Human
ccauuccucagg

SEQ ID NO: 2554491 - RNA, 13 nt, Human
ccauuccucaggg

SEQ ID NO: 2554492 - RNA, 16 nt, Human
ccauuccucagggaca

SEQ ID NO: 2554493 - RNA, 20 nt, Human
ccauucccugccuggggcgg

SEQ ID NO: 2554494 - RNA, 15 nt, Human
ccauucccugccugg

SEQ ID NO: 2554495 - RNA, 14 nt, Human
ccauucccugccug

SEQ ID NO: 2554496 - RNA, 17 nt, Human
ccauuccauuuaucuuu

SEQ ID NO: 2554497 - RNA, 14 nt, Human
cccacgcccccacu

SEQ ID NO: 2554498 - RNA, 13 nt, Human
cccacgcccccac

SEQ ID NO: 2554499 - RNA, 20 nt, Human
cccaccuggccaccugaggu

SEQ ID NO: 2554500 - RNA, 17 nt, Human
cccaccuggccaccuga

SEQ ID NO: 2554501 - RNA, 16 nt, Human
cccacgagggucagga

SEQ ID NO: 2554502 - RNA, 13 nt, Human
cccagacccagug

SEQ ID NO: 2554503 - RNA, 14 nt, Human
cccagacccagugg

SEQ ID NO: 2554504 - RNA, 18 nt, Human
cccagaccccucuggcca

SEQ ID NO: 2554505 - RNA, 19 nt, Human
cccagaccccucuggccag

SEQ ID NO: 2554506 - RNA, 20 nt, Human
cccagaccccucuggccagg

SEQ ID NO: 2554507 - RNA, 23 nt, Human
cccagacagacaucucugcaccc

SEQ ID NO: 2554508 - RNA, 20 nt, Human
cccagacagacaucucugca

SEQ ID NO: 2554509 - RNA, 12 nt, Human
cccagacagcuc

SEQ ID NO: 2554510 - RNA, 13 nt, Human
cccagacagcucc

SEQ ID NO: 2554511 - RNA, 14 nt, Human
cccagacagcuccc

SEQ ID NO: 2554512 - RNA, 16 nt, Human
cccagacagcucccuc

SEQ ID NO: 2554513 - RNA, 20 nt, Human
cccagacagcucccucugcc

SEQ ID NO: 2554514 - RNA, 21 nt, Human
cccagacagcucccucugccu

SEQ ID NO: 2554515 - RNA, 18 nt, Human
cccagaaugccuccugca

SEQ ID NO: 2554516 - RNA, 15 nt, Human
cccacgcccccacug

SEQ ID NO: 2554517 - RNA, 15 nt, Human
cccagacacagaaga

SEQ ID NO: 2554518 - RNA, 19 nt, Human
cccagacagacaucucugc

SEQ ID NO: 2554519 - RNA, 15 nt, Human
cccagagaggaauca

SEQ ID NO: 2554520 - RNA, 19 nt, Human
cccagagaggaaucagacu

SEQ ID NO: 2554521 - RNA, 21 nt, Human
cccagagaggaaucagacuuc

SEQ ID NO: 2554522 - RNA, 14 nt, Human
cccagagaugccuc

SEQ ID NO: 2554523 - RNA, 16 nt, Human
cccagagaugccucca

SEQ ID NO: 2554524 - RNA, 17 nt, Human
cccagagaugccuccac

SEQ ID NO: 2554525 - RNA, 18 nt, Human
cccagagaugccuccacc

SEQ ID NO: 2554526 - RNA, 19 nt, Human
cccagagaugccuccaccg

SEQ ID NO: 2554527 - RNA, 20 nt, Human
cccagagaugccuccaccgc

SEQ ID NO: 2554528 - RNA, 14 nt, Human
cccagagcagggug

SEQ ID NO: 2554529 - RNA, 23 nt, Human
cccagagcaggaggccccuggcc

SEQ ID NO: 2554530 - RNA, 21 nt, Human
cccagagcaggaggccccugg

SEQ ID NO: 2554531 - RNA, 19 nt, Human
cccagagcaggaggccccu

SEQ ID NO: 2554532 - RNA, 16 nt, Human
cccagagcaggaggcc

SEQ ID NO: 2554533 - RNA, 16 nt, Human
cccagagcaggaagca

SEQ ID NO: 2554534 - RNA, 14 nt, Human
cccagagcaggaag

SEQ ID NO: 2554535 - RNA, 12 nt, Human
cccagagcacug

SEQ ID NO: 2554536 - RNA, 20 nt, Human
cccagagaugggacugggag

SEQ ID NO: 2554537 - RNA, 21 nt, Human
cccagagaugccuccaccgcu

SEQ ID NO: 2554538 - RNA, 23 nt, Human
cccagagaugccuccaccgcugc

SEQ ID NO: 2554539 - RNA, 21 nt, Human
cccagagaugggacugggagg

SEQ ID NO: 2554540 - RNA, 17 nt, Human
cccagacgaugucuuca

SEQ ID NO: 2554541 - RNA, 15 nt, Human
cccagacgaugucuu

SEQ ID NO: 2554542 - RNA, 21 nt, Human
cccagaccuuuuauccacuua

SEQ ID NO: 2554543 - RNA, 21 nt, Human
cccagaccuguuagcagacag

SEQ ID NO: 2554544 - RNA, 22 nt, Human
cccagaccuguuagcagacagg

SEQ ID NO: 2554545 - RNA, 18 nt, Human
cccagaccugccucuucc

SEQ ID NO: 2554546 - RNA, 14 nt, Human
cccagaccugccuc

SEQ ID NO: 2554547 - RNA, 21 nt, Human
cccagaccccucuggccagga

SEQ ID NO: 2554548 - RNA, 12 nt, Human
cccagacucaga

SEQ ID NO: 2554549 - RNA, 13 nt, Human
cccagacucagac

SEQ ID NO: 2554550 - RNA, 16 nt, Human
cccagacucagacauu

SEQ ID NO: 2554551 - RNA, 20 nt, Human
cccagacucagacauuggca

SEQ ID NO: 2554552 - RNA, 18 nt, Human
cccaggaggccagccuug

SEQ ID NO: 2554553 - RNA, 23 nt, Human
cccagauugcaacaggcugggcu

SEQ ID NO: 2554554 - RNA, 15 nt, Human
cccagaggagggcag

SEQ ID NO: 2554555 - RNA, 16 nt, Human
cccagaggauugcugc

SEQ ID NO: 2554556 - RNA, 22 nt, Human
cccagaggaaggggccagaggc

SEQ ID NO: 2554557 - RNA, 23 nt, Human
cccagaggaaggggccagaggcu

SEQ ID NO: 2554558 - RNA, 24 nt, Human
cccagaggaaggggccagaggcuc

SEQ ID NO: 2554559 - RNA, 21 nt, Human
cccagaggaaggggccagagg

SEQ ID NO: 2554560 - RNA, 23 nt, Human
cccagagcuguuuauggccucag

SEQ ID NO: 2554561 - RNA, 21 nt, Human
cccagagcuguuuauggccuc

SEQ ID NO: 2554562 - RNA, 22 nt, Human
cccagagcuguuuauggccuca

SEQ ID NO: 2554563 - RNA, 22 nt, Human
cccagagcauuacgugagccag

SEQ ID NO: 2554564 - RNA, 21 nt, Human
cccagagcauuacgugagcca

SEQ ID NO: 2554565 - RNA, 15 nt, Human
cccagagcagggugu

SEQ ID NO: 2554566 - RNA, 12 nt, Human
cccagagcccag

SEQ ID NO: 2554567 - RNA, 13 nt, Human
cccagagcccagc

SEQ ID NO: 2554568 - RNA, 15 nt, Human
cccagagcccagcuc

SEQ ID NO: 2554569 - RNA, 16 nt, Human
cccagagcccagcucc

SEQ ID NO: 2554570 - RNA, 17 nt, Human
cccagagcccagcucca

SEQ ID NO: 2554571 - RNA, 21 nt, Human
cccagagcuguggacuuuguu

SEQ ID NO: 2554572 - RNA, 13 nt, Human
cccagagcuguuu

SEQ ID NO: 2554573 - RNA, 11 nt, Human
cccagagcugu

SEQ ID NO: 2554574 - RNA, 22 nt, Human
cccagauuggcucacacugaga

SEQ ID NO: 2554575 - RNA, 21 nt, Human
cccagauuggcucacacugag

SEQ ID NO: 2554576 - RNA, 20 nt, Human
cccagauuggcucacacuga

SEQ ID NO: 2554577 - RNA, 19 nt, Human
cccagauuggcucacacug

SEQ ID NO: 2554578 - RNA, 14 nt, Human
cccagaggccucuc

SEQ ID NO: 2554579 - RNA, 17 nt, Human
cccagauuggcucacac

SEQ ID NO: 2554580 - RNA, 16 nt, Human
cccagaggcugcccca

SEQ ID NO: 2554581 - RNA, 13 nt, Human
cccagccccaaug

SEQ ID NO: 2554582 - RNA, 15 nt, Human
cccagcaacacaagc

SEQ ID NO: 2554583 - RNA, 19 nt, Human
cccagauuuugcuguauau

SEQ ID NO: 2554584 - RNA, 21 nt, Human
cccagauuuugcuguauauuu

SEQ ID NO: 2554585 - RNA, 18 nt, Human
cccagauuuugcuguaua

SEQ ID NO: 2554586 - RNA, 12 nt, Human
cccagccccauc

SEQ ID NO: 2554587 - RNA, 11 nt, Human
cccagccccau

SEQ ID NO: 2554588 - RNA, 17 nt, Human
cccagccccaaugaaca

SEQ ID NO: 2554589 - RNA, 16 nt, Human
cccagcaacuccaacu

SEQ ID NO: 2554590 - RNA, 19 nt, Human
cccagcaacccuccuauca

SEQ ID NO: 2554591 - RNA, 21 nt, Human
cccagcaacccuccuaucacc

SEQ ID NO: 2554592 - RNA, 22 nt, Human
cccagcaacacaagcuggaagc

SEQ ID NO: 2554593 - RNA, 20 nt, Human
cccagcaacacaagcuggaa

SEQ ID NO: 2554594 - RNA, 13 nt, Human
cccagcaacccuc

SEQ ID NO: 2554595 - RNA, 17 nt, Human
cccagcaacccuccuau

SEQ ID NO: 2554596 - RNA, 15 nt, Human
cccagccccauccuc

SEQ ID NO: 2554597 - RNA, 14 nt, Human
cccagccccauccu

SEQ ID NO: 2554598 - RNA, 14 nt, Human
cccagccccauccc

SEQ ID NO: 2554599 - RNA, 13 nt, Human
cccagccccaucc

SEQ ID NO: 2554600 - RNA, 22 nt, Human
cccagcccccuuugggcccagg

SEQ ID NO: 2554601 - RNA, 15 nt, Human
cccagcccccuuugg

SEQ ID NO: 2554602 - RNA, 24 nt, Human
cccagcccccacagugcugucuga

SEQ ID NO: 2554603 - RNA, 17 nt, Human
cccagcccccacagugc

SEQ ID NO: 2554604 - RNA, 16 nt, Human
cccagcccccacagug

SEQ ID NO: 2554605 - RNA, 12 nt, Human
cccagcccccac

SEQ ID NO: 2554606 - RNA, 19 nt, Human
cccagccccauccucugua

SEQ ID NO: 2554607 - RNA, 18 nt, Human
cccagccccauccucugu

SEQ ID NO: 2554608 - RNA, 11 nt, Human
cccagccucag

SEQ ID NO: 2554609 - RNA, 12 nt, Human
cccagcccuggc

SEQ ID NO: 2554610 - RNA, 11 nt, Human
cccagcccugg

SEQ ID NO: 2554611 - RNA, 19 nt, Human
cccagcccugcuggccgcc

SEQ ID NO: 2554612 - RNA, 20 nt, Human
cccagcccugcuggccgccu

SEQ ID NO: 2554613 - RNA, 16 nt, Human
cccagcccugcuggcc

SEQ ID NO: 2554614 - RNA, 15 nt, Human
cccagcccugcuggc

SEQ ID NO: 2554615 - RNA, 14 nt, Human
cccagcccugcugg

SEQ ID NO: 2554616 - RNA, 13 nt, Human
cccagcccugcug

SEQ ID NO: 2554617 - RNA, 12 nt, Human
cccagcccugcu

SEQ ID NO: 2554618 - RNA, 11 nt, Human
cccagcccugc

SEQ ID NO: 2554619 - RNA, 10 nt, Human
cccagcccug

SEQ ID NO: 2554620 - RNA, 18 nt, Human
cccagcccuauggaugug

SEQ ID NO: 2554621 - RNA, 19 nt, Human
cccagcccucaucccgagc

SEQ ID NO: 2554622 - RNA, 14 nt, Human
cccagcccggcucc

SEQ ID NO: 2554623 - RNA, 20 nt, Human
cccagcccggaccuuggcag

SEQ ID NO: 2554624 - RNA, 21 nt, Human
cccagcccccuuugggcccag

SEQ ID NO: 2554625 - RNA, 16 nt, Human
cccagcccccuuuggg

SEQ ID NO: 2554626 - RNA, 17 nt, Human
cccagcccuauggaugu

SEQ ID NO: 2554627 - RNA, 16 nt, Human
cccagcccggcuccca

SEQ ID NO: 2554628 - RNA, 14 nt, Human
cccagcccucaucc

SEQ ID NO: 2554629 - RNA, 15 nt, Human
cccagcccucauccc

SEQ ID NO: 2554630 - RNA, 16 nt, Human
cccagcccucaucccg

SEQ ID NO: 2554631 - RNA, 23 nt, Human
cccagcccuccuuaucaaaggac

SEQ ID NO: 2554632 - RNA, 22 nt, Human
cccagccucaguccuccccuca

SEQ ID NO: 2554633 - RNA, 16 nt, Human
cccagccucaguccuc

SEQ ID NO: 2554634 - RNA, 12 nt, Human
cccagccucagu

SEQ ID NO: 2554635 - RNA, 20 nt, Human
cccagccuccaagcuccauc

SEQ ID NO: 2554636 - RNA, 18 nt, Human
cccagccuccaagcucca

SEQ ID NO: 2554637 - RNA, 22 nt, Human
cccagccuggcccagcuccccc

SEQ ID NO: 2554638 - RNA, 20 nt, Human
cccagccuggcccagcuccc

SEQ ID NO: 2554639 - RNA, 19 nt, Human
cccagccuggcccagcucc

SEQ ID NO: 2554640 - RNA, 18 nt, Human
cccagccuggcccagcuc

SEQ ID NO: 2554641 - RNA, 15 nt, Human
cccagccucuggcau

SEQ ID NO: 2554642 - RNA, 17 nt, Human
cccagccuggcccagcu

SEQ ID NO: 2554643 - RNA, 21 nt, Human
cccagccucuucuagagccgu

SEQ ID NO: 2554644 - RNA, 16 nt, Human
cccagccucccugaag

SEQ ID NO: 2554645 - RNA, 17 nt, Human
cccagccucccugaagc

SEQ ID NO: 2554646 - RNA, 18 nt, Human
cccagccucccugaagcc

SEQ ID NO: 2554647 - RNA, 15 nt, Human
cccagccucuaggga

SEQ ID NO: 2554648 - RNA, 12 nt, Human
cccaggaccagc

SEQ ID NO: 2554649 - RNA, 13 nt, Human
cccaggaccagcu

SEQ ID NO: 2554650 - RNA, 14 nt, Human
cccaggaccagcuc

SEQ ID NO: 2554651 - RNA, 15 nt, Human
cccaggaccagcuca

SEQ ID NO: 2554652 - RNA, 16 nt, Human
cccaggaccagcucag

SEQ ID NO: 2554653 - RNA, 17 nt, Human
cccaggaccagcucagg

SEQ ID NO: 2554654 - RNA, 20 nt, Human
cccaggaccagcucaggaca

SEQ ID NO: 2554655 - RNA, 18 nt, Human
cccaggaccagcuggggc

SEQ ID NO: 2554656 - RNA, 17 nt, Human
cccaggaccagcugggg

SEQ ID NO: 2554657 - RNA, 16 nt, Human
cccaggaccagcuggg

SEQ ID NO: 2554658 - RNA, 15 nt, Human
cccaggaccagcugg

SEQ ID NO: 2554659 - RNA, 21 nt, Human
cccaggaccagcucaggacag

SEQ ID NO: 2554660 - RNA, 22 nt, Human
cccaggaccagcucaggacaga

SEQ ID NO: 2554661 - RNA, 18 nt, Human
cccaggaccuggcugcca

SEQ ID NO: 2554662 - RNA, 20 nt, Human
cccaggacgcuucugaaugc

SEQ ID NO: 2554663 - RNA, 19 nt, Human
cccaggacgcuucugaaug

SEQ ID NO: 2554664 - RNA, 18 nt, Human
cccaggacgcuucugaau

SEQ ID NO: 2554665 - RNA, 17 nt, Human
cccaggacgcuucugaa

SEQ ID NO: 2554666 - RNA, 16 nt, Human
cccaggacgcuucuga

SEQ ID NO: 2554667 - RNA, 15 nt, Human
cccaggacgcuucug

SEQ ID NO: 2554668 - RNA, 16 nt, Human
cccaggaccuggcugc

SEQ ID NO: 2554669 - RNA, 11 nt, Human
cccaggacccu

SEQ ID NO: 2554670 - RNA, 12 nt, Human
cccaggacccug

SEQ ID NO: 2554671 - RNA, 13 nt, Human
cccaggacccuga

SEQ ID NO: 2554672 - RNA, 23 nt, Human
cccaggacccugaaggggccaug

SEQ ID NO: 2554673 - RNA, 21 nt, Human
cccaggaccagcuggggcgug

SEQ ID NO: 2554674 - RNA, 19 nt, Human
cccaggaccagcuggggcg

SEQ ID NO: 2554675 - RNA, 22 nt, Human
cccaggaccagcuggggcgugg

SEQ ID NO: 2554676 - RNA, 16 nt, Human
cccaggaccccugagu

SEQ ID NO: 2554677 - RNA, 14 nt, Human
cccaggaggccagc

SEQ ID NO: 2554678 - RNA, 22 nt, Human
cccaggagcauccaccuccuuc

SEQ ID NO: 2554679 - RNA, 18 nt, Human
cccaggagcauccaccuc

SEQ ID NO: 2554680 - RNA, 14 nt, Human
cccaggagccccga

SEQ ID NO: 2554681 - RNA, 13 nt, Human
cccaggagccccg

SEQ ID NO: 2554682 - RNA, 22 nt, Human
cccaggacggggccggccaggu

SEQ ID NO: 2554683 - RNA, 19 nt, Human
cccaggacggggccggcca

SEQ ID NO: 2554684 - RNA, 17 nt, Human
cccaggacggggccggc

SEQ ID NO: 2554685 - RNA, 15 nt, Human
cccaggacggggccg

SEQ ID NO: 2554686 - RNA, 23 nt, Human
cccaggacggggccggccaggug

SEQ ID NO: 2554687 - RNA, 15 nt, Human
cccaggacugggcca

SEQ ID NO: 2554688 - RNA, 14 nt, Human
cccaggacugggcc

SEQ ID NO: 2554689 - RNA, 13 nt, Human
cccaggacugggc

SEQ ID NO: 2554690 - RNA, 12 nt, Human
cccaggacuggg

SEQ ID NO: 2554691 - RNA, 16 nt, Human
cccaggagagagaaag

SEQ ID NO: 2554692 - RNA, 15 nt, Human
cccaggagagagaaa

SEQ ID NO: 2554693 - RNA, 14 nt, Human
cccaggagagagaa

SEQ ID NO: 2554694 - RNA, 13 nt, Human
cccaggagagaga

SEQ ID NO: 2554695 - RNA, 15 nt, Human
cccaggagacaguuc

SEQ ID NO: 2554696 - RNA, 17 nt, Human
cccaggagacaguucaa

SEQ ID NO: 2554697 - RNA, 20 nt, Human
cccaggagagagaaagccag

SEQ ID NO: 2554698 - RNA, 14 nt, Human
cccaggagagccag

SEQ ID NO: 2554699 - RNA, 15 nt, Human
cccaggagagccagc

SEQ ID NO: 2554700 - RNA, 18 nt, Human
cccaggagagccagcccu

SEQ ID NO: 2554701 - RNA, 19 nt, Human
cccaggagagccagcccuc

SEQ ID NO: 2554702 - RNA, 21 nt, Human
cccaggagagccagcccuccc

SEQ ID NO: 2554703 - RNA, 22 nt, Human
cccaggagagccagcccucccu

SEQ ID NO: 2554704 - RNA, 23 nt, Human
cccaggagagccagcccucccug

SEQ ID NO: 2554705 - RNA, 14 nt, Human
cccagcucuggucc

SEQ ID NO: 2554706 - RNA, 13 nt, Human
cccagcucugguc

SEQ ID NO: 2554707 - RNA, 12 nt, Human
cccagcucuggu

SEQ ID NO: 2554708 - RNA, 14 nt, Human
cccagcucugaaac

SEQ ID NO: 2554709 - RNA, 22 nt, Human
cccagcucugaaaccaguguua

SEQ ID NO: 2554710 - RNA, 13 nt, Human
cccagcucuggcu

SEQ ID NO: 2554711 - RNA, 16 nt, Human
cccagcucugguccau

SEQ ID NO: 2554712 - RNA, 15 nt, Human
cccagcucuggucca

SEQ ID NO: 2554713 - RNA, 18 nt, Human
cccagcucugguccauag

SEQ ID NO: 2554714 - RNA, 23 nt, Human
cccaggacaccacacccagccuc

SEQ ID NO: 2554715 - RNA, 22 nt, Human
cccaggacaccacacccagccu

SEQ ID NO: 2554716 - RNA, 21 nt, Human
cccaggacaccacacccagcc

SEQ ID NO: 2554717 - RNA, 14 nt, Human
cccagcgagcccug

SEQ ID NO: 2554718 - RNA, 21 nt, Human
cccagccuuggcaucuagagc

SEQ ID NO: 2554719 - RNA, 23 nt, Human
cccagccuucuuugcuugccucu

SEQ ID NO: 2554720 - RNA, 14 nt, Human
cccagcuacucagg

SEQ ID NO: 2554721 - RNA, 11 nt, Human
cccagcucaau

SEQ ID NO: 2554722 - RNA, 20 nt, Human
cccagcuauaccugugccuc

SEQ ID NO: 2554723 - RNA, 21 nt, Human
cccagcuaugguucucucgca

SEQ ID NO: 2554724 - RNA, 12 nt, Human
cccagcucugaa

SEQ ID NO: 2554725 - RNA, 23 nt, Human
cccagcucucccucuggcccugc

SEQ ID NO: 2554726 - RNA, 21 nt, Human
cccagcucucccucuggcccu

SEQ ID NO: 2554727 - RNA, 12 nt, Human
cccagcucagca

SEQ ID NO: 2554728 - RNA, 14 nt, Human
cccagcucagaggg

SEQ ID NO: 2554729 - RNA, 15 nt, Human
cccagcucagagggu

SEQ ID NO: 2554730 - RNA, 19 nt, Human
cccagcuacuugggaagcu

SEQ ID NO: 2554731 - RNA, 18 nt, Human
cccagcuacuugggaagc

SEQ ID NO: 2554732 - RNA, 17 nt, Human
cccagcuauaccugugc

SEQ ID NO: 2554733 - RNA, 16 nt, Human
cccagcuacuugggaa

SEQ ID NO: 2554734 - RNA, 15 nt, Human
cccagcuacuuggga

SEQ ID NO: 2554735 - RNA, 15 nt, Human
cccagcuacucagga

SEQ ID NO: 2554736 - RNA, 20 nt, Human
cccagcuacucaggaggcug

SEQ ID NO: 2554737 - RNA, 16 nt, Human
cccaggaggccagccu

SEQ ID NO: 2554738 - RNA, 15 nt, Human
cccaggaggccagcc

SEQ ID NO: 2554739 - RNA, 15 nt, Human
cccaggcauucccca

SEQ ID NO: 2554740 - RNA, 23 nt, Human
cccaggcaggucuugaacuccug

SEQ ID NO: 2554741 - RNA, 17 nt, Human
cccaggcauuccccagg

SEQ ID NO: 2554742 - RNA, 19 nt, Human
cccagggugggaagggcua

SEQ ID NO: 2554743 - RNA, 18 nt, Human
cccaggguucaguccuca

SEQ ID NO: 2554744 - RNA, 19 nt, Human
cccaggguuaauagggccu

SEQ ID NO: 2554745 - RNA, 16 nt, Human
cccagguaccagcugc

SEQ ID NO: 2554746 - RNA, 15 nt, Human
cccagguaccagcug

SEQ ID NO: 2554747 - RNA, 14 nt, Human
cccagguaccagcu

SEQ ID NO: 2554748 - RNA, 19 nt, Human
cccagguaagcaggaggag

SEQ ID NO: 2554749 - RNA, 17 nt, Human
cccagguaagcaggagg

SEQ ID NO: 2554750 - RNA, 14 nt, Human
cccagguaagcagg

SEQ ID NO: 2554751 - RNA, 18 nt, Human
cccaggguucccccagcc

SEQ ID NO: 2554752 - RNA, 22 nt, Human
cccagguuucuggucucuaggc

SEQ ID NO: 2554753 - RNA, 19 nt, Human
cccagguuucuggucucua

SEQ ID NO: 2554754 - RNA, 13 nt, Human
cccagguuucugg

SEQ ID NO: 2554755 - RNA, 14 nt, Human
cccagguccagcuc

SEQ ID NO: 2554756 - RNA, 14 nt, Human
cccaggucauggaa

SEQ ID NO: 2554757 - RNA, 17 nt, Human
cccaguaaaauugccau

SEQ ID NO: 2554758 - RNA, 16 nt, Human
cccaguaaaauugcca

SEQ ID NO: 2554759 - RNA, 13 nt, Human
cccaguaaaauug

SEQ ID NO: 2554760 - RNA, 12 nt, Human
cccaguaaaauu

SEQ ID NO: 2554761 - RNA, 19 nt, Human
cccagguaccagcugcgcu

SEQ ID NO: 2554762 - RNA, 17 nt, Human
cccagguaccagcugcg

SEQ ID NO: 2554763 - RNA, 13 nt, Human
cccagguuucuau

SEQ ID NO: 2554764 - RNA, 14 nt, Human
cccaguaccuccug

SEQ ID NO: 2554765 - RNA, 15 nt, Human
cccaguaacucaucu

SEQ ID NO: 2554766 - RNA, 18 nt, Human
cccaguaaaauugccaua

SEQ ID NO: 2554767 - RNA, 14 nt, Human
cccagucccccaac

SEQ ID NO: 2554768 - RNA, 23 nt, Human
cccaguccccaccccugccccca

SEQ ID NO: 2554769 - RNA, 21 nt, Human
cccaguccccaccccugcccc

SEQ ID NO: 2554770 - RNA, 22 nt, Human
cccaguaccuccugucucuggc

SEQ ID NO: 2554771 - RNA, 21 nt, Human
cccaguaccuccugucucugg

SEQ ID NO: 2554772 - RNA, 20 nt, Human
cccaguaccuccugucucug

SEQ ID NO: 2554773 - RNA, 14 nt, Human
cccaguaagccacu

SEQ ID NO: 2554774 - RNA, 23 nt, Human
cccaguccccgugccccgccucc

SEQ ID NO: 2554775 - RNA, 13 nt, Human
cccaguccccgug

SEQ ID NO: 2554776 - RNA, 22 nt, Human
cccagucccccaaccccagccg

SEQ ID NO: 2554777 - RNA, 20 nt, Human
cccagucccccaaccccagc

SEQ ID NO: 2554778 - RNA, 12 nt, Human
cccagucccugg

SEQ ID NO: 2554779 - RNA, 13 nt, Human
cccagucccuggg

SEQ ID NO: 2554780 - RNA, 14 nt, Human
cccagucccugggg

SEQ ID NO: 2554781 - RNA, 16 nt, Human
cccagucccuggggga

SEQ ID NO: 2554782 - RNA, 20 nt, Human
cccaguccuggccuggcuuc

SEQ ID NO: 2554783 - RNA, 17 nt, Human
cccaguccuggccuggc

SEQ ID NO: 2554784 - RNA, 16 nt, Human
cccaguccuggccugg

SEQ ID NO: 2554785 - RNA, 15 nt, Human
cccaguccuggccug

SEQ ID NO: 2554786 - RNA, 14 nt, Human
cccaguccuggccu

SEQ ID NO: 2554787 - RNA, 13 nt, Human
cccaguccuggcc

SEQ ID NO: 2554788 - RNA, 23 nt, Human
cccagucccugggggaagcccug

SEQ ID NO: 2554789 - RNA, 22 nt, Human
cccagugggaggggcaggcuga

SEQ ID NO: 2554790 - RNA, 21 nt, Human
cccagugggaggggcaggcug

SEQ ID NO: 2554791 - RNA, 20 nt, Human
cccagugggaggggcaggcu

SEQ ID NO: 2554792 - RNA, 19 nt, Human
cccagugggaggggcaggc

SEQ ID NO: 2554793 - RNA, 18 nt, Human
cccagugggaggggcagg

SEQ ID NO: 2554794 - RNA, 17 nt, Human
cccagugggaggggcag

SEQ ID NO: 2554795 - RNA, 16 nt, Human
cccagugggaggggca

SEQ ID NO: 2554796 - RNA, 20 nt, Human
cccagugguuccuaauccuc

SEQ ID NO: 2554797 - RNA, 14 nt, Human
cccagugggagggg

SEQ ID NO: 2554798 - RNA, 20 nt, Human
cccagugggaggcgcgagcc

SEQ ID NO: 2554799 - RNA, 16 nt, Human
cccagugggaggcgcg

SEQ ID NO: 2554800 - RNA, 15 nt, Human
cccagugggaggcgc

SEQ ID NO: 2554801 - RNA, 12 nt, Human
cccagugggagg

SEQ ID NO: 2554802 - RNA, 18 nt, Human
cccaguggcuguucugga

SEQ ID NO: 2554803 - RNA, 21 nt, Human
cccaguggcugcugcccaggc

SEQ ID NO: 2554804 - RNA, 18 nt, Human
cccaguggcugcugccca

SEQ ID NO: 2554805 - RNA, 15 nt, Human
cccaguggcugcugc

SEQ ID NO: 2554806 - RNA, 17 nt, Human
cccaguggcugcugccc

SEQ ID NO: 2554807 - RNA, 16 nt, Human
cccaguggcugcugcc

SEQ ID NO: 2554808 - RNA, 14 nt, Human
cccaguuagcucuc

SEQ ID NO: 2554809 - RNA, 14 nt, Human
cccaguucacccug

SEQ ID NO: 2554810 - RNA, 20 nt, Human
cccagugucuuccugugggg

SEQ ID NO: 2554811 - RNA, 19 nt, Human
cccaguucaggagucccaa

SEQ ID NO: 2554812 - RNA, 22 nt, Human
cccaguucaacucauggagaug

SEQ ID NO: 2554813 - RNA, 22 nt, Human
cccaguucaggagucccaagga

SEQ ID NO: 2554814 - RNA, 16 nt, Human
cccagugucuuccugu

SEQ ID NO: 2554815 - RNA, 15 nt, Human
cccagugucuuccug

SEQ ID NO: 2554816 - RNA, 22 nt, Human
cccagugucaaguugugcuugu

SEQ ID NO: 2554817 - RNA, 21 nt, Human
cccagugucaaguugugcuug

SEQ ID NO: 2554818 - RNA, 18 nt, Human
cccagugucuuccugugg

SEQ ID NO: 2554819 - RNA, 17 nt, Human
cccagugucuuccugug

SEQ ID NO: 2554820 - RNA, 17 nt, Human
cccagucuacccagaga

SEQ ID NO: 2554821 - RNA, 15 nt, Human
cccagucuacccaga

SEQ ID NO: 2554822 - RNA, 23 nt, Human
cccaguccuggccuggcuucucc

SEQ ID NO: 2554823 - RNA, 15 nt, Human
cccagucucuggcag

SEQ ID NO: 2554824 - RNA, 16 nt, Human
cccagucuacccagag

SEQ ID NO: 2554825 - RNA, 14 nt, Human
cccagugcccccac

SEQ ID NO: 2554826 - RNA, 21 nt, Human
cccagugcccacaggaucagu

SEQ ID NO: 2554827 - RNA, 19 nt, Human
cccagugcccccacugacc

SEQ ID NO: 2554828 - RNA, 20 nt, Human
cccagugcccccacugacca

SEQ ID NO: 2554829 - RNA, 20 nt, Human
cccagucucuggcaguucug

SEQ ID NO: 2554830 - RNA, 22 nt, Human
cccagugcccccacugaccaga

SEQ ID NO: 2554831 - RNA, 15 nt, Human
cccagugccgagaag

SEQ ID NO: 2554832 - RNA, 19 nt, Human
cccagucuggaaugcagug

SEQ ID NO: 2554833 - RNA, 18 nt, Human
cccagucuggaaugcagu

SEQ ID NO: 2554834 - RNA, 10 nt, Human
cccagucugg

SEQ ID NO: 2554835 - RNA, 17 nt, Human
cccaguccuuccaccuc

SEQ ID NO: 2554836 - RNA, 16 nt, Human
cccaguccuuccaccu

SEQ ID NO: 2554837 - RNA, 22 nt, Human
cccaguccuggccuggcuucuc

SEQ ID NO: 2554838 - RNA, 21 nt, Human
cccaguccuggccuggcuucu

SEQ ID NO: 2554839 - RNA, 14 nt, Human
cccaguccuuccac

SEQ ID NO: 2554840 - RNA, 21 nt, Human
ccccaaauggaaaugggcaga

SEQ ID NO: 2554841 - RNA, 19 nt, Human
ccccaaauccgaaccuccu

SEQ ID NO: 2554842 - RNA, 23 nt, Human
ccccaaauccgaaccuccucugu

SEQ ID NO: 2554843 - RNA, 14 nt, Human
ccccaaccccagcc

SEQ ID NO: 2554844 - RNA, 13 nt, Human
ccccaaccccagc

SEQ ID NO: 2554845 - RNA, 13 nt, Human
ccccaaccccuga

SEQ ID NO: 2554846 - RNA, 23 nt, Human
ccccaacccccagcacccgggcu

SEQ ID NO: 2554847 - RNA, 13 nt, Human
ccccaacccccac

SEQ ID NO: 2554848 - RNA, 21 nt, Human
ccccaaagcuuuccugcccca

SEQ ID NO: 2554849 - RNA, 19 nt, Human
ccccaaagcuuuccugccc

SEQ ID NO: 2554850 - RNA, 18 nt, Human
ccccaaagcuuuccugcc

SEQ ID NO: 2554851 - RNA, 16 nt, Human
ccccaaagcuuuccug

SEQ ID NO: 2554852 - RNA, 19 nt, Human
ccccaaaggaaaaagcaca

SEQ ID NO: 2554853 - RNA, 20 nt, Human
ccccaaagagccuggagaag

SEQ ID NO: 2554854 - RNA, 15 nt, Human
ccccaaaucaauaca

SEQ ID NO: 2554855 - RNA, 11 nt, Human
ccccaaauccg

SEQ ID NO: 2554856 - RNA, 18 nt, Human
ccccaaauaagaagggau

SEQ ID NO: 2554857 - RNA, 17 nt, Human
ccccaaauaagaaggga

SEQ ID NO: 2554858 - RNA, 14 nt, Human
ccccaaccugcuga

SEQ ID NO: 2554859 - RNA, 13 nt, Human
ccccaacuccugg

SEQ ID NO: 2554860 - RNA, 14 nt, Human
ccccaacuccugga

SEQ ID NO: 2554861 - RNA, 13 nt, Human
ccccacacugggg

SEQ ID NO: 2554862 - RNA, 15 nt, Human
ccccaacuccuggaa

SEQ ID NO: 2554863 - RNA, 18 nt, Human
ccccacacuggggugccg

SEQ ID NO: 2554864 - RNA, 22 nt, Human
ccccacacuuguuccagcucuu

SEQ ID NO: 2554865 - RNA, 16 nt, Human
ccccaaccccugagga

SEQ ID NO: 2554866 - RNA, 14 nt, Human
ccccaaccccugag

SEQ ID NO: 2554867 - RNA, 17 nt, Human
ccccaaccccugaggaa

SEQ ID NO: 2554868 - RNA, 13 nt, Human
ccccaacccugcc

SEQ ID NO: 2554869 - RNA, 15 nt, Human
ccccaacccugcccc

SEQ ID NO: 2554870 - RNA, 17 nt, Human
ccccaacccugccccug

SEQ ID NO: 2554871 - RNA, 18 nt, Human
ccccaacccugccccugc

SEQ ID NO: 2554872 - RNA, 23 nt, Human
ccccaacccugccccugccccgu

SEQ ID NO: 2554873 - RNA, 13 nt, Human
cccaugugccaag

SEQ ID NO: 2554874 - RNA, 21 nt, Human
cccauguguccugguucccgu

SEQ ID NO: 2554875 - RNA, 14 nt, Human
cccaugugugagug

SEQ ID NO: 2554876 - RNA, 19 nt, Human
cccaugugugagugugugc

SEQ ID NO: 2554877 - RNA, 20 nt, Human
cccaugugugagugugugca

SEQ ID NO: 2554878 - RNA, 15 nt, Human
cccauguuucucugg

SEQ ID NO: 2554879 - RNA, 18 nt, Human
cccauuagaccaagcuug

SEQ ID NO: 2554880 - RNA, 21 nt, Human
cccauuaggacaaucaguccc

SEQ ID NO: 2554881 - RNA, 16 nt, Human
cccauuagcaaaaauu

SEQ ID NO: 2554882 - RNA, 19 nt, Human
ccccaaagagccuggagaa

SEQ ID NO: 2554883 - RNA, 15 nt, Human
ccccaaagagccugg

SEQ ID NO: 2554884 - RNA, 16 nt, Human
cccauuaggacaauca

SEQ ID NO: 2554885 - RNA, 14 nt, Human
ccccaaagagccug

SEQ ID NO: 2554886 - RNA, 22 nt, Human
ccccaaagagccuggagaagcu

SEQ ID NO: 2554887 - RNA, 12 nt, Human
ccccaaagcccc

SEQ ID NO: 2554888 - RNA, 17 nt, Human
cccauguaacagaaagg

SEQ ID NO: 2554889 - RNA, 14 nt, Human
cccauguagccccc

SEQ ID NO: 2554890 - RNA, 15 nt, Human
cccauguagcccccu

SEQ ID NO: 2554891 - RNA, 21 nt, Human
cccauguagcccccuggccuc

SEQ ID NO: 2554892 - RNA, 22 nt, Human
cccauguagcccccuggccucu

SEQ ID NO: 2554893 - RNA, 23 nt, Human
cccauguagcccccuggccucug

SEQ ID NO: 2554894 - RNA, 18 nt, Human
cccaugucgcgcucagca

SEQ ID NO: 2554895 - RNA, 23 nt, Human
cccauguauuuaucucuauuuaa

SEQ ID NO: 2554896 - RNA, 16 nt, Human
cccaugucucgacuca

SEQ ID NO: 2554897 - RNA, 17 nt, Human
cccaugucucgacucau

SEQ ID NO: 2554898 - RNA, 19 nt, Human
cccaugucgcgcucagcau

SEQ ID NO: 2554899 - RNA, 16 nt, Human
cccaugucucucagaa

SEQ ID NO: 2554900 - RNA, 14 nt, Human
cccaucucaugccc

SEQ ID NO: 2554901 - RNA, 13 nt, Human
cccaucugugaau

SEQ ID NO: 2554902 - RNA, 16 nt, Human
cccaucugugaauaag

SEQ ID NO: 2554903 - RNA, 20 nt, Human
cccaucugugaaaggaaaga

SEQ ID NO: 2554904 - RNA, 22 nt, Human
cccaugaacuuaaaaugaaagu

SEQ ID NO: 2554905 - RNA, 20 nt, Human
cccaugaacacacugugucc

SEQ ID NO: 2554906 - RNA, 12 nt, Human
cccaucuugcuu

SEQ ID NO: 2554907 - RNA, 18 nt, Human
cccaugaagacaggacag

SEQ ID NO: 2554908 - RNA, 19 nt, Human
cccaugaagacaggacagu

SEQ ID NO: 2554909 - RNA, 22 nt, Human
cccaugaagacaggacagugcu

SEQ ID NO: 2554910 - RNA, 18 nt, Human
cccaucucacacaugagc

SEQ ID NO: 2554911 - RNA, 13 nt, Human
cccaucucacaca

SEQ ID NO: 2554912 - RNA, 21 nt, Human
cccaucuaugucccuugcugu

SEQ ID NO: 2554913 - RNA, 13 nt, Human
cccaugcugcccu

SEQ ID NO: 2554914 - RNA, 12 nt, Human
cccaugcugccc

SEQ ID NO: 2554915 - RNA, 14 nt, Human
cccaugcugcccug

SEQ ID NO: 2554916 - RNA, 19 nt, Human
cccauggggagggauucug

SEQ ID NO: 2554917 - RNA, 17 nt, Human
cccaugggcucugacag

SEQ ID NO: 2554918 - RNA, 16 nt, Human
cccaugggcucugaca

SEQ ID NO: 2554919 - RNA, 20 nt, Human
cccaugccuguccagccugg

SEQ ID NO: 2554920 - RNA, 16 nt, Human
cccaugagccucagca

SEQ ID NO: 2554921 - RNA, 15 nt, Human
cccaugagccucagc

SEQ ID NO: 2554922 - RNA, 20 nt, Human
cccaugagccucagcauccu

SEQ ID NO: 2554923 - RNA, 16 nt, Human
cccaugccuguccagc

SEQ ID NO: 2554924 - RNA, 19 nt, Human
cccaugccuguccagccug

SEQ ID NO: 2554925 - RNA, 14 nt, Human
cccaugccugucca

SEQ ID NO: 2554926 - RNA, 16 nt, Human
cccaugaaucaaagac

SEQ ID NO: 2554927 - RNA, 20 nt, Human
ccucccgaauagcugggacu

SEQ ID NO: 2554928 - RNA, 19 nt, Human
ccucccgaauagcugggac

SEQ ID NO: 2554929 - RNA, 21 nt, Human
ccucccgaauagcugggacua

SEQ ID NO: 2554930 - RNA, 14 nt, Human
ccuccccugcugca

SEQ ID NO: 2554931 - RNA, 13 nt, Human
ccuccccugcugc

SEQ ID NO: 2554932 - RNA, 16 nt, Human
ccuccccugcugaagg

SEQ ID NO: 2554933 - RNA, 12 nt, Human
ccuccccugcug

SEQ ID NO: 2554934 - RNA, 16 nt, Human
ccuccccugcccuggu

SEQ ID NO: 2554935 - RNA, 18 nt, Human
ccucccgaguagcuggga

SEQ ID NO: 2554936 - RNA, 17 nt, Human
ccucccgaguagcuggg

SEQ ID NO: 2554937 - RNA, 13 nt, Human
ccucccucuaauu

SEQ ID NO: 2554938 - RNA, 13 nt, Human
ccucccucucucu

SEQ ID NO: 2554939 - RNA, 18 nt, Human
ccucccucucucuucugc

SEQ ID NO: 2554940 - RNA, 12 nt, Human
ccucccuccugc

SEQ ID NO: 2554941 - RNA, 15 nt, Human
ccucccuccugccga

SEQ ID NO: 2554942 - RNA, 21 nt, Human
ccucccuccugccgacuccug

SEQ ID NO: 2554943 - RNA, 13 nt, Human
ccucccucuuucc

SEQ ID NO: 2554944 - RNA, 20 nt, Human
ccucccucucucuucugcuc

SEQ ID NO: 2554945 - RNA, 22 nt, Human
ccucccucucucuucugcucca

SEQ ID NO: 2554946 - RNA, 14 nt, Human
ccucccucugaccu

SEQ ID NO: 2554947 - RNA, 18 nt, Human
ccucccucugaccugcag

SEQ ID NO: 2554948 - RNA, 16 nt, Human
ccuccucaccucaugc

SEQ ID NO: 2554949 - RNA, 21 nt, Human
ccucccucugaggcuguagga

SEQ ID NO: 2554950 - RNA, 19 nt, Human
ccucccucugaggcuguag

SEQ ID NO: 2554951 - RNA, 14 nt, Human
ccucccucugaggc

SEQ ID NO: 2554952 - RNA, 19 nt, Human
ccucccucugaccugcagg

SEQ ID NO: 2554953 - RNA, 19 nt, Human
ccuccucaccucaugccca

SEQ ID NO: 2554954 - RNA, 17 nt, Human
ccuccucaccucaugcc

SEQ ID NO: 2554955 - RNA, 13 nt, Human
ccuccucaccucu

SEQ ID NO: 2554956 - RNA, 14 nt, Human
ccuccucaccucug

SEQ ID NO: 2554957 - RNA, 15 nt, Human
ccuccucaccucugg

SEQ ID NO: 2554958 - RNA, 11 nt, Human
ccuccucagau

SEQ ID NO: 2554959 - RNA, 16 nt, Human
ccuccucaccucugga

SEQ ID NO: 2554960 - RNA, 21 nt, Human
ccuccucaccucuggacuggc

SEQ ID NO: 2554961 - RNA, 22 nt, Human
ccuccucaccucuggacuggcu

SEQ ID NO: 2554962 - RNA, 22 nt, Human
ccuccucaccucaugcccaccc

SEQ ID NO: 2554963 - RNA, 14 nt, Human
ccuccucacucccu

SEQ ID NO: 2554964 - RNA, 19 nt, Human
ccuccucacuggccauccc

SEQ ID NO: 2554965 - RNA, 17 nt, Human
ccuccucacuggccauc

SEQ ID NO: 2554966 - RNA, 15 nt, Human
ccuccucacuggcca

SEQ ID NO: 2554967 - RNA, 14 nt, Human
ccuccucacuggcc

SEQ ID NO: 2554968 - RNA, 20 nt, Human
ccuccucacuggccaucccu

SEQ ID NO: 2554969 - RNA, 16 nt, Human
ccuccuccacucuccc

SEQ ID NO: 2554970 - RNA, 12 nt, Human
ccuccuccagcc

SEQ ID NO: 2554971 - RNA, 15 nt, Human
ccuccccucccgucu

SEQ ID NO: 2554972 - RNA, 13 nt, Human
ccuccccucccgu

SEQ ID NO: 2554973 - RNA, 23 nt, Human
ccuccccucucuugcacccgccu

SEQ ID NO: 2554974 - RNA, 15 nt, Human
ccuccccuccuccug

SEQ ID NO: 2554975 - RNA, 14 nt, Human
ccuccccuccccug

SEQ ID NO: 2554976 - RNA, 19 nt, Human
ccuccccuccccugcugca

SEQ ID NO: 2554977 - RNA, 16 nt, Human
ccuccccuccccugcu

SEQ ID NO: 2554978 - RNA, 15 nt, Human
ccuccccuccccugc

SEQ ID NO: 2554979 - RNA, 19 nt, Human
ccuccccucacagccucug

SEQ ID NO: 2554980 - RNA, 18 nt, Human
ccuccccucacagccucu

SEQ ID NO: 2554981 - RNA, 21 nt, Human
ccuccccucacagccucugac

SEQ ID NO: 2554982 - RNA, 16 nt, Human
ccuccccucacagccu

SEQ ID NO: 2554983 - RNA, 15 nt, Human
ccuccccucacagcc

SEQ ID NO: 2554984 - RNA, 13 nt, Human
ccuccccucacag

SEQ ID NO: 2554985 - RNA, 14 nt, Human
ccuccccugccacc

SEQ ID NO: 2554986 - RNA, 13 nt, Human
ccuccccugccac

SEQ ID NO: 2554987 - RNA, 22 nt, Human
ccuccccugaggcucagggaaa

SEQ ID NO: 2554988 - RNA, 14 nt, Human
ccuccccugaggcu

SEQ ID NO: 2554989 - RNA, 12 nt, Human
ccuccccugcca

SEQ ID NO: 2554990 - RNA, 17 nt, Human
ccuccccugccaccagg

SEQ ID NO: 2554991 - RNA, 13 nt, Human
ccuccccugccag

SEQ ID NO: 2554992 - RNA, 16 nt, Human
ccuccccugccagggc

SEQ ID NO: 2554993 - RNA, 18 nt, Human
ccuccccugccagggcag

SEQ ID NO: 2554994 - RNA, 18 nt, Human
ccucccgaauagcuggga

SEQ ID NO: 2554995 - RNA, 14 nt, Human
ccuccccugccauu

SEQ ID NO: 2554996 - RNA, 13 nt, Human
ccuccccugcccu

SEQ ID NO: 2554997 - RNA, 14 nt, Human
ccuccccugcccua

SEQ ID NO: 2554998 - RNA, 15 nt, Human
ccuccccugcccugg

SEQ ID NO: 2554999 - RNA, 15 nt, Human
ccuccccgcaccccc

SEQ ID NO: 2555000 - RNA, 21 nt, Human
ccuccccgcaccccccaagcu

SEQ ID NO: 2555001 - RNA, 14 nt, Human
ccuccccggcccua

SEQ ID NO: 2555002 - RNA, 22 nt, Human
ccucccccuucucccaccccug

SEQ ID NO: 2555003 - RNA, 16 nt, Human
ccuccccgcccuuuuu

SEQ ID NO: 2555004 - RNA, 23 nt, Human
ccuccccggcucgagcaguccug

SEQ ID NO: 2555005 - RNA, 21 nt, Human
ccuccccggcccuaccagcgc

SEQ ID NO: 2555006 - RNA, 13 nt, Human
ccuccccuaucca

SEQ ID NO: 2555007 - RNA, 15 nt, Human
ccuccccuauccacc

SEQ ID NO: 2555008 - RNA, 17 nt, Human
ccuccccuauccaccca

SEQ ID NO: 2555009 - RNA, 18 nt, Human
ccuccccuauccacccag

SEQ ID NO: 2555010 - RNA, 22 nt, Human
ccuccccuauccacccagccca

SEQ ID NO: 2555011 - RNA, 12 nt, Human
ccucccccuucu

SEQ ID NO: 2555012 - RNA, 15 nt, Human
ccucccccuucuccc

SEQ ID NO: 2555013 - RNA, 20 nt, Human
ccucccccugccagugccuu

SEQ ID NO: 2555014 - RNA, 18 nt, Human
ccucccccugccagugcc

SEQ ID NO: 2555015 - RNA, 19 nt, Human
ccucccccugccagugccu

SEQ ID NO: 2555016 - RNA, 16 nt, Human
ccucccccugccagga

SEQ ID NO: 2555017 - RNA, 15 nt, Human
ccucccccugccagu

SEQ ID NO: 2555018 - RNA, 17 nt, Human
ccucccccugccagugc

SEQ ID NO: 2555019 - RNA, 14 nt, Human
ccucccccugccag

SEQ ID NO: 2555020 - RNA, 13 nt, Human
ccucccccugcca

SEQ ID NO: 2555021 - RNA, 15 nt, Human
ccucccccccaugca

SEQ ID NO: 2555022 - RNA, 16 nt, Human
ccucccccccaugcac

SEQ ID NO: 2555023 - RNA, 17 nt, Human
ccucccccccaugcacu

SEQ ID NO: 2555024 - RNA, 19 nt, Human
ccucccccccaugcacugu

SEQ ID NO: 2555025 - RNA, 17 nt, Human
ccucccccgccacuccu

SEQ ID NO: 2555026 - RNA, 17 nt, Human
ccucccccucccccuuc

SEQ ID NO: 2555027 - RNA, 16 nt, Human
ccucccccgccacucc

SEQ ID NO: 2555028 - RNA, 20 nt, Human
ccuccccccacugcaggccc

SEQ ID NO: 2555029 - RNA, 16 nt, Human
ccuccccccacugcag

SEQ ID NO: 2555030 - RNA, 15 nt, Human
ccucccaacucaccc

SEQ ID NO: 2555031 - RNA, 17 nt, Human
ccuccccccacugcagg

SEQ ID NO: 2555032 - RNA, 18 nt, Human
ccuccccccacugcaggc

SEQ ID NO: 2555033 - RNA, 23 nt, Human
ccucccaaagugcugggauuaca

SEQ ID NO: 2555034 - RNA, 12 nt, Human
ccuccauccuga

SEQ ID NO: 2555035 - RNA, 13 nt, Human
ccuccauccugag

SEQ ID NO: 2555036 - RNA, 16 nt, Human
ccuccaugcugccucc

SEQ ID NO: 2555037 - RNA, 19 nt, Human
ccuccaugcugccuccaga

SEQ ID NO: 2555038 - RNA, 11 nt, Human
ccuccauggga

SEQ ID NO: 2555039 - RNA, 14 nt, Human
ccucccaacucacc

SEQ ID NO: 2555040 - RNA, 17 nt, Human
ccucccaaagugcuggg

SEQ ID NO: 2555041 - RNA, 15 nt, Human
ccuccaugugggcua

SEQ ID NO: 2555042 - RNA, 12 nt, Human
ccuccauguggg

SEQ ID NO: 2555043 - RNA, 12 nt, Human
ccuccaggugca

SEQ ID NO: 2555044 - RNA, 11 nt, Human
ccuccaggugc

SEQ ID NO: 2555045 - RNA, 18 nt, Human
ccuccagguuuuucaauu

SEQ ID NO: 2555046 - RNA, 17 nt, Human
ccuccagguuuuucaau

SEQ ID NO: 2555047 - RNA, 17 nt, Human
ccuccagggugugugcu

SEQ ID NO: 2555048 - RNA, 17 nt, Human
ccuccaggugcacaagc

SEQ ID NO: 2555049 - RNA, 21 nt, Human
ccuccagguuuuucaauuaaa

SEQ ID NO: 2555050 - RNA, 16 nt, Human
ccuccagguuuuucaa

SEQ ID NO: 2555051 - RNA, 23 nt, Human
ccuccaguccaaggaaaccacag

SEQ ID NO: 2555052 - RNA, 22 nt, Human
ccuccagguuuuucaauuaaac

SEQ ID NO: 2555053 - RNA, 20 nt, Human
ccuccagguuuuucaauuaa

SEQ ID NO: 2555054 - RNA, 19 nt, Human
ccuccagguuuuucaauua

SEQ ID NO: 2555055 - RNA, 15 nt, Human
ccuccaucccgacau

SEQ ID NO: 2555056 - RNA, 19 nt, Human
ccuccauauuuucuuuaaa

SEQ ID NO: 2555057 - RNA, 14 nt, Human
ccuccaucccgaca

SEQ ID NO: 2555058 - RNA, 15 nt, Human
ccuccagccucuguu

SEQ ID NO: 2555059 - RNA, 13 nt, Human
ccuccagaagccu

SEQ ID NO: 2555060 - RNA, 21 nt, Human
ccuccagaacucacuggggcc

SEQ ID NO: 2555061 - RNA, 22 nt, Human
ccuccagaacucacuggggccu

SEQ ID NO: 2555062 - RNA, 12 nt, Human
ccuccagaagcc

SEQ ID NO: 2555063 - RNA, 22 nt, Human
ccuccacucucccccacccccu

SEQ ID NO: 2555064 - RNA, 19 nt, Human
ccuccacucucccccaccc

SEQ ID NO: 2555065 - RNA, 13 nt, Human
ccuccacucuccu

SEQ ID NO: 2555066 - RNA, 13 nt, Human
ccuccacugucac

SEQ ID NO: 2555067 - RNA, 12 nt, Human
ccuccacuguca

SEQ ID NO: 2555068 - RNA, 15 nt, Human
ccuccagcucuuucc

SEQ ID NO: 2555069 - RNA, 16 nt, Human
ccuccagcucuuuccu

SEQ ID NO: 2555070 - RNA, 22 nt, Human
ccuccagcucuuuccuccuucc

SEQ ID NO: 2555071 - RNA, 17 nt, Human
ccuccagcucuuuccuc

SEQ ID NO: 2555072 - RNA, 19 nt, Human
ccuccagcucuuuccuccu

SEQ ID NO: 2555073 - RNA, 20 nt, Human
ccuccagcuucaggcaggcc

SEQ ID NO: 2555074 - RNA, 19 nt, Human
ccuccagcuuguggagccc

SEQ ID NO: 2555075 - RNA, 21 nt, Human
ccuccagcuucugguacucuc

SEQ ID NO: 2555076 - RNA, 12 nt, Human
ccuccagcuucu

SEQ ID NO: 2555077 - RNA, 22 nt, Human
ccuccagcuuguggagccccac

SEQ ID NO: 2555078 - RNA, 21 nt, Human
ccuccagcuuguggagcccca

SEQ ID NO: 2555079 - RNA, 22 nt, Human
ccuccaggaaugaucucuucuu

SEQ ID NO: 2555080 - RNA, 15 nt, Human
ccuccaggaaccaca

SEQ ID NO: 2555081 - RNA, 23 nt, Human
ccuccagggcuggacugaggccu

SEQ ID NO: 2555082 - RNA, 22 nt, Human
ccuccagggcuggacugaggcc

SEQ ID NO: 2555083 - RNA, 13 nt, Human
ccuccaggcaaaa

SEQ ID NO: 2555084 - RNA, 17 nt, Human
ccucaggugagaagcag

SEQ ID NO: 2555085 - RNA, 18 nt, Human
ccucaggugagaagcaga

SEQ ID NO: 2555086 - RNA, 20 nt, Human
ccucaggugagaagcagagg

SEQ ID NO: 2555087 - RNA, 21 nt, Human
ccucaguggacuuuccacccc

SEQ ID NO: 2555088 - RNA, 20 nt, Human
ccucaguggacuuuccaccc

SEQ ID NO: 2555089 - RNA, 13 nt, Human
ccucaguguauuu

SEQ ID NO: 2555090 - RNA, 23 nt, Human
ccucaguggacuuuccacccccu

SEQ ID NO: 2555091 - RNA, 11 nt, Human
ccucaguguca

SEQ ID NO: 2555092 - RNA, 12 nt, Human
ccucagugucau

SEQ ID NO: 2555093 - RNA, 15 nt, Human
ccucaguucccuugg

SEQ ID NO: 2555094 - RNA, 16 nt, Human
ccucaguucccuuggc

SEQ ID NO: 2555095 - RNA, 17 nt, Human
ccucaguucccuuggcc

SEQ ID NO: 2555096 - RNA, 18 nt, Human
ccucaguucccuuggccu

SEQ ID NO: 2555097 - RNA, 19 nt, Human
ccucaguucccuuggccuc

SEQ ID NO: 2555098 - RNA, 20 nt, Human
ccucaguucccuuggccuca

SEQ ID NO: 2555099 - RNA, 21 nt, Human
ccucaguucccuuggccucag

SEQ ID NO: 2555100 - RNA, 22 nt, Human
ccucaguucccuuggccucaga

SEQ ID NO: 2555101 - RNA, 17 nt, Human
ccuccacucucccccac

SEQ ID NO: 2555102 - RNA, 14 nt, Human
ccuccacucucccc

SEQ ID NO: 2555103 - RNA, 19 nt, Human
ccucaguuuuaucauuuuc

SEQ ID NO: 2555104 - RNA, 15 nt, Human
ccucaguuucccuau

SEQ ID NO: 2555105 - RNA, 16 nt, Human
ccuccacuccuuccug

SEQ ID NO: 2555106 - RNA, 15 nt, Human
ccuccacuccuuccu

SEQ ID NO: 2555107 - RNA, 23 nt, Human
ccucaguuuaauccuucuaguuu

SEQ ID NO: 2555108 - RNA, 23 nt, Human
ccucagugucauuuaugaaaaga

SEQ ID NO: 2555109 - RNA, 17 nt, Human
ccucuagaaauuuuuca

SEQ ID NO: 2555110 - RNA, 18 nt, Human
ccucugcacuccccugcu

SEQ ID NO: 2555111 - RNA, 23 nt, Human
ccucugcacuccccugcugggug

SEQ ID NO: 2555112 - RNA, 14 nt, Human
ccucugcagcaaua

SEQ ID NO: 2555113 - RNA, 18 nt, Human
ccucugcagcaauaaagc

SEQ ID NO: 2555114 - RNA, 16 nt, Human
ccucugcccacucccu

SEQ ID NO: 2555115 - RNA, 13 nt, Human
ccucugcccacuc

SEQ ID NO: 2555116 - RNA, 19 nt, Human
ccucugcagcaauaaagca

SEQ ID NO: 2555117 - RNA, 12 nt, Human
ccucugccaccu

SEQ ID NO: 2555118 - RNA, 13 nt, Human
ccucugccaccuc

SEQ ID NO: 2555119 - RNA, 14 nt, Human
ccucugccaccucc

SEQ ID NO: 2555120 - RNA, 15 nt, Human
ccucugccaccuccc

SEQ ID NO: 2555121 - RNA, 16 nt, Human
ccucugccaccucccc

SEQ ID NO: 2555122 - RNA, 11 nt, Human
ccucugaggcu

SEQ ID NO: 2555123 - RNA, 21 nt, Human
ccucugagggaaagcccagaa

SEQ ID NO: 2555124 - RNA, 20 nt, Human
ccucugagggaaagcccaga

SEQ ID NO: 2555125 - RNA, 17 nt, Human
ccucugaggcuguagga

SEQ ID NO: 2555126 - RNA, 18 nt, Human
ccucugaggcuggauccu

SEQ ID NO: 2555127 - RNA, 13 nt, Human
ccucugaggcuga

SEQ ID NO: 2555128 - RNA, 11 nt, Human
ccucugagccu

SEQ ID NO: 2555129 - RNA, 12 nt, Human
ccucugagccuu

SEQ ID NO: 2555130 - RNA, 17 nt, Human
ccucugagcuuugcaug

SEQ ID NO: 2555131 - RNA, 15 nt, Human
ccucugagcuuugca

SEQ ID NO: 2555132 - RNA, 14 nt, Human
ccucugagcuuugc

SEQ ID NO: 2555133 - RNA, 19 nt, Human
ccucugagccccugggacu

SEQ ID NO: 2555134 - RNA, 17 nt, Human
ccucugcacuccccugc

SEQ ID NO: 2555135 - RNA, 16 nt, Human
ccucugcacuccccug

SEQ ID NO: 2555136 - RNA, 15 nt, Human
ccucugcacuccccu

SEQ ID NO: 2555137 - RNA, 16 nt, Human
ccucugaucuccaugg

SEQ ID NO: 2555138 - RNA, 15 nt, Human
ccucugauaccucaa

SEQ ID NO: 2555139 - RNA, 18 nt, Human
ccucugauacccagagca

SEQ ID NO: 2555140 - RNA, 15 nt, Human
ccucugauacccaga

SEQ ID NO: 2555141 - RNA, 19 nt, Human
ccucugagucaccaucuua

SEQ ID NO: 2555142 - RNA, 22 nt, Human
ccucugagggaaagcccagaaa

SEQ ID NO: 2555143 - RNA, 20 nt, Human
ccucugauacccagagcauu

SEQ ID NO: 2555144 - RNA, 19 nt, Human
ccucugauacccagagcau

SEQ ID NO: 2555145 - RNA, 14 nt, Human
ccucugauaccuca

SEQ ID NO: 2555146 - RNA, 17 nt, Human
ccucugacucagggcuc

SEQ ID NO: 2555147 - RNA, 19 nt, Human
ccucugacucagggcuccu

SEQ ID NO: 2555148 - RNA, 21 nt, Human
ccucugacucagggcuccugg

SEQ ID NO: 2555149 - RNA, 22 nt, Human
ccucugacucagggcuccuggg

SEQ ID NO: 2555150 - RNA, 19 nt, Human
ccucugagaauuccaagga

SEQ ID NO: 2555151 - RNA, 22 nt, Human
ccucugacuuaagcugccucaa

SEQ ID NO: 2555152 - RNA, 12 nt, Human
ccucugacucag

SEQ ID NO: 2555153 - RNA, 16 nt, Human
ccucugacucagggcu

SEQ ID NO: 2555154 - RNA, 19 nt, Human
ccucugaccugcaggccaa

SEQ ID NO: 2555155 - RNA, 20 nt, Human
ccucugaccugcaggccaag

SEQ ID NO: 2555156 - RNA, 17 nt, Human
ccucugaccugcacugg

SEQ ID NO: 2555157 - RNA, 15 nt, Human
ccucugaccugcagg

SEQ ID NO: 2555158 - RNA, 16 nt, Human
ccucugaccugcaggc

SEQ ID NO: 2555159 - RNA, 17 nt, Human
ccucugaccugcaggcc

SEQ ID NO: 2555160 - RNA, 21 nt, Human
ccucugacacacagcucuguc

SEQ ID NO: 2555161 - RNA, 19 nt, Human
ccucugaccccuccucacu

SEQ ID NO: 2555162 - RNA, 18 nt, Human
ccucugaccccuccucac

SEQ ID NO: 2555163 - RNA, 17 nt, Human
ccucugaccccuccuca

SEQ ID NO: 2555164 - RNA, 16 nt, Human
ccucugaccccuccuc

SEQ ID NO: 2555165 - RNA, 15 nt, Human
ccucugaccccuccu

SEQ ID NO: 2555166 - RNA, 14 nt, Human
ccucugaccccucc

SEQ ID NO: 2555167 - RNA, 13 nt, Human
ccucugaccccuc

SEQ ID NO: 2555168 - RNA, 16 nt, Human
ccucugaccugcacug

SEQ ID NO: 2555169 - RNA, 14 nt, Human
ccucugaccugcac

SEQ ID NO: 2555170 - RNA, 22 nt, Human
ccucugaccccuccucacuggc

SEQ ID NO: 2555171 - RNA, 20 nt, Human
ccucugaccccuccucacug

SEQ ID NO: 2555172 - RNA, 12 nt, Human
ccucugaccuau

SEQ ID NO: 2555173 - RNA, 16 nt, Human
ccucugaaacccugga

SEQ ID NO: 2555174 - RNA, 19 nt, Human
ccucugaaacccuggacca

SEQ ID NO: 2555175 - RNA, 11 nt, Human
ccucuccugcc

SEQ ID NO: 2555176 - RNA, 13 nt, Human
ccucugacacaca

SEQ ID NO: 2555177 - RNA, 13 nt, Human
ccucuccgagcug

SEQ ID NO: 2555178 - RNA, 13 nt, Human
ccucucccuguug

SEQ ID NO: 2555179 - RNA, 18 nt, Human
ccucuccucauguucugc

SEQ ID NO: 2555180 - RNA, 20 nt, Human
ccucugacacacagcucugu

SEQ ID NO: 2555181 - RNA, 19 nt, Human
ccucugacacacagcucug

SEQ ID NO: 2555182 - RNA, 14 nt, Human
ccucugacacacag

SEQ ID NO: 2555183 - RNA, 12 nt, Human
ccucuccugccu

SEQ ID NO: 2555184 - RNA, 20 nt, Human
ccucugaaugaaccuucugg

SEQ ID NO: 2555185 - RNA, 20 nt, Human
ccucguccucccccugccag

SEQ ID NO: 2555186 - RNA, 21 nt, Human
ccucguccucccccugccagu

SEQ ID NO: 2555187 - RNA, 14 nt, Human
ccuccuucucuguc

SEQ ID NO: 2555188 - RNA, 15 nt, Human
ccucguccucccccu

SEQ ID NO: 2555189 - RNA, 16 nt, Human
ccucguccucccccug

SEQ ID NO: 2555190 - RNA, 17 nt, Human
ccucguccucccccugc

SEQ ID NO: 2555191 - RNA, 19 nt, Human
ccucguccucccccugcca

SEQ ID NO: 2555192 - RNA, 16 nt, Human
ccuccuuguccaccca

SEQ ID NO: 2555193 - RNA, 15 nt, Human
ccuccuuguccaccc

SEQ ID NO: 2555194 - RNA, 17 nt, Human
ccuccuuggugccuggc

SEQ ID NO: 2555195 - RNA, 20 nt, Human
ccuccuugggcacuuuuuaa

SEQ ID NO: 2555196 - RNA, 12 nt, Human
ccuccuugggca

SEQ ID NO: 2555197 - RNA, 15 nt, Human
ccuccuuggugccug

SEQ ID NO: 2555198 - RNA, 17 nt, Human
ccuccuugccuccugug

SEQ ID NO: 2555199 - RNA, 18 nt, Human
ccuccuugccuccugugu

SEQ ID NO: 2555200 - RNA, 19 nt, Human
ccuccuugccuccugugua

SEQ ID NO: 2555201 - RNA, 22 nt, Human
ccuccuugcucugcaggcaccu

SEQ ID NO: 2555202 - RNA, 18 nt, Human
ccuccuugcucugcaggc

SEQ ID NO: 2555203 - RNA, 15 nt, Human
ccuccuugcucugca

SEQ ID NO: 2555204 - RNA, 20 nt, Human
ccuccuugccuccuguguaa

SEQ ID NO: 2555205 - RNA, 13 nt, Human
ccucgugccaguc

SEQ ID NO: 2555206 - RNA, 12 nt, Human
ccucgugccagu

SEQ ID NO: 2555207 - RNA, 13 nt, Human
ccucguggccagc

SEQ ID NO: 2555208 - RNA, 16 nt, Human
ccucguggccagcccg

SEQ ID NO: 2555209 - RNA, 15 nt, Human
ccucguggccagccc

SEQ ID NO: 2555210 - RNA, 14 nt, Human
ccucguggccagcc

SEQ ID NO: 2555211 - RNA, 14 nt, Human
ccucgugccagucg

SEQ ID NO: 2555212 - RNA, 14 nt, Human
ccucuaagccacuc

SEQ ID NO: 2555213 - RNA, 17 nt, Human
ccucguggccagcccgg

SEQ ID NO: 2555214 - RNA, 19 nt, Human
ccucuaagccacucuucca

SEQ ID NO: 2555215 - RNA, 19 nt, Human
ccucuaagguugggcaggg

SEQ ID NO: 2555216 - RNA, 18 nt, Human
ccucuacagagcuucccu

SEQ ID NO: 2555217 - RNA, 13 nt, Human
ccuccucucugcc

SEQ ID NO: 2555218 - RNA, 15 nt, Human
ccuccucucugcccu

SEQ ID NO: 2555219 - RNA, 16 nt, Human
ccuccucucccauccc

SEQ ID NO: 2555220 - RNA, 15 nt, Human
ccuccucucccaucc

SEQ ID NO: 2555221 - RNA, 14 nt, Human
ccuccucucccauc

SEQ ID NO: 2555222 - RNA, 13 nt, Human
ccuccucucccau

SEQ ID NO: 2555223 - RNA, 22 nt, Human
ccuccuucucugucucaugugu

SEQ ID NO: 2555224 - RNA, 17 nt, Human
ccuccuucucugucuca

SEQ ID NO: 2555225 - RNA, 15 nt, Human
ccuccuucucugucu

SEQ ID NO: 2555226 - RNA, 19 nt, Human
ccuccucucccaucccccu

SEQ ID NO: 2555227 - RNA, 16 nt, Human
ccuccucucugcccua

SEQ ID NO: 2555228 - RNA, 23 nt, Human
ccuccuucucugucucaugugug

SEQ ID NO: 2555229 - RNA, 14 nt, Human
ccuccuugccuccu

SEQ ID NO: 2555230 - RNA, 13 nt, Human
ccuccuccuuccc

SEQ ID NO: 2555231 - RNA, 19 nt, Human
ccuccucccacccggcugc

SEQ ID NO: 2555232 - RNA, 21 nt, Human
ccuccuccuucccaaaggacu

SEQ ID NO: 2555233 - RNA, 19 nt, Human
ccuccucuaagguugggca

SEQ ID NO: 2555234 - RNA, 16 nt, Human
ccuccucccacccggc

SEQ ID NO: 2555235 - RNA, 21 nt, Human
ccuccuccagccgccaugcuc

SEQ ID NO: 2555236 - RNA, 20 nt, Human
ccucuccccagcaagugaga

SEQ ID NO: 2555237 - RNA, 14 nt, Human
ccucuccccagccc

SEQ ID NO: 2555238 - RNA, 16 nt, Human
ccucuccccagcccag

SEQ ID NO: 2555239 - RNA, 12 nt, Human
ccucuccccagc

SEQ ID NO: 2555240 - RNA, 22 nt, Human
ccucuccccaagacuugguguc

SEQ ID NO: 2555241 - RNA, 22 nt, Human
ccucucccgccagacuguuaga

SEQ ID NO: 2555242 - RNA, 17 nt, Human
ccucuccccagcccaga

SEQ ID NO: 2555243 - RNA, 22 nt, Human
ccucucccgucagggcccaagu

SEQ ID NO: 2555244 - RNA, 19 nt, Human
ccucucccgucagggccca

SEQ ID NO: 2555245 - RNA, 17 nt, Human
ccucucccgucagggcc

SEQ ID NO: 2555246 - RNA, 14 nt, Human
ccucuccccaagac

SEQ ID NO: 2555247 - RNA, 22 nt, Human
ccucucccucaacaagggagag

SEQ ID NO: 2555248 - RNA, 17 nt, Human
ccucucccucaacaagg

SEQ ID NO: 2555249 - RNA, 11 nt, Human
ccucucccuca

SEQ ID NO: 2555250 - RNA, 23 nt, Human
ccucucccgucagggcccaaguc

SEQ ID NO: 2555251 - RNA, 10 nt, Human
ccucucccug

SEQ ID NO: 2555252 - RNA, 22 nt, Human
ccucucccuuggauuguccccg

SEQ ID NO: 2555253 - RNA, 13 nt, Human
ccucucccuugga

SEQ ID NO: 2555254 - RNA, 13 nt, Human
ccucucccuggcc

SEQ ID NO: 2555255 - RNA, 15 nt, Human
ccucucccuggcccu

SEQ ID NO: 2555256 - RNA, 15 nt, Human
ccucucccugacccu

SEQ ID NO: 2555257 - RNA, 12 nt, Human
ccucucccugac

SEQ ID NO: 2555258 - RNA, 21 nt, Human
ccucucccugacccuguauau

SEQ ID NO: 2555259 - RNA, 17 nt, Human
ccucuccaggcacccuu

SEQ ID NO: 2555260 - RNA, 14 nt, Human
ccucuccaggcacc

SEQ ID NO: 2555261 - RNA, 13 nt, Human
ccucuccaggcac

SEQ ID NO: 2555262 - RNA, 12 nt, Human
ccucuccaggca

SEQ ID NO: 2555263 - RNA, 11 nt, Human
ccucuccaggc

SEQ ID NO: 2555264 - RNA, 14 nt, Human
ccucuccagcuaua

SEQ ID NO: 2555265 - RNA, 14 nt, Human
ccucuacugggagc

SEQ ID NO: 2555266 - RNA, 20 nt, Human
ccucuacuuaaugagauagu

SEQ ID NO: 2555267 - RNA, 20 nt, Human
ccucuacagagcuucccuga

SEQ ID NO: 2555268 - RNA, 21 nt, Human
ccucuacagagcuucccugac

SEQ ID NO: 2555269 - RNA, 24 nt, Human
ccucuacagagcuucccugacuca

SEQ ID NO: 2555270 - RNA, 17 nt, Human
ccucuacuaaaaagaag

SEQ ID NO: 2555271 - RNA, 19 nt, Human
ccucuccaucuucagcuuc

SEQ ID NO: 2555272 - RNA, 16 nt, Human
ccucuccaucuucagc

SEQ ID NO: 2555273 - RNA, 14 nt, Human
ccucuccaucuuca

SEQ ID NO: 2555274 - RNA, 22 nt, Human
ccucuccauaaccccacccuug

SEQ ID NO: 2555275 - RNA, 19 nt, Human
ccucuccauaaccccaccc

SEQ ID NO: 2555276 - RNA, 18 nt, Human
ccucuccauaaccccacc

SEQ ID NO: 2555277 - RNA, 16 nt, Human
ccucuccauaacccca

SEQ ID NO: 2555278 - RNA, 15 nt, Human
ccucuccccagcaag

SEQ ID NO: 2555279 - RNA, 22 nt, Human
ccucucccauugucccucugcc

SEQ ID NO: 2555280 - RNA, 13 nt, Human
ccucucccaggac

SEQ ID NO: 2555281 - RNA, 14 nt, Human
ccucucccaggacc

SEQ ID NO: 2555282 - RNA, 12 nt, Human
ccucucccagga

SEQ ID NO: 2555283 - RNA, 11 nt, Human
ccucucccagg

SEQ ID NO: 2555284 - RNA, 11 nt, Human
ccgguguccuu

SEQ ID NO: 2555285 - RNA, 15 nt, Human
ccggugugccugcag

SEQ ID NO: 2555286 - RNA, 16 nt, Human
ccggugugccugcagc

SEQ ID NO: 2555287 - RNA, 17 nt, Human
ccggugugccugcagcc

SEQ ID NO: 2555288 - RNA, 16 nt, Human
ccggucugcaagucag

SEQ ID NO: 2555289 - RNA, 23 nt, Human
ccggucccuugagaccucagcca

SEQ ID NO: 2555290 - RNA, 20 nt, Human
ccggucccuugagaccucag

SEQ ID NO: 2555291 - RNA, 22 nt, Human
ccggucccuugagaccucagcc

SEQ ID NO: 2555292 - RNA, 21 nt, Human
ccggucugcaagucagaggau

SEQ ID NO: 2555293 - RNA, 20 nt, Human
ccggucugcaagucagagga

SEQ ID NO: 2555294 - RNA, 19 nt, Human
ccggucugcaagucagagg

SEQ ID NO: 2555295 - RNA, 17 nt, Human
ccggucugcaagucaga

SEQ ID NO: 2555296 - RNA, 23 nt, Human
ccguggaggaggaaggcaagagg

SEQ ID NO: 2555297 - RNA, 17 nt, Human
ccguggaccuuccugcc

SEQ ID NO: 2555298 - RNA, 16 nt, Human
ccguggaccuuccugc

SEQ ID NO: 2555299 - RNA, 15 nt, Human
ccguggaccuuccug

SEQ ID NO: 2555300 - RNA, 14 nt, Human
ccguggaccuuccu

SEQ ID NO: 2555301 - RNA, 22 nt, Human
ccguggaggaggaaggcaagag

SEQ ID NO: 2555302 - RNA, 20 nt, Human
ccguggaggaggaaggcaag

SEQ ID NO: 2555303 - RNA, 16 nt, Human
ccguggaggaggaagg

SEQ ID NO: 2555304 - RNA, 23 nt, Human
ccguggagaugggaugcuugccu

SEQ ID NO: 2555305 - RNA, 23 nt, Human
ccguggauugcacguggccucuu

SEQ ID NO: 2555306 - RNA, 22 nt, Human
ccguggauugcacguggccucu

SEQ ID NO: 2555307 - RNA, 20 nt, Human
ccguggauugcacguggccu

SEQ ID NO: 2555308 - RNA, 19 nt, Human
ccguggauugcacguggcc

SEQ ID NO: 2555309 - RNA, 15 nt, Human
ccguggccccagccu

SEQ ID NO: 2555310 - RNA, 14 nt, Human
ccguggccccagcc

SEQ ID NO: 2555311 - RNA, 13 nt, Human
ccguggccccagc

SEQ ID NO: 2555312 - RNA, 15 nt, Human
ccguggcacugcaua

SEQ ID NO: 2555313 - RNA, 23 nt, Human
ccguggcaucaccuuaggcaggg

SEQ ID NO: 2555314 - RNA, 16 nt, Human
ccgggagccugaucac

SEQ ID NO: 2555315 - RNA, 23 nt, Human
ccgggagccugaucaccugcccu

SEQ ID NO: 2555316 - RNA, 12 nt, Human
ccgggacuccag

SEQ ID NO: 2555317 - RNA, 15 nt, Human
ccgggagcugcugcc

SEQ ID NO: 2555318 - RNA, 12 nt, Human
ccgggagagggg

SEQ ID NO: 2555319 - RNA, 15 nt, Human
ccggggaaaggcaag

SEQ ID NO: 2555320 - RNA, 18 nt, Human
ccggucccuugagaccuc

SEQ ID NO: 2555321 - RNA, 15 nt, Human
ccggggagcgcccgc

SEQ ID NO: 2555322 - RNA, 15 nt, Human
ccggggacccuguga

SEQ ID NO: 2555323 - RNA, 15 nt, Human
ccggggacagaggcc

SEQ ID NO: 2555324 - RNA, 22 nt, Human
ccggggaguuucuuuccugccu

SEQ ID NO: 2555325 - RNA, 15 nt, Human
ccggggaggggcgcu

SEQ ID NO: 2555326 - RNA, 23 nt, Human
ccggggaggagagagcagcuucu

SEQ ID NO: 2555327 - RNA, 18 nt, Human
ccggggcagcugccagag

SEQ ID NO: 2555328 - RNA, 19 nt, Human
ccggggcagcugccagaga

SEQ ID NO: 2555329 - RNA, 20 nt, Human
ccggggcagcugccagagaa

SEQ ID NO: 2555330 - RNA, 17 nt, Human
ccgggaagggggcuggg

SEQ ID NO: 2555331 - RNA, 22 nt, Human
ccgggaaagaagagccggagcc

SEQ ID NO: 2555332 - RNA, 22 nt, Human
ccggcaaccccaguucugcucc

SEQ ID NO: 2555333 - RNA, 21 nt, Human
ccggcaaccccaguucugcuc

SEQ ID NO: 2555334 - RNA, 23 nt, Human
ccggcaaccccaguucugcuccu

SEQ ID NO: 2555335 - RNA, 21 nt, Human
ccggaggggccuggcagccgu

SEQ ID NO: 2555336 - RNA, 16 nt, Human
ccggagccuccagcug

SEQ ID NO: 2555337 - RNA, 14 nt, Human
ccggagccuccagc

SEQ ID NO: 2555338 - RNA, 18 nt, Human
ccggaggguguuuaugua

SEQ ID NO: 2555339 - RNA, 17 nt, Human
ccggagguagagguugu

SEQ ID NO: 2555340 - RNA, 17 nt, Human
ccggaggggccuggcag

SEQ ID NO: 2555341 - RNA, 19 nt, Human
ccggagcaaacucugcugu

SEQ ID NO: 2555342 - RNA, 18 nt, Human
ccggagcaaacucugcug

SEQ ID NO: 2555343 - RNA, 17 nt, Human
ccggagcaaacucugcu

SEQ ID NO: 2555344 - RNA, 18 nt, Human
ccggagauguagcaaaac

SEQ ID NO: 2555345 - RNA, 20 nt, Human
ccggcaaccccaguucugcu

SEQ ID NO: 2555346 - RNA, 17 nt, Human
ccggcaaccccaguucu

SEQ ID NO: 2555347 - RNA, 22 nt, Human
ccggauuggcuuguguguuuca

SEQ ID NO: 2555348 - RNA, 16 nt, Human
ccggauuggcuugugu

SEQ ID NO: 2555349 - RNA, 15 nt, Human
ccggaugugcuuuuc

SEQ ID NO: 2555350 - RNA, 14 nt, Human
ccggaugugcuuuu

SEQ ID NO: 2555351 - RNA, 13 nt, Human
ccggaugugcuuu

SEQ ID NO: 2555352 - RNA, 20 nt, Human
ccggauggcggacaccuggc

SEQ ID NO: 2555353 - RNA, 15 nt, Human
ccggagugagaagcu

SEQ ID NO: 2555354 - RNA, 17 nt, Human
ccggaguccacucccag

SEQ ID NO: 2555355 - RNA, 15 nt, Human
ccggauccugggugg

SEQ ID NO: 2555356 - RNA, 23 nt, Human
ccggacuuucggaguuggggguc

SEQ ID NO: 2555357 - RNA, 16 nt, Human
ccggacuuuucugcaa

SEQ ID NO: 2555358 - RNA, 15 nt, Human
ccggacuuuucugca

SEQ ID NO: 2555359 - RNA, 20 nt, Human
ccggacuuucggaguugggg

SEQ ID NO: 2555360 - RNA, 20 nt, Human
ccggacugcaagcagggcuc

SEQ ID NO: 2555361 - RNA, 16 nt, Human
cccuuggguucugaua

SEQ ID NO: 2555362 - RNA, 14 nt, Human
ccggagaggaccgg

SEQ ID NO: 2555363 - RNA, 14 nt, Human
ccggagauguagca

SEQ ID NO: 2555364 - RNA, 17 nt, Human
ccggagauguagcaaaa

SEQ ID NO: 2555365 - RNA, 17 nt, Human
ccggagauuggacggcc

SEQ ID NO: 2555366 - RNA, 19 nt, Human
ccggagauuggacggccug

SEQ ID NO: 2555367 - RNA, 20 nt, Human
ccggagauuggacggccuga

SEQ ID NO: 2555368 - RNA, 21 nt, Human
ccggagauuggacggccugau

SEQ ID NO: 2555369 - RNA, 13 nt, Human
cccuuccuaauuc

SEQ ID NO: 2555370 - RNA, 14 nt, Human
cccuuccuaauucc

SEQ ID NO: 2555371 - RNA, 19 nt, Human
cccuuccuaauuccacagc

SEQ ID NO: 2555372 - RNA, 20 nt, Human
cccuuccuaauuccacagcu

SEQ ID NO: 2555373 - RNA, 18 nt, Human
cccuucccaucucuuccu

SEQ ID NO: 2555374 - RNA, 21 nt, Human
cccuucccaugacccaggcug

SEQ ID NO: 2555375 - RNA, 12 nt, Human
cccuuccccacu

SEQ ID NO: 2555376 - RNA, 11 nt, Human
cccuuccccau

SEQ ID NO: 2555377 - RNA, 14 nt, Human
cccuuccccauggg

SEQ ID NO: 2555378 - RNA, 21 nt, Human
cccuuccccacugccugccca

SEQ ID NO: 2555379 - RNA, 15 nt, Human
cccuuccccauggga

SEQ ID NO: 2555380 - RNA, 19 nt, Human
cccuucccuugagcccucu

SEQ ID NO: 2555381 - RNA, 14 nt, Human
cccuucccacagga

SEQ ID NO: 2555382 - RNA, 16 nt, Human
cccuucccacuggagg

SEQ ID NO: 2555383 - RNA, 18 nt, Human
cccuucaucuccagggag

SEQ ID NO: 2555384 - RNA, 23 nt, Human
cccuucccacaggacauuucucu

SEQ ID NO: 2555385 - RNA, 13 nt, Human
cccuucccaccuc

SEQ ID NO: 2555386 - RNA, 12 nt, Human
cccuucccaccu

SEQ ID NO: 2555387 - RNA, 16 nt, Human
cccuucaugcauggaa

SEQ ID NO: 2555388 - RNA, 11 nt, Human
cccuucauuug

SEQ ID NO: 2555389 - RNA, 22 nt, Human
cccuguucacucuacuuagcau

SEQ ID NO: 2555390 - RNA, 14 nt, Human
cccuguucacucua

SEQ ID NO: 2555391 - RNA, 19 nt, Human
cccuguucagcuacuccca

SEQ ID NO: 2555392 - RNA, 17 nt, Human
cccuguucagcuacucc

SEQ ID NO: 2555393 - RNA, 23 nt, Human
cccuguguugucucuagagcagg

SEQ ID NO: 2555394 - RNA, 17 nt, Human
cccuucaguacccucuc

SEQ ID NO: 2555395 - RNA, 23 nt, Human
cccuucacuucugaccacacuuc

SEQ ID NO: 2555396 - RNA, 16 nt, Human
cccuucaucuggaacc

SEQ ID NO: 2555397 - RNA, 14 nt, Human
cccuucaucuggaa

SEQ ID NO: 2555398 - RNA, 15 nt, Human
cccuucaucuccagg

SEQ ID NO: 2555399 - RNA, 17 nt, Human
cccuucagugcccacca

SEQ ID NO: 2555400 - RNA, 20 nt, Human
cccuucaguacccucucagc

SEQ ID NO: 2555401 - RNA, 19 nt, Human
cccuucaguacccucucag

SEQ ID NO: 2555402 - RNA, 21 nt, Human
cccuucaguacccucucagcu

SEQ ID NO: 2555403 - RNA, 13 nt, Human
cccuucagugccc

SEQ ID NO: 2555404 - RNA, 22 nt, Human
cccuucacuucugaccacacuu

SEQ ID NO: 2555405 - RNA, 17 nt, Human
cccuguguugucucuag

SEQ ID NO: 2555406 - RNA, 16 nt, Human
cccuguguugucucua

SEQ ID NO: 2555407 - RNA, 15 nt, Human
cccuguguugucucu

SEQ ID NO: 2555408 - RNA, 13 nt, Human
cccuguguugucu

SEQ ID NO: 2555409 - RNA, 21 nt, Human
cccuguguugucucuagagca

SEQ ID NO: 2555410 - RNA, 18 nt, Human
cccuguguugucucuaga

SEQ ID NO: 2555411 - RNA, 13 nt, Human
cccuguucacucu

SEQ ID NO: 2555412 - RNA, 23 nt, Human
cccuggugggccaacaaagaaca

SEQ ID NO: 2555413 - RNA, 12 nt, Human
cccugguguuuc

SEQ ID NO: 2555414 - RNA, 16 nt, Human
cccuggugguugcugu

SEQ ID NO: 2555415 - RNA, 13 nt, Human
cccuggugguuca

SEQ ID NO: 2555416 - RNA, 14 nt, Human
cccugguucucauc

SEQ ID NO: 2555417 - RNA, 19 nt, Human
cccugguuauauucucacg

SEQ ID NO: 2555418 - RNA, 21 nt, Human
cccugguguuucuagcacugg

SEQ ID NO: 2555419 - RNA, 20 nt, Human
cccugguguuucuagcacug

SEQ ID NO: 2555420 - RNA, 22 nt, Human
cccugguguuucuagcacuggc

SEQ ID NO: 2555421 - RNA, 18 nt, Human
cccugguuauauucucac

SEQ ID NO: 2555422 - RNA, 15 nt, Human
cccuugacaccugcu

SEQ ID NO: 2555423 - RNA, 16 nt, Human
cccuuggacuugagga

SEQ ID NO: 2555424 - RNA, 13 nt, Human
cccuuggaggcca

SEQ ID NO: 2555425 - RNA, 15 nt, Human
cccuuggaggccagc

SEQ ID NO: 2555426 - RNA, 17 nt, Human
cccuuggauuguccccg

SEQ ID NO: 2555427 - RNA, 17 nt, Human
cccuuggaggccagcca

SEQ ID NO: 2555428 - RNA, 18 nt, Human
cccuuggaggccagccag

SEQ ID NO: 2555429 - RNA, 17 nt, Human
cccuuggaggcugucuu

SEQ ID NO: 2555430 - RNA, 12 nt, Human
cccuuggccuca

SEQ ID NO: 2555431 - RNA, 13 nt, Human
cccuuggccucag

SEQ ID NO: 2555432 - RNA, 14 nt, Human
cccuucuuuccucu

SEQ ID NO: 2555433 - RNA, 13 nt, Human
cccuucuuuccuc

SEQ ID NO: 2555434 - RNA, 19 nt, Human
cccuucuuuuucuucuuuu

SEQ ID NO: 2555435 - RNA, 15 nt, Human
cccuugacaccgggg

SEQ ID NO: 2555436 - RNA, 17 nt, Human
cccuugaaauuuuaaac

SEQ ID NO: 2555437 - RNA, 21 nt, Human
cccuuccuaauuccacagcug

SEQ ID NO: 2555438 - RNA, 11 nt, Human
cccuucuuuuu

SEQ ID NO: 2555439 - RNA, 23 nt, Human
cccuugguuaggcauugugggaa

SEQ ID NO: 2555440 - RNA, 22 nt, Human
cccuugguuaggcauuguggga

SEQ ID NO: 2555441 - RNA, 17 nt, Human
cccuugguggcaagagc

SEQ ID NO: 2555442 - RNA, 11 nt, Human
cccuuggccag

SEQ ID NO: 2555443 - RNA, 14 nt, Human
cccuuggccucaga

SEQ ID NO: 2555444 - RNA, 12 nt, Human
cccuuggccugu

SEQ ID NO: 2555445 - RNA, 12 nt, Human
cccuugucugag

SEQ ID NO: 2555446 - RNA, 15 nt, Human
cccuugucccacuca

SEQ ID NO: 2555447 - RNA, 22 nt, Human
cccuuguggucccaccccacac

SEQ ID NO: 2555448 - RNA, 14 nt, Human
cccuugucugagau

SEQ ID NO: 2555449 - RNA, 13 nt, Human
cccuugucugaga

SEQ ID NO: 2555450 - RNA, 12 nt, Human
cccuugugugug

SEQ ID NO: 2555451 - RNA, 13 nt, Human
cccuuguucucua

SEQ ID NO: 2555452 - RNA, 23 nt, Human
cccuugucugagaugcugguaau

SEQ ID NO: 2555453 - RNA, 21 nt, Human
cccuuuagccaaacccuuguc

SEQ ID NO: 2555454 - RNA, 20 nt, Human
cccuuucagaugucuucugc

SEQ ID NO: 2555455 - RNA, 19 nt, Human
cccuuucagaugucuucug

SEQ ID NO: 2555456 - RNA, 17 nt, Human
cccuuucagaugucuuc

SEQ ID NO: 2555457 - RNA, 12 nt, Human
ccguuauuaaaa

SEQ ID NO: 2555458 - RNA, 22 nt, Human
ccuacaguuggaaauccaucca

SEQ ID NO: 2555459 - RNA, 19 nt, Human
ccuacaugaaacagaaaca

SEQ ID NO: 2555460 - RNA, 17 nt, Human
ccuacaugcuuugugaa

SEQ ID NO: 2555461 - RNA, 22 nt, Human
ccuacauguauuuguuugcaua

SEQ ID NO: 2555462 - RNA, 18 nt, Human
ccuacaugcuuugugaac

SEQ ID NO: 2555463 - RNA, 18 nt, Human
ccuaccaauagauucccc

SEQ ID NO: 2555464 - RNA, 16 nt, Human
ccuacccacaccucug

SEQ ID NO: 2555465 - RNA, 17 nt, Human
ccuaccaauagauuccc

SEQ ID NO: 2555466 - RNA, 13 nt, Human
ccuacccacccuc

SEQ ID NO: 2555467 - RNA, 11 nt, Human
ccuaccccaca

SEQ ID NO: 2555468 - RNA, 19 nt, Human
ccuaccccaauuccuugua

SEQ ID NO: 2555469 - RNA, 19 nt, Human
ccuacuguaauuugugaua

SEQ ID NO: 2555470 - RNA, 20 nt, Human
ccuacccacaccucugccag

SEQ ID NO: 2555471 - RNA, 19 nt, Human
ccuacccacaccucugcca

SEQ ID NO: 2555472 - RNA, 18 nt, Human
ccuacccacaccucugcc

SEQ ID NO: 2555473 - RNA, 17 nt, Human
ccuacccacaccucugc

SEQ ID NO: 2555474 - RNA, 18 nt, Human
ccuaccccaauuccuugu

SEQ ID NO: 2555475 - RNA, 17 nt, Human
ccuaccccaauuccuug

SEQ ID NO: 2555476 - RNA, 14 nt, Human
ccuacccauccccg

SEQ ID NO: 2555477 - RNA, 19 nt, Human
ccuacccauccccgcagug

SEQ ID NO: 2555478 - RNA, 18 nt, Human
ccuacccacccuccuuuc

SEQ ID NO: 2555479 - RNA, 16 nt, Human
ccuacuuccccuuccu

SEQ ID NO: 2555480 - RNA, 13 nt, Human
ccuacuuccccuu

SEQ ID NO: 2555481 - RNA, 21 nt, Human
ccuagaaauuccccacccuga

SEQ ID NO: 2555482 - RNA, 15 nt, Human
ccuagaaauacaugg

SEQ ID NO: 2555483 - RNA, 22 nt, Human
ccuagaaacguuuggaacaauc

SEQ ID NO: 2555484 - RNA, 22 nt, Human
ccuagguauaauucacauugua

SEQ ID NO: 2555485 - RNA, 13 nt, Human
ccuaggugacaga

SEQ ID NO: 2555486 - RNA, 22 nt, Human
ccuagaagggcuagaaccugga

SEQ ID NO: 2555487 - RNA, 13 nt, Human
ccuagaagggcua

SEQ ID NO: 2555488 - RNA, 21 nt, Human
ccuagaagagugugaaaagga

SEQ ID NO: 2555489 - RNA, 23 nt, Human
ccuagaaguuacugaaugcacca

SEQ ID NO: 2555490 - RNA, 19 nt, Human
ccuagaaguuacugaaugc

SEQ ID NO: 2555491 - RNA, 19 nt, Human
ccuagacuguaaaccucuc

SEQ ID NO: 2555492 - RNA, 16 nt, Human
ccuagacccuccuccu

SEQ ID NO: 2555493 - RNA, 14 nt, Human
ccuacagccccuuu

SEQ ID NO: 2555494 - RNA, 16 nt, Human
ccuacagauagucaaa

SEQ ID NO: 2555495 - RNA, 17 nt, Human
ccuacagcuuugauccc

SEQ ID NO: 2555496 - RNA, 20 nt, Human
ccuacagcuuugaucccuga

SEQ ID NO: 2555497 - RNA, 21 nt, Human
ccuacagcuuugaucccugac

SEQ ID NO: 2555498 - RNA, 22 nt, Human
ccuacaguugaaaaacagcuga

SEQ ID NO: 2555499 - RNA, 19 nt, Human
ccuacagcuugaccgugag

SEQ ID NO: 2555500 - RNA, 15 nt, Human
ccuacagcccaccug

SEQ ID NO: 2555501 - RNA, 18 nt, Human
ccuaaauggccucaugug

SEQ ID NO: 2555502 - RNA, 14 nt, Human
ccuaaauggccuca

SEQ ID NO: 2555503 - RNA, 13 nt, Human
ccuaacaccagcg

SEQ ID NO: 2555504 - RNA, 18 nt, Human
ccuaacacagcaugugua

SEQ ID NO: 2555505 - RNA, 23 nt, Human
ccuacagaggucucugccggcuc

SEQ ID NO: 2555506 - RNA, 17 nt, Human
ccuacagaggucucugc

SEQ ID NO: 2555507 - RNA, 15 nt, Human
ccuacagaggucucu

SEQ ID NO: 2555508 - RNA, 17 nt, Human
ccguggccccagccugg

SEQ ID NO: 2555509 - RNA, 16 nt, Human
ccguggccccagccug

SEQ ID NO: 2555510 - RNA, 21 nt, Human
ccguguguucuccgucccugc

SEQ ID NO: 2555511 - RNA, 13 nt, Human
ccguuacucucca

SEQ ID NO: 2555512 - RNA, 14 nt, Human
ccguuacucuccaa

SEQ ID NO: 2555513 - RNA, 17 nt, Human
ccguuacucuccaaccu

SEQ ID NO: 2555514 - RNA, 17 nt, Human
ccguuagcuccuguggc

SEQ ID NO: 2555515 - RNA, 15 nt, Human
ccguuagcuccugug

SEQ ID NO: 2555516 - RNA, 14 nt, Human
ccguuagcuccugu

SEQ ID NO: 2555517 - RNA, 13 nt, Human
ccguuagcuccug

SEQ ID NO: 2555518 - RNA, 16 nt, Human
ccuaaaauucagugga

SEQ ID NO: 2555519 - RNA, 13 nt, Human
ccuaaacauauga

SEQ ID NO: 2555520 - RNA, 18 nt, Human
ccguuagcuccuguggcc

SEQ ID NO: 2555521 - RNA, 23 nt, Human
ccuaaacagauauaaauggcugg

SEQ ID NO: 2555522 - RNA, 22 nt, Human
ccuaaaauuugcccucccaucc

SEQ ID NO: 2555523 - RNA, 14 nt, Human
ccuaaaauuugccc

SEQ ID NO: 2555524 - RNA, 22 nt, Human
ccguuacucuccaaccuggaca

SEQ ID NO: 2555525 - RNA, 16 nt, Human
ccuaaaccaaaaacug

SEQ ID NO: 2555526 - RNA, 22 nt, Human
ccucaggugagaagcagaggaa

SEQ ID NO: 2555527 - RNA, 21 nt, Human
ccuagucucuaucauuaaagu

SEQ ID NO: 2555528 - RNA, 15 nt, Human
ccuagucucuaucau

SEQ ID NO: 2555529 - RNA, 18 nt, Human
ccuagugaaggcuucucu

SEQ ID NO: 2555530 - RNA, 19 nt, Human
ccuagugaaggcuucucuc

SEQ ID NO: 2555531 - RNA, 21 nt, Human
ccuagugaaggcuucucucug

SEQ ID NO: 2555532 - RNA, 22 nt, Human
ccuagugaaggcuucucucugu

SEQ ID NO: 2555533 - RNA, 18 nt, Human
ccuagugacccggaggcc

SEQ ID NO: 2555534 - RNA, 16 nt, Human
ccuagucucuaucauu

SEQ ID NO: 2555535 - RNA, 23 nt, Human
ccuagugaaggcuucucucugug

SEQ ID NO: 2555536 - RNA, 14 nt, Human
ccuagucucuauca

SEQ ID NO: 2555537 - RNA, 15 nt, Human
ccuaggugacagagu

SEQ ID NO: 2555538 - RNA, 19 nt, Human
ccuauccugguuuuuguag

SEQ ID NO: 2555539 - RNA, 18 nt, Human
ccuaucuaacccucccau

SEQ ID NO: 2555540 - RNA, 18 nt, Human
ccuauccacccagcccau

SEQ ID NO: 2555541 - RNA, 21 nt, Human
ccuauccacccagcccauucu

SEQ ID NO: 2555542 - RNA, 21 nt, Human
ccuaguggcuguccagugccc

SEQ ID NO: 2555543 - RNA, 19 nt, Human
ccuaguggcuguccagugc

SEQ ID NO: 2555544 - RNA, 18 nt, Human
ccuaguggcuguccagug

SEQ ID NO: 2555545 - RNA, 17 nt, Human
ccuaguggcuguccagu

SEQ ID NO: 2555546 - RNA, 16 nt, Human
ccuaguggcuguccag

SEQ ID NO: 2555547 - RNA, 15 nt, Human
ccuaguggcugucca

SEQ ID NO: 2555548 - RNA, 20 nt, Human
ccuagugacccggaggccac

SEQ ID NO: 2555549 - RNA, 19 nt, Human
ccuagugacccggaggcca

SEQ ID NO: 2555550 - RNA, 23 nt, Human
ccuaguggcuguccagugcccau

SEQ ID NO: 2555551 - RNA, 17 nt, Human
ccuaguggggucucccu

SEQ ID NO: 2555552 - RNA, 18 nt, Human
ccuaguggggucucccuc

SEQ ID NO: 2555553 - RNA, 19 nt, Human
ccuaguggggucucccucu

SEQ ID NO: 2555554 - RNA, 20 nt, Human
ccuaguggggucucccucuc

SEQ ID NO: 2555555 - RNA, 16 nt, Human
ccuauccacccagccc

SEQ ID NO: 2555556 - RNA, 17 nt, Human
ccuauccacccagccca

SEQ ID NO: 2555557 - RNA, 16 nt, Human
ccuaucucgugggaga

SEQ ID NO: 2555558 - RNA, 18 nt, Human
ccuaucucgugggagagc

SEQ ID NO: 2555559 - RNA, 17 nt, Human
ccuaucucgugggagag

SEQ ID NO: 2555560 - RNA, 20 nt, Human
ccuaucucgugggagagcca

SEQ ID NO: 2555561 - RNA, 22 nt, Human
ccuaucuguuuacaguguuccg

SEQ ID NO: 2555562 - RNA, 22 nt, Human
ccuaugugauuuuaacucuguc

SEQ ID NO: 2555563 - RNA, 23 nt, Human
ccuaugugauuuuaacucugucu

SEQ ID NO: 2555564 - RNA, 11 nt, Human
ccuauguguaa

SEQ ID NO: 2555565 - RNA, 22 nt, Human
ccuauguuuuuguucaaagcca

SEQ ID NO: 2555566 - RNA, 16 nt, Human
ccuauuagagaagaga

SEQ ID NO: 2555567 - RNA, 21 nt, Human
ccuauucaguucccagaauca

SEQ ID NO: 2555568 - RNA, 15 nt, Human
ccuauucucaccagg

SEQ ID NO: 2555569 - RNA, 13 nt, Human
ccuauucucacca

SEQ ID NO: 2555570 - RNA, 11 nt, Human
ccuauucucac

SEQ ID NO: 2555571 - RNA, 22 nt, Human
ccuauucuauugcaguuauaga

SEQ ID NO: 2555572 - RNA, 15 nt, Human
ccuauuccuccuggg

SEQ ID NO: 2555573 - RNA, 22 nt, Human
ccuauucccacaccuccacagu

SEQ ID NO: 2555574 - RNA, 21 nt, Human
ccuauucccacaccuccacag

SEQ ID NO: 2555575 - RNA, 14 nt, Human
ccuauucccacacc

SEQ ID NO: 2555576 - RNA, 17 nt, Human
ccuauuagagaagagau

SEQ ID NO: 2555577 - RNA, 14 nt, Human
ccuauccacccagc

SEQ ID NO: 2555578 - RNA, 16 nt, Human
ccucacagccucugac

SEQ ID NO: 2555579 - RNA, 15 nt, Human
ccucacagccucuga

SEQ ID NO: 2555580 - RNA, 14 nt, Human
ccucacagccucug

SEQ ID NO: 2555581 - RNA, 13 nt, Human
ccucacagccucu

SEQ ID NO: 2555582 - RNA, 12 nt, Human
ccucacagccuc

SEQ ID NO: 2555583 - RNA, 19 nt, Human
ccucacagcacagagaaga

SEQ ID NO: 2555584 - RNA, 15 nt, Human
ccucacagcacagag

SEQ ID NO: 2555585 - RNA, 23 nt, Human
ccucacaguccuuaccagcagag

SEQ ID NO: 2555586 - RNA, 21 nt, Human
ccucacagccucugaccccuc

SEQ ID NO: 2555587 - RNA, 20 nt, Human
ccucacagccucugaccccu

SEQ ID NO: 2555588 - RNA, 19 nt, Human
ccucacagccucugacccc

SEQ ID NO: 2555589 - RNA, 18 nt, Human
ccucacagccucugaccc

SEQ ID NO: 2555590 - RNA, 23 nt, Human
ccucacagccucugaccccuccu

SEQ ID NO: 2555591 - RNA, 22 nt, Human
ccucacagccucugaccccucc

SEQ ID NO: 2555592 - RNA, 24 nt, Human
ccucacaguccuuaccagcagagc

SEQ ID NO: 2555593 - RNA, 15 nt, Human
ccuauugugauuuga

SEQ ID NO: 2555594 - RNA, 14 nt, Human
ccuauugugauuug

SEQ ID NO: 2555595 - RNA, 13 nt, Human
ccuauugugauuu

SEQ ID NO: 2555596 - RNA, 12 nt, Human
ccuauugugauu

SEQ ID NO: 2555597 - RNA, 15 nt, Human
ccuauugucauuaaa

SEQ ID NO: 2555598 - RNA, 13 nt, Human
ccuauugucauua

SEQ ID NO: 2555599 - RNA, 22 nt, Human
ccuauugcaaagguuccaacug

SEQ ID NO: 2555600 - RNA, 15 nt, Human
ccuauucucgggcug

SEQ ID NO: 2555601 - RNA, 19 nt, Human
ccuauucucaccaggaagg

SEQ ID NO: 2555602 - RNA, 16 nt, Human
ccuauucucaccagga

SEQ ID NO: 2555603 - RNA, 21 nt, Human
ccuauugugauuugacuguuu

SEQ ID NO: 2555604 - RNA, 18 nt, Human
ccuauugugauuugacug

SEQ ID NO: 2555605 - RNA, 17 nt, Human
ccuauugugauuugacu

SEQ ID NO: 2555606 - RNA, 14 nt, Human
ccucacacucaccc

SEQ ID NO: 2555607 - RNA, 13 nt, Human
ccucacacuggga

SEQ ID NO: 2555608 - RNA, 15 nt, Human
ccucacacugggacu

SEQ ID NO: 2555609 - RNA, 12 nt, Human
ccucacacuggg

SEQ ID NO: 2555610 - RNA, 11 nt, Human
ccucacacagc

SEQ ID NO: 2555611 - RNA, 16 nt, Human
ccucagagccaccccu

SEQ ID NO: 2555612 - RNA, 13 nt, Human
ccucagaguccag

SEQ ID NO: 2555613 - RNA, 15 nt, Human
ccucagaguccaggc

SEQ ID NO: 2555614 - RNA, 16 nt, Human
ccucagaguccaggcc

SEQ ID NO: 2555615 - RNA, 17 nt, Human
ccucagaguccaggccc

SEQ ID NO: 2555616 - RNA, 18 nt, Human
ccucagaguccaggcccc

SEQ ID NO: 2555617 - RNA, 16 nt, Human
ccucacuguugaauuu

SEQ ID NO: 2555618 - RNA, 14 nt, Human
ccucacuugaaugu

SEQ ID NO: 2555619 - RNA, 21 nt, Human
ccucacuuccauacagcucua

SEQ ID NO: 2555620 - RNA, 19 nt, Human
ccucacuuccauacagcuc

SEQ ID NO: 2555621 - RNA, 17 nt, Human
ccucagacuuaccagga

SEQ ID NO: 2555622 - RNA, 22 nt, Human
ccucagacuuaccaggaagcag

SEQ ID NO: 2555623 - RNA, 19 nt, Human
ccucagacuuaccaggaag

SEQ ID NO: 2555624 - RNA, 17 nt, Human
ccucacuggccaucccu

SEQ ID NO: 2555625 - RNA, 15 nt, Human
ccucacuggccaucc

SEQ ID NO: 2555626 - RNA, 12 nt, Human
ccucacuggcca

SEQ ID NO: 2555627 - RNA, 14 nt, Human
ccucacuggaugaa

SEQ ID NO: 2555628 - RNA, 21 nt, Human
ccucacugcucccugaagcca

SEQ ID NO: 2555629 - RNA, 19 nt, Human
ccucacugcucccugaagc

SEQ ID NO: 2555630 - RNA, 17 nt, Human
ccucacugcucccugaa

SEQ ID NO: 2555631 - RNA, 16 nt, Human
ccucacugcucccuga

SEQ ID NO: 2555632 - RNA, 17 nt, Human
ccucacugaaugccuca

SEQ ID NO: 2555633 - RNA, 20 nt, Human
ccucacugaaaacaucugga

SEQ ID NO: 2555634 - RNA, 18 nt, Human
ccucacugaaaacaucug

SEQ ID NO: 2555635 - RNA, 17 nt, Human
ccucacucuugccaacc

SEQ ID NO: 2555636 - RNA, 16 nt, Human
ccucacucuugccaac

SEQ ID NO: 2555637 - RNA, 22 nt, Human
ccucacuggccaucccucgugg

SEQ ID NO: 2555638 - RNA, 18 nt, Human
ccucacuggccaucccuc

SEQ ID NO: 2555639 - RNA, 19 nt, Human
ccucacugggguccugggg

SEQ ID NO: 2555640 - RNA, 20 nt, Human
ccucacugggguccuggggc

SEQ ID NO: 2555641 - RNA, 23 nt, Human
ccucacugggguccuggggccuc

SEQ ID NO: 2555642 - RNA, 12 nt, Human
ccucacugggug

SEQ ID NO: 2555643 - RNA, 13 nt, Human
ccucacugggugg

SEQ ID NO: 2555644 - RNA, 14 nt, Human
ccucacuggguggg

SEQ ID NO: 2555645 - RNA, 21 nt, Human
ccucacuggguggggugagga

SEQ ID NO: 2555646 - RNA, 22 nt, Human
ccucacucccuucuaccugcca

SEQ ID NO: 2555647 - RNA, 21 nt, Human
ccucacucccuucuaccugcc

SEQ ID NO: 2555648 - RNA, 20 nt, Human
ccucacucccuucuaccugc

SEQ ID NO: 2555649 - RNA, 19 nt, Human
ccucacucccuucuaccug

SEQ ID NO: 2555650 - RNA, 13 nt, Human
ccucacuccuguu

SEQ ID NO: 2555651 - RNA, 15 nt, Human
ccucacucuugccaa

SEQ ID NO: 2555652 - RNA, 17 nt, Human
ccucacucuggccucag

SEQ ID NO: 2555653 - RNA, 12 nt, Human
ccucacuccugu

SEQ ID NO: 2555654 - RNA, 22 nt, Human
ccucaccucaugcccacccccu

SEQ ID NO: 2555655 - RNA, 19 nt, Human
ccucaccucaugcccaccc

SEQ ID NO: 2555656 - RNA, 17 nt, Human
ccucaccucaugcccac

SEQ ID NO: 2555657 - RNA, 16 nt, Human
ccucaccucaugccca

SEQ ID NO: 2555658 - RNA, 15 nt, Human
ccucaccucaugccc

SEQ ID NO: 2555659 - RNA, 14 nt, Human
ccucaccucaugcc

SEQ ID NO: 2555660 - RNA, 12 nt, Human
ccucaccucaug

SEQ ID NO: 2555661 - RNA, 17 nt, Human
ccucacuauucaaguau

SEQ ID NO: 2555662 - RNA, 23 nt, Human
ccucaccucaugcccacccccug

SEQ ID NO: 2555663 - RNA, 13 nt, Human
ccucaccuccucu

SEQ ID NO: 2555664 - RNA, 14 nt, Human
ccucacucccuucu

SEQ ID NO: 2555665 - RNA, 20 nt, Human
ccucacucccuucccauaag

SEQ ID NO: 2555666 - RNA, 22 nt, Human
ccucacccugccuuaucuugca

SEQ ID NO: 2555667 - RNA, 15 nt, Human
ccucacccugccuua

SEQ ID NO: 2555668 - RNA, 11 nt, Human
ccucacccugc

SEQ ID NO: 2555669 - RNA, 23 nt, Human
ccucacccugagccccuuccuug

SEQ ID NO: 2555670 - RNA, 14 nt, Human
ccucacccugccuu

SEQ ID NO: 2555671 - RNA, 18 nt, Human
ccucaccgagugggggca

SEQ ID NO: 2555672 - RNA, 14 nt, Human
ccucacccuggggc

SEQ ID NO: 2555673 - RNA, 22 nt, Human
ccucaccaggggcaggcacagc

SEQ ID NO: 2555674 - RNA, 20 nt, Human
ccucaccaggggcaggcaca

SEQ ID NO: 2555675 - RNA, 23 nt, Human
ccucaccaggggcaggcacagca

SEQ ID NO: 2555676 - RNA, 21 nt, Human
ccucacccgaggcugcccacu

SEQ ID NO: 2555677 - RNA, 21 nt, Human
ccucacccugagccccuuccu

SEQ ID NO: 2555678 - RNA, 18 nt, Human
ccucacccugagccccuu

SEQ ID NO: 2555679 - RNA, 15 nt, Human
ccucacccugagccc

SEQ ID NO: 2555680 - RNA, 19 nt, Human
ccucaccaggggcaggcac

SEQ ID NO: 2555681 - RNA, 14 nt, Human
ccucaccaggggca

SEQ ID NO: 2555682 - RNA, 13 nt, Human
ccucaccaggggc

SEQ ID NO: 2555683 - RNA, 16 nt, Human
ccucacaucuuucaca

SEQ ID NO: 2555684 - RNA, 17 nt, Human
ccucacagcuggccguc

SEQ ID NO: 2555685 - RNA, 15 nt, Human
ccucacaucuuucac

SEQ ID NO: 2555686 - RNA, 22 nt, Human
ccucagggucccugguggcagc

SEQ ID NO: 2555687 - RNA, 23 nt, Human
ccucagggaucuugcauucccag

SEQ ID NO: 2555688 - RNA, 20 nt, Human
ccucagggucccugguggca

SEQ ID NO: 2555689 - RNA, 17 nt, Human
ccucagggucccuggug

SEQ ID NO: 2555690 - RNA, 16 nt, Human
ccucagggucccuggu

SEQ ID NO: 2555691 - RNA, 24 nt, Human
ccucagggacagagacaccugcac

SEQ ID NO: 2555692 - RNA, 22 nt, Human
ccucagggacagagacaccugc

SEQ ID NO: 2555693 - RNA, 23 nt, Human
ccucagggacagagacaccugca

SEQ ID NO: 2555694 - RNA, 16 nt, Human
ccucaggcuuccuugg

SEQ ID NO: 2555695 - RNA, 17 nt, Human
ccucaggcuuccuuggc

SEQ ID NO: 2555696 - RNA, 18 nt, Human
ccucaggcugcuggagga

SEQ ID NO: 2555697 - RNA, 11 nt, Human
ccucagggaca

SEQ ID NO: 2555698 - RNA, 20 nt, Human
ccucagggacagagacaccu

SEQ ID NO: 2555699 - RNA, 21 nt, Human
ccucagggacagagacaccug

SEQ ID NO: 2555700 - RNA, 14 nt, Human
ccucaggcugcugg

SEQ ID NO: 2555701 - RNA, 15 nt, Human
ccucaggcugcugga

SEQ ID NO: 2555702 - RNA, 16 nt, Human
ccucaggcugcuggag

SEQ ID NO: 2555703 - RNA, 17 nt, Human
ccucaggcugcuggagg

SEQ ID NO: 2555704 - RNA, 19 nt, Human
ccucagcccgccaagguag

SEQ ID NO: 2555705 - RNA, 12 nt, Human
ccucaggcugcu

SEQ ID NO: 2555706 - RNA, 18 nt, Human
ccucagcccugacccugu

SEQ ID NO: 2555707 - RNA, 23 nt, Human
ccucaggccugggggcugggcag

SEQ ID NO: 2555708 - RNA, 17 nt, Human
ccucagcccugacccug

SEQ ID NO: 2555709 - RNA, 16 nt, Human
ccucagcccugacccu

SEQ ID NO: 2555710 - RNA, 18 nt, Human
ccucagcaccccuuccau

SEQ ID NO: 2555711 - RNA, 17 nt, Human
ccucagcaccccuucca

SEQ ID NO: 2555712 - RNA, 16 nt, Human
ccucagcaccccuucc

SEQ ID NO: 2555713 - RNA, 15 nt, Human
ccucagcaccccuuc

SEQ ID NO: 2555714 - RNA, 17 nt, Human
ccucagccagagaagcu

SEQ ID NO: 2555715 - RNA, 22 nt, Human
ccucagcaccccuuccaugugg

SEQ ID NO: 2555716 - RNA, 20 nt, Human
ccucagcaccccuuccaugu

SEQ ID NO: 2555717 - RNA, 16 nt, Human
ccucagccaugaggag

SEQ ID NO: 2555718 - RNA, 16 nt, Human
ccucagccauucacug

SEQ ID NO: 2555719 - RNA, 21 nt, Human
ccucagccaugaggaguugcu

SEQ ID NO: 2555720 - RNA, 23 nt, Human
ccucagccauucacugcccccag

SEQ ID NO: 2555721 - RNA, 13 nt, Human
ccucagccccucu

SEQ ID NO: 2555722 - RNA, 14 nt, Human
ccucagccccucuu

SEQ ID NO: 2555723 - RNA, 16 nt, Human
ccucagccccucuugc

SEQ ID NO: 2555724 - RNA, 18 nt, Human
ccucagccccucuugccc

SEQ ID NO: 2555725 - RNA, 19 nt, Human
ccucagccccucuugcccc

SEQ ID NO: 2555726 - RNA, 20 nt, Human
ccucagccccucuugccccc

SEQ ID NO: 2555727 - RNA, 23 nt, Human
ccucagccccucuugccccccac

SEQ ID NO: 2555728 - RNA, 15 nt, Human
ccucagcccugaccc

SEQ ID NO: 2555729 - RNA, 13 nt, Human
ccucagcccugac

SEQ ID NO: 2555730 - RNA, 19 nt, Human
ccucagaguccaggcccca

SEQ ID NO: 2555731 - RNA, 14 nt, Human
ccucagcaccccuu

SEQ ID NO: 2555732 - RNA, 19 nt, Human
ccucagcaccccugucucu

SEQ ID NO: 2555733 - RNA, 13 nt, Human
ccucagcaccccu

SEQ ID NO: 2555734 - RNA, 16 nt, Human
ccucagaucuucugug

SEQ ID NO: 2555735 - RNA, 14 nt, Human
ccucagagugcaag

SEQ ID NO: 2555736 - RNA, 21 nt, Human
ccucagagugcaagccccugc

SEQ ID NO: 2555737 - RNA, 14 nt, Human
cccugguggcagcu

SEQ ID NO: 2555738 - RNA, 16 nt, Human
cccugggaggcucugg

SEQ ID NO: 2555739 - RNA, 19 nt, Human
cccuggaggcacugaagug

SEQ ID NO: 2555740 - RNA, 15 nt, Human
cccugggaggcucug

SEQ ID NO: 2555741 - RNA, 22 nt, Human
cccuggagccaacugcugcuuu

SEQ ID NO: 2555742 - RNA, 21 nt, Human
cccuggagccaacugcugcuu

SEQ ID NO: 2555743 - RNA, 20 nt, Human
cccuggagccaacugcugcu

SEQ ID NO: 2555744 - RNA, 19 nt, Human
cccuggagccaacugcugc

SEQ ID NO: 2555745 - RNA, 23 nt, Human
cccuggagaguucaauggcugcu

SEQ ID NO: 2555746 - RNA, 22 nt, Human
cccuggagaguucaauggcugc

SEQ ID NO: 2555747 - RNA, 16 nt, Human
cccuggagccaacugc

SEQ ID NO: 2555748 - RNA, 21 nt, Human
cccuggagccagacucugguc

SEQ ID NO: 2555749 - RNA, 20 nt, Human
cccuggagccagacucuggu

SEQ ID NO: 2555750 - RNA, 14 nt, Human
cccuggagccagac

SEQ ID NO: 2555751 - RNA, 13 nt, Human
cccuggagccaga

SEQ ID NO: 2555752 - RNA, 12 nt, Human
cccuggagccca

SEQ ID NO: 2555753 - RNA, 23 nt, Human
cccuggagccagacucuggucuu

SEQ ID NO: 2555754 - RNA, 18 nt, Human
cccugggaggcucuggag

SEQ ID NO: 2555755 - RNA, 17 nt, Human
cccugggaggcucugga

SEQ ID NO: 2555756 - RNA, 15 nt, Human
cccugggauguccac

SEQ ID NO: 2555757 - RNA, 14 nt, Human
cccugggccccacc

SEQ ID NO: 2555758 - RNA, 23 nt, Human
cccugggugggugguggggaggg

SEQ ID NO: 2555759 - RNA, 21 nt, Human
cccugggugggugguggggag

SEQ ID NO: 2555760 - RNA, 16 nt, Human
cccuggguggguggug

SEQ ID NO: 2555761 - RNA, 22 nt, Human
cccugggugggugguggggagg

SEQ ID NO: 2555762 - RNA, 21 nt, Human
cccuggugcugccacacuuca

SEQ ID NO: 2555763 - RNA, 17 nt, Human
cccuggugcugccacac

SEQ ID NO: 2555764 - RNA, 20 nt, Human
cccugggugggcucugugca

SEQ ID NO: 2555765 - RNA, 18 nt, Human
cccugggugggcucugug

SEQ ID NO: 2555766 - RNA, 17 nt, Human
cccugggugggcucugu

SEQ ID NO: 2555767 - RNA, 19 nt, Human
cccugggggaagcccugga

SEQ ID NO: 2555768 - RNA, 20 nt, Human
cccugggggaagcccuggau

SEQ ID NO: 2555769 - RNA, 18 nt, Human
cccuggggcuucuccuga

SEQ ID NO: 2555770 - RNA, 15 nt, Human
cccuggggcuucucc

SEQ ID NO: 2555771 - RNA, 21 nt, Human
cccuggggcuaggcuggagcc

SEQ ID NO: 2555772 - RNA, 21 nt, Human
cccuggggcuucuccugaccc

SEQ ID NO: 2555773 - RNA, 19 nt, Human
cccuggggcuucuccugac

SEQ ID NO: 2555774 - RNA, 17 nt, Human
cccugggggaagcccug

SEQ ID NO: 2555775 - RNA, 18 nt, Human
cccugggggaagcccugg

SEQ ID NO: 2555776 - RNA, 20 nt, Human
cccugguggagaaagcacug

SEQ ID NO: 2555777 - RNA, 23 nt, Human
cccugguggacaguccugggaga

SEQ ID NO: 2555778 - RNA, 20 nt, Human
cccugguggacaguccuggg

SEQ ID NO: 2555779 - RNA, 21 nt, Human
cccugguggacaguccuggga

SEQ ID NO: 2555780 - RNA, 17 nt, Human
cccugguggacaguccu

SEQ ID NO: 2555781 - RNA, 18 nt, Human
cccugguggacaguccug

SEQ ID NO: 2555782 - RNA, 19 nt, Human
cccugguggacaguccugg

SEQ ID NO: 2555783 - RNA, 23 nt, Human
cccugguggagaaagcacugacc

SEQ ID NO: 2555784 - RNA, 16 nt, Human
cccuggugggccaaca

SEQ ID NO: 2555785 - RNA, 22 nt, Human
cccugguggcagugggagcugc

SEQ ID NO: 2555786 - RNA, 15 nt, Human
cccuggaacugucuc

SEQ ID NO: 2555787 - RNA, 18 nt, Human
cccuggaacugucucuca

SEQ ID NO: 2555788 - RNA, 21 nt, Human
cccuggagaguucaauggcug

SEQ ID NO: 2555789 - RNA, 13 nt, Human
cccuggagaguuc

SEQ ID NO: 2555790 - RNA, 13 nt, Human
cccuggagagaag

SEQ ID NO: 2555791 - RNA, 21 nt, Human
cccuggagaggcccucuggag

SEQ ID NO: 2555792 - RNA, 21 nt, Human
cccuggacugugugcucagga

SEQ ID NO: 2555793 - RNA, 22 nt, Human
cccugcuuugggcugcccuggu

SEQ ID NO: 2555794 - RNA, 10 nt, Human
cccugcuguc

SEQ ID NO: 2555795 - RNA, 23 nt, Human
cccugcuuugggcugcccuggug

SEQ ID NO: 2555796 - RNA, 20 nt, Human
cccugcugguucaggguugg

SEQ ID NO: 2555797 - RNA, 19 nt, Human
cccugcugguucaggguug

SEQ ID NO: 2555798 - RNA, 22 nt, Human
cccugccucucugcaggucccu

SEQ ID NO: 2555799 - RNA, 21 nt, Human
cccugccucucugcagguccc

SEQ ID NO: 2555800 - RNA, 13 nt, Human
cccugccugaggg

SEQ ID NO: 2555801 - RNA, 13 nt, Human
cccugccucuguu

SEQ ID NO: 2555802 - RNA, 12 nt, Human
cccugccucuca

SEQ ID NO: 2555803 - RNA, 16 nt, Human
cccugccucucugcag

SEQ ID NO: 2555804 - RNA, 22 nt, Human
cccugccugagggccccucugc

SEQ ID NO: 2555805 - RNA, 21 nt, Human
cccugccugagggccccucug

SEQ ID NO: 2555806 - RNA, 20 nt, Human
cccugccugagggccccucu

SEQ ID NO: 2555807 - RNA, 19 nt, Human
cccugccugagggccccuc

SEQ ID NO: 2555808 - RNA, 23 nt, Human
cccugccugagggccccucugcc

SEQ ID NO: 2555809 - RNA, 13 nt, Human
cccugcugguuca

SEQ ID NO: 2555810 - RNA, 16 nt, Human
cccugcaaccugauug

SEQ ID NO: 2555811 - RNA, 22 nt, Human
cccugcaaccugauugugucuc

SEQ ID NO: 2555812 - RNA, 18 nt, Human
cccugcaaaaggacucuc

SEQ ID NO: 2555813 - RNA, 20 nt, Human
cccugcaaaaggacucucag

SEQ ID NO: 2555814 - RNA, 18 nt, Human
cccugauuugcugggcag

SEQ ID NO: 2555815 - RNA, 12 nt, Human
cccugcagaggg

SEQ ID NO: 2555816 - RNA, 22 nt, Human
cccugcacuugcagacucuaca

SEQ ID NO: 2555817 - RNA, 18 nt, Human
cccugcagagggcacaga

SEQ ID NO: 2555818 - RNA, 20 nt, Human
cccugcagagggcacagaaa

SEQ ID NO: 2555819 - RNA, 21 nt, Human
cccugcaucugaccagcagcg

SEQ ID NO: 2555820 - RNA, 17 nt, Human
cccucuacugggagccu

SEQ ID NO: 2555821 - RNA, 20 nt, Human
cccucuacugggagccuacc

SEQ ID NO: 2555822 - RNA, 18 nt, Human
cccucuacagagcuuccc

SEQ ID NO: 2555823 - RNA, 21 nt, Human
cccucuacagagcuucccuga

SEQ ID NO: 2555824 - RNA, 13 nt, Human
cccuccgcccugc

SEQ ID NO: 2555825 - RNA, 15 nt, Human
cccucuacagagcuu

SEQ ID NO: 2555826 - RNA, 18 nt, Human
cccuccgccaggcgagau

SEQ ID NO: 2555827 - RNA, 13 nt, Human
cccucucagcucc

SEQ ID NO: 2555828 - RNA, 21 nt, Human
cccucucagagcuacuugggc

SEQ ID NO: 2555829 - RNA, 12 nt, Human
cccucucagagc

SEQ ID NO: 2555830 - RNA, 17 nt, Human
cccucucacugucugag

SEQ ID NO: 2555831 - RNA, 15 nt, Human
cccucuauuuagcau

SEQ ID NO: 2555832 - RNA, 19 nt, Human
cccucuagaaauuuuucag

SEQ ID NO: 2555833 - RNA, 19 nt, Human
cccugauuacaccagccuc

SEQ ID NO: 2555834 - RNA, 15 nt, Human
cccugauccugugaa

SEQ ID NO: 2555835 - RNA, 22 nt, Human
cccugaucugacauccccacuc

SEQ ID NO: 2555836 - RNA, 21 nt, Human
cccugaucugacauccccacu

SEQ ID NO: 2555837 - RNA, 21 nt, Human
cccugauuuaggagaagccag

SEQ ID NO: 2555838 - RNA, 23 nt, Human
cccugauuuaggagaagccagga

SEQ ID NO: 2555839 - RNA, 17 nt, Human
cccucucagcuccaggu

SEQ ID NO: 2555840 - RNA, 14 nt, Human
cccucucagcucca

SEQ ID NO: 2555841 - RNA, 21 nt, Human
cccugaguggaucuccaagga

SEQ ID NO: 2555842 - RNA, 22 nt, Human
cccugaguggaucuccaaggac

SEQ ID NO: 2555843 - RNA, 16 nt, Human
cccucucaggcaugcc

SEQ ID NO: 2555844 - RNA, 18 nt, Human
cccugauaacaaccugga

SEQ ID NO: 2555845 - RNA, 23 nt, Human
cccugaguggaucuccaaggacc

SEQ ID NO: 2555846 - RNA, 19 nt, Human
cccugauaacaaccuggag

SEQ ID NO: 2555847 - RNA, 20 nt, Human
cccugaucaagucaccggag

SEQ ID NO: 2555848 - RNA, 15 nt, Human
cccugccacccuggg

SEQ ID NO: 2555849 - RNA, 14 nt, Human
cccugccacccugg

SEQ ID NO: 2555850 - RNA, 14 nt, Human
cccugccaccaggc

SEQ ID NO: 2555851 - RNA, 21 nt, Human
cccugcauucuuucuguauug

SEQ ID NO: 2555852 - RNA, 12 nt, Human
cccugccacccu

SEQ ID NO: 2555853 - RNA, 17 nt, Human
cccugccaccucccuga

SEQ ID NO: 2555854 - RNA, 14 nt, Human
cccugccaccuccc

SEQ ID NO: 2555855 - RNA, 15 nt, Human
cccugccaccaggcc

SEQ ID NO: 2555856 - RNA, 22 nt, Human
cccugccaggagcuuuggaccu

SEQ ID NO: 2555857 - RNA, 13 nt, Human
cccugccagcucu

SEQ ID NO: 2555858 - RNA, 18 nt, Human
cccugccacccuggggag

SEQ ID NO: 2555859 - RNA, 17 nt, Human
cccugccacccugggga

SEQ ID NO: 2555860 - RNA, 23 nt, Human
cccugccuccuuugugaggaagc

SEQ ID NO: 2555861 - RNA, 16 nt, Human
cccugccuccuuugug

SEQ ID NO: 2555862 - RNA, 18 nt, Human
cccugccucucugcaggu

SEQ ID NO: 2555863 - RNA, 11 nt, Human
cccugccucuc

SEQ ID NO: 2555864 - RNA, 14 nt, Human
cccugccuccuuug

SEQ ID NO: 2555865 - RNA, 17 nt, Human
cccugccaucuucccag

SEQ ID NO: 2555866 - RNA, 16 nt, Human
cccugccaucuuccca

SEQ ID NO: 2555867 - RNA, 14 nt, Human
cccugccaucuucc

SEQ ID NO: 2555868 - RNA, 13 nt, Human
cccugccaucuuc

SEQ ID NO: 2555869 - RNA, 19 nt, Human
cccugccaucuucccagca

SEQ ID NO: 2555870 - RNA, 18 nt, Human
cccugccaucuucccagc

SEQ ID NO: 2555871 - RNA, 12 nt, Human
cccugccagggc

SEQ ID NO: 2555872 - RNA, 20 nt, Human
cccugccaucauguuuacag

SEQ ID NO: 2555873 - RNA, 14 nt, Human
cccugccagggcag

SEQ ID NO: 2555874 - RNA, 14 nt, Human
cccugccagugccu

SEQ ID NO: 2555875 - RNA, 15 nt, Human
cccugccagugccuu

SEQ ID NO: 2555876 - RNA, 19 nt, Human
cccgcaccccccaagcugu

SEQ ID NO: 2555877 - RNA, 15 nt, Human
ccccagcugggaggc

SEQ ID NO: 2555878 - RNA, 14 nt, Human
ccccagcugggagg

SEQ ID NO: 2555879 - RNA, 13 nt, Human
ccccagcugggag

SEQ ID NO: 2555880 - RNA, 12 nt, Human
ccccagcuggga

SEQ ID NO: 2555881 - RNA, 11 nt, Human
ccccagcuggg

SEQ ID NO: 2555882 - RNA, 21 nt, Human
ccccagcuggcccgugacaga

SEQ ID NO: 2555883 - RNA, 13 nt, Human
ccccagcuggccc

SEQ ID NO: 2555884 - RNA, 12 nt, Human
ccccagcuggcc

SEQ ID NO: 2555885 - RNA, 11 nt, Human
ccccagcuggc

SEQ ID NO: 2555886 - RNA, 10 nt, Human
ccccagcugg

SEQ ID NO: 2555887 - RNA, 13 nt, Human
ccccagcugcuug

SEQ ID NO: 2555888 - RNA, 16 nt, Human
ccccagcugacaugga

SEQ ID NO: 2555889 - RNA, 10 nt, Human
ccccagcuga

SEQ ID NO: 2555890 - RNA, 22 nt, Human
ccccagcucuggugagucuugg

SEQ ID NO: 2555891 - RNA, 14 nt, Human
ccccagcucuggug

SEQ ID NO: 2555892 - RNA, 22 nt, Human
ccccagcuggggccaggcuggg

SEQ ID NO: 2555893 - RNA, 21 nt, Human
ccccagcuggggccaggcugg

SEQ ID NO: 2555894 - RNA, 13 nt, Human
ccccagccuggcc

SEQ ID NO: 2555895 - RNA, 12 nt, Human
ccccagccuggc

SEQ ID NO: 2555896 - RNA, 11 nt, Human
ccccagccugg

SEQ ID NO: 2555897 - RNA, 13 nt, Human
ccccagccugcua

SEQ ID NO: 2555898 - RNA, 18 nt, Human
ccccagccuggcccagcu

SEQ ID NO: 2555899 - RNA, 17 nt, Human
ccccagccuggcccagc

SEQ ID NO: 2555900 - RNA, 16 nt, Human
ccccagccuggcccag

SEQ ID NO: 2555901 - RNA, 15 nt, Human
ccccagccuggccca

SEQ ID NO: 2555902 - RNA, 21 nt, Human
ccccagccuggcccagcuccc

SEQ ID NO: 2555903 - RNA, 19 nt, Human
ccccagccuggcccagcuc

SEQ ID NO: 2555904 - RNA, 22 nt, Human
ccccagccuggcccagcucccc

SEQ ID NO: 2555905 - RNA, 17 nt, Human
ccccagcucuggcuucc

SEQ ID NO: 2555906 - RNA, 22 nt, Human
ccccagccccuagcccaggaga

SEQ ID NO: 2555907 - RNA, 20 nt, Human
ccccagccccuagcccagga

SEQ ID NO: 2555908 - RNA, 18 nt, Human
ccccagccccuagcccag

SEQ ID NO: 2555909 - RNA, 13 nt, Human
ccccagccccggg

SEQ ID NO: 2555910 - RNA, 15 nt, Human
ccccagccccuagcc

SEQ ID NO: 2555911 - RNA, 15 nt, Human
ccccagccccauccu

SEQ ID NO: 2555912 - RNA, 23 nt, Human
ccccagcccccuuugggcccagg

SEQ ID NO: 2555913 - RNA, 17 nt, Human
ccccagcccccuuuggg

SEQ ID NO: 2555914 - RNA, 17 nt, Human
ccccaccacuucuuuua

SEQ ID NO: 2555915 - RNA, 16 nt, Human
ccccagccccauccca

SEQ ID NO: 2555916 - RNA, 21 nt, Human
ccccaccaagggcgcaagagu

SEQ ID NO: 2555917 - RNA, 19 nt, Human
ccccaccaagggcgcaaga

SEQ ID NO: 2555918 - RNA, 14 nt, Human
ccccaccaccccag

SEQ ID NO: 2555919 - RNA, 12 nt, Human
ccccaccaccua

SEQ ID NO: 2555920 - RNA, 23 nt, Human
ccccaccacgauguggcccuggc

SEQ ID NO: 2555921 - RNA, 21 nt, Human
ccccacagcccacguccuguc

SEQ ID NO: 2555922 - RNA, 22 nt, Human
ccccacagcccacguccuguca

SEQ ID NO: 2555923 - RNA, 23 nt, Human
ccccacaggagguggucugggac

SEQ ID NO: 2555924 - RNA, 19 nt, Human
ccccacagcccacguccug

SEQ ID NO: 2555925 - RNA, 16 nt, Human
ccccacagcccacguc

SEQ ID NO: 2555926 - RNA, 15 nt, Human
ccccacagcccacgu

SEQ ID NO: 2555927 - RNA, 13 nt, Human
ccccacagcccac

SEQ ID NO: 2555928 - RNA, 12 nt, Human
ccccacagccca

SEQ ID NO: 2555929 - RNA, 11 nt, Human
ccccacagccc

SEQ ID NO: 2555930 - RNA, 23 nt, Human
ccccacacuuguuccagcucuuu

SEQ ID NO: 2555931 - RNA, 22 nt, Human
ccccagcugggaggcaagaggg

SEQ ID NO: 2555932 - RNA, 21 nt, Human
ccccagcugggaggcaagagg

SEQ ID NO: 2555933 - RNA, 18 nt, Human
ccccaggaccagcucagg

SEQ ID NO: 2555934 - RNA, 19 nt, Human
ccccaggaccagcucagga

SEQ ID NO: 2555935 - RNA, 21 nt, Human
ccccaggaccagcucaggaca

SEQ ID NO: 2555936 - RNA, 15 nt, Human
ccccaggaccuggcu

SEQ ID NO: 2555937 - RNA, 17 nt, Human
ccccaggaccuggcugc

SEQ ID NO: 2555938 - RNA, 20 nt, Human
ccccaggaccuggcugccau

SEQ ID NO: 2555939 - RNA, 21 nt, Human
ccccaggaccuggcugccaua

SEQ ID NO: 2555940 - RNA, 22 nt, Human
ccccaggacugggccacuucug

SEQ ID NO: 2555941 - RNA, 16 nt, Human
ccccaggacugggcca

SEQ ID NO: 2555942 - RNA, 14 nt, Human
ccccaggacugggc

SEQ ID NO: 2555943 - RNA, 13 nt, Human
ccccaggacuggg

SEQ ID NO: 2555944 - RNA, 12 nt, Human
ccccaggaggcc

SEQ ID NO: 2555945 - RNA, 14 nt, Human
ccccagggccugag

SEQ ID NO: 2555946 - RNA, 15 nt, Human
ccccagggccugagc

SEQ ID NO: 2555947 - RNA, 16 nt, Human
ccccagggccugagcc

SEQ ID NO: 2555948 - RNA, 21 nt, Human
ccccagggcacuucacagagu

SEQ ID NO: 2555949 - RNA, 20 nt, Human
ccccagggcacuucacagag

SEQ ID NO: 2555950 - RNA, 22 nt, Human
ccccagggcacuucacagagug

SEQ ID NO: 2555951 - RNA, 12 nt, Human
ccccagggcacu

SEQ ID NO: 2555952 - RNA, 16 nt, Human
ccccaggaccagcuca

SEQ ID NO: 2555953 - RNA, 18 nt, Human
ccccaggggaaaaugaag

SEQ ID NO: 2555954 - RNA, 17 nt, Human
ccccaggggaaaaugaa

SEQ ID NO: 2555955 - RNA, 16 nt, Human
ccccaggggaaaauga

SEQ ID NO: 2555956 - RNA, 19 nt, Human
ccccagggccugagccugg

SEQ ID NO: 2555957 - RNA, 21 nt, Human
ccccagggccugagccuggcc

SEQ ID NO: 2555958 - RNA, 20 nt, Human
ccccaggggaaagaugagcu

SEQ ID NO: 2555959 - RNA, 19 nt, Human
ccccaggggaaagaugagc

SEQ ID NO: 2555960 - RNA, 17 nt, Human
ccccaggggucccagcc

SEQ ID NO: 2555961 - RNA, 19 nt, Human
ccccaggggucccagccac

SEQ ID NO: 2555962 - RNA, 22 nt, Human
ccccaggggucccagccacccc

SEQ ID NO: 2555963 - RNA, 14 nt, Human
ccccuggcagcccc

SEQ ID NO: 2555964 - RNA, 12 nt, Human
ccccuggcagcc

SEQ ID NO: 2555965 - RNA, 15 nt, Human
ccccuggcagccccu

SEQ ID NO: 2555966 - RNA, 14 nt, Human
ccccuggcccagcg

SEQ ID NO: 2555967 - RNA, 13 nt, Human
ccccuggcccagc

SEQ ID NO: 2555968 - RNA, 11 nt, Human
ccccuggccca

SEQ ID NO: 2555969 - RNA, 13 nt, Human
ccccagguggcug

SEQ ID NO: 2555970 - RNA, 20 nt, Human
ccccagguggcugacccagu

SEQ ID NO: 2555971 - RNA, 21 nt, Human
ccccagguggcugacccaguc

SEQ ID NO: 2555972 - RNA, 23 nt, Human
ccccagguggcugacccaguccc

SEQ ID NO: 2555973 - RNA, 14 nt, Human
ccccaggugccagu

SEQ ID NO: 2555974 - RNA, 22 nt, Human
ccccaggugguuauggagaggg

SEQ ID NO: 2555975 - RNA, 22 nt, Human
ccccagguccagcucuggaggg

SEQ ID NO: 2555976 - RNA, 21 nt, Human
ccccagguccagcucuggagg

SEQ ID NO: 2555977 - RNA, 17 nt, Human
ccccagguccagcucug

SEQ ID NO: 2555978 - RNA, 16 nt, Human
ccccagggucuucccu

SEQ ID NO: 2555979 - RNA, 22 nt, Human
ccccaggguugaggggaccaag

SEQ ID NO: 2555980 - RNA, 19 nt, Human
ccccagggucuucccuacc

SEQ ID NO: 2555981 - RNA, 22 nt, Human
ccccuggcccagcggccccucc

SEQ ID NO: 2555982 - RNA, 16 nt, Human
ccccuggcccagcggc

SEQ ID NO: 2555983 - RNA, 15 nt, Human
ccccuggcccagcgg

SEQ ID NO: 2555984 - RNA, 23 nt, Human
ccccuggcuuuucacugcuggcu

SEQ ID NO: 2555985 - RNA, 22 nt, Human
ccccuggcuuuucacugcuggc

SEQ ID NO: 2555986 - RNA, 11 nt, Human
ccccugggcuc

SEQ ID NO: 2555987 - RNA, 13 nt, Human
ccccugggcucug

SEQ ID NO: 2555988 - RNA, 15 nt, Human
ccccugggcucugcc

SEQ ID NO: 2555989 - RNA, 18 nt, Human
ccccuggggcuucuccug

SEQ ID NO: 2555990 - RNA, 22 nt, Human
ccccugggcuuggccugcugug

SEQ ID NO: 2555991 - RNA, 21 nt, Human
ccccugggcuuggccugcugu

SEQ ID NO: 2555992 - RNA, 20 nt, Human
ccccugggcuuggccugcug

SEQ ID NO: 2555993 - RNA, 23 nt, Human
ccccugggcuuggccugcuguga

SEQ ID NO: 2555994 - RNA, 19 nt, Human
ccccugggcuuggccugcu

SEQ ID NO: 2555995 - RNA, 18 nt, Human
ccccugggcuuggccugc

SEQ ID NO: 2555996 - RNA, 16 nt, Human
ccccugggcuuggccu

SEQ ID NO: 2555997 - RNA, 17 nt, Human
ccccuggcccagcggcc

SEQ ID NO: 2555998 - RNA, 21 nt, Human
ccccugggcucugccccagcu

SEQ ID NO: 2555999 - RNA, 23 nt, Human
ccccugggcucugccccagcucu

SEQ ID NO: 2556000 - RNA, 12 nt, Human
ccccuguccuga

SEQ ID NO: 2556001 - RNA, 16 nt, Human
ccccuguccucacugc

SEQ ID NO: 2556002 - RNA, 15 nt, Human
ccccuguccucacug

SEQ ID NO: 2556003 - RNA, 14 nt, Human
ccccuguccucacu

SEQ ID NO: 2556004 - RNA, 13 nt, Human
ccccuguccucac

SEQ ID NO: 2556005 - RNA, 20 nt, Human
ccccuguccccucagcucca

SEQ ID NO: 2556006 - RNA, 17 nt, Human
ccccuguccccucagcu

SEQ ID NO: 2556007 - RNA, 22 nt, Human
ccccuguccccgcacugggcuu

SEQ ID NO: 2556008 - RNA, 20 nt, Human
ccccuggggcuucuccugac

SEQ ID NO: 2556009 - RNA, 19 nt, Human
ccccuggggcuucuccuga

SEQ ID NO: 2556010 - RNA, 15 nt, Human
ccccugguucucauc

SEQ ID NO: 2556011 - RNA, 23 nt, Human
ccccuggugguucacucuuggag

SEQ ID NO: 2556012 - RNA, 18 nt, Human
ccccugguucucaucuuu

SEQ ID NO: 2556013 - RNA, 19 nt, Human
ccccugggggcucucaugu

SEQ ID NO: 2556014 - RNA, 14 nt, Human
ccccuguacuccag

SEQ ID NO: 2556015 - RNA, 20 nt, Human
ccccuuccuaauuccacagc

SEQ ID NO: 2556016 - RNA, 21 nt, Human
ccccuuccuaauuccacagcu

SEQ ID NO: 2556017 - RNA, 22 nt, Human
ccccuuccuaauuccacagcug

SEQ ID NO: 2556018 - RNA, 19 nt, Human
cccgaggacccagacccag

SEQ ID NO: 2556019 - RNA, 18 nt, Human
cccgaggacccagaccca

SEQ ID NO: 2556020 - RNA, 17 nt, Human
ccccuuccuacucccag

SEQ ID NO: 2556021 - RNA, 13 nt, Human
ccccuucccugca

SEQ ID NO: 2556022 - RNA, 18 nt, Human
ccccuucccugcaaacau

SEQ ID NO: 2556023 - RNA, 14 nt, Human
ccccuucccugcaa

SEQ ID NO: 2556024 - RNA, 12 nt, Human
ccccuucccccu

SEQ ID NO: 2556025 - RNA, 13 nt, Human
ccccuucagugcc

SEQ ID NO: 2556026 - RNA, 16 nt, Human
ccccuuccccauggga

SEQ ID NO: 2556027 - RNA, 23 nt, Human
ccccuuccccacugccugcccac

SEQ ID NO: 2556028 - RNA, 14 nt, Human
ccccugucuagaga

SEQ ID NO: 2556029 - RNA, 14 nt, Human
ccccuuaccacugc

SEQ ID NO: 2556030 - RNA, 20 nt, Human
ccccuguucuggcagaguug

SEQ ID NO: 2556031 - RNA, 14 nt, Human
ccccuucacaaagc

SEQ ID NO: 2556032 - RNA, 17 nt, Human
ccccuucacuucugacc

SEQ ID NO: 2556033 - RNA, 19 nt, Human
ccccuucacuucugaccac

SEQ ID NO: 2556034 - RNA, 22 nt, Human
ccccuucacuucugaccacacu

SEQ ID NO: 2556035 - RNA, 23 nt, Human
ccccuucacuucugaccacacuu

SEQ ID NO: 2556036 - RNA, 16 nt, Human
ccccuuauccaggacu

SEQ ID NO: 2556037 - RNA, 15 nt, Human
ccccuuauccaggac

SEQ ID NO: 2556038 - RNA, 14 nt, Human
ccccuuauccagga

SEQ ID NO: 2556039 - RNA, 15 nt, Human
cccgaggccuucucu

SEQ ID NO: 2556040 - RNA, 15 nt, Human
cccgaggcccgcaug

SEQ ID NO: 2556041 - RNA, 22 nt, Human
cccgaggacgcucccugcucca

SEQ ID NO: 2556042 - RNA, 12 nt, Human
cccgaggcccgc

SEQ ID NO: 2556043 - RNA, 20 nt, Human
cccgaggccuucucugaagg

SEQ ID NO: 2556044 - RNA, 23 nt, Human
cccgagucauucguucuguggag

SEQ ID NO: 2556045 - RNA, 19 nt, Human
cccgaguuuggucccuggg

SEQ ID NO: 2556046 - RNA, 16 nt, Human
cccgaguuuccccaga

SEQ ID NO: 2556047 - RNA, 13 nt, Human
cccgaggcccgca

SEQ ID NO: 2556048 - RNA, 22 nt, Human
cccgaugcugcuuuccccugug

SEQ ID NO: 2556049 - RNA, 20 nt, Human
cccgaugcugcuuuccccug

SEQ ID NO: 2556050 - RNA, 16 nt, Human
cccgaugcugcuuucc

SEQ ID NO: 2556051 - RNA, 15 nt, Human
cccgaugcugcuuuc

SEQ ID NO: 2556052 - RNA, 14 nt, Human
cccgaugcugcuuu

SEQ ID NO: 2556053 - RNA, 13 nt, Human
cccgaucuuucua

SEQ ID NO: 2556054 - RNA, 23 nt, Human
cccgaugcugcuuuccccugugg

SEQ ID NO: 2556055 - RNA, 19 nt, Human
cccgcaaacccccuuugug

SEQ ID NO: 2556056 - RNA, 20 nt, Human
cccgcaaacccccuuugugc

SEQ ID NO: 2556057 - RNA, 18 nt, Human
cccgcaaugugcccccag

SEQ ID NO: 2556058 - RNA, 14 nt, Human
cccgccugcccuca

SEQ ID NO: 2556059 - RNA, 13 nt, Human
cccgccugcccuc

SEQ ID NO: 2556060 - RNA, 13 nt, Human
cccgcacccccac

SEQ ID NO: 2556061 - RNA, 16 nt, Human
cccgcacccccacccu

SEQ ID NO: 2556062 - RNA, 17 nt, Human
cccgcacccccacccuu

SEQ ID NO: 2556063 - RNA, 19 nt, Human
cccgcacagagcuggggcu

SEQ ID NO: 2556064 - RNA, 22 nt, Human
cccgcaaugugcccccagacgc

SEQ ID NO: 2556065 - RNA, 11 nt, Human
cccgcucugga

SEQ ID NO: 2556066 - RNA, 22 nt, Human
cccgcucugcaugcggcccagc

SEQ ID NO: 2556067 - RNA, 14 nt, Human
cccgcucugcaugc

SEQ ID NO: 2556068 - RNA, 13 nt, Human
cccgcucugcaug

SEQ ID NO: 2556069 - RNA, 23 nt, Human
cccgcucccagugucuuccugug

SEQ ID NO: 2556070 - RNA, 15 nt, Human
cccgcucccaguguc

SEQ ID NO: 2556071 - RNA, 21 nt, Human
cccgcucuacaucuucugccu

SEQ ID NO: 2556072 - RNA, 23 nt, Human
cccgcucagcccucccugccccu

SEQ ID NO: 2556073 - RNA, 14 nt, Human
cccgcucccagugu

SEQ ID NO: 2556074 - RNA, 13 nt, Human
cccgcucccagug

SEQ ID NO: 2556075 - RNA, 12 nt, Human
cccgcucccagu

SEQ ID NO: 2556076 - RNA, 23 nt, Human
cccggaagccaaaccucugugag

SEQ ID NO: 2556077 - RNA, 20 nt, Human
cccgcuuucuugcugguugu

SEQ ID NO: 2556078 - RNA, 14 nt, Human
cccggaacaagccu

SEQ ID NO: 2556079 - RNA, 16 nt, Human
cccgcuuggcuucuuc

SEQ ID NO: 2556080 - RNA, 14 nt, Human
cccgcuuguccagc

SEQ ID NO: 2556081 - RNA, 15 nt, Human
cccgcuuguccagcg

SEQ ID NO: 2556082 - RNA, 18 nt, Human
cccgcuuguccagcgccu

SEQ ID NO: 2556083 - RNA, 14 nt, Human
cccgcuuggcuucu

SEQ ID NO: 2556084 - RNA, 15 nt, Human
cccgcugcugcugcu

SEQ ID NO: 2556085 - RNA, 12 nt, Human
cccgcugcugcu

SEQ ID NO: 2556086 - RNA, 22 nt, Human
cccgcugcccaggggagcccuc

SEQ ID NO: 2556087 - RNA, 14 nt, Human
cccgcucuggacca

SEQ ID NO: 2556088 - RNA, 12 nt, Human
cccgcucuggac

SEQ ID NO: 2556089 - RNA, 19 nt, Human
cccgcugaguggacuggag

SEQ ID NO: 2556090 - RNA, 17 nt, Human
cccgcugaguggacugg

SEQ ID NO: 2556091 - RNA, 14 nt, Human
cccgccuguucccc

SEQ ID NO: 2556092 - RNA, 17 nt, Human
cccgccugcccucaugg

SEQ ID NO: 2556093 - RNA, 13 nt, Human
cccgccuguuccc

SEQ ID NO: 2556094 - RNA, 17 nt, Human
cccgccuggcagaacug

SEQ ID NO: 2556095 - RNA, 22 nt, Human
cccgccuggcagaacugagcuc

SEQ ID NO: 2556096 - RNA, 22 nt, Human
cccgcuaagagggagggagggc

SEQ ID NO: 2556097 - RNA, 19 nt, Human
cccgcgcgcgucccccugc

SEQ ID NO: 2556098 - RNA, 17 nt, Human
cccgcgcccgcgcccuc

SEQ ID NO: 2556099 - RNA, 15 nt, Human
cccgcgccuccuucc

SEQ ID NO: 2556100 - RNA, 19 nt, Human
cccgcucagcccucccugc

SEQ ID NO: 2556101 - RNA, 21 nt, Human
cccgcggggacauugggaagg

SEQ ID NO: 2556102 - RNA, 15 nt, Human
cccgcucagcccucc

SEQ ID NO: 2556103 - RNA, 20 nt, Human
cccucauccucauacccacc

SEQ ID NO: 2556104 - RNA, 17 nt, Human
cccucauccucauaccc

SEQ ID NO: 2556105 - RNA, 22 nt, Human
cccucaucaccaacgucugugc

SEQ ID NO: 2556106 - RNA, 17 nt, Human
cccucaucccgagcacc

SEQ ID NO: 2556107 - RNA, 19 nt, Human
cccucauagcccucacccu

SEQ ID NO: 2556108 - RNA, 13 nt, Human
cccucauagcccu

SEQ ID NO: 2556109 - RNA, 15 nt, Human
cccucauagcccuca

SEQ ID NO: 2556110 - RNA, 19 nt, Human
cccucaguuucccuaucuc

SEQ ID NO: 2556111 - RNA, 21 nt, Human
cccucagggucccugguggca

SEQ ID NO: 2556112 - RNA, 20 nt, Human
cccucagucuggcccuuccu

SEQ ID NO: 2556113 - RNA, 17 nt, Human
cccucauggccccucug

SEQ ID NO: 2556114 - RNA, 16 nt, Human
cccucauggccccucu

SEQ ID NO: 2556115 - RNA, 21 nt, Human
cccucauggccccucugaccu

SEQ ID NO: 2556116 - RNA, 21 nt, Human
cccucaucuuucaucaaucau

SEQ ID NO: 2556117 - RNA, 22 nt, Human
cccucauuccaccuucccaugc

SEQ ID NO: 2556118 - RNA, 12 nt, Human
cccucauuaaug

SEQ ID NO: 2556119 - RNA, 15 nt, Human
cccucauucaggaaa

SEQ ID NO: 2556120 - RNA, 16 nt, Human
cccucauucaggaaaa

SEQ ID NO: 2556121 - RNA, 21 nt, Human
cccuccaagaccuucuccuuc

SEQ ID NO: 2556122 - RNA, 19 nt, Human
cccucauuggcucuugaac

SEQ ID NO: 2556123 - RNA, 16 nt, Human
cccucauuucaggagc

SEQ ID NO: 2556124 - RNA, 15 nt, Human
cccuccaaaagcacu

SEQ ID NO: 2556125 - RNA, 17 nt, Human
cccucauucaggaaaac

SEQ ID NO: 2556126 - RNA, 13 nt, Human
cccucaucugucc

SEQ ID NO: 2556127 - RNA, 14 nt, Human
cccucaucuguccc

SEQ ID NO: 2556128 - RNA, 13 nt, Human
cccucaucucucc

SEQ ID NO: 2556129 - RNA, 21 nt, Human
cccucaucgcguccuccuacc

SEQ ID NO: 2556130 - RNA, 17 nt, Human
cccucaucucucugccc

SEQ ID NO: 2556131 - RNA, 22 nt, Human
cccucauccucauacccacccc

SEQ ID NO: 2556132 - RNA, 12 nt, Human
cccucaugcugu

SEQ ID NO: 2556133 - RNA, 14 nt, Human
cccucccuucaacc

SEQ ID NO: 2556134 - RNA, 20 nt, Human
cccucccuguuccccagaga

SEQ ID NO: 2556135 - RNA, 13 nt, Human
cccucccuguccu

SEQ ID NO: 2556136 - RNA, 13 nt, Human
cccucccuggguu

SEQ ID NO: 2556137 - RNA, 12 nt, Human
cccucccugggu

SEQ ID NO: 2556138 - RNA, 13 nt, Human
cccucccuccucu

SEQ ID NO: 2556139 - RNA, 19 nt, Human
cccucccuguuccccagag

SEQ ID NO: 2556140 - RNA, 16 nt, Human
cccucccuggguucag

SEQ ID NO: 2556141 - RNA, 11 nt, Human
cccucccuguc

SEQ ID NO: 2556142 - RNA, 22 nt, Human
cccucccuuggaaaccugcccu

SEQ ID NO: 2556143 - RNA, 21 nt, Human
cccucccuuggaaaccugccc

SEQ ID NO: 2556144 - RNA, 19 nt, Human
cccucccuuggaaaccugc

SEQ ID NO: 2556145 - RNA, 12 nt, Human
cccucccuugga

SEQ ID NO: 2556146 - RNA, 14 nt, Human
cccucccuuucucc

SEQ ID NO: 2556147 - RNA, 13 nt, Human
cccucccuuucuc

SEQ ID NO: 2556148 - RNA, 16 nt, Human
cccucccuuucucccc

SEQ ID NO: 2556149 - RNA, 23 nt, Human
cccucccuuggaaaccugcccug

SEQ ID NO: 2556150 - RNA, 14 nt, Human
cccuccgccauucu

SEQ ID NO: 2556151 - RNA, 20 nt, Human
cccuccgauccuuccuccca

SEQ ID NO: 2556152 - RNA, 16 nt, Human
cccuccgccaggcgag

SEQ ID NO: 2556153 - RNA, 15 nt, Human
cccuccccucucuug

SEQ ID NO: 2556154 - RNA, 14 nt, Human
cccuccccucucuu

SEQ ID NO: 2556155 - RNA, 17 nt, Human
cccuccccuccccugcu

SEQ ID NO: 2556156 - RNA, 16 nt, Human
cccuccccuccccugc

SEQ ID NO: 2556157 - RNA, 22 nt, Human
cccuccccggcccuaccagcgc

SEQ ID NO: 2556158 - RNA, 12 nt, Human
cccuccccuccc

SEQ ID NO: 2556159 - RNA, 23 nt, Human
cccucccucuacugggagccuac

SEQ ID NO: 2556160 - RNA, 13 nt, Human
cccucccucuuuc

SEQ ID NO: 2556161 - RNA, 16 nt, Human
cccuccaauccugccc

SEQ ID NO: 2556162 - RNA, 15 nt, Human
cccuccaauccugcc

SEQ ID NO: 2556163 - RNA, 18 nt, Human
cccuccaaaagcacuuac

SEQ ID NO: 2556164 - RNA, 17 nt, Human
cccuccaaaagcacuua

SEQ ID NO: 2556165 - RNA, 16 nt, Human
cccuccacagccgcag

SEQ ID NO: 2556166 - RNA, 15 nt, Human
cccuccagcuugugg

SEQ ID NO: 2556167 - RNA, 20 nt, Human
cccuccagcuuguggagccc

SEQ ID NO: 2556168 - RNA, 15 nt, Human
cccuccaucccgaca

SEQ ID NO: 2556169 - RNA, 17 nt, Human
cccuccaugugggcuag

SEQ ID NO: 2556170 - RNA, 12 nt, Human
cccucccacaca

SEQ ID NO: 2556171 - RNA, 19 nt, Human
cccuccaucuaaacugccc

SEQ ID NO: 2556172 - RNA, 14 nt, Human
cccucccccugcca

SEQ ID NO: 2556173 - RNA, 13 nt, Human
cccucccacacac

SEQ ID NO: 2556174 - RNA, 12 nt, Human
cccucccccuug

SEQ ID NO: 2556175 - RNA, 17 nt, Human
cccucccccuucuccca

SEQ ID NO: 2556176 - RNA, 13 nt, Human
cccucccccuucu

SEQ ID NO: 2556177 - RNA, 15 nt, Human
cccucccccuugucc

SEQ ID NO: 2556178 - RNA, 13 nt, Human
cccucccccuugu

SEQ ID NO: 2556179 - RNA, 16 nt, Human
cccuccccgcaccccc

SEQ ID NO: 2556180 - RNA, 17 nt, Human
cccuccccgcacccccc

SEQ ID NO: 2556181 - RNA, 17 nt, Human
cccuccccgcccuuuuu

SEQ ID NO: 2556182 - RNA, 16 nt, Human
cccuccccgcccuuuu

SEQ ID NO: 2556183 - RNA, 19 nt, Human
cccuccccggcccuaccag

SEQ ID NO: 2556184 - RNA, 14 nt, Human
cccuccccggcccu

SEQ ID NO: 2556185 - RNA, 21 nt, Human
cccuccccuaaugccugcgga

SEQ ID NO: 2556186 - RNA, 19 nt, Human
cccucagggucccuggugg

SEQ ID NO: 2556187 - RNA, 18 nt, Human
cccucagggucccuggug

SEQ ID NO: 2556188 - RNA, 17 nt, Human
cccucagggucccuggu

SEQ ID NO: 2556189 - RNA, 16 nt, Human
cccucagggucccugg

SEQ ID NO: 2556190 - RNA, 17 nt, Human
cccuagcccaggagaga

SEQ ID NO: 2556191 - RNA, 16 nt, Human
cccuagcccaggagag

SEQ ID NO: 2556192 - RNA, 13 nt, Human
cccuagcccagga

SEQ ID NO: 2556193 - RNA, 18 nt, Human
cccuagccauuccuggua

SEQ ID NO: 2556194 - RNA, 22 nt, Human
cccucagggaucuugcauuccc

SEQ ID NO: 2556195 - RNA, 15 nt, Human
cccucagggucccug

SEQ ID NO: 2556196 - RNA, 21 nt, Human
cccuagagccugccuggagcg

SEQ ID NO: 2556197 - RNA, 20 nt, Human
cccuagagccugccuggagc

SEQ ID NO: 2556198 - RNA, 16 nt, Human
cccuagaguguuguug

SEQ ID NO: 2556199 - RNA, 18 nt, Human
cccuagagccugccugga

SEQ ID NO: 2556200 - RNA, 15 nt, Human
cccuagagccugccu

SEQ ID NO: 2556201 - RNA, 19 nt, Human
cccuagaaucagccuaggg

SEQ ID NO: 2556202 - RNA, 15 nt, Human
cccuagccauuccug

SEQ ID NO: 2556203 - RNA, 13 nt, Human
cccuagccauucc

SEQ ID NO: 2556204 - RNA, 17 nt, Human
cccuagccagcacuugu

SEQ ID NO: 2556205 - RNA, 22 nt, Human
cccuagaucuuucuauuccaaa

SEQ ID NO: 2556206 - RNA, 19 nt, Human
cccuagaggguuccuguag

SEQ ID NO: 2556207 - RNA, 14 nt, Human
cccuaauaaagcug

SEQ ID NO: 2556208 - RNA, 13 nt, Human
cccuaauaaagcu

SEQ ID NO: 2556209 - RNA, 12 nt, Human
cccuaauaaagc

SEQ ID NO: 2556210 - RNA, 19 nt, Human
cccuaagacuccucggccu

SEQ ID NO: 2556211 - RNA, 17 nt, Human
cccuaagccaagggccu

SEQ ID NO: 2556212 - RNA, 18 nt, Human
cccuaauaaagcugugug

SEQ ID NO: 2556213 - RNA, 15 nt, Human
cccuaauaaagcugu

SEQ ID NO: 2556214 - RNA, 19 nt, Human
cccuacuucuuuugcucuu

SEQ ID NO: 2556215 - RNA, 18 nt, Human
cccuacuucuuuugcucu

SEQ ID NO: 2556216 - RNA, 17 nt, Human
cccuagaaacuuccaaa

SEQ ID NO: 2556217 - RNA, 19 nt, Human
cccuaaggaucucucagga

SEQ ID NO: 2556218 - RNA, 21 nt, Human
cccuaaggucauuaccacagg

SEQ ID NO: 2556219 - RNA, 18 nt, Human
cccggaggggccuggcag

SEQ ID NO: 2556220 - RNA, 17 nt, Human
cccggaggggccuggca

SEQ ID NO: 2556221 - RNA, 19 nt, Human
cccggagauuggacggccu

SEQ ID NO: 2556222 - RNA, 21 nt, Human
cccggagcuaacacuggcccc

SEQ ID NO: 2556223 - RNA, 16 nt, Human
cccggauucugggagg

SEQ ID NO: 2556224 - RNA, 18 nt, Human
cccggagguugggugggc

SEQ ID NO: 2556225 - RNA, 20 nt, Human
cccggagcuaacacuggccc

SEQ ID NO: 2556226 - RNA, 14 nt, Human
cccggauucuggga

SEQ ID NO: 2556227 - RNA, 13 nt, Human
cccggcagacgcc

SEQ ID NO: 2556228 - RNA, 16 nt, Human
cccggcaggguccuag

SEQ ID NO: 2556229 - RNA, 13 nt, Human
cccgucuucagcc

SEQ ID NO: 2556230 - RNA, 14 nt, Human
cccgucuucagccu

SEQ ID NO: 2556231 - RNA, 15 nt, Human
cccgucuucagccua

SEQ ID NO: 2556232 - RNA, 16 nt, Human
cccgucuucagccuag

SEQ ID NO: 2556233 - RNA, 17 nt, Human
cccgucuucagccuagc

SEQ ID NO: 2556234 - RNA, 18 nt, Human
cccgugacagacuccuga

SEQ ID NO: 2556235 - RNA, 12 nt, Human
cccgucuucagc

SEQ ID NO: 2556236 - RNA, 18 nt, Human
cccgucuucagccuagcc

SEQ ID NO: 2556237 - RNA, 22 nt, Human
cccgugacagacuccugaggac

SEQ ID NO: 2556238 - RNA, 13 nt, Human
cccgugcagacug

SEQ ID NO: 2556239 - RNA, 21 nt, Human
cccgugaggaugucacucaga

SEQ ID NO: 2556240 - RNA, 15 nt, Human
cccgugcagacugga

SEQ ID NO: 2556241 - RNA, 11 nt, Human
cccguggcccc

SEQ ID NO: 2556242 - RNA, 18 nt, Human
cccgugcagacuggaggg

SEQ ID NO: 2556243 - RNA, 22 nt, Human
cccguugucucccuggcccuca

SEQ ID NO: 2556244 - RNA, 20 nt, Human
cccguugucucccuggcccu

SEQ ID NO: 2556245 - RNA, 19 nt, Human
cccguugucucccuggccc

SEQ ID NO: 2556246 - RNA, 17 nt, Human
cccguugucucccuggc

SEQ ID NO: 2556247 - RNA, 16 nt, Human
cccguugucucccugg

SEQ ID NO: 2556248 - RNA, 14 nt, Human
cccguggccccagc

SEQ ID NO: 2556249 - RNA, 13 nt, Human
cccguggccccag

SEQ ID NO: 2556250 - RNA, 12 nt, Human
cccguggcccca

SEQ ID NO: 2556251 - RNA, 16 nt, Human
cccguuucuccaccua

SEQ ID NO: 2556252 - RNA, 12 nt, Human
cccguuucucca

SEQ ID NO: 2556253 - RNA, 14 nt, Human
cccguuucuggugg

SEQ ID NO: 2556254 - RNA, 22 nt, Human
cccuaaaguguauuuuuuuacu

SEQ ID NO: 2556255 - RNA, 12 nt, Human
cccuaaacugua

SEQ ID NO: 2556256 - RNA, 17 nt, Human
cccuaaaguguauuuuu

SEQ ID NO: 2556257 - RNA, 14 nt, Human
cccuaaaagcacac

SEQ ID NO: 2556258 - RNA, 17 nt, Human
cuaaccacgcuggaccu

SEQ ID NO: 2556259 - RNA, 17 nt, Human
cuaacaugcccuguuca

SEQ ID NO: 2556260 - RNA, 16 nt, Human
cuaaccagcagaaaug

SEQ ID NO: 2556261 - RNA, 15 nt, Human
cuaacauuauuuauu

SEQ ID NO: 2556262 - RNA, 20 nt, Human
cuaaccacgucugucuucac

SEQ ID NO: 2556263 - RNA, 21 nt, Human
cuaaccacgucugucuucaca

SEQ ID NO: 2556264 - RNA, 14 nt, Human
cuaagcaaaaugug

SEQ ID NO: 2556265 - RNA, 17 nt, Human
cuaaccagcagaaaugc

SEQ ID NO: 2556266 - RNA, 21 nt, Human
cuaaccagggaagcugucccu

SEQ ID NO: 2556267 - RNA, 12 nt, Human
cuaagcagagga

SEQ ID NO: 2556268 - RNA, 13 nt, Human
cuaagcagaggag

SEQ ID NO: 2556269 - RNA, 14 nt, Human
cuaagcagaggagg

SEQ ID NO: 2556270 - RNA, 15 nt, Human
cuaagcagaggaggg

SEQ ID NO: 2556271 - RNA, 16 nt, Human
cuaagcagaggagggg

SEQ ID NO: 2556272 - RNA, 18 nt, Human
cuaagcagaggaggggcc

SEQ ID NO: 2556273 - RNA, 19 nt, Human
cuaagcagaggaggggccg

SEQ ID NO: 2556274 - RNA, 20 nt, Human
cuaagcagaggaggggccgc

SEQ ID NO: 2556275 - RNA, 17 nt, Human
cuaagcagcauuucuga

SEQ ID NO: 2556276 - RNA, 23 nt, Human
cuaagcagaggaggggccgcugc

SEQ ID NO: 2556277 - RNA, 19 nt, Human
cuaagcagcauuucugaag

SEQ ID NO: 2556278 - RNA, 21 nt, Human
cuaagcauagcaaacagagga

SEQ ID NO: 2556279 - RNA, 11 nt, Human
cuaagccaagg

SEQ ID NO: 2556280 - RNA, 14 nt, Human
cuaagccaagggcc

SEQ ID NO: 2556281 - RNA, 20 nt, Human
cuaagccacucuuccaaagg

SEQ ID NO: 2556282 - RNA, 18 nt, Human
cuaagccaagggccucuu

SEQ ID NO: 2556283 - RNA, 15 nt, Human
cuaagcaaaauguga

SEQ ID NO: 2556284 - RNA, 18 nt, Human
cuaagcaaaaugugauau

SEQ ID NO: 2556285 - RNA, 23 nt, Human
cuaagcacgggccauaugaauaa

SEQ ID NO: 2556286 - RNA, 20 nt, Human
cuaagcacgggccauaugaa

SEQ ID NO: 2556287 - RNA, 17 nt, Human
cuaagcuaggaaugaaa

SEQ ID NO: 2556288 - RNA, 22 nt, Human
cuaagcuaggaaugaaauccug

SEQ ID NO: 2556289 - RNA, 19 nt, Human
cuaagcuauucaguaauaa

SEQ ID NO: 2556290 - RNA, 21 nt, Human
cuaagcuauucaguaauaacu

SEQ ID NO: 2556291 - RNA, 14 nt, Human
cuaagccuaccugc

SEQ ID NO: 2556292 - RNA, 21 nt, Human
cuaagcccugucgagacacuu

SEQ ID NO: 2556293 - RNA, 20 nt, Human
cuaagcccugucgagacacu

SEQ ID NO: 2556294 - RNA, 12 nt, Human
cuaagcccuguc

SEQ ID NO: 2556295 - RNA, 22 nt, Human
cuaagcccccgcuguaaugaaa

SEQ ID NO: 2556296 - RNA, 18 nt, Human
cuaagcccccgcuguaau

SEQ ID NO: 2556297 - RNA, 14 nt, Human
cuaagcccccgcug

SEQ ID NO: 2556298 - RNA, 19 nt, Human
cuaagccccagcaagcaau

SEQ ID NO: 2556299 - RNA, 17 nt, Human
cuaagccccagcaagca

SEQ ID NO: 2556300 - RNA, 16 nt, Human
cuaagccccagcaagc

SEQ ID NO: 2556301 - RNA, 15 nt, Human
cuaagccccagcaag

SEQ ID NO: 2556302 - RNA, 23 nt, Human
cuaagccuaccugcucuccaagu

SEQ ID NO: 2556303 - RNA, 20 nt, Human
cuaagccuaccugcucucca

SEQ ID NO: 2556304 - RNA, 17 nt, Human
cuaagccuaccugcucu

SEQ ID NO: 2556305 - RNA, 16 nt, Human
cuaagccuaccugcuc

SEQ ID NO: 2556306 - RNA, 14 nt, Human
cuaagccuccuuuu

SEQ ID NO: 2556307 - RNA, 17 nt, Human
cuaagccugaaggggcg

SEQ ID NO: 2556308 - RNA, 20 nt, Human
cuaagccugaaggggcgucu

SEQ ID NO: 2556309 - RNA, 14 nt, Human
cuaagcuaggaaug

SEQ ID NO: 2556310 - RNA, 15 nt, Human
cuaagcuaacccccu

SEQ ID NO: 2556311 - RNA, 22 nt, Human
cuaagcggaccagccucccugu

SEQ ID NO: 2556312 - RNA, 17 nt, Human
cuaagccuuuccauaag

SEQ ID NO: 2556313 - RNA, 14 nt, Human
cuaaggcugaacuu

SEQ ID NO: 2556314 - RNA, 19 nt, Human
cuaaggaugucacagggcc

SEQ ID NO: 2556315 - RNA, 18 nt, Human
cuaaggaugucacagggc

SEQ ID NO: 2556316 - RNA, 20 nt, Human
cuaaggaugucacagggcca

SEQ ID NO: 2556317 - RNA, 20 nt, Human
cuaaggaugcuaaaccuuag

SEQ ID NO: 2556318 - RNA, 18 nt, Human
cuaaggaugcuaaaccuu

SEQ ID NO: 2556319 - RNA, 17 nt, Human
cuaaggaugcuaaaccu

SEQ ID NO: 2556320 - RNA, 23 nt, Human
cuaaggaucucucaggagcacag

SEQ ID NO: 2556321 - RNA, 20 nt, Human
cuaaggaucucucaggagca

SEQ ID NO: 2556322 - RNA, 18 nt, Human
cuaaggaucucucaggag

SEQ ID NO: 2556323 - RNA, 17 nt, Human
cuaaggaucucucagga

SEQ ID NO: 2556324 - RNA, 15 nt, Human
cuaaggaucucucag

SEQ ID NO: 2556325 - RNA, 12 nt, Human
cuaaggaucucu

SEQ ID NO: 2556326 - RNA, 16 nt, Human
cuaagccuuuccauaa

SEQ ID NO: 2556327 - RNA, 22 nt, Human
cuaagggagagugguauuugca

SEQ ID NO: 2556328 - RNA, 17 nt, Human
cuaagggagagugguau

SEQ ID NO: 2556329 - RNA, 23 nt, Human
cuaagggagagugguauuugcag

SEQ ID NO: 2556330 - RNA, 12 nt, Human
cuaaggggcccg

SEQ ID NO: 2556331 - RNA, 13 nt, Human
cuaaggggcccgg

SEQ ID NO: 2556332 - RNA, 18 nt, Human
cuaaggggcccggccagc

SEQ ID NO: 2556333 - RNA, 22 nt, Human
cuaaggggcccggccagccaug

SEQ ID NO: 2556334 - RNA, 15 nt, Human
cuaaggugugcucug

SEQ ID NO: 2556335 - RNA, 18 nt, Human
cuaaggguguaaguaauu

SEQ ID NO: 2556336 - RNA, 19 nt, Human
cuaaggucauuaccacagg

SEQ ID NO: 2556337 - RNA, 22 nt, Human
cuacccacccuccuuucaccac

SEQ ID NO: 2556338 - RNA, 18 nt, Human
cuaccaucagggacagga

SEQ ID NO: 2556339 - RNA, 16 nt, Human
cuaccaucagggacag

SEQ ID NO: 2556340 - RNA, 15 nt, Human
cuaccaucagggaca

SEQ ID NO: 2556341 - RNA, 14 nt, Human
cuaccaucagggac

SEQ ID NO: 2556342 - RNA, 23 nt, Human
cuacccacguucucacacccacc

SEQ ID NO: 2556343 - RNA, 14 nt, Human
cuacccacuucuaa

SEQ ID NO: 2556344 - RNA, 17 nt, Human
cuacccacccuccuuuc

SEQ ID NO: 2556345 - RNA, 18 nt, Human
cuaccacugucuucuuca

SEQ ID NO: 2556346 - RNA, 17 nt, Human
cuaccacuccugccaag

SEQ ID NO: 2556347 - RNA, 20 nt, Human
cuaccagacuguguauucau

SEQ ID NO: 2556348 - RNA, 16 nt, Human
cuaccagacuguguau

SEQ ID NO: 2556349 - RNA, 17 nt, Human
cuaccagcgcccgcugg

SEQ ID NO: 2556350 - RNA, 20 nt, Human
cuacagagcuucccugacuc

SEQ ID NO: 2556351 - RNA, 14 nt, Human
cuaccacuccugcc

SEQ ID NO: 2556352 - RNA, 12 nt, Human
cuaccacuccug

SEQ ID NO: 2556353 - RNA, 22 nt, Human
cuaccagcgcccgcugggcuga

SEQ ID NO: 2556354 - RNA, 21 nt, Human
cuaccagcgcccgcugggcug

SEQ ID NO: 2556355 - RNA, 20 nt, Human
cuaccagcgcccgcugggcu

SEQ ID NO: 2556356 - RNA, 19 nt, Human
cuaccagcgcccgcugggc

SEQ ID NO: 2556357 - RNA, 15 nt, Human
cuaccagguguucua

SEQ ID NO: 2556358 - RNA, 19 nt, Human
cuacccagcgagcccuggu

SEQ ID NO: 2556359 - RNA, 20 nt, Human
cuacccagcgagcccuggug

SEQ ID NO: 2556360 - RNA, 14 nt, Human
cuacccagggccug

SEQ ID NO: 2556361 - RNA, 15 nt, Human
cuacccagggccugc

SEQ ID NO: 2556362 - RNA, 16 nt, Human
cuacccagggccugca

SEQ ID NO: 2556363 - RNA, 19 nt, Human
cuacccagggccugcagga

SEQ ID NO: 2556364 - RNA, 18 nt, Human
cuacccagagaagccccu

SEQ ID NO: 2556365 - RNA, 11 nt, Human
cuacccagggc

SEQ ID NO: 2556366 - RNA, 16 nt, Human
cuacccacuucuaaau

SEQ ID NO: 2556367 - RNA, 22 nt, Human
cuacccacuucuaaauagcaau

SEQ ID NO: 2556368 - RNA, 20 nt, Human
cuaccccgcagacaccuugg

SEQ ID NO: 2556369 - RNA, 15 nt, Human
cuaccccgcagacac

SEQ ID NO: 2556370 - RNA, 12 nt, Human
cuacccaggugc

SEQ ID NO: 2556371 - RNA, 17 nt, Human
cuaccccucccagcuga

SEQ ID NO: 2556372 - RNA, 16 nt, Human
cuaccccucccagcug

SEQ ID NO: 2556373 - RNA, 18 nt, Human
cuaccccucccagcugac

SEQ ID NO: 2556374 - RNA, 15 nt, Human
cuaccccucccagcu

SEQ ID NO: 2556375 - RNA, 13 nt, Human
cuaccccucccag

SEQ ID NO: 2556376 - RNA, 11 nt, Human
cuaccccuccc

SEQ ID NO: 2556377 - RNA, 20 nt, Human
cuaccccugaucugacaucc

SEQ ID NO: 2556378 - RNA, 17 nt, Human
cuacccgcaucuucugu

SEQ ID NO: 2556379 - RNA, 15 nt, Human
cuacccgcagaguuc

SEQ ID NO: 2556380 - RNA, 17 nt, Human
cuacacuccagugagac

SEQ ID NO: 2556381 - RNA, 18 nt, Human
cuacacugugcugagucu

SEQ ID NO: 2556382 - RNA, 16 nt, Human
cuacacuccagugaga

SEQ ID NO: 2556383 - RNA, 17 nt, Human
cuacacuccagccugag

SEQ ID NO: 2556384 - RNA, 18 nt, Human
cuacacuccagccugagc

SEQ ID NO: 2556385 - RNA, 16 nt, Human
cuacacuccagccuga

SEQ ID NO: 2556386 - RNA, 13 nt, Human
cuacacacugcau

SEQ ID NO: 2556387 - RNA, 15 nt, Human
cuacacacugcaugu

SEQ ID NO: 2556388 - RNA, 20 nt, Human
cuacaauuuucucccaggaa

SEQ ID NO: 2556389 - RNA, 16 nt, Human
cuacaauuuucuccca

SEQ ID NO: 2556390 - RNA, 15 nt, Human
cuacaauuuucuccc

SEQ ID NO: 2556391 - RNA, 18 nt, Human
cuacaaugugaacuuuau

SEQ ID NO: 2556392 - RNA, 13 nt, Human
cuacaaugugaac

SEQ ID NO: 2556393 - RNA, 17 nt, Human
cuacaaugugaacuuua

SEQ ID NO: 2556394 - RNA, 19 nt, Human
cuacaaugugaacuuuauu

SEQ ID NO: 2556395 - RNA, 16 nt, Human
cuacaauuuaaagcaa

SEQ ID NO: 2556396 - RNA, 22 nt, Human
cuacagagaaccuggaguuccu

SEQ ID NO: 2556397 - RNA, 16 nt, Human
cuacagagcuucccug

SEQ ID NO: 2556398 - RNA, 17 nt, Human
cuacagagcuucccuga

SEQ ID NO: 2556399 - RNA, 18 nt, Human
cuacagagcuucccugac

SEQ ID NO: 2556400 - RNA, 15 nt, Human
cuacagaggccaugg

SEQ ID NO: 2556401 - RNA, 16 nt, Human
cuacagacuucuccag

SEQ ID NO: 2556402 - RNA, 21 nt, Human
cuacagacuucuccagaccca

SEQ ID NO: 2556403 - RNA, 17 nt, Human
cuacacuccagccuggg

SEQ ID NO: 2556404 - RNA, 23 nt, Human
cuacaauuuucucccaggaagcu

SEQ ID NO: 2556405 - RNA, 21 nt, Human
cuaauaaaauuuaaaagucuu

SEQ ID NO: 2556406 - RNA, 12 nt, Human
cuaauaaagcug

SEQ ID NO: 2556407 - RNA, 20 nt, Human
cuaauaaaauuuaaaagucu

SEQ ID NO: 2556408 - RNA, 17 nt, Human
cuaagguggauuuucau

SEQ ID NO: 2556409 - RNA, 16 nt, Human
cuaaggugugcucuga

SEQ ID NO: 2556410 - RNA, 13 nt, Human
cuaauaaagcugu

SEQ ID NO: 2556411 - RNA, 18 nt, Human
cuaauauuaaaaauaugg

SEQ ID NO: 2556412 - RNA, 16 nt, Human
cuaauauuaaaaauau

SEQ ID NO: 2556413 - RNA, 14 nt, Human
cuaauauuaaaaau

SEQ ID NO: 2556414 - RNA, 13 nt, Human
cuaauauuaaaaa

SEQ ID NO: 2556415 - RNA, 18 nt, Human
cuaauauuuauugcuuua

SEQ ID NO: 2556416 - RNA, 17 nt, Human
cuaauauuuauugcuuu

SEQ ID NO: 2556417 - RNA, 16 nt, Human
cuaauauuuauugcuu

SEQ ID NO: 2556418 - RNA, 14 nt, Human
cuaauauuuuaugu

SEQ ID NO: 2556419 - RNA, 20 nt, Human
cuaaucuauggucgggagac

SEQ ID NO: 2556420 - RNA, 18 nt, Human
cuaaucuauggucgggag

SEQ ID NO: 2556421 - RNA, 19 nt, Human
cuaaucuagauaucgacuu

SEQ ID NO: 2556422 - RNA, 16 nt, Human
cuaauccucuuuuucu

SEQ ID NO: 2556423 - RNA, 21 nt, Human
cuaaucccugggcauugcuuu

SEQ ID NO: 2556424 - RNA, 22 nt, Human
cuaaucccugggcauugcuuuc

SEQ ID NO: 2556425 - RNA, 15 nt, Human
cuaaucgaacuauga

SEQ ID NO: 2556426 - RNA, 23 nt, Human
cuaaucccugggcauugcuuucc

SEQ ID NO: 2556427 - RNA, 18 nt, Human
cuaaucuguagggcugga

SEQ ID NO: 2556428 - RNA, 14 nt, Human
cuaaucuguagggc

SEQ ID NO: 2556429 - RNA, 13 nt, Human
cuaaucuguaggg

SEQ ID NO: 2556430 - RNA, 21 nt, Human
cuaaucuauuggguucauuau

SEQ ID NO: 2556431 - RNA, 19 nt, Human
cuaaucuauuggguucauu

SEQ ID NO: 2556432 - RNA, 20 nt, Human
cuaaucuauuggguucauua

SEQ ID NO: 2556433 - RNA, 14 nt, Human
cuaaucuauugggu

SEQ ID NO: 2556434 - RNA, 17 nt, Human
cuaaucuauuggguuca

SEQ ID NO: 2556435 - RNA, 18 nt, Human
cuaaucuauuggguucau

SEQ ID NO: 2556436 - RNA, 22 nt, Human
cuaaucuauuggguucauuauu

SEQ ID NO: 2556437 - RNA, 17 nt, Human
cuaaucagcauucucac

SEQ ID NO: 2556438 - RNA, 17 nt, Human
cuaauccaggcagaucc

SEQ ID NO: 2556439 - RNA, 19 nt, Human
cuaaucagcauucucacuc

SEQ ID NO: 2556440 - RNA, 18 nt, Human
cuaauccaggcagaucca

SEQ ID NO: 2556441 - RNA, 19 nt, Human
cuaauccaggcagauccag

SEQ ID NO: 2556442 - RNA, 20 nt, Human
cuaauccaggcagauccagg

SEQ ID NO: 2556443 - RNA, 23 nt, Human
cuaauccaggcagauccaggacu

SEQ ID NO: 2556444 - RNA, 18 nt, Human
cuaaucccgauucacccu

SEQ ID NO: 2556445 - RNA, 19 nt, Human
cuaaucccugggcauugcu

SEQ ID NO: 2556446 - RNA, 20 nt, Human
cuaaucccugggcauugcuu

SEQ ID NO: 2556447 - RNA, 22 nt, Human
cuaaucuguagggcuggaccua

SEQ ID NO: 2556448 - RNA, 21 nt, Human
cuaaucuguagggcuggaccu

SEQ ID NO: 2556449 - RNA, 22 nt, Human
cuaaucuucagggcacugcugc

SEQ ID NO: 2556450 - RNA, 15 nt, Human
cuaaucuucagggca

SEQ ID NO: 2556451 - RNA, 22 nt, Human
cuaaugacaucaccacaguuua

SEQ ID NO: 2556452 - RNA, 18 nt, Human
cuaaugaagggaaaggau

SEQ ID NO: 2556453 - RNA, 23 nt, Human
cuaaugaagggaaaggauauuuu

SEQ ID NO: 2556454 - RNA, 22 nt, Human
cuaaugaaugcauaaaauguua

SEQ ID NO: 2556455 - RNA, 19 nt, Human
cuaaugaaugcauaaaaug

SEQ ID NO: 2556456 - RNA, 16 nt, Human
cuaauguacugcauau

SEQ ID NO: 2556457 - RNA, 21 nt, Human
cuaauguauuuuauuguaaca

SEQ ID NO: 2556458 - RNA, 20 nt, Human
cuaauguauuuuauuguaac

SEQ ID NO: 2556459 - RNA, 19 nt, Human
cuaauguauuuuauuguaa

SEQ ID NO: 2556460 - RNA, 18 nt, Human
cuaauguauuuuauugua

SEQ ID NO: 2556461 - RNA, 17 nt, Human
cuaauguauuuuauugu

SEQ ID NO: 2556462 - RNA, 15 nt, Human
cuaauguauuuuauu

SEQ ID NO: 2556463 - RNA, 12 nt, Human
cuaaugauguuu

SEQ ID NO: 2556464 - RNA, 13 nt, Human
cuaaugauguuuu

SEQ ID NO: 2556465 - RNA, 14 nt, Human
cuaauguacugcau

SEQ ID NO: 2556466 - RNA, 19 nt, Human
cuaauguaauaacugugaa

SEQ ID NO: 2556467 - RNA, 15 nt, Human
cuacaagacacagug

SEQ ID NO: 2556468 - RNA, 15 nt, Human
cuacaagagcagccu

SEQ ID NO: 2556469 - RNA, 17 nt, Human
cuacaagagcagccugu

SEQ ID NO: 2556470 - RNA, 18 nt, Human
cuacaagagcagccugug

SEQ ID NO: 2556471 - RNA, 19 nt, Human
cuacaagagcagccugugg

SEQ ID NO: 2556472 - RNA, 20 nt, Human
cuacaagagcagccuguggc

SEQ ID NO: 2556473 - RNA, 19 nt, Human
cuacaagcuaaaauuagau

SEQ ID NO: 2556474 - RNA, 17 nt, Human
cuacaagcuaaaauuag

SEQ ID NO: 2556475 - RNA, 23 nt, Human
cuacaagagcagccuguggcauc

SEQ ID NO: 2556476 - RNA, 21 nt, Human
cuacaagagcagccuguggca

SEQ ID NO: 2556477 - RNA, 22 nt, Human
cuacaagagcagccuguggcau

SEQ ID NO: 2556478 - RNA, 17 nt, Human
cuaauguuuaugagcca

SEQ ID NO: 2556479 - RNA, 18 nt, Human
cuaauguuuaugagccag

SEQ ID NO: 2556480 - RNA, 20 nt, Human
cuaauguuuaugagccagac

SEQ ID NO: 2556481 - RNA, 14 nt, Human
cuaauuaauaaauu

SEQ ID NO: 2556482 - RNA, 19 nt, Human
cuaaugugguuauuucucu

SEQ ID NO: 2556483 - RNA, 19 nt, Human
cuaaugugccuaguucuuu

SEQ ID NO: 2556484 - RNA, 22 nt, Human
cuaaugucuucauuucauugua

SEQ ID NO: 2556485 - RNA, 21 nt, Human
cuaaugucuucauuucauugu

SEQ ID NO: 2556486 - RNA, 19 nt, Human
cuaaugucuucauuucauu

SEQ ID NO: 2556487 - RNA, 22 nt, Human
cuaauguauuuuauuguaacag

SEQ ID NO: 2556488 - RNA, 13 nt, Human
cuaaugucuucau

SEQ ID NO: 2556489 - RNA, 21 nt, Human
cuacccgggaagggggcuggg

SEQ ID NO: 2556490 - RNA, 20 nt, Human
cuacccgggaagggggcugg

SEQ ID NO: 2556491 - RNA, 15 nt, Human
cuacccgggaagggg

SEQ ID NO: 2556492 - RNA, 14 nt, Human
cuacccgggaaggg

SEQ ID NO: 2556493 - RNA, 21 nt, Human
cuacucugugucagguggggc

SEQ ID NO: 2556494 - RNA, 16 nt, Human
cuacucugugucaggu

SEQ ID NO: 2556495 - RNA, 15 nt, Human
cuacucuguuccuuc

SEQ ID NO: 2556496 - RNA, 13 nt, Human
cuacucuguguca

SEQ ID NO: 2556497 - RNA, 16 nt, Human
cuacucuguuccuuca

SEQ ID NO: 2556498 - RNA, 19 nt, Human
cuacucuguuccuucacau

SEQ ID NO: 2556499 - RNA, 15 nt, Human
cuacucuuaagccau

SEQ ID NO: 2556500 - RNA, 22 nt, Human
cuacucuguuccuucacauccu

SEQ ID NO: 2556501 - RNA, 16 nt, Human
cuacuguaauuuguga

SEQ ID NO: 2556502 - RNA, 21 nt, Human
cuacuguaaggcaaucauggu

SEQ ID NO: 2556503 - RNA, 17 nt, Human
cuacuguaauuugugau

SEQ ID NO: 2556504 - RNA, 21 nt, Human
cuacuguaagcaagaaaaaua

SEQ ID NO: 2556505 - RNA, 17 nt, Human
cuacuggucuuguggaa

SEQ ID NO: 2556506 - RNA, 22 nt, Human
cuacuguaauaaagaugauugu

SEQ ID NO: 2556507 - RNA, 13 nt, Human
cuacugugacuga

SEQ ID NO: 2556508 - RNA, 14 nt, Human
cuacuguggaaaaa

SEQ ID NO: 2556509 - RNA, 22 nt, Human
cuacucuuaagccaucuuggua

SEQ ID NO: 2556510 - RNA, 18 nt, Human
cuacucuuaagccaucuu

SEQ ID NO: 2556511 - RNA, 17 nt, Human
cuacucuuaagccaucu

SEQ ID NO: 2556512 - RNA, 16 nt, Human
cuacucuuaagccauc

SEQ ID NO: 2556513 - RNA, 22 nt, Human
cuacucuuaaguuucucagcuc

SEQ ID NO: 2556514 - RNA, 21 nt, Human
cuacucuuaaguuucucagcu

SEQ ID NO: 2556515 - RNA, 14 nt, Human
cuacugaggugcua

SEQ ID NO: 2556516 - RNA, 15 nt, Human
cuacugacauguggg

SEQ ID NO: 2556517 - RNA, 14 nt, Human
cuacugacaugugg

SEQ ID NO: 2556518 - RNA, 20 nt, Human
cuacugacauguggggccag

SEQ ID NO: 2556519 - RNA, 17 nt, Human
cuacugacuuucucagc

SEQ ID NO: 2556520 - RNA, 15 nt, Human
cuacuugggaggcug

SEQ ID NO: 2556521 - RNA, 18 nt, Human
cuacuugggaggcugaga

SEQ ID NO: 2556522 - RNA, 22 nt, Human
cuacuucuuuugcucuuagcug

SEQ ID NO: 2556523 - RNA, 22 nt, Human
cuacuucuuugcuuugcccagc

SEQ ID NO: 2556524 - RNA, 15 nt, Human
cuacuugagaggcug

SEQ ID NO: 2556525 - RNA, 18 nt, Human
cuacuuugacuuuuugca

SEQ ID NO: 2556526 - RNA, 19 nt, Human
cuacuuugacuuuuugcau

SEQ ID NO: 2556527 - RNA, 20 nt, Human
cuacuuugacuuuuugcauu

SEQ ID NO: 2556528 - RNA, 21 nt, Human
cuacuuugacuuuuugcauuu

SEQ ID NO: 2556529 - RNA, 19 nt, Human
cuacuugggaggcugagau

SEQ ID NO: 2556530 - RNA, 12 nt, Human
cuacuugggagg

SEQ ID NO: 2556531 - RNA, 13 nt, Human
cuacuugggccau

SEQ ID NO: 2556532 - RNA, 15 nt, Human
cuacuuuaagcacua

SEQ ID NO: 2556533 - RNA, 14 nt, Human
cuacuuccccuucc

SEQ ID NO: 2556534 - RNA, 15 nt, Human
cuacuuccccuuccu

SEQ ID NO: 2556535 - RNA, 13 nt, Human
cuacuuccuccuc

SEQ ID NO: 2556536 - RNA, 20 nt, Human
cuacuuccccuuccuaauuc

SEQ ID NO: 2556537 - RNA, 16 nt, Human
cuacuucccucaccca

SEQ ID NO: 2556538 - RNA, 20 nt, Human
cuacuuccugugacuucagc

SEQ ID NO: 2556539 - RNA, 19 nt, Human
cuacuuccuccuccccacu

SEQ ID NO: 2556540 - RNA, 17 nt, Human
cuacuuccuccucccca

SEQ ID NO: 2556541 - RNA, 20 nt, Human
cuacuuccuccuccccacuu

SEQ ID NO: 2556542 - RNA, 20 nt, Human
cuacuguguuccuggcaaua

SEQ ID NO: 2556543 - RNA, 15 nt, Human
cuacuguguuccugg

SEQ ID NO: 2556544 - RNA, 19 nt, Human
cuacuguguuccuggcaau

SEQ ID NO: 2556545 - RNA, 12 nt, Human
cuacuguguucc

SEQ ID NO: 2556546 - RNA, 13 nt, Human
cuacuguguuccu

SEQ ID NO: 2556547 - RNA, 14 nt, Human
cuacuguguuccug

SEQ ID NO: 2556548 - RNA, 22 nt, Human
cuacuuagcaugucccuaccga

SEQ ID NO: 2556549 - RNA, 15 nt, Human
cuacuguguguguga

SEQ ID NO: 2556550 - RNA, 21 nt, Human
cuacuguggaaaaauauuuaa

SEQ ID NO: 2556551 - RNA, 22 nt, Human
cuacuguggaaaaauauuuaag

SEQ ID NO: 2556552 - RNA, 15 nt, Human
cuacuguggaaaaau

SEQ ID NO: 2556553 - RNA, 17 nt, Human
cuacuguggaaaaauau

SEQ ID NO: 2556554 - RNA, 18 nt, Human
cuacuguggaaaaauauu

SEQ ID NO: 2556555 - RNA, 20 nt, Human
cuacuguggaaaaauauuua

SEQ ID NO: 2556556 - RNA, 17 nt, Human
cuacugugugugugaau

SEQ ID NO: 2556557 - RNA, 19 nt, Human
cuacugugugugugaauga

SEQ ID NO: 2556558 - RNA, 20 nt, Human
cuacugugugugugaaugaa

SEQ ID NO: 2556559 - RNA, 16 nt, Human
cuagauggcagucacu

SEQ ID NO: 2556560 - RNA, 14 nt, Human
cuagauggcuccuc

SEQ ID NO: 2556561 - RNA, 15 nt, Human
cuagauggcuccucu

SEQ ID NO: 2556562 - RNA, 16 nt, Human
cuagauggcuccucuc

SEQ ID NO: 2556563 - RNA, 18 nt, Human
cuagauggcuccucucag

SEQ ID NO: 2556564 - RNA, 20 nt, Human
cuagaugggcaugggguggg

SEQ ID NO: 2556565 - RNA, 13 nt, Human
cuagauggugcug

SEQ ID NO: 2556566 - RNA, 19 nt, Human
cuagauggugcugagaagc

SEQ ID NO: 2556567 - RNA, 22 nt, Human
cuagauggugcugagaagcuuu

SEQ ID NO: 2556568 - RNA, 14 nt, Human
cuagauggugcuga

SEQ ID NO: 2556569 - RNA, 15 nt, Human
cuagauggugcugag

SEQ ID NO: 2556570 - RNA, 16 nt, Human
cuagauggugcugaga

SEQ ID NO: 2556571 - RNA, 17 nt, Human
cuagauggugcugagaa

SEQ ID NO: 2556572 - RNA, 21 nt, Human
cuagauuacccccucauuguu

SEQ ID NO: 2556573 - RNA, 13 nt, Human
cuagaugucuuua

SEQ ID NO: 2556574 - RNA, 17 nt, Human
cuagaugaaguuuuaca

SEQ ID NO: 2556575 - RNA, 18 nt, Human
cuagaucaugaagaaccu

SEQ ID NO: 2556576 - RNA, 13 nt, Human
cuagauccacaca

SEQ ID NO: 2556577 - RNA, 17 nt, Human
cuagauccacacacaga

SEQ ID NO: 2556578 - RNA, 18 nt, Human
cuagauccacacacagag

SEQ ID NO: 2556579 - RNA, 19 nt, Human
cuagauccacacacagagg

SEQ ID NO: 2556580 - RNA, 21 nt, Human
cuagauccacacacagaggaa

SEQ ID NO: 2556581 - RNA, 13 nt, Human
cuagauuuaugaa

SEQ ID NO: 2556582 - RNA, 17 nt, Human
cuagauuuuguuuugcu

SEQ ID NO: 2556583 - RNA, 13 nt, Human
cuagauuuuguuu

SEQ ID NO: 2556584 - RNA, 12 nt, Human
cuagauuuuguu

SEQ ID NO: 2556585 - RNA, 20 nt, Human
cuagauuuuguuuugcuuuu

SEQ ID NO: 2556586 - RNA, 18 nt, Human
cuagauuuuguuuugcuu

SEQ ID NO: 2556587 - RNA, 21 nt, Human
cuagauuuuguuuugcuuuuu

SEQ ID NO: 2556588 - RNA, 24 nt, Human
cuagauugagagaagagacaaaca

SEQ ID NO: 2556589 - RNA, 20 nt, Human
cuagauucuacauauucuuu

SEQ ID NO: 2556590 - RNA, 18 nt, Human
cuagcaagugagagagau

SEQ ID NO: 2556591 - RNA, 15 nt, Human
cuagcaagugagaga

SEQ ID NO: 2556592 - RNA, 22 nt, Human
cuagcaaucacaacacuggcug

SEQ ID NO: 2556593 - RNA, 20 nt, Human
cuagcaaucacaacacuggc

SEQ ID NO: 2556594 - RNA, 19 nt, Human
cuagcaagugagagagaug

SEQ ID NO: 2556595 - RNA, 17 nt, Human
cuagcacuuugggaggc

SEQ ID NO: 2556596 - RNA, 14 nt, Human
cuagcacuggccug

SEQ ID NO: 2556597 - RNA, 13 nt, Human
cuagcacuggccu

SEQ ID NO: 2556598 - RNA, 15 nt, Human
cuagcaccagggacu

SEQ ID NO: 2556599 - RNA, 17 nt, Human
cuagagugaacuugggc

SEQ ID NO: 2556600 - RNA, 21 nt, Human
cuagagugaacuugggccacu

SEQ ID NO: 2556601 - RNA, 17 nt, Human
cuagaguagaguggagg

SEQ ID NO: 2556602 - RNA, 15 nt, Human
cuagaguccucacuc

SEQ ID NO: 2556603 - RNA, 20 nt, Human
cuagagucugaacagcugua

SEQ ID NO: 2556604 - RNA, 19 nt, Human
cuagagucugaacagcugu

SEQ ID NO: 2556605 - RNA, 16 nt, Human
cuagagucugaacagc

SEQ ID NO: 2556606 - RNA, 19 nt, Human
cuagaguccucacucccag

SEQ ID NO: 2556607 - RNA, 17 nt, Human
cuagagggaccucuccc

SEQ ID NO: 2556608 - RNA, 15 nt, Human
cuagagggaggggcc

SEQ ID NO: 2556609 - RNA, 16 nt, Human
cuagagggaggggccu

SEQ ID NO: 2556610 - RNA, 19 nt, Human
cuagagggaggggccuagg

SEQ ID NO: 2556611 - RNA, 21 nt, Human
cuagagggaggggccuaggcc

SEQ ID NO: 2556612 - RNA, 22 nt, Human
cuagagggaggggccuaggccu

SEQ ID NO: 2556613 - RNA, 22 nt, Human
cuagaggggggauuuccagcca

SEQ ID NO: 2556614 - RNA, 22 nt, Human
cuagagggauacacugaaguua

SEQ ID NO: 2556615 - RNA, 19 nt, Human
cuagaggguuccuguagac

SEQ ID NO: 2556616 - RNA, 15 nt, Human
cuagaggguuccugu

SEQ ID NO: 2556617 - RNA, 16 nt, Human
cuagaggguuccugua

SEQ ID NO: 2556618 - RNA, 18 nt, Human
cuagaggccagccccacc

SEQ ID NO: 2556619 - RNA, 19 nt, Human
cuagaggccagccccaccc

SEQ ID NO: 2556620 - RNA, 20 nt, Human
cuagaggccagccccaccca

SEQ ID NO: 2556621 - RNA, 19 nt, Human
cuagaggcagggaggggac

SEQ ID NO: 2556622 - RNA, 21 nt, Human
cuagaggccagccccacccag

SEQ ID NO: 2556623 - RNA, 18 nt, Human
cuagagggaccucuccca

SEQ ID NO: 2556624 - RNA, 19 nt, Human
cuagagggaccucucccag

SEQ ID NO: 2556625 - RNA, 20 nt, Human
cuagagggaccucucccagg

SEQ ID NO: 2556626 - RNA, 21 nt, Human
cuagagggaccucucccaggg

SEQ ID NO: 2556627 - RNA, 20 nt, Human
cuagacgagcaggcuucuuc

SEQ ID NO: 2556628 - RNA, 14 nt, Human
cuacuuuguccuuu

SEQ ID NO: 2556629 - RNA, 20 nt, Human
cuacuuuguccuuuuuguua

SEQ ID NO: 2556630 - RNA, 21 nt, Human
cuagacgagcaggcuucuucc

SEQ ID NO: 2556631 - RNA, 21 nt, Human
cuagacccacuggacucaccu

SEQ ID NO: 2556632 - RNA, 22 nt, Human
cuacuuuguccuuuuuguuauu

SEQ ID NO: 2556633 - RNA, 19 nt, Human
cuagacgcuucaucccaca

SEQ ID NO: 2556634 - RNA, 23 nt, Human
cuagacucaagguucccagagau

SEQ ID NO: 2556635 - RNA, 22 nt, Human
cuagacucaagguucccagaga

SEQ ID NO: 2556636 - RNA, 15 nt, Human
cuagagccugccugg

SEQ ID NO: 2556637 - RNA, 19 nt, Human
cuagagccugccuggagcg

SEQ ID NO: 2556638 - RNA, 18 nt, Human
cuagagccugccuggagc

SEQ ID NO: 2556639 - RNA, 17 nt, Human
cuagagccugccuggag

SEQ ID NO: 2556640 - RNA, 16 nt, Human
cuagagccugccugga

SEQ ID NO: 2556641 - RNA, 19 nt, Human
cuagaggaaccaaccccca

SEQ ID NO: 2556642 - RNA, 14 nt, Human
cuagaggcagggag

SEQ ID NO: 2556643 - RNA, 15 nt, Human
cuagaggcagggagg

SEQ ID NO: 2556644 - RNA, 18 nt, Human
cuagaggcagggagggga

SEQ ID NO: 2556645 - RNA, 17 nt, Human
cuagaggccagccccac

SEQ ID NO: 2556646 - RNA, 21 nt, Human
cuauauauaauucuguacaua

SEQ ID NO: 2556647 - RNA, 19 nt, Human
cuauauauaauucuguaca

SEQ ID NO: 2556648 - RNA, 18 nt, Human
cuauauauaauucuguac

SEQ ID NO: 2556649 - RNA, 17 nt, Human
cuauauauaauucugua

SEQ ID NO: 2556650 - RNA, 16 nt, Human
cuauauauaauucugu

SEQ ID NO: 2556651 - RNA, 16 nt, Human
cuauauaguuuauuga

SEQ ID NO: 2556652 - RNA, 13 nt, Human
cuauauauaauuc

SEQ ID NO: 2556653 - RNA, 22 nt, Human
cuauauaguuuauugacaauaa

SEQ ID NO: 2556654 - RNA, 18 nt, Human
cuauauaugugaugaucu

SEQ ID NO: 2556655 - RNA, 23 nt, Human
cuauauaugugaugaucuaccag

SEQ ID NO: 2556656 - RNA, 15 nt, Human
cuauauauguguaug

SEQ ID NO: 2556657 - RNA, 13 nt, Human
cuauauaugugua

SEQ ID NO: 2556658 - RNA, 17 nt, Human
cuauauauguguaugua

SEQ ID NO: 2556659 - RNA, 12 nt, Human
cuauauccaugu

SEQ ID NO: 2556660 - RNA, 13 nt, Human
cuauauccaugua

SEQ ID NO: 2556661 - RNA, 14 nt, Human
cuauauccauguac

SEQ ID NO: 2556662 - RNA, 15 nt, Human
cuauauccauguacu

SEQ ID NO: 2556663 - RNA, 16 nt, Human
cuauauccauguacug

SEQ ID NO: 2556664 - RNA, 22 nt, Human
cuaguuauuacccagaguuuuu

SEQ ID NO: 2556665 - RNA, 20 nt, Human
cuaguucauccaauccucac

SEQ ID NO: 2556666 - RNA, 21 nt, Human
cuaguucauccaauccucacu

SEQ ID NO: 2556667 - RNA, 22 nt, Human
cuaguucauccaauccucacug

SEQ ID NO: 2556668 - RNA, 24 nt, Human
cuaguucauccaauccucacuggg

SEQ ID NO: 2556669 - RNA, 12 nt, Human
cuaguucaucca

SEQ ID NO: 2556670 - RNA, 18 nt, Human
cuaguucauccaauccuc

SEQ ID NO: 2556671 - RNA, 19 nt, Human
cuaguucauccaauccuca

SEQ ID NO: 2556672 - RNA, 18 nt, Human
cuauaugauuuauaguuu

SEQ ID NO: 2556673 - RNA, 17 nt, Human
cuauaugauuuauaguu

SEQ ID NO: 2556674 - RNA, 16 nt, Human
cuauaugauuuauagu

SEQ ID NO: 2556675 - RNA, 13 nt, Human
cuauaugauuuau

SEQ ID NO: 2556676 - RNA, 23 nt, Human
cuauaugaauuuaaauauaauuc

SEQ ID NO: 2556677 - RNA, 20 nt, Human
cuauaugaauuuaaauauaa

SEQ ID NO: 2556678 - RNA, 16 nt, Human
cuauaugaauuuaaau

SEQ ID NO: 2556679 - RNA, 15 nt, Human
cuauaugaauuuaaa

SEQ ID NO: 2556680 - RNA, 20 nt, Human
cuauaucuguauauaaaaua

SEQ ID NO: 2556681 - RNA, 19 nt, Human
cuauaucuguauauaaaau

SEQ ID NO: 2556682 - RNA, 16 nt, Human
cuauaucuguauauaa

SEQ ID NO: 2556683 - RNA, 15 nt, Human
cuauaucuguauaua

SEQ ID NO: 2556684 - RNA, 14 nt, Human
cuauaucuauauau

SEQ ID NO: 2556685 - RNA, 13 nt, Human
cuauaucuauaua

SEQ ID NO: 2556686 - RNA, 15 nt, Human
cuauaugaaaaacaa

SEQ ID NO: 2556687 - RNA, 20 nt, Human
cuauauccauguacuguagu

SEQ ID NO: 2556688 - RNA, 18 nt, Human
cuauauccauguacugua

SEQ ID NO: 2556689 - RNA, 19 nt, Human
cuauauccauguacuguag

SEQ ID NO: 2556690 - RNA, 21 nt, Human
cuauauccauguacuguaguu

SEQ ID NO: 2556691 - RNA, 20 nt, Human
cuauauuuuuuguuaaauga

SEQ ID NO: 2556692 - RNA, 23 nt, Human
cuauauuguuuucaguguacaug

SEQ ID NO: 2556693 - RNA, 19 nt, Human
cuauauuguuugcuaagca

SEQ ID NO: 2556694 - RNA, 22 nt, Human
cuauauuguuuucaguguacau

SEQ ID NO: 2556695 - RNA, 14 nt, Human
cuaucacacagugg

SEQ ID NO: 2556696 - RNA, 18 nt, Human
cuaucaauauauaaauuu

SEQ ID NO: 2556697 - RNA, 21 nt, Human
cuaucaauagucaagaaaaau

SEQ ID NO: 2556698 - RNA, 20 nt, Human
cuaucaauagucaagaaaaa

SEQ ID NO: 2556699 - RNA, 16 nt, Human
cuaucaauagucaaga

SEQ ID NO: 2556700 - RNA, 14 nt, Human
cuaucaauagucaa

SEQ ID NO: 2556701 - RNA, 23 nt, Human
cuaucaagugugcuuuagcuuga

SEQ ID NO: 2556702 - RNA, 20 nt, Human
cuaucuguuuacaguguucc

SEQ ID NO: 2556703 - RNA, 17 nt, Human
cuaucuguuuacagugu

SEQ ID NO: 2556704 - RNA, 13 nt, Human
cuaucuuaauuuu

SEQ ID NO: 2556705 - RNA, 21 nt, Human
cuaucuguuuacaguguuccg

SEQ ID NO: 2556706 - RNA, 22 nt, Human
cuauauuuuuuguuaaaugauu

SEQ ID NO: 2556707 - RNA, 13 nt, Human
cuaucaaacugaa

SEQ ID NO: 2556708 - RNA, 20 nt, Human
cuaucaaguauuauaccuuu

SEQ ID NO: 2556709 - RNA, 16 nt, Human
cuaucaaacugaagcc

SEQ ID NO: 2556710 - RNA, 20 nt, Human
cuaucaaacugaagccagaa

SEQ ID NO: 2556711 - RNA, 21 nt, Human
cuaucaaagaccuugugugua

SEQ ID NO: 2556712 - RNA, 21 nt, Human
cuaucaaacugaagccagaaa

SEQ ID NO: 2556713 - RNA, 18 nt, Human
cuaugaaauauuauguua

SEQ ID NO: 2556714 - RNA, 22 nt, Human
cuaugaaugggcaaaacugaau

SEQ ID NO: 2556715 - RNA, 21 nt, Human
cuaucuuugccacccucaugc

SEQ ID NO: 2556716 - RNA, 23 nt, Human
cuaugaaugggcaaaacugaauu

SEQ ID NO: 2556717 - RNA, 14 nt, Human
cuaugaaugggcaa

SEQ ID NO: 2556718 - RNA, 17 nt, Human
cuaugaauucuaaguga

SEQ ID NO: 2556719 - RNA, 14 nt, Human
cuaugacacaugca

SEQ ID NO: 2556720 - RNA, 14 nt, Human
cuaucuuugccacc

SEQ ID NO: 2556721 - RNA, 15 nt, Human
cuaucuuugccaccc

SEQ ID NO: 2556722 - RNA, 18 nt, Human
cuaucuuugccacccuca

SEQ ID NO: 2556723 - RNA, 19 nt, Human
cuaucuuugccacccucau

SEQ ID NO: 2556724 - RNA, 13 nt, Human
cuaugaaauauua

SEQ ID NO: 2556725 - RNA, 23 nt, Human
cuaucuuaauuuugguuguauuc

SEQ ID NO: 2556726 - RNA, 22 nt, Human
cuaucuuaauuuugguuguauu

SEQ ID NO: 2556727 - RNA, 15 nt, Human
cuaucuuaauuuugg

SEQ ID NO: 2556728 - RNA, 14 nt, Human
cuaucuuaauuuug

SEQ ID NO: 2556729 - RNA, 21 nt, Human
cuaucuuagugguuccccacc

SEQ ID NO: 2556730 - RNA, 12 nt, Human
cuaucuuugcca

SEQ ID NO: 2556731 - RNA, 18 nt, Human
cuaucuugcucuguaauc

SEQ ID NO: 2556732 - RNA, 17 nt, Human
cuaucuugcucuguaau

SEQ ID NO: 2556733 - RNA, 21 nt, Human
cuaucuuauauaguuuacuau

SEQ ID NO: 2556734 - RNA, 21 nt, Human
cuaguauuucaugcugggaau

SEQ ID NO: 2556735 - RNA, 20 nt, Human
cuagucccuuccccucccug

SEQ ID NO: 2556736 - RNA, 21 nt, Human
cuagucccuuccccucccugg

SEQ ID NO: 2556737 - RNA, 15 nt, Human
cuaguccuuuacuaa

SEQ ID NO: 2556738 - RNA, 23 nt, Human
cuagucccuuccccucccuggcu

SEQ ID NO: 2556739 - RNA, 14 nt, Human
cuagucucucuggg

SEQ ID NO: 2556740 - RNA, 13 nt, Human
cuagucucucugg

SEQ ID NO: 2556741 - RNA, 22 nt, Human
cuagucucuaucauuaaaguuc

SEQ ID NO: 2556742 - RNA, 21 nt, Human
cuagucucuaucauuaaaguu

SEQ ID NO: 2556743 - RNA, 20 nt, Human
cuagucucuaucauuaaagu

SEQ ID NO: 2556744 - RNA, 23 nt, Human
cuagucuccuuugcacugagggc

SEQ ID NO: 2556745 - RNA, 21 nt, Human
cuagucuccuuugcacugagg

SEQ ID NO: 2556746 - RNA, 20 nt, Human
cuagucuccuuugcacugag

SEQ ID NO: 2556747 - RNA, 19 nt, Human
cuagucuccuuugcacuga

SEQ ID NO: 2556748 - RNA, 15 nt, Human
cuagucuccuuugca

SEQ ID NO: 2556749 - RNA, 21 nt, Human
cuagucguggagaugucuucg

SEQ ID NO: 2556750 - RNA, 20 nt, Human
cuagucguggagaugucuuc

SEQ ID NO: 2556751 - RNA, 18 nt, Human
cuaguccuauucuauugc

SEQ ID NO: 2556752 - RNA, 22 nt, Human
cuagucccuuccccucccuggc

SEQ ID NO: 2556753 - RNA, 14 nt, Human
cuagugcagcugau

SEQ ID NO: 2556754 - RNA, 15 nt, Human
cuagugcagcugauu

SEQ ID NO: 2556755 - RNA, 19 nt, Human
cuagugcagcugauuuuaa

SEQ ID NO: 2556756 - RNA, 16 nt, Human
cuagucucucuggggc

SEQ ID NO: 2556757 - RNA, 13 nt, Human
cuagucuuaagaa

SEQ ID NO: 2556758 - RNA, 17 nt, Human
cuagugccuucuaaagg

SEQ ID NO: 2556759 - RNA, 23 nt, Human
cuagugcccuccacagccgcagc

SEQ ID NO: 2556760 - RNA, 20 nt, Human
cuagugcagcugauuuuaac

SEQ ID NO: 2556761 - RNA, 21 nt, Human
cuagugcagcugauuuuaaca

SEQ ID NO: 2556762 - RNA, 22 nt, Human
cuagugcagcugauuuuaacaa

SEQ ID NO: 2556763 - RNA, 23 nt, Human
cuagugcagcugauuuuaacaau

SEQ ID NO: 2556764 - RNA, 18 nt, Human
cuagugcccuccacagcc

SEQ ID NO: 2556765 - RNA, 19 nt, Human
cuagugcccuccacagccg

SEQ ID NO: 2556766 - RNA, 19 nt, Human
cuagugugguguuuccugg

SEQ ID NO: 2556767 - RNA, 20 nt, Human
cuaguggucuuuguaagagu

SEQ ID NO: 2556768 - RNA, 19 nt, Human
cuaguggucuuuguaagag

SEQ ID NO: 2556769 - RNA, 18 nt, Human
cuaguggucuuuguaaga

SEQ ID NO: 2556770 - RNA, 17 nt, Human
cuaguggucuuuguaag

SEQ ID NO: 2556771 - RNA, 16 nt, Human
cuaguggucuuuguaa

SEQ ID NO: 2556772 - RNA, 15 nt, Human
cuaguggucuuugua

SEQ ID NO: 2556773 - RNA, 14 nt, Human
cuaguggucuuugu

SEQ ID NO: 2556774 - RNA, 23 nt, Human
cuaguggggucucccucuccugc

SEQ ID NO: 2556775 - RNA, 12 nt, Human
cuagugcugcug

SEQ ID NO: 2556776 - RNA, 22 nt, Human
cuagugugguguuuccuggcac

SEQ ID NO: 2556777 - RNA, 21 nt, Human
cuagugugguguuuccuggca

SEQ ID NO: 2556778 - RNA, 23 nt, Human
cuagugugguguuuccuggcacu

SEQ ID NO: 2556779 - RNA, 22 nt, Human
cuaguggucuuuguaagagugu

SEQ ID NO: 2556780 - RNA, 14 nt, Human
cuaguguugcuugg

SEQ ID NO: 2556781 - RNA, 20 nt, Human
cuaguauuucuaugaaauau

SEQ ID NO: 2556782 - RNA, 19 nt, Human
cuaguauuucuaugaaaua

SEQ ID NO: 2556783 - RNA, 22 nt, Human
cuaguauuucuaugaaauauua

SEQ ID NO: 2556784 - RNA, 15 nt, Human
cuaguaucaaaagaa

SEQ ID NO: 2556785 - RNA, 17 nt, Human
cuaguaucaaaagaaag

SEQ ID NO: 2556786 - RNA, 17 nt, Human
cuaguaguuccugcuac

SEQ ID NO: 2556787 - RNA, 23 nt, Human
cuaguauuccagaccugaagaau

SEQ ID NO: 2556788 - RNA, 23 nt, Human
cuaguaucaaaagaaagaaaauc

SEQ ID NO: 2556789 - RNA, 21 nt, Human
cuaggcauuugcugaauacag

SEQ ID NO: 2556790 - RNA, 19 nt, Human
cuaggcaucccaggggacc

SEQ ID NO: 2556791 - RNA, 15 nt, Human
cuaggcaucccaggg

SEQ ID NO: 2556792 - RNA, 18 nt, Human
cuaggcaucccaggggac

SEQ ID NO: 2556793 - RNA, 14 nt, Human
cuaggcaucccagg

SEQ ID NO: 2556794 - RNA, 16 nt, Human
cuaggcaggaccugug

SEQ ID NO: 2556795 - RNA, 15 nt, Human
cuaggcaggaccugu

SEQ ID NO: 2556796 - RNA, 19 nt, Human
cuaggccacaccaucuccu

SEQ ID NO: 2556797 - RNA, 14 nt, Human
cuaggccacuccuc

SEQ ID NO: 2556798 - RNA, 15 nt, Human
cuaggccacuccucc

SEQ ID NO: 2556799 - RNA, 19 nt, Human
cuaggccacuccuccaaag

SEQ ID NO: 2556800 - RNA, 16 nt, Human
cuaggccacuccucca

SEQ ID NO: 2556801 - RNA, 17 nt, Human
cuaggccacuccuccaa

SEQ ID NO: 2556802 - RNA, 22 nt, Human
cuaguacuugggagaccuguaa

SEQ ID NO: 2556803 - RNA, 16 nt, Human
cuaggcccccacuugc

SEQ ID NO: 2556804 - RNA, 15 nt, Human
cuaggcccccacuug

SEQ ID NO: 2556805 - RNA, 13 nt, Human
cuaggcccccacu

SEQ ID NO: 2556806 - RNA, 15 nt, Human
cuaggaacacuccuu

SEQ ID NO: 2556807 - RNA, 13 nt, Human
cuaggaacacucc

SEQ ID NO: 2556808 - RNA, 22 nt, Human
cuagcagcaccguucugugcac

SEQ ID NO: 2556809 - RNA, 11 nt, Human
cuagcagagag

SEQ ID NO: 2556810 - RNA, 21 nt, Human
cuaggaagacuuuggaaagag

SEQ ID NO: 2556811 - RNA, 20 nt, Human
cuagcagcaccguucugugc

SEQ ID NO: 2556812 - RNA, 21 nt, Human
cuagcagcaccguucugugca

SEQ ID NO: 2556813 - RNA, 16 nt, Human
cuaggaaauccagggu

SEQ ID NO: 2556814 - RNA, 17 nt, Human
cuaggaaauccagggug

SEQ ID NO: 2556815 - RNA, 16 nt, Human
cuagcacuggccugca

SEQ ID NO: 2556816 - RNA, 15 nt, Human
cuagcacuggccugc

SEQ ID NO: 2556817 - RNA, 16 nt, Human
cuagcacuuggagcca

SEQ ID NO: 2556818 - RNA, 17 nt, Human
cuagcagaaaucuagaa

SEQ ID NO: 2556819 - RNA, 12 nt, Human
cuagcagcaccg

SEQ ID NO: 2556820 - RNA, 19 nt, Human
cuagcagcaccguucugug

SEQ ID NO: 2556821 - RNA, 19 nt, Human
cuagcagagcaggggcagg

SEQ ID NO: 2556822 - RNA, 23 nt, Human
cuagcagagcaggggcaggguga

SEQ ID NO: 2556823 - RNA, 22 nt, Human
cuaggaccccuccaugugggcu

SEQ ID NO: 2556824 - RNA, 16 nt, Human
cuaggaaugaaauccu

SEQ ID NO: 2556825 - RNA, 17 nt, Human
cuaggaaugaaauccug

SEQ ID NO: 2556826 - RNA, 15 nt, Human
cuaggaauucccagc

SEQ ID NO: 2556827 - RNA, 15 nt, Human
cuaggacucugaggc

SEQ ID NO: 2556828 - RNA, 16 nt, Human
cuaggacucugaggcu

SEQ ID NO: 2556829 - RNA, 22 nt, Human
cuaggacgccacccagcaaaag

SEQ ID NO: 2556830 - RNA, 12 nt, Human
cuaggacucuga

SEQ ID NO: 2556831 - RNA, 14 nt, Human
cuaggacucugagg

SEQ ID NO: 2556832 - RNA, 23 nt, Human
cuaggagaaggaggggaaccaga

SEQ ID NO: 2556833 - RNA, 18 nt, Human
cuaggacgccacccagca

SEQ ID NO: 2556834 - RNA, 23 nt, Human
cuaggagaaccaaaucuggaagc

SEQ ID NO: 2556835 - RNA, 16 nt, Human
cuaggagaccaaggcg

SEQ ID NO: 2556836 - RNA, 20 nt, Human
cuaggagaccaaggcgggag

SEQ ID NO: 2556837 - RNA, 21 nt, Human
cuaggagaaccaaaucuggaa

SEQ ID NO: 2556838 - RNA, 18 nt, Human
cuaggagaaccaaaucug

SEQ ID NO: 2556839 - RNA, 22 nt, Human
cuaggacucugaggcucuuucu

SEQ ID NO: 2556840 - RNA, 22 nt, Human
cuaggagggagacacuggcccc

SEQ ID NO: 2556841 - RNA, 18 nt, Human
cuaggagggagacacugg

SEQ ID NO: 2556842 - RNA, 13 nt, Human
cuaggagggagac

SEQ ID NO: 2556843 - RNA, 17 nt, Human
cuaggaggucucuaaga

SEQ ID NO: 2556844 - RNA, 23 nt, Human
cuaggagauaucugagggaggag

SEQ ID NO: 2556845 - RNA, 21 nt, Human
cuaggagauaucugagggagg

SEQ ID NO: 2556846 - RNA, 19 nt, Human
cuaggagauaucugaggga

SEQ ID NO: 2556847 - RNA, 18 nt, Human
cuaggagauaucugaggg

SEQ ID NO: 2556848 - RNA, 13 nt, Human
cuaggagcacugu

SEQ ID NO: 2556849 - RNA, 15 nt, Human
cuaggagcugggagg

SEQ ID NO: 2556850 - RNA, 16 nt, Human
cuaggagcugggagga

SEQ ID NO: 2556851 - RNA, 19 nt, Human
cuaggagcugggaggaaaa

SEQ ID NO: 2556852 - RNA, 13 nt, Human
cuaggauuucaug

SEQ ID NO: 2556853 - RNA, 22 nt, Human
cuaggcaggacaugcugaagcc

SEQ ID NO: 2556854 - RNA, 13 nt, Human
cuaggcaggacau

SEQ ID NO: 2556855 - RNA, 23 nt, Human
cuaggagggagacacuggccccu

SEQ ID NO: 2556856 - RNA, 17 nt, Human
cuaggauaucuucucca

SEQ ID NO: 2556857 - RNA, 15 nt, Human
cuaggauaucuucuc

SEQ ID NO: 2556858 - RNA, 11 nt, Human
cuaugcauuug

SEQ ID NO: 2556859 - RNA, 12 nt, Human
cuaugcauuuga

SEQ ID NO: 2556860 - RNA, 16 nt, Human
cuaugagaaaagaggc

SEQ ID NO: 2556861 - RNA, 11 nt, Human
cuaugagaaaa

SEQ ID NO: 2556862 - RNA, 17 nt, Human
cuaugacugcuccccag

SEQ ID NO: 2556863 - RNA, 16 nt, Human
cuaugacugcucccca

SEQ ID NO: 2556864 - RNA, 15 nt, Human
cuaugacugcucccc

SEQ ID NO: 2556865 - RNA, 13 nt, Human
cucacaguuccuc

SEQ ID NO: 2556866 - RNA, 16 nt, Human
cucacaguuccucgcc

SEQ ID NO: 2556867 - RNA, 17 nt, Human
cucacaguuccucgccc

SEQ ID NO: 2556868 - RNA, 18 nt, Human
cucacaguuccucgcccu

SEQ ID NO: 2556869 - RNA, 19 nt, Human
cucacaguuccucgcccug

SEQ ID NO: 2556870 - RNA, 20 nt, Human
cucacaguuccucgcccugg

SEQ ID NO: 2556871 - RNA, 22 nt, Human
cucacagugggagccagggcug

SEQ ID NO: 2556872 - RNA, 19 nt, Human
cucacagugggagccaggg

SEQ ID NO: 2556873 - RNA, 17 nt, Human
cucacaguguugcccag

SEQ ID NO: 2556874 - RNA, 21 nt, Human
cucacaguguugcccaggcug

SEQ ID NO: 2556875 - RNA, 23 nt, Human
cucacaguccuuaccagcagagc

SEQ ID NO: 2556876 - RNA, 18 nt, Human
cucaaggccucccacagu

SEQ ID NO: 2556877 - RNA, 19 nt, Human
cucacagucucuuuaaucu

SEQ ID NO: 2556878 - RNA, 18 nt, Human
cucacagugggagccagg

SEQ ID NO: 2556879 - RNA, 20 nt, Human
cucacagucucuuuaaucuu

SEQ ID NO: 2556880 - RNA, 20 nt, Human
cucaagugauucuccugccu

SEQ ID NO: 2556881 - RNA, 19 nt, Human
cucaagugauucuccugcc

SEQ ID NO: 2556882 - RNA, 18 nt, Human
cucaagugauucuccugc

SEQ ID NO: 2556883 - RNA, 22 nt, Human
cucaaggacuuugcagccggca

SEQ ID NO: 2556884 - RNA, 16 nt, Human
cucaaggacuuugcag

SEQ ID NO: 2556885 - RNA, 17 nt, Human
cucaaggccucccacag

SEQ ID NO: 2556886 - RNA, 16 nt, Human
cucaaggccucccaca

SEQ ID NO: 2556887 - RNA, 15 nt, Human
cucaaggccucccac

SEQ ID NO: 2556888 - RNA, 20 nt, Human
cucaaggacuugaaagcauc

SEQ ID NO: 2556889 - RNA, 13 nt, Human
cucacauuuauau

SEQ ID NO: 2556890 - RNA, 19 nt, Human
cucaccagccccagugccc

SEQ ID NO: 2556891 - RNA, 21 nt, Human
cucacauggugcuacgccugc

SEQ ID NO: 2556892 - RNA, 23 nt, Human
cucacaguuccucgcccuggguc

SEQ ID NO: 2556893 - RNA, 20 nt, Human
cucacaucuuucacacuucc

SEQ ID NO: 2556894 - RNA, 21 nt, Human
cucacaguuccucgcccuggg

SEQ ID NO: 2556895 - RNA, 22 nt, Human
cucacaguuccucgcccugggu

SEQ ID NO: 2556896 - RNA, 20 nt, Human
cucacauagcuuacaagcca

SEQ ID NO: 2556897 - RNA, 21 nt, Human
cucaccagccccagugcccac

SEQ ID NO: 2556898 - RNA, 20 nt, Human
cucaccagccccagugccca

SEQ ID NO: 2556899 - RNA, 22 nt, Human
cucacaugucaguaccuucaaa

SEQ ID NO: 2556900 - RNA, 23 nt, Human
cucacauggugcuacgccugcau

SEQ ID NO: 2556901 - RNA, 23 nt, Human
cucacuaggcccccacuugccuc

SEQ ID NO: 2556902 - RNA, 17 nt, Human
cucacuauaccaguaua

SEQ ID NO: 2556903 - RNA, 20 nt, Human
cucacuaggcuucugguuga

SEQ ID NO: 2556904 - RNA, 20 nt, Human
cucacuaucccggcugcccu

SEQ ID NO: 2556905 - RNA, 21 nt, Human
cucacuaucccggcugcccuu

SEQ ID NO: 2556906 - RNA, 17 nt, Human
cucacuauguugcccag

SEQ ID NO: 2556907 - RNA, 16 nt, Human
cucacuauguugccca

SEQ ID NO: 2556908 - RNA, 17 nt, Human
cucaccccuugccauaa

SEQ ID NO: 2556909 - RNA, 13 nt, Human
cucacuaggcuuc

SEQ ID NO: 2556910 - RNA, 16 nt, Human
cucacuaggcuucugg

SEQ ID NO: 2556911 - RNA, 23 nt, Human
cucaccccugguucucaucuuuc

SEQ ID NO: 2556912 - RNA, 21 nt, Human
cucaccccugguucucaucuu

SEQ ID NO: 2556913 - RNA, 20 nt, Human
cucaccccugguucucaucu

SEQ ID NO: 2556914 - RNA, 19 nt, Human
cucaccccugguucucauc

SEQ ID NO: 2556915 - RNA, 22 nt, Human
cucaccccuguccucacugcuc

SEQ ID NO: 2556916 - RNA, 21 nt, Human
cucaccccuguccucacugcu

SEQ ID NO: 2556917 - RNA, 20 nt, Human
cucaccccuguccucacugc

SEQ ID NO: 2556918 - RNA, 19 nt, Human
cucaccccuguccucacug

SEQ ID NO: 2556919 - RNA, 18 nt, Human
cucaccccuguccucacu

SEQ ID NO: 2556920 - RNA, 15 nt, Human
cucaccccuguccuc

SEQ ID NO: 2556921 - RNA, 13 nt, Human
cucaccccugucc

SEQ ID NO: 2556922 - RNA, 18 nt, Human
cucaccccugcccuggga

SEQ ID NO: 2556923 - RNA, 15 nt, Human
cucacccccuucucc

SEQ ID NO: 2556924 - RNA, 14 nt, Human
cucacccccucggg

SEQ ID NO: 2556925 - RNA, 13 nt, Human
cucacccccucgg

SEQ ID NO: 2556926 - RNA, 16 nt, Human
cucacccccuucucca

SEQ ID NO: 2556927 - RNA, 17 nt, Human
cucacccccuucuccau

SEQ ID NO: 2556928 - RNA, 19 nt, Human
cucacccccuucuccaucc

SEQ ID NO: 2556929 - RNA, 20 nt, Human
cucacccccuucuccaucca

SEQ ID NO: 2556930 - RNA, 17 nt, Human
cucaccccugguucuca

SEQ ID NO: 2556931 - RNA, 14 nt, Human
cucaccccugguuc

SEQ ID NO: 2556932 - RNA, 15 nt, Human
cucaccccgucuggg

SEQ ID NO: 2556933 - RNA, 15 nt, Human
cucaccccugcccug

SEQ ID NO: 2556934 - RNA, 16 nt, Human
cucaccccugcccugg

SEQ ID NO: 2556935 - RNA, 17 nt, Human
cucaccccugcccuggg

SEQ ID NO: 2556936 - RNA, 21 nt, Human
cucacccccuucuccauccac

SEQ ID NO: 2556937 - RNA, 13 nt, Human
cucaccccggcag

SEQ ID NO: 2556938 - RNA, 21 nt, Human
cucacccccucgggucuccuc

SEQ ID NO: 2556939 - RNA, 16 nt, Human
cucaccccgucugggg

SEQ ID NO: 2556940 - RNA, 13 nt, Human
cucaccccagccc

SEQ ID NO: 2556941 - RNA, 12 nt, Human
cucaccccagcc

SEQ ID NO: 2556942 - RNA, 14 nt, Human
cucaccccagcccc

SEQ ID NO: 2556943 - RNA, 16 nt, Human
cucacccaugugccaa

SEQ ID NO: 2556944 - RNA, 20 nt, Human
cucaccccccacacucacuc

SEQ ID NO: 2556945 - RNA, 19 nt, Human
cucaccccccacacucacu

SEQ ID NO: 2556946 - RNA, 16 nt, Human
cucaccccccacacuc

SEQ ID NO: 2556947 - RNA, 14 nt, Human
cuaugcauuugaaa

SEQ ID NO: 2556948 - RNA, 23 nt, Human
cuauuugccaugggcuucacugu

SEQ ID NO: 2556949 - RNA, 22 nt, Human
cuauuugccaugggcuucacug

SEQ ID NO: 2556950 - RNA, 16 nt, Human
cuauuuggaauuuaua

SEQ ID NO: 2556951 - RNA, 12 nt, Human
cuauuuggaauu

SEQ ID NO: 2556952 - RNA, 18 nt, Human
cuauuuuaauaaacacuc

SEQ ID NO: 2556953 - RNA, 16 nt, Human
cuauuuguuuucaugg

SEQ ID NO: 2556954 - RNA, 22 nt, Human
cuauuuguugaugcuuguguca

SEQ ID NO: 2556955 - RNA, 17 nt, Human
cuauuugucuuucagga

SEQ ID NO: 2556956 - RNA, 22 nt, Human
cuauuuuaauaaacacucuuga

SEQ ID NO: 2556957 - RNA, 12 nt, Human
cuauuuuauucc

SEQ ID NO: 2556958 - RNA, 23 nt, Human
cuauuuguuuucuucuguauguu

SEQ ID NO: 2556959 - RNA, 18 nt, Human
cuauuuugaaaaauuccu

SEQ ID NO: 2556960 - RNA, 16 nt, Human
cuauuuucauuuucug

SEQ ID NO: 2556961 - RNA, 18 nt, Human
cuauuuucauuguaaaac

SEQ ID NO: 2556962 - RNA, 16 nt, Human
cucaaauggggccaga

SEQ ID NO: 2556963 - RNA, 17 nt, Human
cucaaauggggccagau

SEQ ID NO: 2556964 - RNA, 15 nt, Human
cucaaauggggccag

SEQ ID NO: 2556965 - RNA, 22 nt, Human
cucaaaugcucagaccagcucu

SEQ ID NO: 2556966 - RNA, 12 nt, Human
cuauuuuguaaa

SEQ ID NO: 2556967 - RNA, 17 nt, Human
cuauuuuggauuguaua

SEQ ID NO: 2556968 - RNA, 16 nt, Human
cucaaauuaaucuuuc

SEQ ID NO: 2556969 - RNA, 19 nt, Human
cucaaauggggccagaucc

SEQ ID NO: 2556970 - RNA, 20 nt, Human
cucaaauggggccagaucca

SEQ ID NO: 2556971 - RNA, 21 nt, Human
cucaaauggggccagauccag

SEQ ID NO: 2556972 - RNA, 13 nt, Human
cucaaccucuucu

SEQ ID NO: 2556973 - RNA, 14 nt, Human
cucaaccucuucug

SEQ ID NO: 2556974 - RNA, 18 nt, Human
cucaaccucuucuggcuc

SEQ ID NO: 2556975 - RNA, 20 nt, Human
cucaaccucuucuggcucaa

SEQ ID NO: 2556976 - RNA, 12 nt, Human
cucaaccucuuc

SEQ ID NO: 2556977 - RNA, 23 nt, Human
cucaaauuaaucuuucuuuaccu

SEQ ID NO: 2556978 - RNA, 21 nt, Human
cucaacucuccuccagaguca

SEQ ID NO: 2556979 - RNA, 20 nt, Human
cucaacucuccuccagaguc

SEQ ID NO: 2556980 - RNA, 15 nt, Human
cucaacguauuguuu

SEQ ID NO: 2556981 - RNA, 16 nt, Human
cucaacguauuguuuc

SEQ ID NO: 2556982 - RNA, 17 nt, Human
cucaacguuacauuuuu

SEQ ID NO: 2556983 - RNA, 18 nt, Human
cucaacguugcuccccau

SEQ ID NO: 2556984 - RNA, 21 nt, Human
cucaaccucuucuggcucaaa

SEQ ID NO: 2556985 - RNA, 21 nt, Human
cucaaccugugaugaggggag

SEQ ID NO: 2556986 - RNA, 13 nt, Human
cucaaccugugau

SEQ ID NO: 2556987 - RNA, 16 nt, Human
cucaagcgauucuccu

SEQ ID NO: 2556988 - RNA, 17 nt, Human
cucaagcgauucuccug

SEQ ID NO: 2556989 - RNA, 22 nt, Human
cucaagcccugcagucacagcu

SEQ ID NO: 2556990 - RNA, 18 nt, Human
cucaagaucaaugaaaug

SEQ ID NO: 2556991 - RNA, 17 nt, Human
cucaagaucaaugaaau

SEQ ID NO: 2556992 - RNA, 21 nt, Human
cucaagauacugcuacuguaa

SEQ ID NO: 2556993 - RNA, 22 nt, Human
cucaagauacugcuacuguaau

SEQ ID NO: 2556994 - RNA, 17 nt, Human
cucaagauacugcuacu

SEQ ID NO: 2556995 - RNA, 17 nt, Human
cucaagaggcugaggca

SEQ ID NO: 2556996 - RNA, 17 nt, Human
cucaagcugcaucuaga

SEQ ID NO: 2556997 - RNA, 23 nt, Human
cucaaggaauaaugggcuuagag

SEQ ID NO: 2556998 - RNA, 17 nt, Human
cucaaggaaaggccuga

SEQ ID NO: 2556999 - RNA, 10 nt, Human
cucaaggacu

SEQ ID NO: 2557000 - RNA, 14 nt, Human
cucaaggaaagggg

SEQ ID NO: 2557001 - RNA, 15 nt, Human
cucaaggacuugaaa

SEQ ID NO: 2557002 - RNA, 18 nt, Human
cucaaggacuugaaagca

SEQ ID NO: 2557003 - RNA, 19 nt, Human
cucaaggacuugaaagcau

SEQ ID NO: 2557004 - RNA, 17 nt, Human
cucaagagggcacuggu

SEQ ID NO: 2557005 - RNA, 14 nt, Human
cucaagaggcugag

SEQ ID NO: 2557006 - RNA, 16 nt, Human
cucaagaggcugaggc

SEQ ID NO: 2557007 - RNA, 21 nt, Human
cucaagagggcacugguggcc

SEQ ID NO: 2557008 - RNA, 19 nt, Human
cucaagagggcacuggugg

SEQ ID NO: 2557009 - RNA, 13 nt, Human
cucaacugccuac

SEQ ID NO: 2557010 - RNA, 15 nt, Human
cucaacugccuacuc

SEQ ID NO: 2557011 - RNA, 23 nt, Human
cucaacugccuacuccaaaaugu

SEQ ID NO: 2557012 - RNA, 19 nt, Human
cucaacucuccuccagagu

SEQ ID NO: 2557013 - RNA, 13 nt, Human
cgugccaggcccg

SEQ ID NO: 2557014 - RNA, 23 nt, Human
cgugccuuuugcaccccucccau

SEQ ID NO: 2557015 - RNA, 17 nt, Human
cgugccagucgcgcugc

SEQ ID NO: 2557016 - RNA, 19 nt, Human
cgugccaggcccggggcug

SEQ ID NO: 2557017 - RNA, 23 nt, Human
cgugcuacccccaugcuggaggu

SEQ ID NO: 2557018 - RNA, 20 nt, Human
cgugccagucgcgcugccug

SEQ ID NO: 2557019 - RNA, 21 nt, Human
cgugccuuuugcaccccuccc

SEQ ID NO: 2557020 - RNA, 19 nt, Human
cgugcucgccccagcaggu

SEQ ID NO: 2557021 - RNA, 18 nt, Human
cgugcuccagccuggcuc

SEQ ID NO: 2557022 - RNA, 17 nt, Human
cgugcuccagccuggcu

SEQ ID NO: 2557023 - RNA, 16 nt, Human
cgugcuccagccuggc

SEQ ID NO: 2557024 - RNA, 14 nt, Human
cgugcuaaauuuuc

SEQ ID NO: 2557025 - RNA, 15 nt, Human
cgugcugacagcugc

SEQ ID NO: 2557026 - RNA, 17 nt, Human
cgugcugacagcugcuc

SEQ ID NO: 2557027 - RNA, 16 nt, Human
cgugcugacagcugcu

SEQ ID NO: 2557028 - RNA, 20 nt, Human
cgugcuuagccuccugaccu

SEQ ID NO: 2557029 - RNA, 18 nt, Human
cgugcuuagccuccugac

SEQ ID NO: 2557030 - RNA, 14 nt, Human
cgugcuuccucagu

SEQ ID NO: 2557031 - RNA, 22 nt, Human
cgugcuuguuugcucaccuggg

SEQ ID NO: 2557032 - RNA, 15 nt, Human
cguggaacguuuuuc

SEQ ID NO: 2557033 - RNA, 22 nt, Human
cguggacuccagacucucugug

SEQ ID NO: 2557034 - RNA, 22 nt, Human
cguggacuuggggucagagacu

SEQ ID NO: 2557035 - RNA, 17 nt, Human
cguggagagcuggugcc

SEQ ID NO: 2557036 - RNA, 12 nt, Human
cguggagaggga

SEQ ID NO: 2557037 - RNA, 20 nt, Human
cguggagagcuggugcccgg

SEQ ID NO: 2557038 - RNA, 16 nt, Human
cguggagaugucuucg

SEQ ID NO: 2557039 - RNA, 15 nt, Human
cguggagaugucuuc

SEQ ID NO: 2557040 - RNA, 13 nt, Human
cguggagagggau

SEQ ID NO: 2557041 - RNA, 21 nt, Human
cguggagagggaugaggugcu

SEQ ID NO: 2557042 - RNA, 18 nt, Human
cguggagcagaaucagua

SEQ ID NO: 2557043 - RNA, 17 nt, Human
cguggagcagaaucagu

SEQ ID NO: 2557044 - RNA, 15 nt, Human
cguggagcugccuga

SEQ ID NO: 2557045 - RNA, 14 nt, Human
cguggagcugccug

SEQ ID NO: 2557046 - RNA, 18 nt, Human
cguggaggaaugcucccc

SEQ ID NO: 2557047 - RNA, 17 nt, Human
cguggaggaggaaggca

SEQ ID NO: 2557048 - RNA, 16 nt, Human
cguggaggagcagugc

SEQ ID NO: 2557049 - RNA, 22 nt, Human
cguggaggaaugcucccccauc

SEQ ID NO: 2557050 - RNA, 16 nt, Human
cguggacaggugugcc

SEQ ID NO: 2557051 - RNA, 20 nt, Human
cguggacuccagacucucug

SEQ ID NO: 2557052 - RNA, 17 nt, Human
cguggaccuuccugcca

SEQ ID NO: 2557053 - RNA, 15 nt, Human
cguggaccuuccugc

SEQ ID NO: 2557054 - RNA, 14 nt, Human
cguggaccuuccug

SEQ ID NO: 2557055 - RNA, 16 nt, Human
cguggacucugcacau

SEQ ID NO: 2557056 - RNA, 13 nt, Human
cguggacucugca

SEQ ID NO: 2557057 - RNA, 15 nt, Human
cguggaaagggugcu

SEQ ID NO: 2557058 - RNA, 21 nt, Human
cguggaaagggugcugcuucc

SEQ ID NO: 2557059 - RNA, 20 nt, Human
cguggaacguuuuuccuguu

SEQ ID NO: 2557060 - RNA, 22 nt, Human
cguggaggagcagugcaggcac

SEQ ID NO: 2557061 - RNA, 17 nt, Human
cguggauugcacguggc

SEQ ID NO: 2557062 - RNA, 20 nt, Human
cguggcagauaaucagccuc

SEQ ID NO: 2557063 - RNA, 21 nt, Human
cguggcagauaaucagccucu

SEQ ID NO: 2557064 - RNA, 22 nt, Human
cguggcagauaaucagccucuu

SEQ ID NO: 2557065 - RNA, 21 nt, Human
cguggcauguggccuguggcc

SEQ ID NO: 2557066 - RNA, 20 nt, Human
cguggcauguggccuguggc

SEQ ID NO: 2557067 - RNA, 19 nt, Human
cguggcauguggccugugg

SEQ ID NO: 2557068 - RNA, 16 nt, Human
cguggcauguggccug

SEQ ID NO: 2557069 - RNA, 23 nt, Human
cguggcauagcccagacacagaa

SEQ ID NO: 2557070 - RNA, 16 nt, Human
cguggcauagcccaga

SEQ ID NO: 2557071 - RNA, 13 nt, Human
cguggcaucaccu

SEQ ID NO: 2557072 - RNA, 21 nt, Human
cguggccccagccuggcccag

SEQ ID NO: 2557073 - RNA, 20 nt, Human
cguggccccagccuggccca

SEQ ID NO: 2557074 - RNA, 19 nt, Human
cguggccccagccuggccc

SEQ ID NO: 2557075 - RNA, 18 nt, Human
cguggccccagccuggcc

SEQ ID NO: 2557076 - RNA, 19 nt, Human
cguggcuucccgcucagcc

SEQ ID NO: 2557077 - RNA, 18 nt, Human
cguggcuucccgcucagc

SEQ ID NO: 2557078 - RNA, 17 nt, Human
cguggccccagccuggc

SEQ ID NO: 2557079 - RNA, 16 nt, Human
cguggccccagccugg

SEQ ID NO: 2557080 - RNA, 15 nt, Human
cguggccccagccug

SEQ ID NO: 2557081 - RNA, 14 nt, Human
cguggccccagccu

SEQ ID NO: 2557082 - RNA, 13 nt, Human
cguggccccagcc

SEQ ID NO: 2557083 - RNA, 12 nt, Human
cguggccccagc

SEQ ID NO: 2557084 - RNA, 16 nt, Human
cguggcccagagaagc

SEQ ID NO: 2557085 - RNA, 19 nt, Human
cguggccagcccggcuggu

SEQ ID NO: 2557086 - RNA, 13 nt, Human
cguggccagcccg

SEQ ID NO: 2557087 - RNA, 11 nt, Human
cguggccagcc

SEQ ID NO: 2557088 - RNA, 15 nt, Human
cguggccagcccggc

SEQ ID NO: 2557089 - RNA, 15 nt, Human
cguggcccagagaag

SEQ ID NO: 2557090 - RNA, 21 nt, Human
cguggcuucccgcucagcccu

SEQ ID NO: 2557091 - RNA, 20 nt, Human
cguggcuucccgcucagccc

SEQ ID NO: 2557092 - RNA, 20 nt, Human
cgugggacggugcccaagcc

SEQ ID NO: 2557093 - RNA, 19 nt, Human
cgugggacggugcccaagc

SEQ ID NO: 2557094 - RNA, 22 nt, Human
cgugggaaccccccucccaccc

SEQ ID NO: 2557095 - RNA, 17 nt, Human
cgugggagcgugggagg

SEQ ID NO: 2557096 - RNA, 17 nt, Human
cgugggagagagacgug

SEQ ID NO: 2557097 - RNA, 22 nt, Human
cgugggagacaagaaaucccug

SEQ ID NO: 2557098 - RNA, 23 nt, Human
cgugggaaccccccucccaccca

SEQ ID NO: 2557099 - RNA, 22 nt, Human
cgugggaggcgggaguggagug

SEQ ID NO: 2557100 - RNA, 13 nt, Human
cgugggcucccug

SEQ ID NO: 2557101 - RNA, 17 nt, Human
cgugggcggggccuugc

SEQ ID NO: 2557102 - RNA, 20 nt, Human
cgugggaggcgggaguggag

SEQ ID NO: 2557103 - RNA, 17 nt, Human
cgugggcggcagagagg

SEQ ID NO: 2557104 - RNA, 15 nt, Human
cguugcugugggaac

SEQ ID NO: 2557105 - RNA, 14 nt, Human
cguugcugugggaa

SEQ ID NO: 2557106 - RNA, 11 nt, Human
cguugcugugg

SEQ ID NO: 2557107 - RNA, 12 nt, Human
cguugcaugucg

SEQ ID NO: 2557108 - RNA, 18 nt, Human
cguugauguuggcuggga

SEQ ID NO: 2557109 - RNA, 17 nt, Human
cguugauguuggcuggg

SEQ ID NO: 2557110 - RNA, 19 nt, Human
cguugaggaugaggccgcu

SEQ ID NO: 2557111 - RNA, 16 nt, Human
cguugaggaugaggcc

SEQ ID NO: 2557112 - RNA, 18 nt, Human
cguugaagaggaagggca

SEQ ID NO: 2557113 - RNA, 11 nt, Human
cguggggaggu

SEQ ID NO: 2557114 - RNA, 12 nt, Human
cguggggcagca

SEQ ID NO: 2557115 - RNA, 17 nt, Human
cgugggcucccugacug

SEQ ID NO: 2557116 - RNA, 23 nt, Human
cguggggagggccguaccccacc

SEQ ID NO: 2557117 - RNA, 23 nt, Human
cguccuguccacacccagcucag

SEQ ID NO: 2557118 - RNA, 16 nt, Human
cguccugucagugccg

SEQ ID NO: 2557119 - RNA, 15 nt, Human
cguccugccuguggc

SEQ ID NO: 2557120 - RNA, 14 nt, Human
cguccugccugugg

SEQ ID NO: 2557121 - RNA, 16 nt, Human
cguccugccuguggcg

SEQ ID NO: 2557122 - RNA, 14 nt, Human
cguccugucagugc

SEQ ID NO: 2557123 - RNA, 12 nt, Human
cguccuccucug

SEQ ID NO: 2557124 - RNA, 13 nt, Human
cguccuccucugu

SEQ ID NO: 2557125 - RNA, 14 nt, Human
cguccuccucugug

SEQ ID NO: 2557126 - RNA, 15 nt, Human
cguccuccucuguga

SEQ ID NO: 2557127 - RNA, 13 nt, Human
cguccugccaccu

SEQ ID NO: 2557128 - RNA, 16 nt, Human
cguccucgagcaacug

SEQ ID NO: 2557129 - RNA, 14 nt, Human
cguccugccaccug

SEQ ID NO: 2557130 - RNA, 13 nt, Human
cguccugccugug

SEQ ID NO: 2557131 - RNA, 16 nt, Human
cguccugccaccuggg

SEQ ID NO: 2557132 - RNA, 20 nt, Human
cguccugccaccuggggcag

SEQ ID NO: 2557133 - RNA, 16 nt, Human
cgucuaccugaggggc

SEQ ID NO: 2557134 - RNA, 16 nt, Human
cgucucauacucaccu

SEQ ID NO: 2557135 - RNA, 21 nt, Human
cgucuccaggggcugcuuccu

SEQ ID NO: 2557136 - RNA, 20 nt, Human
cgucuccaggggcugcuucc

SEQ ID NO: 2557137 - RNA, 19 nt, Human
cgucuccaggggcugcuuc

SEQ ID NO: 2557138 - RNA, 14 nt, Human
cgucuccaggggcu

SEQ ID NO: 2557139 - RNA, 23 nt, Human
cgucucaaaaaaaaaaaaaugca

SEQ ID NO: 2557140 - RNA, 11 nt, Human
cgucucagugu

SEQ ID NO: 2557141 - RNA, 21 nt, Human
cgucuacucauuccccggggc

SEQ ID NO: 2557142 - RNA, 17 nt, Human
cgucucaaccccucaca

SEQ ID NO: 2557143 - RNA, 22 nt, Human
cggugcuaucucccccagcccc

SEQ ID NO: 2557144 - RNA, 21 nt, Human
cggugcuaucucccccagccc

SEQ ID NO: 2557145 - RNA, 20 nt, Human
cggugcuaucucccccagcc

SEQ ID NO: 2557146 - RNA, 18 nt, Human
cggugcuaucucccccag

SEQ ID NO: 2557147 - RNA, 22 nt, Human
cggugccuuuuuucacggaagu

SEQ ID NO: 2557148 - RNA, 23 nt, Human
cggugcccaagccagaggcuggg

SEQ ID NO: 2557149 - RNA, 19 nt, Human
cggugccuggguggggcug

SEQ ID NO: 2557150 - RNA, 20 nt, Human
cggugccuggguggggcugc

SEQ ID NO: 2557151 - RNA, 22 nt, Human
cgucugacaggcaaugcuggcu

SEQ ID NO: 2557152 - RNA, 23 nt, Human
cgucuuagaaguggaccaggaca

SEQ ID NO: 2557153 - RNA, 20 nt, Human
cgucuuagcaagaaguaaaa

SEQ ID NO: 2557154 - RNA, 15 nt, Human
cgucugacccucucc

SEQ ID NO: 2557155 - RNA, 13 nt, Human
cgucuucagccua

SEQ ID NO: 2557156 - RNA, 14 nt, Human
cgucuucagccuag

SEQ ID NO: 2557157 - RNA, 21 nt, Human
cgucugacaggcaaugcuggc

SEQ ID NO: 2557158 - RNA, 20 nt, Human
cgucugacaggcaaugcugg

SEQ ID NO: 2557159 - RNA, 19 nt, Human
cgucuugcuugggaagggg

SEQ ID NO: 2557160 - RNA, 14 nt, Human
cgucuugcuuggga

SEQ ID NO: 2557161 - RNA, 12 nt, Human
cgucuucauuaa

SEQ ID NO: 2557162 - RNA, 17 nt, Human
cgucuugcuugggaagg

SEQ ID NO: 2557163 - RNA, 23 nt, Human
cgucuucauuaagcccucuucca

SEQ ID NO: 2557164 - RNA, 19 nt, Human
cgucuucuguauacugugg

SEQ ID NO: 2557165 - RNA, 15 nt, Human
cgucuucagccuagc

SEQ ID NO: 2557166 - RNA, 10 nt, Human
cgucuuugca

SEQ ID NO: 2557167 - RNA, 15 nt, Human
cgugaaaacggagcu

SEQ ID NO: 2557168 - RNA, 16 nt, Human
cgugaaaacggagcug

SEQ ID NO: 2557169 - RNA, 17 nt, Human
cgugaaaacggagcuga

SEQ ID NO: 2557170 - RNA, 16 nt, Human
cgugcacacaccagag

SEQ ID NO: 2557171 - RNA, 19 nt, Human
cgugcacacaccagagccc

SEQ ID NO: 2557172 - RNA, 18 nt, Human
cgugcacacaccagagcc

SEQ ID NO: 2557173 - RNA, 18 nt, Human
cgugaaaacggagcugaa

SEQ ID NO: 2557174 - RNA, 17 nt, Human
cgugcacguggagagcu

SEQ ID NO: 2557175 - RNA, 20 nt, Human
cgugcacguggagagcuggu

SEQ ID NO: 2557176 - RNA, 21 nt, Human
cgugcacguggagagcuggug

SEQ ID NO: 2557177 - RNA, 22 nt, Human
cgugcacguggagagcuggugc

SEQ ID NO: 2557178 - RNA, 15 nt, Human
cgugcauugugcuuc

SEQ ID NO: 2557179 - RNA, 12 nt, Human
cgugcauugugc

SEQ ID NO: 2557180 - RNA, 21 nt, Human
cgugcauugugcuucuuucuu

SEQ ID NO: 2557181 - RNA, 23 nt, Human
cgugcauaccacuuuuguucuug

SEQ ID NO: 2557182 - RNA, 22 nt, Human
cgugcauuggaagaccccaccc

SEQ ID NO: 2557183 - RNA, 21 nt, Human
cgugcauuggaagaccccacc

SEQ ID NO: 2557184 - RNA, 13 nt, Human
cgugcaugugcac

SEQ ID NO: 2557185 - RNA, 21 nt, Human
cgugcaguggugcgaucuggg

SEQ ID NO: 2557186 - RNA, 16 nt, Human
cgugcagacuggaggg

SEQ ID NO: 2557187 - RNA, 17 nt, Human
cgugcagacuggagggg

SEQ ID NO: 2557188 - RNA, 14 nt, Human
cgugcagcauauga

SEQ ID NO: 2557189 - RNA, 18 nt, Human
cuaaaagagauuucaaga

SEQ ID NO: 2557190 - RNA, 21 nt, Human
cuaaaauuugcccucccaucc

SEQ ID NO: 2557191 - RNA, 18 nt, Human
cuaaaauuccacugcguu

SEQ ID NO: 2557192 - RNA, 23 nt, Human
cuaaacaagauuuuaaagacaug

SEQ ID NO: 2557193 - RNA, 22 nt, Human
cuaaacaagauuuuaaagacau

SEQ ID NO: 2557194 - RNA, 14 nt, Human
cuaaacaagauuuu

SEQ ID NO: 2557195 - RNA, 21 nt, Human
cuaaacaagaaucagucuauc

SEQ ID NO: 2557196 - RNA, 17 nt, Human
cuaaaauuuuuaaggac

SEQ ID NO: 2557197 - RNA, 23 nt, Human
cuaaaauuugcccucccaucccg

SEQ ID NO: 2557198 - RNA, 19 nt, Human
cuaaacaagaaucagucua

SEQ ID NO: 2557199 - RNA, 17 nt, Human
cuaaacauuuuguuauu

SEQ ID NO: 2557200 - RNA, 17 nt, Human
cuaaacagauauaaaug

SEQ ID NO: 2557201 - RNA, 13 nt, Human
cuaaacagauaua

SEQ ID NO: 2557202 - RNA, 18 nt, Human
cuaaacauccaauauuuu

SEQ ID NO: 2557203 - RNA, 12 nt, Human
cuaaacagauau

SEQ ID NO: 2557204 - RNA, 18 nt, Human
cuaaacagacuauuuaac

SEQ ID NO: 2557205 - RNA, 16 nt, Human
cuaaacagacuauuua

SEQ ID NO: 2557206 - RNA, 19 nt, Human
cuaaacaaugcugauuugg

SEQ ID NO: 2557207 - RNA, 15 nt, Human
cuaaacccaauccaa

SEQ ID NO: 2557208 - RNA, 19 nt, Human
cuaaacccaauccaaaugg

SEQ ID NO: 2557209 - RNA, 17 nt, Human
cuaaaccuuaguacuga

SEQ ID NO: 2557210 - RNA, 16 nt, Human
cuaaacccaauccaaa

SEQ ID NO: 2557211 - RNA, 19 nt, Human
cuaaaccuuaguacugagu

SEQ ID NO: 2557212 - RNA, 18 nt, Human
cuaaaccuuaguacugag

SEQ ID NO: 2557213 - RNA, 20 nt, Human
cuaaacgagucaauccccuc

SEQ ID NO: 2557214 - RNA, 21 nt, Human
cuaaacgagucaauccccuca

SEQ ID NO: 2557215 - RNA, 24 nt, Human
cguuguaaaauauagcuguacaaa

SEQ ID NO: 2557216 - RNA, 21 nt, Human
cguuguaaaauauagcuguac

SEQ ID NO: 2557217 - RNA, 14 nt, Human
cguuguaaaauaua

SEQ ID NO: 2557218 - RNA, 23 nt, Human
cguugcugugggaacgagagggg

SEQ ID NO: 2557219 - RNA, 21 nt, Human
cguugggccccagccuucuuu

SEQ ID NO: 2557220 - RNA, 16 nt, Human
cguuggagaagcccgu

SEQ ID NO: 2557221 - RNA, 20 nt, Human
cguuguuuacuuaaagauuu

SEQ ID NO: 2557222 - RNA, 18 nt, Human
cguuguuuacuuaaagau

SEQ ID NO: 2557223 - RNA, 11 nt, Human
cguugugaggg

SEQ ID NO: 2557224 - RNA, 18 nt, Human
cguugucucccuggcccu

SEQ ID NO: 2557225 - RNA, 17 nt, Human
cguugucucccuggccc

SEQ ID NO: 2557226 - RNA, 16 nt, Human
cguugucucccuggcc

SEQ ID NO: 2557227 - RNA, 13 nt, Human
cguugucucccug

SEQ ID NO: 2557228 - RNA, 22 nt, Human
cguuuaagacuguaaugaaucu

SEQ ID NO: 2557229 - RNA, 20 nt, Human
cuaaaacaaaagcucaucca

SEQ ID NO: 2557230 - RNA, 12 nt, Human
cuaaaacaauaa

SEQ ID NO: 2557231 - RNA, 22 nt, Human
cuaaaaaugggacuucuuuuca

SEQ ID NO: 2557232 - RNA, 13 nt, Human
cuaaaaaugcaac

SEQ ID NO: 2557233 - RNA, 22 nt, Human
cuaaaaccugagcuagaagcug

SEQ ID NO: 2557234 - RNA, 15 nt, Human
cuaaaaccugagcua

SEQ ID NO: 2557235 - RNA, 17 nt, Human
cuaaaacaauaaaauuu

SEQ ID NO: 2557236 - RNA, 16 nt, Human
cuaaaacuaaauagca

SEQ ID NO: 2557237 - RNA, 22 nt, Human
cuaaaacuaaauagcauguauu

SEQ ID NO: 2557238 - RNA, 22 nt, Human
cuaaaaauauuauaacuuaaaa

SEQ ID NO: 2557239 - RNA, 17 nt, Human
cguuuacuaugccugug

SEQ ID NO: 2557240 - RNA, 14 nt, Human
cguuuacuaugccu

SEQ ID NO: 2557241 - RNA, 23 nt, Human
cguuuacaagcccccccuuccac

SEQ ID NO: 2557242 - RNA, 15 nt, Human
cuaaacggauuccaa

SEQ ID NO: 2557243 - RNA, 16 nt, Human
cuaaacggauuccaaa

SEQ ID NO: 2557244 - RNA, 17 nt, Human
cuaaacggauuccaaag

SEQ ID NO: 2557245 - RNA, 17 nt, Human
cuaaauauauuuuaaga

SEQ ID NO: 2557246 - RNA, 20 nt, Human
cuaaauauauuuuaagacga

SEQ ID NO: 2557247 - RNA, 18 nt, Human
cuaaauauauuuuaagac

SEQ ID NO: 2557248 - RNA, 21 nt, Human
cuaaauccuuuacuguuaguc

SEQ ID NO: 2557249 - RNA, 17 nt, Human
cuaaauccuuuacuguu

SEQ ID NO: 2557250 - RNA, 13 nt, Human
cuaaauauuuccu

SEQ ID NO: 2557251 - RNA, 14 nt, Human
cuaaauauuuccuu

SEQ ID NO: 2557252 - RNA, 22 nt, Human
cuaaauauuuccuuaaacugug

SEQ ID NO: 2557253 - RNA, 15 nt, Human
cuaaauauuuccuua

SEQ ID NO: 2557254 - RNA, 16 nt, Human
cuaaaucuagacucaa

SEQ ID NO: 2557255 - RNA, 15 nt, Human
cuaaaugaauguuua

SEQ ID NO: 2557256 - RNA, 20 nt, Human
cuaaaucuccaaaauaaaac

SEQ ID NO: 2557257 - RNA, 15 nt, Human
cuaaauggaaccacu

SEQ ID NO: 2557258 - RNA, 16 nt, Human
cuaaaugaauguuuac

SEQ ID NO: 2557259 - RNA, 21 nt, Human
cuaaaugcauauccugagcca

SEQ ID NO: 2557260 - RNA, 16 nt, Human
cuaaauggaaccacuc

SEQ ID NO: 2557261 - RNA, 17 nt, Human
cuaaauggaaccacucu

SEQ ID NO: 2557262 - RNA, 18 nt, Human
cuaaauggaaccacucua

SEQ ID NO: 2557263 - RNA, 16 nt, Human
cuaaauggccucaugu

SEQ ID NO: 2557264 - RNA, 13 nt, Human
cuaaauggccuca

SEQ ID NO: 2557265 - RNA, 12 nt, Human
cuaaauggccuc

SEQ ID NO: 2557266 - RNA, 22 nt, Human
cuaaaugcauauccugagccau

SEQ ID NO: 2557267 - RNA, 23 nt, Human
cuaaauugacacuuaaaaauggu

SEQ ID NO: 2557268 - RNA, 19 nt, Human
cuaaauuacaauugucauu

SEQ ID NO: 2557269 - RNA, 18 nt, Human
cuaaauuguaaacuccug

SEQ ID NO: 2557270 - RNA, 14 nt, Human
cuaaauuguaaacu

SEQ ID NO: 2557271 - RNA, 21 nt, Human
cuaaauguggagaaacuguag

SEQ ID NO: 2557272 - RNA, 19 nt, Human
cuaaauguaacagucugau

SEQ ID NO: 2557273 - RNA, 18 nt, Human
cuaaauguaacagucuga

SEQ ID NO: 2557274 - RNA, 16 nt, Human
cuaaauguugaaagau

SEQ ID NO: 2557275 - RNA, 19 nt, Human
cuaaauggccucauguggc

SEQ ID NO: 2557276 - RNA, 17 nt, Human
cuaaauggccucaugug

SEQ ID NO: 2557277 - RNA, 18 nt, Human
cuaaauggucgcccagga

SEQ ID NO: 2557278 - RNA, 19 nt, Human
cuaaauggucgcccaggag

SEQ ID NO: 2557279 - RNA, 16 nt, Human
cuaaauguaacagucu

SEQ ID NO: 2557280 - RNA, 15 nt, Human
cuaaauguaacaguc

SEQ ID NO: 2557281 - RNA, 14 nt, Human
cuaaauguaacagu

SEQ ID NO: 2557282 - RNA, 15 nt, Human
cuaaaugcugaaaaa

SEQ ID NO: 2557283 - RNA, 20 nt, Human
cuaaauggucgcccaggaga

SEQ ID NO: 2557284 - RNA, 21 nt, Human
cuaaauggucgcccaggagac

SEQ ID NO: 2557285 - RNA, 17 nt, Human
cuaacauggaaguacua

SEQ ID NO: 2557286 - RNA, 15 nt, Human
cuaacauggaaguac

SEQ ID NO: 2557287 - RNA, 15 nt, Human
cuaacaugauuuggg

SEQ ID NO: 2557288 - RNA, 15 nt, Human
cuaacacuggccccu

SEQ ID NO: 2557289 - RNA, 13 nt, Human
cuaacacuggccc

SEQ ID NO: 2557290 - RNA, 14 nt, Human
cuaacacuggcccc

SEQ ID NO: 2557291 - RNA, 23 nt, Human
cuaaauuugaauguuaagcagau

SEQ ID NO: 2557292 - RNA, 15 nt, Human
cuaacacacagcucc

SEQ ID NO: 2557293 - RNA, 15 nt, Human
cuaacaaugacauuu

SEQ ID NO: 2557294 - RNA, 13 nt, Human
cuaacaaugacau

SEQ ID NO: 2557295 - RNA, 22 nt, Human
cuaacaaucagcuccuuccugg

SEQ ID NO: 2557296 - RNA, 21 nt, Human
cuaacaccagcguuugagggg

SEQ ID NO: 2557297 - RNA, 14 nt, Human
cuaacacccagucu

SEQ ID NO: 2557298 - RNA, 16 nt, Human
cuaacacuauuuuaug

SEQ ID NO: 2557299 - RNA, 15 nt, Human
cuaacacuauuuuau

SEQ ID NO: 2557300 - RNA, 16 nt, Human
cuaacacacagcuccc

SEQ ID NO: 2557301 - RNA, 14 nt, Human
cuaacacagcaugu

SEQ ID NO: 2557302 - RNA, 16 nt, Human
cuaacacagcaugugu

SEQ ID NO: 2557303 - RNA, 17 nt, Human
cuaacacagcaugugua

SEQ ID NO: 2557304 - RNA, 13 nt, Human
cuaacaccagcgu

SEQ ID NO: 2557305 - RNA, 17 nt, Human
cuaacacauuaucggga

SEQ ID NO: 2557306 - RNA, 15 nt, Human
cuaacaccagacaga

SEQ ID NO: 2557307 - RNA, 12 nt, Human
cggccuccaucc

SEQ ID NO: 2557308 - RNA, 14 nt, Human
cggccuccauccug

SEQ ID NO: 2557309 - RNA, 16 nt, Human
cggcccgaucuuucua

SEQ ID NO: 2557310 - RNA, 17 nt, Human
cggcccagcccggcucc

SEQ ID NO: 2557311 - RNA, 15 nt, Human
cggccgcuccagggg

SEQ ID NO: 2557312 - RNA, 14 nt, Human
cggccgcuccaggg

SEQ ID NO: 2557313 - RNA, 13 nt, Human
cggccgcuccagg

SEQ ID NO: 2557314 - RNA, 14 nt, Human
cggccggccagccc

SEQ ID NO: 2557315 - RNA, 16 nt, Human
cggccggccagccccu

SEQ ID NO: 2557316 - RNA, 23 nt, Human
cggccggccagccccuggcccca

SEQ ID NO: 2557317 - RNA, 19 nt, Human
cggccgucuucacucgccc

SEQ ID NO: 2557318 - RNA, 17 nt, Human
cggcuggagaccaugca

SEQ ID NO: 2557319 - RNA, 20 nt, Human
cggcuggaaaugcugggcug

SEQ ID NO: 2557320 - RNA, 18 nt, Human
cggcuggaaaugcugggc

SEQ ID NO: 2557321 - RNA, 11 nt, Human
cggcugcugag

SEQ ID NO: 2557322 - RNA, 15 nt, Human
cggcuggacuuggag

SEQ ID NO: 2557323 - RNA, 11 nt, Human
cggcugcccuu

SEQ ID NO: 2557324 - RNA, 12 nt, Human
cggcugcccuuu

SEQ ID NO: 2557325 - RNA, 22 nt, Human
cggcugcagcucacccagcccc

SEQ ID NO: 2557326 - RNA, 18 nt, Human
cggcugcagcucacccag

SEQ ID NO: 2557327 - RNA, 20 nt, Human
cggcugcagaggccagaggc

SEQ ID NO: 2557328 - RNA, 15 nt, Human
cggcugcagaggcca

SEQ ID NO: 2557329 - RNA, 12 nt, Human
cggcugcagagg

SEQ ID NO: 2557330 - RNA, 20 nt, Human
cggcugagucaugaucuccc

SEQ ID NO: 2557331 - RNA, 14 nt, Human
cggccucagcaccc

SEQ ID NO: 2557332 - RNA, 22 nt, Human
cggcugagucaugaucucccug

SEQ ID NO: 2557333 - RNA, 23 nt, Human
cggcugagucaugaucucccugc

SEQ ID NO: 2557334 - RNA, 14 nt, Human
cggccaccucugcg

SEQ ID NO: 2557335 - RNA, 13 nt, Human
cggccaccucugc

SEQ ID NO: 2557336 - RNA, 12 nt, Human
cggccaccucug

SEQ ID NO: 2557337 - RNA, 16 nt, Human
cggccacuggccaucu

SEQ ID NO: 2557338 - RNA, 14 nt, Human
cggccacuggccau

SEQ ID NO: 2557339 - RNA, 15 nt, Human
cggccagccaugucu

SEQ ID NO: 2557340 - RNA, 24 nt, Human
cggccaggccagagggagugacag

SEQ ID NO: 2557341 - RNA, 17 nt, Human
cggccagggagaagcuc

SEQ ID NO: 2557342 - RNA, 13 nt, Human
cggccaggugggc

SEQ ID NO: 2557343 - RNA, 20 nt, Human
cggccagccccggcccuggg

SEQ ID NO: 2557344 - RNA, 16 nt, Human
cggccagggagaagcu

SEQ ID NO: 2557345 - RNA, 16 nt, Human
cggcccaagcccgacu

SEQ ID NO: 2557346 - RNA, 15 nt, Human
cggcccaagcccgac

SEQ ID NO: 2557347 - RNA, 12 nt, Human
cggcccacagcu

SEQ ID NO: 2557348 - RNA, 19 nt, Human
cggccccugcugguucagg

SEQ ID NO: 2557349 - RNA, 18 nt, Human
cggccccugcugguucag

SEQ ID NO: 2557350 - RNA, 13 nt, Human
cggccccugcugg

SEQ ID NO: 2557351 - RNA, 19 nt, Human
cggcccacagcucccaccc

SEQ ID NO: 2557352 - RNA, 22 nt, Human
cggcccacagcucccaccccac

SEQ ID NO: 2557353 - RNA, 22 nt, Human
cggcccaagcccgacuugcugu

SEQ ID NO: 2557354 - RNA, 15 nt, Human
cggcccacagcuccc

SEQ ID NO: 2557355 - RNA, 17 nt, Human
cggccaccugcggugcu

SEQ ID NO: 2557356 - RNA, 16 nt, Human
cggccaccugcggugc

SEQ ID NO: 2557357 - RNA, 15 nt, Human
cggccaccugcggug

SEQ ID NO: 2557358 - RNA, 11 nt, Human
cggccaccugc

SEQ ID NO: 2557359 - RNA, 11 nt, Human
cggccaccucu

SEQ ID NO: 2557360 - RNA, 14 nt, Human
cggcauuucaaaug

SEQ ID NO: 2557361 - RNA, 15 nt, Human
cggcauuaaagccau

SEQ ID NO: 2557362 - RNA, 22 nt, Human
cggcaugggaaagccaccucuc

SEQ ID NO: 2557363 - RNA, 14 nt, Human
cggcauuccugcuu

SEQ ID NO: 2557364 - RNA, 21 nt, Human
cggcaugggaaagccaccucu

SEQ ID NO: 2557365 - RNA, 14 nt, Human
cggcauggcuggga

SEQ ID NO: 2557366 - RNA, 13 nt, Human
cggcauggcuggg

SEQ ID NO: 2557367 - RNA, 21 nt, Human
cggcaggacaacgaggaagcc

SEQ ID NO: 2557368 - RNA, 21 nt, Human
cggcaguucugggugcucccu

SEQ ID NO: 2557369 - RNA, 13 nt, Human
cggaaguuuucaa

SEQ ID NO: 2557370 - RNA, 12 nt, Human
cggaaguuuuca

SEQ ID NO: 2557371 - RNA, 12 nt, Human
cggaagggcaca

SEQ ID NO: 2557372 - RNA, 20 nt, Human
cggaagccuuuuuccccaaa

SEQ ID NO: 2557373 - RNA, 14 nt, Human
cggaagcagugccu

SEQ ID NO: 2557374 - RNA, 20 nt, Human
cggaagcagugccuuccaua

SEQ ID NO: 2557375 - RNA, 22 nt, Human
cggaagcagugccuuccauaau

SEQ ID NO: 2557376 - RNA, 23 nt, Human
cggaagcagugccuuccauaauu

SEQ ID NO: 2557377 - RNA, 18 nt, Human
cggaaggcuggcugggca

SEQ ID NO: 2557378 - RNA, 13 nt, Human
cggaagagccuug

SEQ ID NO: 2557379 - RNA, 20 nt, Human
cggaaaagguuuuauuuugu

SEQ ID NO: 2557380 - RNA, 21 nt, Human
cggaaaacgguggaggccagg

SEQ ID NO: 2557381 - RNA, 19 nt, Human
cgcuuuugcuggucacugc

SEQ ID NO: 2557382 - RNA, 18 nt, Human
cggaaguuuucaaugaug

SEQ ID NO: 2557383 - RNA, 21 nt, Human
cggcacagggucugcucuuuc

SEQ ID NO: 2557384 - RNA, 14 nt, Human
cggaauaguuggcu

SEQ ID NO: 2557385 - RNA, 19 nt, Human
cggcacagggucugcucuu

SEQ ID NO: 2557386 - RNA, 20 nt, Human
cggcacccacaagugccacu

SEQ ID NO: 2557387 - RNA, 15 nt, Human
cggcacccacccagc

SEQ ID NO: 2557388 - RNA, 14 nt, Human
cggcagcagccauc

SEQ ID NO: 2557389 - RNA, 13 nt, Human
cggcagcagccau

SEQ ID NO: 2557390 - RNA, 13 nt, Human
cggcagagaggac

SEQ ID NO: 2557391 - RNA, 11 nt, Human
cggcagagagg

SEQ ID NO: 2557392 - RNA, 14 nt, Human
cgguauuaugcuuc

SEQ ID NO: 2557393 - RNA, 12 nt, Human
cgguacucccau

SEQ ID NO: 2557394 - RNA, 22 nt, Human
cgguauccccccaucuugcuuc

SEQ ID NO: 2557395 - RNA, 18 nt, Human
cgguauccccccaucuug

SEQ ID NO: 2557396 - RNA, 18 nt, Human
cgguagguucagccaagg

SEQ ID NO: 2557397 - RNA, 22 nt, Human
cgguagccagcacacagggcag

SEQ ID NO: 2557398 - RNA, 15 nt, Human
cgguagccagcacac

SEQ ID NO: 2557399 - RNA, 21 nt, Human
cgguagccagcacacagggca

SEQ ID NO: 2557400 - RNA, 21 nt, Human
cggguuuuauuguuuaaaauc

SEQ ID NO: 2557401 - RNA, 23 nt, Human
cggguuuggcgggccaaggacug

SEQ ID NO: 2557402 - RNA, 20 nt, Human
cgguaaaacaccggagacua

SEQ ID NO: 2557403 - RNA, 19 nt, Human
cggguuuggcgggccaagg

SEQ ID NO: 2557404 - RNA, 20 nt, Human
cgguccacccaggagccccg

SEQ ID NO: 2557405 - RNA, 16 nt, Human
cgguccacccaggagc

SEQ ID NO: 2557406 - RNA, 15 nt, Human
cgguccacccaggag

SEQ ID NO: 2557407 - RNA, 14 nt, Human
cgguccacccagga

SEQ ID NO: 2557408 - RNA, 19 nt, Human
cgggguggugggaaccaug

SEQ ID NO: 2557409 - RNA, 13 nt, Human
cgggucugccucu

SEQ ID NO: 2557410 - RNA, 22 nt, Human
cgggucaucuguaccucugccu

SEQ ID NO: 2557411 - RNA, 20 nt, Human
cgggugaacaaagcagccac

SEQ ID NO: 2557412 - RNA, 15 nt, Human
cgggucaucuguacc

SEQ ID NO: 2557413 - RNA, 19 nt, Human
cgggucacaggagggaggg

SEQ ID NO: 2557414 - RNA, 18 nt, Human
cgggguggugggaaccau

SEQ ID NO: 2557415 - RNA, 12 nt, Human
cgggguggagca

SEQ ID NO: 2557416 - RNA, 11 nt, Human
cgggucacagg

SEQ ID NO: 2557417 - RNA, 23 nt, Human
cggguggggguggaauaaaauac

SEQ ID NO: 2557418 - RNA, 12 nt, Human
cgggugggggug

SEQ ID NO: 2557419 - RNA, 19 nt, Human
cgggugggcggcacagccu

SEQ ID NO: 2557420 - RNA, 20 nt, Human
cggguggggcuuggggcuca

SEQ ID NO: 2557421 - RNA, 16 nt, Human
cggguggggcuugggg

SEQ ID NO: 2557422 - RNA, 16 nt, Human
cggguugugugucugu

SEQ ID NO: 2557423 - RNA, 17 nt, Human
cggguugugugucuguu

SEQ ID NO: 2557424 - RNA, 22 nt, Human
cgggugugcaaugucugaguga

SEQ ID NO: 2557425 - RNA, 21 nt, Human
cgggugaacaaagcagccacg

SEQ ID NO: 2557426 - RNA, 15 nt, Human
cgggugcucagggcu

SEQ ID NO: 2557427 - RNA, 18 nt, Human
cggguggaucaccugagg

SEQ ID NO: 2557428 - RNA, 19 nt, Human
cggguggaucaccugaggu

SEQ ID NO: 2557429 - RNA, 15 nt, Human
cggguggcaggugga

SEQ ID NO: 2557430 - RNA, 18 nt, Human
cgggugcucagggcugac

SEQ ID NO: 2557431 - RNA, 20 nt, Human
cgggugggcggcacagccuu

SEQ ID NO: 2557432 - RNA, 18 nt, Human
cggguggcuagucagaga

SEQ ID NO: 2557433 - RNA, 19 nt, Human
cggucugcaagucagagga

SEQ ID NO: 2557434 - RNA, 16 nt, Human
cggucugcaagucaga

SEQ ID NO: 2557435 - RNA, 20 nt, Human
cggucugcaagucagaggau

SEQ ID NO: 2557436 - RNA, 11 nt, Human
cggucucaggc

SEQ ID NO: 2557437 - RNA, 21 nt, Human
cggucuaaagugagcucuaug

SEQ ID NO: 2557438 - RNA, 14 nt, Human
cggucccacacugg

SEQ ID NO: 2557439 - RNA, 18 nt, Human
cgguccaagccugcaacu

SEQ ID NO: 2557440 - RNA, 17 nt, Human
cgguauuaugcuucuug

SEQ ID NO: 2557441 - RNA, 16 nt, Human
cgguauuaugcuucuu

SEQ ID NO: 2557442 - RNA, 22 nt, Human
cggucggguuuuauuguuuaaa

SEQ ID NO: 2557443 - RNA, 18 nt, Human
cgguccccuccgccaggc

SEQ ID NO: 2557444 - RNA, 19 nt, Human
cggucccuugagaccucag

SEQ ID NO: 2557445 - RNA, 21 nt, Human
cggucccuugagaccucagcc

SEQ ID NO: 2557446 - RNA, 22 nt, Human
cggucccuugagaccucagcca

SEQ ID NO: 2557447 - RNA, 23 nt, Human
cggucccuugagaccucagccau

SEQ ID NO: 2557448 - RNA, 17 nt, Human
cggugagcuacaaaugc

SEQ ID NO: 2557449 - RNA, 20 nt, Human
cggugcccaagccagaggcu

SEQ ID NO: 2557450 - RNA, 18 nt, Human
cggugcccaagccagagg

SEQ ID NO: 2557451 - RNA, 15 nt, Human
cggugcccaagccag

SEQ ID NO: 2557452 - RNA, 14 nt, Human
cggugcccaagcca

SEQ ID NO: 2557453 - RNA, 14 nt, Human
cggugcagucuggg

SEQ ID NO: 2557454 - RNA, 13 nt, Human
cggugcagucugg

SEQ ID NO: 2557455 - RNA, 16 nt, Human
cggugagaacucugcc

SEQ ID NO: 2557456 - RNA, 16 nt, Human
cggugcagucugggug

SEQ ID NO: 2557457 - RNA, 17 nt, Human
cggugccagguuuucug

SEQ ID NO: 2557458 - RNA, 21 nt, Human
cggugagaggggaacagacug

SEQ ID NO: 2557459 - RNA, 20 nt, Human
cggugagaggggaacagacu

SEQ ID NO: 2557460 - RNA, 14 nt, Human
cggggacccuguga

SEQ ID NO: 2557461 - RNA, 12 nt, Human
cggggacccugu

SEQ ID NO: 2557462 - RNA, 14 nt, Human
cgggcagcacagca

SEQ ID NO: 2557463 - RNA, 12 nt, Human
cgggcagcacag

SEQ ID NO: 2557464 - RNA, 23 nt, Human
cggggacagcuccuucuguccua

SEQ ID NO: 2557465 - RNA, 16 nt, Human
cggggagcccccgccc

SEQ ID NO: 2557466 - RNA, 22 nt, Human
cggggaggagagagcagcuucu

SEQ ID NO: 2557467 - RNA, 18 nt, Human
cggggagcgcccgcgccc

SEQ ID NO: 2557468 - RNA, 13 nt, Human
cggggaggccaag

SEQ ID NO: 2557469 - RNA, 14 nt, Human
cggggaggccaagu

SEQ ID NO: 2557470 - RNA, 19 nt, Human
cggggaggccaagugcagg

SEQ ID NO: 2557471 - RNA, 21 nt, Human
cggggaggccaagugcaggcu

SEQ ID NO: 2557472 - RNA, 18 nt, Human
cggggccucgggaccuca

SEQ ID NO: 2557473 - RNA, 23 nt, Human
cggggcucuucucauuucacccc

SEQ ID NO: 2557474 - RNA, 17 nt, Human
cggggcucuucucauuu

SEQ ID NO: 2557475 - RNA, 17 nt, Human
cggggcguuucuuugcc

SEQ ID NO: 2557476 - RNA, 14 nt, Human
cggggcguuucuuu

SEQ ID NO: 2557477 - RNA, 16 nt, Human
cggggcucuucucauu

SEQ ID NO: 2557478 - RNA, 22 nt, Human
cggggccuugcgguauccgccc

SEQ ID NO: 2557479 - RNA, 22 nt, Human
cggggccuggcgggaugggcca

SEQ ID NO: 2557480 - RNA, 23 nt, Human
cggggcuucaaccuugagacagc

SEQ ID NO: 2557481 - RNA, 14 nt, Human
cggggcuuggcuga

SEQ ID NO: 2557482 - RNA, 15 nt, Human
cggggcuuggcugag

SEQ ID NO: 2557483 - RNA, 21 nt, Human
cggggcuggguuggcgcaccc

SEQ ID NO: 2557484 - RNA, 12 nt, Human
cggggcuggguu

SEQ ID NO: 2557485 - RNA, 10 nt, Human
cggggcuggg

SEQ ID NO: 2557486 - RNA, 15 nt, Human
cgggggcagagaggg

SEQ ID NO: 2557487 - RNA, 13 nt, Human
cgggggcagcuga

SEQ ID NO: 2557488 - RNA, 12 nt, Human
cgggggcagcug

SEQ ID NO: 2557489 - RNA, 12 nt, Human
cgggggcuggcc

SEQ ID NO: 2557490 - RNA, 15 nt, Human
cgggggcuggccuag

SEQ ID NO: 2557491 - RNA, 13 nt, Human
cgggggcuggccu

SEQ ID NO: 2557492 - RNA, 15 nt, Human
cggggggacagcucc

SEQ ID NO: 2557493 - RNA, 15 nt, Human
cgggguauccugggg

SEQ ID NO: 2557494 - RNA, 16 nt, Human
cgggguccuguggcag

SEQ ID NO: 2557495 - RNA, 16 nt, Human
cgggguauuuuaggca

SEQ ID NO: 2557496 - RNA, 21 nt, Human
cgggguauccugggggaccca

SEQ ID NO: 2557497 - RNA, 23 nt, Human
cggggggccccagucagccucuc

SEQ ID NO: 2557498 - RNA, 22 nt, Human
cggggggccccagucagccucu

SEQ ID NO: 2557499 - RNA, 18 nt, Human
cgggggcuggccuaggag

SEQ ID NO: 2557500 - RNA, 12 nt, Human
cggggggaggga

SEQ ID NO: 2557501 - RNA, 20 nt, Human
cggggggccccagucagccu

SEQ ID NO: 2557502 - RNA, 23 nt, Human
cggggugaguccauucucccagg

SEQ ID NO: 2557503 - RNA, 19 nt, Human
cgggguccuguggcaggca

SEQ ID NO: 2557504 - RNA, 17 nt, Human
cgggguccuguggcagg

SEQ ID NO: 2557505 - RNA, 22 nt, Human
cggggugaguccauucucccag

SEQ ID NO: 2557506 - RNA, 16 nt, Human
cggggugcccacaggc

SEQ ID NO: 2557507 - RNA, 22 nt, Human
cgggcacucagaagacacugau

SEQ ID NO: 2557508 - RNA, 14 nt, Human
cgggcacucagaag

SEQ ID NO: 2557509 - RNA, 19 nt, Human
cgggcaccuauagucccag

SEQ ID NO: 2557510 - RNA, 21 nt, Human
cgggcaccuauagucccagcu

SEQ ID NO: 2557511 - RNA, 22 nt, Human
cggggacagcuccuucuguccu

SEQ ID NO: 2557512 - RNA, 17 nt, Human
cgggauuaguacacacu

SEQ ID NO: 2557513 - RNA, 16 nt, Human
cgggaugguccugggg

SEQ ID NO: 2557514 - RNA, 18 nt, Human
cgggaugguccuggggcu

SEQ ID NO: 2557515 - RNA, 18 nt, Human
cgggaggucgaggcagga

SEQ ID NO: 2557516 - RNA, 20 nt, Human
cgggaggucgaggcaggagg

SEQ ID NO: 2557517 - RNA, 19 nt, Human
cggcuggccuggccccuca

SEQ ID NO: 2557518 - RNA, 22 nt, Human
cggcuggccuggccccucaggg

SEQ ID NO: 2557519 - RNA, 22 nt, Human
cggcuggagaccaugcagagcg

SEQ ID NO: 2557520 - RNA, 21 nt, Human
cggcuggagaccaugcagagc

SEQ ID NO: 2557521 - RNA, 23 nt, Human
cggcuggccuggccccucagggu

SEQ ID NO: 2557522 - RNA, 16 nt, Human
cgggagaaucauguga

SEQ ID NO: 2557523 - RNA, 21 nt, Human
cgggagaaucaugugaacccg

SEQ ID NO: 2557524 - RNA, 12 nt, Human
cgggagacagca

SEQ ID NO: 2557525 - RNA, 14 nt, Human
cgggagcagugucu

SEQ ID NO: 2557526 - RNA, 15 nt, Human
cgggagcagugucuu

SEQ ID NO: 2557527 - RNA, 20 nt, Human
cgggagcagugucuuccaua

SEQ ID NO: 2557528 - RNA, 23 nt, Human
cgggagcagugucuuccauaaug

SEQ ID NO: 2557529 - RNA, 14 nt, Human
cgggagcaucucuu

SEQ ID NO: 2557530 - RNA, 22 nt, Human
cgggagccaugcgcccccuccg

SEQ ID NO: 2557531 - RNA, 22 nt, Human
cgggagcaucucuugaggccag

SEQ ID NO: 2557532 - RNA, 18 nt, Human
cgggagccgcuggcagaa

SEQ ID NO: 2557533 - RNA, 17 nt, Human
cgggagccgcuggcaga

SEQ ID NO: 2557534 - RNA, 15 nt, Human
cggaaaccuuggugu

SEQ ID NO: 2557535 - RNA, 22 nt, Human
cgcugggugguacccucuggag

SEQ ID NO: 2557536 - RNA, 19 nt, Human
cgcugggugguacccucug

SEQ ID NO: 2557537 - RNA, 14 nt, Human
cgcugggugguacc

SEQ ID NO: 2557538 - RNA, 18 nt, Human
cgcucucuggccuucggc

SEQ ID NO: 2557539 - RNA, 22 nt, Human
cgcugucagccauuccuguucc

SEQ ID NO: 2557540 - RNA, 15 nt, Human
cgcugguagagaugg

SEQ ID NO: 2557541 - RNA, 13 nt, Human
cgcugucacaggc

SEQ ID NO: 2557542 - RNA, 23 nt, Human
cgcugguagagauggaggaggag

SEQ ID NO: 2557543 - RNA, 17 nt, Human
cgcugugcugcccugcc

SEQ ID NO: 2557544 - RNA, 16 nt, Human
cgcugugcugcccugc

SEQ ID NO: 2557545 - RNA, 15 nt, Human
cgcugugcugcccug

SEQ ID NO: 2557546 - RNA, 15 nt, Human
cgcugucuccagacc

SEQ ID NO: 2557547 - RNA, 14 nt, Human
cgcugucuccagac

SEQ ID NO: 2557548 - RNA, 23 nt, Human
cgcugucccuaguaaaaauacaa

SEQ ID NO: 2557549 - RNA, 15 nt, Human
cggaaaacaugcuac

SEQ ID NO: 2557550 - RNA, 20 nt, Human
cggaaaacaugcuacacacu

SEQ ID NO: 2557551 - RNA, 16 nt, Human
cgcuuugauucauagu

SEQ ID NO: 2557552 - RNA, 18 nt, Human
cgcuugugcagaaaacau

SEQ ID NO: 2557553 - RNA, 17 nt, Human
cgcuugugcagaaaaca

SEQ ID NO: 2557554 - RNA, 17 nt, Human
cgcuuguccagcgccua

SEQ ID NO: 2557555 - RNA, 20 nt, Human
cgcuuguccagcgccuagug

SEQ ID NO: 2557556 - RNA, 23 nt, Human
cgcuugccucggcuccugcugca

SEQ ID NO: 2557557 - RNA, 14 nt, Human
cgcuuggagcagag

SEQ ID NO: 2557558 - RNA, 22 nt, Human
cgcuugccucggcuccugcugc

SEQ ID NO: 2557559 - RNA, 21 nt, Human
cgcuugccucggcuccugcug

SEQ ID NO: 2557560 - RNA, 18 nt, Human
cgcuugcuuuucuguauu

SEQ ID NO: 2557561 - RNA, 20 nt, Human
cgcuugccucggcuccugcu

SEQ ID NO: 2557562 - RNA, 18 nt, Human
cgcuugccucggcuccug

SEQ ID NO: 2557563 - RNA, 16 nt, Human
cgcuugccucggcucc

SEQ ID NO: 2557564 - RNA, 15 nt, Human
cgcuugccucggcuc

SEQ ID NO: 2557565 - RNA, 14 nt, Human
cgcuugccucggcu

SEQ ID NO: 2557566 - RNA, 13 nt, Human
cgcuugccucggc

SEQ ID NO: 2557567 - RNA, 11 nt, Human
cgcuugccucg

SEQ ID NO: 2557568 - RNA, 18 nt, Human
cgcugugcugcccugccc

SEQ ID NO: 2557569 - RNA, 19 nt, Human
cgcuucuugccucugugcu

SEQ ID NO: 2557570 - RNA, 18 nt, Human
cgcuucuugccucugugc

SEQ ID NO: 2557571 - RNA, 22 nt, Human
cgcuucuugccucugugcugug

SEQ ID NO: 2557572 - RNA, 17 nt, Human
cgcuugccacuagggcu

SEQ ID NO: 2557573 - RNA, 16 nt, Human
cgcuacccgggaaggg

SEQ ID NO: 2557574 - RNA, 12 nt, Human
cgcucagcccuc

SEQ ID NO: 2557575 - RNA, 21 nt, Human
cgcucagcccucccugccccu

SEQ ID NO: 2557576 - RNA, 16 nt, Human
cgcucagcccucccug

SEQ ID NO: 2557577 - RNA, 14 nt, Human
cgcucucuggccuu

SEQ ID NO: 2557578 - RNA, 15 nt, Human
cgcucucuggccuuc

SEQ ID NO: 2557579 - RNA, 22 nt, Human
cgcucagggccaugcugaggcc

SEQ ID NO: 2557580 - RNA, 21 nt, Human
cgcucagggccaugcugaggc

SEQ ID NO: 2557581 - RNA, 20 nt, Human
cgcucagggccaugcugagg

SEQ ID NO: 2557582 - RNA, 19 nt, Human
cgcucagggccaugcugag

SEQ ID NO: 2557583 - RNA, 11 nt, Human
cgcuacccacu

SEQ ID NO: 2557584 - RNA, 23 nt, Human
cgcgccuucucccccccggggcu

SEQ ID NO: 2557585 - RNA, 19 nt, Human
cgcgccuucucccccccgg

SEQ ID NO: 2557586 - RNA, 13 nt, Human
cgcgcugccugug

SEQ ID NO: 2557587 - RNA, 19 nt, Human
cgcgcgucccccugccggc

SEQ ID NO: 2557588 - RNA, 15 nt, Human
cgcgcugccugugug

SEQ ID NO: 2557589 - RNA, 20 nt, Human
cgcgccacucgcuuccccca

SEQ ID NO: 2557590 - RNA, 22 nt, Human
cgcgccacucgcuucccccaua

SEQ ID NO: 2557591 - RNA, 22 nt, Human
cgcgccacuacacuccagccug

SEQ ID NO: 2557592 - RNA, 23 nt, Human
cgcgccacuacacuccagccuga

SEQ ID NO: 2557593 - RNA, 15 nt, Human
cgcgccacucgcuuc

SEQ ID NO: 2557594 - RNA, 18 nt, Human
cgcgccacucgcuucccc

SEQ ID NO: 2557595 - RNA, 22 nt, Human
cgcuaagagggagggagggcuc

SEQ ID NO: 2557596 - RNA, 21 nt, Human
cgcuaaucccgauucacccug

SEQ ID NO: 2557597 - RNA, 23 nt, Human
cgcggcggagcuggccccgccgc

SEQ ID NO: 2557598 - RNA, 22 nt, Human
cgcggcggagcuggccccgccg

SEQ ID NO: 2557599 - RNA, 21 nt, Human
cgcggcggagcuggccccgcc

SEQ ID NO: 2557600 - RNA, 18 nt, Human
cgcggcggagcuggcccc

SEQ ID NO: 2557601 - RNA, 17 nt, Human
cgcggcggagcuggccc

SEQ ID NO: 2557602 - RNA, 22 nt, Human
cgcggccagccccggcccuggg

SEQ ID NO: 2557603 - RNA, 15 nt, Human
cgcggccagccccgg

SEQ ID NO: 2557604 - RNA, 14 nt, Human
cgcggccagccccg

SEQ ID NO: 2557605 - RNA, 12 nt, Human
cgcggccagccc

SEQ ID NO: 2557606 - RNA, 15 nt, Human
cgcggcggagcuggc

SEQ ID NO: 2557607 - RNA, 19 nt, Human
ccucugcccacucccugca

SEQ ID NO: 2557608 - RNA, 17 nt, Human
ccucugcccacucccug

SEQ ID NO: 2557609 - RNA, 20 nt, Human
ccucugcccacucccugcaa

SEQ ID NO: 2557610 - RNA, 17 nt, Human
ccucugcccagcuuggg

SEQ ID NO: 2557611 - RNA, 16 nt, Human
ccucugcccagcuugg

SEQ ID NO: 2557612 - RNA, 14 nt, Human
ccucugcccagcuu

SEQ ID NO: 2557613 - RNA, 13 nt, Human
ccucugcccagcu

SEQ ID NO: 2557614 - RNA, 11 nt, Human
ccucugcccag

SEQ ID NO: 2557615 - RNA, 23 nt, Human
ccucugccagaagauccccucag

SEQ ID NO: 2557616 - RNA, 11 nt, Human
ccucugccaga

SEQ ID NO: 2557617 - RNA, 20 nt, Human
ccucugccaccuccccuauc

SEQ ID NO: 2557618 - RNA, 22 nt, Human
cgccagauucuuuccugaggcu

SEQ ID NO: 2557619 - RNA, 20 nt, Human
ccucugcccagcuugggccc

SEQ ID NO: 2557620 - RNA, 18 nt, Human
ccucugcccagcuugggc

SEQ ID NO: 2557621 - RNA, 19 nt, Human
ccucugccccauccuccag

SEQ ID NO: 2557622 - RNA, 23 nt, Human
ccucugcccagcuugggcccagc

SEQ ID NO: 2557623 - RNA, 22 nt, Human
ccucugccccauccuccagcag

SEQ ID NO: 2557624 - RNA, 14 nt, Human
ccucugccccgucu

SEQ ID NO: 2557625 - RNA, 21 nt, Human
cgccagccuccucuggacggc

SEQ ID NO: 2557626 - RNA, 18 nt, Human
cgccagccuccucuggac

SEQ ID NO: 2557627 - RNA, 17 nt, Human
cgccagccuccucugga

SEQ ID NO: 2557628 - RNA, 16 nt, Human
cgccagccuccucugg

SEQ ID NO: 2557629 - RNA, 15 nt, Human
cgccagccuccucug

SEQ ID NO: 2557630 - RNA, 14 nt, Human
cgccagccuccucu

SEQ ID NO: 2557631 - RNA, 13 nt, Human
cgccagccuccuc

SEQ ID NO: 2557632 - RNA, 22 nt, Human
cgccagcacagaaacagaggag

SEQ ID NO: 2557633 - RNA, 15 nt, Human
cgccagcgaacuuga

SEQ ID NO: 2557634 - RNA, 23 nt, Human
cgccagccuccucuggacggcag

SEQ ID NO: 2557635 - RNA, 20 nt, Human
cgcccacuguccugggcgcc

SEQ ID NO: 2557636 - RNA, 19 nt, Human
cgcccacuguccugggcgc

SEQ ID NO: 2557637 - RNA, 18 nt, Human
cgcccacuguccugggcg

SEQ ID NO: 2557638 - RNA, 17 nt, Human
cgcccacuguccugggc

SEQ ID NO: 2557639 - RNA, 16 nt, Human
cgcccacuguccuggg

SEQ ID NO: 2557640 - RNA, 15 nt, Human
cgcccacuguccugg

SEQ ID NO: 2557641 - RNA, 14 nt, Human
cgcccacuguccug

SEQ ID NO: 2557642 - RNA, 12 nt, Human
cgcccacugucc

SEQ ID NO: 2557643 - RNA, 14 nt, Human
cgcccaccucccca

SEQ ID NO: 2557644 - RNA, 12 nt, Human
cgcccaccuccc

SEQ ID NO: 2557645 - RNA, 11 nt, Human
cgcccaccucc

SEQ ID NO: 2557646 - RNA, 23 nt, Human
cgcccaccgcaugcccccucgug

SEQ ID NO: 2557647 - RNA, 21 nt, Human
cgcccaccgcaugcccccucg

SEQ ID NO: 2557648 - RNA, 18 nt, Human
cgcccaccgcaugccccc

SEQ ID NO: 2557649 - RNA, 17 nt, Human
cgcccaccgcaugcccc

SEQ ID NO: 2557650 - RNA, 16 nt, Human
cgcccaccgcaugccc

SEQ ID NO: 2557651 - RNA, 13 nt, Human
cgcccaccgcaug

SEQ ID NO: 2557652 - RNA, 19 nt, Human
cgcccaccccgcucugcau

SEQ ID NO: 2557653 - RNA, 18 nt, Human
cgcccaccccgcucugca

SEQ ID NO: 2557654 - RNA, 22 nt, Human
cgcccacaggaagccugcaguc

SEQ ID NO: 2557655 - RNA, 21 nt, Human
cgcccacaggaagccugcagu

SEQ ID NO: 2557656 - RNA, 20 nt, Human
cgcccacaggaagccugcag

SEQ ID NO: 2557657 - RNA, 16 nt, Human
cgccaucccagcccca

SEQ ID NO: 2557658 - RNA, 14 nt, Human
cgccaucccagccc

SEQ ID NO: 2557659 - RNA, 23 nt, Human
cgccaggggaaaaucagccugcu

SEQ ID NO: 2557660 - RNA, 17 nt, Human
cgcccuuccucuccacc

SEQ ID NO: 2557661 - RNA, 13 nt, Human
cgcccuuccucuc

SEQ ID NO: 2557662 - RNA, 12 nt, Human
cgcccuuccucu

SEQ ID NO: 2557663 - RNA, 15 nt, Human
cgcccuuaccuuccc

SEQ ID NO: 2557664 - RNA, 22 nt, Human
cgcccugggcucgucuuugcag

SEQ ID NO: 2557665 - RNA, 21 nt, Human
cgcccugggcucgucuuugca

SEQ ID NO: 2557666 - RNA, 19 nt, Human
cgcgccaaauaaugucucu

SEQ ID NO: 2557667 - RNA, 23 nt, Human
cgcgccaaauaaugucucuguga

SEQ ID NO: 2557668 - RNA, 21 nt, Human
cgcgccaaauaaugucucugu

SEQ ID NO: 2557669 - RNA, 16 nt, Human
cgcccuggacugugug

SEQ ID NO: 2557670 - RNA, 22 nt, Human
cgcccuggaagccggcggccca

SEQ ID NO: 2557671 - RNA, 16 nt, Human
cgcccuggaagccggc

SEQ ID NO: 2557672 - RNA, 12 nt, Human
cgcccugggcuc

SEQ ID NO: 2557673 - RNA, 13 nt, Human
cgcccuggaagcc

SEQ ID NO: 2557674 - RNA, 12 nt, Human
cgcccuggaagc

SEQ ID NO: 2557675 - RNA, 21 nt, Human
cgcccugcuccucccuggcug

SEQ ID NO: 2557676 - RNA, 18 nt, Human
cgcccugcuccucccugg

SEQ ID NO: 2557677 - RNA, 17 nt, Human
cgcccugcuccucccug

SEQ ID NO: 2557678 - RNA, 15 nt, Human
cgcccugcuccuccc

SEQ ID NO: 2557679 - RNA, 14 nt, Human
cgccccugccaccu

SEQ ID NO: 2557680 - RNA, 21 nt, Human
cgccccucccacagcgcuggc

SEQ ID NO: 2557681 - RNA, 21 nt, Human
cgccccucauuuaucccucaa

SEQ ID NO: 2557682 - RNA, 19 nt, Human
cgccccucccacagcgcug

SEQ ID NO: 2557683 - RNA, 17 nt, Human
cgccccgccccacauuc

SEQ ID NO: 2557684 - RNA, 13 nt, Human
cgccccgccccac

SEQ ID NO: 2557685 - RNA, 14 nt, Human
cgccccgccccaca

SEQ ID NO: 2557686 - RNA, 12 nt, Human
cgcccagucugg

SEQ ID NO: 2557687 - RNA, 14 nt, Human
cgcccccugcccuc

SEQ ID NO: 2557688 - RNA, 16 nt, Human
cgcccaguccuuccac

SEQ ID NO: 2557689 - RNA, 19 nt, Human
cgcccccugcccuccccuc

SEQ ID NO: 2557690 - RNA, 15 nt, Human
cgcccccugcccucc

SEQ ID NO: 2557691 - RNA, 22 nt, Human
cgcccaggcuuagucacugaga

SEQ ID NO: 2557692 - RNA, 15 nt, Human
cgcccaguccuucca

SEQ ID NO: 2557693 - RNA, 14 nt, Human
cgcccaguccuucc

SEQ ID NO: 2557694 - RNA, 22 nt, Human
cgcccaggcuggccagccccac

SEQ ID NO: 2557695 - RNA, 20 nt, Human
cgcccaggcuggccagcccc

SEQ ID NO: 2557696 - RNA, 19 nt, Human
cgcccaggcuggccagccc

SEQ ID NO: 2557697 - RNA, 17 nt, Human
cgcccaggcuggccagc

SEQ ID NO: 2557698 - RNA, 16 nt, Human
cgcccaggcuggccag

SEQ ID NO: 2557699 - RNA, 15 nt, Human
cgcccaggcuggcca

SEQ ID NO: 2557700 - RNA, 20 nt, Human
cgcccaggcuggagugcagu

SEQ ID NO: 2557701 - RNA, 22 nt, Human
cgcccagagacccaagcugccu

SEQ ID NO: 2557702 - RNA, 22 nt, Human
cgcccacuguccugggcgcccu

SEQ ID NO: 2557703 - RNA, 16 nt, Human
cuccuccuucccaaag

SEQ ID NO: 2557704 - RNA, 12 nt, Human
cuccuccuuccc

SEQ ID NO: 2557705 - RNA, 17 nt, Human
cuccucccggugcccaa

SEQ ID NO: 2557706 - RNA, 15 nt, Human
cuccucccggugccc

SEQ ID NO: 2557707 - RNA, 17 nt, Human
cuccuccccaaaucaau

SEQ ID NO: 2557708 - RNA, 14 nt, Human
cuccuccccaaauc

SEQ ID NO: 2557709 - RNA, 15 nt, Human
cuccucccauguuau

SEQ ID NO: 2557710 - RNA, 14 nt, Human
cuccucccggugcc

SEQ ID NO: 2557711 - RNA, 19 nt, Human
cuccuccuuggugccuggc

SEQ ID NO: 2557712 - RNA, 22 nt, Human
cuccucuccccagcaagugaga

SEQ ID NO: 2557713 - RNA, 15 nt, Human
cuccucuccccagcc

SEQ ID NO: 2557714 - RNA, 15 nt, Human
cuccucgcaagcugg

SEQ ID NO: 2557715 - RNA, 16 nt, Human
cuccucgcaagcuggg

SEQ ID NO: 2557716 - RNA, 17 nt, Human
cuccucgagggcaggga

SEQ ID NO: 2557717 - RNA, 15 nt, Human
cuccucgagggcagg

SEQ ID NO: 2557718 - RNA, 21 nt, Human
cuccucgagggcagggacuuu

SEQ ID NO: 2557719 - RNA, 14 nt, Human
cuccucgcaagcug

SEQ ID NO: 2557720 - RNA, 19 nt, Human
cuccuccaccgccauggcu

SEQ ID NO: 2557721 - RNA, 18 nt, Human
cuccuccaccgccauggc

SEQ ID NO: 2557722 - RNA, 16 nt, Human
cuccuccaccgccaug

SEQ ID NO: 2557723 - RNA, 15 nt, Human
cuccuccaccgccau

SEQ ID NO: 2557724 - RNA, 13 nt, Human
cuccuccaccgcc

SEQ ID NO: 2557725 - RNA, 18 nt, Human
cuccuccaaaggcccccu

SEQ ID NO: 2557726 - RNA, 14 nt, Human
cuccuccaaaggcc

SEQ ID NO: 2557727 - RNA, 22 nt, Human
cuccuccagccgccaugcuccu

SEQ ID NO: 2557728 - RNA, 20 nt, Human
cuccucauguacauacccug

SEQ ID NO: 2557729 - RNA, 11 nt, Human
cuccucaugua

SEQ ID NO: 2557730 - RNA, 15 nt, Human
cuccucaucccgugu

SEQ ID NO: 2557731 - RNA, 14 nt, Human
cuccucaucucuaa

SEQ ID NO: 2557732 - RNA, 21 nt, Human
cuccuccaagacacuguggac

SEQ ID NO: 2557733 - RNA, 15 nt, Human
cuccuccaaaggaag

SEQ ID NO: 2557734 - RNA, 18 nt, Human
cuccuccaaaggaagucu

SEQ ID NO: 2557735 - RNA, 23 nt, Human
cuccuccaaaggaagucuaggag

SEQ ID NO: 2557736 - RNA, 22 nt, Human
cuccuccaccgccauggcuucc

SEQ ID NO: 2557737 - RNA, 16 nt, Human
cuccuccacucucccc

SEQ ID NO: 2557738 - RNA, 11 nt, Human
cuccuccaggg

SEQ ID NO: 2557739 - RNA, 13 nt, Human
cuccuccagggcc

SEQ ID NO: 2557740 - RNA, 15 nt, Human
cuccuccaugggaga

SEQ ID NO: 2557741 - RNA, 18 nt, Human
cuccuccaugggagaaaa

SEQ ID NO: 2557742 - RNA, 13 nt, Human
cuccuccagggug

SEQ ID NO: 2557743 - RNA, 14 nt, Human
cuccuccagggcca

SEQ ID NO: 2557744 - RNA, 19 nt, Human
cuccuccagggccacgugc

SEQ ID NO: 2557745 - RNA, 20 nt, Human
cuccuccagggccacgugcc

SEQ ID NO: 2557746 - RNA, 22 nt, Human
cuccuccagggccacgugccag

SEQ ID NO: 2557747 - RNA, 16 nt, Human
cuccgcccugccacuc

SEQ ID NO: 2557748 - RNA, 15 nt, Human
cuccgcccugccacu

SEQ ID NO: 2557749 - RNA, 17 nt, Human
cuccgcccugccacuca

SEQ ID NO: 2557750 - RNA, 14 nt, Human
cuccgcccugccac

SEQ ID NO: 2557751 - RNA, 13 nt, Human
cuccgcccugcca

SEQ ID NO: 2557752 - RNA, 23 nt, Human
cuccgccaggcgagauggggugg

SEQ ID NO: 2557753 - RNA, 21 nt, Human
cuccgccagccuccucuggac

SEQ ID NO: 2557754 - RNA, 13 nt, Human
cuccgccaggcga

SEQ ID NO: 2557755 - RNA, 20 nt, Human
cuccgccagccuccucugga

SEQ ID NO: 2557756 - RNA, 18 nt, Human
cuccgccagccuccucug

SEQ ID NO: 2557757 - RNA, 15 nt, Human
cuccgccagccuccu

SEQ ID NO: 2557758 - RNA, 23 nt, Human
cuccgccauucucaagcccugca

SEQ ID NO: 2557759 - RNA, 17 nt, Human
cuccucacccccagcuu

SEQ ID NO: 2557760 - RNA, 15 nt, Human
cuccucacccccagc

SEQ ID NO: 2557761 - RNA, 20 nt, Human
cuccucacccccagcuuugc

SEQ ID NO: 2557762 - RNA, 21 nt, Human
cuccucacccccagcuuugcu

SEQ ID NO: 2557763 - RNA, 19 nt, Human
cuccucaccucaugcccac

SEQ ID NO: 2557764 - RNA, 17 nt, Human
cuccucaccucaugccc

SEQ ID NO: 2557765 - RNA, 16 nt, Human
cuccucaccucaugcc

SEQ ID NO: 2557766 - RNA, 15 nt, Human
cuccucaccucaugc

SEQ ID NO: 2557767 - RNA, 14 nt, Human
cuccucaccucaug

SEQ ID NO: 2557768 - RNA, 12 nt, Human
cuccucaccuca

SEQ ID NO: 2557769 - RNA, 15 nt, Human
cuccucaccccgucu

SEQ ID NO: 2557770 - RNA, 18 nt, Human
cuccucaccccgucuggg

SEQ ID NO: 2557771 - RNA, 12 nt, Human
cuccucaucccg

SEQ ID NO: 2557772 - RNA, 20 nt, Human
cuccucaccucaugcccacc

SEQ ID NO: 2557773 - RNA, 22 nt, Human
cuccucaccucuggacuggcua

SEQ ID NO: 2557774 - RNA, 18 nt, Human
cuccucaccucuggacug

SEQ ID NO: 2557775 - RNA, 21 nt, Human
cuccucaccucuggacuggcu

SEQ ID NO: 2557776 - RNA, 13 nt, Human
cuccucaccucug

SEQ ID NO: 2557777 - RNA, 14 nt, Human
cuccucaccucugg

SEQ ID NO: 2557778 - RNA, 15 nt, Human
cuccucaccucugga

SEQ ID NO: 2557779 - RNA, 16 nt, Human
cuccucaccucuggac

SEQ ID NO: 2557780 - RNA, 19 nt, Human
cucccuauuuuuuuucugu

SEQ ID NO: 2557781 - RNA, 20 nt, Human
cucccuauuuuuuuucuguu

SEQ ID NO: 2557782 - RNA, 14 nt, Human
cucccucagugccc

SEQ ID NO: 2557783 - RNA, 23 nt, Human
cucccucagugcccucauuuuau

SEQ ID NO: 2557784 - RNA, 13 nt, Human
cucccucauucca

SEQ ID NO: 2557785 - RNA, 17 nt, Human
cucccuuucuucccuac

SEQ ID NO: 2557786 - RNA, 23 nt, Human
cucccuuuuuccuuguccccaca

SEQ ID NO: 2557787 - RNA, 22 nt, Human
cucccuuuuuccuuguccccac

SEQ ID NO: 2557788 - RNA, 22 nt, Human
cuccgaacacccucgaagcgcg

SEQ ID NO: 2557789 - RNA, 15 nt, Human
cuccgaccagacacc

SEQ ID NO: 2557790 - RNA, 14 nt, Human
cucccuuuuuauau

SEQ ID NO: 2557791 - RNA, 22 nt, Human
cucccucauuucaggagcagcc

SEQ ID NO: 2557792 - RNA, 14 nt, Human
cucccuuugaaaug

SEQ ID NO: 2557793 - RNA, 21 nt, Human
cucccuuuuuccuugucccca

SEQ ID NO: 2557794 - RNA, 20 nt, Human
cucccuuuuuccuugucccc

SEQ ID NO: 2557795 - RNA, 18 nt, Human
cucccuuuuuccuugucc

SEQ ID NO: 2557796 - RNA, 16 nt, Human
cucccuuuuuccuugu

SEQ ID NO: 2557797 - RNA, 21 nt, Human
cucccuuuuuauaucccauuu

SEQ ID NO: 2557798 - RNA, 14 nt, Human
cuccugccucagcc

SEQ ID NO: 2557799 - RNA, 13 nt, Human
cuccugccucagc

SEQ ID NO: 2557800 - RNA, 11 nt, Human
cuccugcccuu

SEQ ID NO: 2557801 - RNA, 15 nt, Human
cuccugccgacuccu

SEQ ID NO: 2557802 - RNA, 13 nt, Human
cuccugcccuguu

SEQ ID NO: 2557803 - RNA, 12 nt, Human
cuccugcccugu

SEQ ID NO: 2557804 - RNA, 18 nt, Human
cuccugcccaguccccca

SEQ ID NO: 2557805 - RNA, 20 nt, Human
cuccugcaggcagccaggcc

SEQ ID NO: 2557806 - RNA, 18 nt, Human
cuccugcaggcagccagg

SEQ ID NO: 2557807 - RNA, 14 nt, Human
cuccugcagaccac

SEQ ID NO: 2557808 - RNA, 12 nt, Human
cuccugcccagg

SEQ ID NO: 2557809 - RNA, 13 nt, Human
cuccugcccagga

SEQ ID NO: 2557810 - RNA, 14 nt, Human
cuccugcccaggag

SEQ ID NO: 2557811 - RNA, 15 nt, Human
cuccugcccaggaga

SEQ ID NO: 2557812 - RNA, 17 nt, Human
cuccugcccaguccccc

SEQ ID NO: 2557813 - RNA, 15 nt, Human
cuccugcccaguccc

SEQ ID NO: 2557814 - RNA, 14 nt, Human
cuccugcccagucc

SEQ ID NO: 2557815 - RNA, 13 nt, Human
cuccugcccaguc

SEQ ID NO: 2557816 - RNA, 16 nt, Human
cuccugcccaggagag

SEQ ID NO: 2557817 - RNA, 17 nt, Human
cuccugcccaggagagc

SEQ ID NO: 2557818 - RNA, 20 nt, Human
cuccugcccaggagagccag

SEQ ID NO: 2557819 - RNA, 22 nt, Human
cuccugcccaggagagccagcc

SEQ ID NO: 2557820 - RNA, 17 nt, Human
cuccugcaggcagccag

SEQ ID NO: 2557821 - RNA, 16 nt, Human
cuccugcaggcagcca

SEQ ID NO: 2557822 - RNA, 22 nt, Human
cuccugcacuuacuugcuuauu

SEQ ID NO: 2557823 - RNA, 20 nt, Human
cuccugcacuuacuugcuua

SEQ ID NO: 2557824 - RNA, 19 nt, Human
cuccugcacuuacuugcuu

SEQ ID NO: 2557825 - RNA, 18 nt, Human
cuccugcacuuacuugcu

SEQ ID NO: 2557826 - RNA, 11 nt, Human
cuccugcaggc

SEQ ID NO: 2557827 - RNA, 17 nt, Human
cuccucuccccagccca

SEQ ID NO: 2557828 - RNA, 18 nt, Human
cuccucuccccagcccag

SEQ ID NO: 2557829 - RNA, 19 nt, Human
cuccucuccccagcccaga

SEQ ID NO: 2557830 - RNA, 20 nt, Human
cuccucuccccagcccagag

SEQ ID NO: 2557831 - RNA, 21 nt, Human
cuccucuccccagcccagaga

SEQ ID NO: 2557832 - RNA, 22 nt, Human
cuccucuccccagcccagagac

SEQ ID NO: 2557833 - RNA, 14 nt, Human
cuccucuccccuac

SEQ ID NO: 2557834 - RNA, 12 nt, Human
cuccucuccccu

SEQ ID NO: 2557835 - RNA, 23 nt, Human
cuccucuccccagcccagagaca

SEQ ID NO: 2557836 - RNA, 17 nt, Human
cuccugcacuuacuugc

SEQ ID NO: 2557837 - RNA, 15 nt, Human
cuccugcacuuacuu

SEQ ID NO: 2557838 - RNA, 14 nt, Human
cuccucuccccucu

SEQ ID NO: 2557839 - RNA, 18 nt, Human
cuccucuccccuaccacu

SEQ ID NO: 2557840 - RNA, 17 nt, Human
cuccucuccccuaccac

SEQ ID NO: 2557841 - RNA, 15 nt, Human
cuccucuccccucua

SEQ ID NO: 2557842 - RNA, 20 nt, Human
cuccuguggccccacccugg

SEQ ID NO: 2557843 - RNA, 19 nt, Human
cuccuguggccccacccug

SEQ ID NO: 2557844 - RNA, 15 nt, Human
cuccugugcuuuccc

SEQ ID NO: 2557845 - RNA, 13 nt, Human
cuccuguggcccc

SEQ ID NO: 2557846 - RNA, 20 nt, Human
cuccugugcuacuuugccuu

SEQ ID NO: 2557847 - RNA, 11 nt, Human
cuccugugcua

SEQ ID NO: 2557848 - RNA, 16 nt, Human
cuccugugcaugggug

SEQ ID NO: 2557849 - RNA, 17 nt, Human
cuccugugcaacuuucc

SEQ ID NO: 2557850 - RNA, 13 nt, Human
cuccugugcccuu

SEQ ID NO: 2557851 - RNA, 12 nt, Human
cuccugugcccu

SEQ ID NO: 2557852 - RNA, 22 nt, Human
cuccugugcccacaucccaggc

SEQ ID NO: 2557853 - RNA, 21 nt, Human
cuccugugcccacaucccagg

SEQ ID NO: 2557854 - RNA, 14 nt, Human
cuccugugcccaca

SEQ ID NO: 2557855 - RNA, 11 nt, Human
cuccugugccc

SEQ ID NO: 2557856 - RNA, 17 nt, Human
cuccugugcauggguga

SEQ ID NO: 2557857 - RNA, 20 nt, Human
cuccugugcaugggugaagg

SEQ ID NO: 2557858 - RNA, 22 nt, Human
cuccuguggccccacccugggc

SEQ ID NO: 2557859 - RNA, 21 nt, Human
cuccuguggccccacccuggg

SEQ ID NO: 2557860 - RNA, 13 nt, Human
cuccuguguacag

SEQ ID NO: 2557861 - RNA, 11 nt, Human
cuccuguguaa

SEQ ID NO: 2557862 - RNA, 19 nt, Human
cuccugugugugcgccuac

SEQ ID NO: 2557863 - RNA, 16 nt, Human
cuccugugugugcgcc

SEQ ID NO: 2557864 - RNA, 21 nt, Human
cuccugucuucccaggguagc

SEQ ID NO: 2557865 - RNA, 19 nt, Human
cuccugucuucccagggua

SEQ ID NO: 2557866 - RNA, 18 nt, Human
cuccugucuucccagggu

SEQ ID NO: 2557867 - RNA, 17 nt, Human
cuccugucuucccaggg

SEQ ID NO: 2557868 - RNA, 15 nt, Human
cuccugucuucccag

SEQ ID NO: 2557869 - RNA, 14 nt, Human
cuccugucuuccca

SEQ ID NO: 2557870 - RNA, 10 nt, Human
cuccugucuu

SEQ ID NO: 2557871 - RNA, 17 nt, Human
cuccugucugccagcca

SEQ ID NO: 2557872 - RNA, 19 nt, Human
cuccugucugccagccagc

SEQ ID NO: 2557873 - RNA, 22 nt, Human
cuccugucugccagccagcagc

SEQ ID NO: 2557874 - RNA, 23 nt, Human
cuccugucugccagccagcagcc

SEQ ID NO: 2557875 - RNA, 18 nt, Human
cuccugccuuccuccugg

SEQ ID NO: 2557876 - RNA, 19 nt, Human
cuccugccuuccuccuggg

SEQ ID NO: 2557877 - RNA, 20 nt, Human
cuccugccuuccuccugggc

SEQ ID NO: 2557878 - RNA, 16 nt, Human
cuccugccuucugucc

SEQ ID NO: 2557879 - RNA, 22 nt, Human
cuccugccuucuguccuggugu

SEQ ID NO: 2557880 - RNA, 21 nt, Human
cuccugccuucuguccuggug

SEQ ID NO: 2557881 - RNA, 17 nt, Human
cuccugcgcgcaugugc

SEQ ID NO: 2557882 - RNA, 15 nt, Human
cuccugccucagccu

SEQ ID NO: 2557883 - RNA, 17 nt, Human
cuccugccugccccucu

SEQ ID NO: 2557884 - RNA, 14 nt, Human
cuccugccugcccc

SEQ ID NO: 2557885 - RNA, 17 nt, Human
cuccugccgacuccugg

SEQ ID NO: 2557886 - RNA, 16 nt, Human
cuccugccgacuccug

SEQ ID NO: 2557887 - RNA, 18 nt, Human
cuccugccuguagcagug

SEQ ID NO: 2557888 - RNA, 16 nt, Human
cuccugccuguagcag

SEQ ID NO: 2557889 - RNA, 15 nt, Human
cuccugccuguagca

SEQ ID NO: 2557890 - RNA, 14 nt, Human
cuccugccuguagc

SEQ ID NO: 2557891 - RNA, 16 nt, Human
cuccugccuuccuccu

SEQ ID NO: 2557892 - RNA, 19 nt, Human
cuccugccuguagcaguga

SEQ ID NO: 2557893 - RNA, 23 nt, Human
cucccuaucuaacccucccaugg

SEQ ID NO: 2557894 - RNA, 17 nt, Human
cucccuauuuuuuuucu

SEQ ID NO: 2557895 - RNA, 21 nt, Human
cucccuagugacccggaggcc

SEQ ID NO: 2557896 - RNA, 21 nt, Human
cucccuagccagcacuuguau

SEQ ID NO: 2557897 - RNA, 22 nt, Human
cucccuaccaccuccccagccu

SEQ ID NO: 2557898 - RNA, 23 nt, Human
cucccuagugacccggaggccac

SEQ ID NO: 2557899 - RNA, 22 nt, Human
cucccuagugacccggaggcca

SEQ ID NO: 2557900 - RNA, 16 nt, Human
cucccggcguggugga

SEQ ID NO: 2557901 - RNA, 20 nt, Human
cucccggcuaugggggcacu

SEQ ID NO: 2557902 - RNA, 13 nt, Human
cucccuaccaccu

SEQ ID NO: 2557903 - RNA, 14 nt, Human
cucccuaccaccuc

SEQ ID NO: 2557904 - RNA, 15 nt, Human
cucccuaccaccucc

SEQ ID NO: 2557905 - RNA, 14 nt, Human
cucccggcacucca

SEQ ID NO: 2557906 - RNA, 17 nt, Human
cucccgcugcugcugcu

SEQ ID NO: 2557907 - RNA, 20 nt, Human
cucccggagguugggugggc

SEQ ID NO: 2557908 - RNA, 19 nt, Human
cucccggagguuggguggg

SEQ ID NO: 2557909 - RNA, 15 nt, Human
cucccggagggcccu

SEQ ID NO: 2557910 - RNA, 17 nt, Human
cucccggcaugggaaag

SEQ ID NO: 2557911 - RNA, 18 nt, Human
cucccggcacuccaugcu

SEQ ID NO: 2557912 - RNA, 19 nt, Human
cucccggcaugggaaagcc

SEQ ID NO: 2557913 - RNA, 12 nt, Human
cucccggcgugg

SEQ ID NO: 2557914 - RNA, 16 nt, Human
cucccgcugcugcugc

SEQ ID NO: 2557915 - RNA, 15 nt, Human
cucccgcugcugcug

SEQ ID NO: 2557916 - RNA, 14 nt, Human
cucccgcugcugcu

SEQ ID NO: 2557917 - RNA, 13 nt, Human
cucccgcugcugc

SEQ ID NO: 2557918 - RNA, 18 nt, Human
cuccccugcugcaggggc

SEQ ID NO: 2557919 - RNA, 20 nt, Human
cucccgcugcccaggggagc

SEQ ID NO: 2557920 - RNA, 18 nt, Human
cucccgaguagcugggac

SEQ ID NO: 2557921 - RNA, 17 nt, Human
cucccgaguagcuggga

SEQ ID NO: 2557922 - RNA, 16 nt, Human
cucccgaguagcuggg

SEQ ID NO: 2557923 - RNA, 18 nt, Human
cucccgaauagcugggac

SEQ ID NO: 2557924 - RNA, 15 nt, Human
cucccgaguagcugg

SEQ ID NO: 2557925 - RNA, 16 nt, Human
cuccccugcugcaggg

SEQ ID NO: 2557926 - RNA, 15 nt, Human
cuccccugcugcagg

SEQ ID NO: 2557927 - RNA, 13 nt, Human
cuccccugcugca

SEQ ID NO: 2557928 - RNA, 16 nt, Human
cuccccugcugaaggu

SEQ ID NO: 2557929 - RNA, 13 nt, Human
cuccccugcuggg

SEQ ID NO: 2557930 - RNA, 16 nt, Human
cucccgaauagcuggg

SEQ ID NO: 2557931 - RNA, 17 nt, Human
cucccgaauagcuggga

SEQ ID NO: 2557932 - RNA, 20 nt, Human
cucccaucugggaguccccu

SEQ ID NO: 2557933 - RNA, 15 nt, Human
cucccaucugggagu

SEQ ID NO: 2557934 - RNA, 13 nt, Human
cucccaucuggga

SEQ ID NO: 2557935 - RNA, 12 nt, Human
cucccaucuggg

SEQ ID NO: 2557936 - RNA, 22 nt, Human
cucccaucugggaguccccuuu

SEQ ID NO: 2557937 - RNA, 16 nt, Human
cucccaugaccauacu

SEQ ID NO: 2557938 - RNA, 21 nt, Human
cucccaugaccauacugaggg

SEQ ID NO: 2557939 - RNA, 21 nt, Human
cuccccaaaucaauacacuag

SEQ ID NO: 2557940 - RNA, 12 nt, Human
cucccauuucua

SEQ ID NO: 2557941 - RNA, 14 nt, Human
cucccauuuccuga

SEQ ID NO: 2557942 - RNA, 16 nt, Human
cucccauuucuacucu

SEQ ID NO: 2557943 - RNA, 14 nt, Human
cucccauuucuacu

SEQ ID NO: 2557944 - RNA, 12 nt, Human
cuccccaaaaac

SEQ ID NO: 2557945 - RNA, 21 nt, Human
cuccccacacuaaccuggguu

SEQ ID NO: 2557946 - RNA, 20 nt, Human
cuccccaacccugccccugc

SEQ ID NO: 2557947 - RNA, 17 nt, Human
cuccccaacccugcccc

SEQ ID NO: 2557948 - RNA, 19 nt, Human
cuccccaacccugccccug

SEQ ID NO: 2557949 - RNA, 12 nt, Human
cuccccaacccu

SEQ ID NO: 2557950 - RNA, 14 nt, Human
cuccccaacccugc

SEQ ID NO: 2557951 - RNA, 15 nt, Human
cuccccaacccugcc

SEQ ID NO: 2557952 - RNA, 19 nt, Human
cuccccacugccuacugca

SEQ ID NO: 2557953 - RNA, 16 nt, Human
cuccccacugccuacu

SEQ ID NO: 2557954 - RNA, 12 nt, Human
cuccccagcaag

SEQ ID NO: 2557955 - RNA, 17 nt, Human
cuccccagccccuagcc

SEQ ID NO: 2557956 - RNA, 15 nt, Human
cuccccagccccuag

SEQ ID NO: 2557957 - RNA, 13 nt, Human
cuccccagccccu

SEQ ID NO: 2557958 - RNA, 20 nt, Human
cuccccagaguuccccaugc

SEQ ID NO: 2557959 - RNA, 17 nt, Human
cuccccagagcacuggg

SEQ ID NO: 2557960 - RNA, 16 nt, Human
cuccccagagcacugg

SEQ ID NO: 2557961 - RNA, 15 nt, Human
cuccccagagcacug

SEQ ID NO: 2557962 - RNA, 13 nt, Human
cuccccagcccug

SEQ ID NO: 2557963 - RNA, 22 nt, Human
cuccccagccccuagcccagga

SEQ ID NO: 2557964 - RNA, 21 nt, Human
cuccccagccccuagcccagg

SEQ ID NO: 2557965 - RNA, 19 nt, Human
cuccccagccccuagccca

SEQ ID NO: 2557966 - RNA, 16 nt, Human
cuccccagcccuggcu

SEQ ID NO: 2557967 - RNA, 15 nt, Human
cuccccagcccuggc

SEQ ID NO: 2557968 - RNA, 20 nt, Human
cuccccagcaagugagagcu

SEQ ID NO: 2557969 - RNA, 20 nt, Human
cuccccagccccaucccaaa

SEQ ID NO: 2557970 - RNA, 12 nt, Human
cuccccugcugg

SEQ ID NO: 2557971 - RNA, 15 nt, Human
cuccccugcccugcu

SEQ ID NO: 2557972 - RNA, 16 nt, Human
cuccccugcccugcug

SEQ ID NO: 2557973 - RNA, 14 nt, Human
cuccccugcccugg

SEQ ID NO: 2557974 - RNA, 12 nt, Human
cuccccagcuca

SEQ ID NO: 2557975 - RNA, 17 nt, Human
cuccccaggccaggcca

SEQ ID NO: 2557976 - RNA, 15 nt, Human
cuccccaggccaggc

SEQ ID NO: 2557977 - RNA, 12 nt, Human
cuccccaggcca

SEQ ID NO: 2557978 - RNA, 21 nt, Human
cuccccaggccaggccaccag

SEQ ID NO: 2557979 - RNA, 21 nt, Human
cuccccaggccguggcugccc

SEQ ID NO: 2557980 - RNA, 23 nt, Human
cucacuauggugccaauggaacc

SEQ ID NO: 2557981 - RNA, 17 nt, Human
cucacuauggugccaau

SEQ ID NO: 2557982 - RNA, 18 nt, Human
cucacuauguugcccagg

SEQ ID NO: 2557983 - RNA, 15 nt, Human
cucacuauggugcca

SEQ ID NO: 2557984 - RNA, 22 nt, Human
cucacuaugaaucuauuauacu

SEQ ID NO: 2557985 - RNA, 17 nt, Human
cucacuauccuacccca

SEQ ID NO: 2557986 - RNA, 11 nt, Human
cuccauccuga

SEQ ID NO: 2557987 - RNA, 16 nt, Human
cuccauccugaggcuc

SEQ ID NO: 2557988 - RNA, 18 nt, Human
cuccauccugaggcucca

SEQ ID NO: 2557989 - RNA, 14 nt, Human
cuccaucuccacuc

SEQ ID NO: 2557990 - RNA, 12 nt, Human
cuccaucucucu

SEQ ID NO: 2557991 - RNA, 16 nt, Human
cuccaucuccacucca

SEQ ID NO: 2557992 - RNA, 17 nt, Human
cuccaucucucuggccc

SEQ ID NO: 2557993 - RNA, 16 nt, Human
cuccaucucucuggcc

SEQ ID NO: 2557994 - RNA, 15 nt, Human
cuccaucucucuggc

SEQ ID NO: 2557995 - RNA, 13 nt, Human
cuccaucucucug

SEQ ID NO: 2557996 - RNA, 18 nt, Human
cuccaucucucuggcccu

SEQ ID NO: 2557997 - RNA, 16 nt, Human
cuccaucuggcagggu

SEQ ID NO: 2557998 - RNA, 13 nt, Human
cuccaugagcacc

SEQ ID NO: 2557999 - RNA, 21 nt, Human
cuccaugagacacaucuccuc

SEQ ID NO: 2558000 - RNA, 17 nt, Human
cuccaugaguuuuuucu

SEQ ID NO: 2558001 - RNA, 17 nt, Human
cuccaucuucuuugcag

SEQ ID NO: 2558002 - RNA, 16 nt, Human
cuccaucuucuuugca

SEQ ID NO: 2558003 - RNA, 19 nt, Human
cuccaucuucagcuucuuc

SEQ ID NO: 2558004 - RNA, 17 nt, Human
cuccaucuucagcuucu

SEQ ID NO: 2558005 - RNA, 12 nt, Human
cuccaucuguuu

SEQ ID NO: 2558006 - RNA, 12 nt, Human
cuccaucuuauu

SEQ ID NO: 2558007 - RNA, 21 nt, Human
cuccauggcuuccuccucccu

SEQ ID NO: 2558008 - RNA, 20 nt, Human
cuccauggcuuccuccuccc

SEQ ID NO: 2558009 - RNA, 19 nt, Human
cuccauggcuuccuccucc

SEQ ID NO: 2558010 - RNA, 18 nt, Human
cuccauggcuuccuccuc

SEQ ID NO: 2558011 - RNA, 17 nt, Human
cuccauggcuuccuccu

SEQ ID NO: 2558012 - RNA, 16 nt, Human
cuccauggcuuccucc

SEQ ID NO: 2558013 - RNA, 15 nt, Human
cuccauggcuuccuc

SEQ ID NO: 2558014 - RNA, 13 nt, Human
cuccaugucucug

SEQ ID NO: 2558015 - RNA, 22 nt, Human
cuccaugucucugagcauuaga

SEQ ID NO: 2558016 - RNA, 13 nt, Human
cuccaugugggcu

SEQ ID NO: 2558017 - RNA, 17 nt, Human
cucccaaagugcuggga

SEQ ID NO: 2558018 - RNA, 22 nt, Human
cucccaacucaccccagcccca

SEQ ID NO: 2558019 - RNA, 19 nt, Human
cucccaggggcuggcuuca

SEQ ID NO: 2558020 - RNA, 21 nt, Human
cucccaaggcugcgucuggag

SEQ ID NO: 2558021 - RNA, 18 nt, Human
cucccaaggcugcgucug

SEQ ID NO: 2558022 - RNA, 22 nt, Human
cucccagggccagggcccugca

SEQ ID NO: 2558023 - RNA, 23 nt, Human
cucccagggccagggcccugcag

SEQ ID NO: 2558024 - RNA, 17 nt, Human
cucccaacucaccccag

SEQ ID NO: 2558025 - RNA, 16 nt, Human
cucccaacucacccca

SEQ ID NO: 2558026 - RNA, 18 nt, Human
cucccaaagugcugggau

SEQ ID NO: 2558027 - RNA, 22 nt, Human
cucccaaagugcugggauuaca

SEQ ID NO: 2558028 - RNA, 23 nt, Human
cucccaucugugaaaggaaagag

SEQ ID NO: 2558029 - RNA, 18 nt, Human
cucccaucugugaaagga

SEQ ID NO: 2558030 - RNA, 15 nt, Human
cucccaucugugaaa

SEQ ID NO: 2558031 - RNA, 14 nt, Human
cucccaucugugaa

SEQ ID NO: 2558032 - RNA, 11 nt, Human
cucccaucugu

SEQ ID NO: 2558033 - RNA, 21 nt, Human
cucccaucucacacaugagca

SEQ ID NO: 2558034 - RNA, 11 nt, Human
cucccaucugg

SEQ ID NO: 2558035 - RNA, 24 nt, Human
cucccagguaccagcugcgcuugc

SEQ ID NO: 2558036 - RNA, 16 nt, Human
cucccagguaccagcu

SEQ ID NO: 2558037 - RNA, 19 nt, Human
cucccagguaccagcugcg

SEQ ID NO: 2558038 - RNA, 18 nt, Human
cucccagguaccagcugc

SEQ ID NO: 2558039 - RNA, 17 nt, Human
cucccagguaccagcug

SEQ ID NO: 2558040 - RNA, 22 nt, Human
cucccagguaccagcugcgcuu

SEQ ID NO: 2558041 - RNA, 21 nt, Human
cucccagguaccagcugcgcu

SEQ ID NO: 2558042 - RNA, 17 nt, Human
cuccuucacagaugggu

SEQ ID NO: 2558043 - RNA, 16 nt, Human
cuccuucacagauggg

SEQ ID NO: 2558044 - RNA, 14 nt, Human
cuccugugugugcg

SEQ ID NO: 2558045 - RNA, 14 nt, Human
cuccuguguacagg

SEQ ID NO: 2558046 - RNA, 18 nt, Human
cuccuguguagcugggau

SEQ ID NO: 2558047 - RNA, 20 nt, Human
cuccugugugugcgccuaca

SEQ ID NO: 2558048 - RNA, 19 nt, Human
cuccuucacagaugggugc

SEQ ID NO: 2558049 - RNA, 13 nt, Human
cucgcugccagcu

SEQ ID NO: 2558050 - RNA, 16 nt, Human
cucgcugccagcucug

SEQ ID NO: 2558051 - RNA, 13 nt, Human
cuccuucaccuuu

SEQ ID NO: 2558052 - RNA, 20 nt, Human
cucgcugcugcgcccugggc

SEQ ID NO: 2558053 - RNA, 19 nt, Human
cucgcugccagcucuguau

SEQ ID NO: 2558054 - RNA, 15 nt, Human
cucgcuggacucuca

SEQ ID NO: 2558055 - RNA, 16 nt, Human
cucgcuggacucucag

SEQ ID NO: 2558056 - RNA, 15 nt, Human
cucgcugcuucugug

SEQ ID NO: 2558057 - RNA, 12 nt, Human
cucgcuguugcu

SEQ ID NO: 2558058 - RNA, 19 nt, Human
cucgcuggacucucagucu

SEQ ID NO: 2558059 - RNA, 17 nt, Human
cucggcucacugcaucc

SEQ ID NO: 2558060 - RNA, 18 nt, Human
cucggcucacugcauccu

SEQ ID NO: 2558061 - RNA, 22 nt, Human
cucggcuccccauguguccugg

SEQ ID NO: 2558062 - RNA, 19 nt, Human
cucggcuccccaugugucc

SEQ ID NO: 2558063 - RNA, 14 nt, Human
cucggcucacugca

SEQ ID NO: 2558064 - RNA, 20 nt, Human
cucggaguaucugggaacug

SEQ ID NO: 2558065 - RNA, 21 nt, Human
cucggaguaucugggaacugu

SEQ ID NO: 2558066 - RNA, 15 nt, Human
cucggaggcugcccc

SEQ ID NO: 2558067 - RNA, 13 nt, Human
cucggaggcugcc

SEQ ID NO: 2558068 - RNA, 12 nt, Human
cucggaggcugc

SEQ ID NO: 2558069 - RNA, 18 nt, Human
cucggaggccccaaagga

SEQ ID NO: 2558070 - RNA, 17 nt, Human
cucggagggauuccccu

SEQ ID NO: 2558071 - RNA, 16 nt, Human
cucggaggcugccccc

SEQ ID NO: 2558072 - RNA, 17 nt, Human
cucggaguaucugggaa

SEQ ID NO: 2558073 - RNA, 19 nt, Human
cucgcuucccccauagcca

SEQ ID NO: 2558074 - RNA, 16 nt, Human
cucgcuucccccauag

SEQ ID NO: 2558075 - RNA, 18 nt, Human
cucgcuucccccauagcc

SEQ ID NO: 2558076 - RNA, 15 nt, Human
cucgcuguugcugaa

SEQ ID NO: 2558077 - RNA, 13 nt, Human
cucgcuguugcug

SEQ ID NO: 2558078 - RNA, 16 nt, Human
cucgcuguugcugaau

SEQ ID NO: 2558079 - RNA, 14 nt, Human
cucgcuucccccau

SEQ ID NO: 2558080 - RNA, 15 nt, Human
cucggaggccccaaa

SEQ ID NO: 2558081 - RNA, 13 nt, Human
cucggaggcccca

SEQ ID NO: 2558082 - RNA, 12 nt, Human
cucggaggcccc

SEQ ID NO: 2558083 - RNA, 13 nt, Human
cucggaggaagcc

SEQ ID NO: 2558084 - RNA, 17 nt, Human
cucggaggaagccccca

SEQ ID NO: 2558085 - RNA, 13 nt, Human
cucggagccucau

SEQ ID NO: 2558086 - RNA, 16 nt, Human
cucggagccucauccg

SEQ ID NO: 2558087 - RNA, 22 nt, Human
cucggagccucauccgaggcag

SEQ ID NO: 2558088 - RNA, 23 nt, Human
cucggagccucauccgaggcagg

SEQ ID NO: 2558089 - RNA, 16 nt, Human
cucuacagaggccaug

SEQ ID NO: 2558090 - RNA, 14 nt, Human
cucuacagaggcca

SEQ ID NO: 2558091 - RNA, 15 nt, Human
cucuacaucuucugc

SEQ ID NO: 2558092 - RNA, 23 nt, Human
cucuacagagcuucccugacuca

SEQ ID NO: 2558093 - RNA, 21 nt, Human
cucuacagcuaaucagcauuc

SEQ ID NO: 2558094 - RNA, 19 nt, Human
cucuacagaggccaugggc

SEQ ID NO: 2558095 - RNA, 17 nt, Human
cucuacaaacucccacu

SEQ ID NO: 2558096 - RNA, 16 nt, Human
cucuacaacugagucc

SEQ ID NO: 2558097 - RNA, 23 nt, Human
cucuacaacugaguccuuaaaca

SEQ ID NO: 2558098 - RNA, 17 nt, Human
cucuacaacugaguccu

SEQ ID NO: 2558099 - RNA, 14 nt, Human
cucuacacugugaa

SEQ ID NO: 2558100 - RNA, 16 nt, Human
cucuaauuuauuuugu

SEQ ID NO: 2558101 - RNA, 22 nt, Human
cucuaauuggaagaaauuccug

SEQ ID NO: 2558102 - RNA, 16 nt, Human
cucuacaaacucccac

SEQ ID NO: 2558103 - RNA, 20 nt, Human
cucuaauucccauuuugcaa

SEQ ID NO: 2558104 - RNA, 17 nt, Human
cucuaauuggaagaaau

SEQ ID NO: 2558105 - RNA, 17 nt, Human
cucuacagagcuucccu

SEQ ID NO: 2558106 - RNA, 18 nt, Human
cucuacagagcuucccug

SEQ ID NO: 2558107 - RNA, 20 nt, Human
cucuacagagcuucccugac

SEQ ID NO: 2558108 - RNA, 22 nt, Human
cucuacagagcuucccugacuc

SEQ ID NO: 2558109 - RNA, 13 nt, Human
cucuacagaggcc

SEQ ID NO: 2558110 - RNA, 21 nt, Human
cucuaaccccaggccccgagg

SEQ ID NO: 2558111 - RNA, 19 nt, Human
cucuaaccccaggccccga

SEQ ID NO: 2558112 - RNA, 15 nt, Human
cucuaacccuaggca

SEQ ID NO: 2558113 - RNA, 18 nt, Human
cucuaaccccaggccccg

SEQ ID NO: 2558114 - RNA, 17 nt, Human
cucuaaccccaggcccc

SEQ ID NO: 2558115 - RNA, 16 nt, Human
cucuaaccccaggccc

SEQ ID NO: 2558116 - RNA, 15 nt, Human
cucuaaccccaggcc

SEQ ID NO: 2558117 - RNA, 19 nt, Human
cucggcuccugcugcacca

SEQ ID NO: 2558118 - RNA, 17 nt, Human
cucggcuccugcugcac

SEQ ID NO: 2558119 - RNA, 16 nt, Human
cucggcuccugcugca

SEQ ID NO: 2558120 - RNA, 17 nt, Human
cucggcuuuucucagcu

SEQ ID NO: 2558121 - RNA, 15 nt, Human
cucggcuccugcugc

SEQ ID NO: 2558122 - RNA, 14 nt, Human
cucggcuccugcug

SEQ ID NO: 2558123 - RNA, 13 nt, Human
cucggcuccugcu

SEQ ID NO: 2558124 - RNA, 20 nt, Human
cucggaucaccgagaguagc

SEQ ID NO: 2558125 - RNA, 13 nt, Human
cucuacaaaaagc

SEQ ID NO: 2558126 - RNA, 20 nt, Human
cucuaggggucaggcuccau

SEQ ID NO: 2558127 - RNA, 17 nt, Human
cucuaggggucaggcuc

SEQ ID NO: 2558128 - RNA, 14 nt, Human
cucuagggcagugg

SEQ ID NO: 2558129 - RNA, 22 nt, Human
cucuagggagggacauggcccc

SEQ ID NO: 2558130 - RNA, 20 nt, Human
cucuagggaccccuccuccc

SEQ ID NO: 2558131 - RNA, 19 nt, Human
cucuagggaccccuccucc

SEQ ID NO: 2558132 - RNA, 18 nt, Human
cucuagggaccccuccuc

SEQ ID NO: 2558133 - RNA, 16 nt, Human
cucuagggaccccucc

SEQ ID NO: 2558134 - RNA, 14 nt, Human
cucuagguggggcg

SEQ ID NO: 2558135 - RNA, 13 nt, Human
cucuagguggggc

SEQ ID NO: 2558136 - RNA, 22 nt, Human
cucuaggugcccuuggaggcca

SEQ ID NO: 2558137 - RNA, 15 nt, Human
cucuaguauuccaga

SEQ ID NO: 2558138 - RNA, 15 nt, Human
cucuagguggggcgg

SEQ ID NO: 2558139 - RNA, 13 nt, Human
cucuagugcccuc

SEQ ID NO: 2558140 - RNA, 14 nt, Human
cucuagugcccucc

SEQ ID NO: 2558141 - RNA, 18 nt, Human
cucuagugcccuccacag

SEQ ID NO: 2558142 - RNA, 18 nt, Human
cucuagcuggugguuuca

SEQ ID NO: 2558143 - RNA, 17 nt, Human
cucuagcuggugguuuc

SEQ ID NO: 2558144 - RNA, 13 nt, Human
cucuagcuggugg

SEQ ID NO: 2558145 - RNA, 16 nt, Human
cucuagcugugggggu

SEQ ID NO: 2558146 - RNA, 17 nt, Human
cucuaggaaauauuuau

SEQ ID NO: 2558147 - RNA, 15 nt, Human
cucuaggcuggggaa

SEQ ID NO: 2558148 - RNA, 14 nt, Human
cucuaggcugggga

SEQ ID NO: 2558149 - RNA, 13 nt, Human
cucuaggcugggg

SEQ ID NO: 2558150 - RNA, 12 nt, Human
cucuaggcuggg

SEQ ID NO: 2558151 - RNA, 14 nt, Human
cucuagggaccccu

SEQ ID NO: 2558152 - RNA, 23 nt, Human
cucuagggaaaaaccagcgugug

SEQ ID NO: 2558153 - RNA, 16 nt, Human
cucuagagcagggauu

SEQ ID NO: 2558154 - RNA, 13 nt, Human
cucuagagcaggg

SEQ ID NO: 2558155 - RNA, 16 nt, Human
cucuagacacugccac

SEQ ID NO: 2558156 - RNA, 21 nt, Human
cucuagacacugccacacagg

SEQ ID NO: 2558157 - RNA, 20 nt, Human
cucuagaauuuuaagugcuu

SEQ ID NO: 2558158 - RNA, 23 nt, Human
cucuagaauuuuaagugcuuugu

SEQ ID NO: 2558159 - RNA, 17 nt, Human
cucuagacaacccugca

SEQ ID NO: 2558160 - RNA, 18 nt, Human
cucuagacaacccugcaa

SEQ ID NO: 2558161 - RNA, 23 nt, Human
cucuagacaacccugcaaaggac

SEQ ID NO: 2558162 - RNA, 19 nt, Human
cucuagaagccaagggaaa

SEQ ID NO: 2558163 - RNA, 18 nt, Human
cucuagaagccaagggaa

SEQ ID NO: 2558164 - RNA, 22 nt, Human
cucuagaagccaagggaaaggg

SEQ ID NO: 2558165 - RNA, 13 nt, Human
cucuacuuugagg

SEQ ID NO: 2558166 - RNA, 15 nt, Human
cucuagaagccaagg

SEQ ID NO: 2558167 - RNA, 12 nt, Human
cucuagaaauuu

SEQ ID NO: 2558168 - RNA, 15 nt, Human
cucuaggaaauauuu

SEQ ID NO: 2558169 - RNA, 20 nt, Human
cucuagcugggggugggcca

SEQ ID NO: 2558170 - RNA, 23 nt, Human
cucuagcugggggugggccaggc

SEQ ID NO: 2558171 - RNA, 14 nt, Human
cucuagccugggca

SEQ ID NO: 2558172 - RNA, 17 nt, Human
cucuagauuuuguuuug

SEQ ID NO: 2558173 - RNA, 20 nt, Human
cucuagauuuuguuuugcuu

SEQ ID NO: 2558174 - RNA, 19 nt, Human
cucuagauuuuguuuugcu

SEQ ID NO: 2558175 - RNA, 19 nt, Human
cucuagccaaaugguuuaa

SEQ ID NO: 2558176 - RNA, 13 nt, Human
cucuagccugggc

SEQ ID NO: 2558177 - RNA, 13 nt, Human
cucuacccuggca

SEQ ID NO: 2558178 - RNA, 12 nt, Human
cucuaccugaca

SEQ ID NO: 2558179 - RNA, 22 nt, Human
cucuaccugacacucccuuggg

SEQ ID NO: 2558180 - RNA, 22 nt, Human
cucuacccucccacccccuucu

SEQ ID NO: 2558181 - RNA, 20 nt, Human
cucuaccucauaucaguuug

SEQ ID NO: 2558182 - RNA, 19 nt, Human
cucuacccauauuacagau

SEQ ID NO: 2558183 - RNA, 16 nt, Human
cucuacccauauuaca

SEQ ID NO: 2558184 - RNA, 14 nt, Human
cucuacccucccac

SEQ ID NO: 2558185 - RNA, 15 nt, Human
cucuacccucccacc

SEQ ID NO: 2558186 - RNA, 16 nt, Human
cucuacccucccaccc

SEQ ID NO: 2558187 - RNA, 17 nt, Human
cucuacccucccacccc

SEQ ID NO: 2558188 - RNA, 18 nt, Human
cucuacccucccaccccc

SEQ ID NO: 2558189 - RNA, 18 nt, Human
cucuacaucuucugccuu

SEQ ID NO: 2558190 - RNA, 17 nt, Human
cucuacaucuucugccu

SEQ ID NO: 2558191 - RNA, 20 nt, Human
cucuaccaagcuauccuggc

SEQ ID NO: 2558192 - RNA, 18 nt, Human
cucuaccagacuguguau

SEQ ID NO: 2558193 - RNA, 20 nt, Human
cucuaccauccccuguagag

SEQ ID NO: 2558194 - RNA, 13 nt, Human
cucuacccagggc

SEQ ID NO: 2558195 - RNA, 14 nt, Human
cucuacccagggcc

SEQ ID NO: 2558196 - RNA, 17 nt, Human
cucuacccagggccugc

SEQ ID NO: 2558197 - RNA, 18 nt, Human
cucuacccagggccugca

SEQ ID NO: 2558198 - RNA, 20 nt, Human
cucuaccauuugcagagucc

SEQ ID NO: 2558199 - RNA, 22 nt, Human
cucuaccauuugcagaguccug

SEQ ID NO: 2558200 - RNA, 20 nt, Human
cucuacuuagcaugucccua

SEQ ID NO: 2558201 - RNA, 15 nt, Human
cucuacuuaaugaga

SEQ ID NO: 2558202 - RNA, 19 nt, Human
cucuacuuagcaugucccu

SEQ ID NO: 2558203 - RNA, 17 nt, Human
cucuacuuagcaugucc

SEQ ID NO: 2558204 - RNA, 18 nt, Human
cucuacugggagccuacc

SEQ ID NO: 2558205 - RNA, 21 nt, Human
cucuacugggagccuacccac

SEQ ID NO: 2558206 - RNA, 18 nt, Human
cucuacuuaauccaaugg

SEQ ID NO: 2558207 - RNA, 17 nt, Human
cucuacuuaauccaaug

SEQ ID NO: 2558208 - RNA, 16 nt, Human
cucuacuuagcauguc

SEQ ID NO: 2558209 - RNA, 20 nt, Human
cucuacguggcaaauuaacu

SEQ ID NO: 2558210 - RNA, 19 nt, Human
cucuacuaaaaagaaggaa

SEQ ID NO: 2558211 - RNA, 15 nt, Human
cucuacuaaaaagaa

SEQ ID NO: 2558212 - RNA, 22 nt, Human
cucuacuaaaaauacaaaaauu

SEQ ID NO: 2558213 - RNA, 16 nt, Human
cucuacuaaaaaugca

SEQ ID NO: 2558214 - RNA, 19 nt, Human
cucuacuaaaaauacagaa

SEQ ID NO: 2558215 - RNA, 21 nt, Human
cucuacuaacaaucagcuccu

SEQ ID NO: 2558216 - RNA, 16 nt, Human
cucuacuccuaccuca

SEQ ID NO: 2558217 - RNA, 19 nt, Human
cucuacuccuaccucagcc

SEQ ID NO: 2558218 - RNA, 19 nt, Human
cucuaguuugauuaaauuc

SEQ ID NO: 2558219 - RNA, 20 nt, Human
cucuaguuugauuaaauucu

SEQ ID NO: 2558220 - RNA, 15 nt, Human
cucuaguucuuuguu

SEQ ID NO: 2558221 - RNA, 13 nt, Human
cucuaguucuuug

SEQ ID NO: 2558222 - RNA, 18 nt, Human
cucuaguucuuuguucau

SEQ ID NO: 2558223 - RNA, 21 nt, Human
cucuaguuugauuaaauucuu

SEQ ID NO: 2558224 - RNA, 15 nt, Human
cucuaguuugauuaa

SEQ ID NO: 2558225 - RNA, 18 nt, Human
cucuagugcugugaaaaa

SEQ ID NO: 2558226 - RNA, 19 nt, Human
cucuagugcugugaaaaaa

SEQ ID NO: 2558227 - RNA, 20 nt, Human
cucuagugcugugaaaaaaa

SEQ ID NO: 2558228 - RNA, 14 nt, Human
cucuagugcuguga

SEQ ID NO: 2558229 - RNA, 15 nt, Human
cucuagugcugugaa

SEQ ID NO: 2558230 - RNA, 16 nt, Human
cucuagugcugugaaa

SEQ ID NO: 2558231 - RNA, 17 nt, Human
cucuagugcugugaaaa

SEQ ID NO: 2558232 - RNA, 12 nt, Human
cucuagugcugu

SEQ ID NO: 2558233 - RNA, 13 nt, Human
cucuagugcugug

SEQ ID NO: 2558234 - RNA, 14 nt, Human
cucuagugccuucu

SEQ ID NO: 2558235 - RNA, 16 nt, Human
cucuagugccuucuaa

SEQ ID NO: 2558236 - RNA, 21 nt, Human
cucuagugcccuccacagccg

SEQ ID NO: 2558237 - RNA, 15 nt, Human
cucucaggccagcug

SEQ ID NO: 2558238 - RNA, 13 nt, Human
cucucaggccagc

SEQ ID NO: 2558239 - RNA, 23 nt, Human
cucucaggccaaacucaccugcc

SEQ ID NO: 2558240 - RNA, 22 nt, Human
cucucaggccaaacucaccugc

SEQ ID NO: 2558241 - RNA, 21 nt, Human
cucucaggccaaacucaccug

SEQ ID NO: 2558242 - RNA, 20 nt, Human
cucucaggccaaacucaccu

SEQ ID NO: 2558243 - RNA, 12 nt, Human
cucucaggccaa

SEQ ID NO: 2558244 - RNA, 21 nt, Human
cucucaggcaugccuguguga

SEQ ID NO: 2558245 - RNA, 21 nt, Human
cucucaggccagcugcuuggg

SEQ ID NO: 2558246 - RNA, 19 nt, Human
cucucaggccagcugcuug

SEQ ID NO: 2558247 - RNA, 18 nt, Human
cucucaggccagcugcuu

SEQ ID NO: 2558248 - RNA, 17 nt, Human
cucucaggccagcugcu

SEQ ID NO: 2558249 - RNA, 14 nt, Human
cucucaugaaccuc

SEQ ID NO: 2558250 - RNA, 20 nt, Human
cucucauguuuucaacugcc

SEQ ID NO: 2558251 - RNA, 11 nt, Human
cucucauuccc

SEQ ID NO: 2558252 - RNA, 14 nt, Human
cucucauuccccag

SEQ ID NO: 2558253 - RNA, 15 nt, Human
cucucauuccccagg

SEQ ID NO: 2558254 - RNA, 21 nt, Human
cucucauuccccagguggcug

SEQ ID NO: 2558255 - RNA, 16 nt, Human
cucucauuccccaggu

SEQ ID NO: 2558256 - RNA, 20 nt, Human
cucucauuccccagguggcu

SEQ ID NO: 2558257 - RNA, 13 nt, Human
cucuccaaccugg

SEQ ID NO: 2558258 - RNA, 17 nt, Human
cucuccaagggcuucug

SEQ ID NO: 2558259 - RNA, 15 nt, Human
cucuccaagggcuuc

SEQ ID NO: 2558260 - RNA, 14 nt, Human
cucuccaagggcuu

SEQ ID NO: 2558261 - RNA, 13 nt, Human
cucuccaagggcu

SEQ ID NO: 2558262 - RNA, 15 nt, Human
cucuccaaaaaugca

SEQ ID NO: 2558263 - RNA, 14 nt, Human
cucuccaaccugga

SEQ ID NO: 2558264 - RNA, 12 nt, Human
cucuccaagggc

SEQ ID NO: 2558265 - RNA, 16 nt, Human
cucuccaaccuggaca

SEQ ID NO: 2558266 - RNA, 18 nt, Human
cucuccagccccuggaug

SEQ ID NO: 2558267 - RNA, 17 nt, Human
cucuccagccccuggau

SEQ ID NO: 2558268 - RNA, 16 nt, Human
cucuccagccccugga

SEQ ID NO: 2558269 - RNA, 15 nt, Human
cucuccagccccugg

SEQ ID NO: 2558270 - RNA, 17 nt, Human
cucuccaagucucagug

SEQ ID NO: 2558271 - RNA, 22 nt, Human
cucuccaagggcuucugcaccc

SEQ ID NO: 2558272 - RNA, 21 nt, Human
cucuccaagggcuucugcacc

SEQ ID NO: 2558273 - RNA, 11 nt, Human
cucuccacugc

SEQ ID NO: 2558274 - RNA, 14 nt, Human
cucuccagccccug

SEQ ID NO: 2558275 - RNA, 14 nt, Human
cucuccacugccuu

SEQ ID NO: 2558276 - RNA, 12 nt, Human
cucuccacugcc

SEQ ID NO: 2558277 - RNA, 13 nt, Human
cucuccagcucca

SEQ ID NO: 2558278 - RNA, 13 nt, Human
cucuccagcuaua

SEQ ID NO: 2558279 - RNA, 23 nt, Human
cucuccaagggcuucugcacccu

SEQ ID NO: 2558280 - RNA, 15 nt, Human
cucuccagcuccaag

SEQ ID NO: 2558281 - RNA, 14 nt, Human
cucuccagcuccaa

SEQ ID NO: 2558282 - RNA, 13 nt, Human
cucuccccagcaa

SEQ ID NO: 2558283 - RNA, 19 nt, Human
cucuccagccccuggaugc

SEQ ID NO: 2558284 - RNA, 14 nt, Human
cucuccagccugac

SEQ ID NO: 2558285 - RNA, 12 nt, Human
cucuccucugcu

SEQ ID NO: 2558286 - RNA, 24 nt, Human
cucuccccagcaagugagagcugg

SEQ ID NO: 2558287 - RNA, 22 nt, Human
cucuccccagcaagugagagcu

SEQ ID NO: 2558288 - RNA, 14 nt, Human
cucuccccagcaag

SEQ ID NO: 2558289 - RNA, 18 nt, Human
cucuccucugcugcuggc

SEQ ID NO: 2558290 - RNA, 15 nt, Human
cucuccucugcugcu

SEQ ID NO: 2558291 - RNA, 14 nt, Human
cucuccucugcugc

SEQ ID NO: 2558292 - RNA, 13 nt, Human
cucuccucugcug

SEQ ID NO: 2558293 - RNA, 22 nt, Human
cucuccucuugccacugccucu

SEQ ID NO: 2558294 - RNA, 19 nt, Human
cucuccucuugccacugcc

SEQ ID NO: 2558295 - RNA, 21 nt, Human
cucuccugauagucuuucagu

SEQ ID NO: 2558296 - RNA, 16 nt, Human
cucuccagcuccaaga

SEQ ID NO: 2558297 - RNA, 12 nt, Human
cucuccugccua

SEQ ID NO: 2558298 - RNA, 17 nt, Human
cucuccucuugccacug

SEQ ID NO: 2558299 - RNA, 16 nt, Human
cucuccucuugccacu

SEQ ID NO: 2558300 - RNA, 15 nt, Human
cucuccucuugccac

SEQ ID NO: 2558301 - RNA, 14 nt, Human
cucuccucuugcca

SEQ ID NO: 2558302 - RNA, 16 nt, Human
cucuccuuccuggagc

SEQ ID NO: 2558303 - RNA, 14 nt, Human
cucuccuuccugug

SEQ ID NO: 2558304 - RNA, 14 nt, Human
cucuccuuucuuuu

SEQ ID NO: 2558305 - RNA, 16 nt, Human
cucuccuuucuuucua

SEQ ID NO: 2558306 - RNA, 21 nt, Human
cucuccuguccaaccuaaccc

SEQ ID NO: 2558307 - RNA, 13 nt, Human
cucuccuggagga

SEQ ID NO: 2558308 - RNA, 12 nt, Human
cucuccuggagg

SEQ ID NO: 2558309 - RNA, 13 nt, Human
cucuccugccuac

SEQ ID NO: 2558310 - RNA, 13 nt, Human
cucucucaggcca

SEQ ID NO: 2558311 - RNA, 12 nt, Human
cucucuccagau

SEQ ID NO: 2558312 - RNA, 21 nt, Human
cucucucaauuuuugguugaa

SEQ ID NO: 2558313 - RNA, 14 nt, Human
cucucuccacccua

SEQ ID NO: 2558314 - RNA, 14 nt, Human
cucucuccccucaa

SEQ ID NO: 2558315 - RNA, 20 nt, Human
cucucucccauggagcccca

SEQ ID NO: 2558316 - RNA, 14 nt, Human
cucucucccaugga

SEQ ID NO: 2558317 - RNA, 23 nt, Human
cucucucccagucuacccagaga

SEQ ID NO: 2558318 - RNA, 19 nt, Human
cucucucccagucuaccca

SEQ ID NO: 2558319 - RNA, 13 nt, Human
cucucucccaguc

SEQ ID NO: 2558320 - RNA, 12 nt, Human
cucucuccagga

SEQ ID NO: 2558321 - RNA, 14 nt, Human
cucucuccagaugu

SEQ ID NO: 2558322 - RNA, 17 nt, Human
cucucuccagauguuuc

SEQ ID NO: 2558323 - RNA, 12 nt, Human
cucucucccagu

SEQ ID NO: 2558324 - RNA, 12 nt, Human
cucucucacucc

SEQ ID NO: 2558325 - RNA, 16 nt, Human
cucucuauagcaccag

SEQ ID NO: 2558326 - RNA, 19 nt, Human
cucucuacuccuaccucag

SEQ ID NO: 2558327 - RNA, 20 nt, Human
cucucuacuccuaccucagc

SEQ ID NO: 2558328 - RNA, 21 nt, Human
cucuccuuucuuuuucuucuu

SEQ ID NO: 2558329 - RNA, 16 nt, Human
cucuccuuucuuuuuc

SEQ ID NO: 2558330 - RNA, 22 nt, Human
cucucuacuccuaccucagccu

SEQ ID NO: 2558331 - RNA, 14 nt, Human
cugacccacugcuu

SEQ ID NO: 2558332 - RNA, 13 nt, Human
cugacccacugcu

SEQ ID NO: 2558333 - RNA, 13 nt, Human
cugacccaugcug

SEQ ID NO: 2558334 - RNA, 16 nt, Human
cugacccaggccgcag

SEQ ID NO: 2558335 - RNA, 15 nt, Human
cugacccaggccgca

SEQ ID NO: 2558336 - RNA, 14 nt, Human
cugacccaggccgc

SEQ ID NO: 2558337 - RNA, 13 nt, Human
cugacccaggccg

SEQ ID NO: 2558338 - RNA, 12 nt, Human
cugacccaggcc

SEQ ID NO: 2558339 - RNA, 15 nt, Human
cugacccagccuguu

SEQ ID NO: 2558340 - RNA, 21 nt, Human
cugacccagccccuugagaaa

SEQ ID NO: 2558341 - RNA, 15 nt, Human
cugacccaugcugcc

SEQ ID NO: 2558342 - RNA, 14 nt, Human
cugacccaugcugc

SEQ ID NO: 2558343 - RNA, 16 nt, Human
cugacccaugcugccc

SEQ ID NO: 2558344 - RNA, 18 nt, Human
cugacuagugaggaaaga

SEQ ID NO: 2558345 - RNA, 23 nt, Human
cugacuagaagggccaguccugc

SEQ ID NO: 2558346 - RNA, 22 nt, Human
cugacuagaagggccaguccug

SEQ ID NO: 2558347 - RNA, 12 nt, Human
cugacccacugc

SEQ ID NO: 2558348 - RNA, 12 nt, Human
cugaccacacuu

SEQ ID NO: 2558349 - RNA, 13 nt, Human
cugaccacacuuc

SEQ ID NO: 2558350 - RNA, 16 nt, Human
cugaccacacuuccug

SEQ ID NO: 2558351 - RNA, 17 nt, Human
cugaccacacuuccugu

SEQ ID NO: 2558352 - RNA, 18 nt, Human
cugaccacacuuccuguc

SEQ ID NO: 2558353 - RNA, 19 nt, Human
cugaccacacuuccugucc

SEQ ID NO: 2558354 - RNA, 20 nt, Human
cugaccacacuuccugucca

SEQ ID NO: 2558355 - RNA, 21 nt, Human
cugaccaauauuguacaguuu

SEQ ID NO: 2558356 - RNA, 20 nt, Human
cugaccaauauuguacaguu

SEQ ID NO: 2558357 - RNA, 19 nt, Human
cugaccaauauuguacagu

SEQ ID NO: 2558358 - RNA, 22 nt, Human
cugacauuguuggccaaagcca

SEQ ID NO: 2558359 - RNA, 18 nt, Human
cugacauuuggaguguuc

SEQ ID NO: 2558360 - RNA, 21 nt, Human
cugacauuuggaguguucccc

SEQ ID NO: 2558361 - RNA, 15 nt, Human
cugacauuaacaguu

SEQ ID NO: 2558362 - RNA, 18 nt, Human
cugacauuaacaguuuuc

SEQ ID NO: 2558363 - RNA, 20 nt, Human
cugacauuaacaguuuucca

SEQ ID NO: 2558364 - RNA, 19 nt, Human
cugaccaacaguuccuuca

SEQ ID NO: 2558365 - RNA, 16 nt, Human
cugaccaacauggaga

SEQ ID NO: 2558366 - RNA, 14 nt, Human
cugaccaagagaga

SEQ ID NO: 2558367 - RNA, 17 nt, Human
cugaccaagagagaaag

SEQ ID NO: 2558368 - RNA, 18 nt, Human
cugaccaauauuguacag

SEQ ID NO: 2558369 - RNA, 15 nt, Human
cugaccaauauugua

SEQ ID NO: 2558370 - RNA, 18 nt, Human
cugacagaugucagccga

SEQ ID NO: 2558371 - RNA, 12 nt, Human
cugacagccucc

SEQ ID NO: 2558372 - RNA, 13 nt, Human
cugacagccuccc

SEQ ID NO: 2558373 - RNA, 14 nt, Human
cugacagccuccca

SEQ ID NO: 2558374 - RNA, 13 nt, Human
cugacagcugcuc

SEQ ID NO: 2558375 - RNA, 14 nt, Human
cugacagcugcucc

SEQ ID NO: 2558376 - RNA, 12 nt, Human
cugacagcugcu

SEQ ID NO: 2558377 - RNA, 17 nt, Human
cugacagccucccaccc

SEQ ID NO: 2558378 - RNA, 20 nt, Human
cugacagccucccaccccca

SEQ ID NO: 2558379 - RNA, 23 nt, Human
cugaagauggcauccugugaagu

SEQ ID NO: 2558380 - RNA, 22 nt, Human
cugaagaugcagcucacuaccc

SEQ ID NO: 2558381 - RNA, 16 nt, Human
cugaagaugcagcuca

SEQ ID NO: 2558382 - RNA, 20 nt, Human
cugaagauggcauccuguga

SEQ ID NO: 2558383 - RNA, 15 nt, Human
cugaagaugcagcuc

SEQ ID NO: 2558384 - RNA, 22 nt, Human
cugaagaugcagcaaaauguga

SEQ ID NO: 2558385 - RNA, 17 nt, Human
cugaagaugaucauuug

SEQ ID NO: 2558386 - RNA, 16 nt, Human
cugaagaugaucauuu

SEQ ID NO: 2558387 - RNA, 23 nt, Human
cugaagauauaacuauugcccag

SEQ ID NO: 2558388 - RNA, 20 nt, Human
cugaagaguggguuucacaa

SEQ ID NO: 2558389 - RNA, 18 nt, Human
cugaagaguccucugaau

SEQ ID NO: 2558390 - RNA, 15 nt, Human
cugaagaguccucug

SEQ ID NO: 2558391 - RNA, 16 nt, Human
cugaagaguccucuga

SEQ ID NO: 2558392 - RNA, 23 nt, Human
cugaagaggcgggccagccaggc

SEQ ID NO: 2558393 - RNA, 22 nt, Human
cugaagaggcgggccagccagg

SEQ ID NO: 2558394 - RNA, 14 nt, Human
cugaagaguccucu

SEQ ID NO: 2558395 - RNA, 21 nt, Human
cugaagaggcgggccagccag

SEQ ID NO: 2558396 - RNA, 19 nt, Human
cugacauguggggccaggu

SEQ ID NO: 2558397 - RNA, 14 nt, Human
cugacauguggggc

SEQ ID NO: 2558398 - RNA, 20 nt, Human
cugacaugauuccuuccugu

SEQ ID NO: 2558399 - RNA, 21 nt, Human
cugacauuguuggccaaagcc

SEQ ID NO: 2558400 - RNA, 21 nt, Human
cugacauguggggccagguca

SEQ ID NO: 2558401 - RNA, 16 nt, Human
cugacaugauuccuuc

SEQ ID NO: 2558402 - RNA, 14 nt, Human
cugacauuaacagu

SEQ ID NO: 2558403 - RNA, 14 nt, Human
cugacaucucugca

SEQ ID NO: 2558404 - RNA, 15 nt, Human
cugacaucucugcaa

SEQ ID NO: 2558405 - RNA, 16 nt, Human
cugacaucucugcaau

SEQ ID NO: 2558406 - RNA, 16 nt, Human
cugacaucuggaaucu

SEQ ID NO: 2558407 - RNA, 21 nt, Human
cugacaucuguguuucaagug

SEQ ID NO: 2558408 - RNA, 17 nt, Human
cugacaucuguguuuca

SEQ ID NO: 2558409 - RNA, 16 nt, Human
cugacaucuguguuuc

SEQ ID NO: 2558410 - RNA, 14 nt, Human
cugacauccccacu

SEQ ID NO: 2558411 - RNA, 15 nt, Human
cugacaugauuccuu

SEQ ID NO: 2558412 - RNA, 21 nt, Human
cugacaucuuaguauuugcau

SEQ ID NO: 2558413 - RNA, 23 nt, Human
cugacaggcagccuggacauaga

SEQ ID NO: 2558414 - RNA, 20 nt, Human
cugacaggcagccuggacau

SEQ ID NO: 2558415 - RNA, 15 nt, Human
cugacagcugcuccu

SEQ ID NO: 2558416 - RNA, 16 nt, Human
cugacagcugcuccua

SEQ ID NO: 2558417 - RNA, 15 nt, Human
cugacaggcagccug

SEQ ID NO: 2558418 - RNA, 17 nt, Human
cugacagcugcuccuag

SEQ ID NO: 2558419 - RNA, 21 nt, Human
cugacaggcaaugcuggcugu

SEQ ID NO: 2558420 - RNA, 15 nt, Human
cugacagucuugugc

SEQ ID NO: 2558421 - RNA, 21 nt, Human
cugacaguccucuccaccuag

SEQ ID NO: 2558422 - RNA, 19 nt, Human
cugacaguccucuccaccu

SEQ ID NO: 2558423 - RNA, 17 nt, Human
cugacaguccucuccac

SEQ ID NO: 2558424 - RNA, 13 nt, Human
cugacuucuaagu

SEQ ID NO: 2558425 - RNA, 15 nt, Human
cugacuucuaaguaa

SEQ ID NO: 2558426 - RNA, 21 nt, Human
cugacuucaggggcugcccgc

SEQ ID NO: 2558427 - RNA, 20 nt, Human
cugacuucaggggcugcccg

SEQ ID NO: 2558428 - RNA, 19 nt, Human
cugacuucaggggcugccc

SEQ ID NO: 2558429 - RNA, 14 nt, Human
cugacuucaggggc

SEQ ID NO: 2558430 - RNA, 18 nt, Human
cugacuguuuucucuuga

SEQ ID NO: 2558431 - RNA, 19 nt, Human
cugacuucugccuggagac

SEQ ID NO: 2558432 - RNA, 18 nt, Human
cugacuucugccuggaga

SEQ ID NO: 2558433 - RNA, 16 nt, Human
cugacuucugccugga

SEQ ID NO: 2558434 - RNA, 15 nt, Human
cugacuucugccugg

SEQ ID NO: 2558435 - RNA, 14 nt, Human
cugacuucugccug

SEQ ID NO: 2558436 - RNA, 13 nt, Human
cugacuucugccu

SEQ ID NO: 2558437 - RNA, 12 nt, Human
cugacuucugcc

SEQ ID NO: 2558438 - RNA, 16 nt, Human
cugacuucuaaguaaa

SEQ ID NO: 2558439 - RNA, 17 nt, Human
cugacuucaucucccac

SEQ ID NO: 2558440 - RNA, 23 nt, Human
cugacuucaucucccaccuagca

SEQ ID NO: 2558441 - RNA, 11 nt, Human
cugacuucugc

SEQ ID NO: 2558442 - RNA, 22 nt, Human
cugacuucaggggcugcccgcu

SEQ ID NO: 2558443 - RNA, 16 nt, Human
cugacucacaagaaga

SEQ ID NO: 2558444 - RNA, 15 nt, Human
cugacucacaagaag

SEQ ID NO: 2558445 - RNA, 14 nt, Human
cugacucacaagaa

SEQ ID NO: 2558446 - RNA, 13 nt, Human
cugacucacaaga

SEQ ID NO: 2558447 - RNA, 18 nt, Human
cugacucaacauguuacu

SEQ ID NO: 2558448 - RNA, 21 nt, Human
cugacucgucugacugugugu

SEQ ID NO: 2558449 - RNA, 21 nt, Human
cugacucuaggugcccuugga

SEQ ID NO: 2558450 - RNA, 13 nt, Human
cugacucucugug

SEQ ID NO: 2558451 - RNA, 14 nt, Human
cugacucucuguga

SEQ ID NO: 2558452 - RNA, 12 nt, Human
cugacucagggc

SEQ ID NO: 2558453 - RNA, 14 nt, Human
cugacucagggcuc

SEQ ID NO: 2558454 - RNA, 21 nt, Human
cugacucacaagaagaccaga

SEQ ID NO: 2558455 - RNA, 17 nt, Human
cugacucacaagaagac

SEQ ID NO: 2558456 - RNA, 17 nt, Human
cugacucuuaagaagac

SEQ ID NO: 2558457 - RNA, 17 nt, Human
cugacucugaaaucuga

SEQ ID NO: 2558458 - RNA, 15 nt, Human
cugacucugaaaucu

SEQ ID NO: 2558459 - RNA, 14 nt, Human
cugacucugaaauc

SEQ ID NO: 2558460 - RNA, 14 nt, Human
cugacucucaaauc

SEQ ID NO: 2558461 - RNA, 16 nt, Human
cugacucucugugacc

SEQ ID NO: 2558462 - RNA, 18 nt, Human
cugacucucugugaccug

SEQ ID NO: 2558463 - RNA, 16 nt, Human
cugacuguuuucucuu

SEQ ID NO: 2558464 - RNA, 15 nt, Human
cugacucugcccccu

SEQ ID NO: 2558465 - RNA, 14 nt, Human
cugacucugccccc

SEQ ID NO: 2558466 - RNA, 12 nt, Human
cugacucugccc

SEQ ID NO: 2558467 - RNA, 20 nt, Human
cugacucugaaaucugaaga

SEQ ID NO: 2558468 - RNA, 20 nt, Human
cugacucugcccccugcugg

SEQ ID NO: 2558469 - RNA, 19 nt, Human
cugacucugcccccugcug

SEQ ID NO: 2558470 - RNA, 21 nt, Human
cugacucugcccccugcuggc

SEQ ID NO: 2558471 - RNA, 14 nt, Human
cugagaaauuuaua

SEQ ID NO: 2558472 - RNA, 11 nt, Human
cugagaaauuu

SEQ ID NO: 2558473 - RNA, 15 nt, Human
cugagaacacuguga

SEQ ID NO: 2558474 - RNA, 11 nt, Human
cugagaacacu

SEQ ID NO: 2558475 - RNA, 15 nt, Human
cugacuuugcucuuu

SEQ ID NO: 2558476 - RNA, 22 nt, Human
cugacuuucauuucuugaggua

SEQ ID NO: 2558477 - RNA, 16 nt, Human
cugacuuugcucuuuc

SEQ ID NO: 2558478 - RNA, 22 nt, Human
cugagaacccugcguggggaca

SEQ ID NO: 2558479 - RNA, 18 nt, Human
cugagaacccugcguggg

SEQ ID NO: 2558480 - RNA, 23 nt, Human
cugagaacccugcguggggacag

SEQ ID NO: 2558481 - RNA, 22 nt, Human
cugagaacacugugaaaacauu

SEQ ID NO: 2558482 - RNA, 17 nt, Human
cugagaacacugugaaa

SEQ ID NO: 2558483 - RNA, 17 nt, Human
cugagaacccugcgugg

SEQ ID NO: 2558484 - RNA, 22 nt, Human
cugagaaagacuauucaaacag

SEQ ID NO: 2558485 - RNA, 23 nt, Human
cugagaaagacuauucaaacagu

SEQ ID NO: 2558486 - RNA, 20 nt, Human
cugacuuggggagauggagu

SEQ ID NO: 2558487 - RNA, 22 nt, Human
cugacuuggggagauggaguuc

SEQ ID NO: 2558488 - RNA, 21 nt, Human
cugacuuggggagauggaguu

SEQ ID NO: 2558489 - RNA, 14 nt, Human
cugacuuugcucuu

SEQ ID NO: 2558490 - RNA, 23 nt, Human
cugagaagagagaucaaauggaa

SEQ ID NO: 2558491 - RNA, 17 nt, Human
cugagaagauugugaau

SEQ ID NO: 2558492 - RNA, 22 nt, Human
cugagaagagagaucaaaugga

SEQ ID NO: 2558493 - RNA, 23 nt, Human
cugagaagguccuuaaugauccg

SEQ ID NO: 2558494 - RNA, 17 nt, Human
cugagaagguccuuaau

SEQ ID NO: 2558495 - RNA, 15 nt, Human
cugagaauaagaaag

SEQ ID NO: 2558496 - RNA, 23 nt, Human
cugagaauauaauacuguauuug

SEQ ID NO: 2558497 - RNA, 20 nt, Human
cugagaauauaauacuguau

SEQ ID NO: 2558498 - RNA, 15 nt, Human
cugagacagcccggg

SEQ ID NO: 2558499 - RNA, 14 nt, Human
cugagacagcccgg

SEQ ID NO: 2558500 - RNA, 16 nt, Human
cugagaauuccaagga

SEQ ID NO: 2558501 - RNA, 15 nt, Human
cugagaauuccaagg

SEQ ID NO: 2558502 - RNA, 19 nt, Human
cugagaauguaagaacuac

SEQ ID NO: 2558503 - RNA, 22 nt, Human
cugagaauuuaaaaauaagaaa

SEQ ID NO: 2558504 - RNA, 17 nt, Human
cugagacaaauggaggc

SEQ ID NO: 2558505 - RNA, 17 nt, Human
cugagaauguaagaacu

SEQ ID NO: 2558506 - RNA, 14 nt, Human
cugagaaucuuuau

SEQ ID NO: 2558507 - RNA, 22 nt, Human
cugagaaucuuuauugagaaag

SEQ ID NO: 2558508 - RNA, 20 nt, Human
cugaggcccuucucuccagc

SEQ ID NO: 2558509 - RNA, 19 nt, Human
cugaggcccuucucuccag

SEQ ID NO: 2558510 - RNA, 18 nt, Human
cugaggcccuucucucca

SEQ ID NO: 2558511 - RNA, 15 nt, Human
cugaggcccuucucu

SEQ ID NO: 2558512 - RNA, 14 nt, Human
cugaggcccuucuc

SEQ ID NO: 2558513 - RNA, 23 nt, Human
cugaggcccagagggccugcaag

SEQ ID NO: 2558514 - RNA, 21 nt, Human
cugaggcccagagggccugca

SEQ ID NO: 2558515 - RNA, 19 nt, Human
cugaggcccagagggccug

SEQ ID NO: 2558516 - RNA, 18 nt, Human
cugaggcccagagggccu

SEQ ID NO: 2558517 - RNA, 17 nt, Human
cugaggcccagagggcc

SEQ ID NO: 2558518 - RNA, 16 nt, Human
cugaggcccagagggc

SEQ ID NO: 2558519 - RNA, 15 nt, Human
cugaggcccagaggg

SEQ ID NO: 2558520 - RNA, 14 nt, Human
cugaggcccagagg

SEQ ID NO: 2558521 - RNA, 13 nt, Human
cugaggcccagag

SEQ ID NO: 2558522 - RNA, 12 nt, Human
cugaggcccaga

SEQ ID NO: 2558523 - RNA, 14 nt, Human
cugaggcagguccc

SEQ ID NO: 2558524 - RNA, 17 nt, Human
cugaggcagguccccag

SEQ ID NO: 2558525 - RNA, 18 nt, Human
cugaggcagguccccaga

SEQ ID NO: 2558526 - RNA, 19 nt, Human
cugaggcagguccccagac

SEQ ID NO: 2558527 - RNA, 21 nt, Human
cugaggccacacucagcacaa

SEQ ID NO: 2558528 - RNA, 24 nt, Human
cugaggccacacucagcacaaggc

SEQ ID NO: 2558529 - RNA, 14 nt, Human
cugaggccacacuc

SEQ ID NO: 2558530 - RNA, 20 nt, Human
cugaggccacacucagcaca

SEQ ID NO: 2558531 - RNA, 12 nt, Human
cugaggccacac

SEQ ID NO: 2558532 - RNA, 22 nt, Human
cugaggcagggaaguccccagg

SEQ ID NO: 2558533 - RNA, 22 nt, Human
cugaggcagcagugugaggcca

SEQ ID NO: 2558534 - RNA, 23 nt, Human
cugaggcagcagugugaggccag

SEQ ID NO: 2558535 - RNA, 24 nt, Human
cugaggcagcagugugaggccagg

SEQ ID NO: 2558536 - RNA, 15 nt, Human
cugaggcagaagaau

SEQ ID NO: 2558537 - RNA, 15 nt, Human
cugaggcaggaggau

SEQ ID NO: 2558538 - RNA, 14 nt, Human
cugaggcagggaag

SEQ ID NO: 2558539 - RNA, 16 nt, Human
cugaggcagggaaguc

SEQ ID NO: 2558540 - RNA, 20 nt, Human
cugaggcagggaagucccca

SEQ ID NO: 2558541 - RNA, 21 nt, Human
cugaggcagggaaguccccag

SEQ ID NO: 2558542 - RNA, 15 nt, Human
cugaggcagcagugu

SEQ ID NO: 2558543 - RNA, 17 nt, Human
cugaggcagcaguguga

SEQ ID NO: 2558544 - RNA, 18 nt, Human
cugaggcagacagcagcu

SEQ ID NO: 2558545 - RNA, 22 nt, Human
cugaggcagacagcagcucagg

SEQ ID NO: 2558546 - RNA, 14 nt, Human
cugaggcagacagc

SEQ ID NO: 2558547 - RNA, 15 nt, Human
cugaggcagacagca

SEQ ID NO: 2558548 - RNA, 16 nt, Human
cugaggcagacagcag

SEQ ID NO: 2558549 - RNA, 17 nt, Human
cugaggcagacagcagc

SEQ ID NO: 2558550 - RNA, 19 nt, Human
cugaggaucagaguaaucc

SEQ ID NO: 2558551 - RNA, 15 nt, Human
cugaggagugaggaa

SEQ ID NO: 2558552 - RNA, 15 nt, Human
cugaggaugagcugg

SEQ ID NO: 2558553 - RNA, 13 nt, Human
cugaggaugagcu

SEQ ID NO: 2558554 - RNA, 16 nt, Human
cugaggcaagagaauu

SEQ ID NO: 2558555 - RNA, 12 nt, Human
cugaggcaagag

SEQ ID NO: 2558556 - RNA, 13 nt, Human
cugaggcacgagc

SEQ ID NO: 2558557 - RNA, 13 nt, Human
cugaggcagacag

SEQ ID NO: 2558558 - RNA, 17 nt, Human
cugaggaugagcuggaa

SEQ ID NO: 2558559 - RNA, 16 nt, Human
cugaggaugagcugga

SEQ ID NO: 2558560 - RNA, 22 nt, Human
cugaggauuuaagggauggaaa

SEQ ID NO: 2558561 - RNA, 18 nt, Human
cugaggaugagcuggaag

SEQ ID NO: 2558562 - RNA, 14 nt, Human
cugaggauuucaag

SEQ ID NO: 2558563 - RNA, 17 nt, Human
cugaggauuucaagccu

SEQ ID NO: 2558564 - RNA, 18 nt, Human
cugaggauuucaagccug

SEQ ID NO: 2558565 - RNA, 12 nt, Human
cugagcugaggc

SEQ ID NO: 2558566 - RNA, 13 nt, Human
cugagcugaggca

SEQ ID NO: 2558567 - RNA, 17 nt, Human
cugaggaucagaguaau

SEQ ID NO: 2558568 - RNA, 22 nt, Human
cugagcucgguggacccaggga

SEQ ID NO: 2558569 - RNA, 19 nt, Human
cugagcucugcauuugucu

SEQ ID NO: 2558570 - RNA, 21 nt, Human
cugagccagauuucacucucc

SEQ ID NO: 2558571 - RNA, 20 nt, Human
cugagccagauuucacucuc

SEQ ID NO: 2558572 - RNA, 19 nt, Human
cugagccagauuucacucu

SEQ ID NO: 2558573 - RNA, 18 nt, Human
cugagccagauuucacuc

SEQ ID NO: 2558574 - RNA, 17 nt, Human
cugagccagauuucacu

SEQ ID NO: 2558575 - RNA, 18 nt, Human
cugagacagcccgggcuc

SEQ ID NO: 2558576 - RNA, 17 nt, Human
cugagacagcccgggcu

SEQ ID NO: 2558577 - RNA, 16 nt, Human
cugagacagcccgggc

SEQ ID NO: 2558578 - RNA, 14 nt, Human
cugagcccuggcag

SEQ ID NO: 2558579 - RNA, 15 nt, Human
cugagcccuggcagg

SEQ ID NO: 2558580 - RNA, 17 nt, Human
cugagcccucaaaguga

SEQ ID NO: 2558581 - RNA, 16 nt, Human
cugagcccucaaagug

SEQ ID NO: 2558582 - RNA, 11 nt, Human
cugagcccugg

SEQ ID NO: 2558583 - RNA, 12 nt, Human
cugagcccuggc

SEQ ID NO: 2558584 - RNA, 13 nt, Human
cugagcccuggca

SEQ ID NO: 2558585 - RNA, 16 nt, Human
cugagccucagucucc

SEQ ID NO: 2558586 - RNA, 21 nt, Human
cugagccucagucucccuccc

SEQ ID NO: 2558587 - RNA, 19 nt, Human
cugagccagucccaggggc

SEQ ID NO: 2558588 - RNA, 18 nt, Human
cugagccagucccagggg

SEQ ID NO: 2558589 - RNA, 15 nt, Human
cugagccagauuuca

SEQ ID NO: 2558590 - RNA, 20 nt, Human
cugagacaaauggaggccug

SEQ ID NO: 2558591 - RNA, 22 nt, Human
cugagccaguucaguaccugga

SEQ ID NO: 2558592 - RNA, 22 nt, Human
cugagccagugucaggaggaag

SEQ ID NO: 2558593 - RNA, 16 nt, Human
cugagccagugucagg

SEQ ID NO: 2558594 - RNA, 22 nt, Human
cugagccucucaccuguacucu

SEQ ID NO: 2558595 - RNA, 13 nt, Human
cugagccuggcca

SEQ ID NO: 2558596 - RNA, 14 nt, Human
cugagccuggccag

SEQ ID NO: 2558597 - RNA, 15 nt, Human
cugagccuggccagc

SEQ ID NO: 2558598 - RNA, 17 nt, Human
cugagccuggccagccu

SEQ ID NO: 2558599 - RNA, 14 nt, Human
cugagccucugcuc

SEQ ID NO: 2558600 - RNA, 15 nt, Human
cugagccucugcucc

SEQ ID NO: 2558601 - RNA, 16 nt, Human
cugagccucugcuccc

SEQ ID NO: 2558602 - RNA, 18 nt, Human
cugagccucugcucccca

SEQ ID NO: 2558603 - RNA, 21 nt, Human
cugagccucucaccuguacuc

SEQ ID NO: 2558604 - RNA, 13 nt, Human
cugagccucucac

SEQ ID NO: 2558605 - RNA, 12 nt, Human
cugagccucugc

SEQ ID NO: 2558606 - RNA, 22 nt, Human
cugagccucagucucccucccu

SEQ ID NO: 2558607 - RNA, 16 nt, Human
cugagcgacagugaga

SEQ ID NO: 2558608 - RNA, 20 nt, Human
cugagcgacagugagacucu

SEQ ID NO: 2558609 - RNA, 16 nt, Human
cugagccuuguaauuc

SEQ ID NO: 2558610 - RNA, 15 nt, Human
cugagccuuguaauu

SEQ ID NO: 2558611 - RNA, 12 nt, Human
cugagccuucag

SEQ ID NO: 2558612 - RNA, 16 nt, Human
cugagccuggcuggca

SEQ ID NO: 2558613 - RNA, 14 nt, Human
cugagccuggcugg

SEQ ID NO: 2558614 - RNA, 17 nt, Human
cugagccuucagucuug

SEQ ID NO: 2558615 - RNA, 13 nt, Human
cugagcucacucg

SEQ ID NO: 2558616 - RNA, 22 nt, Human
cugagcuccaugugcccccucu

SEQ ID NO: 2558617 - RNA, 18 nt, Human
cugagcuccccaccaccc

SEQ ID NO: 2558618 - RNA, 17 nt, Human
cugagcucgguggaccc

SEQ ID NO: 2558619 - RNA, 18 nt, Human
cugagcucgguggaccca

SEQ ID NO: 2558620 - RNA, 20 nt, Human
cugagcucgguggacccagg

SEQ ID NO: 2558621 - RNA, 20 nt, Human
cugagcuccccaccacccca

SEQ ID NO: 2558622 - RNA, 14 nt, Human
cugagcuccucugg

SEQ ID NO: 2558623 - RNA, 15 nt, Human
cugagcuccucuggg

SEQ ID NO: 2558624 - RNA, 16 nt, Human
cugagcuccucugggc

SEQ ID NO: 2558625 - RNA, 17 nt, Human
cugagcuccucugggca

SEQ ID NO: 2558626 - RNA, 18 nt, Human
cugagcuccucugggcag

SEQ ID NO: 2558627 - RNA, 20 nt, Human
cugagcuccucugggcagga

SEQ ID NO: 2558628 - RNA, 23 nt, Human
cugagcuccucugggcaggaccu

SEQ ID NO: 2558629 - RNA, 19 nt, Human
cugagcuagaagcuggagg

SEQ ID NO: 2558630 - RNA, 13 nt, Human
cugagcuauuuca

SEQ ID NO: 2558631 - RNA, 16 nt, Human
cugagcuauuucaucu

SEQ ID NO: 2558632 - RNA, 21 nt, Human
cugagcuauuucaucuauuuu

SEQ ID NO: 2558633 - RNA, 19 nt, Human
cugagcggaugcaucuggg

SEQ ID NO: 2558634 - RNA, 14 nt, Human
cugagcgcuccugc

SEQ ID NO: 2558635 - RNA, 23 nt, Human
cugagcgugcuuuccaaaaccca

SEQ ID NO: 2558636 - RNA, 20 nt, Human
cugagcgaggagaugcuccu

SEQ ID NO: 2558637 - RNA, 21 nt, Human
cugagccuuguaauucuaaau

SEQ ID NO: 2558638 - RNA, 17 nt, Human
cugagcgauuauuaucu

SEQ ID NO: 2558639 - RNA, 15 nt, Human
cugagcgccaggaug

SEQ ID NO: 2558640 - RNA, 15 nt, Human
cugagcgccuccauc

SEQ ID NO: 2558641 - RNA, 13 nt, Human
cugagcgccucca

SEQ ID NO: 2558642 - RNA, 22 nt, Human
cugagcgccuccauccaaggcc

SEQ ID NO: 2558643 - RNA, 17 nt, Human
cucuuuaugacuguuuu

SEQ ID NO: 2558644 - RNA, 22 nt, Human
cucuuuauauggccucaagauc

SEQ ID NO: 2558645 - RNA, 13 nt, Human
cucuuucccuccc

SEQ ID NO: 2558646 - RNA, 17 nt, Human
cucuuucccucccuucc

SEQ ID NO: 2558647 - RNA, 17 nt, Human
cucuuuagaguuagacu

SEQ ID NO: 2558648 - RNA, 15 nt, Human
cucuuuagaguuaga

SEQ ID NO: 2558649 - RNA, 21 nt, Human
cucuuuaagaguuaguuucuu

SEQ ID NO: 2558650 - RNA, 19 nt, Human
cucuuuagaguuagacugu

SEQ ID NO: 2558651 - RNA, 18 nt, Human
cucuuuagaguuagacug

SEQ ID NO: 2558652 - RNA, 21 nt, Human
cucuuuagaguuagacuguug

SEQ ID NO: 2558653 - RNA, 12 nt, Human
cucuuuagccag

SEQ ID NO: 2558654 - RNA, 16 nt, Human
cucuuuaaucuucagu

SEQ ID NO: 2558655 - RNA, 23 nt, Human
cucuuuaaugucacaggcagguc

SEQ ID NO: 2558656 - RNA, 22 nt, Human
cucuuuaaugucacaggcaggu

SEQ ID NO: 2558657 - RNA, 21 nt, Human
cucuuuaaugucacaggcagg

SEQ ID NO: 2558658 - RNA, 20 nt, Human
cucuuuaaugucacaggcag

SEQ ID NO: 2558659 - RNA, 17 nt, Human
cucuugguccugcugca

SEQ ID NO: 2558660 - RNA, 16 nt, Human
cucuugguccugcugc

SEQ ID NO: 2558661 - RNA, 15 nt, Human
cucuugguccugcug

SEQ ID NO: 2558662 - RNA, 13 nt, Human
cucuugguccugc

SEQ ID NO: 2558663 - RNA, 13 nt, Human
cucuuguggaugu

SEQ ID NO: 2558664 - RNA, 13 nt, Human
cucuuuaaaaaca

SEQ ID NO: 2558665 - RNA, 16 nt, Human
cucuuguuuucaguuu

SEQ ID NO: 2558666 - RNA, 15 nt, Human
cucuuuaacuucucg

SEQ ID NO: 2558667 - RNA, 18 nt, Human
cucuuuaaugucacaggc

SEQ ID NO: 2558668 - RNA, 15 nt, Human
cucuucuugaaauuu

SEQ ID NO: 2558669 - RNA, 20 nt, Human
cucuucuugaaauuuuaacc

SEQ ID NO: 2558670 - RNA, 15 nt, Human
cucuucuucuucaga

SEQ ID NO: 2558671 - RNA, 17 nt, Human
cucuucuucuucagaag

SEQ ID NO: 2558672 - RNA, 18 nt, Human
cucuucuucuucagaaga

SEQ ID NO: 2558673 - RNA, 16 nt, Human
cucuucugugggugac

SEQ ID NO: 2558674 - RNA, 18 nt, Human
cucuucuggguuccuucc

SEQ ID NO: 2558675 - RNA, 23 nt, Human
cucuucugugggugacccagguc

SEQ ID NO: 2558676 - RNA, 19 nt, Human
cucuucuuaacuuaaauuu

SEQ ID NO: 2558677 - RNA, 18 nt, Human
cucuuccagaaucccaag

SEQ ID NO: 2558678 - RNA, 13 nt, Human
cucuuccagaauc

SEQ ID NO: 2558679 - RNA, 23 nt, Human
cucuuccgaaaaauccucuuccu

SEQ ID NO: 2558680 - RNA, 22 nt, Human
cucuuccgaaaaauccucuucc

SEQ ID NO: 2558681 - RNA, 20 nt, Human
cucuuccgaaaaauccucuu

SEQ ID NO: 2558682 - RNA, 20 nt, Human
cucuuccuacccaaccacuc

SEQ ID NO: 2558683 - RNA, 19 nt, Human
cucuuccuacccaaccacu

SEQ ID NO: 2558684 - RNA, 22 nt, Human
cucuuccuacccaaccacucaa

SEQ ID NO: 2558685 - RNA, 15 nt, Human
cucuuccuacccaac

SEQ ID NO: 2558686 - RNA, 12 nt, Human
cucuuccuaccc

SEQ ID NO: 2558687 - RNA, 20 nt, Human
cucuuccgugacgucacugg

SEQ ID NO: 2558688 - RNA, 19 nt, Human
cucuuccggagauguagca

SEQ ID NO: 2558689 - RNA, 22 nt, Human
cucuuccggagauguagcaaaa

SEQ ID NO: 2558690 - RNA, 23 nt, Human
cucuuccggagauguagcaaaac

SEQ ID NO: 2558691 - RNA, 15 nt, Human
cucuugaacuccuga

SEQ ID NO: 2558692 - RNA, 19 nt, Human
cucuuggguucaagcgauu

SEQ ID NO: 2558693 - RNA, 21 nt, Human
cucuuggguucaagcgauucu

SEQ ID NO: 2558694 - RNA, 19 nt, Human
cucuuggguucaagugauu

SEQ ID NO: 2558695 - RNA, 23 nt, Human
cucuucuugaacacucaugcuga

SEQ ID NO: 2558696 - RNA, 18 nt, Human
cucuucuugaacacucau

SEQ ID NO: 2558697 - RNA, 14 nt, Human
cucuucuucuuucu

SEQ ID NO: 2558698 - RNA, 22 nt, Human
cucuucuuuauacuguaauuua

SEQ ID NO: 2558699 - RNA, 21 nt, Human
cucuucuuuauacuguaauuu

SEQ ID NO: 2558700 - RNA, 22 nt, Human
cucuucuuuaaagggauggcaa

SEQ ID NO: 2558701 - RNA, 22 nt, Human
cucuugaaauauaggaacuuaa

SEQ ID NO: 2558702 - RNA, 24 nt, Human
cucuucuuuauacuguaauuuagu

SEQ ID NO: 2558703 - RNA, 23 nt, Human
cucuucuuuuaaaccauuuucuu

SEQ ID NO: 2558704 - RNA, 19 nt, Human
cucuucuuuuggcuuccau

SEQ ID NO: 2558705 - RNA, 16 nt, Human
cucuucuuuuggcuuc

SEQ ID NO: 2558706 - RNA, 16 nt, Human
cugaaagcccugagcu

SEQ ID NO: 2558707 - RNA, 17 nt, Human
cugaaagcccugagcuu

SEQ ID NO: 2558708 - RNA, 18 nt, Human
cugaaagcccugagcuuu

SEQ ID NO: 2558709 - RNA, 19 nt, Human
cugaaagcccugagcuuuc

SEQ ID NO: 2558710 - RNA, 23 nt, Human
cugaaagcccugagcuuucugcu

SEQ ID NO: 2558711 - RNA, 23 nt, Human
cugaaagccauuuguuggggcag

SEQ ID NO: 2558712 - RNA, 23 nt, Human
cugaaagccagcugccgaccaga

SEQ ID NO: 2558713 - RNA, 22 nt, Human
cugaaauagacccacaagaggc

SEQ ID NO: 2558714 - RNA, 18 nt, Human
cugaaauauacacacagc

SEQ ID NO: 2558715 - RNA, 19 nt, Human
cugaaauauacacacagca

SEQ ID NO: 2558716 - RNA, 14 nt, Human
cucuuucuguauau

SEQ ID NO: 2558717 - RNA, 20 nt, Human
cucuuuccuuggcucccauu

SEQ ID NO: 2558718 - RNA, 15 nt, Human
cucuuucuguauaua

SEQ ID NO: 2558719 - RNA, 19 nt, Human
cucuuucugucccuucugu

SEQ ID NO: 2558720 - RNA, 16 nt, Human
cucuuuccuccuucca

SEQ ID NO: 2558721 - RNA, 13 nt, Human
cucuuuccuugcu

SEQ ID NO: 2558722 - RNA, 11 nt, Human
cucuuuccuug

SEQ ID NO: 2558723 - RNA, 16 nt, Human
cucuuuccuucuugcc

SEQ ID NO: 2558724 - RNA, 22 nt, Human
cucuuuccuguuguuguuaaug

SEQ ID NO: 2558725 - RNA, 10 nt, Human
cucuuugaga

SEQ ID NO: 2558726 - RNA, 15 nt, Human
cucuuugagauagaa

SEQ ID NO: 2558727 - RNA, 23 nt, Human
cucuuugagauagaagaacugca

SEQ ID NO: 2558728 - RNA, 14 nt, Human
cucuuugaaugaca

SEQ ID NO: 2558729 - RNA, 18 nt, Human
cucuuucuucucugcugc

SEQ ID NO: 2558730 - RNA, 22 nt, Human
cucuuugaaauagucuguguga

SEQ ID NO: 2558731 - RNA, 12 nt, Human
cucuuugaauuu

SEQ ID NO: 2558732 - RNA, 17 nt, Human
cucuuugaaugacaaag

SEQ ID NO: 2558733 - RNA, 20 nt, Human
cucuuugaauuuucuguguu

SEQ ID NO: 2558734 - RNA, 15 nt, Human
cugaaagcccugagc

SEQ ID NO: 2558735 - RNA, 21 nt, Human
cugaaagccacguuccuuacu

SEQ ID NO: 2558736 - RNA, 14 nt, Human
cugaaagccagcug

SEQ ID NO: 2558737 - RNA, 13 nt, Human
cugaaauuucaga

SEQ ID NO: 2558738 - RNA, 20 nt, Human
cugaaauucuccuggagguc

SEQ ID NO: 2558739 - RNA, 13 nt, Human
cugaaaugaagau

SEQ ID NO: 2558740 - RNA, 16 nt, Human
cugaaaucugaagacc

SEQ ID NO: 2558741 - RNA, 19 nt, Human
cugaaaucucagaauuccu

SEQ ID NO: 2558742 - RNA, 20 nt, Human
cugaacacuuuuguuguaaa

SEQ ID NO: 2558743 - RNA, 23 nt, Human
cugaacacuccaauuaaggauuu

SEQ ID NO: 2558744 - RNA, 19 nt, Human
cugaacacuuuuguuguaa

SEQ ID NO: 2558745 - RNA, 18 nt, Human
cugaacacuccaauuaag

SEQ ID NO: 2558746 - RNA, 14 nt, Human
cugaaauuucagau

SEQ ID NO: 2558747 - RNA, 13 nt, Human
cugaaauuuuaua

SEQ ID NO: 2558748 - RNA, 14 nt, Human
cugaaauuucacca

SEQ ID NO: 2558749 - RNA, 22 nt, Human
cugaacuaauaaaucuguugcc

SEQ ID NO: 2558750 - RNA, 15 nt, Human
cugaacucaaacuga

SEQ ID NO: 2558751 - RNA, 18 nt, Human
cugaacucaaacugagga

SEQ ID NO: 2558752 - RNA, 13 nt, Human
cugaacucacuuu

SEQ ID NO: 2558753 - RNA, 16 nt, Human
cugaacucugacaaca

SEQ ID NO: 2558754 - RNA, 17 nt, Human
cugaacucugacaacag

SEQ ID NO: 2558755 - RNA, 17 nt, Human
cugaacggggagaaaag

SEQ ID NO: 2558756 - RNA, 12 nt, Human
cugaacagugga

SEQ ID NO: 2558757 - RNA, 13 nt, Human
cugaacggggaga

SEQ ID NO: 2558758 - RNA, 13 nt, Human
cugaacagcugua

SEQ ID NO: 2558759 - RNA, 19 nt, Human
cugaagaauugaaaaacca

SEQ ID NO: 2558760 - RNA, 16 nt, Human
cugaacugggaccuuu

SEQ ID NO: 2558761 - RNA, 16 nt, Human
cugaagaccucgagca

SEQ ID NO: 2558762 - RNA, 23 nt, Human
cugaagaagcaccaaucaugaau

SEQ ID NO: 2558763 - RNA, 19 nt, Human
cugaacugauggguuucuc

SEQ ID NO: 2558764 - RNA, 13 nt, Human
cugaacucuccag

SEQ ID NO: 2558765 - RNA, 22 nt, Human
cucuggcuccagcuggccggga

SEQ ID NO: 2558766 - RNA, 16 nt, Human
cucuggcucucauggg

SEQ ID NO: 2558767 - RNA, 13 nt, Human
cucuggcucucau

SEQ ID NO: 2558768 - RNA, 12 nt, Human
cucuggcucuca

SEQ ID NO: 2558769 - RNA, 18 nt, Human
cucuggcugaacccugug

SEQ ID NO: 2558770 - RNA, 17 nt, Human
cucuggcugaacccugu

SEQ ID NO: 2558771 - RNA, 16 nt, Human
cucuggcugaacccug

SEQ ID NO: 2558772 - RNA, 15 nt, Human
cucuggcugaacccu

SEQ ID NO: 2558773 - RNA, 20 nt, Human
cucuggcugaacccugugcu

SEQ ID NO: 2558774 - RNA, 19 nt, Human
cucuggcugaacccugugc

SEQ ID NO: 2558775 - RNA, 21 nt, Human
cucuggcugaacccugugcug

SEQ ID NO: 2558776 - RNA, 13 nt, Human
cucuggcuggcua

SEQ ID NO: 2558777 - RNA, 18 nt, Human
cucuggcuuccagguauc

SEQ ID NO: 2558778 - RNA, 17 nt, Human
cucuggcuuccagguau

SEQ ID NO: 2558779 - RNA, 14 nt, Human
cucuggcuuccagg

SEQ ID NO: 2558780 - RNA, 13 nt, Human
cucuggcuuccag

SEQ ID NO: 2558781 - RNA, 12 nt, Human
cucuggcuucca

SEQ ID NO: 2558782 - RNA, 22 nt, Human
cucuggcugguuuggaaugcuu

SEQ ID NO: 2558783 - RNA, 21 nt, Human
cucuggcugguuuggaaugcu

SEQ ID NO: 2558784 - RNA, 15 nt, Human
cucuggcuggggagc

SEQ ID NO: 2558785 - RNA, 13 nt, Human
cucuggcugggga

SEQ ID NO: 2558786 - RNA, 23 nt, Human
cucuggcuggcuaacuggaagca

SEQ ID NO: 2558787 - RNA, 22 nt, Human
cucugggaaaugagaaggcagc

SEQ ID NO: 2558788 - RNA, 20 nt, Human
cucugggaaaugagaaggca

SEQ ID NO: 2558789 - RNA, 14 nt, Human
cucugucucaucca

SEQ ID NO: 2558790 - RNA, 15 nt, Human
cucugucucauccau

SEQ ID NO: 2558791 - RNA, 23 nt, Human
cucugggaaaugagaaggcagcc

SEQ ID NO: 2558792 - RNA, 19 nt, Human
cucugggaaauaagagaga

SEQ ID NO: 2558793 - RNA, 17 nt, Human
cucugucugcccuucac

SEQ ID NO: 2558794 - RNA, 14 nt, Human
cucugucugcccuu

SEQ ID NO: 2558795 - RNA, 22 nt, Human
cucugucugaguaagaaacaga

SEQ ID NO: 2558796 - RNA, 23 nt, Human
cucugucucaugugugcucuucu

SEQ ID NO: 2558797 - RNA, 20 nt, Human
cucugucucaugugugcucu

SEQ ID NO: 2558798 - RNA, 16 nt, Human
cucugucucaugugug

SEQ ID NO: 2558799 - RNA, 14 nt, Human
cucugucucaugug

SEQ ID NO: 2558800 - RNA, 13 nt, Human
cucugugcugugu

SEQ ID NO: 2558801 - RNA, 15 nt, Human
cucugugcuguggaa

SEQ ID NO: 2558802 - RNA, 14 nt, Human
cucugugcugugga

SEQ ID NO: 2558803 - RNA, 21 nt, Human
cucugugcugacccuccuguu

SEQ ID NO: 2558804 - RNA, 20 nt, Human
cucugugcugacccuccugu

SEQ ID NO: 2558805 - RNA, 19 nt, Human
cucugugcugacccuccug

SEQ ID NO: 2558806 - RNA, 15 nt, Human
cucugugcugacccu

SEQ ID NO: 2558807 - RNA, 15 nt, Human
cucugugccuucuuu

SEQ ID NO: 2558808 - RNA, 16 nt, Human
cucugugccuucuuuu

SEQ ID NO: 2558809 - RNA, 23 nt, Human
cucugugcccaugggcacugcug

SEQ ID NO: 2558810 - RNA, 22 nt, Human
cucugugcccaugggcacugcu

SEQ ID NO: 2558811 - RNA, 20 nt, Human
cucugugcccaugggcacug

SEQ ID NO: 2558812 - RNA, 16 nt, Human
cucugugcccaugggc

SEQ ID NO: 2558813 - RNA, 20 nt, Human
cucugugcccccaucacccu

SEQ ID NO: 2558814 - RNA, 13 nt, Human
cucugugccuucg

SEQ ID NO: 2558815 - RNA, 14 nt, Human
cucugugcccaugg

SEQ ID NO: 2558816 - RNA, 12 nt, Human
cucugugcccau

SEQ ID NO: 2558817 - RNA, 22 nt, Human
cucugugcccacccuccacucu

SEQ ID NO: 2558818 - RNA, 18 nt, Human
cucugugagacucgagaa

SEQ ID NO: 2558819 - RNA, 17 nt, Human
cucugugagacucgaga

SEQ ID NO: 2558820 - RNA, 13 nt, Human
cucugugagacuc

SEQ ID NO: 2558821 - RNA, 22 nt, Human
cucugucugcccuucaccccag

SEQ ID NO: 2558822 - RNA, 17 nt, Human
cucugucuucaccugau

SEQ ID NO: 2558823 - RNA, 22 nt, Human
cucugugagcaucacaguuuug

SEQ ID NO: 2558824 - RNA, 18 nt, Human
cucugugagcaucacagu

SEQ ID NO: 2558825 - RNA, 21 nt, Human
cucugugagcaucacaguuuu

SEQ ID NO: 2558826 - RNA, 20 nt, Human
cucugugcagucacuggagg

SEQ ID NO: 2558827 - RNA, 15 nt, Human
cucuuccaggcuggg

SEQ ID NO: 2558828 - RNA, 14 nt, Human
cucuuccaggcugg

SEQ ID NO: 2558829 - RNA, 13 nt, Human
cucuuccaggcug

SEQ ID NO: 2558830 - RNA, 23 nt, Human
cucuuacuuuccuuuccccagcc

SEQ ID NO: 2558831 - RNA, 22 nt, Human
cucuuacuuuccuuuccccagc

SEQ ID NO: 2558832 - RNA, 14 nt, Human
cucuuacugcuaac

SEQ ID NO: 2558833 - RNA, 19 nt, Human
cucuuacugcaaaugucau

SEQ ID NO: 2558834 - RNA, 17 nt, Human
cucuuccacucuccuug

SEQ ID NO: 2558835 - RNA, 13 nt, Human
cucuuagaaaaac

SEQ ID NO: 2558836 - RNA, 15 nt, Human
cucuuagaaaaacca

SEQ ID NO: 2558837 - RNA, 22 nt, Human
cucuuacgcccaacccuucccc

SEQ ID NO: 2558838 - RNA, 18 nt, Human
cucuuacgcccaacccuu

SEQ ID NO: 2558839 - RNA, 18 nt, Human
cucuguucaguguaaaua

SEQ ID NO: 2558840 - RNA, 16 nt, Human
cucuuacugcaaaugu

SEQ ID NO: 2558841 - RNA, 20 nt, Human
cucuuacgcccaacccuucc

SEQ ID NO: 2558842 - RNA, 14 nt, Human
cucuuacugcaaau

SEQ ID NO: 2558843 - RNA, 17 nt, Human
cucuguucauuuccuca

SEQ ID NO: 2558844 - RNA, 16 nt, Human
cucuguucauuuccuc

SEQ ID NO: 2558845 - RNA, 23 nt, Human
cucugugcuuugacucaccuguu

SEQ ID NO: 2558846 - RNA, 21 nt, Human
cucugugcuuugacucaccug

SEQ ID NO: 2558847 - RNA, 18 nt, Human
cucugugcuuugacucac

SEQ ID NO: 2558848 - RNA, 18 nt, Human
cucugugcuguggaagca

SEQ ID NO: 2558849 - RNA, 22 nt, Human
cucugugcuuuuaaaugcauaa

SEQ ID NO: 2558850 - RNA, 16 nt, Human
cucugugggcugcacu

SEQ ID NO: 2558851 - RNA, 14 nt, Human
cucugugggcugca

SEQ ID NO: 2558852 - RNA, 13 nt, Human
cucugugggcugc

SEQ ID NO: 2558853 - RNA, 14 nt, Human
cucuggcccugccu

SEQ ID NO: 2558854 - RNA, 23 nt, Human
cucugugggcugcacucugugcc

SEQ ID NO: 2558855 - RNA, 17 nt, Human
cucugugggcugcacuc

SEQ ID NO: 2558856 - RNA, 17 nt, Human
cucugugggcuggcagu

SEQ ID NO: 2558857 - RNA, 16 nt, Human
cucugugucacuggcu

SEQ ID NO: 2558858 - RNA, 13 nt, Human
cucugugucacug

SEQ ID NO: 2558859 - RNA, 19 nt, Human
cucuguguauuugcuuuuu

SEQ ID NO: 2558860 - RNA, 18 nt, Human
cucuguguauuugcuuuu

SEQ ID NO: 2558861 - RNA, 15 nt, Human
cucugugucaggugg

SEQ ID NO: 2558862 - RNA, 13 nt, Human
cucuguucauuuc

SEQ ID NO: 2558863 - RNA, 14 nt, Human
cucuguucauuucc

SEQ ID NO: 2558864 - RNA, 14 nt, Human
cucuguucagugua

SEQ ID NO: 2558865 - RNA, 15 nt, Human
cucuguucaguguaa

SEQ ID NO: 2558866 - RNA, 17 nt, Human
cucuguucaguguaaau

SEQ ID NO: 2558867 - RNA, 19 nt, Human
cucuguguuuguuccuaca

SEQ ID NO: 2558868 - RNA, 20 nt, Human
cucuguguugugaaugucau

SEQ ID NO: 2558869 - RNA, 23 nt, Human
cucugugucacuggcugccucca

SEQ ID NO: 2558870 - RNA, 20 nt, Human
cucugugucacuggcugccu

SEQ ID NO: 2558871 - RNA, 18 nt, Human
cucugugucacuggcugc

SEQ ID NO: 2558872 - RNA, 17 nt, Human
cucugugucacuggcug

SEQ ID NO: 2558873 - RNA, 13 nt, Human
cucugugugcucc

SEQ ID NO: 2558874 - RNA, 21 nt, Human
cucuggagggguguggcuccu

SEQ ID NO: 2558875 - RNA, 20 nt, Human
cucuggagggguguggcucc

SEQ ID NO: 2558876 - RNA, 19 nt, Human
cucuggagggguguggcuc

SEQ ID NO: 2558877 - RNA, 16 nt, Human
cucuggaggggagggg

SEQ ID NO: 2558878 - RNA, 15 nt, Human
cucuggaugccugau

SEQ ID NO: 2558879 - RNA, 22 nt, Human
cucuggaucaaaguaggcagga

SEQ ID NO: 2558880 - RNA, 20 nt, Human
cucuggaguggccacuaagc

SEQ ID NO: 2558881 - RNA, 12 nt, Human
cucuggaguggc

SEQ ID NO: 2558882 - RNA, 14 nt, Human
cucuggaguggcca

SEQ ID NO: 2558883 - RNA, 15 nt, Human
cucuggaguggccac

SEQ ID NO: 2558884 - RNA, 16 nt, Human
cucuggaguggccacu

SEQ ID NO: 2558885 - RNA, 14 nt, Human
cucuggcagcucag

SEQ ID NO: 2558886 - RNA, 12 nt, Human
cucuggcagcuc

SEQ ID NO: 2558887 - RNA, 22 nt, Human
cucuggacaggcauguucucug

SEQ ID NO: 2558888 - RNA, 16 nt, Human
cucuggacaggcaugu

SEQ ID NO: 2558889 - RNA, 14 nt, Human
cucuggacaggcau

SEQ ID NO: 2558890 - RNA, 19 nt, Human
cucuggagcccacuguacu

SEQ ID NO: 2558891 - RNA, 15 nt, Human
cucuggaggggaggg

SEQ ID NO: 2558892 - RNA, 14 nt, Human
cucuggaggggagg

SEQ ID NO: 2558893 - RNA, 24 nt, Human
cucugcuuugacugagcagacugg

SEQ ID NO: 2558894 - RNA, 15 nt, Human
cucuggcuccagcug

SEQ ID NO: 2558895 - RNA, 16 nt, Human
cucuggcuccagcugg

SEQ ID NO: 2558896 - RNA, 20 nt, Human
cucuggcuagaggccagccc

SEQ ID NO: 2558897 - RNA, 21 nt, Human
cucuggcuagaggccagcccc

SEQ ID NO: 2558898 - RNA, 22 nt, Human
cucuggcuagaggccagcccca

SEQ ID NO: 2558899 - RNA, 16 nt, Human
cucuggcuagaggcca

SEQ ID NO: 2558900 - RNA, 19 nt, Human
cucuggccuucggccucca

SEQ ID NO: 2558901 - RNA, 16 nt, Human
cucuggccucccaccc

SEQ ID NO: 2558902 - RNA, 15 nt, Human
cucuggccucccacc

SEQ ID NO: 2558903 - RNA, 14 nt, Human
cucuggccucccac

SEQ ID NO: 2558904 - RNA, 13 nt, Human
cucuggccuccca

SEQ ID NO: 2558905 - RNA, 17 nt, Human
cucuggccucccacccg

SEQ ID NO: 2558906 - RNA, 19 nt, Human
cucuggcuagaggccagcc

SEQ ID NO: 2558907 - RNA, 16 nt, Human
cucuggcagcucagag

SEQ ID NO: 2558908 - RNA, 15 nt, Human
cucuggcagcucaga

SEQ ID NO: 2558909 - RNA, 12 nt, Human
cucuggccuucg

SEQ ID NO: 2558910 - RNA, 23 nt, Human
cucuggaugccugauugccaagc

SEQ ID NO: 2558911 - RNA, 19 nt, Human
cucuggaugccugauugcc

SEQ ID NO: 2558912 - RNA, 18 nt, Human
cucuggcccugccuucuu

SEQ ID NO: 2558913 - RNA, 18 nt, Human
cucuggccucagccgacu

SEQ ID NO: 2558914 - RNA, 15 nt, Human
cucuggcccugccuu

SEQ ID NO: 2558915 - RNA, 22 nt, Human
cucucuccccucaaagucugca

SEQ ID NO: 2558916 - RNA, 19 nt, Human
cucucuccccucaaagucu

SEQ ID NO: 2558917 - RNA, 14 nt, Human
cucucuccuccugc

SEQ ID NO: 2558918 - RNA, 17 nt, Human
cucucuccuccugccca

SEQ ID NO: 2558919 - RNA, 15 nt, Human
cucucuccuguacuu

SEQ ID NO: 2558920 - RNA, 13 nt, Human
cucucuccucccu

SEQ ID NO: 2558921 - RNA, 20 nt, Human
cucucuccuguacuuuuucc

SEQ ID NO: 2558922 - RNA, 20 nt, Human
cucucuccuccugcccaccu

SEQ ID NO: 2558923 - RNA, 14 nt, Human
cucucuccugucca

SEQ ID NO: 2558924 - RNA, 19 nt, Human
cucucuccuguccaaccua

SEQ ID NO: 2558925 - RNA, 15 nt, Human
cucucuccuuugcug

SEQ ID NO: 2558926 - RNA, 15 nt, Human
cucucuccuguccaa

SEQ ID NO: 2558927 - RNA, 13 nt, Human
cucucucugacuc

SEQ ID NO: 2558928 - RNA, 15 nt, Human
cucucucucuuuccu

SEQ ID NO: 2558929 - RNA, 15 nt, Human
cucucucucucuccc

SEQ ID NO: 2558930 - RNA, 15 nt, Human
cucucucucuccccu

SEQ ID NO: 2558931 - RNA, 12 nt, Human
cucucucuucug

SEQ ID NO: 2558932 - RNA, 18 nt, Human
cucucucuucugcuccac

SEQ ID NO: 2558933 - RNA, 20 nt, Human
cucucugaagaugaucauuu

SEQ ID NO: 2558934 - RNA, 14 nt, Human
cucucucugacucu

SEQ ID NO: 2558935 - RNA, 18 nt, Human
cucugccugaaccuucca

SEQ ID NO: 2558936 - RNA, 14 nt, Human
cucugccugcauuc

SEQ ID NO: 2558937 - RNA, 16 nt, Human
cucugccugcauucug

SEQ ID NO: 2558938 - RNA, 11 nt, Human
cucugccugcc

SEQ ID NO: 2558939 - RNA, 22 nt, Human
cucugccugcauucugccgugu

SEQ ID NO: 2558940 - RNA, 22 nt, Human
cucugccugaagucacacagug

SEQ ID NO: 2558941 - RNA, 21 nt, Human
cucugccugaagucacacagu

SEQ ID NO: 2558942 - RNA, 21 nt, Human
cucucucuucugcuccacccu

SEQ ID NO: 2558943 - RNA, 16 nt, Human
cucucugaaccccucc

SEQ ID NO: 2558944 - RNA, 15 nt, Human
cucugcuucucugac

SEQ ID NO: 2558945 - RNA, 14 nt, Human
cucugcuucucuga

SEQ ID NO: 2558946 - RNA, 13 nt, Human
cucugcuucucug

SEQ ID NO: 2558947 - RNA, 12 nt, Human
cucugcuucucu

SEQ ID NO: 2558948 - RNA, 17 nt, Human
cucugcuucucugacuu

SEQ ID NO: 2558949 - RNA, 16 nt, Human
cucugcuucucugacu

SEQ ID NO: 2558950 - RNA, 21 nt, Human
cucugcuucucugacuucugc

SEQ ID NO: 2558951 - RNA, 19 nt, Human
cucugcuugacaacaucug

SEQ ID NO: 2558952 - RNA, 21 nt, Human
cucugcuggccuggccggcaa

SEQ ID NO: 2558953 - RNA, 17 nt, Human
cucugcuggccuggccg

SEQ ID NO: 2558954 - RNA, 16 nt, Human
cucugcuggccuggcc

SEQ ID NO: 2558955 - RNA, 15 nt, Human
cucugcuggccuggc

SEQ ID NO: 2558956 - RNA, 14 nt, Human
cucugcuggccugg

SEQ ID NO: 2558957 - RNA, 13 nt, Human
cucugcuggccug

SEQ ID NO: 2558958 - RNA, 13 nt, Human
cucugccugcccc

SEQ ID NO: 2558959 - RNA, 12 nt, Human
cucugccugccc

SEQ ID NO: 2558960 - RNA, 13 nt, Human
cucugcugucuaa

SEQ ID NO: 2558961 - RNA, 23 nt, Human
cucugcuguacauauuugagacu

SEQ ID NO: 2558962 - RNA, 14 nt, Human
cucugcuucucacg

SEQ ID NO: 2558963 - RNA, 15 nt, Human
cucuggacaggcaug

SEQ ID NO: 2558964 - RNA, 17 nt, Human
cucugcuugagucaggu

SEQ ID NO: 2558965 - RNA, 18 nt, Human
cucugcuugagucagguu

SEQ ID NO: 2558966 - RNA, 19 nt, Human
cucugcuuugacugagcag

SEQ ID NO: 2558967 - RNA, 19 nt, Human
cuguauuugugacuaauug

SEQ ID NO: 2558968 - RNA, 17 nt, Human
cuguauuugugacuaau

SEQ ID NO: 2558969 - RNA, 16 nt, Human
cuguauuugugacuaa

SEQ ID NO: 2558970 - RNA, 15 nt, Human
cuguauuugugacua

SEQ ID NO: 2558971 - RNA, 14 nt, Human
cuguauuugugacu

SEQ ID NO: 2558972 - RNA, 13 nt, Human
cuguauuugugac

SEQ ID NO: 2558973 - RNA, 12 nt, Human
cuguauuuguga

SEQ ID NO: 2558974 - RNA, 23 nt, Human
cuguauuuguaucucugaagcau

SEQ ID NO: 2558975 - RNA, 21 nt, Human
cuguauuugugacuaauugua

SEQ ID NO: 2558976 - RNA, 20 nt, Human
cuguauuugugacuaauugu

SEQ ID NO: 2558977 - RNA, 23 nt, Human
cuguauuugugacuaauuguaua

SEQ ID NO: 2558978 - RNA, 16 nt, Human
cuguauuuuaaaagaa

SEQ ID NO: 2558979 - RNA, 13 nt, Human
cuguauuuuaaaa

SEQ ID NO: 2558980 - RNA, 20 nt, Human
cuguccacacccagcucagc

SEQ ID NO: 2558981 - RNA, 15 nt, Human
cuguccacacccagc

SEQ ID NO: 2558982 - RNA, 11 nt, Human
cuguccaagga

SEQ ID NO: 2558983 - RNA, 16 nt, Human
cuguccaaccuaaccc

SEQ ID NO: 2558984 - RNA, 20 nt, Human
cuguccaaccuaaccccuuu

SEQ ID NO: 2558985 - RNA, 23 nt, Human
cuguccaaccuaaccccuuuccu

SEQ ID NO: 2558986 - RNA, 19 nt, Human
cuguccaaaggaggcuggc

SEQ ID NO: 2558987 - RNA, 20 nt, Human
cuguccaaaggaggcuggca

SEQ ID NO: 2558988 - RNA, 21 nt, Human
cuguccaaaggaggcuggcag

SEQ ID NO: 2558989 - RNA, 22 nt, Human
cuguccaaaggaggcuggcagg

SEQ ID NO: 2558990 - RNA, 20 nt, Human
cuguccaaacugccuaagcc

SEQ ID NO: 2558991 - RNA, 15 nt, Human
cuguccaaacugccu

SEQ ID NO: 2558992 - RNA, 17 nt, Human
cuguccaaaggaggcug

SEQ ID NO: 2558993 - RNA, 18 nt, Human
cuguccaaaggaggcugg

SEQ ID NO: 2558994 - RNA, 15 nt, Human
cuguccagacagccu

SEQ ID NO: 2558995 - RNA, 13 nt, Human
cuguccagacagc

SEQ ID NO: 2558996 - RNA, 12 nt, Human
cuguccagacag

SEQ ID NO: 2558997 - RNA, 19 nt, Human
cuguccaggcacugcugcc

SEQ ID NO: 2558998 - RNA, 18 nt, Human
cuguccaggcacugcugc

SEQ ID NO: 2558999 - RNA, 22 nt, Human
cuguccaggcacugcugcccag

SEQ ID NO: 2559000 - RNA, 21 nt, Human
cuguccaggcacugcugccca

SEQ ID NO: 2559001 - RNA, 20 nt, Human
cuguccaggcacugcugccc

SEQ ID NO: 2559002 - RNA, 14 nt, Human
cugucccaccccca

SEQ ID NO: 2559003 - RNA, 19 nt, Human
cugucccaccaugcagugc

SEQ ID NO: 2559004 - RNA, 17 nt, Human
cuguccaggcacugcug

SEQ ID NO: 2559005 - RNA, 22 nt, Human
cugucccagguuaucugggcau

SEQ ID NO: 2559006 - RNA, 19 nt, Human
cugucccagguuaucuggg

SEQ ID NO: 2559007 - RNA, 23 nt, Human
cugucccaccucuucucuuccug

SEQ ID NO: 2559008 - RNA, 15 nt, Human
cugucccaccucuuc

SEQ ID NO: 2559009 - RNA, 16 nt, Human
cugucccacccccacc

SEQ ID NO: 2559010 - RNA, 14 nt, Human
cugucccaccucuu

SEQ ID NO: 2559011 - RNA, 13 nt, Human
cugucccaccucu

SEQ ID NO: 2559012 - RNA, 19 nt, Human
cugucccauggacacucca

SEQ ID NO: 2559013 - RNA, 17 nt, Human
cugucccauggacacuc

SEQ ID NO: 2559014 - RNA, 22 nt, Human
cugucccagugccgagaaggaa

SEQ ID NO: 2559015 - RNA, 16 nt, Human
cuguauauaaaggaaa

SEQ ID NO: 2559016 - RNA, 18 nt, Human
cuguauauaaaauauuuu

SEQ ID NO: 2559017 - RNA, 21 nt, Human
cuguauaguuaggauagcauu

SEQ ID NO: 2559018 - RNA, 16 nt, Human
cuguauaguuaggaua

SEQ ID NO: 2559019 - RNA, 15 nt, Human
cuguauauacaauaa

SEQ ID NO: 2559020 - RNA, 18 nt, Human
cuguauauacaauaacau

SEQ ID NO: 2559021 - RNA, 19 nt, Human
cuguauauacaauaacaua

SEQ ID NO: 2559022 - RNA, 23 nt, Human
cuguauauacaauaacauaauuu

SEQ ID NO: 2559023 - RNA, 15 nt, Human
cuguaucccaugagc

SEQ ID NO: 2559024 - RNA, 14 nt, Human
cuguaucccaugag

SEQ ID NO: 2559025 - RNA, 20 nt, Human
cuguaccuuuugaggagccc

SEQ ID NO: 2559026 - RNA, 21 nt, Human
cuguaccuguuccuuagaccu

SEQ ID NO: 2559027 - RNA, 14 nt, Human
cuguaccucugccu

SEQ ID NO: 2559028 - RNA, 22 nt, Human
cuguaccucuugagccuugaac

SEQ ID NO: 2559029 - RNA, 22 nt, Human
cuguaccuuuugaggagcccca

SEQ ID NO: 2559030 - RNA, 15 nt, Human
cuguauaguacuggc

SEQ ID NO: 2559031 - RNA, 15 nt, Human
cuguaugauucccag

SEQ ID NO: 2559032 - RNA, 18 nt, Human
cuguaucccaugagccuc

SEQ ID NO: 2559033 - RNA, 13 nt, Human
cuguauauacuuu

SEQ ID NO: 2559034 - RNA, 19 nt, Human
cuguaucccaugagccuca

SEQ ID NO: 2559035 - RNA, 21 nt, Human
cuguauggaauacaauguaau

SEQ ID NO: 2559036 - RNA, 12 nt, Human
cuguaugucaga

SEQ ID NO: 2559037 - RNA, 20 nt, Human
cuguaugucucgugguagga

SEQ ID NO: 2559038 - RNA, 13 nt, Human
cuguauguugucc

SEQ ID NO: 2559039 - RNA, 19 nt, Human
cuguauuaagagugaaaau

SEQ ID NO: 2559040 - RNA, 18 nt, Human
cuguauguuguccaauug

SEQ ID NO: 2559041 - RNA, 15 nt, Human
cuguauguuguccaa

SEQ ID NO: 2559042 - RNA, 15 nt, Human
cuguauuaagccacu

SEQ ID NO: 2559043 - RNA, 18 nt, Human
cuguauuuaugugugagg

SEQ ID NO: 2559044 - RNA, 23 nt, Human
cuguauuuaugugugaggagcug

SEQ ID NO: 2559045 - RNA, 14 nt, Human
cuguauuuguaucu

SEQ ID NO: 2559046 - RNA, 22 nt, Human
cuguauuugccggugccuagga

SEQ ID NO: 2559047 - RNA, 16 nt, Human
cuguauuugagaauau

SEQ ID NO: 2559048 - RNA, 17 nt, Human
cuguauuuaugugugag

SEQ ID NO: 2559049 - RNA, 20 nt, Human
cuguccuacucugugucagg

SEQ ID NO: 2559050 - RNA, 18 nt, Human
cuguccuacucuguguca

SEQ ID NO: 2559051 - RNA, 17 nt, Human
cuguccuacucuguguc

SEQ ID NO: 2559052 - RNA, 16 nt, Human
cuguccuacucugugu

SEQ ID NO: 2559053 - RNA, 21 nt, Human
cugucccuugccucaaugcca

SEQ ID NO: 2559054 - RNA, 20 nt, Human
cugucccuugccucaaugcc

SEQ ID NO: 2559055 - RNA, 16 nt, Human
cugucccuugccucaa

SEQ ID NO: 2559056 - RNA, 15 nt, Human
cugucccuugccuca

SEQ ID NO: 2559057 - RNA, 13 nt, Human
cugucccuugccu

SEQ ID NO: 2559058 - RNA, 18 nt, Human
cugucccuucugucccuc

SEQ ID NO: 2559059 - RNA, 19 nt, Human
cugucccuucugucccuca

SEQ ID NO: 2559060 - RNA, 17 nt, Human
cugucccuucugucccu

SEQ ID NO: 2559061 - RNA, 21 nt, Human
cugucccuucucuuaauuuaa

SEQ ID NO: 2559062 - RNA, 23 nt, Human
cugucccucccaccucugugacc

SEQ ID NO: 2559063 - RNA, 19 nt, Human
cugucccuucccccauaag

SEQ ID NO: 2559064 - RNA, 16 nt, Human
cugucccuucucuuaa

SEQ ID NO: 2559065 - RNA, 18 nt, Human
cugucccccagcucuggu

SEQ ID NO: 2559066 - RNA, 17 nt, Human
cugucccccagcucugg

SEQ ID NO: 2559067 - RNA, 16 nt, Human
cugucccccagcucug

SEQ ID NO: 2559068 - RNA, 15 nt, Human
cugucccccagcucu

SEQ ID NO: 2559069 - RNA, 14 nt, Human
cugucccccagcuc

SEQ ID NO: 2559070 - RNA, 13 nt, Human
cugucccccagcu

SEQ ID NO: 2559071 - RNA, 18 nt, Human
cugucccauggacacucc

SEQ ID NO: 2559072 - RNA, 14 nt, Human
cugucccccugaca

SEQ ID NO: 2559073 - RNA, 13 nt, Human
cugucccccugac

SEQ ID NO: 2559074 - RNA, 21 nt, Human
cugucccucccaccucuguga

SEQ ID NO: 2559075 - RNA, 19 nt, Human
cugucccucccaccucugu

SEQ ID NO: 2559076 - RNA, 18 nt, Human
cugucccucccaccucug

SEQ ID NO: 2559077 - RNA, 17 nt, Human
cugucccucccaccucu

SEQ ID NO: 2559078 - RNA, 15 nt, Human
cugucccucccccuu

SEQ ID NO: 2559079 - RNA, 12 nt, Human
cugucccuccgg

SEQ ID NO: 2559080 - RNA, 16 nt, Human
cugucccucccaccuc

SEQ ID NO: 2559081 - RNA, 15 nt, Human
cugucccucccaccu

SEQ ID NO: 2559082 - RNA, 13 nt, Human
cugucccucccac

SEQ ID NO: 2559083 - RNA, 23 nt, Human
cugucccucaaaugacccaaaga

SEQ ID NO: 2559084 - RNA, 12 nt, Human
cugucccucacu

SEQ ID NO: 2559085 - RNA, 13 nt, Human
cugucccucacug

SEQ ID NO: 2559086 - RNA, 13 nt, Human
cugucccucacag

SEQ ID NO: 2559087 - RNA, 16 nt, Human
cugucccucacagcac

SEQ ID NO: 2559088 - RNA, 12 nt, Human
cugucccucaca

SEQ ID NO: 2559089 - RNA, 15 nt, Human
cugucccucaaauga

SEQ ID NO: 2559090 - RNA, 17 nt, Human
cugucccuaggucagcu

SEQ ID NO: 2559091 - RNA, 19 nt, Human
cugucccuaguaaaaauac

SEQ ID NO: 2559092 - RNA, 21 nt, Human
cugucccuaguaaaaauacaa

SEQ ID NO: 2559093 - RNA, 21 nt, Human
cuguccucacugcucccugaa

SEQ ID NO: 2559094 - RNA, 19 nt, Human
cuguccucacugcucccug

SEQ ID NO: 2559095 - RNA, 16 nt, Human
cugucucaguuucacu

SEQ ID NO: 2559096 - RNA, 12 nt, Human
cugucucaucca

SEQ ID NO: 2559097 - RNA, 15 nt, Human
cugucucauccauca

SEQ ID NO: 2559098 - RNA, 16 nt, Human
cugucucauccaucau

SEQ ID NO: 2559099 - RNA, 17 nt, Human
cugucucauccaucauc

SEQ ID NO: 2559100 - RNA, 20 nt, Human
cugucucauccaucaucaug

SEQ ID NO: 2559101 - RNA, 21 nt, Human
cugucucauccaucaucaugu

SEQ ID NO: 2559102 - RNA, 21 nt, Human
cugucucaagagggcacuggu

SEQ ID NO: 2559103 - RNA, 20 nt, Human
cugucucaagagggcacugg

SEQ ID NO: 2559104 - RNA, 19 nt, Human
cugucucaagagggcacug

SEQ ID NO: 2559105 - RNA, 18 nt, Human
cugucucaagagggcacu

SEQ ID NO: 2559106 - RNA, 21 nt, Human
cuguccuacucugugucaggu

SEQ ID NO: 2559107 - RNA, 13 nt, Human
cugucccuuggag

SEQ ID NO: 2559108 - RNA, 15 nt, Human
cuguccuaggccaca

SEQ ID NO: 2559109 - RNA, 16 nt, Human
cuguccucacugcucc

SEQ ID NO: 2559110 - RNA, 14 nt, Human
cuguccucacugcu

SEQ ID NO: 2559111 - RNA, 13 nt, Human
cuguccucacugc

SEQ ID NO: 2559112 - RNA, 22 nt, Human
cugucccuuggagcuguaaacc

SEQ ID NO: 2559113 - RNA, 22 nt, Human
cugucucaaaaaaagaaaaaga

SEQ ID NO: 2559114 - RNA, 15 nt, Human
cugucucuagccacu

SEQ ID NO: 2559115 - RNA, 20 nt, Human
cugucucuagccacuuuggu

SEQ ID NO: 2559116 - RNA, 17 nt, Human
cugucucuagccacuuu

SEQ ID NO: 2559117 - RNA, 13 nt, Human
cugucucucauga

SEQ ID NO: 2559118 - RNA, 17 nt, Human
cugucucucaugaaccu

SEQ ID NO: 2559119 - RNA, 18 nt, Human
cugucucuacuaaaaaua

SEQ ID NO: 2559120 - RNA, 22 nt, Human
cugucuccuuucaccccagggc

SEQ ID NO: 2559121 - RNA, 23 nt, Human
cugucuccuuucaccccagggcc

SEQ ID NO: 2559122 - RNA, 17 nt, Human
cugucucaguuucacuu

SEQ ID NO: 2559123 - RNA, 13 nt, Human
cugucucaucccc

SEQ ID NO: 2559124 - RNA, 14 nt, Human
cugucucaucccca

SEQ ID NO: 2559125 - RNA, 15 nt, Human
cugucucauccccag

SEQ ID NO: 2559126 - RNA, 16 nt, Human
cugucucauccccagg

SEQ ID NO: 2559127 - RNA, 17 nt, Human
cugucucauccccaggg

SEQ ID NO: 2559128 - RNA, 19 nt, Human
cugucucauccccaggggu

SEQ ID NO: 2559129 - RNA, 21 nt, Human
cugucucauccccaggggucc

SEQ ID NO: 2559130 - RNA, 12 nt, Human
cugucuccagac

SEQ ID NO: 2559131 - RNA, 20 nt, Human
cugucucauccccagggguc

SEQ ID NO: 2559132 - RNA, 20 nt, Human
cugucuccuuaacacugagc

SEQ ID NO: 2559133 - RNA, 22 nt, Human
cugggcucccuucccaccucuc

SEQ ID NO: 2559134 - RNA, 21 nt, Human
cugggcucccuucccaccucu

SEQ ID NO: 2559135 - RNA, 20 nt, Human
cugggcucccuucccaccuc

SEQ ID NO: 2559136 - RNA, 20 nt, Human
cugggccuccucacaacaug

SEQ ID NO: 2559137 - RNA, 19 nt, Human
cugggcucccuucccaccu

SEQ ID NO: 2559138 - RNA, 14 nt, Human
cuggguacuugugg

SEQ ID NO: 2559139 - RNA, 16 nt, Human
cuggguacuuguggac

SEQ ID NO: 2559140 - RNA, 18 nt, Human
cuggguacuuguggacac

SEQ ID NO: 2559141 - RNA, 16 nt, Human
cugggucgcccuggac

SEQ ID NO: 2559142 - RNA, 19 nt, Human
cuggguacuuguggacaca

SEQ ID NO: 2559143 - RNA, 20 nt, Human
cuggguuggcgcacccuccc

SEQ ID NO: 2559144 - RNA, 18 nt, Human
cuggguuggcgcacccuc

SEQ ID NO: 2559145 - RNA, 16 nt, Human
cuggguuggcgcaccc

SEQ ID NO: 2559146 - RNA, 23 nt, Human
cuggguuggcgcacccuccccuc

SEQ ID NO: 2559147 - RNA, 22 nt, Human
cuggguuggcgcacccuccccu

SEQ ID NO: 2559148 - RNA, 15 nt, Human
cuggguuggagggug

SEQ ID NO: 2559149 - RNA, 22 nt, Human
cuggguuggugcacagugauuu

SEQ ID NO: 2559150 - RNA, 19 nt, Human
cuggguuggugcacaguga

SEQ ID NO: 2559151 - RNA, 16 nt, Human
cuggguuggugcacag

SEQ ID NO: 2559152 - RNA, 15 nt, Human
cuggguuggugcaca

SEQ ID NO: 2559153 - RNA, 14 nt, Human
cuggguuggugcac

SEQ ID NO: 2559154 - RNA, 13 nt, Human
cuggguuggugca

SEQ ID NO: 2559155 - RNA, 23 nt, Human
cuggguuuauuacauggcagugu

SEQ ID NO: 2559156 - RNA, 22 nt, Human
cuggguuuauuacauggcagug

SEQ ID NO: 2559157 - RNA, 22 nt, Human
cuggguuuaaggggagaggaaa

SEQ ID NO: 2559158 - RNA, 18 nt, Human
cuggguuuaaggggagag

SEQ ID NO: 2559159 - RNA, 15 nt, Human
cuggguuuggacccc

SEQ ID NO: 2559160 - RNA, 13 nt, Human
cuggguuucuagc

SEQ ID NO: 2559161 - RNA, 18 nt, Human
cuggguuucucuguauag

SEQ ID NO: 2559162 - RNA, 18 nt, Human
cugggucgcccuggacug

SEQ ID NO: 2559163 - RNA, 17 nt, Human
cugggucgcccuggacu

SEQ ID NO: 2559164 - RNA, 22 nt, Human
cugggucgcccuggacugugug

SEQ ID NO: 2559165 - RNA, 22 nt, Human
cugggucucgcuuuguugccca

SEQ ID NO: 2559166 - RNA, 15 nt, Human
cugggucugugucuc

SEQ ID NO: 2559167 - RNA, 16 nt, Human
cugggucugugucucu

SEQ ID NO: 2559168 - RNA, 17 nt, Human
cugggucugugucucuu

SEQ ID NO: 2559169 - RNA, 13 nt, Human
cugguagggcagu

SEQ ID NO: 2559170 - RNA, 18 nt, Human
cugguaggaccaagcauc

SEQ ID NO: 2559171 - RNA, 19 nt, Human
cuggucacaggacucugcc

SEQ ID NO: 2559172 - RNA, 17 nt, Human
cugguaggaccaagcau

SEQ ID NO: 2559173 - RNA, 15 nt, Human
cugguaggaccaagc

SEQ ID NO: 2559174 - RNA, 15 nt, Human
cugguagcucaggug

SEQ ID NO: 2559175 - RNA, 16 nt, Human
cugguagcucaggugg

SEQ ID NO: 2559176 - RNA, 14 nt, Human
cugguagcucaggu

SEQ ID NO: 2559177 - RNA, 13 nt, Human
cugguagcucagg

SEQ ID NO: 2559178 - RNA, 14 nt, Human
cugguagauagaaa

SEQ ID NO: 2559179 - RNA, 15 nt, Human
cugguagauagaaau

SEQ ID NO: 2559180 - RNA, 23 nt, Human
cugguagauagaaauaaauagcu

SEQ ID NO: 2559181 - RNA, 16 nt, Human
cuggguuuggacccca

SEQ ID NO: 2559182 - RNA, 18 nt, Human
cuggguuuggaccccagc

SEQ ID NO: 2559183 - RNA, 14 nt, Human
cugguagagaugga

SEQ ID NO: 2559184 - RNA, 23 nt, Human
cuggucacaggacucugccuccu

SEQ ID NO: 2559185 - RNA, 22 nt, Human
cuggucacaggacucugccucc

SEQ ID NO: 2559186 - RNA, 21 nt, Human
cuggucacaggacucugccuc

SEQ ID NO: 2559187 - RNA, 20 nt, Human
cuggucacaggacucugccu

SEQ ID NO: 2559188 - RNA, 12 nt, Human
cugguagggcag

SEQ ID NO: 2559189 - RNA, 19 nt, Human
cugguaguuaguagcaugu

SEQ ID NO: 2559190 - RNA, 23 nt, Human
cuggucacagggcaugccccggc

SEQ ID NO: 2559191 - RNA, 21 nt, Human
cugguaguuaguagcauguug

SEQ ID NO: 2559192 - RNA, 14 nt, Human
cuggucacugccau

SEQ ID NO: 2559193 - RNA, 22 nt, Human
cuggucacugccauggaggcac

SEQ ID NO: 2559194 - RNA, 14 nt, Human
cuggucccacucag

SEQ ID NO: 2559195 - RNA, 23 nt, Human
cuggucucaaacucuugaccuca

SEQ ID NO: 2559196 - RNA, 13 nt, Human
cuggucccacuca

SEQ ID NO: 2559197 - RNA, 19 nt, Human
cugguccaugauggaguca

SEQ ID NO: 2559198 - RNA, 16 nt, Human
cugguccaugauggag

SEQ ID NO: 2559199 - RNA, 17 nt, Human
cugguccaugauggagu

SEQ ID NO: 2559200 - RNA, 21 nt, Human
cugguccauagagagcaagac

SEQ ID NO: 2559201 - RNA, 21 nt, Human
cugguccagggaagcuggccg

SEQ ID NO: 2559202 - RNA, 22 nt, Human
cugguccagggaagcuggccga

SEQ ID NO: 2559203 - RNA, 15 nt, Human
cugguccagggaagc

SEQ ID NO: 2559204 - RNA, 17 nt, Human
cugguccagggaagcug

SEQ ID NO: 2559205 - RNA, 12 nt, Human
cuggucagccca

SEQ ID NO: 2559206 - RNA, 13 nt, Human
cuggucagcccaa

SEQ ID NO: 2559207 - RNA, 15 nt, Human
cugguccaaaagauu

SEQ ID NO: 2559208 - RNA, 22 nt, Human
cugguccaaaagauugcugaaa

SEQ ID NO: 2559209 - RNA, 14 nt, Human
cugguggcagcuca

SEQ ID NO: 2559210 - RNA, 13 nt, Human
cugguggcagcuc

SEQ ID NO: 2559211 - RNA, 18 nt, Human
cuggugugaccugagggc

SEQ ID NO: 2559212 - RNA, 17 nt, Human
cuggugugaccugaggg

SEQ ID NO: 2559213 - RNA, 16 nt, Human
cuggugugaccugagg

SEQ ID NO: 2559214 - RNA, 17 nt, Human
cuggugugaacuaaacu

SEQ ID NO: 2559215 - RNA, 17 nt, Human
cuggucuccucagccuc

SEQ ID NO: 2559216 - RNA, 16 nt, Human
cuggucucgaacuccu

SEQ ID NO: 2559217 - RNA, 12 nt, Human
cugguggcagcu

SEQ ID NO: 2559218 - RNA, 13 nt, Human
cuggucucagcag

SEQ ID NO: 2559219 - RNA, 21 nt, Human
cuggucucaaacuccugggcu

SEQ ID NO: 2559220 - RNA, 21 nt, Human
cuggucucagcagcgaccacc

SEQ ID NO: 2559221 - RNA, 20 nt, Human
cuggucucagcagcgaccac

SEQ ID NO: 2559222 - RNA, 14 nt, Human
cuggucucagcagc

SEQ ID NO: 2559223 - RNA, 16 nt, Human
cuggucuccucagccu

SEQ ID NO: 2559224 - RNA, 22 nt, Human
cuggucucagcagcgaccaccc

SEQ ID NO: 2559225 - RNA, 23 nt, Human
cugguguuucuagcacuggccug

SEQ ID NO: 2559226 - RNA, 22 nt, Human
cugguguuucuagcacuggccu

SEQ ID NO: 2559227 - RNA, 24 nt, Human
cugguguuucuagcacuggccugc

SEQ ID NO: 2559228 - RNA, 20 nt, Human
cugguucaggguuggccccu

SEQ ID NO: 2559229 - RNA, 22 nt, Human
cugguuccagggucccucugug

SEQ ID NO: 2559230 - RNA, 18 nt, Human
cugguuccagggucccuc

SEQ ID NO: 2559231 - RNA, 16 nt, Human
cugguuccaggguccc

SEQ ID NO: 2559232 - RNA, 15 nt, Human
cugguuccagggucc

SEQ ID NO: 2559233 - RNA, 14 nt, Human
cugguuccaggguc

SEQ ID NO: 2559234 - RNA, 13 nt, Human
cugguuccagggu

SEQ ID NO: 2559235 - RNA, 20 nt, Human
cugguuaacuuguuuggccu

SEQ ID NO: 2559236 - RNA, 18 nt, Human
cuguaaggcaaucauggu

SEQ ID NO: 2559237 - RNA, 23 nt, Human
cugguuccagggucccucugugu

SEQ ID NO: 2559238 - RNA, 14 nt, Human
cuguaagcugaagu

SEQ ID NO: 2559239 - RNA, 18 nt, Human
cuguaauuugugauacaa

SEQ ID NO: 2559240 - RNA, 17 nt, Human
cuguaauuugugauaca

SEQ ID NO: 2559241 - RNA, 16 nt, Human
cuguaaggcaugaagg

SEQ ID NO: 2559242 - RNA, 17 nt, Human
cuguaaggcaugaagga

SEQ ID NO: 2559243 - RNA, 21 nt, Human
cuguaauuugugauacaaugc

SEQ ID NO: 2559244 - RNA, 22 nt, Human
cuguaauuugugauacaaugcu

SEQ ID NO: 2559245 - RNA, 23 nt, Human
cuguacagagcccacgcccccac

SEQ ID NO: 2559246 - RNA, 16 nt, Human
cuguaaguuuugaauu

SEQ ID NO: 2559247 - RNA, 22 nt, Human
cuguacaugaaaacacauuuuu

SEQ ID NO: 2559248 - RNA, 23 nt, Human
cuguacaugaaaacacauuuuuc

SEQ ID NO: 2559249 - RNA, 15 nt, Human
cuguacauuguggga

SEQ ID NO: 2559250 - RNA, 16 nt, Human
cuguacauagccuaua

SEQ ID NO: 2559251 - RNA, 15 nt, Human
cuguacauagccuau

SEQ ID NO: 2559252 - RNA, 19 nt, Human
cuguaccagcccagauguu

SEQ ID NO: 2559253 - RNA, 21 nt, Human
cuguaccucuugagccuugaa

SEQ ID NO: 2559254 - RNA, 18 nt, Human
cugggagagccuuccagg

SEQ ID NO: 2559255 - RNA, 17 nt, Human
cugggagagccuuccag

SEQ ID NO: 2559256 - RNA, 12 nt, Human
cugggagaaccu

SEQ ID NO: 2559257 - RNA, 14 nt, Human
cugggagaaccuca

SEQ ID NO: 2559258 - RNA, 15 nt, Human
cugggagaaccucag

SEQ ID NO: 2559259 - RNA, 16 nt, Human
cugggagaaccucagg

SEQ ID NO: 2559260 - RNA, 20 nt, Human
cugggagagccuuccagggg

SEQ ID NO: 2559261 - RNA, 19 nt, Human
cugggagagccuuccaggg

SEQ ID NO: 2559262 - RNA, 21 nt, Human
cugggagagccuuccaggggu

SEQ ID NO: 2559263 - RNA, 12 nt, Human
cugggagaggau

SEQ ID NO: 2559264 - RNA, 17 nt, Human
cugggagaaccucaggc

SEQ ID NO: 2559265 - RNA, 18 nt, Human
cugggagaaccucaggcu

SEQ ID NO: 2559266 - RNA, 18 nt, Human
cuggcuguuggcuggggg

SEQ ID NO: 2559267 - RNA, 20 nt, Human
cuggcuuguaacuccaccaa

SEQ ID NO: 2559268 - RNA, 17 nt, Human
cuggcuuguaacuccac

SEQ ID NO: 2559269 - RNA, 19 nt, Human
cuggcuuguaacuccacca

SEQ ID NO: 2559270 - RNA, 14 nt, Human
cuggcuuugagaag

SEQ ID NO: 2559271 - RNA, 22 nt, Human
cuggcuuucuccgacugcuagg

SEQ ID NO: 2559272 - RNA, 15 nt, Human
cuggcuuucuccgac

SEQ ID NO: 2559273 - RNA, 11 nt, Human
cuggcuuuggc

SEQ ID NO: 2559274 - RNA, 14 nt, Human
cuggcuuuggcuuc

SEQ ID NO: 2559275 - RNA, 23 nt, Human
cuggcuuuuauuaaugcacuuuc

SEQ ID NO: 2559276 - RNA, 22 nt, Human
cuggcuuuuauuaaugcacuuu

SEQ ID NO: 2559277 - RNA, 14 nt, Human
cuggcuuuuauuaa

SEQ ID NO: 2559278 - RNA, 23 nt, Human
cuggcuuuucacugcuggcugcc

SEQ ID NO: 2559279 - RNA, 17 nt, Human
cugggaaaauaccccau

SEQ ID NO: 2559280 - RNA, 14 nt, Human
cugggaaaauaccc

SEQ ID NO: 2559281 - RNA, 11 nt, Human
cugggaaacag

SEQ ID NO: 2559282 - RNA, 19 nt, Human
cugggaaagacauccauaa

SEQ ID NO: 2559283 - RNA, 15 nt, Human
cugggaaacagaggc

SEQ ID NO: 2559284 - RNA, 16 nt, Human
cugggaaacagaggcu

SEQ ID NO: 2559285 - RNA, 19 nt, Human
cuggcugucaguaugacau

SEQ ID NO: 2559286 - RNA, 20 nt, Human
cuggcuguguucuggugagg

SEQ ID NO: 2559287 - RNA, 17 nt, Human
cuggcuguuggcugggg

SEQ ID NO: 2559288 - RNA, 16 nt, Human
cuggcuguuggcuggg

SEQ ID NO: 2559289 - RNA, 20 nt, Human
cuggcugguuagagguuccc

SEQ ID NO: 2559290 - RNA, 12 nt, Human
cuggcugggacg

SEQ ID NO: 2559291 - RNA, 16 nt, Human
cuggcugggacguggc

SEQ ID NO: 2559292 - RNA, 19 nt, Human
cuggcugggacguggcuca

SEQ ID NO: 2559293 - RNA, 21 nt, Human
cuggcugggacguggcucagc

SEQ ID NO: 2559294 - RNA, 12 nt, Human
cuggcgcagcca

SEQ ID NO: 2559295 - RNA, 20 nt, Human
cuggcgacaguuuuccuucu

SEQ ID NO: 2559296 - RNA, 22 nt, Human
cuggcgacacguagcagcuuag

SEQ ID NO: 2559297 - RNA, 19 nt, Human
cuggcgacaguuuuccuuc

SEQ ID NO: 2559298 - RNA, 14 nt, Human
cuggccuuuuccua

SEQ ID NO: 2559299 - RNA, 13 nt, Human
cuggccuuuuccu

SEQ ID NO: 2559300 - RNA, 14 nt, Human
cuggccuuucauau

SEQ ID NO: 2559301 - RNA, 17 nt, Human
cuggccuuccacuuggc

SEQ ID NO: 2559302 - RNA, 16 nt, Human
cuggccuuccugcccu

SEQ ID NO: 2559303 - RNA, 12 nt, Human
cuggccuguucu

SEQ ID NO: 2559304 - RNA, 19 nt, Human
cuggcgccaucgccgggac

SEQ ID NO: 2559305 - RNA, 22 nt, Human
cuggcgccaacaacuucuccau

SEQ ID NO: 2559306 - RNA, 21 nt, Human
cuggcgccaacaacuucucca

SEQ ID NO: 2559307 - RNA, 16 nt, Human
cuggcgcagccaaggc

SEQ ID NO: 2559308 - RNA, 19 nt, Human
cuggcgcagccaaggccga

SEQ ID NO: 2559309 - RNA, 15 nt, Human
cuggcgcagccaagg

SEQ ID NO: 2559310 - RNA, 13 nt, Human
cuggcgcagccaa

SEQ ID NO: 2559311 - RNA, 14 nt, Human
cuggcuggaaggga

SEQ ID NO: 2559312 - RNA, 14 nt, Human
cuggcugcuugccc

SEQ ID NO: 2559313 - RNA, 13 nt, Human
cuggcugcuugcc

SEQ ID NO: 2559314 - RNA, 19 nt, Human
cuggcugcugcccccaccc

SEQ ID NO: 2559315 - RNA, 17 nt, Human
cuggcugcugcccccac

SEQ ID NO: 2559316 - RNA, 16 nt, Human
cuggcugcugccccca

SEQ ID NO: 2559317 - RNA, 15 nt, Human
cuggcugcugccccc

SEQ ID NO: 2559318 - RNA, 15 nt, Human
cuggcuggcugcagu

SEQ ID NO: 2559319 - RNA, 17 nt, Human
cuggcuggcugcaguga

SEQ ID NO: 2559320 - RNA, 15 nt, Human
cuggcuggcacagaa

SEQ ID NO: 2559321 - RNA, 18 nt, Human
cuggcuggagccuagaac

SEQ ID NO: 2559322 - RNA, 15 nt, Human
cuggcuggagccuag

SEQ ID NO: 2559323 - RNA, 12 nt, Human
cuggcuggagcc

SEQ ID NO: 2559324 - RNA, 13 nt, Human
cuggcuggaguga

SEQ ID NO: 2559325 - RNA, 19 nt, Human
cugggagaggugccagcaa

SEQ ID NO: 2559326 - RNA, 18 nt, Human
cugggagaggugccagca

SEQ ID NO: 2559327 - RNA, 23 nt, Human
cugggagaggugccagcaacuga

SEQ ID NO: 2559328 - RNA, 20 nt, Human
cugggagaggugccagcaac

SEQ ID NO: 2559329 - RNA, 15 nt, Human
cugggagauucaagg

SEQ ID NO: 2559330 - RNA, 22 nt, Human
cugggagcagcccgcugagugg

SEQ ID NO: 2559331 - RNA, 19 nt, Human
cugggagauucaagggacc

SEQ ID NO: 2559332 - RNA, 19 nt, Human
cugggagccuacccacccc

SEQ ID NO: 2559333 - RNA, 22 nt, Human
cugggagccuacccacccccag

SEQ ID NO: 2559334 - RNA, 16 nt, Human
cugggagccuacccac

SEQ ID NO: 2559335 - RNA, 23 nt, Human
cugggaggagggagagggagguc

SEQ ID NO: 2559336 - RNA, 20 nt, Human
cugggaggagggagagggag

SEQ ID NO: 2559337 - RNA, 19 nt, Human
cugggaggagggagaggga

SEQ ID NO: 2559338 - RNA, 17 nt, Human
cugggaggagggagagg

SEQ ID NO: 2559339 - RNA, 16 nt, Human
cugggaggagggagag

SEQ ID NO: 2559340 - RNA, 15 nt, Human
cugggaggagggaga

SEQ ID NO: 2559341 - RNA, 14 nt, Human
cugggaggagggag

SEQ ID NO: 2559342 - RNA, 19 nt, Human
cugggaggaauggacagac

SEQ ID NO: 2559343 - RNA, 22 nt, Human
cugggaggaauggacagacaga

SEQ ID NO: 2559344 - RNA, 20 nt, Human
cugggagcuccacucugcuu

SEQ ID NO: 2559345 - RNA, 17 nt, Human
cugggagcuccacucug

SEQ ID NO: 2559346 - RNA, 16 nt, Human
cugggagcuccacucu

SEQ ID NO: 2559347 - RNA, 21 nt, Human
cugggagcuccacucugcuuc

SEQ ID NO: 2559348 - RNA, 15 nt, Human
cugggaggaagcagg

SEQ ID NO: 2559349 - RNA, 17 nt, Human
cugggaggaauggacag

SEQ ID NO: 2559350 - RNA, 21 nt, Human
cugggaggaagcagguugagg

SEQ ID NO: 2559351 - RNA, 21 nt, Human
cugggaggcucuggagcccac

SEQ ID NO: 2559352 - RNA, 20 nt, Human
cugggaggcucuggagccca

SEQ ID NO: 2559353 - RNA, 21 nt, Human
cugggaggcaagaggggugga

SEQ ID NO: 2559354 - RNA, 20 nt, Human
cugggaggcaagaggggugg

SEQ ID NO: 2559355 - RNA, 18 nt, Human
cugggaggcaagaggggu

SEQ ID NO: 2559356 - RNA, 17 nt, Human
cugggaggcaagagggg

SEQ ID NO: 2559357 - RNA, 23 nt, Human
cugggaggcaagagggguggaga

SEQ ID NO: 2559358 - RNA, 22 nt, Human
cugggaggcaagagggguggag

SEQ ID NO: 2559359 - RNA, 18 nt, Human
cugggaggcucuggagcc

SEQ ID NO: 2559360 - RNA, 17 nt, Human
cugggaggcucuggagc

SEQ ID NO: 2559361 - RNA, 19 nt, Human
cugggaggucaaggcugca

SEQ ID NO: 2559362 - RNA, 21 nt, Human
cugggaggucaaggcugcagu

SEQ ID NO: 2559363 - RNA, 23 nt, Human
cugggaguaguugucuuuccugg

SEQ ID NO: 2559364 - RNA, 21 nt, Human
cugggaguaguugucuuuccu

SEQ ID NO: 2559365 - RNA, 18 nt, Human
cugggcccugggcuggaa

SEQ ID NO: 2559366 - RNA, 16 nt, Human
cugggcccugggcugg

SEQ ID NO: 2559367 - RNA, 15 nt, Human
cugggcccugggcug

SEQ ID NO: 2559368 - RNA, 14 nt, Human
cugggcccugggcu

SEQ ID NO: 2559369 - RNA, 13 nt, Human
cugggcccugggc

SEQ ID NO: 2559370 - RNA, 16 nt, Human
cugggccgcugccacg

SEQ ID NO: 2559371 - RNA, 15 nt, Human
cugggccgcugccac

SEQ ID NO: 2559372 - RNA, 21 nt, Human
cugggccccagcccacccucc

SEQ ID NO: 2559373 - RNA, 20 nt, Human
cugggccccagcccacccuc

SEQ ID NO: 2559374 - RNA, 19 nt, Human
cugggccccagcccacccu

SEQ ID NO: 2559375 - RNA, 15 nt, Human
cugggccccaguugu

SEQ ID NO: 2559376 - RNA, 11 nt, Human
cugggcccugg

SEQ ID NO: 2559377 - RNA, 19 nt, Human
cugggccccaguuguauuu

SEQ ID NO: 2559378 - RNA, 24 nt, Human
cugggccccaaacgggcugcccug

SEQ ID NO: 2559379 - RNA, 13 nt, Human
cugggccccacca

SEQ ID NO: 2559380 - RNA, 14 nt, Human
cugggccccaccac

SEQ ID NO: 2559381 - RNA, 18 nt, Human
cugggccccagcccaccc

SEQ ID NO: 2559382 - RNA, 16 nt, Human
cugggccccagcccac

SEQ ID NO: 2559383 - RNA, 15 nt, Human
cugggccccagccca

SEQ ID NO: 2559384 - RNA, 14 nt, Human
cugggccccagccc

SEQ ID NO: 2559385 - RNA, 13 nt, Human
cugggccccagcc

SEQ ID NO: 2559386 - RNA, 12 nt, Human
cugggccccagc

SEQ ID NO: 2559387 - RNA, 16 nt, Human
cugggccccaccaccu

SEQ ID NO: 2559388 - RNA, 18 nt, Human
cugggccccaccaccuag

SEQ ID NO: 2559389 - RNA, 13 nt, Human
cugggaguccccu

SEQ ID NO: 2559390 - RNA, 20 nt, Human
cugggaucccucauccucau

SEQ ID NO: 2559391 - RNA, 18 nt, Human
cugggaugauuggagggg

SEQ ID NO: 2559392 - RNA, 20 nt, Human
cugggaucacauguggacuu

SEQ ID NO: 2559393 - RNA, 14 nt, Human
cugggaguccccuu

SEQ ID NO: 2559394 - RNA, 13 nt, Human
cugggauccuaag

SEQ ID NO: 2559395 - RNA, 16 nt, Human
cugggauuacaggugu

SEQ ID NO: 2559396 - RNA, 18 nt, Human
cugggauuacagguguga

SEQ ID NO: 2559397 - RNA, 20 nt, Human
cugggauuacaggugugaac

SEQ ID NO: 2559398 - RNA, 17 nt, Human
cugggauuacaggugug

SEQ ID NO: 2559399 - RNA, 22 nt, Human
cugggaugagccgcugugagcc

SEQ ID NO: 2559400 - RNA, 21 nt, Human
cugggaugagccgcugugagc

SEQ ID NO: 2559401 - RNA, 17 nt, Human
cugggaugagccgcugu

SEQ ID NO: 2559402 - RNA, 17 nt, Human
cugggauccuaagggcu

SEQ ID NO: 2559403 - RNA, 20 nt, Human
cugggaugggaggagaggac

SEQ ID NO: 2559404 - RNA, 16 nt, Human
cuggccuucggccucc

SEQ ID NO: 2559405 - RNA, 17 nt, Human
cuggccuucggccucca

SEQ ID NO: 2559406 - RNA, 18 nt, Human
cuggccuucggccuccau

SEQ ID NO: 2559407 - RNA, 21 nt, Human
cuggccuucggccuccauccu

SEQ ID NO: 2559408 - RNA, 15 nt, Human
cuggccuucggccuc

SEQ ID NO: 2559409 - RNA, 17 nt, Human
cuggccuggccccucag

SEQ ID NO: 2559410 - RNA, 16 nt, Human
cuggccuggccccuca

SEQ ID NO: 2559411 - RNA, 16 nt, Human
cuggccugagcuggga

SEQ ID NO: 2559412 - RNA, 14 nt, Human
cuggccucugcacu

SEQ ID NO: 2559413 - RNA, 13 nt, Human
cuggccucugcac

SEQ ID NO: 2559414 - RNA, 14 nt, Human
cuggccuggccccu

SEQ ID NO: 2559415 - RNA, 13 nt, Human
cuggccuggcccc

SEQ ID NO: 2559416 - RNA, 15 nt, Human
cuggccugcugggcu

SEQ ID NO: 2559417 - RNA, 19 nt, Human
cuggccugcugggcucucc

SEQ ID NO: 2559418 - RNA, 20 nt, Human
cuggccugcugggcucucca

SEQ ID NO: 2559419 - RNA, 18 nt, Human
cuggccugagcugggaug

SEQ ID NO: 2559420 - RNA, 15 nt, Human
cuggccugagcuggg

SEQ ID NO: 2559421 - RNA, 19 nt, Human
cuggccugcacggugggcc

SEQ ID NO: 2559422 - RNA, 24 nt, Human
cuggccugaggucucgcugaugcu

SEQ ID NO: 2559423 - RNA, 20 nt, Human
cuggccugaggucucgcuga

SEQ ID NO: 2559424 - RNA, 23 nt, Human
cuggccagggccuggaagacaga

SEQ ID NO: 2559425 - RNA, 16 nt, Human
cuggccagggccugga

SEQ ID NO: 2559426 - RNA, 15 nt, Human
cuggccagggccugg

SEQ ID NO: 2559427 - RNA, 16 nt, Human
cuggccaguccaggcu

SEQ ID NO: 2559428 - RNA, 15 nt, Human
cuggccaguccaggc

SEQ ID NO: 2559429 - RNA, 18 nt, Human
cuggccaguccaggcugc

SEQ ID NO: 2559430 - RNA, 13 nt, Human
cuggccccaggac

SEQ ID NO: 2559431 - RNA, 17 nt, Human
cuggccaguccaggcug

SEQ ID NO: 2559432 - RNA, 16 nt, Human
cuggccccaggaccug

SEQ ID NO: 2559433 - RNA, 20 nt, Human
cuggccccaggaccuggcug

SEQ ID NO: 2559434 - RNA, 14 nt, Human
cuggccagggccug

SEQ ID NO: 2559435 - RNA, 13 nt, Human
cuggccaggcaga

SEQ ID NO: 2559436 - RNA, 14 nt, Human
cuggccaggcagau

SEQ ID NO: 2559437 - RNA, 21 nt, Human
cuggccaggcagaucugugcc

SEQ ID NO: 2559438 - RNA, 22 nt, Human
cuggccaggcagaucugugccc

SEQ ID NO: 2559439 - RNA, 21 nt, Human
cuggccagccccacagcccac

SEQ ID NO: 2559440 - RNA, 20 nt, Human
cuggccagccccacagccca

SEQ ID NO: 2559441 - RNA, 19 nt, Human
cuggccagccccacagccc

SEQ ID NO: 2559442 - RNA, 18 nt, Human
cuggccagccccacagcc

SEQ ID NO: 2559443 - RNA, 17 nt, Human
cuggccagccccacagc

SEQ ID NO: 2559444 - RNA, 12 nt, Human
cuggccaggagc

SEQ ID NO: 2559445 - RNA, 13 nt, Human
cuggccaggagcu

SEQ ID NO: 2559446 - RNA, 15 nt, Human
cuggccaggagcucu

SEQ ID NO: 2559447 - RNA, 17 nt, Human
cuggccaggagcucuuc

SEQ ID NO: 2559448 - RNA, 20 nt, Human
cuggccaggagcucuucagg

SEQ ID NO: 2559449 - RNA, 22 nt, Human
cuggccaggagcucuucaggcc

SEQ ID NO: 2559450 - RNA, 12 nt, Human
cuggccaggaug

SEQ ID NO: 2559451 - RNA, 23 nt, Human
cuggccaggauggaggggugguc

SEQ ID NO: 2559452 - RNA, 11 nt, Human
cuggccaggca

SEQ ID NO: 2559453 - RNA, 23 nt, Human
cuggccucaagugauucuccugc

SEQ ID NO: 2559454 - RNA, 19 nt, Human
cuggccccaugucucucag

SEQ ID NO: 2559455 - RNA, 21 nt, Human
cuggccccaugucucucagaa

SEQ ID NO: 2559456 - RNA, 15 nt, Human
cuggcccccagcugu

SEQ ID NO: 2559457 - RNA, 21 nt, Human
cuggccccaggaccuggcugc

SEQ ID NO: 2559458 - RNA, 17 nt, Human
cuggccccauggucagc

SEQ ID NO: 2559459 - RNA, 16 nt, Human
cuggccccaugucucu

SEQ ID NO: 2559460 - RNA, 13 nt, Human
cuggccuccacag

SEQ ID NO: 2559461 - RNA, 14 nt, Human
cuggccucccaaau

SEQ ID NO: 2559462 - RNA, 22 nt, Human
cuggccucaggugggccgcagg

SEQ ID NO: 2559463 - RNA, 22 nt, Human
cuggccucaagugauucuccug

SEQ ID NO: 2559464 - RNA, 12 nt, Human
cuggccucugca

SEQ ID NO: 2559465 - RNA, 16 nt, Human
cuggccucccaaauga

SEQ ID NO: 2559466 - RNA, 13 nt, Human
cuggccucccaca

SEQ ID NO: 2559467 - RNA, 12 nt, Human
cuggccucccac

SEQ ID NO: 2559468 - RNA, 14 nt, Human
cuggccucccacag

SEQ ID NO: 2559469 - RNA, 18 nt, Human
cuggcaaggacacagaug

SEQ ID NO: 2559470 - RNA, 17 nt, Human
cuggcaaggacacagau

SEQ ID NO: 2559471 - RNA, 19 nt, Human
cuggcacccaccguggagg

SEQ ID NO: 2559472 - RNA, 15 nt, Human
cuggcacagggcagu

SEQ ID NO: 2559473 - RNA, 15 nt, Human
cuggcaauagugugu

SEQ ID NO: 2559474 - RNA, 19 nt, Human
cuggcaauaguguguucug

SEQ ID NO: 2559475 - RNA, 22 nt, Human
cuggcacccggccccugcuggu

SEQ ID NO: 2559476 - RNA, 18 nt, Human
cuggcacccggccccugc

SEQ ID NO: 2559477 - RNA, 17 nt, Human
cuggcacccggccccug

SEQ ID NO: 2559478 - RNA, 16 nt, Human
cuggcacccggccccu

SEQ ID NO: 2559479 - RNA, 18 nt, Human
cuggaauauauaaccagu

SEQ ID NO: 2559480 - RNA, 20 nt, Human
cuggaagugcuaauuuugaa

SEQ ID NO: 2559481 - RNA, 18 nt, Human
cuggaaucuggagaccag

SEQ ID NO: 2559482 - RNA, 19 nt, Human
cuggaaucuggagaccagg

SEQ ID NO: 2559483 - RNA, 17 nt, Human
cuggaaucuggagacca

SEQ ID NO: 2559484 - RNA, 20 nt, Human
cuggaagguggggacaggga

SEQ ID NO: 2559485 - RNA, 15 nt, Human
cuggaauacaugaaa

SEQ ID NO: 2559486 - RNA, 18 nt, Human
cuggaauacaugaaauau

SEQ ID NO: 2559487 - RNA, 23 nt, Human
cuggaaucaggaauauuuuccaa

SEQ ID NO: 2559488 - RNA, 23 nt, Human
cuggaaucaagaugucagacugg

SEQ ID NO: 2559489 - RNA, 22 nt, Human
cuggcaaagguggcucuccagu

SEQ ID NO: 2559490 - RNA, 21 nt, Human
cuggcaaagguggcucuccag

SEQ ID NO: 2559491 - RNA, 18 nt, Human
cuggcaaagguggcucuc

SEQ ID NO: 2559492 - RNA, 22 nt, Human
cuggcaaagggagcagaacuga

SEQ ID NO: 2559493 - RNA, 14 nt, Human
cuggcaacaucuuu

SEQ ID NO: 2559494 - RNA, 19 nt, Human
cuggcaaagggagcagaac

SEQ ID NO: 2559495 - RNA, 20 nt, Human
cuggaaucuggagagcuaga

SEQ ID NO: 2559496 - RNA, 19 nt, Human
cuggaaucuggagagcuag

SEQ ID NO: 2559497 - RNA, 24 nt, Human
cuggaaucuggagaccagggagcc

SEQ ID NO: 2559498 - RNA, 16 nt, Human
cuggcaaggacacaga

SEQ ID NO: 2559499 - RNA, 22 nt, Human
cuggcaagcuagaaccuggagg

SEQ ID NO: 2559500 - RNA, 19 nt, Human
cuggcaagcuagaaccugg

SEQ ID NO: 2559501 - RNA, 17 nt, Human
cuggcaacaucuuuauc

SEQ ID NO: 2559502 - RNA, 14 nt, Human
cuggcaagaaugug

SEQ ID NO: 2559503 - RNA, 22 nt, Human
cuggcaugggaaugaaugucag

SEQ ID NO: 2559504 - RNA, 19 nt, Human
cuggcaugggaaugaaugu

SEQ ID NO: 2559505 - RNA, 18 nt, Human
cuggcaugggaaugaaug

SEQ ID NO: 2559506 - RNA, 16 nt, Human
cuggcaugggaaugaa

SEQ ID NO: 2559507 - RNA, 15 nt, Human
cuggcacuauaaugu

SEQ ID NO: 2559508 - RNA, 16 nt, Human
cuggcacuauaaugua

SEQ ID NO: 2559509 - RNA, 22 nt, Human
cuggcacuauaauguaagcucu

SEQ ID NO: 2559510 - RNA, 17 nt, Human
cuggcaccgccuucucu

SEQ ID NO: 2559511 - RNA, 21 nt, Human
cuggcacgguggcucaggccu

SEQ ID NO: 2559512 - RNA, 23 nt, Human
cuggcaucgcaccauucugacuc

SEQ ID NO: 2559513 - RNA, 17 nt, Human
cuggccaccugaggugg

SEQ ID NO: 2559514 - RNA, 16 nt, Human
cuggccaccugaggug

SEQ ID NO: 2559515 - RNA, 15 nt, Human
cuggccaccugaggu

SEQ ID NO: 2559516 - RNA, 11 nt, Human
cuggccaccug

SEQ ID NO: 2559517 - RNA, 18 nt, Human
cuggccaccucucuccuu

SEQ ID NO: 2559518 - RNA, 16 nt, Human
cuggccaccucucucc

SEQ ID NO: 2559519 - RNA, 23 nt, Human
cuggccaccaggcuggcgcagcc

SEQ ID NO: 2559520 - RNA, 22 nt, Human
cuggccaccaggcuggcgcagc

SEQ ID NO: 2559521 - RNA, 21 nt, Human
cuggccaccaggcuggcgcag

SEQ ID NO: 2559522 - RNA, 20 nt, Human
cuggccaccaggcuggcgca

SEQ ID NO: 2559523 - RNA, 19 nt, Human
cuggccaccaggcuggcgc

SEQ ID NO: 2559524 - RNA, 18 nt, Human
cuggccaccaggcuggcg

SEQ ID NO: 2559525 - RNA, 17 nt, Human
cuggccaccaggcuggc

SEQ ID NO: 2559526 - RNA, 16 nt, Human
cuggccaccaggcugg

SEQ ID NO: 2559527 - RNA, 15 nt, Human
cuggccaccaggcug

SEQ ID NO: 2559528 - RNA, 13 nt, Human
cuggccaccaggc

SEQ ID NO: 2559529 - RNA, 16 nt, Human
cuggccagccccacag

SEQ ID NO: 2559530 - RNA, 15 nt, Human
cuggccagccccaca

SEQ ID NO: 2559531 - RNA, 14 nt, Human
cuggccagccccac

SEQ ID NO: 2559532 - RNA, 13 nt, Human
cuggccagcccca

SEQ ID NO: 2559533 - RNA, 22 nt, Human
cuggccaccugaggugggccca

SEQ ID NO: 2559534 - RNA, 21 nt, Human
cuggccaccugaggugggccc

SEQ ID NO: 2559535 - RNA, 20 nt, Human
cuggccaccugaggugggcc

SEQ ID NO: 2559536 - RNA, 18 nt, Human
cuggccaccugagguggg

SEQ ID NO: 2559537 - RNA, 21 nt, Human
cuggccaccaccccccacucu

SEQ ID NO: 2559538 - RNA, 20 nt, Human
cuggccaccaccccccacuc

SEQ ID NO: 2559539 - RNA, 19 nt, Human
cuggccaccaccccccacu

SEQ ID NO: 2559540 - RNA, 16 nt, Human
cuggccaccacccccc

SEQ ID NO: 2559541 - RNA, 14 nt, Human
cuggccaccacccc

SEQ ID NO: 2559542 - RNA, 13 nt, Human
cuggccaccaccc

SEQ ID NO: 2559543 - RNA, 18 nt, Human
cuggcauuagaauuauuu

SEQ ID NO: 2559544 - RNA, 24 nt, Human
cuggcaugggaaugaaugucagug

SEQ ID NO: 2559545 - RNA, 15 nt, Human
cuggcauuacagcug

SEQ ID NO: 2559546 - RNA, 16 nt, Human
cuggcauuacagcugg

SEQ ID NO: 2559547 - RNA, 20 nt, Human
cugcccaggccccugccacc

SEQ ID NO: 2559548 - RNA, 19 nt, Human
cugcccaggccccugccac

SEQ ID NO: 2559549 - RNA, 18 nt, Human
cugcccaggccccugcca

SEQ ID NO: 2559550 - RNA, 16 nt, Human
cugcccaggccccugc

SEQ ID NO: 2559551 - RNA, 17 nt, Human
cugccccagcccaaguc

SEQ ID NO: 2559552 - RNA, 16 nt, Human
cugccccagcccaagu

SEQ ID NO: 2559553 - RNA, 13 nt, Human
cugccccagccca

SEQ ID NO: 2559554 - RNA, 14 nt, Human
cugccccagccaga

SEQ ID NO: 2559555 - RNA, 13 nt, Human
cugccccagccag

SEQ ID NO: 2559556 - RNA, 13 nt, Human
cugccccagaggc

SEQ ID NO: 2559557 - RNA, 23 nt, Human
cugccccaccccuccccauuagc

SEQ ID NO: 2559558 - RNA, 13 nt, Human
cugccccaacucu

SEQ ID NO: 2559559 - RNA, 12 nt, Human
cugccccaacuc

SEQ ID NO: 2559560 - RNA, 12 nt, Human
cugcccacccgu

SEQ ID NO: 2559561 - RNA, 14 nt, Human
cugccccaacuccu

SEQ ID NO: 2559562 - RNA, 21 nt, Human
cugccccaacuccuggaagcu

SEQ ID NO: 2559563 - RNA, 16 nt, Human
cugccccaacuccugg

SEQ ID NO: 2559564 - RNA, 17 nt, Human
cugccccaacuccugga

SEQ ID NO: 2559565 - RNA, 18 nt, Human
cugccccaacuccuggaa

SEQ ID NO: 2559566 - RNA, 20 nt, Human
cugccccaacuccuggaagc

SEQ ID NO: 2559567 - RNA, 12 nt, Human
cugcccaccugg

SEQ ID NO: 2559568 - RNA, 15 nt, Human
cugcccaggccccug

SEQ ID NO: 2559569 - RNA, 14 nt, Human
cugcccaggccccu

SEQ ID NO: 2559570 - RNA, 19 nt, Human
cugcccaaccugcucuccu

SEQ ID NO: 2559571 - RNA, 17 nt, Human
cugccauucacuucaua

SEQ ID NO: 2559572 - RNA, 15 nt, Human
cugccauuucugaga

SEQ ID NO: 2559573 - RNA, 15 nt, Human
cugcccacccccuca

SEQ ID NO: 2559574 - RNA, 14 nt, Human
cugcccacccccuc

SEQ ID NO: 2559575 - RNA, 13 nt, Human
cugcccacccccu

SEQ ID NO: 2559576 - RNA, 12 nt, Human
cugcccaccccc

SEQ ID NO: 2559577 - RNA, 19 nt, Human
cugcccacccccucaagcc

SEQ ID NO: 2559578 - RNA, 16 nt, Human
cugcccacccccucaa

SEQ ID NO: 2559579 - RNA, 16 nt, Human
cugcccaauuggagga

SEQ ID NO: 2559580 - RNA, 21 nt, Human
cugcccaauaugcaguucugc

SEQ ID NO: 2559581 - RNA, 21 nt, Human
cugcccaauuuugcagggagc

SEQ ID NO: 2559582 - RNA, 17 nt, Human
cugcccacauuggaccc

SEQ ID NO: 2559583 - RNA, 24 nt, Human
cugcccgucucucucccauggagc

SEQ ID NO: 2559584 - RNA, 23 nt, Human
cugcccgucucucucccauggag

SEQ ID NO: 2559585 - RNA, 22 nt, Human
cugcccgucucucucccaugga

SEQ ID NO: 2559586 - RNA, 21 nt, Human
cugcccgucucucucccaugg

SEQ ID NO: 2559587 - RNA, 19 nt, Human
cugcccgucucucucccau

SEQ ID NO: 2559588 - RNA, 18 nt, Human
cugcccgucucucuccca

SEQ ID NO: 2559589 - RNA, 21 nt, Human
cugcccguaaacacgccugca

SEQ ID NO: 2559590 - RNA, 18 nt, Human
cugcccguaaacacgccu

SEQ ID NO: 2559591 - RNA, 19 nt, Human
cugcccguaaacacgccug

SEQ ID NO: 2559592 - RNA, 23 nt, Human
cugcccggggcagcugccagaga

SEQ ID NO: 2559593 - RNA, 19 nt, Human
cugcccgggcgcggccagc

SEQ ID NO: 2559594 - RNA, 19 nt, Human
cugcccgcucccagugucu

SEQ ID NO: 2559595 - RNA, 17 nt, Human
cugcccgcucccagugu

SEQ ID NO: 2559596 - RNA, 16 nt, Human
cugcccgcucccagug

SEQ ID NO: 2559597 - RNA, 21 nt, Human
cugcccgggcgcggccagccc

SEQ ID NO: 2559598 - RNA, 13 nt, Human
cugcccggggcag

SEQ ID NO: 2559599 - RNA, 15 nt, Human
cugcccggggcagcu

SEQ ID NO: 2559600 - RNA, 16 nt, Human
cugcccggggcagcug

SEQ ID NO: 2559601 - RNA, 19 nt, Human
cugcccggggcagcugcca

SEQ ID NO: 2559602 - RNA, 20 nt, Human
cugcccggggcagcugccag

SEQ ID NO: 2559603 - RNA, 21 nt, Human
cugcccggggcagcugccaga

SEQ ID NO: 2559604 - RNA, 22 nt, Human
cugcccggggcagcugccagag

SEQ ID NO: 2559605 - RNA, 20 nt, Human
cugcccuaaugcgcaggcug

SEQ ID NO: 2559606 - RNA, 21 nt, Human
cugcccuaaugcgcaggcugg

SEQ ID NO: 2559607 - RNA, 15 nt, Human
cugcccgucuucagc

SEQ ID NO: 2559608 - RNA, 16 nt, Human
cugcccgucuucagcc

SEQ ID NO: 2559609 - RNA, 17 nt, Human
cugcccgucuucagccu

SEQ ID NO: 2559610 - RNA, 18 nt, Human
cugcccgucuucagccua

SEQ ID NO: 2559611 - RNA, 22 nt, Human
cugcccuaaugcgcaggcuggc

SEQ ID NO: 2559612 - RNA, 18 nt, Human
cugcccuacagaggucuc

SEQ ID NO: 2559613 - RNA, 21 nt, Human
cugcccgucuucagccuagcc

SEQ ID NO: 2559614 - RNA, 22 nt, Human
cugcccucguggccagcccggc

SEQ ID NO: 2559615 - RNA, 21 nt, Human
cugcccucguggccagcccgg

SEQ ID NO: 2559616 - RNA, 23 nt, Human
cugcccucguggccagcccggcu

SEQ ID NO: 2559617 - RNA, 20 nt, Human
cugcccucguggccagcccg

SEQ ID NO: 2559618 - RNA, 19 nt, Human
cugcccucguggccagccc

SEQ ID NO: 2559619 - RNA, 18 nt, Human
cugcccucguggccagcc

SEQ ID NO: 2559620 - RNA, 18 nt, Human
cugccccuggcagccccu

SEQ ID NO: 2559621 - RNA, 19 nt, Human
cugccccagcccaagucca

SEQ ID NO: 2559622 - RNA, 18 nt, Human
cugccccagcccaagucc

SEQ ID NO: 2559623 - RNA, 13 nt, Human
cugccccagcucu

SEQ ID NO: 2559624 - RNA, 19 nt, Human
cugccccuggcagccccug

SEQ ID NO: 2559625 - RNA, 13 nt, Human
cugcccgagcugg

SEQ ID NO: 2559626 - RNA, 14 nt, Human
cugccccagcucug

SEQ ID NO: 2559627 - RNA, 13 nt, Human
cugccccuguucu

SEQ ID NO: 2559628 - RNA, 16 nt, Human
cugccccuggcucuga

SEQ ID NO: 2559629 - RNA, 13 nt, Human
cugcccggcaggg

SEQ ID NO: 2559630 - RNA, 20 nt, Human
cugcccggcaggguccuaga

SEQ ID NO: 2559631 - RNA, 21 nt, Human
cugcccgagcuggugcauuac

SEQ ID NO: 2559632 - RNA, 18 nt, Human
cugccccuguucucuucc

SEQ ID NO: 2559633 - RNA, 14 nt, Human
cugcccgagcuggu

SEQ ID NO: 2559634 - RNA, 15 nt, Human
cugcccgagcuggug

SEQ ID NO: 2559635 - RNA, 16 nt, Human
cugcccgagcuggugc

SEQ ID NO: 2559636 - RNA, 15 nt, Human
cugcccgcucccagu

SEQ ID NO: 2559637 - RNA, 14 nt, Human
cugcccgcucccag

SEQ ID NO: 2559638 - RNA, 13 nt, Human
cugcccgcuccca

SEQ ID NO: 2559639 - RNA, 17 nt, Human
cugcccgagcuggugca

SEQ ID NO: 2559640 - RNA, 21 nt, Human
cugccaggaagccagcaggcu

SEQ ID NO: 2559641 - RNA, 20 nt, Human
cugccaggaagccagcaggc

SEQ ID NO: 2559642 - RNA, 14 nt, Human
cugccaggaagcca

SEQ ID NO: 2559643 - RNA, 13 nt, Human
cugccaggaagcc

SEQ ID NO: 2559644 - RNA, 12 nt, Human
cugccagcugca

SEQ ID NO: 2559645 - RNA, 13 nt, Human
cugccagcugcac

SEQ ID NO: 2559646 - RNA, 11 nt, Human
cugccagcugc

SEQ ID NO: 2559647 - RNA, 22 nt, Human
cugccagaugcugauguucagu

SEQ ID NO: 2559648 - RNA, 21 nt, Human
cugccagaugcugauguucag

SEQ ID NO: 2559649 - RNA, 17 nt, Human
cugccagcucuguauca

SEQ ID NO: 2559650 - RNA, 23 nt, Human
cugccagaugcugauguucagug

SEQ ID NO: 2559651 - RNA, 15 nt, Human
cugccagcaacgcag

SEQ ID NO: 2559652 - RNA, 18 nt, Human
cugccagaugcugauguu

SEQ ID NO: 2559653 - RNA, 17 nt, Human
cugccagaugcugaugu

SEQ ID NO: 2559654 - RNA, 16 nt, Human
cugccagaugcugaug

SEQ ID NO: 2559655 - RNA, 14 nt, Human
cugccagaugcuga

SEQ ID NO: 2559656 - RNA, 20 nt, Human
cugccagagaagcaucggag

SEQ ID NO: 2559657 - RNA, 13 nt, Human
cugccagaugcug

SEQ ID NO: 2559658 - RNA, 13 nt, Human
cugccagagaagc

SEQ ID NO: 2559659 - RNA, 16 nt, Human
cugccagcugcacuga

SEQ ID NO: 2559660 - RNA, 17 nt, Human
cugccagcugcacugau

SEQ ID NO: 2559661 - RNA, 22 nt, Human
cugccaggaagccagcaggcuc

SEQ ID NO: 2559662 - RNA, 21 nt, Human
cugccauccagguucagcuug

SEQ ID NO: 2559663 - RNA, 15 nt, Human
cugccauccucccaa

SEQ ID NO: 2559664 - RNA, 20 nt, Human
cugccauggaggcacacagc

SEQ ID NO: 2559665 - RNA, 22 nt, Human
cugccauggcgugucccucucg

SEQ ID NO: 2559666 - RNA, 14 nt, Human
cugccauggcgugu

SEQ ID NO: 2559667 - RNA, 21 nt, Human
cugccauggcgugucccucuc

SEQ ID NO: 2559668 - RNA, 23 nt, Human
cugccauggaggcacacagcugc

SEQ ID NO: 2559669 - RNA, 21 nt, Human
cugccauggaggcacacagcu

SEQ ID NO: 2559670 - RNA, 15 nt, Human
cugccacccuaccug

SEQ ID NO: 2559671 - RNA, 19 nt, Human
cugccacccaccucccugc

SEQ ID NO: 2559672 - RNA, 22 nt, Human
cugccacccaccucccugccuc

SEQ ID NO: 2559673 - RNA, 23 nt, Human
cugccacccaccucccugccucc

SEQ ID NO: 2559674 - RNA, 20 nt, Human
cugccacccaccucccugcc

SEQ ID NO: 2559675 - RNA, 20 nt, Human
cugcaucaagaugugacaug

SEQ ID NO: 2559676 - RNA, 14 nt, Human
cugcauauguugaa

SEQ ID NO: 2559677 - RNA, 21 nt, Human
cugcauauguugaauacuuuu

SEQ ID NO: 2559678 - RNA, 21 nt, Human
cugcauaguauuccauugugu

SEQ ID NO: 2559679 - RNA, 14 nt, Human
cugcauacaaucug

SEQ ID NO: 2559680 - RNA, 15 nt, Human
cugcauaccaaccug

SEQ ID NO: 2559681 - RNA, 15 nt, Human
cugcauaugaaagga

SEQ ID NO: 2559682 - RNA, 20 nt, Human
cugcauacuuuuuaaaugua

SEQ ID NO: 2559683 - RNA, 14 nt, Human
cugcauacuuuuua

SEQ ID NO: 2559684 - RNA, 16 nt, Human
cugcauaccaaccugg

SEQ ID NO: 2559685 - RNA, 16 nt, Human
cugccaccucccugac

SEQ ID NO: 2559686 - RNA, 15 nt, Human
cugccaccucccuga

SEQ ID NO: 2559687 - RNA, 13 nt, Human
cugccaccucccu

SEQ ID NO: 2559688 - RNA, 13 nt, Human
cugccaccucccc

SEQ ID NO: 2559689 - RNA, 12 nt, Human
cugccaccuccc

SEQ ID NO: 2559690 - RNA, 14 nt, Human
cugccaccuccccu

SEQ ID NO: 2559691 - RNA, 22 nt, Human
cugccaccuccccuauccaccc

SEQ ID NO: 2559692 - RNA, 22 nt, Human
cugccagaagauccccucagga

SEQ ID NO: 2559693 - RNA, 21 nt, Human
cugccagaagauccccucagg

SEQ ID NO: 2559694 - RNA, 18 nt, Human
cugccaccucccugaccc

SEQ ID NO: 2559695 - RNA, 17 nt, Human
cugccaccucccugacc

SEQ ID NO: 2559696 - RNA, 17 nt, Human
cugccagacccccugga

SEQ ID NO: 2559697 - RNA, 19 nt, Human
cugccagacccccuggaga

SEQ ID NO: 2559698 - RNA, 22 nt, Human
cugccagacggcacccacccag

SEQ ID NO: 2559699 - RNA, 23 nt, Human
cugccagaagauccccucaggac

SEQ ID NO: 2559700 - RNA, 11 nt, Human
cugccagagaa

SEQ ID NO: 2559701 - RNA, 12 nt, Human
cugccacccugg

SEQ ID NO: 2559702 - RNA, 14 nt, Human
cugccacccugggg

SEQ ID NO: 2559703 - RNA, 21 nt, Human
cugccacccuggggagaaagu

SEQ ID NO: 2559704 - RNA, 11 nt, Human
cugccaccucc

SEQ ID NO: 2559705 - RNA, 19 nt, Human
cugccacccuaccuguuca

SEQ ID NO: 2559706 - RNA, 14 nt, Human
cugcaccggcuggc

SEQ ID NO: 2559707 - RNA, 22 nt, Human
cugcacccuggggccuggaccu

SEQ ID NO: 2559708 - RNA, 21 nt, Human
cugcacccuggggccuggacc

SEQ ID NO: 2559709 - RNA, 16 nt, Human
cugcacccuggggccu

SEQ ID NO: 2559710 - RNA, 21 nt, Human
cugaggccccuucuagguggc

SEQ ID NO: 2559711 - RNA, 23 nt, Human
cugaggcccuucucuccagcccc

SEQ ID NO: 2559712 - RNA, 22 nt, Human
cugaggcccuucucuccagccc

SEQ ID NO: 2559713 - RNA, 16 nt, Human
cugcaccggcuggccu

SEQ ID NO: 2559714 - RNA, 15 nt, Human
cugcaccggcuggcc

SEQ ID NO: 2559715 - RNA, 15 nt, Human
cugcaccgggccaca

SEQ ID NO: 2559716 - RNA, 14 nt, Human
cugcaccgggccac

SEQ ID NO: 2559717 - RNA, 20 nt, Human
cugcacuccccugcugggug

SEQ ID NO: 2559718 - RNA, 19 nt, Human
cugcacuccccugcugggu

SEQ ID NO: 2559719 - RNA, 13 nt, Human
cugcacuccccug

SEQ ID NO: 2559720 - RNA, 18 nt, Human
cugcaccgggccacagag

SEQ ID NO: 2559721 - RNA, 23 nt, Human
cugcacccuggggccuggaccug

SEQ ID NO: 2559722 - RNA, 20 nt, Human
cugcacuccagucuggguga

SEQ ID NO: 2559723 - RNA, 20 nt, Human
cugcacuccagccuggguga

SEQ ID NO: 2559724 - RNA, 21 nt, Human
cugcacuguccugcuccacag

SEQ ID NO: 2559725 - RNA, 20 nt, Human
cugcacuguccugcuccaca

SEQ ID NO: 2559726 - RNA, 19 nt, Human
cugcacuguccugcuccac

SEQ ID NO: 2559727 - RNA, 18 nt, Human
cugcacuguccugcucca

SEQ ID NO: 2559728 - RNA, 23 nt, Human
cugcacuguccugcuccacagug

SEQ ID NO: 2559729 - RNA, 15 nt, Human
cugcagaaggaaaaa

SEQ ID NO: 2559730 - RNA, 14 nt, Human
cugcagaaggaaaa

SEQ ID NO: 2559731 - RNA, 17 nt, Human
cugcacuguccugcucc

SEQ ID NO: 2559732 - RNA, 16 nt, Human
cugcacuguccugcuc

SEQ ID NO: 2559733 - RNA, 15 nt, Human
cugcacuguccugcu

SEQ ID NO: 2559734 - RNA, 14 nt, Human
cugcacuguccugc

SEQ ID NO: 2559735 - RNA, 13 nt, Human
cugcacuguccug

SEQ ID NO: 2559736 - RNA, 11 nt, Human
cugcacugucc

SEQ ID NO: 2559737 - RNA, 16 nt, Human
cugcagaaggccaaga

SEQ ID NO: 2559738 - RNA, 15 nt, Human
cugcagaaggccaag

SEQ ID NO: 2559739 - RNA, 14 nt, Human
cugcagaaggccaa

SEQ ID NO: 2559740 - RNA, 13 nt, Human
cugcagaaggcca

SEQ ID NO: 2559741 - RNA, 22 nt, Human
cugcagaaggaaaaauguguaa

SEQ ID NO: 2559742 - RNA, 21 nt, Human
cugcagaaggaaaaaugugua

SEQ ID NO: 2559743 - RNA, 20 nt, Human
cugcagaaggaaaaaugugu

SEQ ID NO: 2559744 - RNA, 19 nt, Human
cugcagaaggaaaaaugug

SEQ ID NO: 2559745 - RNA, 19 nt, Human
cugcagaaggccaagaauc

SEQ ID NO: 2559746 - RNA, 15 nt, Human
cugcagaccacgccc

SEQ ID NO: 2559747 - RNA, 22 nt, Human
cugcagaauuuggguucugccu

SEQ ID NO: 2559748 - RNA, 22 nt, Human
cugcacuggggagcccgucuca

SEQ ID NO: 2559749 - RNA, 16 nt, Human
cugcacuggggagccc

SEQ ID NO: 2559750 - RNA, 12 nt, Human
cugcacugucaa

SEQ ID NO: 2559751 - RNA, 21 nt, Human
cugcacuccccugcugggugu

SEQ ID NO: 2559752 - RNA, 18 nt, Human
cugcacuccccugcuggg

SEQ ID NO: 2559753 - RNA, 20 nt, Human
cugcacuccggccugaugac

SEQ ID NO: 2559754 - RNA, 21 nt, Human
cugcacuggaguccagucucu

SEQ ID NO: 2559755 - RNA, 15 nt, Human
cugcagcaauaaagc

SEQ ID NO: 2559756 - RNA, 16 nt, Human
cugcagcaauaaagca

SEQ ID NO: 2559757 - RNA, 13 nt, Human
cugcagagggcac

SEQ ID NO: 2559758 - RNA, 20 nt, Human
cugcagaggccagaggcccc

SEQ ID NO: 2559759 - RNA, 17 nt, Human
cugcagaggccagaggc

SEQ ID NO: 2559760 - RNA, 21 nt, Human
cugcagaggccagaggccccc

SEQ ID NO: 2559761 - RNA, 21 nt, Human
cugcagaggggaaaccagugu

SEQ ID NO: 2559762 - RNA, 13 nt, Human
cugcagaggccag

SEQ ID NO: 2559763 - RNA, 11 nt, Human
cugcagaggcc

SEQ ID NO: 2559764 - RNA, 23 nt, Human
cugcagagcugcgggcugggugu

SEQ ID NO: 2559765 - RNA, 10 nt, Human
cugcagaggg

SEQ ID NO: 2559766 - RNA, 18 nt, Human
cugcagaccuguccuccu

SEQ ID NO: 2559767 - RNA, 16 nt, Human
cugcagaccuguccuc

SEQ ID NO: 2559768 - RNA, 15 nt, Human
cugcagaccuguccu

SEQ ID NO: 2559769 - RNA, 14 nt, Human
cugcagaccugucc

SEQ ID NO: 2559770 - RNA, 11 nt, Human
cugcagaccug

SEQ ID NO: 2559771 - RNA, 22 nt, Human
cugcagaccuguccuccuggug

SEQ ID NO: 2559772 - RNA, 20 nt, Human
cugcagaccuguccuccugg

SEQ ID NO: 2559773 - RNA, 15 nt, Human
cugcagacucacugu

SEQ ID NO: 2559774 - RNA, 18 nt, Human
cugcaggucccuaauaaa

SEQ ID NO: 2559775 - RNA, 17 nt, Human
cugcaggucccuaauaa

SEQ ID NO: 2559776 - RNA, 16 nt, Human
cugcaggucccuaaua

SEQ ID NO: 2559777 - RNA, 15 nt, Human
cugcaggucccuaau

SEQ ID NO: 2559778 - RNA, 14 nt, Human
cugcaggucccuaa

SEQ ID NO: 2559779 - RNA, 13 nt, Human
cugcaggucccua

SEQ ID NO: 2559780 - RNA, 12 nt, Human
cugcaggucccu

SEQ ID NO: 2559781 - RNA, 11 nt, Human
cugcagguccc

SEQ ID NO: 2559782 - RNA, 17 nt, Human
cugcagcaauaaagcag

SEQ ID NO: 2559783 - RNA, 23 nt, Human
cugcagauuugggcuggaacaga

SEQ ID NO: 2559784 - RNA, 20 nt, Human
cugcagauuugggcuggaac

SEQ ID NO: 2559785 - RNA, 19 nt, Human
cugcagauuugggcuggaa

SEQ ID NO: 2559786 - RNA, 23 nt, Human
cugcagaggggaaaccaguguag

SEQ ID NO: 2559787 - RNA, 18 nt, Human
cugcagauuugggcugga

SEQ ID NO: 2559788 - RNA, 14 nt, Human
cugcagcagaggca

SEQ ID NO: 2559789 - RNA, 13 nt, Human
cugcagcagaggc

SEQ ID NO: 2559790 - RNA, 20 nt, Human
cugcagcagcgguggccucu

SEQ ID NO: 2559791 - RNA, 19 nt, Human
cugcagcagcgguggccuc

SEQ ID NO: 2559792 - RNA, 18 nt, Human
cugcagcagaggcacugg

SEQ ID NO: 2559793 - RNA, 11 nt, Human
cugcagcauga

SEQ ID NO: 2559794 - RNA, 17 nt, Human
cugcagcaugaccugug

SEQ ID NO: 2559795 - RNA, 22 nt, Human
cugcagcaugaccugugaccag

SEQ ID NO: 2559796 - RNA, 22 nt, Human
cugcaggggcucuggagagaaa

SEQ ID NO: 2559797 - RNA, 19 nt, Human
cugcaggggcucuggagag

SEQ ID NO: 2559798 - RNA, 18 nt, Human
cugcaggggcucuggaga

SEQ ID NO: 2559799 - RNA, 17 nt, Human
cugcagggggugugucu

SEQ ID NO: 2559800 - RNA, 20 nt, Human
cugcagggggugugucugcu

SEQ ID NO: 2559801 - RNA, 21 nt, Human
cugcaggguggugcugggacu

SEQ ID NO: 2559802 - RNA, 20 nt, Human
cugcaggguggugcugggac

SEQ ID NO: 2559803 - RNA, 19 nt, Human
cugcaggguggugcuggga

SEQ ID NO: 2559804 - RNA, 18 nt, Human
cugcaggguggugcuggg

SEQ ID NO: 2559805 - RNA, 16 nt, Human
cugcaggguggugcug

SEQ ID NO: 2559806 - RNA, 21 nt, Human
cugcaggggcucuggagagaa

SEQ ID NO: 2559807 - RNA, 23 nt, Human
cugcagggggugugucugcucag

SEQ ID NO: 2559808 - RNA, 21 nt, Human
cugcagcauguugcugaggag

SEQ ID NO: 2559809 - RNA, 20 nt, Human
cugcagcauguugcugagga

SEQ ID NO: 2559810 - RNA, 18 nt, Human
cugcagcauguugcugag

SEQ ID NO: 2559811 - RNA, 19 nt, Human
cugcagcaugaccugugac

SEQ ID NO: 2559812 - RNA, 22 nt, Human
cugcagcauguugcugaggagu

SEQ ID NO: 2559813 - RNA, 12 nt, Human
cugcagccagcc

SEQ ID NO: 2559814 - RNA, 14 nt, Human
cugcagccagccca

SEQ ID NO: 2559815 - RNA, 15 nt, Human
cugcagccagcccag

SEQ ID NO: 2559816 - RNA, 16 nt, Human
cugcagccagcccagc

SEQ ID NO: 2559817 - RNA, 17 nt, Human
cugcagccagcccagcc

SEQ ID NO: 2559818 - RNA, 18 nt, Human
cugcagccagcccagccc

SEQ ID NO: 2559819 - RNA, 22 nt, Human
cugcagccagcccagcccagcu

SEQ ID NO: 2559820 - RNA, 17 nt, Human
cugcaggggcucuggag

SEQ ID NO: 2559821 - RNA, 16 nt, Human
cugcaggggcucugga

SEQ ID NO: 2559822 - RNA, 15 nt, Human
cugcaggggcucugg

SEQ ID NO: 2559823 - RNA, 23 nt, Human
cugcaguagucucugugcuuuga

SEQ ID NO: 2559824 - RNA, 20 nt, Human
cugcaguagucucugugcuu

SEQ ID NO: 2559825 - RNA, 16 nt, Human
cugcaguagucucugu

SEQ ID NO: 2559826 - RNA, 15 nt, Human
cugcaguagucucug

SEQ ID NO: 2559827 - RNA, 17 nt, Human
cugcaguaugaaaauaa

SEQ ID NO: 2559828 - RNA, 16 nt, Human
cugcaguaugaaaaua

SEQ ID NO: 2559829 - RNA, 20 nt, Human
cugcagguugggccauacug

SEQ ID NO: 2559830 - RNA, 15 nt, Human
cugcagguugggcca

SEQ ID NO: 2559831 - RNA, 14 nt, Human
cugcaguaaaucuu

SEQ ID NO: 2559832 - RNA, 17 nt, Human
cugcaguaaaucuuuua

SEQ ID NO: 2559833 - RNA, 21 nt, Human
cugcagguucuucuuccugaa

SEQ ID NO: 2559834 - RNA, 20 nt, Human
cugcagguucuucuuccuga

SEQ ID NO: 2559835 - RNA, 19 nt, Human
cugcaggugcugcugcgug

SEQ ID NO: 2559836 - RNA, 17 nt, Human
cugcaggugcugcugcg

SEQ ID NO: 2559837 - RNA, 14 nt, Human
cugcaggugcugcu

SEQ ID NO: 2559838 - RNA, 23 nt, Human
cugcaggguggugcugggacuga

SEQ ID NO: 2559839 - RNA, 22 nt, Human
cugcaggguggugcugggacug

SEQ ID NO: 2559840 - RNA, 23 nt, Human
cugcaggucccuaauaaagcugu

SEQ ID NO: 2559841 - RNA, 22 nt, Human
cugcaggucccuaauaaagcug

SEQ ID NO: 2559842 - RNA, 21 nt, Human
cugcaggucccuaauaaagcu

SEQ ID NO: 2559843 - RNA, 20 nt, Human
cugcaggucccuaauaaagc

SEQ ID NO: 2559844 - RNA, 19 nt, Human
cugcaggucccuaauaaag

SEQ ID NO: 2559845 - RNA, 16 nt, Human
cugcaguugccaguca

SEQ ID NO: 2559846 - RNA, 13 nt, Human
cugcaguugccag

SEQ ID NO: 2559847 - RNA, 19 nt, Human
cugcaguuugagacaggag

SEQ ID NO: 2559848 - RNA, 21 nt, Human
cugcaguuugagacaggagac

SEQ ID NO: 2559849 - RNA, 13 nt, Human
cugcaguccugga

SEQ ID NO: 2559850 - RNA, 22 nt, Human
cugcagucaucuugaccaagca

SEQ ID NO: 2559851 - RNA, 14 nt, Human
cugcagucacagcu

SEQ ID NO: 2559852 - RNA, 13 nt, Human
cugcagucacagc

SEQ ID NO: 2559853 - RNA, 22 nt, Human
cugcagucacuucgugggaucu

SEQ ID NO: 2559854 - RNA, 19 nt, Human
cugcagucacuucguggga

SEQ ID NO: 2559855 - RNA, 21 nt, Human
cugcagucagucaugauggca

SEQ ID NO: 2559856 - RNA, 22 nt, Human
cugcagugaaagacaagcugca

SEQ ID NO: 2559857 - RNA, 9 nt, Human
cugcaguga

SEQ ID NO: 2559858 - RNA, 21 nt, Human
cugcagucuggcugagcccug

SEQ ID NO: 2559859 - RNA, 20 nt, Human
cugcagucuggcugagcccu

SEQ ID NO: 2559860 - RNA, 17 nt, Human
cugcagucuggcugagc

SEQ ID NO: 2559861 - RNA, 14 nt, Human
cugcuuguuuccua

SEQ ID NO: 2559862 - RNA, 19 nt, Human
cugcuugugucccuccugg

SEQ ID NO: 2559863 - RNA, 22 nt, Human
cugcuuggguggagaagccauu

SEQ ID NO: 2559864 - RNA, 13 nt, Human
cugcuuguuuccu

SEQ ID NO: 2559865 - RNA, 16 nt, Human
cugcuuucuguuguca

SEQ ID NO: 2559866 - RNA, 20 nt, Human
cugcuuugacugagcagacu

SEQ ID NO: 2559867 - RNA, 21 nt, Human
cugcuuugacugagcagacug

SEQ ID NO: 2559868 - RNA, 22 nt, Human
cugcuuuucugcccuggcugcu

SEQ ID NO: 2559869 - RNA, 21 nt, Human
cugcuuuucugcccuggcugc

SEQ ID NO: 2559870 - RNA, 20 nt, Human
cugcuuuucugcccuggcug

SEQ ID NO: 2559871 - RNA, 19 nt, Human
cugcuuuucugcccuggcu

SEQ ID NO: 2559872 - RNA, 15 nt, Human
cugcuuuuggucugu

SEQ ID NO: 2559873 - RNA, 13 nt, Human
cugcuuuggaaau

SEQ ID NO: 2559874 - RNA, 21 nt, Human
cugcuuugcucuucaagaaau

SEQ ID NO: 2559875 - RNA, 23 nt, Human
cugcuuugacugagcagacuggu

SEQ ID NO: 2559876 - RNA, 16 nt, Human
cugcuuugggcugccc

SEQ ID NO: 2559877 - RNA, 20 nt, Human
cugcuuugggaagccgugcu

SEQ ID NO: 2559878 - RNA, 22 nt, Human
cugcuuugacugagcagacugg

SEQ ID NO: 2559879 - RNA, 17 nt, Human
cugcuuuuggucugugu

SEQ ID NO: 2559880 - RNA, 24 nt, Human
cugcuuuucugcccuggcugcugc

SEQ ID NO: 2559881 - RNA, 22 nt, Human
cuggaagccaaaauguaggcuu

SEQ ID NO: 2559882 - RNA, 15 nt, Human
cuggaagccagcuuu

SEQ ID NO: 2559883 - RNA, 16 nt, Human
cuggaagccagcuuuc

SEQ ID NO: 2559884 - RNA, 17 nt, Human
cuggaagccagcuuucc

SEQ ID NO: 2559885 - RNA, 18 nt, Human
cuggaagccggcggccca

SEQ ID NO: 2559886 - RNA, 17 nt, Human
cuggaagcuaauuugca

SEQ ID NO: 2559887 - RNA, 18 nt, Human
cuggaagcuaauuugcau

SEQ ID NO: 2559888 - RNA, 19 nt, Human
cuggaagcuaauuugcauu

SEQ ID NO: 2559889 - RNA, 22 nt, Human
cuggaagccggcggcccaagcc

SEQ ID NO: 2559890 - RNA, 22 nt, Human
cuggaagcuaauuugcauuaaa

SEQ ID NO: 2559891 - RNA, 12 nt, Human
cuggaagcugug

SEQ ID NO: 2559892 - RNA, 17 nt, Human
cuggaaggagugagagg

SEQ ID NO: 2559893 - RNA, 16 nt, Human
cuggaagcuguguccu

SEQ ID NO: 2559894 - RNA, 22 nt, Human
cuggaagcuguguccuugcacc

SEQ ID NO: 2559895 - RNA, 15 nt, Human
cuggaagugacuuug

SEQ ID NO: 2559896 - RNA, 18 nt, Human
cuggaagugacuuuggcu

SEQ ID NO: 2559897 - RNA, 16 nt, Human
cuggaaguccaaugug

SEQ ID NO: 2559898 - RNA, 19 nt, Human
cuggaaguccaauguggca

SEQ ID NO: 2559899 - RNA, 22 nt, Human
cuggaagggcuagaaccuguag

SEQ ID NO: 2559900 - RNA, 15 nt, Human
cuggaagggcuagaa

SEQ ID NO: 2559901 - RNA, 16 nt, Human
cuggaagggcagagua

SEQ ID NO: 2559902 - RNA, 19 nt, Human
cuggaaggggaagggacac

SEQ ID NO: 2559903 - RNA, 17 nt, Human
cuggaaggggcccgugg

SEQ ID NO: 2559904 - RNA, 19 nt, Human
cuggaaggggcccguggga

SEQ ID NO: 2559905 - RNA, 18 nt, Human
cugcuugggcuucauccu

SEQ ID NO: 2559906 - RNA, 17 nt, Human
cugcuugggcuucaucc

SEQ ID NO: 2559907 - RNA, 15 nt, Human
cugcuugggcuucau

SEQ ID NO: 2559908 - RNA, 13 nt, Human
cugcuugggcuuc

SEQ ID NO: 2559909 - RNA, 19 nt, Human
cugcuugggcuucauccuc

SEQ ID NO: 2559910 - RNA, 19 nt, Human
cugcuugugaaaggaaaga

SEQ ID NO: 2559911 - RNA, 18 nt, Human
cugcuuggguggagaagc

SEQ ID NO: 2559912 - RNA, 14 nt, Human
cugcuuggguggag

SEQ ID NO: 2559913 - RNA, 21 nt, Human
cugcuuggguggagaagccau

SEQ ID NO: 2559914 - RNA, 20 nt, Human
cugcuuggguggagaagcca

SEQ ID NO: 2559915 - RNA, 20 nt, Human
cugcuugauuuuugccucuu

SEQ ID NO: 2559916 - RNA, 13 nt, Human
cugcuugauuuuu

SEQ ID NO: 2559917 - RNA, 22 nt, Human
cugcuugaggcaacucaucuua

SEQ ID NO: 2559918 - RNA, 20 nt, Human
cugcuugcuugcuuuuuaau

SEQ ID NO: 2559919 - RNA, 13 nt, Human
cugcugcuggcug

SEQ ID NO: 2559920 - RNA, 12 nt, Human
cugcugcuggcu

SEQ ID NO: 2559921 - RNA, 16 nt, Human
cugcugcugcugcgcc

SEQ ID NO: 2559922 - RNA, 20 nt, Human
cugcugcugcgcccuuaccu

SEQ ID NO: 2559923 - RNA, 16 nt, Human
cugcugcugcgcccuu

SEQ ID NO: 2559924 - RNA, 15 nt, Human
cugcugcugcgcccu

SEQ ID NO: 2559925 - RNA, 14 nt, Human
cugcugcugcugug

SEQ ID NO: 2559926 - RNA, 15 nt, Human
cugcugcuggaucac

SEQ ID NO: 2559927 - RNA, 15 nt, Human
cugcugcugcugcug

SEQ ID NO: 2559928 - RNA, 19 nt, Human
cugcugggacuggccaggu

SEQ ID NO: 2559929 - RNA, 12 nt, Human
cugcuggcugcc

SEQ ID NO: 2559930 - RNA, 14 nt, Human
cugcuggcuugcag

SEQ ID NO: 2559931 - RNA, 16 nt, Human
cugcuggcuugcagug

SEQ ID NO: 2559932 - RNA, 17 nt, Human
cugcugggacuggccag

SEQ ID NO: 2559933 - RNA, 15 nt, Human
cugcuggcugccuua

SEQ ID NO: 2559934 - RNA, 14 nt, Human
cugcuggcugccuu

SEQ ID NO: 2559935 - RNA, 14 nt, Human
cugcugcuggcugg

SEQ ID NO: 2559936 - RNA, 13 nt, Human
cugcuggcugccu

SEQ ID NO: 2559937 - RNA, 15 nt, Human
cugcuggguguggcg

SEQ ID NO: 2559938 - RNA, 14 nt, Human
cugcuggguguggc

SEQ ID NO: 2559939 - RNA, 12 nt, Human
cugcuggguggc

SEQ ID NO: 2559940 - RNA, 11 nt, Human
cugcugggugg

SEQ ID NO: 2559941 - RNA, 14 nt, Human
cugcugggcucucc

SEQ ID NO: 2559942 - RNA, 17 nt, Human
cugcugguccgugggac

SEQ ID NO: 2559943 - RNA, 16 nt, Human
cugcugguccguggga

SEQ ID NO: 2559944 - RNA, 16 nt, Human
cugcuggucacagccu

SEQ ID NO: 2559945 - RNA, 15 nt, Human
cugcuggucacagcc

SEQ ID NO: 2559946 - RNA, 22 nt, Human
cugcugguaauuuguaucugaa

SEQ ID NO: 2559947 - RNA, 20 nt, Human
cugcugguaauuuguaucug

SEQ ID NO: 2559948 - RNA, 18 nt, Human
cugcuggucacagccucc

SEQ ID NO: 2559949 - RNA, 17 nt, Human
cugcuggucacagccuc

SEQ ID NO: 2559950 - RNA, 20 nt, Human
cugcuggucacagccuccuc

SEQ ID NO: 2559951 - RNA, 17 nt, Human
cugcuggguguggcgca

SEQ ID NO: 2559952 - RNA, 17 nt, Human
cugcuggguggcccauc

SEQ ID NO: 2559953 - RNA, 16 nt, Human
cugcuggguggcccau

SEQ ID NO: 2559954 - RNA, 15 nt, Human
cugcuggguggccca

SEQ ID NO: 2559955 - RNA, 14 nt, Human
cugcuggguggccc

SEQ ID NO: 2559956 - RNA, 19 nt, Human
cugcuggguggcccauccc

SEQ ID NO: 2559957 - RNA, 18 nt, Human
cugcuggguggcccaucc

SEQ ID NO: 2559958 - RNA, 21 nt, Human
cugcuggguggcccauccccc

SEQ ID NO: 2559959 - RNA, 19 nt, Human
cugcuggguuuuccuccgg

SEQ ID NO: 2559960 - RNA, 12 nt, Human
cugcuugaggaa

SEQ ID NO: 2559961 - RNA, 13 nt, Human
cugcuugaggaaa

SEQ ID NO: 2559962 - RNA, 14 nt, Human
cugcuugaggaaaa

SEQ ID NO: 2559963 - RNA, 16 nt, Human
cugcuugaggaaaaca

SEQ ID NO: 2559964 - RNA, 13 nt, Human
cugcuugaggcaa

SEQ ID NO: 2559965 - RNA, 20 nt, Human
cugcuugaggcaacucaucu

SEQ ID NO: 2559966 - RNA, 21 nt, Human
cugcuugaggcaacucaucuu

SEQ ID NO: 2559967 - RNA, 20 nt, Human
cugcuucucugacuucugcc

SEQ ID NO: 2559968 - RNA, 19 nt, Human
cugcuucucugacuucugc

SEQ ID NO: 2559969 - RNA, 17 nt, Human
cugcuucucugacuucu

SEQ ID NO: 2559970 - RNA, 16 nt, Human
cugcuucucugacuuc

SEQ ID NO: 2559971 - RNA, 15 nt, Human
cugcuucucugacuu

SEQ ID NO: 2559972 - RNA, 14 nt, Human
cugcuucucugacu

SEQ ID NO: 2559973 - RNA, 13 nt, Human
cugcuucucugac

SEQ ID NO: 2559974 - RNA, 22 nt, Human
cugcuucucugacuucugccug

SEQ ID NO: 2559975 - RNA, 21 nt, Human
cugcuucucugacuucugccu

SEQ ID NO: 2559976 - RNA, 23 nt, Human
cugcuucucugacuucugccugg

SEQ ID NO: 2559977 - RNA, 17 nt, Human
cugcuugacaacaucug

SEQ ID NO: 2559978 - RNA, 16 nt, Human
cugcuucuuaacccca

SEQ ID NO: 2559979 - RNA, 21 nt, Human
cugcuucucccacuuggccaa

SEQ ID NO: 2559980 - RNA, 20 nt, Human
cugcuucucccacuuggcca

SEQ ID NO: 2559981 - RNA, 18 nt, Human
cugcuucucccacuuggc

SEQ ID NO: 2559982 - RNA, 19 nt, Human
cugcuucuccauggccacc

SEQ ID NO: 2559983 - RNA, 16 nt, Human
cugcuucuccagccug

SEQ ID NO: 2559984 - RNA, 15 nt, Human
cugcuucuccagccu

SEQ ID NO: 2559985 - RNA, 14 nt, Human
cugcuucuccagcc

SEQ ID NO: 2559986 - RNA, 23 nt, Human
cugcuguccccucuugccccaac

SEQ ID NO: 2559987 - RNA, 22 nt, Human
cugcuguccccucuugccccaa

SEQ ID NO: 2559988 - RNA, 21 nt, Human
cugcuguccccucuugcccca

SEQ ID NO: 2559989 - RNA, 20 nt, Human
cugcuguccccucuugcccc

SEQ ID NO: 2559990 - RNA, 20 nt, Human
cugcugucccucccccuugu

SEQ ID NO: 2559991 - RNA, 18 nt, Human
cugcuuccuccuggaaau

SEQ ID NO: 2559992 - RNA, 17 nt, Human
cugcugucccucccccu

SEQ ID NO: 2559993 - RNA, 19 nt, Human
cugcuuccugucuuuggga

SEQ ID NO: 2559994 - RNA, 19 nt, Human
cugcuguccccucuugccc

SEQ ID NO: 2559995 - RNA, 18 nt, Human
cugcuguccccucuugcc

SEQ ID NO: 2559996 - RNA, 14 nt, Human
cugcuguccccucu

SEQ ID NO: 2559997 - RNA, 13 nt, Human
cugcuguccccuc

SEQ ID NO: 2559998 - RNA, 21 nt, Human
cugcuguccagacagccugua

SEQ ID NO: 2559999 - RNA, 20 nt, Human
cugcuguccagacagccugu

SEQ ID NO: 2560000 - RNA, 19 nt, Human
cugcuguccagacagccug

SEQ ID NO: 2560001 - RNA, 18 nt, Human
cugcuguccagacagccu

SEQ ID NO: 2560002 - RNA, 17 nt, Human
cugcuguccagacagcc

SEQ ID NO: 2560003 - RNA, 16 nt, Human
cugcuguccagacagc

SEQ ID NO: 2560004 - RNA, 15 nt, Human
cugcuguccagacag

SEQ ID NO: 2560005 - RNA, 14 nt, Human
cugcuguccagaca

SEQ ID NO: 2560006 - RNA, 11 nt, Human
cugcuguccag

SEQ ID NO: 2560007 - RNA, 22 nt, Human
cugcuggugcagagcugaagau

SEQ ID NO: 2560008 - RNA, 18 nt, Human
cugcuggugcagagcuga

SEQ ID NO: 2560009 - RNA, 23 nt, Human
cugcucuauuguagcauuucuug

SEQ ID NO: 2560010 - RNA, 15 nt, Human
cugcucuccgaccag

SEQ ID NO: 2560011 - RNA, 15 nt, Human
cugcucuauuguagc

SEQ ID NO: 2560012 - RNA, 20 nt, Human
cugcuccucuccccagcaag

SEQ ID NO: 2560013 - RNA, 19 nt, Human
cugcuccucuccccagcaa

SEQ ID NO: 2560014 - RNA, 23 nt, Human
cugcucccccacccccuccccag

SEQ ID NO: 2560015 - RNA, 21 nt, Human
cugcucccccacccccucccc

SEQ ID NO: 2560016 - RNA, 22 nt, Human
cugcucccccacccccucccca

SEQ ID NO: 2560017 - RNA, 23 nt, Human
cugcuccucuccccagcaaguga

SEQ ID NO: 2560018 - RNA, 23 nt, Human
cugcggugcuaucucccccagcc

SEQ ID NO: 2560019 - RNA, 22 nt, Human
cugcggugcuaucucccccagc

SEQ ID NO: 2560020 - RNA, 21 nt, Human
cugcggugcuaucucccccag

SEQ ID NO: 2560021 - RNA, 20 nt, Human
cugcggugcuaucuccccca

SEQ ID NO: 2560022 - RNA, 21 nt, Human
cugcucccagcagcccuaagg

SEQ ID NO: 2560023 - RNA, 17 nt, Human
cugcucccagcagcccu

SEQ ID NO: 2560024 - RNA, 16 nt, Human
cugcucccagcagccc

SEQ ID NO: 2560025 - RNA, 15 nt, Human
cugcucccagcagcc

SEQ ID NO: 2560026 - RNA, 14 nt, Human
cugcucccagcagc

SEQ ID NO: 2560027 - RNA, 22 nt, Human
cugcgguuuguuggaucuucaa

SEQ ID NO: 2560028 - RNA, 22 nt, Human
cugcgggugaacaaagcagcca

SEQ ID NO: 2560029 - RNA, 18 nt, Human
cugcuccccagcccuggc

SEQ ID NO: 2560030 - RNA, 17 nt, Human
cugcuccccagcccugg

SEQ ID NO: 2560031 - RNA, 16 nt, Human
cugcuccccagcccug

SEQ ID NO: 2560032 - RNA, 22 nt, Human
cugcucccagcagcccuaagga

SEQ ID NO: 2560033 - RNA, 20 nt, Human
cugcuccccagcagcggaac

SEQ ID NO: 2560034 - RNA, 20 nt, Human
cugcuccccagcccuggcuc

SEQ ID NO: 2560035 - RNA, 19 nt, Human
cugcuccccagcccuggcu

SEQ ID NO: 2560036 - RNA, 16 nt, Human
cugcuccccaggggag

SEQ ID NO: 2560037 - RNA, 12 nt, Human
cugcucccccac

SEQ ID NO: 2560038 - RNA, 13 nt, Human
cugcucccccacc

SEQ ID NO: 2560039 - RNA, 14 nt, Human
cugcucccccaccc

SEQ ID NO: 2560040 - RNA, 17 nt, Human
cugcucccccacccccu

SEQ ID NO: 2560041 - RNA, 21 nt, Human
cugcucugcgugucaccugug

SEQ ID NO: 2560042 - RNA, 22 nt, Human
cugcucugcgugucaccugugc

SEQ ID NO: 2560043 - RNA, 20 nt, Human
cugcucugcgugucaccugu

SEQ ID NO: 2560044 - RNA, 22 nt, Human
cugcucugcccuuguucccuag

SEQ ID NO: 2560045 - RNA, 18 nt, Human
cugcucuggaauuugcaa

SEQ ID NO: 2560046 - RNA, 13 nt, Human
cugcucuggaaaa

SEQ ID NO: 2560047 - RNA, 20 nt, Human
cugcucuccaagucucagug

SEQ ID NO: 2560048 - RNA, 20 nt, Human
cugcucugaugaagaggagu

SEQ ID NO: 2560049 - RNA, 11 nt, Human
cugcucugccc

SEQ ID NO: 2560050 - RNA, 16 nt, Human
cugcucuugaacuccu

SEQ ID NO: 2560051 - RNA, 18 nt, Human
cugcucuugaacuccuga

SEQ ID NO: 2560052 - RNA, 19 nt, Human
cugcucuugaacuccugac

SEQ ID NO: 2560053 - RNA, 19 nt, Human
cugcucuggaauuugcaag

SEQ ID NO: 2560054 - RNA, 15 nt, Human
cugcucugugcccac

SEQ ID NO: 2560055 - RNA, 12 nt, Human
cugcucugguua

SEQ ID NO: 2560056 - RNA, 13 nt, Human
cugcugcaguugc

SEQ ID NO: 2560057 - RNA, 10 nt, Human
cugcugcagu

SEQ ID NO: 2560058 - RNA, 14 nt, Human
cugcugcaguugcc

SEQ ID NO: 2560059 - RNA, 15 nt, Human
cugcugcaguugcca

SEQ ID NO: 2560060 - RNA, 23 nt, Human
cugcugccugcuuuuuauggccu

SEQ ID NO: 2560061 - RNA, 14 nt, Human
cugcugccugcuuu

SEQ ID NO: 2560062 - RNA, 21 nt, Human
cugcugcaggggcucuggaga

SEQ ID NO: 2560063 - RNA, 20 nt, Human
cugcugccgccucccagccu

SEQ ID NO: 2560064 - RNA, 14 nt, Human
cugcugccucccca

SEQ ID NO: 2560065 - RNA, 21 nt, Human
cugcugccgccucccagccug

SEQ ID NO: 2560066 - RNA, 15 nt, Human
cugcugccuccccaa

SEQ ID NO: 2560067 - RNA, 19 nt, Human
cugcugccuccccaacccu

SEQ ID NO: 2560068 - RNA, 21 nt, Human
cugccugcaguacuuuaccuc

SEQ ID NO: 2560069 - RNA, 20 nt, Human
cugccugcaguacuuuaccu

SEQ ID NO: 2560070 - RNA, 22 nt, Human
cugccugcagaggucugugcug

SEQ ID NO: 2560071 - RNA, 21 nt, Human
cugccugcagaggucugugcu

SEQ ID NO: 2560072 - RNA, 19 nt, Human
cugccugcagaggucugug

SEQ ID NO: 2560073 - RNA, 16 nt, Human
cugccugcagaggucu

SEQ ID NO: 2560074 - RNA, 15 nt, Human
cugcccugccugagg

SEQ ID NO: 2560075 - RNA, 13 nt, Human
cugcccugccuga

SEQ ID NO: 2560076 - RNA, 15 nt, Human
cugccugcaccccug

SEQ ID NO: 2560077 - RNA, 12 nt, Human
cugcccugccug

SEQ ID NO: 2560078 - RNA, 19 nt, Human
cugccugaagucacacagu

SEQ ID NO: 2560079 - RNA, 23 nt, Human
cugccugccgguaaacacgccug

SEQ ID NO: 2560080 - RNA, 12 nt, Human
cugccugccugu

SEQ ID NO: 2560081 - RNA, 15 nt, Human
cugccugccugucug

SEQ ID NO: 2560082 - RNA, 14 nt, Human
cugccugccugucu

SEQ ID NO: 2560083 - RNA, 16 nt, Human
cugccugccugucugu

SEQ ID NO: 2560084 - RNA, 18 nt, Human
cugccugcgcccaccccg

SEQ ID NO: 2560085 - RNA, 16 nt, Human
cugccugccuuggccu

SEQ ID NO: 2560086 - RNA, 23 nt, Human
cugccugcagaggucugugcuga

SEQ ID NO: 2560087 - RNA, 15 nt, Human
cugccugccagcugc

SEQ ID NO: 2560088 - RNA, 16 nt, Human
cugccugccagcugca

SEQ ID NO: 2560089 - RNA, 20 nt, Human
cugccugccagcugcacuga

SEQ ID NO: 2560090 - RNA, 21 nt, Human
cugccugccagcugcacugau

SEQ ID NO: 2560091 - RNA, 12 nt, Human
cugccugcccac

SEQ ID NO: 2560092 - RNA, 17 nt, Human
cugcccugcccaccugg

SEQ ID NO: 2560093 - RNA, 20 nt, Human
cugcccugcccaccuggccu

SEQ ID NO: 2560094 - RNA, 16 nt, Human
cugccugaagucacac

SEQ ID NO: 2560095 - RNA, 18 nt, Human
cugccugaagucacacag

SEQ ID NO: 2560096 - RNA, 21 nt, Human
cugcccugcccaccuggccuc

SEQ ID NO: 2560097 - RNA, 18 nt, Human
cugcccugcccuagcucc

SEQ ID NO: 2560098 - RNA, 15 nt, Human
cugcgggucacagga

SEQ ID NO: 2560099 - RNA, 21 nt, Human
cugcgggucacaggagggagg

SEQ ID NO: 2560100 - RNA, 22 nt, Human
cugcgggcuggguguggucucc

SEQ ID NO: 2560101 - RNA, 15 nt, Human
cugcggggcuuggcu

SEQ ID NO: 2560102 - RNA, 19 nt, Human
cugcgccgccgccggaguc

SEQ ID NO: 2560103 - RNA, 16 nt, Human
cugcgcccuuccccag

SEQ ID NO: 2560104 - RNA, 14 nt, Human
cugcgcccugggcu

SEQ ID NO: 2560105 - RNA, 13 nt, Human
cugcgcccugggc

SEQ ID NO: 2560106 - RNA, 18 nt, Human
cugcgcccuuaccuuccc

SEQ ID NO: 2560107 - RNA, 17 nt, Human
cugcgcccuuaccuucc

SEQ ID NO: 2560108 - RNA, 13 nt, Human
cugcgcccuuccc

SEQ ID NO: 2560109 - RNA, 14 nt, Human
cugcgcccuucccc

SEQ ID NO: 2560110 - RNA, 19 nt, Human
cugcggugcuaucuccccc

SEQ ID NO: 2560111 - RNA, 18 nt, Human
cugcggugcuaucucccc

SEQ ID NO: 2560112 - RNA, 22 nt, Human
cugcgggucacaggagggaggg

SEQ ID NO: 2560113 - RNA, 23 nt, Human
cugcgggucacaggagggagggg

SEQ ID NO: 2560114 - RNA, 23 nt, Human
cugcgguccacccaggagccccg

SEQ ID NO: 2560115 - RNA, 22 nt, Human
cugccugcuuuucacugcugca

SEQ ID NO: 2560116 - RNA, 20 nt, Human
cugccugcuuuucacugcug

SEQ ID NO: 2560117 - RNA, 22 nt, Human
cugccugcuuuuuauggccugu

SEQ ID NO: 2560118 - RNA, 13 nt, Human
cugccuuccuccu

SEQ ID NO: 2560119 - RNA, 14 nt, Human
cugccuuccuccug

SEQ ID NO: 2560120 - RNA, 15 nt, Human
cugccuuccuccugg

SEQ ID NO: 2560121 - RNA, 16 nt, Human
cugccuuccuccuggg

SEQ ID NO: 2560122 - RNA, 17 nt, Human
cugccuucccuagcuuu

SEQ ID NO: 2560123 - RNA, 16 nt, Human
cugccuucccuagcuu

SEQ ID NO: 2560124 - RNA, 15 nt, Human
cugccuucccuagcu

SEQ ID NO: 2560125 - RNA, 12 nt, Human
cugccuucccua

SEQ ID NO: 2560126 - RNA, 11 nt, Human
cugccuucccu

SEQ ID NO: 2560127 - RNA, 23 nt, Human
cugccugcuuuucacugcugcaa

SEQ ID NO: 2560128 - RNA, 17 nt, Human
cugccuucgcuucuugc

SEQ ID NO: 2560129 - RNA, 15 nt, Human
cugccuucgcuucuu

SEQ ID NO: 2560130 - RNA, 14 nt, Human
cugccuucgcuucu

SEQ ID NO: 2560131 - RNA, 13 nt, Human
cugccuucgcuuc

SEQ ID NO: 2560132 - RNA, 15 nt, Human
cugccuuccuugcua

SEQ ID NO: 2560133 - RNA, 14 nt, Human
cugccuuccuugcu

SEQ ID NO: 2560134 - RNA, 13 nt, Human
cugccuuccuugc

SEQ ID NO: 2560135 - RNA, 12 nt, Human
cugccuuccuug

SEQ ID NO: 2560136 - RNA, 18 nt, Human
cugccuuccuccugggcc

SEQ ID NO: 2560137 - RNA, 21 nt, Human
cugccuuccuccugggcccuc

SEQ ID NO: 2560138 - RNA, 18 nt, Human
cugcgcccaccccgcucu

SEQ ID NO: 2560139 - RNA, 17 nt, Human
cugcgcccaccccgcuc

SEQ ID NO: 2560140 - RNA, 15 nt, Human
cugcgcccaccccgc

SEQ ID NO: 2560141 - RNA, 23 nt, Human
cugcgcccaguccuuccaccucg

SEQ ID NO: 2560142 - RNA, 19 nt, Human
cugcgcccaguccuuccac

SEQ ID NO: 2560143 - RNA, 22 nt, Human
cugcgcccaccccgcucugcau

SEQ ID NO: 2560144 - RNA, 20 nt, Human
cugcgcccaccccgcucugc

SEQ ID NO: 2560145 - RNA, 18 nt, Human
cugcgcccaguccuucca

SEQ ID NO: 2560146 - RNA, 12 nt, Human
cuugcaccugca

SEQ ID NO: 2560147 - RNA, 16 nt, Human
cuugcaccucugaccu

SEQ ID NO: 2560148 - RNA, 22 nt, Human
cuugcaagaaucagugcaaaga

SEQ ID NO: 2560149 - RNA, 18 nt, Human
cuugcaagaaucagugca

SEQ ID NO: 2560150 - RNA, 14 nt, Human
cuugcaauggcagc

SEQ ID NO: 2560151 - RNA, 19 nt, Human
cuugcacgcccauguguga

SEQ ID NO: 2560152 - RNA, 13 nt, Human
cuugcaccugcau

SEQ ID NO: 2560153 - RNA, 14 nt, Human
cuugcaccugcauc

SEQ ID NO: 2560154 - RNA, 21 nt, Human
cuugcacuaaaguauguaaag

SEQ ID NO: 2560155 - RNA, 22 nt, Human
cuugcaaaguaucccuacugua

SEQ ID NO: 2560156 - RNA, 14 nt, Human
cuugcaacacacag

SEQ ID NO: 2560157 - RNA, 15 nt, Human
cuugcaacacacaga

SEQ ID NO: 2560158 - RNA, 17 nt, Human
cuugcaacacacagaca

SEQ ID NO: 2560159 - RNA, 19 nt, Human
cuugcaacacacagacaca

SEQ ID NO: 2560160 - RNA, 20 nt, Human
cuugcaacuucaugucaacu

SEQ ID NO: 2560161 - RNA, 14 nt, Human
cuugcaagaaucag

SEQ ID NO: 2560162 - RNA, 21 nt, Human
cuugagugggguuaucucugu

SEQ ID NO: 2560163 - RNA, 23 nt, Human
cuugagugggguuaucucugugu

SEQ ID NO: 2560164 - RNA, 22 nt, Human
cuugagugggguuaucucugug

SEQ ID NO: 2560165 - RNA, 21 nt, Human
cuugcauaauaagcuaaagag

SEQ ID NO: 2560166 - RNA, 22 nt, Human
cuugcauaauaagcuaaagagg

SEQ ID NO: 2560167 - RNA, 20 nt, Human
cuugcauaauaagcuaaaga

SEQ ID NO: 2560168 - RNA, 22 nt, Human
cuugcaguucagcaccacccua

SEQ ID NO: 2560169 - RNA, 21 nt, Human
cuugcaguagauuuucuuuaa

SEQ ID NO: 2560170 - RNA, 17 nt, Human
cuugcaguagauuuucu

SEQ ID NO: 2560171 - RNA, 22 nt, Human
cuugcaguagauuuucuuuaaa

SEQ ID NO: 2560172 - RNA, 18 nt, Human
cuugcaguucagcaccac

SEQ ID NO: 2560173 - RNA, 20 nt, Human
cuugcaggucucaacccuuu

SEQ ID NO: 2560174 - RNA, 14 nt, Human
cuugcaguagauuu

SEQ ID NO: 2560175 - RNA, 18 nt, Human
cuugcagacucuacagag

SEQ ID NO: 2560176 - RNA, 23 nt, Human
cuugcaucaauuuuucuuauuuc

SEQ ID NO: 2560177 - RNA, 21 nt, Human
cuugcaugaggcuaguguggu

SEQ ID NO: 2560178 - RNA, 21 nt, Human
cuugcaugguuuagaaagcuu

SEQ ID NO: 2560179 - RNA, 19 nt, Human
cuugagccuugaacuuuga

SEQ ID NO: 2560180 - RNA, 16 nt, Human
cuugagccaguaauug

SEQ ID NO: 2560181 - RNA, 13 nt, Human
cuugagccaguaa

SEQ ID NO: 2560182 - RNA, 21 nt, Human
cuugagcaguggcugguccag

SEQ ID NO: 2560183 - RNA, 16 nt, Human
cuugagcaguggcugg

SEQ ID NO: 2560184 - RNA, 14 nt, Human
cuugagcaguggcu

SEQ ID NO: 2560185 - RNA, 21 nt, Human
cuugagcaaguuccuucuggu

SEQ ID NO: 2560186 - RNA, 20 nt, Human
cuugagcaaguuccuucugg

SEQ ID NO: 2560187 - RNA, 13 nt, Human
cuugagcaguggc

SEQ ID NO: 2560188 - RNA, 20 nt, Human
cuugagaguagaugguuuga

SEQ ID NO: 2560189 - RNA, 22 nt, Human
cuugagaguaucaggucuccca

SEQ ID NO: 2560190 - RNA, 19 nt, Human
cuugagcaaguuccuucug

SEQ ID NO: 2560191 - RNA, 15 nt, Human
cuugagaugucuucu

SEQ ID NO: 2560192 - RNA, 20 nt, Human
cuugaccauucuccaccugc

SEQ ID NO: 2560193 - RNA, 17 nt, Human
cuugaccauucuccacc

SEQ ID NO: 2560194 - RNA, 21 nt, Human
cuugaccauucuccaccugcc

SEQ ID NO: 2560195 - RNA, 14 nt, Human
cuugagagggugga

SEQ ID NO: 2560196 - RNA, 20 nt, Human
cuugagccuugaacuuugac

SEQ ID NO: 2560197 - RNA, 22 nt, Human
cuugagccuugaacuuugaccu

SEQ ID NO: 2560198 - RNA, 13 nt, Human
cuugagcucagga

SEQ ID NO: 2560199 - RNA, 12 nt, Human
cuugagcccagg

SEQ ID NO: 2560200 - RNA, 22 nt, Human
cuugaggaggggcagguaaacu

SEQ ID NO: 2560201 - RNA, 14 nt, Human
cuugaggaguguga

SEQ ID NO: 2560202 - RNA, 16 nt, Human
cuugaggauuuugagu

SEQ ID NO: 2560203 - RNA, 22 nt, Human
cuugaggagugugagaaucaaa

SEQ ID NO: 2560204 - RNA, 14 nt, Human
cuugagggcccaga

SEQ ID NO: 2560205 - RNA, 24 nt, Human
cuugaggcuuagcuuugcucugcc

SEQ ID NO: 2560206 - RNA, 16 nt, Human
cuugagggagcuuagc

SEQ ID NO: 2560207 - RNA, 17 nt, Human
cuugaggauuuugagua

SEQ ID NO: 2560208 - RNA, 14 nt, Human
cuugaggccaggag

SEQ ID NO: 2560209 - RNA, 19 nt, Human
cuugagggcccagagcagg

SEQ ID NO: 2560210 - RNA, 18 nt, Human
cuugagggcccagagcag

SEQ ID NO: 2560211 - RNA, 17 nt, Human
cuugagggcccagagca

SEQ ID NO: 2560212 - RNA, 16 nt, Human
cuugagggcccagagc

SEQ ID NO: 2560213 - RNA, 14 nt, Human
cuugaggucuuuug

SEQ ID NO: 2560214 - RNA, 17 nt, Human
cuugaggucuuuugaca

SEQ ID NO: 2560215 - RNA, 22 nt, Human
cuugaccagcagaucccagcuc

SEQ ID NO: 2560216 - RNA, 18 nt, Human
cuugaggucuuuugacau

SEQ ID NO: 2560217 - RNA, 22 nt, Human
cuugaggucuuuugacaugugg

SEQ ID NO: 2560218 - RNA, 23 nt, Human
cuugaggucuuuugacaugugga

SEQ ID NO: 2560219 - RNA, 14 nt, Human
cuugaacccgggag

SEQ ID NO: 2560220 - RNA, 19 nt, Human
cuugaacccgggaggcaga

SEQ ID NO: 2560221 - RNA, 20 nt, Human
cuugaacccgggaggcagag

SEQ ID NO: 2560222 - RNA, 18 nt, Human
cuugaacuccuggccuca

SEQ ID NO: 2560223 - RNA, 17 nt, Human
cuugaacuccuggccuc

SEQ ID NO: 2560224 - RNA, 15 nt, Human
cuugaacuccuggcc

SEQ ID NO: 2560225 - RNA, 14 nt, Human
cuugaacuccuggc

SEQ ID NO: 2560226 - RNA, 20 nt, Human
cuugaacuggguacuugugg

SEQ ID NO: 2560227 - RNA, 18 nt, Human
cuugaacuggguacuugu

SEQ ID NO: 2560228 - RNA, 15 nt, Human
cuugaacuuugaccu

SEQ ID NO: 2560229 - RNA, 17 nt, Human
cuugaccaggccugggc

SEQ ID NO: 2560230 - RNA, 15 nt, Human
cuugaccaggccugg

SEQ ID NO: 2560231 - RNA, 23 nt, Human
cuugaccagcagaucccagcuca

SEQ ID NO: 2560232 - RNA, 17 nt, Human
cuugaacugagcuugga

SEQ ID NO: 2560233 - RNA, 19 nt, Human
cuugaacugagcuuggaag

SEQ ID NO: 2560234 - RNA, 16 nt, Human
cuugaacuggguacuu

SEQ ID NO: 2560235 - RNA, 19 nt, Human
cuugaaauuuuaaacuaua

SEQ ID NO: 2560236 - RNA, 13 nt, Human
cuugaaauuuuaa

SEQ ID NO: 2560237 - RNA, 20 nt, Human
cuugaaauuaagaaggcaaa

SEQ ID NO: 2560238 - RNA, 19 nt, Human
cuugaacuccuggccucaa

SEQ ID NO: 2560239 - RNA, 19 nt, Human
cuucuuuccacagaagcuc

SEQ ID NO: 2560240 - RNA, 14 nt, Human
cuucuuucauuuuc

SEQ ID NO: 2560241 - RNA, 16 nt, Human
cuucuuuccucuuccc

SEQ ID NO: 2560242 - RNA, 15 nt, Human
cuucuuuccucuucc

SEQ ID NO: 2560243 - RNA, 14 nt, Human
cuucuuuccucuuc

SEQ ID NO: 2560244 - RNA, 11 nt, Human
cuucuuuccuc

SEQ ID NO: 2560245 - RNA, 21 nt, Human
cuucuuucuuugggaauauuu

SEQ ID NO: 2560246 - RNA, 19 nt, Human
cuucuuugauaauguuaaa

SEQ ID NO: 2560247 - RNA, 17 nt, Human
cuucuuugauaauguua

SEQ ID NO: 2560248 - RNA, 18 nt, Human
cuucuuugcagccugggu

SEQ ID NO: 2560249 - RNA, 14 nt, Human
cuucuuugauaaug

SEQ ID NO: 2560250 - RNA, 13 nt, Human
cuucuuuccacag

SEQ ID NO: 2560251 - RNA, 22 nt, Human
cuucuuuauaauucuacuuuga

SEQ ID NO: 2560252 - RNA, 20 nt, Human
cuucuuuauacuguaauuua

SEQ ID NO: 2560253 - RNA, 14 nt, Human
cuucuuuauacugu

SEQ ID NO: 2560254 - RNA, 20 nt, Human
cugucugacaaccucuuggu

SEQ ID NO: 2560255 - RNA, 13 nt, Human
cugucucuggccu

SEQ ID NO: 2560256 - RNA, 16 nt, Human
cugucucugccucccu

SEQ ID NO: 2560257 - RNA, 18 nt, Human
cugucucugccucccuca

SEQ ID NO: 2560258 - RNA, 13 nt, Human
cugucucugccuc

SEQ ID NO: 2560259 - RNA, 16 nt, Human
cugucucuccaucugu

SEQ ID NO: 2560260 - RNA, 13 nt, Human
cugucucuccauc

SEQ ID NO: 2560261 - RNA, 22 nt, Human
cugucugaaggacacuuccugc

SEQ ID NO: 2560262 - RNA, 20 nt, Human
cugucugaaggacacuuccu

SEQ ID NO: 2560263 - RNA, 19 nt, Human
cugucugaaggacacuucc

SEQ ID NO: 2560264 - RNA, 16 nt, Human
cugucugaagccaaug

SEQ ID NO: 2560265 - RNA, 15 nt, Human
cugucucuuccauau

SEQ ID NO: 2560266 - RNA, 14 nt, Human
cugucucugucaug

SEQ ID NO: 2560267 - RNA, 12 nt, Human
cugucucuucca

SEQ ID NO: 2560268 - RNA, 14 nt, Human
cuucuuuuugcugu

SEQ ID NO: 2560269 - RNA, 15 nt, Human
cuucuuuuugcuguu

SEQ ID NO: 2560270 - RNA, 15 nt, Human
cuucuuuuggcuucc

SEQ ID NO: 2560271 - RNA, 23 nt, Human
cuucuuuuuauuuucuuuuguaa

SEQ ID NO: 2560272 - RNA, 19 nt, Human
cuugaaauauaggaacuua

SEQ ID NO: 2560273 - RNA, 21 nt, Human
cuugaaauuaagaaggcaaaa

SEQ ID NO: 2560274 - RNA, 16 nt, Human
cuucuuuuugcuguug

SEQ ID NO: 2560275 - RNA, 22 nt, Human
cuugaaaugaaaguauaacuga

SEQ ID NO: 2560276 - RNA, 13 nt, Human
cuucuuuugcucu

SEQ ID NO: 2560277 - RNA, 16 nt, Human
cuucuuuugauuaugu

SEQ ID NO: 2560278 - RNA, 13 nt, Human
cuucuuuugauua

SEQ ID NO: 2560279 - RNA, 14 nt, Human
cuucuuuugauuau

SEQ ID NO: 2560280 - RNA, 14 nt, Human
cuucuuuugcucuu

SEQ ID NO: 2560281 - RNA, 13 nt, Human
cuucuuuugugaa

SEQ ID NO: 2560282 - RNA, 15 nt, Human
cuucuuuuuauuuuc

SEQ ID NO: 2560283 - RNA, 20 nt, Human
cuucuuuuuauuuucuuuug

SEQ ID NO: 2560284 - RNA, 18 nt, Human
cuucuuuggguaaacgug

SEQ ID NO: 2560285 - RNA, 19 nt, Human
cuucuuugcuuugcccagc

SEQ ID NO: 2560286 - RNA, 15 nt, Human
cuucuuugcuugccu

SEQ ID NO: 2560287 - RNA, 13 nt, Human
cuucuuugcuugc

SEQ ID NO: 2560288 - RNA, 19 nt, Human
cuucuuuuaaaccauuuuc

SEQ ID NO: 2560289 - RNA, 13 nt, Human
cuucuuuuacuca

SEQ ID NO: 2560290 - RNA, 12 nt, Human
cuucuuuugagc

SEQ ID NO: 2560291 - RNA, 17 nt, Human
cuucuuuucacauucuu

SEQ ID NO: 2560292 - RNA, 20 nt, Human
cuucuuuucacauucuuaua

SEQ ID NO: 2560293 - RNA, 16 nt, Human
cuucuuuucacauucu

SEQ ID NO: 2560294 - RNA, 14 nt, Human
cuucuuuucacauu

SEQ ID NO: 2560295 - RNA, 18 nt, Human
cuuguaaaaauuaaaagu

SEQ ID NO: 2560296 - RNA, 18 nt, Human
cuuguaaaggaauuuaaa

SEQ ID NO: 2560297 - RNA, 18 nt, Human
cuuguaaagacuguagaa

SEQ ID NO: 2560298 - RNA, 21 nt, Human
cuuguaaauagcucagguguc

SEQ ID NO: 2560299 - RNA, 22 nt, Human
cuuggggaguuaagaccuggca

SEQ ID NO: 2560300 - RNA, 23 nt, Human
cuuggggaguuaagaccuggcag

SEQ ID NO: 2560301 - RNA, 21 nt, Human
cuuggggaguuaagaccuggc

SEQ ID NO: 2560302 - RNA, 20 nt, Human
cuugguuuguaaauuaacuu

SEQ ID NO: 2560303 - RNA, 19 nt, Human
cuuggggauucuuccaucu

SEQ ID NO: 2560304 - RNA, 21 nt, Human
cuuggggauucuuccaucuga

SEQ ID NO: 2560305 - RNA, 14 nt, Human
cuuggggcaggcag

SEQ ID NO: 2560306 - RNA, 15 nt, Human
cuuggggcaggcagu

SEQ ID NO: 2560307 - RNA, 19 nt, Human
cuuggggaccagagcugcc

SEQ ID NO: 2560308 - RNA, 18 nt, Human
cuuggggaccagagcugc

SEQ ID NO: 2560309 - RNA, 17 nt, Human
cuuggggaccagagcug

SEQ ID NO: 2560310 - RNA, 14 nt, Human
cuuggcuucuucuu

SEQ ID NO: 2560311 - RNA, 14 nt, Human
cuuggcuugcccac

SEQ ID NO: 2560312 - RNA, 16 nt, Human
cuuggggaccagagcu

SEQ ID NO: 2560313 - RNA, 16 nt, Human
cuuggcuggugcaccu

SEQ ID NO: 2560314 - RNA, 13 nt, Human
cuuggcuggugca

SEQ ID NO: 2560315 - RNA, 17 nt, Human
cuuggcuguagaaggag

SEQ ID NO: 2560316 - RNA, 21 nt, Human
cuuggcugugaggccccugga

SEQ ID NO: 2560317 - RNA, 13 nt, Human
cuuggcugugagg

SEQ ID NO: 2560318 - RNA, 12 nt, Human
cuuggcugugag

SEQ ID NO: 2560319 - RNA, 22 nt, Human
cuuggcuguagaaggagacaga

SEQ ID NO: 2560320 - RNA, 16 nt, Human
cuuggcuucucauacg

SEQ ID NO: 2560321 - RNA, 23 nt, Human
cuuggcuucucauacguccacca

SEQ ID NO: 2560322 - RNA, 18 nt, Human
cuuggcuuccuuucuugg

SEQ ID NO: 2560323 - RNA, 16 nt, Human
cuuggcuuccuuucuu

SEQ ID NO: 2560324 - RNA, 20 nt, Human
cuuggcuguuggcagugagu

SEQ ID NO: 2560325 - RNA, 20 nt, Human
cuuggcuucaggggaguccc

SEQ ID NO: 2560326 - RNA, 22 nt, Human
cuugucacugguagaccaaaau

SEQ ID NO: 2560327 - RNA, 13 nt, Human
cuugucaaagaag

SEQ ID NO: 2560328 - RNA, 13 nt, Human
cuugucagagcug

SEQ ID NO: 2560329 - RNA, 21 nt, Human
cuugucagagcugggaggggu

SEQ ID NO: 2560330 - RNA, 14 nt, Human
cuugucagagcugg

SEQ ID NO: 2560331 - RNA, 15 nt, Human
cuugucagagcuggg

SEQ ID NO: 2560332 - RNA, 16 nt, Human
cuuguggacacagcuc

SEQ ID NO: 2560333 - RNA, 18 nt, Human
cuuguggacacagcucuu

SEQ ID NO: 2560334 - RNA, 17 nt, Human
cuuguggacacagcucu

SEQ ID NO: 2560335 - RNA, 15 nt, Human
cuugucacugguaga

SEQ ID NO: 2560336 - RNA, 23 nt, Human
cuugucacugguagaccaaaaua

SEQ ID NO: 2560337 - RNA, 14 nt, Human
cuuguauuuuguga

SEQ ID NO: 2560338 - RNA, 18 nt, Human
cuuguauuauguguguuu

SEQ ID NO: 2560339 - RNA, 15 nt, Human
cuuguauuaagaaug

SEQ ID NO: 2560340 - RNA, 12 nt, Human
cuuguauuuaaa

SEQ ID NO: 2560341 - RNA, 18 nt, Human
cuuguauuuaaauauuaa

SEQ ID NO: 2560342 - RNA, 20 nt, Human
cuuguauuuaaauauuaaau

SEQ ID NO: 2560343 - RNA, 14 nt, Human
cuuguaacuccacc

SEQ ID NO: 2560344 - RNA, 19 nt, Human
cuuguaucaacacuguuac

SEQ ID NO: 2560345 - RNA, 23 nt, Human
cuuguauauuuuaagaaauaaca

SEQ ID NO: 2560346 - RNA, 20 nt, Human
cuuguaucaacacuguuacu

SEQ ID NO: 2560347 - RNA, 21 nt, Human
cuuguaugaaagauggcugug

SEQ ID NO: 2560348 - RNA, 15 nt, Human
cuuguaacuccacca

SEQ ID NO: 2560349 - RNA, 17 nt, Human
cuuguaacuccaccaac

SEQ ID NO: 2560350 - RNA, 20 nt, Human
cuuguaaugauauagccaga

SEQ ID NO: 2560351 - RNA, 21 nt, Human
cuuguaacuccaccaacccau

SEQ ID NO: 2560352 - RNA, 13 nt, Human
cuuguauuaaacu

SEQ ID NO: 2560353 - RNA, 23 nt, Human
cuuguauuaaacucuucacaaaa

SEQ ID NO: 2560354 - RNA, 14 nt, Human
cuuguauuaagaau

SEQ ID NO: 2560355 - RNA, 17 nt, Human
cuuguauuaaagacaga

SEQ ID NO: 2560356 - RNA, 17 nt, Human
cuuguauuaaguuguua

SEQ ID NO: 2560357 - RNA, 13 nt, Human
cuuguauuaaguu

SEQ ID NO: 2560358 - RNA, 13 nt, Human
cuuguauuaugug

SEQ ID NO: 2560359 - RNA, 23 nt, Human
cuuguauuaaguuguuaauaaaa

SEQ ID NO: 2560360 - RNA, 22 nt, Human
cuuguauuaaguuguuaauaaa

SEQ ID NO: 2560361 - RNA, 15 nt, Human
cuuggagccugcaga

SEQ ID NO: 2560362 - RNA, 16 nt, Human
cuuggagccugcagag

SEQ ID NO: 2560363 - RNA, 17 nt, Human
cuuggagccugcagagc

SEQ ID NO: 2560364 - RNA, 18 nt, Human
cuuggagccugcagagcu

SEQ ID NO: 2560365 - RNA, 15 nt, Human
cuuggaccucugcuc

SEQ ID NO: 2560366 - RNA, 14 nt, Human
cuuggaccucugcu

SEQ ID NO: 2560367 - RNA, 13 nt, Human
cuuggaccucugc

SEQ ID NO: 2560368 - RNA, 12 nt, Human
cuuggaccucug

SEQ ID NO: 2560369 - RNA, 13 nt, Human
cuuggagccugca

SEQ ID NO: 2560370 - RNA, 21 nt, Human
cuuggagccggacuuucggag

SEQ ID NO: 2560371 - RNA, 14 nt, Human
cuuggagccggacu

SEQ ID NO: 2560372 - RNA, 16 nt, Human
cuuggaccucugcucu

SEQ ID NO: 2560373 - RNA, 18 nt, Human
cuuggagccccagugcca

SEQ ID NO: 2560374 - RNA, 21 nt, Human
cuuggagccccagugccaagc

SEQ ID NO: 2560375 - RNA, 21 nt, Human
cuuggauuauuuuaaaucauu

SEQ ID NO: 2560376 - RNA, 18 nt, Human
cuuggauguaccugcccc

SEQ ID NO: 2560377 - RNA, 15 nt, Human
cuuggauguauaugu

SEQ ID NO: 2560378 - RNA, 23 nt, Human
cuuggauaaugcuguugccucau

SEQ ID NO: 2560379 - RNA, 19 nt, Human
cuuggagccugcagagcug

SEQ ID NO: 2560380 - RNA, 20 nt, Human
cuuggagccugcagagcugc

SEQ ID NO: 2560381 - RNA, 22 nt, Human
cuuggaguauuggggucugacc

SEQ ID NO: 2560382 - RNA, 18 nt, Human
cuuggauaaugcuguugc

SEQ ID NO: 2560383 - RNA, 22 nt, Human
cuuggauaaugcuguugccuca

SEQ ID NO: 2560384 - RNA, 22 nt, Human
cuuggcucgaaucucugugccu

SEQ ID NO: 2560385 - RNA, 21 nt, Human
cuuggcucgaaucucugugcc

SEQ ID NO: 2560386 - RNA, 20 nt, Human
cuuggcucgaaucucugugc

SEQ ID NO: 2560387 - RNA, 19 nt, Human
cuuggcucgaaucucugug

SEQ ID NO: 2560388 - RNA, 18 nt, Human
cuuggcucgaaucucugu

SEQ ID NO: 2560389 - RNA, 14 nt, Human
cuuggcucagacau

SEQ ID NO: 2560390 - RNA, 16 nt, Human
cuuggcucagacaugu

SEQ ID NO: 2560391 - RNA, 13 nt, Human
cuuggcugcaggg

SEQ ID NO: 2560392 - RNA, 12 nt, Human
cuuggcugcagg

SEQ ID NO: 2560393 - RNA, 13 nt, Human
cuuggauuguccc

SEQ ID NO: 2560394 - RNA, 14 nt, Human
cuuggauugucccc

SEQ ID NO: 2560395 - RNA, 17 nt, Human
cuuggcuacacagggau

SEQ ID NO: 2560396 - RNA, 19 nt, Human
cuuggcggcagcagccauc

SEQ ID NO: 2560397 - RNA, 23 nt, Human
cuuggcucaaguccucuuuucug

SEQ ID NO: 2560398 - RNA, 12 nt, Human
cuuggcucagac

SEQ ID NO: 2560399 - RNA, 21 nt, Human
cuuggcucaauccucuaagcu

SEQ ID NO: 2560400 - RNA, 24 nt, Human
cuuggcucacugcaacuucugccu

SEQ ID NO: 2560401 - RNA, 13 nt, Human
cuugcuugcuuuu

SEQ ID NO: 2560402 - RNA, 17 nt, Human
cuugcugguuuucugga

SEQ ID NO: 2560403 - RNA, 23 nt, Human
cuugcuggggacggggggcccca

SEQ ID NO: 2560404 - RNA, 16 nt, Human
cuugcuguauaugcag

SEQ ID NO: 2560405 - RNA, 14 nt, Human
cuugcuguccuagg

SEQ ID NO: 2560406 - RNA, 18 nt, Human
cuugcuuggcugcuuggc

SEQ ID NO: 2560407 - RNA, 14 nt, Human
cuugcuuggcugcu

SEQ ID NO: 2560408 - RNA, 22 nt, Human
cuugcuggacggggacugggga

SEQ ID NO: 2560409 - RNA, 22 nt, Human
cuugcuuguugggauuccugac

SEQ ID NO: 2560410 - RNA, 21 nt, Human
cuugcuuguugggauuccuga

SEQ ID NO: 2560411 - RNA, 21 nt, Human
cuuggacauccuccucccacc

SEQ ID NO: 2560412 - RNA, 20 nt, Human
cuuggacauccuccucccac

SEQ ID NO: 2560413 - RNA, 19 nt, Human
cuuggacauccuccuccca

SEQ ID NO: 2560414 - RNA, 17 nt, Human
cuuggacauccuccucc

SEQ ID NO: 2560415 - RNA, 22 nt, Human
cuuggacauccuccucccaccc

SEQ ID NO: 2560416 - RNA, 15 nt, Human
cuugcuuuuaaaauc

SEQ ID NO: 2560417 - RNA, 16 nt, Human
cuuggacauccuccuc

SEQ ID NO: 2560418 - RNA, 15 nt, Human
cuuggacauccuccu

SEQ ID NO: 2560419 - RNA, 13 nt, Human
cuugcauuuuugc

SEQ ID NO: 2560420 - RNA, 14 nt, Human
cuugcauuuuugca

SEQ ID NO: 2560421 - RNA, 20 nt, Human
cuugcauuuuugcaggagca

SEQ ID NO: 2560422 - RNA, 21 nt, Human
cuugcauuuuugcaggagcag

SEQ ID NO: 2560423 - RNA, 20 nt, Human
cuugcugccuucuggauucu

SEQ ID NO: 2560424 - RNA, 17 nt, Human
cuugcuggacggggacu

SEQ ID NO: 2560425 - RNA, 21 nt, Human
cuugcuggacggggacugggg

SEQ ID NO: 2560426 - RNA, 19 nt, Human
cuugcugccuucuggauuc

SEQ ID NO: 2560427 - RNA, 15 nt, Human
cuugcugccuucugg

SEQ ID NO: 2560428 - RNA, 17 nt, Human
cuugccaaauauaaaua

SEQ ID NO: 2560429 - RNA, 12 nt, Human
cuugcauuccca

SEQ ID NO: 2560430 - RNA, 16 nt, Human
cuugcauucccagugg

SEQ ID NO: 2560431 - RNA, 14 nt, Human
cuugcauucccagu

SEQ ID NO: 2560432 - RNA, 18 nt, Human
cuugcauugaauauauua

SEQ ID NO: 2560433 - RNA, 12 nt, Human
cuugcauuuuug

SEQ ID NO: 2560434 - RNA, 14 nt, Human
cuugcauugcagag

SEQ ID NO: 2560435 - RNA, 12 nt, Human
cuuugaauuuuc

SEQ ID NO: 2560436 - RNA, 22 nt, Human
cuuugcacugagggccacacua

SEQ ID NO: 2560437 - RNA, 19 nt, Human
cuuugcacugagggccaca

SEQ ID NO: 2560438 - RNA, 18 nt, Human
cuuugcacugagggccac

SEQ ID NO: 2560439 - RNA, 16 nt, Human
cuuugcacugagggcc

SEQ ID NO: 2560440 - RNA, 15 nt, Human
cuuugcacugagggc

SEQ ID NO: 2560441 - RNA, 14 nt, Human
cuuugcacugaggg

SEQ ID NO: 2560442 - RNA, 13 nt, Human
cuuugcacugagg

SEQ ID NO: 2560443 - RNA, 15 nt, Human
cuuugcagacaggca

SEQ ID NO: 2560444 - RNA, 14 nt, Human
cuuugcagacaggc

SEQ ID NO: 2560445 - RNA, 18 nt, Human
cuuugaauaaaaaugcac

SEQ ID NO: 2560446 - RNA, 18 nt, Human
cuuugaaggggccucacc

SEQ ID NO: 2560447 - RNA, 17 nt, Human
cuuugaauaaaaaugca

SEQ ID NO: 2560448 - RNA, 16 nt, Human
cuuugaagucauacca

SEQ ID NO: 2560449 - RNA, 18 nt, Human
cuuugaauccucucucug

SEQ ID NO: 2560450 - RNA, 19 nt, Human
cuuugaauccucucucugu

SEQ ID NO: 2560451 - RNA, 23 nt, Human
cuuugaauccucucucuguguua

SEQ ID NO: 2560452 - RNA, 23 nt, Human
cuuugaaugcuuuuugaauguua

SEQ ID NO: 2560453 - RNA, 16 nt, Human
cuuugaaugcuuuuug

SEQ ID NO: 2560454 - RNA, 13 nt, Human
cuuugaaugcuuu

SEQ ID NO: 2560455 - RNA, 15 nt, Human
cuuugaaugacaaag

SEQ ID NO: 2560456 - RNA, 16 nt, Human
cuuugaaugcggccca

SEQ ID NO: 2560457 - RNA, 16 nt, Human
cuuugcccaacaccag

SEQ ID NO: 2560458 - RNA, 15 nt, Human
cuuugcccagaaaga

SEQ ID NO: 2560459 - RNA, 14 nt, Human
cuuugcccacaaug

SEQ ID NO: 2560460 - RNA, 19 nt, Human
cuuugcccaacaccagccc

SEQ ID NO: 2560461 - RNA, 18 nt, Human
cuuugcccaacaccagcc

SEQ ID NO: 2560462 - RNA, 16 nt, Human
cuuugcacugauauau

SEQ ID NO: 2560463 - RNA, 23 nt, Human
cuuugcacugagggccacacuau

SEQ ID NO: 2560464 - RNA, 13 nt, Human
cuuugccagcuuu

SEQ ID NO: 2560465 - RNA, 18 nt, Human
cuuugccagcugcugcug

SEQ ID NO: 2560466 - RNA, 20 nt, Human
cuuugccagcuuuuccuccc

SEQ ID NO: 2560467 - RNA, 21 nt, Human
cuuugccacccucaugcugug

SEQ ID NO: 2560468 - RNA, 17 nt, Human
cuuugccagcugcugcu

SEQ ID NO: 2560469 - RNA, 18 nt, Human
cuuugccagaaagcauaa

SEQ ID NO: 2560470 - RNA, 23 nt, Human
cuuuggaaagaguaggaagacuu

SEQ ID NO: 2560471 - RNA, 19 nt, Human
cuuuggaaagaguaggaag

SEQ ID NO: 2560472 - RNA, 20 nt, Human
cuuugcccugguagggcagu

SEQ ID NO: 2560473 - RNA, 22 nt, Human
cuuugcccaacaccagccccug

SEQ ID NO: 2560474 - RNA, 23 nt, Human
cuuugccccaccuuuauuaaaau

SEQ ID NO: 2560475 - RNA, 21 nt, Human
cuuuccugaggcugggcuccc

SEQ ID NO: 2560476 - RNA, 20 nt, Human
cuuuccugaggcugggcucc

SEQ ID NO: 2560477 - RNA, 16 nt, Human
cuuuccugaggcuggg

SEQ ID NO: 2560478 - RNA, 17 nt, Human
cuuuccugaggcugggc

SEQ ID NO: 2560479 - RNA, 17 nt, Human
cuuucuuagaaauuuau

SEQ ID NO: 2560480 - RNA, 22 nt, Human
cuuucuuacaaggaagguggug

SEQ ID NO: 2560481 - RNA, 15 nt, Human
cuuucuuuaccugag

SEQ ID NO: 2560482 - RNA, 14 nt, Human
cuuucuuagaaauu

SEQ ID NO: 2560483 - RNA, 13 nt, Human
cuuucuuagaaau

SEQ ID NO: 2560484 - RNA, 11 nt, Human
cuuucuuagaa

SEQ ID NO: 2560485 - RNA, 22 nt, Human
cuuucuguugucauugcuguug

SEQ ID NO: 2560486 - RNA, 21 nt, Human
cuuucuguugucauugcuguu

SEQ ID NO: 2560487 - RNA, 15 nt, Human
cuuucuguugucauu

SEQ ID NO: 2560488 - RNA, 14 nt, Human
cuuucuguugucau

SEQ ID NO: 2560489 - RNA, 15 nt, Human
cuuucuguuggugua

SEQ ID NO: 2560490 - RNA, 16 nt, Human
cuuucuguugccacaa

SEQ ID NO: 2560491 - RNA, 19 nt, Human
cuuugaagcaguuguguca

SEQ ID NO: 2560492 - RNA, 16 nt, Human
cuuugaaggggccuca

SEQ ID NO: 2560493 - RNA, 14 nt, Human
cuuugaagcaguug

SEQ ID NO: 2560494 - RNA, 22 nt, Human
cuuugaagaggaaaaugaauaa

SEQ ID NO: 2560495 - RNA, 20 nt, Human
cuuugaagaggaaaaugaau

SEQ ID NO: 2560496 - RNA, 18 nt, Human
cuuugaagaggaaaauga

SEQ ID NO: 2560497 - RNA, 14 nt, Human
cuuugaagaggaaa

SEQ ID NO: 2560498 - RNA, 13 nt, Human
cuuugaagaggaa

SEQ ID NO: 2560499 - RNA, 15 nt, Human
cuuugaaauuguuua

SEQ ID NO: 2560500 - RNA, 21 nt, Human
cuuugaaauagucugugugaa

SEQ ID NO: 2560501 - RNA, 21 nt, Human
cuuuccacccccucccuggcc

SEQ ID NO: 2560502 - RNA, 19 nt, Human
cuuugaaauagucugugug

SEQ ID NO: 2560503 - RNA, 23 nt, Human
cuuugaaauguguuucuguauaa

SEQ ID NO: 2560504 - RNA, 22 nt, Human
cuuugaaauguguuucuguaua

SEQ ID NO: 2560505 - RNA, 21 nt, Human
cuuugaaauguguuucuguau

SEQ ID NO: 2560506 - RNA, 18 nt, Human
cuuugaaauguguuucug

SEQ ID NO: 2560507 - RNA, 14 nt, Human
cuuugaaauguguu

SEQ ID NO: 2560508 - RNA, 16 nt, Human
cuuugaaaugaauaua

SEQ ID NO: 2560509 - RNA, 22 nt, Human
cuuucuuugggaauauuugaau

SEQ ID NO: 2560510 - RNA, 21 nt, Human
cuuucuuugggaauauuugaa

SEQ ID NO: 2560511 - RNA, 20 nt, Human
cuuucuuugggaauauuuga

SEQ ID NO: 2560512 - RNA, 18 nt, Human
cuuucuuugggaauauuu

SEQ ID NO: 2560513 - RNA, 23 nt, Human
cuuucuuugggaauauuugaauc

SEQ ID NO: 2560514 - RNA, 21 nt, Human
cuuucuuuucgccguggcugc

SEQ ID NO: 2560515 - RNA, 17 nt, Human
cuuucuuucuuagaaau

SEQ ID NO: 2560516 - RNA, 16 nt, Human
cuuucuuucuuagaaa

SEQ ID NO: 2560517 - RNA, 15 nt, Human
cuuucuuucuuagaa

SEQ ID NO: 2560518 - RNA, 17 nt, Human
cuuucuuucuaacucca

SEQ ID NO: 2560519 - RNA, 18 nt, Human
cuuucuuuaccugagacc

SEQ ID NO: 2560520 - RNA, 17 nt, Human
cuuucuuuaccugagac

SEQ ID NO: 2560521 - RNA, 16 nt, Human
cuuuccaaaguacacu

SEQ ID NO: 2560522 - RNA, 20 nt, Human
cuuuccaaagccaaugugaa

SEQ ID NO: 2560523 - RNA, 16 nt, Human
cuuucauuuacugugg

SEQ ID NO: 2560524 - RNA, 22 nt, Human
cuuuccaaaguacacuguuuca

SEQ ID NO: 2560525 - RNA, 16 nt, Human
cuuuccaaaugcccag

SEQ ID NO: 2560526 - RNA, 21 nt, Human
cuuuccacuccuccuagccac

SEQ ID NO: 2560527 - RNA, 14 nt, Human
cuuuccaggaaggc

SEQ ID NO: 2560528 - RNA, 21 nt, Human
cuuuccacggagccacuccuc

SEQ ID NO: 2560529 - RNA, 22 nt, Human
cuuuccacggagccacuccucu

SEQ ID NO: 2560530 - RNA, 18 nt, Human
cuuuccacuccuccuagc

SEQ ID NO: 2560531 - RNA, 23 nt, Human
cuuuccaaagccaaugugaacag

SEQ ID NO: 2560532 - RNA, 21 nt, Human
cuuuccaaaggccauggagag

SEQ ID NO: 2560533 - RNA, 23 nt, Human
cuuucauuaaaggcuucucucuc

SEQ ID NO: 2560534 - RNA, 23 nt, Human
cuuuccacccccucccuggccug

SEQ ID NO: 2560535 - RNA, 15 nt, Human
cuuuccccaugucuc

SEQ ID NO: 2560536 - RNA, 20 nt, Human
cuuuccccaugucucgacuc

SEQ ID NO: 2560537 - RNA, 21 nt, Human
cuuuccccaugucucgacuca

SEQ ID NO: 2560538 - RNA, 17 nt, Human
cuuuccccagcccaggg

SEQ ID NO: 2560539 - RNA, 16 nt, Human
cuuuccccagcccagg

SEQ ID NO: 2560540 - RNA, 15 nt, Human
cuuuccccagcccag

SEQ ID NO: 2560541 - RNA, 14 nt, Human
cuuuccccagccca

SEQ ID NO: 2560542 - RNA, 13 nt, Human
cuuuccccagccc

SEQ ID NO: 2560543 - RNA, 21 nt, Human
cuuuccagcucaccccccaca

SEQ ID NO: 2560544 - RNA, 17 nt, Human
cuuucccauggggaggg

SEQ ID NO: 2560545 - RNA, 13 nt, Human
cuuuccagcucac

SEQ ID NO: 2560546 - RNA, 12 nt, Human
cuuuccagcuca

SEQ ID NO: 2560547 - RNA, 9 nt, Human
cuuuccaga

SEQ ID NO: 2560548 - RNA, 22 nt, Human
cuuuccacccccucccuggccu

SEQ ID NO: 2560549 - RNA, 20 nt, Human
cuuucccuuuuccauuugaa

SEQ ID NO: 2560550 - RNA, 13 nt, Human
cuuuccccugugg

SEQ ID NO: 2560551 - RNA, 21 nt, Human
cuuuccgguguuuaagacauu

SEQ ID NO: 2560552 - RNA, 19 nt, Human
cuuucccccaccagcuaag

SEQ ID NO: 2560553 - RNA, 18 nt, Human
cuuuccuaucauggagug

SEQ ID NO: 2560554 - RNA, 21 nt, Human
cuuuccuagauggcagucacu

SEQ ID NO: 2560555 - RNA, 17 nt, Human
cuuuccuaaggcugcaa

SEQ ID NO: 2560556 - RNA, 20 nt, Human
cuuuccuaaggcugcaaggu

SEQ ID NO: 2560557 - RNA, 20 nt, Human
cuuuccuagauggcagucac

SEQ ID NO: 2560558 - RNA, 15 nt, Human
cuuuccuaaauguuu

SEQ ID NO: 2560559 - RNA, 16 nt, Human
cuuuccuaaggcugca

SEQ ID NO: 2560560 - RNA, 17 nt, Human
cuuuccguggcacugca

SEQ ID NO: 2560561 - RNA, 19 nt, Human
cuuuccguggcacugcaua

SEQ ID NO: 2560562 - RNA, 14 nt, Human
cuugucaugugaca

SEQ ID NO: 2560563 - RNA, 15 nt, Human
cuugugucucugugc

SEQ ID NO: 2560564 - RNA, 17 nt, Human
cuugugucucugugcuu

SEQ ID NO: 2560565 - RNA, 18 nt, Human
cuugugucucugugcuuu

SEQ ID NO: 2560566 - RNA, 21 nt, Human
cuuguggacacagcucuucuc

SEQ ID NO: 2560567 - RNA, 17 nt, Human
cuugugugguuuggccc

SEQ ID NO: 2560568 - RNA, 18 nt, Human
cuugugucuguacacgug

SEQ ID NO: 2560569 - RNA, 15 nt, Human
cuugugucuguacac

SEQ ID NO: 2560570 - RNA, 14 nt, Human
cuugugucuguaca

SEQ ID NO: 2560571 - RNA, 12 nt, Human
cuugugucugua

SEQ ID NO: 2560572 - RNA, 21 nt, Human
cuugugucucugugcuuuuaa

SEQ ID NO: 2560573 - RNA, 13 nt, Human
cuugugucugcgu

SEQ ID NO: 2560574 - RNA, 19 nt, Human
cuuuauuuuguguuuagga

SEQ ID NO: 2560575 - RNA, 18 nt, Human
cuuuauuuuuuaaguauu

SEQ ID NO: 2560576 - RNA, 21 nt, Human
cuuuauuuuuuaaguauuuau

SEQ ID NO: 2560577 - RNA, 22 nt, Human
cuuuauuuuuuaaguauuuaua

SEQ ID NO: 2560578 - RNA, 23 nt, Human
cuuuauuuuuuaaguauuuauau

SEQ ID NO: 2560579 - RNA, 19 nt, Human
cuugugugugggcugugag

SEQ ID NO: 2560580 - RNA, 21 nt, Human
cuugugugugggcugugagug

SEQ ID NO: 2560581 - RNA, 11 nt, Human
cuuguguguuu

SEQ ID NO: 2560582 - RNA, 20 nt, Human
cuugugugugggcugugagu

SEQ ID NO: 2560583 - RNA, 13 nt, Human
cuuuauuuucugg

SEQ ID NO: 2560584 - RNA, 18 nt, Human
cuuuauuuucugguagau

SEQ ID NO: 2560585 - RNA, 22 nt, Human
cuuucaagcagucgugccugug

SEQ ID NO: 2560586 - RNA, 20 nt, Human
cuuucaagcagucgugccug

SEQ ID NO: 2560587 - RNA, 19 nt, Human
cuuucaagcagucgugccu

SEQ ID NO: 2560588 - RNA, 14 nt, Human
cuuucaacuugcau

SEQ ID NO: 2560589 - RNA, 14 nt, Human
cuuucaaauuucac

SEQ ID NO: 2560590 - RNA, 15 nt, Human
cuuucaaauuucaca

SEQ ID NO: 2560591 - RNA, 14 nt, Human
cuuucaaaaacaug

SEQ ID NO: 2560592 - RNA, 19 nt, Human
cuuucaaaaccuuuugaaa

SEQ ID NO: 2560593 - RNA, 15 nt, Human
cuuucaaagaaggaa

SEQ ID NO: 2560594 - RNA, 21 nt, Human
cuuucaaauugagagaaugga

SEQ ID NO: 2560595 - RNA, 18 nt, Human
cuuucaaagaaggaauuc

SEQ ID NO: 2560596 - RNA, 21 nt, Human
cuuucaaagaaggaauucuag

SEQ ID NO: 2560597 - RNA, 23 nt, Human
cuuucaagcagucgugccugugu

SEQ ID NO: 2560598 - RNA, 17 nt, Human
cuuucauccacuagugc

SEQ ID NO: 2560599 - RNA, 22 nt, Human
cuuucauccugacucugccccc

SEQ ID NO: 2560600 - RNA, 21 nt, Human
cuuucauccugacucugcccc

SEQ ID NO: 2560601 - RNA, 20 nt, Human
cuuucauccugacucugccc

SEQ ID NO: 2560602 - RNA, 19 nt, Human
cuuucauccugacucugcc

SEQ ID NO: 2560603 - RNA, 18 nt, Human
cuuucauccugacucugc

SEQ ID NO: 2560604 - RNA, 17 nt, Human
cuuucauccugacucug

SEQ ID NO: 2560605 - RNA, 19 nt, Human
cuuucauguaaacugugca

SEQ ID NO: 2560606 - RNA, 20 nt, Human
cuuucauguaaacugugcac

SEQ ID NO: 2560607 - RNA, 21 nt, Human
cuuucauguaaacugugcacc

SEQ ID NO: 2560608 - RNA, 21 nt, Human
cuuucauuaaaggcuucucuc

SEQ ID NO: 2560609 - RNA, 20 nt, Human
cuuucauuaaagcauuuacu

SEQ ID NO: 2560610 - RNA, 21 nt, Human
cuuucauggggugaugcuggg

SEQ ID NO: 2560611 - RNA, 19 nt, Human
cuuucauggggugaugcug

SEQ ID NO: 2560612 - RNA, 17 nt, Human
cuuucauguaaacugug

SEQ ID NO: 2560613 - RNA, 22 nt, Human
cuuucaugaguuuuucccagcu

SEQ ID NO: 2560614 - RNA, 18 nt, Human
cuuucaugaguuuuuccc

SEQ ID NO: 2560615 - RNA, 18 nt, Human
cuuuuuuauacauaaaca

SEQ ID NO: 2560616 - RNA, 21 nt, Human
cuuuuucuccagcugggcucu

SEQ ID NO: 2560617 - RNA, 18 nt, Human
cuuuuucuaaugugguua

SEQ ID NO: 2560618 - RNA, 14 nt, Human
cuuuuucucccucu

SEQ ID NO: 2560619 - RNA, 17 nt, Human
cuuuuucucccucugga

SEQ ID NO: 2560620 - RNA, 19 nt, Human
cuuuuuuauacacauaauu

SEQ ID NO: 2560621 - RNA, 19 nt, Human
cuuuuuuaucaugugaaau

SEQ ID NO: 2560622 - RNA, 18 nt, Human
cuuuuuuaugugccgugu

SEQ ID NO: 2560623 - RNA, 23 nt, Human
cuuuuuuaugugccguguuauug

SEQ ID NO: 2560624 - RNA, 21 nt, Human
cuuuuuucacggaaguuuuca

SEQ ID NO: 2560625 - RNA, 15 nt, Human
cuuuuuucacaaauu

SEQ ID NO: 2560626 - RNA, 12 nt, Human
cuuuuuucaaaa

SEQ ID NO: 2560627 - RNA, 11 nt, Human
gaaaaagaaaa

SEQ ID NO: 2560628 - RNA, 16 nt, Human
gaaaaagaaaaaauau

SEQ ID NO: 2560629 - RNA, 19 nt, Human
cuuuuuagggccaggcagg

SEQ ID NO: 2560630 - RNA, 12 nt, Human
cuuuuucauuug

SEQ ID NO: 2560631 - RNA, 18 nt, Human
cuuuuucauuugccuauu

SEQ ID NO: 2560632 - RNA, 15 nt, Human
cuuuuucauuugccu

SEQ ID NO: 2560633 - RNA, 13 nt, Human
cuuuuucauuugc

SEQ ID NO: 2560634 - RNA, 17 nt, Human
cuuuuucauuugccuau

SEQ ID NO: 2560635 - RNA, 22 nt, Human
cuuuuuccagacacuuuuuuga

SEQ ID NO: 2560636 - RNA, 16 nt, Human
cuuuuuuauacauaaa

SEQ ID NO: 2560637 - RNA, 17 nt, Human
cuuuuuuauacauaaac

SEQ ID NO: 2560638 - RNA, 15 nt, Human
cuuuuuuauacauaa

SEQ ID NO: 2560639 - RNA, 17 nt, Human
cuuuuuccuugucccca

SEQ ID NO: 2560640 - RNA, 13 nt, Human
cuuuuuccagagg

SEQ ID NO: 2560641 - RNA, 17 nt, Human
cuuuuuccccaaagucu

SEQ ID NO: 2560642 - RNA, 19 nt, Human
cuuuugcaccugcucucuu

SEQ ID NO: 2560643 - RNA, 20 nt, Human
cuuuugcaccccucccauua

SEQ ID NO: 2560644 - RNA, 19 nt, Human
cuuuugcaccccucccauu

SEQ ID NO: 2560645 - RNA, 22 nt, Human
cuuuugcaccugcucucuugua

SEQ ID NO: 2560646 - RNA, 18 nt, Human
cuuuugcaccccucccau

SEQ ID NO: 2560647 - RNA, 17 nt, Human
cuuuugcaccccuccca

SEQ ID NO: 2560648 - RNA, 16 nt, Human
cuuuugcaccccuccc

SEQ ID NO: 2560649 - RNA, 15 nt, Human
cuuuugcaccccucc

SEQ ID NO: 2560650 - RNA, 14 nt, Human
cuuuugcaccccuc

SEQ ID NO: 2560651 - RNA, 12 nt, Human
cuuuugcacccc

SEQ ID NO: 2560652 - RNA, 23 nt, Human
cuuuuuaaaguguuucuguuauu

SEQ ID NO: 2560653 - RNA, 19 nt, Human
cuuuuuaaaguguuucugu

SEQ ID NO: 2560654 - RNA, 20 nt, Human
cuuuuuaaauguaaagauau

SEQ ID NO: 2560655 - RNA, 21 nt, Human
cuuuuuaaauguaaagauauu

SEQ ID NO: 2560656 - RNA, 23 nt, Human
cuuuuuaaauucaguccuaagaa

SEQ ID NO: 2560657 - RNA, 17 nt, Human
cuuuuuaagcuuauuua

SEQ ID NO: 2560658 - RNA, 19 nt, Human
cuuuuuaagcuuauuuaau

SEQ ID NO: 2560659 - RNA, 20 nt, Human
cuuuuuaauaaaaaggcacc

SEQ ID NO: 2560660 - RNA, 14 nt, Human
cuuuuuaauaaaaa

SEQ ID NO: 2560661 - RNA, 15 nt, Human
cuuuuuaauaaaaag

SEQ ID NO: 2560662 - RNA, 22 nt, Human
cuuuuuaauuguuguuucuuuc

SEQ ID NO: 2560663 - RNA, 16 nt, Human
cuuuuuaauuguuguu

SEQ ID NO: 2560664 - RNA, 15 nt, Human
cuuuuuaauuguugu

SEQ ID NO: 2560665 - RNA, 14 nt, Human
cuuuuuaauuguug

SEQ ID NO: 2560666 - RNA, 17 nt, Human
cuuuuuaauucaccaaa

SEQ ID NO: 2560667 - RNA, 22 nt, Human
cuuuuuaauauugauaugcuua

SEQ ID NO: 2560668 - RNA, 23 nt, Human
cuuuuuaauuguuguuucuuucu

SEQ ID NO: 2560669 - RNA, 20 nt, Human
cuuuuuaccaaguuucaggu

SEQ ID NO: 2560670 - RNA, 15 nt, Human
cuuuuuacuccccuu

SEQ ID NO: 2560671 - RNA, 19 nt, Human
cuuuuuacuccccuugagc

SEQ ID NO: 2560672 - RNA, 20 nt, Human
cuuuucuuuucuacccuagc

SEQ ID NO: 2560673 - RNA, 17 nt, Human
cuuuucuuuucuacccu

SEQ ID NO: 2560674 - RNA, 13 nt, Human
cuuuucuuuucuu

SEQ ID NO: 2560675 - RNA, 23 nt, Human
cuuuugauaaucaacugggcuga

SEQ ID NO: 2560676 - RNA, 22 nt, Human
cuuuugauaaucaacugggcug

SEQ ID NO: 2560677 - RNA, 14 nt, Human
cuuuugcaaacuuu

SEQ ID NO: 2560678 - RNA, 17 nt, Human
cuuuucuuucagccaag

SEQ ID NO: 2560679 - RNA, 16 nt, Human
cuuuucuuucuaccaa

SEQ ID NO: 2560680 - RNA, 20 nt, Human
cuuuuccuuggggcaggcag

SEQ ID NO: 2560681 - RNA, 16 nt, Human
cuuuucgccguggcug

SEQ ID NO: 2560682 - RNA, 15 nt, Human
cuuuuaauuaaaugc

SEQ ID NO: 2560683 - RNA, 14 nt, Human
cuuuuaauuaaaug

SEQ ID NO: 2560684 - RNA, 19 nt, Human
cuuuuaaugcuccaaaugc

SEQ ID NO: 2560685 - RNA, 18 nt, Human
cuuuuaaugcuccaaaug

SEQ ID NO: 2560686 - RNA, 22 nt, Human
cuuuuaauuaaugaaauaucug

SEQ ID NO: 2560687 - RNA, 19 nt, Human
cuuuuaauuaaugaaauau

SEQ ID NO: 2560688 - RNA, 16 nt, Human
cuuuuaauuaaugaaa

SEQ ID NO: 2560689 - RNA, 20 nt, Human
cuuuuaauuaaaugcucauc

SEQ ID NO: 2560690 - RNA, 13 nt, Human
cuuuucacaaaua

SEQ ID NO: 2560691 - RNA, 12 nt, Human
cuuuucacaaau

SEQ ID NO: 2560692 - RNA, 20 nt, Human
cuuuucacauagcugucuag

SEQ ID NO: 2560693 - RNA, 23 nt, Human
cuuuuaauuaaugaaauaucugu

SEQ ID NO: 2560694 - RNA, 13 nt, Human
cuuuucacauucu

SEQ ID NO: 2560695 - RNA, 15 nt, Human
cuuuucacaaauaaa

SEQ ID NO: 2560696 - RNA, 14 nt, Human
cuuuucacaaauaa

SEQ ID NO: 2560697 - RNA, 20 nt, Human
cuuuucacauucuuauaaau

SEQ ID NO: 2560698 - RNA, 19 nt, Human
cuuuucacauucuuauaaa

SEQ ID NO: 2560699 - RNA, 17 nt, Human
cuuuucacauucuuaua

SEQ ID NO: 2560700 - RNA, 14 nt, Human
cuuuucacauucuu

SEQ ID NO: 2560701 - RNA, 23 nt, Human
cuuuuccaacccucaucaccaac

SEQ ID NO: 2560702 - RNA, 13 nt, Human
cuuuuccaacccu

SEQ ID NO: 2560703 - RNA, 22 nt, Human
cuuuucauuuaggugaggaagc

SEQ ID NO: 2560704 - RNA, 19 nt, Human
cuuuucacucccuccauca

SEQ ID NO: 2560705 - RNA, 12 nt, Human
cuuuucacugcu

SEQ ID NO: 2560706 - RNA, 16 nt, Human
cuuuuccucucucccg

SEQ ID NO: 2560707 - RNA, 23 nt, Human
cuuuuccucccuuggguucugau

SEQ ID NO: 2560708 - RNA, 15 nt, Human
cuuuuccucccuugg

SEQ ID NO: 2560709 - RNA, 13 nt, Human
cuuuuccucccuu

SEQ ID NO: 2560710 - RNA, 20 nt, Human
cuuuuccuauuuucagccca

SEQ ID NO: 2560711 - RNA, 19 nt, Human
cuuuuccuauuuucagccc

SEQ ID NO: 2560712 - RNA, 16 nt, Human
cuuuuccuauuuguuu

SEQ ID NO: 2560713 - RNA, 20 nt, Human
cuuuucacugcugcaaggcc

SEQ ID NO: 2560714 - RNA, 16 nt, Human
cuuuucacugcuggcu

SEQ ID NO: 2560715 - RNA, 14 nt, Human
cuuuucccuucuuu

SEQ ID NO: 2560716 - RNA, 18 nt, Human
cuuuuccucucucccgga

SEQ ID NO: 2560717 - RNA, 13 nt, Human
cuuuuccuugggg

SEQ ID NO: 2560718 - RNA, 17 nt, Human
cuuuuccuuggggcagg

SEQ ID NO: 2560719 - RNA, 21 nt, Human
cuuuuccuuggggcaggcagu

SEQ ID NO: 2560720 - RNA, 20 nt, Human
cuuuucgcaggauucuuccu

SEQ ID NO: 2560721 - RNA, 21 nt, Human
cuuuucgcaggauucuuccuc

SEQ ID NO: 2560722 - RNA, 18 nt, Human
cuuuggaguccccucacc

SEQ ID NO: 2560723 - RNA, 16 nt, Human
cuuuggaguccccuca

SEQ ID NO: 2560724 - RNA, 14 nt, Human
cuuuggaguccccu

SEQ ID NO: 2560725 - RNA, 14 nt, Human
cuuuggaggccccu

SEQ ID NO: 2560726 - RNA, 22 nt, Human
cuuuggaguccccucaccuccu

SEQ ID NO: 2560727 - RNA, 18 nt, Human
cuuuguuuuuaugaagaa

SEQ ID NO: 2560728 - RNA, 21 nt, Human
cuuuguuuuuuuuuccugucc

SEQ ID NO: 2560729 - RNA, 16 nt, Human
cuuuguuuuuuuuucc

SEQ ID NO: 2560730 - RNA, 18 nt, Human
cuuuuaaaacacuuccau

SEQ ID NO: 2560731 - RNA, 23 nt, Human
cuuuguuuuuuuuuccuguccuu

SEQ ID NO: 2560732 - RNA, 17 nt, Human
cuuuggaccuaauccaa

SEQ ID NO: 2560733 - RNA, 23 nt, Human
cuuuggagcuuuuuucuuuaaga

SEQ ID NO: 2560734 - RNA, 13 nt, Human
cuuuggagcuuuu

SEQ ID NO: 2560735 - RNA, 23 nt, Human
cuuuggagaucaaggagaggagg

SEQ ID NO: 2560736 - RNA, 16 nt, Human
cuuuggagaucaagga

SEQ ID NO: 2560737 - RNA, 11 nt, Human
cuuuggaagga

SEQ ID NO: 2560738 - RNA, 19 nt, Human
cuuuggagaccauuaucag

SEQ ID NO: 2560739 - RNA, 21 nt, Human
cuuuggaccuaaauggccuca

SEQ ID NO: 2560740 - RNA, 16 nt, Human
cuuuggaccuaaucca

SEQ ID NO: 2560741 - RNA, 20 nt, Human
cuuuuaaaccucaccuuugu

SEQ ID NO: 2560742 - RNA, 16 nt, Human
cuuuuaaaagacaaga

SEQ ID NO: 2560743 - RNA, 14 nt, Human
cuuuuaaaagacaa

SEQ ID NO: 2560744 - RNA, 17 nt, Human
cuuuuaaaccauuuucu

SEQ ID NO: 2560745 - RNA, 12 nt, Human
cuuuuaaacugu

SEQ ID NO: 2560746 - RNA, 13 nt, Human
cuuuuaaacugug

SEQ ID NO: 2560747 - RNA, 15 nt, Human
cuuuuaaacugugua

SEQ ID NO: 2560748 - RNA, 22 nt, Human
cuuuuaaaagacaagacuucag

SEQ ID NO: 2560749 - RNA, 23 nt, Human
cuuuuaaaggggcagaaaaacuc

SEQ ID NO: 2560750 - RNA, 14 nt, Human
cuuuuaaucagaca

SEQ ID NO: 2560751 - RNA, 22 nt, Human
cuuuuaauaaacuuuuuuuuga

SEQ ID NO: 2560752 - RNA, 16 nt, Human
cuuuuaauacagggua

SEQ ID NO: 2560753 - RNA, 21 nt, Human
cuuuuaacaccugauguguac

SEQ ID NO: 2560754 - RNA, 20 nt, Human
cuuuuaacaccugaugugua

SEQ ID NO: 2560755 - RNA, 19 nt, Human
cuuuuaacaccugaugugu

SEQ ID NO: 2560756 - RNA, 22 nt, Human
cuuuuaaaggggcagaaaaacu

SEQ ID NO: 2560757 - RNA, 23 nt, Human
cuuuuaacaccugauguguacau

SEQ ID NO: 2560758 - RNA, 16 nt, Human
gaacacuccuucacag

SEQ ID NO: 2560759 - RNA, 15 nt, Human
gaacacuccuucaca

SEQ ID NO: 2560760 - RNA, 19 nt, Human
gaacagacuggaagcacag

SEQ ID NO: 2560761 - RNA, 20 nt, Human
gaacagacuggaagcacagc

SEQ ID NO: 2560762 - RNA, 17 nt, Human
gaacacuccuucacaga

SEQ ID NO: 2560763 - RNA, 20 nt, Human
gaacacuccaauuaaggauu

SEQ ID NO: 2560764 - RNA, 11 nt, Human
gaaauuugaau

SEQ ID NO: 2560765 - RNA, 21 nt, Human
gaaauucccuucaucuggaac

SEQ ID NO: 2560766 - RNA, 22 nt, Human
gaaauucccuucaucuggaacc

SEQ ID NO: 2560767 - RNA, 12 nt, Human
gaaauuccugua

SEQ ID NO: 2560768 - RNA, 13 nt, Human
gaaauuuccagag

SEQ ID NO: 2560769 - RNA, 21 nt, Human
gaaauuauguauguuuacaua

SEQ ID NO: 2560770 - RNA, 18 nt, Human
gaaauuauguauguuuac

SEQ ID NO: 2560771 - RNA, 15 nt, Human
gaaauuauuuaauaa

SEQ ID NO: 2560772 - RNA, 13 nt, Human
gaaauuauuuaau

SEQ ID NO: 2560773 - RNA, 17 nt, Human
gaaauucccuucaucug

SEQ ID NO: 2560774 - RNA, 17 nt, Human
gaaauuauuuaauaaaa

SEQ ID NO: 2560775 - RNA, 23 nt, Human
gaaauuaguacuccccuccuuga

SEQ ID NO: 2560776 - RNA, 19 nt, Human
gaaauuacuacaaaauuug

SEQ ID NO: 2560777 - RNA, 13 nt, Human
gaaauuagccggg

SEQ ID NO: 2560778 - RNA, 21 nt, Human
gaaauuacuuaucauccacau

SEQ ID NO: 2560779 - RNA, 16 nt, Human
gaaauuagcuguguga

SEQ ID NO: 2560780 - RNA, 13 nt, Human
gaaauuagggccc

SEQ ID NO: 2560781 - RNA, 19 nt, Human
gaaauuagcugugugaaau

SEQ ID NO: 2560782 - RNA, 16 nt, Human
gaacagcuucagguua

SEQ ID NO: 2560783 - RNA, 15 nt, Human
gaacagcuucagguu

SEQ ID NO: 2560784 - RNA, 14 nt, Human
gaacagcuucaggu

SEQ ID NO: 2560785 - RNA, 15 nt, Human
gaacagcuguaaucu

SEQ ID NO: 2560786 - RNA, 22 nt, Human
gaacagacuggaagcacagcuu

SEQ ID NO: 2560787 - RNA, 18 nt, Human
gaacagauaaucagugug

SEQ ID NO: 2560788 - RNA, 14 nt, Human
gaaauuugauuucu

SEQ ID NO: 2560789 - RNA, 19 nt, Human
gaacaggcaagugaagaaa

SEQ ID NO: 2560790 - RNA, 17 nt, Human
gaacagcuucagguuau

SEQ ID NO: 2560791 - RNA, 13 nt, Human
gaacaguaaacau

SEQ ID NO: 2560792 - RNA, 14 nt, Human
gaacaguaacugcc

SEQ ID NO: 2560793 - RNA, 12 nt, Human
gaacaguaaaca

SEQ ID NO: 2560794 - RNA, 14 nt, Human
gaacaguguuuccc

SEQ ID NO: 2560795 - RNA, 24 nt, Human
gaacaguuaccucugccucagaaa

SEQ ID NO: 2560796 - RNA, 16 nt, Human
gaacaguguuucccau

SEQ ID NO: 2560797 - RNA, 17 nt, Human
gaacaguguuucccaua

SEQ ID NO: 2560798 - RNA, 18 nt, Human
gaacaguguuucccauaa

SEQ ID NO: 2560799 - RNA, 21 nt, Human
gaacaguguuucccauaauuu

SEQ ID NO: 2560800 - RNA, 19 nt, Human
gaacauccuuccuucccac

SEQ ID NO: 2560801 - RNA, 14 nt, Human
gaacaguuuguaca

SEQ ID NO: 2560802 - RNA, 14 nt, Human
gaacaucccugcca

SEQ ID NO: 2560803 - RNA, 19 nt, Human
gaacauggacuuguauauu

SEQ ID NO: 2560804 - RNA, 17 nt, Human
gaacauggacuuguaua

SEQ ID NO: 2560805 - RNA, 13 nt, Human
gaacauccuuccu

SEQ ID NO: 2560806 - RNA, 15 nt, Human
gaacaucccugccag

SEQ ID NO: 2560807 - RNA, 17 nt, Human
gaacaucuguccuguga

SEQ ID NO: 2560808 - RNA, 23 nt, Human
gaacaugaaaacagaaaacgguu

SEQ ID NO: 2560809 - RNA, 15 nt, Human
gaacauggagagcua

SEQ ID NO: 2560810 - RNA, 22 nt, Human
gaacauggacuuguauauuugu

SEQ ID NO: 2560811 - RNA, 19 nt, Human
gaacaugugagagguuuga

SEQ ID NO: 2560812 - RNA, 11 nt, Human
gaaccaaagcg

SEQ ID NO: 2560813 - RNA, 20 nt, Human
gaaccaaagcgaauuuuaaa

SEQ ID NO: 2560814 - RNA, 23 nt, Human
gaaccaaagcgaauuuuaaaaga

SEQ ID NO: 2560815 - RNA, 19 nt, Human
gaaccaacaaguaaauauu

SEQ ID NO: 2560816 - RNA, 24 nt, Human
gaaccaacaaccucaacugccuac

SEQ ID NO: 2560817 - RNA, 15 nt, Human
gaaccaacacuaaca

SEQ ID NO: 2560818 - RNA, 17 nt, Human
gaaccaaaucuggaagc

SEQ ID NO: 2560819 - RNA, 16 nt, Human
gaaccaaaucuggaag

SEQ ID NO: 2560820 - RNA, 16 nt, Human
gaacauguacacuggu

SEQ ID NO: 2560821 - RNA, 13 nt, Human
gaaauauuuauuu

SEQ ID NO: 2560822 - RNA, 20 nt, Human
gaaauaucugaaaauguaug

SEQ ID NO: 2560823 - RNA, 15 nt, Human
gaaauauuuagcaaa

SEQ ID NO: 2560824 - RNA, 14 nt, Human
gaaauaucauuuau

SEQ ID NO: 2560825 - RNA, 13 nt, Human
gaaauaucauuua

SEQ ID NO: 2560826 - RNA, 18 nt, Human
gaaauaucugaaaaugua

SEQ ID NO: 2560827 - RNA, 19 nt, Human
gaaauaucugaaaauguau

SEQ ID NO: 2560828 - RNA, 16 nt, Human
gaaauauuuauuuuaa

SEQ ID NO: 2560829 - RNA, 15 nt, Human
gaaauauuuauuuua

SEQ ID NO: 2560830 - RNA, 19 nt, Human
gaaauauuuagcaaauaau

SEQ ID NO: 2560831 - RNA, 22 nt, Human
gaaauaucaguuacucagcccu

SEQ ID NO: 2560832 - RNA, 15 nt, Human
gaaaugaaugugugu

SEQ ID NO: 2560833 - RNA, 13 nt, Human
gaaaugaaugugu

SEQ ID NO: 2560834 - RNA, 12 nt, Human
gaaaugaauaua

SEQ ID NO: 2560835 - RNA, 19 nt, Human
gaaaugaauaauuucccaa

SEQ ID NO: 2560836 - RNA, 15 nt, Human
gaaaugaauuaaagu

SEQ ID NO: 2560837 - RNA, 14 nt, Human
gaaaugaccaauau

SEQ ID NO: 2560838 - RNA, 15 nt, Human
gaaaugagaaggcag

SEQ ID NO: 2560839 - RNA, 20 nt, Human
gaaaugaaugugugugguuu

SEQ ID NO: 2560840 - RNA, 19 nt, Human
gaaaugacuaaaaaacaaa

SEQ ID NO: 2560841 - RNA, 23 nt, Human
gaaauaaaaggaagccaaagagu

SEQ ID NO: 2560842 - RNA, 17 nt, Human
gaaauaaaggaugugau

SEQ ID NO: 2560843 - RNA, 17 nt, Human
gaaauauaggaacuuaa

SEQ ID NO: 2560844 - RNA, 20 nt, Human
gaaauaucaguuacucagcc

SEQ ID NO: 2560845 - RNA, 21 nt, Human
gaaauaucaguuacucagccc

SEQ ID NO: 2560846 - RNA, 12 nt, Human
gaaauaucauuu

SEQ ID NO: 2560847 - RNA, 23 nt, Human
gaaauaucaguuacucagcccug

SEQ ID NO: 2560848 - RNA, 20 nt, Human
gaaauaaaggaugugauugu

SEQ ID NO: 2560849 - RNA, 23 nt, Human
gaaauauauauguguguguaugu

SEQ ID NO: 2560850 - RNA, 14 nt, Human
gaaauauauaugug

SEQ ID NO: 2560851 - RNA, 17 nt, Human
gaaauauauaugugugu

SEQ ID NO: 2560852 - RNA, 19 nt, Human
gaaaugggcagagcagaga

SEQ ID NO: 2560853 - RNA, 17 nt, Human
gaaaugggcagagcaga

SEQ ID NO: 2560854 - RNA, 17 nt, Human
gaaauguacagcaagga

SEQ ID NO: 2560855 - RNA, 18 nt, Human
gaaaugcugauggauaac

SEQ ID NO: 2560856 - RNA, 17 nt, Human
gaaaugcugcauuuuaa

SEQ ID NO: 2560857 - RNA, 14 nt, Human
gaaaugcugccugc

SEQ ID NO: 2560858 - RNA, 13 nt, Human
gaaaugcugccug

SEQ ID NO: 2560859 - RNA, 14 nt, Human
gaaauguguuucug

SEQ ID NO: 2560860 - RNA, 13 nt, Human
gaaauguguuucu

SEQ ID NO: 2560861 - RNA, 18 nt, Human
gaaauuacuacaaaauuu

SEQ ID NO: 2560862 - RNA, 15 nt, Human
gaaaugggcagagca

SEQ ID NO: 2560863 - RNA, 16 nt, Human
gaaaugggcagagcag

SEQ ID NO: 2560864 - RNA, 20 nt, Human
gaaaugcauuauuuugaaug

SEQ ID NO: 2560865 - RNA, 23 nt, Human
gaaaugcauccauuccucaggga

SEQ ID NO: 2560866 - RNA, 18 nt, Human
gaaaugaggucagagccu

SEQ ID NO: 2560867 - RNA, 14 nt, Human
gaaaugaucaguuu

SEQ ID NO: 2560868 - RNA, 11 nt, Human
gaaaugagcug

SEQ ID NO: 2560869 - RNA, 18 nt, Human
gaaaugagaucaggcucu

SEQ ID NO: 2560870 - RNA, 19 nt, Human
gaaaugagaaggcagccac

SEQ ID NO: 2560871 - RNA, 18 nt, Human
gaaaugagaaggcagcca

SEQ ID NO: 2560872 - RNA, 17 nt, Human
gaaaugagaaggcagcc

SEQ ID NO: 2560873 - RNA, 16 nt, Human
gaaaugagaucaggcu

SEQ ID NO: 2560874 - RNA, 22 nt, Human
gaaagacuauucaaacagucuc

SEQ ID NO: 2560875 - RNA, 23 nt, Human
gaaagacuauucaaacagucuca

SEQ ID NO: 2560876 - RNA, 19 nt, Human
gaaagacuauucaaacagu

SEQ ID NO: 2560877 - RNA, 18 nt, Human
gaaacugaggaauuuucu

SEQ ID NO: 2560878 - RNA, 22 nt, Human
gaaacugaggaauuuucuuugu

SEQ ID NO: 2560879 - RNA, 15 nt, Human
gaaacugcagggaaa

SEQ ID NO: 2560880 - RNA, 16 nt, Human
gaaagagagaaaauaa

SEQ ID NO: 2560881 - RNA, 17 nt, Human
gaaagagagaaaauaaa

SEQ ID NO: 2560882 - RNA, 18 nt, Human
gaaagagagaaaauaaaa

SEQ ID NO: 2560883 - RNA, 20 nt, Human
gaaagagagaaaauaaaaag

SEQ ID NO: 2560884 - RNA, 21 nt, Human
gaaagagagaaaauaaaaagu

SEQ ID NO: 2560885 - RNA, 22 nt, Human
gaaagagagaaaauaaaaaguu

SEQ ID NO: 2560886 - RNA, 23 nt, Human
gaaagagagaaaauaaaaaguua

SEQ ID NO: 2560887 - RNA, 12 nt, Human
gaaagagagaaa

SEQ ID NO: 2560888 - RNA, 13 nt, Human
gaaagagagaaaa

SEQ ID NO: 2560889 - RNA, 14 nt, Human
gaaagagagaaaau

SEQ ID NO: 2560890 - RNA, 15 nt, Human
gaaagagagaaaaua

SEQ ID NO: 2560891 - RNA, 11 nt, Human
gaaagagagaa

SEQ ID NO: 2560892 - RNA, 14 nt, Human
gaaagacugagcuc

SEQ ID NO: 2560893 - RNA, 19 nt, Human
gaaagagagagaauucuuu

SEQ ID NO: 2560894 - RNA, 22 nt, Human
gaaagagcacuuaagagaauau

SEQ ID NO: 2560895 - RNA, 21 nt, Human
gaaagagcacuuaagagaaua

SEQ ID NO: 2560896 - RNA, 18 nt, Human
gaaagagcacuuaagaga

SEQ ID NO: 2560897 - RNA, 16 nt, Human
gaaagagcacuuaaga

SEQ ID NO: 2560898 - RNA, 17 nt, Human
gaaagaugagcuuuucu

SEQ ID NO: 2560899 - RNA, 14 nt, Human
gaaagauaacuagg

SEQ ID NO: 2560900 - RNA, 22 nt, Human
gaaagauggcugugccucugcc

SEQ ID NO: 2560901 - RNA, 16 nt, Human
gaaagaucaaaagguu

SEQ ID NO: 2560902 - RNA, 13 nt, Human
gaaagcagaacag

SEQ ID NO: 2560903 - RNA, 14 nt, Human
gaaagcagaacagu

SEQ ID NO: 2560904 - RNA, 23 nt, Human
gaaagauggcugugccucugccu

SEQ ID NO: 2560905 - RNA, 14 nt, Human
gaaagcaauaaaug

SEQ ID NO: 2560906 - RNA, 20 nt, Human
gaaaccuuuuuuaagauuuu

SEQ ID NO: 2560907 - RNA, 19 nt, Human
gaaaccuuuuuuaagauuu

SEQ ID NO: 2560908 - RNA, 18 nt, Human
gaaaccuuuuuuaagauu

SEQ ID NO: 2560909 - RNA, 17 nt, Human
gaaaccuuuuuuaagau

SEQ ID NO: 2560910 - RNA, 14 nt, Human
gaaaccuuuuuuaa

SEQ ID NO: 2560911 - RNA, 21 nt, Human
gaaaccuuuagggcagcuugc

SEQ ID NO: 2560912 - RNA, 20 nt, Human
gaaaccuuuagggcagcuug

SEQ ID NO: 2560913 - RNA, 19 nt, Human
gaaaccuuuagggcagcuu

SEQ ID NO: 2560914 - RNA, 17 nt, Human
gaaaccuugguguaguu

SEQ ID NO: 2560915 - RNA, 18 nt, Human
gaaaccuuuagggcagcu

SEQ ID NO: 2560916 - RNA, 17 nt, Human
gaaaccuuuagggcagc

SEQ ID NO: 2560917 - RNA, 22 nt, Human
gaaaccuugguguaguugaacu

SEQ ID NO: 2560918 - RNA, 13 nt, Human
gaaaaauguguaa

SEQ ID NO: 2560919 - RNA, 14 nt, Human
gaaaaauguguaau

SEQ ID NO: 2560920 - RNA, 16 nt, Human
gaaaaaugagccuggc

SEQ ID NO: 2560921 - RNA, 20 nt, Human
gaaaaaucuaagugauauaa

SEQ ID NO: 2560922 - RNA, 18 nt, Human
gaaaaaugagagaaggga

SEQ ID NO: 2560923 - RNA, 16 nt, Human
gaaaaaucuaagugau

SEQ ID NO: 2560924 - RNA, 20 nt, Human
gaaaaaugcccuuaaaucau

SEQ ID NO: 2560925 - RNA, 16 nt, Human
gaaaaagcacaagaag

SEQ ID NO: 2560926 - RNA, 17 nt, Human
gaaaaagcacaagaagc

SEQ ID NO: 2560927 - RNA, 22 nt, Human
gaaaaagcaguaacugacaacu

SEQ ID NO: 2560928 - RNA, 13 nt, Human
gaaacugccagca

SEQ ID NO: 2560929 - RNA, 15 nt, Human
gaaacugccagcaac

SEQ ID NO: 2560930 - RNA, 16 nt, Human
gaaacuccacaucugc

SEQ ID NO: 2560931 - RNA, 23 nt, Human
gaaacucaccugcuggccccuca

SEQ ID NO: 2560932 - RNA, 22 nt, Human
gaaacucagagucggaacggag

SEQ ID NO: 2560933 - RNA, 19 nt, Human
gaaacucaccugcuggccc

SEQ ID NO: 2560934 - RNA, 20 nt, Human
gaaacucaccugcuggcccc

SEQ ID NO: 2560935 - RNA, 21 nt, Human
gaaacucaccugcuggccccu

SEQ ID NO: 2560936 - RNA, 22 nt, Human
gaaacucaccugcuggccccuc

SEQ ID NO: 2560937 - RNA, 14 nt, Human
gaaacugaaugcuc

SEQ ID NO: 2560938 - RNA, 19 nt, Human
gaaacucuuuuugggcucc

SEQ ID NO: 2560939 - RNA, 17 nt, Human
gaaacuccacaucugcc

SEQ ID NO: 2560940 - RNA, 23 nt, Human
gaaacucauaauagacuucccac

SEQ ID NO: 2560941 - RNA, 19 nt, Human
gaaacuaggugcauauuua

SEQ ID NO: 2560942 - RNA, 17 nt, Human
gaaacucaccauguaaa

SEQ ID NO: 2560943 - RNA, 20 nt, Human
gaaacucaccauguaaaaga

SEQ ID NO: 2560944 - RNA, 21 nt, Human
gaaacucacccccaaggggca

SEQ ID NO: 2560945 - RNA, 18 nt, Human
gaaacucaccugcuggcc

SEQ ID NO: 2560946 - RNA, 20 nt, Human
gaaacuaggugcauauuuau

SEQ ID NO: 2560947 - RNA, 22 nt, Human
gaaaccuuuuuuaagauuuuuc

SEQ ID NO: 2560948 - RNA, 21 nt, Human
gaaaccuuuuuuaagauuuuu

SEQ ID NO: 2560949 - RNA, 23 nt, Human
gaaaccuuuuuuaagauuuuucu

SEQ ID NO: 2560950 - RNA, 17 nt, Human
gaaagcauuugaaugca

SEQ ID NO: 2560951 - RNA, 16 nt, Human
gaaagcauuugaaugc

SEQ ID NO: 2560952 - RNA, 15 nt, Human
gaaagcauuugaaug

SEQ ID NO: 2560953 - RNA, 14 nt, Human
gaaagcauuugaau

SEQ ID NO: 2560954 - RNA, 23 nt, Human
gaaagcacaggugggcuucccag

SEQ ID NO: 2560955 - RNA, 15 nt, Human
gaaagcacagguggg

SEQ ID NO: 2560956 - RNA, 12 nt, Human
gaaagcauuuga

SEQ ID NO: 2560957 - RNA, 21 nt, Human
gaaagcacugcaugaauaaaa

SEQ ID NO: 2560958 - RNA, 21 nt, Human
gaaagcauguggcauguucau

SEQ ID NO: 2560959 - RNA, 13 nt, Human
gaaagccaccucu

SEQ ID NO: 2560960 - RNA, 21 nt, Human
gaaagcauuugaaugcauuuu

SEQ ID NO: 2560961 - RNA, 20 nt, Human
gaaagcauuugaaugcauuu

SEQ ID NO: 2560962 - RNA, 18 nt, Human
gaaagcauuugaaugcau

SEQ ID NO: 2560963 - RNA, 14 nt, Human
gaaagccaggcagg

SEQ ID NO: 2560964 - RNA, 11 nt, Human
gaaagccaggc

SEQ ID NO: 2560965 - RNA, 20 nt, Human
gaaagccaccucucccucaa

SEQ ID NO: 2560966 - RNA, 19 nt, Human
gaaagccaccucucccuca

SEQ ID NO: 2560967 - RNA, 18 nt, Human
gaaagccaccucucccuc

SEQ ID NO: 2560968 - RNA, 15 nt, Human
gaaagccaccucucc

SEQ ID NO: 2560969 - RNA, 14 nt, Human
gaaagccaccucuc

SEQ ID NO: 2560970 - RNA, 22 nt, Human
gaaagcauguggcauguucauc

SEQ ID NO: 2560971 - RNA, 16 nt, Human
gaaaggaaagaggcuc

SEQ ID NO: 2560972 - RNA, 11 nt, Human
gaaaggaaaga

SEQ ID NO: 2560973 - RNA, 21 nt, Human
gaaagcuugcccuggugccuc

SEQ ID NO: 2560974 - RNA, 17 nt, Human
gaaagcauccaugugug

SEQ ID NO: 2560975 - RNA, 20 nt, Human
gaaagccagugacuccagga

SEQ ID NO: 2560976 - RNA, 19 nt, Human
gaaagccagugacuccagg

SEQ ID NO: 2560977 - RNA, 17 nt, Human
gaaagccagugacucca

SEQ ID NO: 2560978 - RNA, 23 nt, Human
gaaagccaggcagguagccaggg

SEQ ID NO: 2560979 - RNA, 16 nt, Human
gaaagccagugacucc

SEQ ID NO: 2560980 - RNA, 17 nt, Human
gaaaggagaggaaagaa

SEQ ID NO: 2560981 - RNA, 14 nt, Human
gaaaggauucaugu

SEQ ID NO: 2560982 - RNA, 22 nt, Human
gaaaguacuucuccacccugcu

SEQ ID NO: 2560983 - RNA, 22 nt, Human
gaaaggauguaaacagugccug

SEQ ID NO: 2560984 - RNA, 17 nt, Human
gaaagucagaugcccag

SEQ ID NO: 2560985 - RNA, 20 nt, Human
gaaagucagaugcccagagg

SEQ ID NO: 2560986 - RNA, 22 nt, Human
gaaagucgaauuaauagcuuuu

SEQ ID NO: 2560987 - RNA, 21 nt, Human
gaaagucauuggcuuuauccu

SEQ ID NO: 2560988 - RNA, 18 nt, Human
gaaagucauuggcuuuau

SEQ ID NO: 2560989 - RNA, 17 nt, Human
gaaagucauuggcuuua

SEQ ID NO: 2560990 - RNA, 14 nt, Human
gaaagucauuggcu

SEQ ID NO: 2560991 - RNA, 22 nt, Human
gaaaggaagcuccacugucacc

SEQ ID NO: 2560992 - RNA, 18 nt, Human
gaaaggaagcuccacugu

SEQ ID NO: 2560993 - RNA, 21 nt, Human
gaaaggaagugggacuggcac

SEQ ID NO: 2560994 - RNA, 21 nt, Human
gaaaggacucugggguuuuua

SEQ ID NO: 2560995 - RNA, 11 nt, Human
gaaaggagacu

SEQ ID NO: 2560996 - RNA, 15 nt, Human
gaaaggaguagaaaa

SEQ ID NO: 2560997 - RNA, 16 nt, Human
gaaaggaguagaaaaa

SEQ ID NO: 2560998 - RNA, 20 nt, Human
gaaaggauguaaacagugcc

SEQ ID NO: 2560999 - RNA, 14 nt, Human
gaaaggagaggaaa

SEQ ID NO: 2561000 - RNA, 23 nt, Human
gaaaggacucugggguuuuuacu

SEQ ID NO: 2561001 - RNA, 13 nt, Human
gaaaggagacuag

SEQ ID NO: 2561002 - RNA, 14 nt, Human
gaaauaaaaccuuu

SEQ ID NO: 2561003 - RNA, 22 nt, Human
gaaaguuuucagaaccucuucc

SEQ ID NO: 2561004 - RNA, 16 nt, Human
gaaauaaaaggaagcc

SEQ ID NO: 2561005 - RNA, 17 nt, Human
gaaauaaaaggaagcca

SEQ ID NO: 2561006 - RNA, 18 nt, Human
gaaauaaaaggaagccaa

SEQ ID NO: 2561007 - RNA, 19 nt, Human
gaaauaaaaggaagccaaa

SEQ ID NO: 2561008 - RNA, 15 nt, Human
gaaauaaaaccuuuc

SEQ ID NO: 2561009 - RNA, 16 nt, Human
gaaauaaaaccuuuca

SEQ ID NO: 2561010 - RNA, 17 nt, Human
gaaauaaaaccuuucaa

SEQ ID NO: 2561011 - RNA, 18 nt, Human
gaaauaaaaccuuucaaa

SEQ ID NO: 2561012 - RNA, 14 nt, Human
gaaaguuuacagga

SEQ ID NO: 2561013 - RNA, 18 nt, Human
gaaaguugcacggcugcu

SEQ ID NO: 2561014 - RNA, 17 nt, Human
gaaaguuacaaauugcu

SEQ ID NO: 2561015 - RNA, 16 nt, Human
gaaaguuuacaggaaa

SEQ ID NO: 2561016 - RNA, 20 nt, Human
gaaaguugcacggcugcuga

SEQ ID NO: 2561017 - RNA, 19 nt, Human
gaaaguugcacggcugcug

SEQ ID NO: 2561018 - RNA, 17 nt, Human
gaaaguuccuuauguau

SEQ ID NO: 2561019 - RNA, 23 nt, Human
gaaaguguaaagcauuccaacaa

SEQ ID NO: 2561020 - RNA, 16 nt, Human
gaaaguguaaagcauu

SEQ ID NO: 2561021 - RNA, 15 nt, Human
gaaaguguaaagcau

SEQ ID NO: 2561022 - RNA, 14 nt, Human
gaaaguguaaagca

SEQ ID NO: 2561023 - RNA, 13 nt, Human
gaaaguguaaagc

SEQ ID NO: 2561024 - RNA, 12 nt, Human
gaaaguguaaag

SEQ ID NO: 2561025 - RNA, 20 nt, Human
gaaaguggugcucaguugua

SEQ ID NO: 2561026 - RNA, 18 nt, Human
gaaaguggugcucaguug

SEQ ID NO: 2561027 - RNA, 16 nt, Human
gaaaguggugcucagu

SEQ ID NO: 2561028 - RNA, 23 nt, Human
gaaagugggugagaugcuggaga

SEQ ID NO: 2561029 - RNA, 21 nt, Human
gaaagugggugagaugcugga

SEQ ID NO: 2561030 - RNA, 21 nt, Human
gaaaguggccaugccacccug

SEQ ID NO: 2561031 - RNA, 16 nt, Human
gaaagugaauuugaau

SEQ ID NO: 2561032 - RNA, 17 nt, Human
gaaagugaauuugaaug

SEQ ID NO: 2561033 - RNA, 19 nt, Human
gaaagugaauuugaaugaa

SEQ ID NO: 2561034 - RNA, 23 nt, Human
gaaagugaauuugaaugaaaaau

SEQ ID NO: 2561035 - RNA, 22 nt, Human
gaaagugauuucuagaaagccu

SEQ ID NO: 2561036 - RNA, 21 nt, Human
gaaagugauaucccccagccu

SEQ ID NO: 2561037 - RNA, 13 nt, Human
gaaagugaauuug

SEQ ID NO: 2561038 - RNA, 19 nt, Human
gaaagugaagcaaaucaga

SEQ ID NO: 2561039 - RNA, 16 nt, Human
gaaagugaaaguccag

SEQ ID NO: 2561040 - RNA, 22 nt, Human
gaaggaaacccagcucuggucc

SEQ ID NO: 2561041 - RNA, 21 nt, Human
gaaggaaacccagcucugguc

SEQ ID NO: 2561042 - RNA, 15 nt, Human
gaaggaacguccccu

SEQ ID NO: 2561043 - RNA, 22 nt, Human
gaagcuucuggugaccuuccaa

SEQ ID NO: 2561044 - RNA, 19 nt, Human
gaaggaaagaaagaaggaa

SEQ ID NO: 2561045 - RNA, 16 nt, Human
gaagcuuccaguccaa

SEQ ID NO: 2561046 - RNA, 13 nt, Human
gaagcuuccaguc

SEQ ID NO: 2561047 - RNA, 19 nt, Human
gaaggaagacuucaucccu

SEQ ID NO: 2561048 - RNA, 23 nt, Human
gaaggaaccaaagcgaauuuuaa

SEQ ID NO: 2561049 - RNA, 20 nt, Human
gaaggaacucuggcuuccag

SEQ ID NO: 2561050 - RNA, 15 nt, Human
gaaggaacucuggcu

SEQ ID NO: 2561051 - RNA, 23 nt, Human
gaaggaacucuggcuuccaggua

SEQ ID NO: 2561052 - RNA, 22 nt, Human
gaaggaacucuggcuuccaggu

SEQ ID NO: 2561053 - RNA, 23 nt, Human
gaaggaaggagacucaccucugc

SEQ ID NO: 2561054 - RNA, 16 nt, Human
gaaggaagugaagagg

SEQ ID NO: 2561055 - RNA, 22 nt, Human
gaaggacccggaggggccuggc

SEQ ID NO: 2561056 - RNA, 22 nt, Human
gaaggaccacauuuuauauuua

SEQ ID NO: 2561057 - RNA, 20 nt, Human
gaaggaccacauuuuauauu

SEQ ID NO: 2561058 - RNA, 16 nt, Human
gaaggaccacauuuua

SEQ ID NO: 2561059 - RNA, 17 nt, Human
gaaggacacuuccugcc

SEQ ID NO: 2561060 - RNA, 18 nt, Human
gaaggacacuuccugccu

SEQ ID NO: 2561061 - RNA, 15 nt, Human
gaaggacacuuccug

SEQ ID NO: 2561062 - RNA, 16 nt, Human
gaaggacaaggcuaga

SEQ ID NO: 2561063 - RNA, 15 nt, Human
gaaggaggaggagga

SEQ ID NO: 2561064 - RNA, 21 nt, Human
gaaggacauugcggacagcca

SEQ ID NO: 2561065 - RNA, 20 nt, Human
gaaggacauugcggacagcc

SEQ ID NO: 2561066 - RNA, 22 nt, Human
gaaggaauaaauugcuccuuga

SEQ ID NO: 2561067 - RNA, 20 nt, Human
gaaggaauauauggcagagu

SEQ ID NO: 2561068 - RNA, 19 nt, Human
gaaggaauauauggcagag

SEQ ID NO: 2561069 - RNA, 15 nt, Human
gaaggaauugacuuc

SEQ ID NO: 2561070 - RNA, 19 nt, Human
gaaggacauugcggacagc

SEQ ID NO: 2561071 - RNA, 20 nt, Human
gaagccuguuuuguuggaag

SEQ ID NO: 2561072 - RNA, 22 nt, Human
gaagccuguuuuguuggaaggu

SEQ ID NO: 2561073 - RNA, 13 nt, Human
gaagccuggaaca

SEQ ID NO: 2561074 - RNA, 16 nt, Human
gaagccugcccuuguc

SEQ ID NO: 2561075 - RNA, 14 nt, Human
gaagccuuagccag

SEQ ID NO: 2561076 - RNA, 23 nt, Human
gaagcuguguccuugcaccugca

SEQ ID NO: 2561077 - RNA, 13 nt, Human
gaagcuguuguac

SEQ ID NO: 2561078 - RNA, 24 nt, Human
gaagcuguguccuugcaccugcau

SEQ ID NO: 2561079 - RNA, 20 nt, Human
gaaggaaacccagcucuggu

SEQ ID NO: 2561080 - RNA, 19 nt, Human
gaaggaaacccagcucugg

SEQ ID NO: 2561081 - RNA, 21 nt, Human
gaagcuguuguacauuuauga

SEQ ID NO: 2561082 - RNA, 19 nt, Human
gaagcuguuguacauuuau

SEQ ID NO: 2561083 - RNA, 18 nt, Human
gaagcuguuguacauuua

SEQ ID NO: 2561084 - RNA, 16 nt, Human
gaagcuguuguacauu

SEQ ID NO: 2561085 - RNA, 22 nt, Human
gaagcuguuguacauuuaugau

SEQ ID NO: 2561086 - RNA, 15 nt, Human
gaagcuucagaaguu

SEQ ID NO: 2561087 - RNA, 20 nt, Human
gaagccgcuggggccaguug

SEQ ID NO: 2561088 - RNA, 18 nt, Human
gaagccgcuggggccagu

SEQ ID NO: 2561089 - RNA, 13 nt, Human
gaagccucuggga

SEQ ID NO: 2561090 - RNA, 14 nt, Human
gaagccgcugcugg

SEQ ID NO: 2561091 - RNA, 21 nt, Human
gaagccucugggucagugguc

SEQ ID NO: 2561092 - RNA, 12 nt, Human
gaagccugaggc

SEQ ID NO: 2561093 - RNA, 13 nt, Human
gaagccugaggcu

SEQ ID NO: 2561094 - RNA, 12 nt, Human
gaagccugcccu

SEQ ID NO: 2561095 - RNA, 15 nt, Human
gaagccugcaggagu

SEQ ID NO: 2561096 - RNA, 16 nt, Human
gaagccaaagaaaaau

SEQ ID NO: 2561097 - RNA, 14 nt, Human
gaagccaaagaaaa

SEQ ID NO: 2561098 - RNA, 13 nt, Human
gaagccaaagaaa

SEQ ID NO: 2561099 - RNA, 12 nt, Human
gaagccaaagaa

SEQ ID NO: 2561100 - RNA, 17 nt, Human
gaagccaacuuggcuuu

SEQ ID NO: 2561101 - RNA, 15 nt, Human
gaagccaacuuggcu

SEQ ID NO: 2561102 - RNA, 13 nt, Human
gaagccaaagagu

SEQ ID NO: 2561103 - RNA, 14 nt, Human
gaagccgcuggggc

SEQ ID NO: 2561104 - RNA, 10 nt, Human
gaagccaaag

SEQ ID NO: 2561105 - RNA, 18 nt, Human
gaagccaaaccucuguga

SEQ ID NO: 2561106 - RNA, 15 nt, Human
gaagcauuuuauaaa

SEQ ID NO: 2561107 - RNA, 17 nt, Human
gaagcauuuuauaaauc

SEQ ID NO: 2561108 - RNA, 13 nt, Human
gaagcauuuuaua

SEQ ID NO: 2561109 - RNA, 18 nt, Human
gaaggaggaggaggaggu

SEQ ID NO: 2561110 - RNA, 14 nt, Human
gaaggaggcuggcu

SEQ ID NO: 2561111 - RNA, 15 nt, Human
gaaggaggugaggga

SEQ ID NO: 2561112 - RNA, 13 nt, Human
gaaggaggugagg

SEQ ID NO: 2561113 - RNA, 19 nt, Human
gaaggaggguuagggaggg

SEQ ID NO: 2561114 - RNA, 16 nt, Human
gaaggaugccaagaag

SEQ ID NO: 2561115 - RNA, 16 nt, Human
gaaggaugagcauuua

SEQ ID NO: 2561116 - RNA, 10 nt, Human
gaaggauccg

SEQ ID NO: 2561117 - RNA, 10 nt, Human
gaaggauccu

SEQ ID NO: 2561118 - RNA, 22 nt, Human
gaaggaucuguuuuuaaaaauc

SEQ ID NO: 2561119 - RNA, 20 nt, Human
gaaggcagggagggccuggg

SEQ ID NO: 2561120 - RNA, 22 nt, Human
gaaggcagggagggccugggcc

SEQ ID NO: 2561121 - RNA, 23 nt, Human
gaaggcagggagggccugggccc

SEQ ID NO: 2561122 - RNA, 21 nt, Human
gaaggcagggggaaggugggg

SEQ ID NO: 2561123 - RNA, 14 nt, Human
gaaggauuguaaaa

SEQ ID NO: 2561124 - RNA, 18 nt, Human
gaaggcagggagggccug

SEQ ID NO: 2561125 - RNA, 13 nt, Human
gaaggauuguaaa

SEQ ID NO: 2561126 - RNA, 14 nt, Human
gaaggaugagcauu

SEQ ID NO: 2561127 - RNA, 15 nt, Human
gaaggauguacauuu

SEQ ID NO: 2561128 - RNA, 16 nt, Human
gaaggauguacauuuc

SEQ ID NO: 2561129 - RNA, 17 nt, Human
gaaggauguacauuucc

SEQ ID NO: 2561130 - RNA, 20 nt, Human
gaaggauguacauuuccaaa

SEQ ID NO: 2561131 - RNA, 13 nt, Human
gaagggggcuggg

SEQ ID NO: 2561132 - RNA, 21 nt, Human
gaaggggcgucuguucccccu

SEQ ID NO: 2561133 - RNA, 13 nt, Human
gaagggggauaug

SEQ ID NO: 2561134 - RNA, 22 nt, Human
gaaggggccucaccgagugggg

SEQ ID NO: 2561135 - RNA, 23 nt, Human
gaaggggcccugguccuuccagg

SEQ ID NO: 2561136 - RNA, 16 nt, Human
gaaggggccagaggcu

SEQ ID NO: 2561137 - RNA, 17 nt, Human
gaaggggccagaggcuc

SEQ ID NO: 2561138 - RNA, 14 nt, Human
gaaggggccagagg

SEQ ID NO: 2561139 - RNA, 23 nt, Human
gaaggggaggcagccggcaccca

SEQ ID NO: 2561140 - RNA, 17 nt, Human
gaaggcaucagucccua

SEQ ID NO: 2561141 - RNA, 22 nt, Human
gaaggcagggggaagguggggu

SEQ ID NO: 2561142 - RNA, 21 nt, Human
gaaggcauaucagucucugag

SEQ ID NO: 2561143 - RNA, 18 nt, Human
gaaggucggaggcuuggg

SEQ ID NO: 2561144 - RNA, 23 nt, Human
gaaggucacucuuccugcaagga

SEQ ID NO: 2561145 - RNA, 16 nt, Human
gaagguccugcuauua

SEQ ID NO: 2561146 - RNA, 15 nt, Human
gaaggucggaggcuu

SEQ ID NO: 2561147 - RNA, 14 nt, Human
gaaggucggaggcu

SEQ ID NO: 2561148 - RNA, 22 nt, Human
gaagggggccaugaggccucag

SEQ ID NO: 2561149 - RNA, 21 nt, Human
gaaggucacucuuccugcaag

SEQ ID NO: 2561150 - RNA, 14 nt, Human
gaaggucaccagca

SEQ ID NO: 2561151 - RNA, 17 nt, Human
gaaggucaccugagccc

SEQ ID NO: 2561152 - RNA, 14 nt, Human
gaagggggccauga

SEQ ID NO: 2561153 - RNA, 16 nt, Human
gaagggggauaugaau

SEQ ID NO: 2561154 - RNA, 20 nt, Human
gaagggggccaugaggccuc

SEQ ID NO: 2561155 - RNA, 21 nt, Human
gaaggugaggagcuugaaacc

SEQ ID NO: 2561156 - RNA, 19 nt, Human
gaaguaaccauuugcacug

SEQ ID NO: 2561157 - RNA, 14 nt, Human
gaaguaacaguaac

SEQ ID NO: 2561158 - RNA, 19 nt, Human
gaaguaauaugcacacauu

SEQ ID NO: 2561159 - RNA, 20 nt, Human
gaaguaauaugcacacauuu

SEQ ID NO: 2561160 - RNA, 20 nt, Human
gaagucaagcccagccacgu

SEQ ID NO: 2561161 - RNA, 13 nt, Human
gaagucacacagu

SEQ ID NO: 2561162 - RNA, 19 nt, Human
gaaguauuuugcuggaaua

SEQ ID NO: 2561163 - RNA, 21 nt, Human
gaaguaauaugcacacauuuu

SEQ ID NO: 2561164 - RNA, 15 nt, Human
gaagucaaagcaagg

SEQ ID NO: 2561165 - RNA, 16 nt, Human
gaagucaaagcaagga

SEQ ID NO: 2561166 - RNA, 17 nt, Human
gaaguaagugggguugc

SEQ ID NO: 2561167 - RNA, 15 nt, Human
gaagucacugcacag

SEQ ID NO: 2561168 - RNA, 13 nt, Human
gaagucagagagg

SEQ ID NO: 2561169 - RNA, 18 nt, Human
gaagucuuagauguauau

SEQ ID NO: 2561170 - RNA, 22 nt, Human
gaaguccccuuccaucccagag

SEQ ID NO: 2561171 - RNA, 17 nt, Human
gaaguccccaggcccca

SEQ ID NO: 2561172 - RNA, 16 nt, Human
gaaguccccaggcccc

SEQ ID NO: 2561173 - RNA, 23 nt, Human
gaaguccaagcauuuagauguau

SEQ ID NO: 2561174 - RNA, 14 nt, Human
gaaguccaaugugg

SEQ ID NO: 2561175 - RNA, 17 nt, Human
gaaguccaauguggcaa

SEQ ID NO: 2561176 - RNA, 23 nt, Human
gaaguccccaggccccaggaagc

SEQ ID NO: 2561177 - RNA, 17 nt, Human
gaagaagggagaagaaa

SEQ ID NO: 2561178 - RNA, 16 nt, Human
gaagaagggagaagaa

SEQ ID NO: 2561179 - RNA, 15 nt, Human
gaagaagggagaaga

SEQ ID NO: 2561180 - RNA, 14 nt, Human
gaagaagggagaag

SEQ ID NO: 2561181 - RNA, 19 nt, Human
gaagaagggagaagaaagg

SEQ ID NO: 2561182 - RNA, 18 nt, Human
gaagaagggagaagaaag

SEQ ID NO: 2561183 - RNA, 16 nt, Human
gaagaagggcacccua

SEQ ID NO: 2561184 - RNA, 14 nt, Human
gaagaagucagaga

SEQ ID NO: 2561185 - RNA, 13 nt, Human
gaagaaguguguc

SEQ ID NO: 2561186 - RNA, 16 nt, Human
gaagacuucaucccuc

SEQ ID NO: 2561187 - RNA, 15 nt, Human
gaagacuucaucccu

SEQ ID NO: 2561188 - RNA, 19 nt, Human
gaagacuucaucccucugg

SEQ ID NO: 2561189 - RNA, 17 nt, Human
gaagacuucaucccucu

SEQ ID NO: 2561190 - RNA, 18 nt, Human
gaagagccugcaggugcu

SEQ ID NO: 2561191 - RNA, 16 nt, Human
gaagagccggagccuc

SEQ ID NO: 2561192 - RNA, 18 nt, Human
gaagaauacaaacauauu

SEQ ID NO: 2561193 - RNA, 12 nt, Human
gaagagccuugc

SEQ ID NO: 2561194 - RNA, 15 nt, Human
gaagagcuguucaca

SEQ ID NO: 2561195 - RNA, 20 nt, Human
gaagagcuguucacagccag

SEQ ID NO: 2561196 - RNA, 13 nt, Human
gaagagcuguuca

SEQ ID NO: 2561197 - RNA, 17 nt, Human
gaagagcuauuauauaa

SEQ ID NO: 2561198 - RNA, 23 nt, Human
gaagagcuguucacagccagacu

SEQ ID NO: 2561199 - RNA, 14 nt, Human
gaagaggaaaauga

SEQ ID NO: 2561200 - RNA, 18 nt, Human
gaagaggaaaaugaauaa

SEQ ID NO: 2561201 - RNA, 15 nt, Human
gaagaggaaaaugaa

SEQ ID NO: 2561202 - RNA, 10 nt, Human
gaagaggacu

SEQ ID NO: 2561203 - RNA, 20 nt, Human
gaagaguagcauuucauucu

SEQ ID NO: 2561204 - RNA, 16 nt, Human
gaagaguagcauuuca

SEQ ID NO: 2561205 - RNA, 23 nt, Human
gaagaguaagucaaccugccuga

SEQ ID NO: 2561206 - RNA, 14 nt, Human
gaagaguccucuga

SEQ ID NO: 2561207 - RNA, 16 nt, Human
gaagaguccucugaau

SEQ ID NO: 2561208 - RNA, 22 nt, Human
gaagauugagauguguucacaa

SEQ ID NO: 2561209 - RNA, 17 nt, Human
gaagauugagauguguu

SEQ ID NO: 2561210 - RNA, 18 nt, Human
gaagcauuuacuuugugu

SEQ ID NO: 2561211 - RNA, 14 nt, Human
gaagauucuuuccc

SEQ ID NO: 2561212 - RNA, 13 nt, Human
gaagauugugaau

SEQ ID NO: 2561213 - RNA, 22 nt, Human
gaagauuugaugcuggagaggu

SEQ ID NO: 2561214 - RNA, 20 nt, Human
gaagauuugaugcuggagag

SEQ ID NO: 2561215 - RNA, 13 nt, Human
gaagaugcagcuc

SEQ ID NO: 2561216 - RNA, 14 nt, Human
gaagaugcagcuca

SEQ ID NO: 2561217 - RNA, 20 nt, Human
gaagauggcauccugugaag

SEQ ID NO: 2561218 - RNA, 16 nt, Human
gaagauggcauccugu

SEQ ID NO: 2561219 - RNA, 17 nt, Human
gaagaugaaagaggagg

SEQ ID NO: 2561220 - RNA, 13 nt, Human
gaagaugaaagag

SEQ ID NO: 2561221 - RNA, 14 nt, Human
gaagaugaaucaau

SEQ ID NO: 2561222 - RNA, 21 nt, Human
gaagaugcagcaaaaugugaa

SEQ ID NO: 2561223 - RNA, 16 nt, Human
gaagaugaucagaccu

SEQ ID NO: 2561224 - RNA, 13 nt, Human
gaagaugaucaga

SEQ ID NO: 2561225 - RNA, 17 nt, Human
gaagauguagaggagaa

SEQ ID NO: 2561226 - RNA, 18 nt, Human
gaagaugggggcaagaag

SEQ ID NO: 2561227 - RNA, 12 nt, Human
gaagaugggggc

SEQ ID NO: 2561228 - RNA, 17 nt, Human
gaagauucuccugugcu

SEQ ID NO: 2561229 - RNA, 17 nt, Human
gaagaguguacuggggg

SEQ ID NO: 2561230 - RNA, 15 nt, Human
gaagaguguacuggg

SEQ ID NO: 2561231 - RNA, 14 nt, Human
gaagaguguacugg

SEQ ID NO: 2561232 - RNA, 17 nt, Human
gaagaguggguuucaca

SEQ ID NO: 2561233 - RNA, 18 nt, Human
gaagaguggguuucacaa

SEQ ID NO: 2561234 - RNA, 14 nt, Human
gaagagugagaggg

SEQ ID NO: 2561235 - RNA, 16 nt, Human
gaagagugagagggca

SEQ ID NO: 2561236 - RNA, 14 nt, Human
gaagauauuuuucc

SEQ ID NO: 2561237 - RNA, 21 nt, Human
gaagauauaacuauugcccag

SEQ ID NO: 2561238 - RNA, 14 nt, Human
gaagauaucuugaa

SEQ ID NO: 2561239 - RNA, 22 nt, Human
gaagauauaacuauugcccagg

SEQ ID NO: 2561240 - RNA, 20 nt, Human
gaagauaggcucugcacaga

SEQ ID NO: 2561241 - RNA, 18 nt, Human
gaagauaggcucugcaca

SEQ ID NO: 2561242 - RNA, 17 nt, Human
gaagauccuaaaacaaa

SEQ ID NO: 2561243 - RNA, 20 nt, Human
gaagauccccucaggacugc

SEQ ID NO: 2561244 - RNA, 16 nt, Human
gaagauccccucagga

SEQ ID NO: 2561245 - RNA, 18 nt, Human
gaagaucacgcuccccgc

SEQ ID NO: 2561246 - RNA, 15 nt, Human
gaagauccccucagg

SEQ ID NO: 2561247 - RNA, 17 nt, Human
gaagaucacgcuccccg

SEQ ID NO: 2561248 - RNA, 16 nt, Human
gaagaucacgcucccc

SEQ ID NO: 2561249 - RNA, 21 nt, Human
gaagaucauauacgugaaaau

SEQ ID NO: 2561250 - RNA, 22 nt, Human
gaagauccugcggguggggcuu

SEQ ID NO: 2561251 - RNA, 14 nt, Human
gaagauccugcggg

SEQ ID NO: 2561252 - RNA, 13 nt, Human
gaagauccuaccc

SEQ ID NO: 2561253 - RNA, 18 nt, Human
gaagaucguuaguaucua

SEQ ID NO: 2561254 - RNA, 15 nt, Human
gaagaucuuaaauuu

SEQ ID NO: 2561255 - RNA, 15 nt, Human
gaaccacaagacugc

SEQ ID NO: 2561256 - RNA, 14 nt, Human
gaaccacaagacug

SEQ ID NO: 2561257 - RNA, 18 nt, Human
gaaccacaucuugcucug

SEQ ID NO: 2561258 - RNA, 20 nt, Human
gaaccacaucuugcucugcu

SEQ ID NO: 2561259 - RNA, 23 nt, Human
gaaccaaguggaccuugagacca

SEQ ID NO: 2561260 - RNA, 24 nt, Human
gaaccaaguggaccuugagaccac

SEQ ID NO: 2561261 - RNA, 13 nt, Human
gaacuccugaccu

SEQ ID NO: 2561262 - RNA, 16 nt, Human
gaacuccuaaaucaag

SEQ ID NO: 2561263 - RNA, 13 nt, Human
gaacuguuguaua

SEQ ID NO: 2561264 - RNA, 20 nt, Human
gaacuguguuucaaguucaa

SEQ ID NO: 2561265 - RNA, 13 nt, Human
gaaccaauauuug

SEQ ID NO: 2561266 - RNA, 17 nt, Human
gaacugugccuuugagu

SEQ ID NO: 2561267 - RNA, 16 nt, Human
gaacucccuuucaaca

SEQ ID NO: 2561268 - RNA, 15 nt, Human
gaacuccuaaaucaa

SEQ ID NO: 2561269 - RNA, 17 nt, Human
gaacuuggcgcugcccc

SEQ ID NO: 2561270 - RNA, 17 nt, Human
gaacuucucucagacuu

SEQ ID NO: 2561271 - RNA, 14 nt, Human
gaacuucuaauaua

SEQ ID NO: 2561272 - RNA, 14 nt, Human
gaacuuaaauaaug

SEQ ID NO: 2561273 - RNA, 14 nt, Human
gaacuguuguauaa

SEQ ID NO: 2561274 - RNA, 15 nt, Human
gaacuguuguauaaa

SEQ ID NO: 2561275 - RNA, 16 nt, Human
gaacuguuguauaaau

SEQ ID NO: 2561276 - RNA, 20 nt, Human
gaacuguuguauaaauuuau

SEQ ID NO: 2561277 - RNA, 17 nt, Human
gaacuuaaauaauguga

SEQ ID NO: 2561278 - RNA, 15 nt, Human
gaacuucuaauauau

SEQ ID NO: 2561279 - RNA, 13 nt, Human
gaacuucuaauau

SEQ ID NO: 2561280 - RNA, 23 nt, Human
gaacuucgcaucaaaagacaauu

SEQ ID NO: 2561281 - RNA, 13 nt, Human
gaacuuaaaauga

SEQ ID NO: 2561282 - RNA, 15 nt, Human
gaacuuaaauaaaug

SEQ ID NO: 2561283 - RNA, 18 nt, Human
gaacuuaaauaaauguca

SEQ ID NO: 2561284 - RNA, 22 nt, Human
gaacuuguaaaggaauuuaaaa

SEQ ID NO: 2561285 - RNA, 22 nt, Human
gaacuuggggaguuaagaccug

SEQ ID NO: 2561286 - RNA, 17 nt, Human
gaacuuggggaacaagg

SEQ ID NO: 2561287 - RNA, 18 nt, Human
gaacuuggcgcugccccu

SEQ ID NO: 2561288 - RNA, 17 nt, Human
gaacuugggccacugug

SEQ ID NO: 2561289 - RNA, 13 nt, Human
gaacuuucauuuu

SEQ ID NO: 2561290 - RNA, 12 nt, Human
gaacuuucauuu

SEQ ID NO: 2561291 - RNA, 15 nt, Human
gaacuuguuuucugg

SEQ ID NO: 2561292 - RNA, 17 nt, Human
gaacuuuccaggaaggc

SEQ ID NO: 2561293 - RNA, 23 nt, Human
gaacuuucauuuuuuuccaggcu

SEQ ID NO: 2561294 - RNA, 14 nt, Human
gaacuuucauuuuu

SEQ ID NO: 2561295 - RNA, 24 nt, Human
gaacuuuccacauucagagcuuac

SEQ ID NO: 2561296 - RNA, 22 nt, Human
gaagaaauuccuguagcaucuu

SEQ ID NO: 2561297 - RNA, 18 nt, Human
gaagaaauuccuguagca

SEQ ID NO: 2561298 - RNA, 18 nt, Human
gaagaacacccucuaaau

SEQ ID NO: 2561299 - RNA, 15 nt, Human
gaagaaauuccugua

SEQ ID NO: 2561300 - RNA, 14 nt, Human
gaagaaauuccugu

SEQ ID NO: 2561301 - RNA, 15 nt, Human
gaagaaaucacagaa

SEQ ID NO: 2561302 - RNA, 21 nt, Human
gaagaaaggguguuuuucugu

SEQ ID NO: 2561303 - RNA, 15 nt, Human
gaagaaaguggaaaa

SEQ ID NO: 2561304 - RNA, 22 nt, Human
gaagaaaucacagaaucauaug

SEQ ID NO: 2561305 - RNA, 18 nt, Human
gaagaaaucacagaauca

SEQ ID NO: 2561306 - RNA, 22 nt, Human
gaagaacaucuuuaugguaaag

SEQ ID NO: 2561307 - RNA, 13 nt, Human
gaagaacauagaa

SEQ ID NO: 2561308 - RNA, 16 nt, Human
gaagaacauccaagga

SEQ ID NO: 2561309 - RNA, 17 nt, Human
gaagaacauccaaggag

SEQ ID NO: 2561310 - RNA, 20 nt, Human
gaagaacauccaaggagaaa

SEQ ID NO: 2561311 - RNA, 14 nt, Human
gaagaagcucucuc

SEQ ID NO: 2561312 - RNA, 17 nt, Human
gaagaagcuuaggcagg

SEQ ID NO: 2561313 - RNA, 16 nt, Human
gaagaagcuuaggcag

SEQ ID NO: 2561314 - RNA, 18 nt, Human
gaagaagcuuaggcaggg

SEQ ID NO: 2561315 - RNA, 16 nt, Human
gaacuuugaccucugc

SEQ ID NO: 2561316 - RNA, 22 nt, Human
gaacuuugaccucugcagcaau

SEQ ID NO: 2561317 - RNA, 17 nt, Human
gaagaaaggguguuuuu

SEQ ID NO: 2561318 - RNA, 21 nt, Human
gaagaaaggccaucagagcaa

SEQ ID NO: 2561319 - RNA, 18 nt, Human
gaagaaaggccaucagag

SEQ ID NO: 2561320 - RNA, 17 nt, Human
gaagaaagagaaggagc

SEQ ID NO: 2561321 - RNA, 14 nt, Human
gaacuuugaaggac

SEQ ID NO: 2561322 - RNA, 21 nt, Human
gaacuuucucuucauacuuuu

SEQ ID NO: 2561323 - RNA, 23 nt, Human
gaacuuucucuucauacuuuuuu

SEQ ID NO: 2561324 - RNA, 12 nt, Human
gagacagcccgg

SEQ ID NO: 2561325 - RNA, 16 nt, Human
gagacagccaacuaug

SEQ ID NO: 2561326 - RNA, 14 nt, Human
gagacagagcuggu

SEQ ID NO: 2561327 - RNA, 19 nt, Human
gagacagaguuuucacucu

SEQ ID NO: 2561328 - RNA, 16 nt, Human
gagacacggagcccag

SEQ ID NO: 2561329 - RNA, 20 nt, Human
gagacaccugcaccuccccc

SEQ ID NO: 2561330 - RNA, 21 nt, Human
gagacaccugcaccucccccc

SEQ ID NO: 2561331 - RNA, 15 nt, Human
gagacacuggccccu

SEQ ID NO: 2561332 - RNA, 20 nt, Human
gagacacuaacgacuucagg

SEQ ID NO: 2561333 - RNA, 13 nt, Human
gagacaccugcac

SEQ ID NO: 2561334 - RNA, 15 nt, Human
gagacaccugcaccu

SEQ ID NO: 2561335 - RNA, 17 nt, Human
gagacaccugcaccucc

SEQ ID NO: 2561336 - RNA, 18 nt, Human
gagacaccugcaccuccc

SEQ ID NO: 2561337 - RNA, 19 nt, Human
gagacaccugcaccucccc

SEQ ID NO: 2561338 - RNA, 15 nt, Human
gagacagaagcaggc

SEQ ID NO: 2561339 - RNA, 12 nt, Human
gagacagaagca

SEQ ID NO: 2561340 - RNA, 17 nt, Human
gagacacuugccuucuu

SEQ ID NO: 2561341 - RNA, 17 nt, Human
gagacacuggccccuca

SEQ ID NO: 2561342 - RNA, 16 nt, Human
gagacagaagcaggcu

SEQ ID NO: 2561343 - RNA, 22 nt, Human
gagacagagaggacgugggcgg

SEQ ID NO: 2561344 - RNA, 14 nt, Human
gagaauugggggcu

SEQ ID NO: 2561345 - RNA, 18 nt, Human
gagaauugcuugaaccca

SEQ ID NO: 2561346 - RNA, 18 nt, Human
gagaauucuuacauguuu

SEQ ID NO: 2561347 - RNA, 22 nt, Human
gagaauucuuacauguuuucuu

SEQ ID NO: 2561348 - RNA, 21 nt, Human
gagaauuucuaccauuucaga

SEQ ID NO: 2561349 - RNA, 15 nt, Human
gagaauuuuaaauua

SEQ ID NO: 2561350 - RNA, 16 nt, Human
gagaauuuuaaauuau

SEQ ID NO: 2561351 - RNA, 17 nt, Human
gagaauugggauuacau

SEQ ID NO: 2561352 - RNA, 15 nt, Human
gagaauuguaucauu

SEQ ID NO: 2561353 - RNA, 21 nt, Human
gagaauuguaucauuugaaca

SEQ ID NO: 2561354 - RNA, 20 nt, Human
gagacaaacaccucccagga

SEQ ID NO: 2561355 - RNA, 22 nt, Human
gagacaaacaccucccaggaga

SEQ ID NO: 2561356 - RNA, 19 nt, Human
gagacaaacaccucccagg

SEQ ID NO: 2561357 - RNA, 17 nt, Human
gagacaagaaaucccug

SEQ ID NO: 2561358 - RNA, 16 nt, Human
gagacaaauggaggcc

SEQ ID NO: 2561359 - RNA, 17 nt, Human
gagacacaagccuucgg

SEQ ID NO: 2561360 - RNA, 15 nt, Human
gagacacaagccuuc

SEQ ID NO: 2561361 - RNA, 18 nt, Human
gagacacacugaagaagc

SEQ ID NO: 2561362 - RNA, 20 nt, Human
gagacacaacaacuccuagg

SEQ ID NO: 2561363 - RNA, 18 nt, Human
gagacaaaucuaugccac

SEQ ID NO: 2561364 - RNA, 16 nt, Human
gagaagcccgugugag

SEQ ID NO: 2561365 - RNA, 15 nt, Human
gagaagcccguguga

SEQ ID NO: 2561366 - RNA, 14 nt, Human
gagaagcccgugug

SEQ ID NO: 2561367 - RNA, 22 nt, Human
gagaagccccuuccccauggga

SEQ ID NO: 2561368 - RNA, 21 nt, Human
gagaagccccuuccccauggg

SEQ ID NO: 2561369 - RNA, 15 nt, Human
gagaagccccuuccc

SEQ ID NO: 2561370 - RNA, 20 nt, Human
gagaagccauugucuucgga

SEQ ID NO: 2561371 - RNA, 15 nt, Human
gagaagccauugucu

SEQ ID NO: 2561372 - RNA, 11 nt, Human
gagaagccauu

SEQ ID NO: 2561373 - RNA, 20 nt, Human
gagaagccagugcggcaggu

SEQ ID NO: 2561374 - RNA, 22 nt, Human
gagaagccaggaauuucccagg

SEQ ID NO: 2561375 - RNA, 23 nt, Human
gagaagccaggaauuucccagga

SEQ ID NO: 2561376 - RNA, 12 nt, Human
gagaagccagga

SEQ ID NO: 2561377 - RNA, 22 nt, Human
gagaagccagcuuuccucauca

SEQ ID NO: 2561378 - RNA, 21 nt, Human
gagaaugcacaaacagaggcc

SEQ ID NO: 2561379 - RNA, 20 nt, Human
gagaaugcacaaacagaggc

SEQ ID NO: 2561380 - RNA, 22 nt, Human
gagaaugcacaaacagaggccg

SEQ ID NO: 2561381 - RNA, 13 nt, Human
gagaaugagccuc

SEQ ID NO: 2561382 - RNA, 13 nt, Human
gagaaugaggguc

SEQ ID NO: 2561383 - RNA, 17 nt, Human
gagaaugagggccaaga

SEQ ID NO: 2561384 - RNA, 16 nt, Human
gagaauucuuacaugu

SEQ ID NO: 2561385 - RNA, 23 nt, Human
gagaaccgagcaaagaucaaaau

SEQ ID NO: 2561386 - RNA, 22 nt, Human
gagaaccgagcaaagaucaaaa

SEQ ID NO: 2561387 - RNA, 20 nt, Human
gagaaccgagcaaagaucaa

SEQ ID NO: 2561388 - RNA, 21 nt, Human
gagaacccugcguggggacag

SEQ ID NO: 2561389 - RNA, 20 nt, Human
gagaacccugcguggggaca

SEQ ID NO: 2561390 - RNA, 16 nt, Human
gagaagaacugaaauc

SEQ ID NO: 2561391 - RNA, 14 nt, Human
gagaagaacugaaa

SEQ ID NO: 2561392 - RNA, 13 nt, Human
gagaagaacugaa

SEQ ID NO: 2561393 - RNA, 15 nt, Human
gagaagagcuguuca

SEQ ID NO: 2561394 - RNA, 22 nt, Human
gagaagagcuguucacagccag

SEQ ID NO: 2561395 - RNA, 15 nt, Human
gagaagagggccugu

SEQ ID NO: 2561396 - RNA, 14 nt, Human
gagaagagggccug

SEQ ID NO: 2561397 - RNA, 21 nt, Human
gagaagaggcuggugcugugg

SEQ ID NO: 2561398 - RNA, 13 nt, Human
gagaagaggcugg

SEQ ID NO: 2561399 - RNA, 19 nt, Human
gagaagagggccuguggga

SEQ ID NO: 2561400 - RNA, 16 nt, Human
gagaagagggccugug

SEQ ID NO: 2561401 - RNA, 23 nt, Human
gagaagcaagaaagaaacccgac

SEQ ID NO: 2561402 - RNA, 23 nt, Human
gagaaaguacuucuccacccugc

SEQ ID NO: 2561403 - RNA, 18 nt, Human
gagaaagaagagacagga

SEQ ID NO: 2561404 - RNA, 13 nt, Human
gagaaagaagaga

SEQ ID NO: 2561405 - RNA, 19 nt, Human
gagaaagagcacuuaagag

SEQ ID NO: 2561406 - RNA, 18 nt, Human
gagaaagagcacuuaaga

SEQ ID NO: 2561407 - RNA, 18 nt, Human
gagaaagaaguaggcaug

SEQ ID NO: 2561408 - RNA, 20 nt, Human
gagaaauauggacacuuaau

SEQ ID NO: 2561409 - RNA, 23 nt, Human
gagaaauaaaguuugcuuagaaa

SEQ ID NO: 2561410 - RNA, 20 nt, Human
gagaaagugauuucuagaaa

SEQ ID NO: 2561411 - RNA, 16 nt, Human
gagaaagaggaagcuu

SEQ ID NO: 2561412 - RNA, 18 nt, Human
gagaaagugugagcaaac

SEQ ID NO: 2561413 - RNA, 17 nt, Human
gagaacaaacagaucga

SEQ ID NO: 2561414 - RNA, 14 nt, Human
gagaaauuuauaaa

SEQ ID NO: 2561415 - RNA, 22 nt, Human
gagaacacagccgauucaccug

SEQ ID NO: 2561416 - RNA, 17 nt, Human
gagaaccaaaucuggaa

SEQ ID NO: 2561417 - RNA, 13 nt, Human
gagaaccaaaucu

SEQ ID NO: 2561418 - RNA, 18 nt, Human
gagaaccaaaucuggaag

SEQ ID NO: 2561419 - RNA, 19 nt, Human
gagaaccacuacaugcagc

SEQ ID NO: 2561420 - RNA, 13 nt, Human
gagaaagacuauu

SEQ ID NO: 2561421 - RNA, 15 nt, Human
gagaaagacuauuca

SEQ ID NO: 2561422 - RNA, 17 nt, Human
gagaaagacuauucaaa

SEQ ID NO: 2561423 - RNA, 18 nt, Human
gagaaagacuauucaaac

SEQ ID NO: 2561424 - RNA, 17 nt, Human
gagaaacucuugagauc

SEQ ID NO: 2561425 - RNA, 23 nt, Human
gagaaaccuuauuguaccucucu

SEQ ID NO: 2561426 - RNA, 21 nt, Human
gagaaaccuuauuguaccucu

SEQ ID NO: 2561427 - RNA, 12 nt, Human
gagaaacccugu

SEQ ID NO: 2561428 - RNA, 19 nt, Human
gagaaacagagacaggccc

SEQ ID NO: 2561429 - RNA, 19 nt, Human
gacuuguauauuuuaagaa

SEQ ID NO: 2561430 - RNA, 13 nt, Human
gacucgguuucuc

SEQ ID NO: 2561431 - RNA, 13 nt, Human
gacuuggaagcuc

SEQ ID NO: 2561432 - RNA, 19 nt, Human
gacuuguauauuuguacaa

SEQ ID NO: 2561433 - RNA, 18 nt, Human
gacuugugucccaugauc

SEQ ID NO: 2561434 - RNA, 13 nt, Human
gacuuguguccca

SEQ ID NO: 2561435 - RNA, 13 nt, Human
gacuugugucucu

SEQ ID NO: 2561436 - RNA, 16 nt, Human
gacuugugucucugug

SEQ ID NO: 2561437 - RNA, 19 nt, Human
gagaaaauaaaaaguuaaa

SEQ ID NO: 2561438 - RNA, 18 nt, Human
gagaaaauccccauugaa

SEQ ID NO: 2561439 - RNA, 17 nt, Human
gagaaacaauaaagaga

SEQ ID NO: 2561440 - RNA, 13 nt, Human
gagaaacagagac

SEQ ID NO: 2561441 - RNA, 14 nt, Human
gagaaacagagaca

SEQ ID NO: 2561442 - RNA, 21 nt, Human
gagaaaauggacguguuauga

SEQ ID NO: 2561443 - RNA, 18 nt, Human
gagaaaauaaaaaguuaa

SEQ ID NO: 2561444 - RNA, 16 nt, Human
gacuuguuuuugcaca

SEQ ID NO: 2561445 - RNA, 15 nt, Human
gacuuguuuuugcac

SEQ ID NO: 2561446 - RNA, 18 nt, Human
gacuuguuuuaugcucag

SEQ ID NO: 2561447 - RNA, 16 nt, Human
gacuuggaagcuccgc

SEQ ID NO: 2561448 - RNA, 15 nt, Human
gacuuggaagcuccg

SEQ ID NO: 2561449 - RNA, 20 nt, Human
gacucgggcuccugugcccu

SEQ ID NO: 2561450 - RNA, 19 nt, Human
gacucgggcuccugugccc

SEQ ID NO: 2561451 - RNA, 14 nt, Human
gacucggggguggg

SEQ ID NO: 2561452 - RNA, 16 nt, Human
gacucgggggugggga

SEQ ID NO: 2561453 - RNA, 14 nt, Human
gacuuggaagcucc

SEQ ID NO: 2561454 - RNA, 18 nt, Human
gacucgcgacaaugcaaa

SEQ ID NO: 2561455 - RNA, 17 nt, Human
gacuccugcaggcagcc

SEQ ID NO: 2561456 - RNA, 19 nt, Human
gacucgcgacaaugcaaac

SEQ ID NO: 2561457 - RNA, 18 nt, Human
gacucgggcuccugugcc

SEQ ID NO: 2561458 - RNA, 17 nt, Human
gacucgggcuccugugc

SEQ ID NO: 2561459 - RNA, 16 nt, Human
gacucgggcuccugug

SEQ ID NO: 2561460 - RNA, 15 nt, Human
gacucgggcuccugu

SEQ ID NO: 2561461 - RNA, 14 nt, Human
gacuccggcccucc

SEQ ID NO: 2561462 - RNA, 23 nt, Human
gagacagcccgggcucugccucc

SEQ ID NO: 2561463 - RNA, 22 nt, Human
gagacagcccgggcucugccuc

SEQ ID NO: 2561464 - RNA, 21 nt, Human
gagacagcccgggcucugccu

SEQ ID NO: 2561465 - RNA, 20 nt, Human
gagacagcccgggcucugcc

SEQ ID NO: 2561466 - RNA, 19 nt, Human
gagacagcccgggcucugc

SEQ ID NO: 2561467 - RNA, 18 nt, Human
gagacagcccgggcucug

SEQ ID NO: 2561468 - RNA, 17 nt, Human
gagacagcccgggcucu

SEQ ID NO: 2561469 - RNA, 14 nt, Human
gagacagcccgggc

SEQ ID NO: 2561470 - RNA, 15 nt, Human
gagacagcucugcau

SEQ ID NO: 2561471 - RNA, 18 nt, Human
gagacagcucugcauacu

SEQ ID NO: 2561472 - RNA, 13 nt, Human
gagacagcucugc

SEQ ID NO: 2561473 - RNA, 24 nt, Human
gagacagcccgggcucugccuccc

SEQ ID NO: 2561474 - RNA, 22 nt, Human
gagacaguuucuuagcuuuuua

SEQ ID NO: 2561475 - RNA, 21 nt, Human
gagacaguuucuuagcuuuuu

SEQ ID NO: 2561476 - RNA, 19 nt, Human
gagacagccccagagcagg

SEQ ID NO: 2561477 - RNA, 18 nt, Human
gagacagccccagagcag

SEQ ID NO: 2561478 - RNA, 15 nt, Human
gagacagccccagag

SEQ ID NO: 2561479 - RNA, 14 nt, Human
gagacagccccaga

SEQ ID NO: 2561480 - RNA, 13 nt, Human
gagacagccccag

SEQ ID NO: 2561481 - RNA, 15 nt, Human
gagacauacuugaag

SEQ ID NO: 2561482 - RNA, 18 nt, Human
gagacauacuugaagggc

SEQ ID NO: 2561483 - RNA, 20 nt, Human
gagacauacuugaagggcca

SEQ ID NO: 2561484 - RNA, 21 nt, Human
gagacauacuugaagggccag

SEQ ID NO: 2561485 - RNA, 13 nt, Human
gagacaugugaca

SEQ ID NO: 2561486 - RNA, 19 nt, Human
gagacauuccugggcacag

SEQ ID NO: 2561487 - RNA, 14 nt, Human
gagaccaaccugac

SEQ ID NO: 2561488 - RNA, 15 nt, Human
gagaccaaccugacc

SEQ ID NO: 2561489 - RNA, 14 nt, Human
gagacaugugacau

SEQ ID NO: 2561490 - RNA, 18 nt, Human
gagacauuccugggcaca

SEQ ID NO: 2561491 - RNA, 20 nt, Human
gagacuuccaaaccugacag

SEQ ID NO: 2561492 - RNA, 14 nt, Human
gagacuugcucucu

SEQ ID NO: 2561493 - RNA, 13 nt, Human
gagacuuguauga

SEQ ID NO: 2561494 - RNA, 21 nt, Human
gagacuuagggcaccaggggu

SEQ ID NO: 2561495 - RNA, 18 nt, Human
gagacuuagggcaccagg

SEQ ID NO: 2561496 - RNA, 17 nt, Human
gagacuguuuugaauuu

SEQ ID NO: 2561497 - RNA, 12 nt, Human
gagacuggagca

SEQ ID NO: 2561498 - RNA, 23 nt, Human
gagacugcuucccauccuacccu

SEQ ID NO: 2561499 - RNA, 16 nt, Human
gagacuggagcaucug

SEQ ID NO: 2561500 - RNA, 23 nt, Human
gagacugucucaagagggcacug

SEQ ID NO: 2561501 - RNA, 23 nt, Human
gagaccaguugggagcacuggag

SEQ ID NO: 2561502 - RNA, 22 nt, Human
gagacugcgggaugguccuggg

SEQ ID NO: 2561503 - RNA, 23 nt, Human
gagacugcgggaugguccugggg

SEQ ID NO: 2561504 - RNA, 22 nt, Human
gagacugcuucccauccuaccc

SEQ ID NO: 2561505 - RNA, 20 nt, Human
gagacugcuucccauccuac

SEQ ID NO: 2561506 - RNA, 17 nt, Human
gagacugcuucccaucc

SEQ ID NO: 2561507 - RNA, 14 nt, Human
gagacugcuuccca

SEQ ID NO: 2561508 - RNA, 22 nt, Human
gagacugucucaagagggcacu

SEQ ID NO: 2561509 - RNA, 14 nt, Human
gagacucugucuca

SEQ ID NO: 2561510 - RNA, 15 nt, Human
gagacugcccagcua

SEQ ID NO: 2561511 - RNA, 19 nt, Human
gagacugcgggaugguccu

SEQ ID NO: 2561512 - RNA, 12 nt, Human
gagacucugugg

SEQ ID NO: 2561513 - RNA, 23 nt, Human
gagacucuguggggccuugguuc

SEQ ID NO: 2561514 - RNA, 20 nt, Human
gagacucgagaacuuucauu

SEQ ID NO: 2561515 - RNA, 17 nt, Human
gagacucgagaacuuuc

SEQ ID NO: 2561516 - RNA, 16 nt, Human
gagacucgagaacuuu

SEQ ID NO: 2561517 - RNA, 15 nt, Human
gagacucgagaacuu

SEQ ID NO: 2561518 - RNA, 17 nt, Human
gagacuccugcccuguu

SEQ ID NO: 2561519 - RNA, 14 nt, Human
gagacucgagaacu

SEQ ID NO: 2561520 - RNA, 22 nt, Human
gagacuccugcaggcagccagg

SEQ ID NO: 2561521 - RNA, 18 nt, Human
gagacucgcgacaaugca

SEQ ID NO: 2561522 - RNA, 16 nt, Human
gagacucgcgacaaug

SEQ ID NO: 2561523 - RNA, 18 nt, Human
gagaccaggcaaagcaag

SEQ ID NO: 2561524 - RNA, 17 nt, Human
gagaccaggagggcacu

SEQ ID NO: 2561525 - RNA, 14 nt, Human
gagaccaggcaaag

SEQ ID NO: 2561526 - RNA, 16 nt, Human
gagaccagggagccuu

SEQ ID NO: 2561527 - RNA, 22 nt, Human
gagaccaguugggagcacugga

SEQ ID NO: 2561528 - RNA, 21 nt, Human
gagaccaguugggagcacugg

SEQ ID NO: 2561529 - RNA, 20 nt, Human
gagaccaguugggagcacug

SEQ ID NO: 2561530 - RNA, 12 nt, Human
gagaccaucccu

SEQ ID NO: 2561531 - RNA, 16 nt, Human
gagaccaaccugacca

SEQ ID NO: 2561532 - RNA, 17 nt, Human
gagaccaaccugaccaa

SEQ ID NO: 2561533 - RNA, 22 nt, Human
gagaccaagacucugaaaucuc

SEQ ID NO: 2561534 - RNA, 23 nt, Human
gagaccaagacucugaaaucuca

SEQ ID NO: 2561535 - RNA, 13 nt, Human
gagaccagccugg

SEQ ID NO: 2561536 - RNA, 16 nt, Human
gagaccagccugggca

SEQ ID NO: 2561537 - RNA, 19 nt, Human
gagaccagccugggcagca

SEQ ID NO: 2561538 - RNA, 18 nt, Human
gagaccaaggcgggagca

SEQ ID NO: 2561539 - RNA, 14 nt, Human
gagaccagccuggc

SEQ ID NO: 2561540 - RNA, 23 nt, Human
gagagcccagagguaacagaaca

SEQ ID NO: 2561541 - RNA, 21 nt, Human
gagagcccagagguaacagaa

SEQ ID NO: 2561542 - RNA, 11 nt, Human
gagagcccagc

SEQ ID NO: 2561543 - RNA, 23 nt, Human
gagagccugcucccccacccccu

SEQ ID NO: 2561544 - RNA, 15 nt, Human
gagagccugcuggca

SEQ ID NO: 2561545 - RNA, 14 nt, Human
gagagccugcuggc

SEQ ID NO: 2561546 - RNA, 13 nt, Human
gagagccugcugg

SEQ ID NO: 2561547 - RNA, 12 nt, Human
gagagccugcug

SEQ ID NO: 2561548 - RNA, 13 nt, Human
gagagccugcugc

SEQ ID NO: 2561549 - RNA, 14 nt, Human
gagagccugcugca

SEQ ID NO: 2561550 - RNA, 19 nt, Human
gagagccagagaagugaca

SEQ ID NO: 2561551 - RNA, 15 nt, Human
gagagccagagaagu

SEQ ID NO: 2561552 - RNA, 16 nt, Human
gagagccagaaccugg

SEQ ID NO: 2561553 - RNA, 22 nt, Human
gagagccagagaagugacaggg

SEQ ID NO: 2561554 - RNA, 11 nt, Human
gagagccagcc

SEQ ID NO: 2561555 - RNA, 12 nt, Human
gagagccagccc

SEQ ID NO: 2561556 - RNA, 13 nt, Human
gagagccagcccu

SEQ ID NO: 2561557 - RNA, 14 nt, Human
gagagccauuuugu

SEQ ID NO: 2561558 - RNA, 14 nt, Human
gagagccagcccuc

SEQ ID NO: 2561559 - RNA, 20 nt, Human
gagagccagcccucccuguc

SEQ ID NO: 2561560 - RNA, 14 nt, Human
gagagcccagaggu

SEQ ID NO: 2561561 - RNA, 17 nt, Human
gagagccauuuugugaa

SEQ ID NO: 2561562 - RNA, 10 nt, Human
gagagcccag

SEQ ID NO: 2561563 - RNA, 16 nt, Human
gagagccaccaagagg

SEQ ID NO: 2561564 - RNA, 16 nt, Human
gagagaguugaaccua

SEQ ID NO: 2561565 - RNA, 23 nt, Human
gagagcaggcuggcagcucucca

SEQ ID NO: 2561566 - RNA, 17 nt, Human
gagagaggcagagagcg

SEQ ID NO: 2561567 - RNA, 16 nt, Human
gagagaggcagagagc

SEQ ID NO: 2561568 - RNA, 12 nt, Human
gagagaggggaa

SEQ ID NO: 2561569 - RNA, 11 nt, Human
gagagaaaaua

SEQ ID NO: 2561570 - RNA, 12 nt, Human
gagagaaaauaa

SEQ ID NO: 2561571 - RNA, 18 nt, Human
gagagaaaacagaccuaa

SEQ ID NO: 2561572 - RNA, 22 nt, Human
gagagaaaacagaccuaaugcu

SEQ ID NO: 2561573 - RNA, 13 nt, Human
gagagaaaacuua

SEQ ID NO: 2561574 - RNA, 23 nt, Human
gagagaaaacagaccuaaugcuc

SEQ ID NO: 2561575 - RNA, 17 nt, Human
gagagaagagaaugcac

SEQ ID NO: 2561576 - RNA, 14 nt, Human
gagagaaaaacaaa

SEQ ID NO: 2561577 - RNA, 22 nt, Human
gagacuuuuaaucagacaaagu

SEQ ID NO: 2561578 - RNA, 14 nt, Human
gagagaaaauaaaa

SEQ ID NO: 2561579 - RNA, 13 nt, Human
gagagaaaauaaa

SEQ ID NO: 2561580 - RNA, 20 nt, Human
gagagaaaacuuauuugagu

SEQ ID NO: 2561581 - RNA, 12 nt, Human
gagagaagggga

SEQ ID NO: 2561582 - RNA, 15 nt, Human
gagagaaggggagga

SEQ ID NO: 2561583 - RNA, 17 nt, Human
gagagaaggggaggagg

SEQ ID NO: 2561584 - RNA, 16 nt, Human
gagagaaggggaggag

SEQ ID NO: 2561585 - RNA, 13 nt, Human
gagagaagugccc

SEQ ID NO: 2561586 - RNA, 19 nt, Human
gagagacacacugaagaag

SEQ ID NO: 2561587 - RNA, 21 nt, Human
gagagaagugccccugcugcc

SEQ ID NO: 2561588 - RNA, 18 nt, Human
gagagaagugccccugcu

SEQ ID NO: 2561589 - RNA, 15 nt, Human
gagagaggcagagag

SEQ ID NO: 2561590 - RNA, 13 nt, Human
gagagaggacagc

SEQ ID NO: 2561591 - RNA, 13 nt, Human
gagagaggcagag

SEQ ID NO: 2561592 - RNA, 15 nt, Human
gagagugagguggaa

SEQ ID NO: 2561593 - RNA, 14 nt, Human
gagaguuuccugaa

SEQ ID NO: 2561594 - RNA, 19 nt, Human
gagagugaacaaauuuaca

SEQ ID NO: 2561595 - RNA, 17 nt, Human
gagauacagaauuuuau

SEQ ID NO: 2561596 - RNA, 15 nt, Human
gagagugaacaaauu

SEQ ID NO: 2561597 - RNA, 11 nt, Human
gagaguaacuu

SEQ ID NO: 2561598 - RNA, 14 nt, Human
gagagucugucuca

SEQ ID NO: 2561599 - RNA, 19 nt, Human
gagagguuauaggucacuc

SEQ ID NO: 2561600 - RNA, 16 nt, Human
gagagguuaaggugca

SEQ ID NO: 2561601 - RNA, 12 nt, Human
gagagguggagc

SEQ ID NO: 2561602 - RNA, 23 nt, Human
gagaggugggccagucuguggau

SEQ ID NO: 2561603 - RNA, 22 nt, Human
gagaggugggccagucugugga

SEQ ID NO: 2561604 - RNA, 14 nt, Human
gagaggugggccag

SEQ ID NO: 2561605 - RNA, 18 nt, Human
gagaggucaagcccagga

SEQ ID NO: 2561606 - RNA, 19 nt, Human
gagaggucaagcccaggag

SEQ ID NO: 2561607 - RNA, 24 nt, Human
gagaggucaagcccaggaggacug

SEQ ID NO: 2561608 - RNA, 21 nt, Human
gagaggugccagcaacugaau

SEQ ID NO: 2561609 - RNA, 14 nt, Human
gagaggugccagca

SEQ ID NO: 2561610 - RNA, 13 nt, Human
gagaggugccagc

SEQ ID NO: 2561611 - RNA, 17 nt, Human
gagaggucuuuuuuaaa

SEQ ID NO: 2561612 - RNA, 11 nt, Human
gagagggcuuu

SEQ ID NO: 2561613 - RNA, 21 nt, Human
gagagggugggagugggccca

SEQ ID NO: 2561614 - RNA, 18 nt, Human
gagaggggaacagacugg

SEQ ID NO: 2561615 - RNA, 13 nt, Human
gagaggggaacag

SEQ ID NO: 2561616 - RNA, 14 nt, Human
gagagccuuccagg

SEQ ID NO: 2561617 - RNA, 13 nt, Human
gagagccuuccag

SEQ ID NO: 2561618 - RNA, 13 nt, Human
gagagccuggugc

SEQ ID NO: 2561619 - RNA, 17 nt, Human
gagagccuggugcugcu

SEQ ID NO: 2561620 - RNA, 19 nt, Human
gagagggaggcaagcccug

SEQ ID NO: 2561621 - RNA, 19 nt, Human
gagagccuggugcugcugc

SEQ ID NO: 2561622 - RNA, 18 nt, Human
gagagggcaguguuuccu

SEQ ID NO: 2561623 - RNA, 16 nt, Human
gagagggcaggcauga

SEQ ID NO: 2561624 - RNA, 14 nt, Human
gagagggcagaggg

SEQ ID NO: 2561625 - RNA, 23 nt, Human
gagagggaggucacuggaaaggg

SEQ ID NO: 2561626 - RNA, 21 nt, Human
gagagggcaugcgcacaaggc

SEQ ID NO: 2561627 - RNA, 14 nt, Human
gaggaacaaggcaa

SEQ ID NO: 2561628 - RNA, 21 nt, Human
gaggaaauaagaaaaaucaug

SEQ ID NO: 2561629 - RNA, 13 nt, Human
gaggaaaggccag

SEQ ID NO: 2561630 - RNA, 14 nt, Human
gaggaaaggccagc

SEQ ID NO: 2561631 - RNA, 19 nt, Human
gaggaaaggccagcuggca

SEQ ID NO: 2561632 - RNA, 23 nt, Human
gaggaaacucaccugcuggcccc

SEQ ID NO: 2561633 - RNA, 14 nt, Human
gaggaaacucagag

SEQ ID NO: 2561634 - RNA, 20 nt, Human
gaggaaagucauuggcuuua

SEQ ID NO: 2561635 - RNA, 18 nt, Human
gaggaaagucauuggcuu

SEQ ID NO: 2561636 - RNA, 12 nt, Human
gaggaaagucau

SEQ ID NO: 2561637 - RNA, 19 nt, Human
gaggaaagguuugagaagc

SEQ ID NO: 2561638 - RNA, 23 nt, Human
gaggaaaggccagcuggcagcag

SEQ ID NO: 2561639 - RNA, 16 nt, Human
gaggaacaaggcaagg

SEQ ID NO: 2561640 - RNA, 14 nt, Human
gaggaaccagagcc

SEQ ID NO: 2561641 - RNA, 15 nt, Human
gaggaaccagagcca

SEQ ID NO: 2561642 - RNA, 18 nt, Human
gaggaaccagagccaugg

SEQ ID NO: 2561643 - RNA, 22 nt, Human
gaggaaccagagccauggacuc

SEQ ID NO: 2561644 - RNA, 17 nt, Human
gaggaagaagcuuaggc

SEQ ID NO: 2561645 - RNA, 23 nt, Human
gaggaacuucagacacaaaaguc

SEQ ID NO: 2561646 - RNA, 23 nt, Human
gaggaagaacggggcucuucuca

SEQ ID NO: 2561647 - RNA, 21 nt, Human
gaggaacuguccagagagcaa

SEQ ID NO: 2561648 - RNA, 19 nt, Human
gaggaacuguccagagagc

SEQ ID NO: 2561649 - RNA, 19 nt, Human
gaggaagaacggggcucuu

SEQ ID NO: 2561650 - RNA, 18 nt, Human
gaggaacuguccagagag

SEQ ID NO: 2561651 - RNA, 17 nt, Human
gaggaacuguccagaga

SEQ ID NO: 2561652 - RNA, 16 nt, Human
gaggaacuguccagag

SEQ ID NO: 2561653 - RNA, 15 nt, Human
gaggaacuguccaga

SEQ ID NO: 2561654 - RNA, 20 nt, Human
gaggaacuagccaccaacuc

SEQ ID NO: 2561655 - RNA, 18 nt, Human
gaggaagccgcuggggcc

SEQ ID NO: 2561656 - RNA, 17 nt, Human
gaggaagccgcuggggc

SEQ ID NO: 2561657 - RNA, 14 nt, Human
gaggaagccgcugg

SEQ ID NO: 2561658 - RNA, 21 nt, Human
gaggaagcagaauaaagcaau

SEQ ID NO: 2561659 - RNA, 20 nt, Human
gaggaagcagaauaaagcaa

SEQ ID NO: 2561660 - RNA, 19 nt, Human
gaggaagcagaauaaagca

SEQ ID NO: 2561661 - RNA, 17 nt, Human
gaggaagcagaauaaag

SEQ ID NO: 2561662 - RNA, 16 nt, Human
gaggaagcagaauaaa

SEQ ID NO: 2561663 - RNA, 15 nt, Human
gaggaagcagaauaa

SEQ ID NO: 2561664 - RNA, 14 nt, Human
gaggaagcagaaua

SEQ ID NO: 2561665 - RNA, 13 nt, Human
gaggaagcagaau

SEQ ID NO: 2561666 - RNA, 13 nt, Human
gaggaagccgcug

SEQ ID NO: 2561667 - RNA, 17 nt, Human
gaggaagagaaaaaaua

SEQ ID NO: 2561668 - RNA, 20 nt, Human
gaggaagaagcuuaggcagg

SEQ ID NO: 2561669 - RNA, 13 nt, Human
gaggaagagcagg

SEQ ID NO: 2561670 - RNA, 17 nt, Human
gaggaagagcaggcaca

SEQ ID NO: 2561671 - RNA, 19 nt, Human
gaggaagagcaggcacaug

SEQ ID NO: 2561672 - RNA, 12 nt, Human
gaggaagcagaa

SEQ ID NO: 2561673 - RNA, 21 nt, Human
gaggaagaugggggcaagaag

SEQ ID NO: 2561674 - RNA, 20 nt, Human
gagcuuugaaaauucagugg

SEQ ID NO: 2561675 - RNA, 21 nt, Human
gagcuuucuguccuuuuggca

SEQ ID NO: 2561676 - RNA, 23 nt, Human
gagcuuucuguccuuuuggcacu

SEQ ID NO: 2561677 - RNA, 22 nt, Human
gagcuuucugcuaucaaagagg

SEQ ID NO: 2561678 - RNA, 21 nt, Human
gagcuuuccauguugcugcca

SEQ ID NO: 2561679 - RNA, 19 nt, Human
gagcuuuccauguugcugc

SEQ ID NO: 2561680 - RNA, 18 nt, Human
gagcuuuccauguugcug

SEQ ID NO: 2561681 - RNA, 17 nt, Human
gagcuuuccauguugcu

SEQ ID NO: 2561682 - RNA, 20 nt, Human
gagcuugggggaugacuaga

SEQ ID NO: 2561683 - RNA, 22 nt, Human
gagcuuuauguaauaaugugaa

SEQ ID NO: 2561684 - RNA, 15 nt, Human
gagcuuucaaagaag

SEQ ID NO: 2561685 - RNA, 18 nt, Human
gagcuuucaaagaaggaa

SEQ ID NO: 2561686 - RNA, 22 nt, Human
gagcuugaaacccguggcgcuu

SEQ ID NO: 2561687 - RNA, 13 nt, Human
gagcuugggaaug

SEQ ID NO: 2561688 - RNA, 14 nt, Human
gagcuuggccagaa

SEQ ID NO: 2561689 - RNA, 15 nt, Human
gagcuuggccagaag

SEQ ID NO: 2561690 - RNA, 17 nt, Human
gagcuuugcugcuacag

SEQ ID NO: 2561691 - RNA, 14 nt, Human
gagcuuugcugcua

SEQ ID NO: 2561692 - RNA, 13 nt, Human
gagcuuugcugcu

SEQ ID NO: 2561693 - RNA, 12 nt, Human
gagcuuugcugc

SEQ ID NO: 2561694 - RNA, 21 nt, Human
gagcuuugcauguuccacuaa

SEQ ID NO: 2561695 - RNA, 19 nt, Human
gagcuuugcauguuccacu

SEQ ID NO: 2561696 - RNA, 15 nt, Human
gagcuuuucuaggcu

SEQ ID NO: 2561697 - RNA, 23 nt, Human
gaggaaaaccaagccguggcuuc

SEQ ID NO: 2561698 - RNA, 21 nt, Human
gaggaaaaccaagccguggcu

SEQ ID NO: 2561699 - RNA, 20 nt, Human
gaggaaaaccaagccguggc

SEQ ID NO: 2561700 - RNA, 18 nt, Human
gagcuuuuuucuuuaaga

SEQ ID NO: 2561701 - RNA, 22 nt, Human
gaggaaaaaaaucguccaggga

SEQ ID NO: 2561702 - RNA, 17 nt, Human
gaggaaagcaaaggaga

SEQ ID NO: 2561703 - RNA, 16 nt, Human
gaggaaagcaaaggag

SEQ ID NO: 2561704 - RNA, 16 nt, Human
gaggaaagaaugaaag

SEQ ID NO: 2561705 - RNA, 17 nt, Human
gaggaaacucaccugcu

SEQ ID NO: 2561706 - RNA, 20 nt, Human
gaggaaacucaccugcuggc

SEQ ID NO: 2561707 - RNA, 22 nt, Human
gaggaaacucaccugcuggccc

SEQ ID NO: 2561708 - RNA, 21 nt, Human
gaggaaaaguaaggugcaguu

SEQ ID NO: 2561709 - RNA, 22 nt, Human
gaggaaaaguaaccaucacugg

SEQ ID NO: 2561710 - RNA, 14 nt, Human
gaggaaacucaccu

SEQ ID NO: 2561711 - RNA, 18 nt, Human
gaggaaacaacagcuuua

SEQ ID NO: 2561712 - RNA, 17 nt, Human
gagcugacacaggauga

SEQ ID NO: 2561713 - RNA, 16 nt, Human
gagcugacacaggaug

SEQ ID NO: 2561714 - RNA, 10 nt, Human
gagcugagau

SEQ ID NO: 2561715 - RNA, 13 nt, Human
gagcugagaucgu

SEQ ID NO: 2561716 - RNA, 16 nt, Human
gagcugagcagggaga

SEQ ID NO: 2561717 - RNA, 13 nt, Human
gagcugagaugga

SEQ ID NO: 2561718 - RNA, 17 nt, Human
gagcugagccucucacc

SEQ ID NO: 2561719 - RNA, 13 nt, Human
gagcugagcaggg

SEQ ID NO: 2561720 - RNA, 23 nt, Human
gagcugacacaaaccugccuggg

SEQ ID NO: 2561721 - RNA, 22 nt, Human
gagcugacacaaaccugccugg

SEQ ID NO: 2561722 - RNA, 23 nt, Human
gagcugaacccauuuugagugac

SEQ ID NO: 2561723 - RNA, 18 nt, Human
gagcugacacaaaccugc

SEQ ID NO: 2561724 - RNA, 22 nt, Human
gagcugaacccauuuugaguga

SEQ ID NO: 2561725 - RNA, 19 nt, Human
gagcugaacccauuuugag

SEQ ID NO: 2561726 - RNA, 22 nt, Human
gagcugaaaaaucacauccugg

SEQ ID NO: 2561727 - RNA, 17 nt, Human
gagcugaaaugcugcau

SEQ ID NO: 2561728 - RNA, 21 nt, Human
gagcucuugugaggaaaguca

SEQ ID NO: 2561729 - RNA, 20 nt, Human
gagcugaaaaaucacauccu

SEQ ID NO: 2561730 - RNA, 20 nt, Human
gagcugauccagagcacaga

SEQ ID NO: 2561731 - RNA, 16 nt, Human
gagcugauccagagca

SEQ ID NO: 2561732 - RNA, 15 nt, Human
gagcugauccagagc

SEQ ID NO: 2561733 - RNA, 13 nt, Human
gagcugauccaga

SEQ ID NO: 2561734 - RNA, 15 nt, Human
gagcugaguggggga

SEQ ID NO: 2561735 - RNA, 23 nt, Human
gagcugaggggggccgugcccag

SEQ ID NO: 2561736 - RNA, 17 nt, Human
gagcugaggccacacuc

SEQ ID NO: 2561737 - RNA, 16 nt, Human
gagcugaggcagcagu

SEQ ID NO: 2561738 - RNA, 17 nt, Human
gagcugaggcaauucua

SEQ ID NO: 2561739 - RNA, 16 nt, Human
gagcucgugggacagu

SEQ ID NO: 2561740 - RNA, 21 nt, Human
gagcucguguauccuggggcu

SEQ ID NO: 2561741 - RNA, 20 nt, Human
gagcucguguauccuggggc

SEQ ID NO: 2561742 - RNA, 19 nt, Human
gagcucguguauccugggg

SEQ ID NO: 2561743 - RNA, 18 nt, Human
gagcucguguauccuggg

SEQ ID NO: 2561744 - RNA, 16 nt, Human
gagcucguguauccug

SEQ ID NO: 2561745 - RNA, 15 nt, Human
gagcucgguggaccc

SEQ ID NO: 2561746 - RNA, 23 nt, Human
gagcucguguauccuggggcucc

SEQ ID NO: 2561747 - RNA, 22 nt, Human
gagcucguguauccuggggcuc

SEQ ID NO: 2561748 - RNA, 14 nt, Human
gagcucuacccagg

SEQ ID NO: 2561749 - RNA, 15 nt, Human
gagcucuacccaggg

SEQ ID NO: 2561750 - RNA, 20 nt, Human
gagcucuacccagggccugc

SEQ ID NO: 2561751 - RNA, 21 nt, Human
gagcucuacccagggccugca

SEQ ID NO: 2561752 - RNA, 23 nt, Human
gagcucuacccagggccugcagg

SEQ ID NO: 2561753 - RNA, 17 nt, Human
gagcucuugugaggaaa

SEQ ID NO: 2561754 - RNA, 17 nt, Human
gagcucuucauguuuca

SEQ ID NO: 2561755 - RNA, 20 nt, Human
gagcuccagacccccagcaa

SEQ ID NO: 2561756 - RNA, 16 nt, Human
gagcucacucggcacc

SEQ ID NO: 2561757 - RNA, 19 nt, Human
gagcucacuguggugucug

SEQ ID NO: 2561758 - RNA, 20 nt, Human
gagcuauuuccauuccagaa

SEQ ID NO: 2561759 - RNA, 19 nt, Human
gagcuauuuccauuccaga

SEQ ID NO: 2561760 - RNA, 21 nt, Human
gagcuauuuccauuccagaau

SEQ ID NO: 2561761 - RNA, 18 nt, Human
gagcuauuuccauuccag

SEQ ID NO: 2561762 - RNA, 13 nt, Human
gagcuauuuccau

SEQ ID NO: 2561763 - RNA, 13 nt, Human
gagcuauugcugu

SEQ ID NO: 2561764 - RNA, 14 nt, Human
gagcuauguauuaa

SEQ ID NO: 2561765 - RNA, 22 nt, Human
gagcuccacucugcuucucuga

SEQ ID NO: 2561766 - RNA, 13 nt, Human
gagcuccagaccc

SEQ ID NO: 2561767 - RNA, 15 nt, Human
gagcuccagaccccc

SEQ ID NO: 2561768 - RNA, 17 nt, Human
gagcuccagacccccag

SEQ ID NO: 2561769 - RNA, 19 nt, Human
gagcuccagacccccagca

SEQ ID NO: 2561770 - RNA, 22 nt, Human
gagcuccagacccccagcaacc

SEQ ID NO: 2561771 - RNA, 21 nt, Human
gagcucagagagggcaggcau

SEQ ID NO: 2561772 - RNA, 20 nt, Human
gagcucagagagggcaggca

SEQ ID NO: 2561773 - RNA, 15 nt, Human
gagcucagaccccca

SEQ ID NO: 2561774 - RNA, 14 nt, Human
gagcucagaccccc

SEQ ID NO: 2561775 - RNA, 18 nt, Human
gagcucagacccccacuc

SEQ ID NO: 2561776 - RNA, 20 nt, Human
gagcucagacccccacucuc

SEQ ID NO: 2561777 - RNA, 18 nt, Human
gagcucagagagggcagg

SEQ ID NO: 2561778 - RNA, 21 nt, Human
gagcucagacccccacucuca

SEQ ID NO: 2561779 - RNA, 15 nt, Human
gagcuagaagcugga

SEQ ID NO: 2561780 - RNA, 21 nt, Human
gagcuagaaccuggagggcua

SEQ ID NO: 2561781 - RNA, 17 nt, Human
gagcuagaaccuggagg

SEQ ID NO: 2561782 - RNA, 19 nt, Human
gagcuagaaccuggagagc

SEQ ID NO: 2561783 - RNA, 17 nt, Human
gagcuagaaccuggaga

SEQ ID NO: 2561784 - RNA, 14 nt, Human
gagcuagaaccugg

SEQ ID NO: 2561785 - RNA, 22 nt, Human
gagcuagaaccuagaagggcua

SEQ ID NO: 2561786 - RNA, 15 nt, Human
gagccugccuggagc

SEQ ID NO: 2561787 - RNA, 14 nt, Human
gagccugccuggag

SEQ ID NO: 2561788 - RNA, 13 nt, Human
gagccugccugga

SEQ ID NO: 2561789 - RNA, 15 nt, Human
gagccugcaguuauu

SEQ ID NO: 2561790 - RNA, 18 nt, Human
gagccugcaggugcugcu

SEQ ID NO: 2561791 - RNA, 15 nt, Human
gagcuagcagcaggg

SEQ ID NO: 2561792 - RNA, 17 nt, Human
gagcuagcagcagggag

SEQ ID NO: 2561793 - RNA, 18 nt, Human
gagcuagcgcugccgcac

SEQ ID NO: 2561794 - RNA, 19 nt, Human
gagcuagcgcugccgcacc

SEQ ID NO: 2561795 - RNA, 23 nt, Human
gagcuagcgcugccgcaccccag

SEQ ID NO: 2561796 - RNA, 18 nt, Human
gagcuagaagcuggagga

SEQ ID NO: 2561797 - RNA, 14 nt, Human
gagcuagcgcugcc

SEQ ID NO: 2561798 - RNA, 19 nt, Human
gagccagauuucacucucc

SEQ ID NO: 2561799 - RNA, 18 nt, Human
gagccagauuucacucuc

SEQ ID NO: 2561800 - RNA, 15 nt, Human
gagccagauuucacu

SEQ ID NO: 2561801 - RNA, 20 nt, Human
gagccacugcaccgggccac

SEQ ID NO: 2561802 - RNA, 13 nt, Human
gagccacugcacc

SEQ ID NO: 2561803 - RNA, 16 nt, Human
gagcagccuguggcau

SEQ ID NO: 2561804 - RNA, 18 nt, Human
gagcagccuguggcaucu

SEQ ID NO: 2561805 - RNA, 11 nt, Human
gagcagccugu

SEQ ID NO: 2561806 - RNA, 13 nt, Human
gagcagccugugg

SEQ ID NO: 2561807 - RNA, 14 nt, Human
gagcagccuguggc

SEQ ID NO: 2561808 - RNA, 15 nt, Human
gagcagccuguggca

SEQ ID NO: 2561809 - RNA, 19 nt, Human
gagccacugcaccgggcca

SEQ ID NO: 2561810 - RNA, 18 nt, Human
gagccacugcaccgggcc

SEQ ID NO: 2561811 - RNA, 17 nt, Human
gagcccaccuuggcuca

SEQ ID NO: 2561812 - RNA, 15 nt, Human
gagcccaccuuggcu

SEQ ID NO: 2561813 - RNA, 13 nt, Human
gagcccaccuugg

SEQ ID NO: 2561814 - RNA, 12 nt, Human
gagccaggcaca

SEQ ID NO: 2561815 - RNA, 13 nt, Human
gagccaggcacac

SEQ ID NO: 2561816 - RNA, 12 nt, Human
gagccaggccug

SEQ ID NO: 2561817 - RNA, 21 nt, Human
gagccaggccugggucugugu

SEQ ID NO: 2561818 - RNA, 22 nt, Human
gagccaggccugggucuguguc

SEQ ID NO: 2561819 - RNA, 13 nt, Human
gagccagcucccu

SEQ ID NO: 2561820 - RNA, 18 nt, Human
gagccagcucccucuauu

SEQ ID NO: 2561821 - RNA, 13 nt, Human
gagccagauuuca

SEQ ID NO: 2561822 - RNA, 19 nt, Human
gagccagcccucccugucc

SEQ ID NO: 2561823 - RNA, 16 nt, Human
gagccagcccucccug

SEQ ID NO: 2561824 - RNA, 15 nt, Human
gagccagccugcucc

SEQ ID NO: 2561825 - RNA, 20 nt, Human
gagccagcccucccuguccu

SEQ ID NO: 2561826 - RNA, 21 nt, Human
gagccagcccucccuguccuc

SEQ ID NO: 2561827 - RNA, 19 nt, Human
gagauagccaaggccaaag

SEQ ID NO: 2561828 - RNA, 16 nt, Human
gagcagagaccauccc

SEQ ID NO: 2561829 - RNA, 18 nt, Human
gagcagagaccaucccug

SEQ ID NO: 2561830 - RNA, 17 nt, Human
gagcagagaccaucccu

SEQ ID NO: 2561831 - RNA, 21 nt, Human
gagauagccaaggccaaagga

SEQ ID NO: 2561832 - RNA, 20 nt, Human
gagauagccaaggccaaagg

SEQ ID NO: 2561833 - RNA, 15 nt, Human
gagauaaaucuagua

SEQ ID NO: 2561834 - RNA, 17 nt, Human
gagaguuuugucuugaa

SEQ ID NO: 2561835 - RNA, 22 nt, Human
gagaguuuugucuugaaugucu

SEQ ID NO: 2561836 - RNA, 14 nt, Human
gagaguuuuggaug

SEQ ID NO: 2561837 - RNA, 15 nt, Human
gagaguuuugucuug

SEQ ID NO: 2561838 - RNA, 18 nt, Human
gagagugcaacaguagca

SEQ ID NO: 2561839 - RNA, 21 nt, Human
gagauaauguuagagguuuua

SEQ ID NO: 2561840 - RNA, 15 nt, Human
gagauaauaugagaa

SEQ ID NO: 2561841 - RNA, 17 nt, Human
gagcagccucagaacaa

SEQ ID NO: 2561842 - RNA, 20 nt, Human
gagcagcccuggagucaugc

SEQ ID NO: 2561843 - RNA, 16 nt, Human
gagcagcccuggaguc

SEQ ID NO: 2561844 - RNA, 15 nt, Human
gagcagaggggcuga

SEQ ID NO: 2561845 - RNA, 22 nt, Human
gagcagccacauuccugaugcu

SEQ ID NO: 2561846 - RNA, 21 nt, Human
gagcagccacauuccugaugc

SEQ ID NO: 2561847 - RNA, 13 nt, Human
gagcagaggcagc

SEQ ID NO: 2561848 - RNA, 18 nt, Human
gagcagagcaagucugca

SEQ ID NO: 2561849 - RNA, 21 nt, Human
gagcagagaccaucccugaag

SEQ ID NO: 2561850 - RNA, 19 nt, Human
gagcagagaccaucccuga

SEQ ID NO: 2561851 - RNA, 23 nt, Human
gagcagagaccaucccugaaggc

SEQ ID NO: 2561852 - RNA, 12 nt, Human
gagauauauuuu

SEQ ID NO: 2561853 - RNA, 18 nt, Human
gagauaucugagggagga

SEQ ID NO: 2561854 - RNA, 15 nt, Human
gagauauauuuuuaa

SEQ ID NO: 2561855 - RNA, 19 nt, Human
gagccggggaguuucuuuc

SEQ ID NO: 2561856 - RNA, 18 nt, Human
gagccggggaguuucuuu

SEQ ID NO: 2561857 - RNA, 22 nt, Human
gagccggggaguuucuuuccug

SEQ ID NO: 2561858 - RNA, 20 nt, Human
gagccgggccuggggcuccu

SEQ ID NO: 2561859 - RNA, 14 nt, Human
gagccgggccuggg

SEQ ID NO: 2561860 - RNA, 13 nt, Human
gagccgggccugg

SEQ ID NO: 2561861 - RNA, 15 nt, Human
gagccgggccccugg

SEQ ID NO: 2561862 - RNA, 16 nt, Human
gagccgggccccuggg

SEQ ID NO: 2561863 - RNA, 22 nt, Human
gagccgggaaagaagagccgga

SEQ ID NO: 2561864 - RNA, 17 nt, Human
gagccgggucugccucu

SEQ ID NO: 2561865 - RNA, 20 nt, Human
gagccgggucugccucuucu

SEQ ID NO: 2561866 - RNA, 21 nt, Human
gagccgggucugccucuucug

SEQ ID NO: 2561867 - RNA, 22 nt, Human
gagccgggucugccucuucugg

SEQ ID NO: 2561868 - RNA, 20 nt, Human
gagccggguggaucgccuga

SEQ ID NO: 2561869 - RNA, 14 nt, Human
gagccgugaugccu

SEQ ID NO: 2561870 - RNA, 16 nt, Human
gagccggagccuccag

SEQ ID NO: 2561871 - RNA, 12 nt, Human
gagccggagccu

SEQ ID NO: 2561872 - RNA, 22 nt, Human
gagccggacuuucggaguuggg

SEQ ID NO: 2561873 - RNA, 20 nt, Human
gagccgcugugagccccugg

SEQ ID NO: 2561874 - RNA, 19 nt, Human
gagccgcugugagccccug

SEQ ID NO: 2561875 - RNA, 19 nt, Human
gagccgcuggcagaaggga

SEQ ID NO: 2561876 - RNA, 14 nt, Human
gagccgcuggcaga

SEQ ID NO: 2561877 - RNA, 20 nt, Human
gagccgagaucgcgccacug

SEQ ID NO: 2561878 - RNA, 22 nt, Human
gagcccuugccuccccauuucc

SEQ ID NO: 2561879 - RNA, 21 nt, Human
gagccgcaucuucuccaucug

SEQ ID NO: 2561880 - RNA, 22 nt, Human
gagccgcaucuucuccaucugg

SEQ ID NO: 2561881 - RNA, 22 nt, Human
gagccgagaucacgccacugca

SEQ ID NO: 2561882 - RNA, 21 nt, Human
gagccgagaucacgccacugc

SEQ ID NO: 2561883 - RNA, 16 nt, Human
gagcccacaaagccuu

SEQ ID NO: 2561884 - RNA, 14 nt, Human
gagcccaagggaau

SEQ ID NO: 2561885 - RNA, 19 nt, Human
gagcccacugcccaccccc

SEQ ID NO: 2561886 - RNA, 18 nt, Human
gagcccacgcccccacug

SEQ ID NO: 2561887 - RNA, 21 nt, Human
gagcccacuguacuugcucuu

SEQ ID NO: 2561888 - RNA, 18 nt, Human
gagcccacuguacuugcu

SEQ ID NO: 2561889 - RNA, 17 nt, Human
gagcccuugccucccca

SEQ ID NO: 2561890 - RNA, 16 nt, Human
gagcccuugccucccc

SEQ ID NO: 2561891 - RNA, 15 nt, Human
gagcccuugccuccc

SEQ ID NO: 2561892 - RNA, 23 nt, Human
gagcccacugcccacccccucaa

SEQ ID NO: 2561893 - RNA, 21 nt, Human
gagcccacugcccacccccuc

SEQ ID NO: 2561894 - RNA, 20 nt, Human
gagcccacugcccacccccu

SEQ ID NO: 2561895 - RNA, 11 nt, Human
gagcccacugu

SEQ ID NO: 2561896 - RNA, 20 nt, Human
gagccgagaucacgccacug

SEQ ID NO: 2561897 - RNA, 19 nt, Human
gagccgagaucacgccacu

SEQ ID NO: 2561898 - RNA, 12 nt, Human
gagccugaggga

SEQ ID NO: 2561899 - RNA, 15 nt, Human
gagccugagggaucu

SEQ ID NO: 2561900 - RNA, 10 nt, Human
gagccugagg

SEQ ID NO: 2561901 - RNA, 12 nt, Human
gagccugcaguu

SEQ ID NO: 2561902 - RNA, 22 nt, Human
gagccucugucacugcaggcac

SEQ ID NO: 2561903 - RNA, 21 nt, Human
gagccucugucacugcaggca

SEQ ID NO: 2561904 - RNA, 20 nt, Human
gagccucugucacugcaggc

SEQ ID NO: 2561905 - RNA, 18 nt, Human
gagccucugucacugcag

SEQ ID NO: 2561906 - RNA, 13 nt, Human
gagccucugucac

SEQ ID NO: 2561907 - RNA, 12 nt, Human
gagccucuguca

SEQ ID NO: 2561908 - RNA, 17 nt, Human
gagccucugcuccccag

SEQ ID NO: 2561909 - RNA, 19 nt, Human
gagccugaauuuuguugcu

SEQ ID NO: 2561910 - RNA, 24 nt, Human
gagccucugucacugcaggcacuc

SEQ ID NO: 2561911 - RNA, 17 nt, Human
gagccucauccgaggca

SEQ ID NO: 2561912 - RNA, 18 nt, Human
gagccucauccgaggcag

SEQ ID NO: 2561913 - RNA, 19 nt, Human
gagccucauccgaggcagg

SEQ ID NO: 2561914 - RNA, 20 nt, Human
gagccucauccgaggcaggg

SEQ ID NO: 2561915 - RNA, 20 nt, Human
gagccucccucaauuccccc

SEQ ID NO: 2561916 - RNA, 21 nt, Human
gagccucccucaauucccccu

SEQ ID NO: 2561917 - RNA, 13 nt, Human
gagccuccugccc

SEQ ID NO: 2561918 - RNA, 16 nt, Human
gagccucugcucccca

SEQ ID NO: 2561919 - RNA, 22 nt, Human
gagccuccucucucaaacuggg

SEQ ID NO: 2561920 - RNA, 15 nt, Human
gagccucagcauccu

SEQ ID NO: 2561921 - RNA, 14 nt, Human
gagccucagcaucc

SEQ ID NO: 2561922 - RNA, 19 nt, Human
gagccucagucucccuccc

SEQ ID NO: 2561923 - RNA, 18 nt, Human
gagccucagucucccucc

SEQ ID NO: 2561924 - RNA, 17 nt, Human
gagccucagcauccugg

SEQ ID NO: 2561925 - RNA, 15 nt, Human
gagccuacccacccc

SEQ ID NO: 2561926 - RNA, 17 nt, Human
gagccuacccaccccca

SEQ ID NO: 2561927 - RNA, 13 nt, Human
gagccgugguccu

SEQ ID NO: 2561928 - RNA, 17 nt, Human
gagccgugguccuuugg

SEQ ID NO: 2561929 - RNA, 13 nt, Human
gagccucagcauc

SEQ ID NO: 2561930 - RNA, 21 nt, Human
gacguacguaucagcggcccc

SEQ ID NO: 2561931 - RNA, 19 nt, Human
gacgguucaccagccucuc

SEQ ID NO: 2561932 - RNA, 17 nt, Human
gacgguucaccagccuc

SEQ ID NO: 2561933 - RNA, 18 nt, Human
gacgguucaccagccucu

SEQ ID NO: 2561934 - RNA, 16 nt, Human
gacggucccacacugg

SEQ ID NO: 2561935 - RNA, 21 nt, Human
gacgguauuaugcuucuugga

SEQ ID NO: 2561936 - RNA, 16 nt, Human
gacggugcagucuggg

SEQ ID NO: 2561937 - RNA, 23 nt, Human
gacgggugggcggcuggagacca

SEQ ID NO: 2561938 - RNA, 16 nt, Human
gacggugcccaagcca

SEQ ID NO: 2561939 - RNA, 23 nt, Human
gacggugcccaagccagaggcug

SEQ ID NO: 2561940 - RNA, 18 nt, Human
gacggugcccaagccaga

SEQ ID NO: 2561941 - RNA, 21 nt, Human
gacggugggcauuugugaggc

SEQ ID NO: 2561942 - RNA, 17 nt, Human
gacggugcuccaggcag

SEQ ID NO: 2561943 - RNA, 15 nt, Human
gacgguucaccagcc

SEQ ID NO: 2561944 - RNA, 20 nt, Human
gacguguuaugacuccagaa

SEQ ID NO: 2561945 - RNA, 17 nt, Human
gacguguuaugacucca

SEQ ID NO: 2561946 - RNA, 15 nt, Human
gacguaggggagggg

SEQ ID NO: 2561947 - RNA, 21 nt, Human
gacguagcugcaaaggacaga

SEQ ID NO: 2561948 - RNA, 23 nt, Human
gacguaugcuuauuuuaaaauuu

SEQ ID NO: 2561949 - RNA, 14 nt, Human
gacgucaagucucc

SEQ ID NO: 2561950 - RNA, 20 nt, Human
gacguacuccaacagaagaa

SEQ ID NO: 2561951 - RNA, 12 nt, Human
gacguagcugca

SEQ ID NO: 2561952 - RNA, 20 nt, Human
gacguaggaacgguaaauuu

SEQ ID NO: 2561953 - RNA, 18 nt, Human
gacgucaagucuccuucc

SEQ ID NO: 2561954 - RNA, 12 nt, Human
gacgucccucca

SEQ ID NO: 2561955 - RNA, 18 nt, Human
gacggagucccaccuugg

SEQ ID NO: 2561956 - RNA, 14 nt, Human
gacggagucccacc

SEQ ID NO: 2561957 - RNA, 18 nt, Human
gacgaggggugucuuggg

SEQ ID NO: 2561958 - RNA, 22 nt, Human
gacgaggcccucgggcccagcc

SEQ ID NO: 2561959 - RNA, 21 nt, Human
gacgaggcccucgggcccagc

SEQ ID NO: 2561960 - RNA, 17 nt, Human
gacgaggcccucgggcc

SEQ ID NO: 2561961 - RNA, 14 nt, Human
gacgaccuuuaccu

SEQ ID NO: 2561962 - RNA, 21 nt, Human
gacggagucccaccuuggcug

SEQ ID NO: 2561963 - RNA, 19 nt, Human
gacgcagcaggaggccagg

SEQ ID NO: 2561964 - RNA, 22 nt, Human
gacgcaugcccucaaucccagc

SEQ ID NO: 2561965 - RNA, 23 nt, Human
gacggggggccccagucagccuc

SEQ ID NO: 2561966 - RNA, 22 nt, Human
gacggggggccccagucagccu

SEQ ID NO: 2561967 - RNA, 19 nt, Human
gacgguauuaugcuucuug

SEQ ID NO: 2561968 - RNA, 17 nt, Human
gacgggguuucaccaug

SEQ ID NO: 2561969 - RNA, 16 nt, Human
gacggggacuggggau

SEQ ID NO: 2561970 - RNA, 17 nt, Human
gacggggggccccaguc

SEQ ID NO: 2561971 - RNA, 22 nt, Human
gacggcugggcacacgccuccc

SEQ ID NO: 2561972 - RNA, 18 nt, Human
gaccuuuccaccacagcc

SEQ ID NO: 2561973 - RNA, 17 nt, Human
gaccuuuccaccacagc

SEQ ID NO: 2561974 - RNA, 17 nt, Human
gaccuuucagcugugaa

SEQ ID NO: 2561975 - RNA, 20 nt, Human
gaccuuguuguuguuaaaua

SEQ ID NO: 2561976 - RNA, 13 nt, Human
gaccuuuccacca

SEQ ID NO: 2561977 - RNA, 23 nt, Human
gaccuuuccaccacagccagcac

SEQ ID NO: 2561978 - RNA, 21 nt, Human
gaccuuuccaccacagccagc

SEQ ID NO: 2561979 - RNA, 17 nt, Human
gaccuuuccugaggaag

SEQ ID NO: 2561980 - RNA, 21 nt, Human
gacgaacauccaaccuuccca

SEQ ID NO: 2561981 - RNA, 21 nt, Human
gaccuuugucaucuuucuucu

SEQ ID NO: 2561982 - RNA, 22 nt, Human
gaccuuuucaacuuggcuuccu

SEQ ID NO: 2561983 - RNA, 14 nt, Human
gacgaacuuccaug

SEQ ID NO: 2561984 - RNA, 21 nt, Human
gacgacaagugcugaacagug

SEQ ID NO: 2561985 - RNA, 21 nt, Human
gacgaacuuccauggcccuca

SEQ ID NO: 2561986 - RNA, 15 nt, Human
gaccuuguucacacu

SEQ ID NO: 2561987 - RNA, 13 nt, Human
gaccuugugaucu

SEQ ID NO: 2561988 - RNA, 17 nt, Human
gaccuuguuacuucuga

SEQ ID NO: 2561989 - RNA, 20 nt, Human
gaccuuguugcaugauguau

SEQ ID NO: 2561990 - RNA, 14 nt, Human
gaccuuguugcaug

SEQ ID NO: 2561991 - RNA, 21 nt, Human
gaccuuucaauaggaaaaacu

SEQ ID NO: 2561992 - RNA, 16 nt, Human
gaccuuguuacuucug

SEQ ID NO: 2561993 - RNA, 23 nt, Human
gaccuugcaacuucaugucaacu

SEQ ID NO: 2561994 - RNA, 16 nt, Human
gaccuugcaacuucau

SEQ ID NO: 2561995 - RNA, 19 nt, Human
gaccuugaaggguaaagaa

SEQ ID NO: 2561996 - RNA, 20 nt, Human
gaccugcggcugcugugugc

SEQ ID NO: 2561997 - RNA, 16 nt, Human
gaccugcggcugcugu

SEQ ID NO: 2561998 - RNA, 12 nt, Human
gaccugccugua

SEQ ID NO: 2561999 - RNA, 23 nt, Human
gaccugccuccugccugccccuc

SEQ ID NO: 2562000 - RNA, 18 nt, Human
gaccugccucuucccccu

SEQ ID NO: 2562001 - RNA, 19 nt, Human
gaccugccucggccuccca

SEQ ID NO: 2562002 - RNA, 17 nt, Human
gaccuggcaaggacaca

SEQ ID NO: 2562003 - RNA, 16 nt, Human
gaccuggcaaggacac

SEQ ID NO: 2562004 - RNA, 17 nt, Human
gaccuggauaacuuagg

SEQ ID NO: 2562005 - RNA, 15 nt, Human
gaccuggauaacuua

SEQ ID NO: 2562006 - RNA, 20 nt, Human
gaccuggagccccugggugg

SEQ ID NO: 2562007 - RNA, 18 nt, Human
gaccuggagccccugggu

SEQ ID NO: 2562008 - RNA, 17 nt, Human
gaccuggagccccuggg

SEQ ID NO: 2562009 - RNA, 16 nt, Human
gaccuggagccccugg

SEQ ID NO: 2562010 - RNA, 23 nt, Human
gaccuugaacuggguacuugugg

SEQ ID NO: 2562011 - RNA, 19 nt, Human
gaccugcugagggaccagc

SEQ ID NO: 2562012 - RNA, 20 nt, Human
gaccugcugagggaccagcc

SEQ ID NO: 2562013 - RNA, 21 nt, Human
gaccugcugagggaccagcca

SEQ ID NO: 2562014 - RNA, 15 nt, Human
gaccuggagccccug

SEQ ID NO: 2562015 - RNA, 14 nt, Human
gaccuggagccccu

SEQ ID NO: 2562016 - RNA, 13 nt, Human
gaccuggagcccc

SEQ ID NO: 2562017 - RNA, 12 nt, Human
gaccuggagccc

SEQ ID NO: 2562018 - RNA, 13 nt, Human
gacucauucugaa

SEQ ID NO: 2562019 - RNA, 16 nt, Human
gacucauucugaagga

SEQ ID NO: 2562020 - RNA, 20 nt, Human
gacucauucccuagaucuuu

SEQ ID NO: 2562021 - RNA, 17 nt, Human
gacucauucugaaggag

SEQ ID NO: 2562022 - RNA, 16 nt, Human
gacuccacccauccua

SEQ ID NO: 2562023 - RNA, 14 nt, Human
gacuccacccaucc

SEQ ID NO: 2562024 - RNA, 16 nt, Human
gacuccaggagaggag

SEQ ID NO: 2562025 - RNA, 12 nt, Human
gacuccaggaga

SEQ ID NO: 2562026 - RNA, 20 nt, Human
gacuccagccugccuggcag

SEQ ID NO: 2562027 - RNA, 16 nt, Human
gacuccagacucucug

SEQ ID NO: 2562028 - RNA, 15 nt, Human
gacucagguugucug

SEQ ID NO: 2562029 - RNA, 21 nt, Human
gacucagguuguaguaaagaa

SEQ ID NO: 2562030 - RNA, 23 nt, Human
gacucagguuguaguaaagaaau

SEQ ID NO: 2562031 - RNA, 15 nt, Human
gacucaguggggagg

SEQ ID NO: 2562032 - RNA, 21 nt, Human
gacucauauccccuauuuaac

SEQ ID NO: 2562033 - RNA, 12 nt, Human
gacucaguguuc

SEQ ID NO: 2562034 - RNA, 15 nt, Human
gacucaguuugucag

SEQ ID NO: 2562035 - RNA, 16 nt, Human
gacuccugcaggcagc

SEQ ID NO: 2562036 - RNA, 15 nt, Human
gacuccugcaggcag

SEQ ID NO: 2562037 - RNA, 14 nt, Human
gacuccugcaggca

SEQ ID NO: 2562038 - RNA, 20 nt, Human
gacucccuccucaccucugg

SEQ ID NO: 2562039 - RNA, 23 nt, Human
gacucccuccucaccucuggacu

SEQ ID NO: 2562040 - RNA, 15 nt, Human
gacuccgcuggaggu

SEQ ID NO: 2562041 - RNA, 22 nt, Human
gacucccuuaaaauagaaauaa

SEQ ID NO: 2562042 - RNA, 24 nt, Human
gacucccuccucaccucuggacug

SEQ ID NO: 2562043 - RNA, 16 nt, Human
gacuccccaggccagg

SEQ ID NO: 2562044 - RNA, 15 nt, Human
gacuccccaggccag

SEQ ID NO: 2562045 - RNA, 23 nt, Human
gacucccauuccugaagaaccag

SEQ ID NO: 2562046 - RNA, 18 nt, Human
gacuccccaggccaggcc

SEQ ID NO: 2562047 - RNA, 12 nt, Human
gacucccuccuc

SEQ ID NO: 2562048 - RNA, 13 nt, Human
gacucccuccuca

SEQ ID NO: 2562049 - RNA, 14 nt, Human
gacucccuccucac

SEQ ID NO: 2562050 - RNA, 16 nt, Human
gacucccuccucaccu

SEQ ID NO: 2562051 - RNA, 19 nt, Human
gacucccuccucaccucug

SEQ ID NO: 2562052 - RNA, 13 nt, Human
gacucccauuccu

SEQ ID NO: 2562053 - RNA, 22 nt, Human
gacucccauuccugaagaacca

SEQ ID NO: 2562054 - RNA, 20 nt, Human
gacuccaguggggcaagauu

SEQ ID NO: 2562055 - RNA, 23 nt, Human
gacuccaugagaagccgugggug

SEQ ID NO: 2562056 - RNA, 21 nt, Human
gacuagaauucuagugcugcu

SEQ ID NO: 2562057 - RNA, 19 nt, Human
gacuagaauucuagugcug

SEQ ID NO: 2562058 - RNA, 22 nt, Human
gacuagaauucuagugcugcug

SEQ ID NO: 2562059 - RNA, 18 nt, Human
gacuagaauucuagugcu

SEQ ID NO: 2562060 - RNA, 16 nt, Human
gacuagaauucuagug

SEQ ID NO: 2562061 - RNA, 23 nt, Human
gacuagaagggccaguccugccu

SEQ ID NO: 2562062 - RNA, 17 nt, Human
gacucaggauccagucc

SEQ ID NO: 2562063 - RNA, 12 nt, Human
gacucagggcag

SEQ ID NO: 2562064 - RNA, 13 nt, Human
gacucagggcagc

SEQ ID NO: 2562065 - RNA, 16 nt, Human
gacucagggcagcgcc

SEQ ID NO: 2562066 - RNA, 15 nt, Human
gacucaggaugccca

SEQ ID NO: 2562067 - RNA, 16 nt, Human
gacucaggaugcccag

SEQ ID NO: 2562068 - RNA, 17 nt, Human
gacucaggaugcccagg

SEQ ID NO: 2562069 - RNA, 18 nt, Human
gacucaggaugcccaggg

SEQ ID NO: 2562070 - RNA, 19 nt, Human
gacucaggaugcccagggc

SEQ ID NO: 2562071 - RNA, 23 nt, Human
gacucaggaugcccagggccacu

SEQ ID NO: 2562072 - RNA, 17 nt, Human
gacucagggcagcgcca

SEQ ID NO: 2562073 - RNA, 18 nt, Human
gacucagggcagcgccag

SEQ ID NO: 2562074 - RNA, 20 nt, Human
gacucagggccaugccugcc

SEQ ID NO: 2562075 - RNA, 19 nt, Human
gacucagggccaugccugc

SEQ ID NO: 2562076 - RNA, 23 nt, Human
gacucagggcagcgccaggcuga

SEQ ID NO: 2562077 - RNA, 22 nt, Human
gacucagggccaugccugcccc

SEQ ID NO: 2562078 - RNA, 21 nt, Human
gacucagggccaugccugccc

SEQ ID NO: 2562079 - RNA, 14 nt, Human
gacucagggcccca

SEQ ID NO: 2562080 - RNA, 15 nt, Human
gacucagggccccag

SEQ ID NO: 2562081 - RNA, 17 nt, Human
gacucagggccccagca

SEQ ID NO: 2562082 - RNA, 14 nt, Human
gacucagggcuccu

SEQ ID NO: 2562083 - RNA, 16 nt, Human
gacucagggcuccugg

SEQ ID NO: 2562084 - RNA, 17 nt, Human
gacucagggcuccuggg

SEQ ID NO: 2562085 - RNA, 19 nt, Human
gacucagggcuccuggguu

SEQ ID NO: 2562086 - RNA, 12 nt, Human
gacucagggcuc

SEQ ID NO: 2562087 - RNA, 13 nt, Human
gacucagggcucc

SEQ ID NO: 2562088 - RNA, 18 nt, Human
gacucagggccccagcac

SEQ ID NO: 2562089 - RNA, 20 nt, Human
gacucagggccccagcacua

SEQ ID NO: 2562090 - RNA, 23 nt, Human
gacuacugggcaaagaguguaga

SEQ ID NO: 2562091 - RNA, 15 nt, Human
gacuagaaccuggag

SEQ ID NO: 2562092 - RNA, 20 nt, Human
gacuagaaccuggagggcug

SEQ ID NO: 2562093 - RNA, 16 nt, Human
gacuagaaccuggagg

SEQ ID NO: 2562094 - RNA, 15 nt, Human
gacuagaagggccag

SEQ ID NO: 2562095 - RNA, 12 nt, Human
gacuacaggcac

SEQ ID NO: 2562096 - RNA, 17 nt, Human
gacuacucccccaggug

SEQ ID NO: 2562097 - RNA, 22 nt, Human
gacguguuaugacuccagaauu

SEQ ID NO: 2562098 - RNA, 12 nt, Human
gacguuccagcc

SEQ ID NO: 2562099 - RNA, 14 nt, Human
gacguguuuguguu

SEQ ID NO: 2562100 - RNA, 21 nt, Human
gacuaauuccugcccugccca

SEQ ID NO: 2562101 - RNA, 13 nt, Human
gacuaauuguaua

SEQ ID NO: 2562102 - RNA, 15 nt, Human
gacuacaccuacgga

SEQ ID NO: 2562103 - RNA, 18 nt, Human
gacuaauuuaaaaaauaa

SEQ ID NO: 2562104 - RNA, 13 nt, Human
gacuaauuucaaa

SEQ ID NO: 2562105 - RNA, 22 nt, Human
gacuaauuucaaaaugcuuuuu

SEQ ID NO: 2562106 - RNA, 22 nt, Human
gacuaauuguauaacagguuau

SEQ ID NO: 2562107 - RNA, 21 nt, Human
gacuaauuguauaacagguua

SEQ ID NO: 2562108 - RNA, 12 nt, Human
gacuaauuucaa

SEQ ID NO: 2562109 - RNA, 20 nt, Human
gacuaauuguauaacagguu

SEQ ID NO: 2562110 - RNA, 19 nt, Human
gacuaauuguauaacaggu

SEQ ID NO: 2562111 - RNA, 15 nt, Human
gacuaauuguauaac

SEQ ID NO: 2562112 - RNA, 22 nt, Human
gaccccagcugugagccuuggc

SEQ ID NO: 2562113 - RNA, 18 nt, Human
gaccccagcugugagccu

SEQ ID NO: 2562114 - RNA, 21 nt, Human
gaccccagcugggaggcaaga

SEQ ID NO: 2562115 - RNA, 21 nt, Human
gaccccagcugugagccuugg

SEQ ID NO: 2562116 - RNA, 16 nt, Human
gaccccagcugggagg

SEQ ID NO: 2562117 - RNA, 15 nt, Human
gaccccagcugggag

SEQ ID NO: 2562118 - RNA, 14 nt, Human
gaccccagcuggga

SEQ ID NO: 2562119 - RNA, 13 nt, Human
gaccccagcuggg

SEQ ID NO: 2562120 - RNA, 12 nt, Human
gaccccagcugg

SEQ ID NO: 2562121 - RNA, 17 nt, Human
gaccccaucugcccagg

SEQ ID NO: 2562122 - RNA, 16 nt, Human
gaccccaucugcccag

SEQ ID NO: 2562123 - RNA, 15 nt, Human
gaccccaucugccca

SEQ ID NO: 2562124 - RNA, 16 nt, Human
gaccccaucugugaau

SEQ ID NO: 2562125 - RNA, 19 nt, Human
gaccccaucugugaauaag

SEQ ID NO: 2562126 - RNA, 20 nt, Human
gaccccgagccuggcuccaa

SEQ ID NO: 2562127 - RNA, 22 nt, Human
gaccccucauagcccucacccu

SEQ ID NO: 2562128 - RNA, 18 nt, Human
gaccccaucugcccagga

SEQ ID NO: 2562129 - RNA, 12 nt, Human
gaccccucaccu

SEQ ID NO: 2562130 - RNA, 18 nt, Human
gacccugaggcccagagg

SEQ ID NO: 2562131 - RNA, 23 nt, Human
gaccccucauagcccucacccug

SEQ ID NO: 2562132 - RNA, 13 nt, Human
gaccccuccaugu

SEQ ID NO: 2562133 - RNA, 21 nt, Human
gacccugaggcccagagggcc

SEQ ID NO: 2562134 - RNA, 12 nt, Human
gacccugcccug

SEQ ID NO: 2562135 - RNA, 20 nt, Human
gacccugaggcccagagggc

SEQ ID NO: 2562136 - RNA, 19 nt, Human
gacccugaggcccagaggg

SEQ ID NO: 2562137 - RNA, 15 nt, Human
gacccugcccugugg

SEQ ID NO: 2562138 - RNA, 13 nt, Human
gacccugcccugu

SEQ ID NO: 2562139 - RNA, 16 nt, Human
gacccugcccuguggg

SEQ ID NO: 2562140 - RNA, 23 nt, Human
gacccugucucaaaaaaagaaaa

SEQ ID NO: 2562141 - RNA, 22 nt, Human
gacccaggccgcagcucuugcc

SEQ ID NO: 2562142 - RNA, 17 nt, Human
gacccaggccgcagcuc

SEQ ID NO: 2562143 - RNA, 15 nt, Human
gacccaggccgcagc

SEQ ID NO: 2562144 - RNA, 13 nt, Human
gacccaggccgca

SEQ ID NO: 2562145 - RNA, 11 nt, Human
gacccaggccg

SEQ ID NO: 2562146 - RNA, 16 nt, Human
gacccaggcaccugca

SEQ ID NO: 2562147 - RNA, 11 nt, Human
gacccaggcac

SEQ ID NO: 2562148 - RNA, 15 nt, Human
gacccagucccuggg

SEQ ID NO: 2562149 - RNA, 15 nt, Human
gacccaggcugggca

SEQ ID NO: 2562150 - RNA, 14 nt, Human
gacccaggcugggc

SEQ ID NO: 2562151 - RNA, 19 nt, Human
gacccaggccgcagcucuu

SEQ ID NO: 2562152 - RNA, 13 nt, Human
gacccaggcuggg

SEQ ID NO: 2562153 - RNA, 15 nt, Human
gacccaugcugcccu

SEQ ID NO: 2562154 - RNA, 14 nt, Human
gacccaugcugccc

SEQ ID NO: 2562155 - RNA, 16 nt, Human
gacccaugcugcccug

SEQ ID NO: 2562156 - RNA, 14 nt, Human
gacccagucccugg

SEQ ID NO: 2562157 - RNA, 19 nt, Human
gaccccagcggcugaguca

SEQ ID NO: 2562158 - RNA, 18 nt, Human
gaccccagcggcugaguc

SEQ ID NO: 2562159 - RNA, 12 nt, Human
gacccacugcuu

SEQ ID NO: 2562160 - RNA, 18 nt, Human
gacccaccccugugcucc

SEQ ID NO: 2562161 - RNA, 17 nt, Human
gacccaccccugugcuc

SEQ ID NO: 2562162 - RNA, 16 nt, Human
gacccaccccugugcu

SEQ ID NO: 2562163 - RNA, 15 nt, Human
gacccaccccugugc

SEQ ID NO: 2562164 - RNA, 17 nt, Human
gacccagcccucauccc

SEQ ID NO: 2562165 - RNA, 22 nt, Human
gacccaccugguggccucugcc

SEQ ID NO: 2562166 - RNA, 11 nt, Human
gacccacugcu

SEQ ID NO: 2562167 - RNA, 14 nt, Human
gacccaccccugug

SEQ ID NO: 2562168 - RNA, 12 nt, Human
gacccaccccug

SEQ ID NO: 2562169 - RNA, 18 nt, Human
gaccaagagagaaagaag

SEQ ID NO: 2562170 - RNA, 14 nt, Human
gaccaacugucacu

SEQ ID NO: 2562171 - RNA, 19 nt, Human
gaccaacugggcccaagac

SEQ ID NO: 2562172 - RNA, 14 nt, Human
gaccaagagagaaa

SEQ ID NO: 2562173 - RNA, 12 nt, Human
gaccaagcagga

SEQ ID NO: 2562174 - RNA, 15 nt, Human
gaccaagagagaaag

SEQ ID NO: 2562175 - RNA, 16 nt, Human
gaccaagagagaaaga

SEQ ID NO: 2562176 - RNA, 17 nt, Human
gaccaacccuguuuccu

SEQ ID NO: 2562177 - RNA, 16 nt, Human
gaccaacccuguuucc

SEQ ID NO: 2562178 - RNA, 21 nt, Human
gaccaacauggagaaacccug

SEQ ID NO: 2562179 - RNA, 22 nt, Human
gaccaacauggagaaacccugu

SEQ ID NO: 2562180 - RNA, 18 nt, Human
gaccaacccuguuuccug

SEQ ID NO: 2562181 - RNA, 13 nt, Human
gaccaaccugacc

SEQ ID NO: 2562182 - RNA, 14 nt, Human
gaccaaccugacca

SEQ ID NO: 2562183 - RNA, 20 nt, Human
gaccaacuagacauucuguc

SEQ ID NO: 2562184 - RNA, 19 nt, Human
gaccaacuagacauucugu

SEQ ID NO: 2562185 - RNA, 18 nt, Human
gaccaacuagacauucug

SEQ ID NO: 2562186 - RNA, 17 nt, Human
gaccaacuagacauucu

SEQ ID NO: 2562187 - RNA, 13 nt, Human
gaccaacugggcc

SEQ ID NO: 2562188 - RNA, 14 nt, Human
gaccaacugggccc

SEQ ID NO: 2562189 - RNA, 17 nt, Human
gaccucagaguccaggc

SEQ ID NO: 2562190 - RNA, 18 nt, Human
gaccucagaguccaggcc

SEQ ID NO: 2562191 - RNA, 19 nt, Human
gaccucagaguccaggccc

SEQ ID NO: 2562192 - RNA, 10 nt, Human
gaccucagcc

SEQ ID NO: 2562193 - RNA, 21 nt, Human
gaccucagaguccaggcccca

SEQ ID NO: 2562194 - RNA, 11 nt, Human
gaccucagcca

SEQ ID NO: 2562195 - RNA, 11 nt, Human
gaccucagccu

SEQ ID NO: 2562196 - RNA, 12 nt, Human
gaccucagccug

SEQ ID NO: 2562197 - RNA, 13 nt, Human
gaccucagccugu

SEQ ID NO: 2562198 - RNA, 14 nt, Human
gaccucagccugug

SEQ ID NO: 2562199 - RNA, 16 nt, Human
gaccucagccugugcu

SEQ ID NO: 2562200 - RNA, 19 nt, Human
gaccucagccugugcugcc

SEQ ID NO: 2562201 - RNA, 13 nt, Human
gaccucagccuuc

SEQ ID NO: 2562202 - RNA, 14 nt, Human
gaccucagccuucc

SEQ ID NO: 2562203 - RNA, 16 nt, Human
gaccucagcugcuucu

SEQ ID NO: 2562204 - RNA, 14 nt, Human
gaccucagcugcuu

SEQ ID NO: 2562205 - RNA, 20 nt, Human
gaccucagccuuccccuugc

SEQ ID NO: 2562206 - RNA, 20 nt, Human
gaccuaaaauuugcccuccc

SEQ ID NO: 2562207 - RNA, 19 nt, Human
gaccuaaaauuugcccucc

SEQ ID NO: 2562208 - RNA, 16 nt, Human
gaccuaaauggccuca

SEQ ID NO: 2562209 - RNA, 20 nt, Human
gaccgugggcggggccuugc

SEQ ID NO: 2562210 - RNA, 18 nt, Human
gaccgugggcggggccuu

SEQ ID NO: 2562211 - RNA, 21 nt, Human
gaccgugggcggggccuugcg

SEQ ID NO: 2562212 - RNA, 20 nt, Human
gaccuaaauggccucaugug

SEQ ID NO: 2562213 - RNA, 22 nt, Human
gaccuaaaauuugcccucccau

SEQ ID NO: 2562214 - RNA, 14 nt, Human
gaccuaaugcuccu

SEQ ID NO: 2562215 - RNA, 15 nt, Human
gaccuaaugcuccuu

SEQ ID NO: 2562216 - RNA, 13 nt, Human
gaccuacaaauca

SEQ ID NO: 2562217 - RNA, 22 nt, Human
gaccuaaugcuccuuguuccua

SEQ ID NO: 2562218 - RNA, 14 nt, Human
gaccuaccucaggu

SEQ ID NO: 2562219 - RNA, 13 nt, Human
gaccuaccucagg

SEQ ID NO: 2562220 - RNA, 12 nt, Human
gaccuaccucag

SEQ ID NO: 2562221 - RNA, 15 nt, Human
gaccuaccucagguu

SEQ ID NO: 2562222 - RNA, 14 nt, Human
gaccgugaggccag

SEQ ID NO: 2562223 - RNA, 13 nt, Human
gaccguccucacc

SEQ ID NO: 2562224 - RNA, 19 nt, Human
gaccgugaggccagagaca

SEQ ID NO: 2562225 - RNA, 15 nt, Human
gaccgugaggccaga

SEQ ID NO: 2562226 - RNA, 15 nt, Human
gaccggcggcucgga

SEQ ID NO: 2562227 - RNA, 15 nt, Human
gaccgguacagaaag

SEQ ID NO: 2562228 - RNA, 20 nt, Human
gacccuuacagccucugacu

SEQ ID NO: 2562229 - RNA, 21 nt, Human
gacccuguugcuaagccccag

SEQ ID NO: 2562230 - RNA, 17 nt, Human
gacccuugacaccugcu

SEQ ID NO: 2562231 - RNA, 21 nt, Human
gacccuuauuacacggaaaac

SEQ ID NO: 2562232 - RNA, 17 nt, Human
gacccuuacagccucug

SEQ ID NO: 2562233 - RNA, 19 nt, Human
gacccuucccuugagcccu

SEQ ID NO: 2562234 - RNA, 13 nt, Human
gaccccucaccuu

SEQ ID NO: 2562235 - RNA, 14 nt, Human
gaccccucaccuug

SEQ ID NO: 2562236 - RNA, 12 nt, Human
gacccugucucu

SEQ ID NO: 2562237 - RNA, 20 nt, Human
gacccugugacauggugccu

SEQ ID NO: 2562238 - RNA, 22 nt, Human
gaccccucaccuugcaacacac

SEQ ID NO: 2562239 - RNA, 16 nt, Human
gacccuguugcuaagc

SEQ ID NO: 2562240 - RNA, 15 nt, Human
gacccuguugcuaag

SEQ ID NO: 2562241 - RNA, 22 nt, Human
gacccugugacauggugccuga

SEQ ID NO: 2562242 - RNA, 21 nt, Human
gacccugugacauggugccug

SEQ ID NO: 2562243 - RNA, 14 nt, Human
gacccuguggaagc

SEQ ID NO: 2562244 - RNA, 15 nt, Human
gaccugaggcccuuc

SEQ ID NO: 2562245 - RNA, 13 nt, Human
gaccucaggccug

SEQ ID NO: 2562246 - RNA, 12 nt, Human
gaccucaggccu

SEQ ID NO: 2562247 - RNA, 11 nt, Human
gaccucaggcc

SEQ ID NO: 2562248 - RNA, 17 nt, Human
gaccugaggcugugguc

SEQ ID NO: 2562249 - RNA, 15 nt, Human
gaccugaggcugugg

SEQ ID NO: 2562250 - RNA, 14 nt, Human
gaccugaggcugug

SEQ ID NO: 2562251 - RNA, 13 nt, Human
gaccugaggcugu

SEQ ID NO: 2562252 - RNA, 18 nt, Human
gaccugaggcuccugugc

SEQ ID NO: 2562253 - RNA, 14 nt, Human
gaccugaggcuccu

SEQ ID NO: 2562254 - RNA, 21 nt, Human
gaccucaggcacuagccuuug

SEQ ID NO: 2562255 - RNA, 19 nt, Human
gaccucaggcacuagccuu

SEQ ID NO: 2562256 - RNA, 18 nt, Human
gaccucaggcacuagccu

SEQ ID NO: 2562257 - RNA, 17 nt, Human
gaccucagcugcuucuc

SEQ ID NO: 2562258 - RNA, 17 nt, Human
gaccucaggcacuagcc

SEQ ID NO: 2562259 - RNA, 21 nt, Human
gaccugaggcccuucucucca

SEQ ID NO: 2562260 - RNA, 18 nt, Human
gaccugaggcccuucucu

SEQ ID NO: 2562261 - RNA, 23 nt, Human
gaccugauuucugagcauuuaau

SEQ ID NO: 2562262 - RNA, 14 nt, Human
gaccugauccugga

SEQ ID NO: 2562263 - RNA, 15 nt, Human
gaccugauccuggag

SEQ ID NO: 2562264 - RNA, 18 nt, Human
gaccugauccuggaggcc

SEQ ID NO: 2562265 - RNA, 21 nt, Human
gaccugauccuggaggcccag

SEQ ID NO: 2562266 - RNA, 19 nt, Human
gaccugauuuacaguuuca

SEQ ID NO: 2562267 - RNA, 20 nt, Human
gaccugaggcuccugugcua

SEQ ID NO: 2562268 - RNA, 16 nt, Human
gaccugcacuggggag

SEQ ID NO: 2562269 - RNA, 20 nt, Human
gaccugcacuggggagcccg

SEQ ID NO: 2562270 - RNA, 13 nt, Human
gaccugcaggcca

SEQ ID NO: 2562271 - RNA, 22 nt, Human
gaccugccuccugccugccccu

SEQ ID NO: 2562272 - RNA, 20 nt, Human
gaccugccuccugccugccc

SEQ ID NO: 2562273 - RNA, 19 nt, Human
gaccugccuccugccugcc

SEQ ID NO: 2562274 - RNA, 16 nt, Human
gaccugccuccugccu

SEQ ID NO: 2562275 - RNA, 15 nt, Human
gaccugccucggccu

SEQ ID NO: 2562276 - RNA, 14 nt, Human
gaccugccuccugc

SEQ ID NO: 2562277 - RNA, 13 nt, Human
gaccugccuccug

SEQ ID NO: 2562278 - RNA, 22 nt, Human
gaccugccucccuucaugcaug

SEQ ID NO: 2562279 - RNA, 11 nt, Human
gaccugccucc

SEQ ID NO: 2562280 - RNA, 21 nt, Human
gaccugccccgcccagcugca

SEQ ID NO: 2562281 - RNA, 15 nt, Human
gaccugccaggcagg

SEQ ID NO: 2562282 - RNA, 20 nt, Human
gaccugcaggccaagagcag

SEQ ID NO: 2562283 - RNA, 18 nt, Human
gaccugccaggcaggggu

SEQ ID NO: 2562284 - RNA, 17 nt, Human
gaccugccaggcagggg

SEQ ID NO: 2562285 - RNA, 16 nt, Human
gaccugccaggcaggg

SEQ ID NO: 2562286 - RNA, 21 nt, Human
gaccugccccuccucucugcc

SEQ ID NO: 2562287 - RNA, 20 nt, Human
gaccugccaggcaggggugg

SEQ ID NO: 2562288 - RNA, 19 nt, Human
gaccugccaggcaggggug

SEQ ID NO: 2562289 - RNA, 21 nt, Human
gaccugccaggcagggguggg

SEQ ID NO: 2562290 - RNA, 17 nt, Human
gacaugucuuuucuugc

SEQ ID NO: 2562291 - RNA, 23 nt, Human
gacauggugccugagaggcaggc

SEQ ID NO: 2562292 - RNA, 22 nt, Human
gacauggugccugagaggcagg

SEQ ID NO: 2562293 - RNA, 21 nt, Human
gacauggugccugagaggcag

SEQ ID NO: 2562294 - RNA, 20 nt, Human
gacauggugccugagaggca

SEQ ID NO: 2562295 - RNA, 15 nt, Human
gacaugucuguucua

SEQ ID NO: 2562296 - RNA, 11 nt, Human
gacauguacag

SEQ ID NO: 2562297 - RNA, 18 nt, Human
gacaugugaaaccuuuuu

SEQ ID NO: 2562298 - RNA, 17 nt, Human
gacauuuugccaaaauu

SEQ ID NO: 2562299 - RNA, 15 nt, Human
gacaugugaaaccuu

SEQ ID NO: 2562300 - RNA, 14 nt, Human
gacaugugaaaccu

SEQ ID NO: 2562301 - RNA, 12 nt, Human
gacaugugaaac

SEQ ID NO: 2562302 - RNA, 12 nt, Human
gacauguacaga

SEQ ID NO: 2562303 - RNA, 17 nt, Human
gacaugucuguucuaca

SEQ ID NO: 2562304 - RNA, 21 nt, Human
gacaugucuuuucuugcauga

SEQ ID NO: 2562305 - RNA, 22 nt, Human
gaccaaauuccuuggcaugccu

SEQ ID NO: 2562306 - RNA, 16 nt, Human
gaccaacauggagaaa

SEQ ID NO: 2562307 - RNA, 23 nt, Human
gaccaaauuccuuggcaugccuu

SEQ ID NO: 2562308 - RNA, 17 nt, Human
gaccaacauggagaaac

SEQ ID NO: 2562309 - RNA, 19 nt, Human
gaccaaaauccccuucuca

SEQ ID NO: 2562310 - RNA, 17 nt, Human
gaccaaaauccccuucu

SEQ ID NO: 2562311 - RNA, 13 nt, Human
gaccaaaaucccc

SEQ ID NO: 2562312 - RNA, 17 nt, Human
gaccaaaccuagccccu

SEQ ID NO: 2562313 - RNA, 13 nt, Human
gaccaaaccuagc

SEQ ID NO: 2562314 - RNA, 20 nt, Human
gacauuuuuucagucauaua

SEQ ID NO: 2562315 - RNA, 15 nt, Human
gacauuuuuucaguc

SEQ ID NO: 2562316 - RNA, 22 nt, Human
gacaugggacauuugcucaugg

SEQ ID NO: 2562317 - RNA, 17 nt, Human
gacaugggacauuugcu

SEQ ID NO: 2562318 - RNA, 19 nt, Human
gacauggugccugagaggc

SEQ ID NO: 2562319 - RNA, 18 nt, Human
gacauggugccugagagg

SEQ ID NO: 2562320 - RNA, 17 nt, Human
gacauggugccugagag

SEQ ID NO: 2562321 - RNA, 16 nt, Human
gacauggugccugaga

SEQ ID NO: 2562322 - RNA, 14 nt, Human
gacauggugccuga

SEQ ID NO: 2562323 - RNA, 15 nt, Human
gacauggggaggaag

SEQ ID NO: 2562324 - RNA, 16 nt, Human
gacauggggaggaagg

SEQ ID NO: 2562325 - RNA, 12 nt, Human
gacaugaauaug

SEQ ID NO: 2562326 - RNA, 18 nt, Human
gacaugcgguagccagca

SEQ ID NO: 2562327 - RNA, 14 nt, Human
gacaugaauaugau

SEQ ID NO: 2562328 - RNA, 19 nt, Human
gacaugcgguagccagcac

SEQ ID NO: 2562329 - RNA, 22 nt, Human
gacaugcgguagccagcacaca

SEQ ID NO: 2562330 - RNA, 23 nt, Human
gacaugcgguagccagcacacag

SEQ ID NO: 2562331 - RNA, 14 nt, Human
gacaugcugaagcc

SEQ ID NO: 2562332 - RNA, 20 nt, Human
gacauagagagggagaagaa

SEQ ID NO: 2562333 - RNA, 22 nt, Human
gacauggagacuccugcccugu

SEQ ID NO: 2562334 - RNA, 20 nt, Human
gacauggagacuccugcccu

SEQ ID NO: 2562335 - RNA, 19 nt, Human
gacauggagacuccugccc

SEQ ID NO: 2562336 - RNA, 17 nt, Human
gacauggagacuccugc

SEQ ID NO: 2562337 - RNA, 19 nt, Human
gacaugcugaagccaaagc

SEQ ID NO: 2562338 - RNA, 18 nt, Human
gacaugcugaagccaaag

SEQ ID NO: 2562339 - RNA, 15 nt, Human
gacaugcugaagcca

SEQ ID NO: 2562340 - RNA, 14 nt, Human
gacaugcugacuuu

SEQ ID NO: 2562341 - RNA, 16 nt, Human
gacauggacccggagc

SEQ ID NO: 2562342 - RNA, 17 nt, Human
gacauggacccggagcu

SEQ ID NO: 2562343 - RNA, 17 nt, Human
gacaucucugcacccug

SEQ ID NO: 2562344 - RNA, 15 nt, Human
gacaucucugcaccc

SEQ ID NO: 2562345 - RNA, 14 nt, Human
gacaucuggaaucu

SEQ ID NO: 2562346 - RNA, 18 nt, Human
gacaucuggaaucuggag

SEQ ID NO: 2562347 - RNA, 19 nt, Human
gacaucuggaaucuggaga

SEQ ID NO: 2562348 - RNA, 14 nt, Human
gacaucaacagaua

SEQ ID NO: 2562349 - RNA, 20 nt, Human
gacaucuggaaucuggagac

SEQ ID NO: 2562350 - RNA, 22 nt, Human
gacaucuggaaucuggagacca

SEQ ID NO: 2562351 - RNA, 21 nt, Human
gacaucuguuucuaaauguuu

SEQ ID NO: 2562352 - RNA, 16 nt, Human
gacaucucuuugaauu

SEQ ID NO: 2562353 - RNA, 16 nt, Human
gacaucuuaguauuug

SEQ ID NO: 2562354 - RNA, 20 nt, Human
gacaugaagauucuuuccca

SEQ ID NO: 2562355 - RNA, 19 nt, Human
gacaucuuaguauuugcau

SEQ ID NO: 2562356 - RNA, 20 nt, Human
gacaucuucaaagcuugaag

SEQ ID NO: 2562357 - RNA, 21 nt, Human
gacaucuucaaagcuugaaga

SEQ ID NO: 2562358 - RNA, 23 nt, Human
gacauaggccaugaaaaaaauga

SEQ ID NO: 2562359 - RNA, 13 nt, Human
gacauauucauuu

SEQ ID NO: 2562360 - RNA, 20 nt, Human
gacauauucauuuggaaaua

SEQ ID NO: 2562361 - RNA, 23 nt, Human
gacauacuaaccagcagaaaugc

SEQ ID NO: 2562362 - RNA, 22 nt, Human
gacauagagagggagaagaagu

SEQ ID NO: 2562363 - RNA, 16 nt, Human
gacauaauuucacuga

SEQ ID NO: 2562364 - RNA, 22 nt, Human
gacauagcccaucccugccugg

SEQ ID NO: 2562365 - RNA, 21 nt, Human
gacauagagagggagaagaag

SEQ ID NO: 2562366 - RNA, 18 nt, Human
gacauagcccaucccugc

SEQ ID NO: 2562367 - RNA, 12 nt, Human
gacaggcuggcu

SEQ ID NO: 2562368 - RNA, 14 nt, Human
gacaggcuggcucc

SEQ ID NO: 2562369 - RNA, 21 nt, Human
gacaggcuggcuccagaugca

SEQ ID NO: 2562370 - RNA, 22 nt, Human
gacaggcuggcuccagaugcag

SEQ ID NO: 2562371 - RNA, 23 nt, Human
gacauaacguuuuuccuuuaaaa

SEQ ID NO: 2562372 - RNA, 15 nt, Human
gacagggaagagcag

SEQ ID NO: 2562373 - RNA, 22 nt, Human
gacauaaugggguccuggccau

SEQ ID NO: 2562374 - RNA, 15 nt, Human
gacauacuaaccagc

SEQ ID NO: 2562375 - RNA, 16 nt, Human
gacauacuaaccagca

SEQ ID NO: 2562376 - RNA, 19 nt, Human
gacaggcucuuagcagcuu

SEQ ID NO: 2562377 - RNA, 18 nt, Human
gacaggcucuuagcagcu

SEQ ID NO: 2562378 - RNA, 17 nt, Human
gacaggcucuuagcagc

SEQ ID NO: 2562379 - RNA, 13 nt, Human
gacaggcucuuag

SEQ ID NO: 2562380 - RNA, 21 nt, Human
gacaggcccaagagaugaaga

SEQ ID NO: 2562381 - RNA, 14 nt, Human
gacaggcagcagag

SEQ ID NO: 2562382 - RNA, 15 nt, Human
gacaggcagccugga

SEQ ID NO: 2562383 - RNA, 18 nt, Human
gacaggcccaagagauga

SEQ ID NO: 2562384 - RNA, 22 nt, Human
gacaggcccaagagaugaagag

SEQ ID NO: 2562385 - RNA, 16 nt, Human
gacaggcccaagagau

SEQ ID NO: 2562386 - RNA, 23 nt, Human
gacaggaugggggcuggccucug

SEQ ID NO: 2562387 - RNA, 20 nt, Human
gacaggagggcaagggccau

SEQ ID NO: 2562388 - RNA, 13 nt, Human
gacaggcagcaga

SEQ ID NO: 2562389 - RNA, 23 nt, Human
gacagaucucugcuuuggaaauc

SEQ ID NO: 2562390 - RNA, 21 nt, Human
gacagaucucugcuuuggaaa

SEQ ID NO: 2562391 - RNA, 19 nt, Human
gacagaucucugcuuugga

SEQ ID NO: 2562392 - RNA, 23 nt, Human
gacagaucaagcugugagacagu

SEQ ID NO: 2562393 - RNA, 16 nt, Human
gacagacacaggcccg

SEQ ID NO: 2562394 - RNA, 15 nt, Human
gacagacacaggccc

SEQ ID NO: 2562395 - RNA, 21 nt, Human
gacacuaaccacgcuggaccu

SEQ ID NO: 2562396 - RNA, 20 nt, Human
gacacuaaccacgcuggacc

SEQ ID NO: 2562397 - RNA, 15 nt, Human
gacacguccacccca

SEQ ID NO: 2562398 - RNA, 14 nt, Human
gacagacacaggcc

SEQ ID NO: 2562399 - RNA, 13 nt, Human
gacagcugccugg

SEQ ID NO: 2562400 - RNA, 12 nt, Human
gacagcugccug

SEQ ID NO: 2562401 - RNA, 22 nt, Human
gacagccaacuauggccugugg

SEQ ID NO: 2562402 - RNA, 13 nt, Human
gacagccacggcc

SEQ ID NO: 2562403 - RNA, 20 nt, Human
gacagaugaaugccguggau

SEQ ID NO: 2562404 - RNA, 19 nt, Human
gacagaugaaugccgugga

SEQ ID NO: 2562405 - RNA, 18 nt, Human
gacagaucaauggcgcag

SEQ ID NO: 2562406 - RNA, 14 nt, Human
gacagaugccccag

SEQ ID NO: 2562407 - RNA, 18 nt, Human
gacagaugccccagagcu

SEQ ID NO: 2562408 - RNA, 19 nt, Human
gacagaugccccagagcug

SEQ ID NO: 2562409 - RNA, 19 nt, Human
gacagccaacuauggccug

SEQ ID NO: 2562410 - RNA, 19 nt, Human
gacaggcauguucucugag

SEQ ID NO: 2562411 - RNA, 18 nt, Human
gacaggcauguucucuga

SEQ ID NO: 2562412 - RNA, 17 nt, Human
gacaggcaaugcuggcu

SEQ ID NO: 2562413 - RNA, 24 nt, Human
gacaggcaaugcuggcuguuggcu

SEQ ID NO: 2562414 - RNA, 16 nt, Human
gacaggaugggggcug

SEQ ID NO: 2562415 - RNA, 17 nt, Human
gacaggagggcaagggc

SEQ ID NO: 2562416 - RNA, 16 nt, Human
gacaggcaaugcuggc

SEQ ID NO: 2562417 - RNA, 14 nt, Human
gacaggcaaugcug

SEQ ID NO: 2562418 - RNA, 15 nt, Human
gacagcugccuggga

SEQ ID NO: 2562419 - RNA, 14 nt, Human
gacagcugccuggg

SEQ ID NO: 2562420 - RNA, 11 nt, Human
gacagcugcuc

SEQ ID NO: 2562421 - RNA, 14 nt, Human
gacagcugcuccua

SEQ ID NO: 2562422 - RNA, 17 nt, Human
gacagcugcuccuagag

SEQ ID NO: 2562423 - RNA, 20 nt, Human
gacagcugcuccuagaggga

SEQ ID NO: 2562424 - RNA, 21 nt, Human
gacagcugcuccuagagggag

SEQ ID NO: 2562425 - RNA, 22 nt, Human
gacagcugucccugucaccaag

SEQ ID NO: 2562426 - RNA, 18 nt, Human
gacagcugucccugucac

SEQ ID NO: 2562427 - RNA, 19 nt, Human
gacagcugucccugucacc

SEQ ID NO: 2562428 - RNA, 14 nt, Human
gacagcugucccug

SEQ ID NO: 2562429 - RNA, 15 nt, Human
gacagcugucccugu

SEQ ID NO: 2562430 - RNA, 16 nt, Human
gacagcugucccuguc

SEQ ID NO: 2562431 - RNA, 17 nt, Human
gacagcugucccuguca

SEQ ID NO: 2562432 - RNA, 18 nt, Human
gacaggagaccuggcacu

SEQ ID NO: 2562433 - RNA, 21 nt, Human
gacaggagaccuggcacugga

SEQ ID NO: 2562434 - RNA, 11 nt, Human
gacaggagaaa

SEQ ID NO: 2562435 - RNA, 12 nt, Human
gacaggagaaau

SEQ ID NO: 2562436 - RNA, 24 nt, Human
gacaggagaaaugcauccauuccu

SEQ ID NO: 2562437 - RNA, 15 nt, Human
gacaggaccugacua

SEQ ID NO: 2562438 - RNA, 20 nt, Human
gacaggacgggcuugggcuu

SEQ ID NO: 2562439 - RNA, 21 nt, Human
gacagcuucucauccugcagg

SEQ ID NO: 2562440 - RNA, 15 nt, Human
gacagcuugagccgg

SEQ ID NO: 2562441 - RNA, 22 nt, Human
gacagcuucucauccugcaggc

SEQ ID NO: 2562442 - RNA, 18 nt, Human
gacaagagaugggaauga

SEQ ID NO: 2562443 - RNA, 19 nt, Human
gacaagcaauuagacaaga

SEQ ID NO: 2562444 - RNA, 12 nt, Human
gacaagcagagg

SEQ ID NO: 2562445 - RNA, 22 nt, Human
gacaagccaacuuguaaauaca

SEQ ID NO: 2562446 - RNA, 16 nt, Human
gacaagcacugcuagg

SEQ ID NO: 2562447 - RNA, 19 nt, Human
gacaagccaacuuguaaau

SEQ ID NO: 2562448 - RNA, 12 nt, Human
gacaagccccag

SEQ ID NO: 2562449 - RNA, 23 nt, Human
gacaagccaacuuguaaauacac

SEQ ID NO: 2562450 - RNA, 15 nt, Human
gacaagccccaggca

SEQ ID NO: 2562451 - RNA, 15 nt, Human
gacaagcucacagac

SEQ ID NO: 2562452 - RNA, 22 nt, Human
gacaaggauugcuacuguccua

SEQ ID NO: 2562453 - RNA, 14 nt, Human
gaagucuuuguaca

SEQ ID NO: 2562454 - RNA, 16 nt, Human
gaagucuuuguacaga

SEQ ID NO: 2562455 - RNA, 24 nt, Human
gacaagacuucaguauguugucaa

SEQ ID NO: 2562456 - RNA, 20 nt, Human
gacaagacuucaguauguug

SEQ ID NO: 2562457 - RNA, 19 nt, Human
gacaagacuucaguauguu

SEQ ID NO: 2562458 - RNA, 16 nt, Human
gacaagacuucaguau

SEQ ID NO: 2562459 - RNA, 20 nt, Human
gacaagagaugggaaugagg

SEQ ID NO: 2562460 - RNA, 14 nt, Human
gacaagagauggga

SEQ ID NO: 2562461 - RNA, 15 nt, Human
gacaauaaucucacu

SEQ ID NO: 2562462 - RNA, 13 nt, Human
gacaauaauuuca

SEQ ID NO: 2562463 - RNA, 19 nt, Human
gacaauaauuucagguuuu

SEQ ID NO: 2562464 - RNA, 20 nt, Human
gacaaucaguccccucccau

SEQ ID NO: 2562465 - RNA, 19 nt, Human
gacaaucaguccccuccca

SEQ ID NO: 2562466 - RNA, 18 nt, Human
gacaaucaguccccuccc

SEQ ID NO: 2562467 - RNA, 17 nt, Human
gacaaucaguccccucc

SEQ ID NO: 2562468 - RNA, 16 nt, Human
gacaaucaguccccuc

SEQ ID NO: 2562469 - RNA, 14 nt, Human
gacaaucagucccc

SEQ ID NO: 2562470 - RNA, 17 nt, Human
gacaaucaacucuaaua

SEQ ID NO: 2562471 - RNA, 16 nt, Human
gacaaugacccagugg

SEQ ID NO: 2562472 - RNA, 20 nt, Human
gacaaucaugaaauaugcau

SEQ ID NO: 2562473 - RNA, 19 nt, Human
gacaaucaugaaauaugca

SEQ ID NO: 2562474 - RNA, 21 nt, Human
gacaaucaugaaauaugcauc

SEQ ID NO: 2562475 - RNA, 23 nt, Human
gacaagguagcccuggccagagg

SEQ ID NO: 2562476 - RNA, 14 nt, Human
gacaagguagcccu

SEQ ID NO: 2562477 - RNA, 21 nt, Human
gacaagguagcccuggccaga

SEQ ID NO: 2562478 - RNA, 23 nt, Human
gacaaggccccagagacucagag

SEQ ID NO: 2562479 - RNA, 16 nt, Human
gacaaggccccagaga

SEQ ID NO: 2562480 - RNA, 17 nt, Human
gacaaggccccagagac

SEQ ID NO: 2562481 - RNA, 16 nt, Human
gacaagccccaggcag

SEQ ID NO: 2562482 - RNA, 17 nt, Human
gacaagccccaggcagg

SEQ ID NO: 2562483 - RNA, 13 nt, Human
gacaaggccccag

SEQ ID NO: 2562484 - RNA, 14 nt, Human
gacaaggccccaga

SEQ ID NO: 2562485 - RNA, 14 nt, Human
gacaauaaaacauu

SEQ ID NO: 2562486 - RNA, 20 nt, Human
gacaaguggacucagggcag

SEQ ID NO: 2562487 - RNA, 20 nt, Human
gacaagugcugaacagugga

SEQ ID NO: 2562488 - RNA, 15 nt, Human
gacaaguggacucag

SEQ ID NO: 2562489 - RNA, 22 nt, Human
gacaagguucuucccuuuuaca

SEQ ID NO: 2562490 - RNA, 17 nt, Human
gacacaggcccggcucc

SEQ ID NO: 2562491 - RNA, 15 nt, Human
gacacaggcccggcu

SEQ ID NO: 2562492 - RNA, 13 nt, Human
gacacacagcucu

SEQ ID NO: 2562493 - RNA, 21 nt, Human
gacacacacacgcacgcacac

SEQ ID NO: 2562494 - RNA, 20 nt, Human
gacacacacacgcacgcaca

SEQ ID NO: 2562495 - RNA, 19 nt, Human
gacacacacacgcacgcac

SEQ ID NO: 2562496 - RNA, 18 nt, Human
gacacacacacgcacgca

SEQ ID NO: 2562497 - RNA, 23 nt, Human
gacacacacacgcacgcacacac

SEQ ID NO: 2562498 - RNA, 22 nt, Human
gacacacacacgcacgcacaca

SEQ ID NO: 2562499 - RNA, 13 nt, Human
gacaauuuauuau

SEQ ID NO: 2562500 - RNA, 19 nt, Human
gacaauuuauuauggcaca

SEQ ID NO: 2562501 - RNA, 20 nt, Human
gacaauuucaaaaaaauaaa

SEQ ID NO: 2562502 - RNA, 22 nt, Human
gacacaaguggaccuuaggccu

SEQ ID NO: 2562503 - RNA, 22 nt, Human
gacacaagccuucggcgccuua

SEQ ID NO: 2562504 - RNA, 15 nt, Human
gacacacacacgcac

SEQ ID NO: 2562505 - RNA, 14 nt, Human
gacacacacacgca

SEQ ID NO: 2562506 - RNA, 13 nt, Human
gacacacacacgc

SEQ ID NO: 2562507 - RNA, 12 nt, Human
gacacacacacg

SEQ ID NO: 2562508 - RNA, 12 nt, Human
gacacacacaca

SEQ ID NO: 2562509 - RNA, 17 nt, Human
gacaaugacuuacugua

SEQ ID NO: 2562510 - RNA, 20 nt, Human
gacaaugacuuacuguacau

SEQ ID NO: 2562511 - RNA, 12 nt, Human
gacaaugcaaac

SEQ ID NO: 2562512 - RNA, 21 nt, Human
gacaaugacuuacuguacaug

SEQ ID NO: 2562513 - RNA, 18 nt, Human
gacaaugcaaaccaucau

SEQ ID NO: 2562514 - RNA, 16 nt, Human
gacaaugcaaaccauc

SEQ ID NO: 2562515 - RNA, 12 nt, Human
gacaauuuauua

SEQ ID NO: 2562516 - RNA, 15 nt, Human
gacaauugucuuuuu

SEQ ID NO: 2562517 - RNA, 22 nt, Human
gacaauuuauauuuaauaaaau

SEQ ID NO: 2562518 - RNA, 13 nt, Human
gacaccugcccug

SEQ ID NO: 2562519 - RNA, 14 nt, Human
gacaccugcccugc

SEQ ID NO: 2562520 - RNA, 15 nt, Human
gacaccugcccugcc

SEQ ID NO: 2562521 - RNA, 17 nt, Human
gacaccuugacagggca

SEQ ID NO: 2562522 - RNA, 15 nt, Human
gacaccuugacaggg

SEQ ID NO: 2562523 - RNA, 20 nt, Human
gacaccuugacagggcacac

SEQ ID NO: 2562524 - RNA, 18 nt, Human
gacaccuugacagggcac

SEQ ID NO: 2562525 - RNA, 15 nt, Human
gacacgaauauugcu

SEQ ID NO: 2562526 - RNA, 14 nt, Human
gacaccuuggacau

SEQ ID NO: 2562527 - RNA, 18 nt, Human
gacacuaaccacgcugga

SEQ ID NO: 2562528 - RNA, 17 nt, Human
gacacuaaccacgcugg

SEQ ID NO: 2562529 - RNA, 16 nt, Human
gacacuaaccacgcug

SEQ ID NO: 2562530 - RNA, 15 nt, Human
gacacuaaccacgcu

SEQ ID NO: 2562531 - RNA, 18 nt, Human
gacacgaauauugcugau

SEQ ID NO: 2562532 - RNA, 17 nt, Human
gacacgaauauugcuga

SEQ ID NO: 2562533 - RNA, 19 nt, Human
gacacgaauauugcugaug

SEQ ID NO: 2562534 - RNA, 14 nt, Human
gacacguccacccc

SEQ ID NO: 2562535 - RNA, 15 nt, Human
gacacggggcagugg

SEQ ID NO: 2562536 - RNA, 17 nt, Human
gacaccuuugcaggcau

SEQ ID NO: 2562537 - RNA, 12 nt, Human
gacaccuuucau

SEQ ID NO: 2562538 - RNA, 23 nt, Human
gacacccugugauggggcccugc

SEQ ID NO: 2562539 - RNA, 22 nt, Human
gacacccugugauggggcccug

SEQ ID NO: 2562540 - RNA, 16 nt, Human
gacaccgccacauggc

SEQ ID NO: 2562541 - RNA, 10 nt, Human
gacacccggc

SEQ ID NO: 2562542 - RNA, 13 nt, Human
gacacccucaacc

SEQ ID NO: 2562543 - RNA, 22 nt, Human
gacaccgggccaguaucuauau

SEQ ID NO: 2562544 - RNA, 19 nt, Human
gacaccgggccaguaucua

SEQ ID NO: 2562545 - RNA, 20 nt, Human
gacaccgggguggugggaac

SEQ ID NO: 2562546 - RNA, 17 nt, Human
gacaccuacugaguggc

SEQ ID NO: 2562547 - RNA, 20 nt, Human
gacaccugcaccucccccca

SEQ ID NO: 2562548 - RNA, 22 nt, Human
gacaccugcaccuccccccacu

SEQ ID NO: 2562549 - RNA, 13 nt, Human
gacaccugcaccu

SEQ ID NO: 2562550 - RNA, 15 nt, Human
gacaccugcaccucc

SEQ ID NO: 2562551 - RNA, 16 nt, Human
gacaccugcaccuccc

SEQ ID NO: 2562552 - RNA, 17 nt, Human
gacaccugcaccucccc

SEQ ID NO: 2562553 - RNA, 19 nt, Human
gacaccugcaccucccccc

SEQ ID NO: 2562554 - RNA, 22 nt, Human
gacacaggucuuuccuaaggcu

SEQ ID NO: 2562555 - RNA, 16 nt, Human
gacacaggucuuuccu

SEQ ID NO: 2562556 - RNA, 17 nt, Human
gacacaggucuuuccua

SEQ ID NO: 2562557 - RNA, 17 nt, Human
gacacagugaccauacu

SEQ ID NO: 2562558 - RNA, 19 nt, Human
gacacagggacuugaaguu

SEQ ID NO: 2562559 - RNA, 18 nt, Human
gacacagggacuugaagu

SEQ ID NO: 2562560 - RNA, 16 nt, Human
gacacagggacuugaa

SEQ ID NO: 2562561 - RNA, 21 nt, Human
gacacagggacuugaaguugu

SEQ ID NO: 2562562 - RNA, 20 nt, Human
gacacagggacuugaaguug

SEQ ID NO: 2562563 - RNA, 18 nt, Human
gacacaggcccggcucca

SEQ ID NO: 2562564 - RNA, 17 nt, Human
gacacaggcccucccug

SEQ ID NO: 2562565 - RNA, 13 nt, Human
gacacccugugau

SEQ ID NO: 2562566 - RNA, 12 nt, Human
gacacccuguga

SEQ ID NO: 2562567 - RNA, 22 nt, Human
gacacauaugcaccuugugucu

SEQ ID NO: 2562568 - RNA, 16 nt, Human
gacacauaugaggggg

SEQ ID NO: 2562569 - RNA, 15 nt, Human
gacacauaugagggg

SEQ ID NO: 2562570 - RNA, 21 nt, Human
gacaccccuuauccaggacuc

SEQ ID NO: 2562571 - RNA, 20 nt, Human
gacaccccuuauccaggacu

SEQ ID NO: 2562572 - RNA, 19 nt, Human
gacaccccuuauccaggac

SEQ ID NO: 2562573 - RNA, 18 nt, Human
gacaccccuuauccagga

SEQ ID NO: 2562574 - RNA, 17 nt, Human
gacaccccuuauccagg

SEQ ID NO: 2562575 - RNA, 13 nt, Human
gacacccccucgc

SEQ ID NO: 2562576 - RNA, 15 nt, Human
gcagacaggaccagg

SEQ ID NO: 2562577 - RNA, 13 nt, Human
gcagacaggacca

SEQ ID NO: 2562578 - RNA, 12 nt, Human
gcagacaggacc

SEQ ID NO: 2562579 - RNA, 18 nt, Human
gcagacacagggacuuga

SEQ ID NO: 2562580 - RNA, 16 nt, Human
gcagacacagggacuu

SEQ ID NO: 2562581 - RNA, 18 nt, Human
gcagacaggaccagggau

SEQ ID NO: 2562582 - RNA, 19 nt, Human
gcagacaggcaagcaccuc

SEQ ID NO: 2562583 - RNA, 22 nt, Human
gcagacacagggacuugaaguu

SEQ ID NO: 2562584 - RNA, 21 nt, Human
gcagacacagggacuugaagu

SEQ ID NO: 2562585 - RNA, 19 nt, Human
gcagacacagggacuugaa

SEQ ID NO: 2562586 - RNA, 15 nt, Human
gcagacagcuccacc

SEQ ID NO: 2562587 - RNA, 20 nt, Human
gcagacaggccccgugaggc

SEQ ID NO: 2562588 - RNA, 23 nt, Human
gcagacaggcaagcaccuccugc

SEQ ID NO: 2562589 - RNA, 21 nt, Human
gcagaauaaagcaauuuuccu

SEQ ID NO: 2562590 - RNA, 20 nt, Human
gcagaauaaagcaauuuucc

SEQ ID NO: 2562591 - RNA, 19 nt, Human
gcagaauaaagcaauuuuc

SEQ ID NO: 2562592 - RNA, 18 nt, Human
gcagaauaaagcaauuuu

SEQ ID NO: 2562593 - RNA, 17 nt, Human
gcagaauaaagcaauuu

SEQ ID NO: 2562594 - RNA, 16 nt, Human
gcagaauaaagcaauu

SEQ ID NO: 2562595 - RNA, 15 nt, Human
gcagaauaaagcaau

SEQ ID NO: 2562596 - RNA, 23 nt, Human
gcacuucauugagaguuuugucu

SEQ ID NO: 2562597 - RNA, 13 nt, Human
gcagaauguuuuu

SEQ ID NO: 2562598 - RNA, 17 nt, Human
gcagaauccuggcccuc

SEQ ID NO: 2562599 - RNA, 17 nt, Human
gcagaauguuuuuaaaa

SEQ ID NO: 2562600 - RNA, 23 nt, Human
gcagaauccuaggcuccacccca

SEQ ID NO: 2562601 - RNA, 17 nt, Human
gcagaauagcaaggugc

SEQ ID NO: 2562602 - RNA, 17 nt, Human
gcagaauacuuuucucu

SEQ ID NO: 2562603 - RNA, 22 nt, Human
gcagaauaaagcaauuuuccuu

SEQ ID NO: 2562604 - RNA, 18 nt, Human
gcagaauaaucuuugggu

SEQ ID NO: 2562605 - RNA, 19 nt, Human
gcacuuagcuaucagaaga

SEQ ID NO: 2562606 - RNA, 17 nt, Human
gcacuuagcuaucagaa

SEQ ID NO: 2562607 - RNA, 22 nt, Human
gcacuuacugguaggaccaagc

SEQ ID NO: 2562608 - RNA, 16 nt, Human
gcacuuaugauuucau

SEQ ID NO: 2562609 - RNA, 13 nt, Human
gcacuucacagag

SEQ ID NO: 2562610 - RNA, 18 nt, Human
gcacuuauuuaaugccga

SEQ ID NO: 2562611 - RNA, 15 nt, Human
gcacuucacagagug

SEQ ID NO: 2562612 - RNA, 14 nt, Human
gcacuucacagagu

SEQ ID NO: 2562613 - RNA, 22 nt, Human
gcacuuaacaagcucccaggcc

SEQ ID NO: 2562614 - RNA, 19 nt, Human
gcacuuaaggcacucuguu

SEQ ID NO: 2562615 - RNA, 18 nt, Human
gcacuuaagagaauauuu

SEQ ID NO: 2562616 - RNA, 17 nt, Human
gcacugccaugcagggc

SEQ ID NO: 2562617 - RNA, 15 nt, Human
gcacugccaugcagg

SEQ ID NO: 2562618 - RNA, 14 nt, Human
gcacugccaugcag

SEQ ID NO: 2562619 - RNA, 21 nt, Human
gcacugcccauggacaggcug

SEQ ID NO: 2562620 - RNA, 14 nt, Human
gcacguggccucuu

SEQ ID NO: 2562621 - RNA, 13 nt, Human
gcacguggccucu

SEQ ID NO: 2562622 - RNA, 23 nt, Human
gcacguggcauguggccuguggc

SEQ ID NO: 2562623 - RNA, 18 nt, Human
gcacguggcauguggccu

SEQ ID NO: 2562624 - RNA, 20 nt, Human
gcacguggagagcuggugcc

SEQ ID NO: 2562625 - RNA, 17 nt, Human
gcacguggccucuugag

SEQ ID NO: 2562626 - RNA, 15 nt, Human
gcacguggccucuug

SEQ ID NO: 2562627 - RNA, 19 nt, Human
gcacguggccucuugagca

SEQ ID NO: 2562628 - RNA, 18 nt, Human
gcacggugggccuugcug

SEQ ID NO: 2562629 - RNA, 17 nt, Human
gcacggugggccuugcu

SEQ ID NO: 2562630 - RNA, 16 nt, Human
gcacggugggccuugc

SEQ ID NO: 2562631 - RNA, 13 nt, Human
gcacggcugcuga

SEQ ID NO: 2562632 - RNA, 20 nt, Human
gcacggugggccuugcuggg

SEQ ID NO: 2562633 - RNA, 19 nt, Human
gcacggugggccuugcugg

SEQ ID NO: 2562634 - RNA, 21 nt, Human
gcacguaguagggucaggcca

SEQ ID NO: 2562635 - RNA, 20 nt, Human
gcacguaguagggucaggcc

SEQ ID NO: 2562636 - RNA, 22 nt, Human
gcacguagcugaggccggaugc

SEQ ID NO: 2562637 - RNA, 16 nt, Human
gcacguaguaggguca

SEQ ID NO: 2562638 - RNA, 15 nt, Human
gcacguggagagcug

SEQ ID NO: 2562639 - RNA, 16 nt, Human
gcacguggagagcugg

SEQ ID NO: 2562640 - RNA, 18 nt, Human
gcacguggagagcuggug

SEQ ID NO: 2562641 - RNA, 13 nt, Human
gcacgucauggga

SEQ ID NO: 2562642 - RNA, 19 nt, Human
gcacugguggcccgacagc

SEQ ID NO: 2562643 - RNA, 24 nt, Human
gcacugguggcccgacagccuggc

SEQ ID NO: 2562644 - RNA, 23 nt, Human
gcacugguggcccgacagccugg

SEQ ID NO: 2562645 - RNA, 22 nt, Human
gcacugguggcccgacagccug

SEQ ID NO: 2562646 - RNA, 20 nt, Human
gcacugcuuccagugaggcu

SEQ ID NO: 2562647 - RNA, 22 nt, Human
gcacugcuuccagugaggcucu

SEQ ID NO: 2562648 - RNA, 18 nt, Human
gcacugcuuccagugagg

SEQ ID NO: 2562649 - RNA, 16 nt, Human
gcacugcuuccaguga

SEQ ID NO: 2562650 - RNA, 21 nt, Human
gcacugcuaggcgagugccag

SEQ ID NO: 2562651 - RNA, 20 nt, Human
gcacugcuaggcgagugcca

SEQ ID NO: 2562652 - RNA, 23 nt, Human
gcacugcuaggcgagugccagga

SEQ ID NO: 2562653 - RNA, 22 nt, Human
gcacugcuaggcgagugccagg

SEQ ID NO: 2562654 - RNA, 18 nt, Human
gcacugccugauggaccu

SEQ ID NO: 2562655 - RNA, 11 nt, Human
gcacugccuga

SEQ ID NO: 2562656 - RNA, 17 nt, Human
gcaccuuagacaguccc

SEQ ID NO: 2562657 - RNA, 14 nt, Human
gcaccuuagacagu

SEQ ID NO: 2562658 - RNA, 20 nt, Human
gcaccuuaccaacuuucugu

SEQ ID NO: 2562659 - RNA, 21 nt, Human
gcaccuggcugagccuggcug

SEQ ID NO: 2562660 - RNA, 20 nt, Human
gcaccuggcugagccuggcu

SEQ ID NO: 2562661 - RNA, 18 nt, Human
gcaccuggcaucgcacca

SEQ ID NO: 2562662 - RNA, 22 nt, Human
gcaccuggaauauauaaccagu

SEQ ID NO: 2562663 - RNA, 18 nt, Human
gcaccuggaauauauaac

SEQ ID NO: 2562664 - RNA, 21 nt, Human
gcaccuggaauauauaaccag

SEQ ID NO: 2562665 - RNA, 23 nt, Human
gcacccgggcucagggaccacag

SEQ ID NO: 2562666 - RNA, 22 nt, Human
gcacccgggcucagggaccaca

SEQ ID NO: 2562667 - RNA, 21 nt, Human
gcacccgggcucagggaccac

SEQ ID NO: 2562668 - RNA, 17 nt, Human
gcacccgggcucaggga

SEQ ID NO: 2562669 - RNA, 21 nt, Human
gcacccuaguucuaccucagg

SEQ ID NO: 2562670 - RNA, 15 nt, Human
gcacccucaggcagg

SEQ ID NO: 2562671 - RNA, 18 nt, Human
gcaccuuagacagucccu

SEQ ID NO: 2562672 - RNA, 21 nt, Human
gcaccuuaccaacuuucugua

SEQ ID NO: 2562673 - RNA, 22 nt, Human
gcaccuugugucuguacacgug

SEQ ID NO: 2562674 - RNA, 20 nt, Human
gcaccuugugucuguacacg

SEQ ID NO: 2562675 - RNA, 15 nt, Human
gcacgaaauguuauu

SEQ ID NO: 2562676 - RNA, 15 nt, Human
gcacgaacccaccug

SEQ ID NO: 2562677 - RNA, 16 nt, Human
gcacgaacccaccugc

SEQ ID NO: 2562678 - RNA, 17 nt, Human
gcacgaacccaccugcu

SEQ ID NO: 2562679 - RNA, 19 nt, Human
gcacgaacccaccugcuga

SEQ ID NO: 2562680 - RNA, 23 nt, Human
gcacgaacccaccugcugagaga

SEQ ID NO: 2562681 - RNA, 12 nt, Human
gcacgauuucug

SEQ ID NO: 2562682 - RNA, 23 nt, Human
gcacgauguggaaaaaugagaga

SEQ ID NO: 2562683 - RNA, 12 nt, Human
gcacggacucuu

SEQ ID NO: 2562684 - RNA, 12 nt, Human
gcacggcugcug

SEQ ID NO: 2562685 - RNA, 14 nt, Human
gcacggugggccuu

SEQ ID NO: 2562686 - RNA, 14 nt, Human
gcaauggcagccuu

SEQ ID NO: 2562687 - RNA, 20 nt, Human
gcaccacugcacuccagccu

SEQ ID NO: 2562688 - RNA, 13 nt, Human
gcaauggcagccu

SEQ ID NO: 2562689 - RNA, 12 nt, Human
gcaauggcagcc

SEQ ID NO: 2562690 - RNA, 15 nt, Human
gcaccagcagccugg

SEQ ID NO: 2562691 - RNA, 23 nt, Human
gcaaugccauccucaaacacugc

SEQ ID NO: 2562692 - RNA, 23 nt, Human
gcaccacugcacuccagccuggg

SEQ ID NO: 2562693 - RNA, 21 nt, Human
gcaccacugcacuccagccug

SEQ ID NO: 2562694 - RNA, 22 nt, Human
gcaccacugcacuccagccugg

SEQ ID NO: 2562695 - RNA, 18 nt, Human
gcaccacuguguauuuaa

SEQ ID NO: 2562696 - RNA, 18 nt, Human
gcaccagcgaagggagug

SEQ ID NO: 2562697 - RNA, 17 nt, Human
gcaccagcgaagggagu

SEQ ID NO: 2562698 - RNA, 16 nt, Human
gcaccagcagccugga

SEQ ID NO: 2562699 - RNA, 19 nt, Human
gcaccagcuucuccaggcu

SEQ ID NO: 2562700 - RNA, 18 nt, Human
gcaccagcuucuccaggc

SEQ ID NO: 2562701 - RNA, 17 nt, Human
gcaccagcuucuccagg

SEQ ID NO: 2562702 - RNA, 16 nt, Human
gcaccagcuucuccag

SEQ ID NO: 2562703 - RNA, 20 nt, Human
gcaccagcuucuccaggcuc

SEQ ID NO: 2562704 - RNA, 17 nt, Human
gcaccauucugacucgg

SEQ ID NO: 2562705 - RNA, 15 nt, Human
gcaccauucugacuc

SEQ ID NO: 2562706 - RNA, 19 nt, Human
gcacccggccccugcuggu

SEQ ID NO: 2562707 - RNA, 18 nt, Human
gcacccggccccugcugg

SEQ ID NO: 2562708 - RNA, 19 nt, Human
gcacccacaagugccacug

SEQ ID NO: 2562709 - RNA, 16 nt, Human
gcacccgggcucaggg

SEQ ID NO: 2562710 - RNA, 19 nt, Human
gcacccacccagcacccag

SEQ ID NO: 2562711 - RNA, 22 nt, Human
gcacccaccaucaugucuggcu

SEQ ID NO: 2562712 - RNA, 23 nt, Human
gcaccauucugacucgguuucuc

SEQ ID NO: 2562713 - RNA, 24 nt, Human
gcagccccauucugccugcccagg

SEQ ID NO: 2562714 - RNA, 21 nt, Human
gcagccccauucugccugccc

SEQ ID NO: 2562715 - RNA, 19 nt, Human
gcagccccauucugccugc

SEQ ID NO: 2562716 - RNA, 18 nt, Human
gcagccccauucugccug

SEQ ID NO: 2562717 - RNA, 16 nt, Human
gcagcaauaaagcagc

SEQ ID NO: 2562718 - RNA, 23 nt, Human
gcagcaauaaagcagcguuucua

SEQ ID NO: 2562719 - RNA, 17 nt, Human
gcagccccauucugccu

SEQ ID NO: 2562720 - RNA, 22 nt, Human
gcagcccuagagccugccugga

SEQ ID NO: 2562721 - RNA, 19 nt, Human
gcagcccuagagccugccu

SEQ ID NO: 2562722 - RNA, 18 nt, Human
gcagcccuagagccugcc

SEQ ID NO: 2562723 - RNA, 17 nt, Human
gcagcccuagagccugc

SEQ ID NO: 2562724 - RNA, 13 nt, Human
gcagcccuagagc

SEQ ID NO: 2562725 - RNA, 13 nt, Human
gcagcccugcaga

SEQ ID NO: 2562726 - RNA, 15 nt, Human
gcagcccguguggcc

SEQ ID NO: 2562727 - RNA, 14 nt, Human
gcagaauaaagcaa

SEQ ID NO: 2562728 - RNA, 23 nt, Human
gcagccccgcgccuccuuccuug

SEQ ID NO: 2562729 - RNA, 17 nt, Human
gcagcccguguggcccc

SEQ ID NO: 2562730 - RNA, 18 nt, Human
gcagcccguguggccccu

SEQ ID NO: 2562731 - RNA, 19 nt, Human
gcagcccguguggccccuu

SEQ ID NO: 2562732 - RNA, 20 nt, Human
gcagcccguguggccccuuc

SEQ ID NO: 2562733 - RNA, 24 nt, Human
gcagcccuaaggaucucucaggag

SEQ ID NO: 2562734 - RNA, 23 nt, Human
gcagcccuaaggaucucucagga

SEQ ID NO: 2562735 - RNA, 22 nt, Human
gcagcccuaaggaucucucagg

SEQ ID NO: 2562736 - RNA, 21 nt, Human
gcagcccguguggccccuuca

SEQ ID NO: 2562737 - RNA, 21 nt, Human
gcagccccuguucuggcagag

SEQ ID NO: 2562738 - RNA, 20 nt, Human
gcagccccuguucuggcaga

SEQ ID NO: 2562739 - RNA, 20 nt, Human
gcagccccgugggguuccuc

SEQ ID NO: 2562740 - RNA, 17 nt, Human
gcagaguuguaaauaua

SEQ ID NO: 2562741 - RNA, 16 nt, Human
gcagaguuguaaauau

SEQ ID NO: 2562742 - RNA, 14 nt, Human
gcagaguuguaaau

SEQ ID NO: 2562743 - RNA, 13 nt, Human
gcagaguuguaaa

SEQ ID NO: 2562744 - RNA, 20 nt, Human
gcagaguugaagacagagcu

SEQ ID NO: 2562745 - RNA, 18 nt, Human
gcagauaaacaguaguga

SEQ ID NO: 2562746 - RNA, 19 nt, Human
gcagaccuccccagccccu

SEQ ID NO: 2562747 - RNA, 17 nt, Human
gcagaccuccccagccc

SEQ ID NO: 2562748 - RNA, 16 nt, Human
gcagaccuccccagcc

SEQ ID NO: 2562749 - RNA, 15 nt, Human
gcagaccuccccagc

SEQ ID NO: 2562750 - RNA, 13 nt, Human
gcagaccucccca

SEQ ID NO: 2562751 - RNA, 21 nt, Human
gcagaguugaagacagagcua

SEQ ID NO: 2562752 - RNA, 23 nt, Human
gcagaccacgcccguccugccug

SEQ ID NO: 2562753 - RNA, 20 nt, Human
gcagaccacgcccguccugc

SEQ ID NO: 2562754 - RNA, 21 nt, Human
gcagaccaccccgccugcccu

SEQ ID NO: 2562755 - RNA, 17 nt, Human
gcagaccaccccgccug

SEQ ID NO: 2562756 - RNA, 13 nt, Human
gcagaccaccccg

SEQ ID NO: 2562757 - RNA, 17 nt, Human
gcagacaguuaagagaa

SEQ ID NO: 2562758 - RNA, 15 nt, Human
gcagacauugucagc

SEQ ID NO: 2562759 - RNA, 12 nt, Human
gcagacauuguc

SEQ ID NO: 2562760 - RNA, 19 nt, Human
gcagacaugugcacuugaa

SEQ ID NO: 2562761 - RNA, 20 nt, Human
gcagauucauuuuucuuucu

SEQ ID NO: 2562762 - RNA, 17 nt, Human
gcagauugaaaaggaca

SEQ ID NO: 2562763 - RNA, 19 nt, Human
gcagauucauuuuucuuuc

SEQ ID NO: 2562764 - RNA, 21 nt, Human
gcagauuuucagcaaacucuu

SEQ ID NO: 2562765 - RNA, 20 nt, Human
gcagauuuuaggaaaugaau

SEQ ID NO: 2562766 - RNA, 16 nt, Human
gcagauuugggcugga

SEQ ID NO: 2562767 - RNA, 14 nt, Human
gcagauuggagaaa

SEQ ID NO: 2562768 - RNA, 20 nt, Human
gcagauuguguaacaauuuu

SEQ ID NO: 2562769 - RNA, 19 nt, Human
gcagauuggagaaacccuu

SEQ ID NO: 2562770 - RNA, 20 nt, Human
gcagauuuagugaaagcuag

SEQ ID NO: 2562771 - RNA, 23 nt, Human
gcagauuuagugaaagcuagaga

SEQ ID NO: 2562772 - RNA, 24 nt, Human
gcagaguuuguguguugucuugaa

SEQ ID NO: 2562773 - RNA, 20 nt, Human
gcagaguuuguguguugucu

SEQ ID NO: 2562774 - RNA, 18 nt, Human
gcagaguuuccaaaacca

SEQ ID NO: 2562775 - RNA, 23 nt, Human
gcagaguuguaaauauauaaaua

SEQ ID NO: 2562776 - RNA, 21 nt, Human
gcagaguuguaaauauauaaa

SEQ ID NO: 2562777 - RNA, 20 nt, Human
gcagaguuguaaauauauaa

SEQ ID NO: 2562778 - RNA, 16 nt, Human
gcagauaaucagccuc

SEQ ID NO: 2562779 - RNA, 17 nt, Human
gcagauaaucagccucu

SEQ ID NO: 2562780 - RNA, 18 nt, Human
gcagauaaucagccucuu

SEQ ID NO: 2562781 - RNA, 19 nt, Human
gcagauaaucagccucuua

SEQ ID NO: 2562782 - RNA, 22 nt, Human
gcagauacaggaaaagcugcug

SEQ ID NO: 2562783 - RNA, 18 nt, Human
gcagauaccucacccugc

SEQ ID NO: 2562784 - RNA, 15 nt, Human
gcagauacugucucu

SEQ ID NO: 2562785 - RNA, 17 nt, Human
gcagcccugcagagggc

SEQ ID NO: 2562786 - RNA, 16 nt, Human
gcagcccugcagaggg

SEQ ID NO: 2562787 - RNA, 15 nt, Human
gcagcccugcagagg

SEQ ID NO: 2562788 - RNA, 14 nt, Human
gcagcccugcagag

SEQ ID NO: 2562789 - RNA, 13 nt, Human
gcagcccugcuuu

SEQ ID NO: 2562790 - RNA, 13 nt, Human
gcagcccuccuca

SEQ ID NO: 2562791 - RNA, 15 nt, Human
gcagcccuccucacc

SEQ ID NO: 2562792 - RNA, 18 nt, Human
gcagcccuccucaccccg

SEQ ID NO: 2562793 - RNA, 10 nt, Human
gcagccuggg

SEQ ID NO: 2562794 - RNA, 14 nt, Human
gcagccuggggcug

SEQ ID NO: 2562795 - RNA, 18 nt, Human
gcagccuggguggcuaug

SEQ ID NO: 2562796 - RNA, 17 nt, Human
gcagccuggggcuggcc

SEQ ID NO: 2562797 - RNA, 23 nt, Human
gcagccuguccugggcugguggc

SEQ ID NO: 2562798 - RNA, 19 nt, Human
gcagccuguccugggcugg

SEQ ID NO: 2562799 - RNA, 14 nt, Human
gcagccuguggcau

SEQ ID NO: 2562800 - RNA, 16 nt, Human
gcagccuguggcaucu

SEQ ID NO: 2562801 - RNA, 22 nt, Human
gcagccuguggcaucuuugccu

SEQ ID NO: 2562802 - RNA, 18 nt, Human
gcagcuuuaaccauuaaa

SEQ ID NO: 2562803 - RNA, 22 nt, Human
gcagcuuuaaacucagggacag

SEQ ID NO: 2562804 - RNA, 21 nt, Human
gcagcuuuaaacucagggaca

SEQ ID NO: 2562805 - RNA, 20 nt, Human
gcagcuuuaaacucagggac

SEQ ID NO: 2562806 - RNA, 19 nt, Human
gcagcuuuaaacucaggga

SEQ ID NO: 2562807 - RNA, 17 nt, Human
gcagcuuuaaacucagg

SEQ ID NO: 2562808 - RNA, 15 nt, Human
gcagcucaccucucc

SEQ ID NO: 2562809 - RNA, 14 nt, Human
gcagcuugccccgg

SEQ ID NO: 2562810 - RNA, 21 nt, Human
gcagcuugcguuagaaugagg

SEQ ID NO: 2562811 - RNA, 23 nt, Human
gcagcucaagcagcgaccgcccc

SEQ ID NO: 2562812 - RNA, 15 nt, Human
gcagcucaaaggcac

SEQ ID NO: 2562813 - RNA, 15 nt, Human
gcagccuuggcaaac

SEQ ID NO: 2562814 - RNA, 13 nt, Human
gcagcgccuuucc

SEQ ID NO: 2562815 - RNA, 15 nt, Human
gcagcgccuuuccca

SEQ ID NO: 2562816 - RNA, 18 nt, Human
gcagccuuugccuccccg

SEQ ID NO: 2562817 - RNA, 15 nt, Human
gcagccuuuaaugca

SEQ ID NO: 2562818 - RNA, 17 nt, Human
gcagccuuugccucccc

SEQ ID NO: 2562819 - RNA, 14 nt, Human
gcagcucaccucuc

SEQ ID NO: 2562820 - RNA, 17 nt, Human
gcagcgcggggagcccg

SEQ ID NO: 2562821 - RNA, 14 nt, Human
gcagcucaaaggca

SEQ ID NO: 2562822 - RNA, 17 nt, Human
gcagcucaaaggcacag

SEQ ID NO: 2562823 - RNA, 14 nt, Human
gcagcuaguuuucu

SEQ ID NO: 2562824 - RNA, 21 nt, Human
gcagcggggcgaagcccaggc

SEQ ID NO: 2562825 - RNA, 14 nt, Human
gcaggcagccaggc

SEQ ID NO: 2562826 - RNA, 13 nt, Human
gcaggcagccagg

SEQ ID NO: 2562827 - RNA, 12 nt, Human
gcaggcagccag

SEQ ID NO: 2562828 - RNA, 16 nt, Human
gcaggaggccccuggc

SEQ ID NO: 2562829 - RNA, 14 nt, Human
gcaggaggccccug

SEQ ID NO: 2562830 - RNA, 17 nt, Human
gcaggaggccaggccgg

SEQ ID NO: 2562831 - RNA, 19 nt, Human
gcaggaggccccuggccca

SEQ ID NO: 2562832 - RNA, 18 nt, Human
gcaggaggccccuggccc

SEQ ID NO: 2562833 - RNA, 22 nt, Human
gcaggaggccccuggcccagcg

SEQ ID NO: 2562834 - RNA, 15 nt, Human
gcaggaggccaggcc

SEQ ID NO: 2562835 - RNA, 16 nt, Human
gcaggaggccaggccg

SEQ ID NO: 2562836 - RNA, 14 nt, Human
gcaggaggccaggc

SEQ ID NO: 2562837 - RNA, 23 nt, Human
gcaggaggauugcuugagcccag

SEQ ID NO: 2562838 - RNA, 13 nt, Human
gcaggcagacacg

SEQ ID NO: 2562839 - RNA, 12 nt, Human
gcaggcagacac

SEQ ID NO: 2562840 - RNA, 11 nt, Human
gcaggcagaca

SEQ ID NO: 2562841 - RNA, 10 nt, Human
gcaggcagac

SEQ ID NO: 2562842 - RNA, 23 nt, Human
gcaggcagacacggaucugagaa

SEQ ID NO: 2562843 - RNA, 20 nt, Human
gcaggcagacacggaucuga

SEQ ID NO: 2562844 - RNA, 20 nt, Human
gcaggcacucaaugcagcca

SEQ ID NO: 2562845 - RNA, 15 nt, Human
gcaggcaccuuagug

SEQ ID NO: 2562846 - RNA, 20 nt, Human
gcaggcaccuuaguggcuuu

SEQ ID NO: 2562847 - RNA, 18 nt, Human
gcaggcacagcacaggga

SEQ ID NO: 2562848 - RNA, 15 nt, Human
gcaggcacagcacag

SEQ ID NO: 2562849 - RNA, 15 nt, Human
gcaggcacauggagg

SEQ ID NO: 2562850 - RNA, 22 nt, Human
gcagcuuuaaccauuaaaacug

SEQ ID NO: 2562851 - RNA, 21 nt, Human
gcagcuuuaaccauuaaaacu

SEQ ID NO: 2562852 - RNA, 23 nt, Human
gcaggaaaaggugauauccauuc

SEQ ID NO: 2562853 - RNA, 21 nt, Human
gcaggaaaugaaaaugucuug

SEQ ID NO: 2562854 - RNA, 16 nt, Human
gcaggaaggagagccu

SEQ ID NO: 2562855 - RNA, 17 nt, Human
gcaggaaggagagccug

SEQ ID NO: 2562856 - RNA, 23 nt, Human
gcaggaaggagagccugcugcau

SEQ ID NO: 2562857 - RNA, 20 nt, Human
gcaggaaggcugagaggaga

SEQ ID NO: 2562858 - RNA, 17 nt, Human
gcaggaauguguggcag

SEQ ID NO: 2562859 - RNA, 17 nt, Human
gcaggacaacgaggaag

SEQ ID NO: 2562860 - RNA, 20 nt, Human
gcaggaggaucacuugaguc

SEQ ID NO: 2562861 - RNA, 23 nt, Human
gcaggaggaucacuugaguccag

SEQ ID NO: 2562862 - RNA, 18 nt, Human
gcaggacaacgaggaagc

SEQ ID NO: 2562863 - RNA, 19 nt, Human
gcaggacaacgaggaagcc

SEQ ID NO: 2562864 - RNA, 14 nt, Human
gcaggaggauugcu

SEQ ID NO: 2562865 - RNA, 15 nt, Human
gcauuauugcauuau

SEQ ID NO: 2562866 - RNA, 14 nt, Human
gcauuauugcauua

SEQ ID NO: 2562867 - RNA, 17 nt, Human
gcauuaucuagauacug

SEQ ID NO: 2562868 - RNA, 18 nt, Human
gcauuauauuuguaaauu

SEQ ID NO: 2562869 - RNA, 19 nt, Human
gcauuauauaccauuuauc

SEQ ID NO: 2562870 - RNA, 15 nt, Human
gcauuauauaccauu

SEQ ID NO: 2562871 - RNA, 21 nt, Human
gcauucuugguuggcuggccu

SEQ ID NO: 2562872 - RNA, 20 nt, Human
gcauucugccgugugcccuc

SEQ ID NO: 2562873 - RNA, 22 nt, Human
gcauucugccgugugcccucgg

SEQ ID NO: 2562874 - RNA, 22 nt, Human
gcauucaauuuauucaagaaaa

SEQ ID NO: 2562875 - RNA, 16 nt, Human
gcauucagagagcagc

SEQ ID NO: 2562876 - RNA, 13 nt, Human
gcauucagagagc

SEQ ID NO: 2562877 - RNA, 12 nt, Human
gcauucacccag

SEQ ID NO: 2562878 - RNA, 15 nt, Human
gcauucacccagaca

SEQ ID NO: 2562879 - RNA, 19 nt, Human
gcauucacccagacagcuc

SEQ ID NO: 2562880 - RNA, 20 nt, Human
gcauucacccagacagcucc

SEQ ID NO: 2562881 - RNA, 16 nt, Human
gcauucuuuuaaaaga

SEQ ID NO: 2562882 - RNA, 18 nt, Human
gcauucuuucuguauuga

SEQ ID NO: 2562883 - RNA, 13 nt, Human
gcauucuuucugu

SEQ ID NO: 2562884 - RNA, 17 nt, Human
gcauucuugguuggcug

SEQ ID NO: 2562885 - RNA, 21 nt, Human
gcauucuuuuaaaagacaaga

SEQ ID NO: 2562886 - RNA, 20 nt, Human
gcauucuuuuaaaagacaag

SEQ ID NO: 2562887 - RNA, 12 nt, Human
gcauugaacaca

SEQ ID NO: 2562888 - RNA, 16 nt, Human
gcauugaacacaaacu

SEQ ID NO: 2562889 - RNA, 18 nt, Human
gcauugaacacaaacugu

SEQ ID NO: 2562890 - RNA, 19 nt, Human
gcauugaacacaaacugua

SEQ ID NO: 2562891 - RNA, 14 nt, Human
gcauuugaguuuau

SEQ ID NO: 2562892 - RNA, 23 nt, Human
gcauuugcucuuucaucucugcu

SEQ ID NO: 2562893 - RNA, 21 nt, Human
gcauuugaggucuguucuuuc

SEQ ID NO: 2562894 - RNA, 13 nt, Human
gcauuugcugaau

SEQ ID NO: 2562895 - RNA, 16 nt, Human
gcauuuguuugaacug

SEQ ID NO: 2562896 - RNA, 14 nt, Human
gcauuugcugaaua

SEQ ID NO: 2562897 - RNA, 13 nt, Human
gcauuugugaggc

SEQ ID NO: 2562898 - RNA, 12 nt, Human
gccaaaggaagc

SEQ ID NO: 2562899 - RNA, 15 nt, Human
gccaaauuauuugug

SEQ ID NO: 2562900 - RNA, 11 nt, Human
gccaaauuauu

SEQ ID NO: 2562901 - RNA, 20 nt, Human
gccaaagcuaggguggcccu

SEQ ID NO: 2562902 - RNA, 14 nt, Human
gccaaaccucuguu

SEQ ID NO: 2562903 - RNA, 15 nt, Human
gccaaaccucuguuc

SEQ ID NO: 2562904 - RNA, 16 nt, Human
gccaaaccucuguuca

SEQ ID NO: 2562905 - RNA, 17 nt, Human
gccaaaccucuguucag

SEQ ID NO: 2562906 - RNA, 19 nt, Human
gccaaaccucuguucagug

SEQ ID NO: 2562907 - RNA, 22 nt, Human
gccaaaccucuguucaguguaa

SEQ ID NO: 2562908 - RNA, 16 nt, Human
gccaaagcuagggugg

SEQ ID NO: 2562909 - RNA, 22 nt, Human
gccaaagcuaggccuggccaga

SEQ ID NO: 2562910 - RNA, 16 nt, Human
gccaaagcuaggccug

SEQ ID NO: 2562911 - RNA, 20 nt, Human
gccaaagccaaagcuaggcc

SEQ ID NO: 2562912 - RNA, 13 nt, Human
gccaaagccaaag

SEQ ID NO: 2562913 - RNA, 16 nt, Human
gccaaagccuccucca

SEQ ID NO: 2562914 - RNA, 19 nt, Human
gccaaagccuccuccagcc

SEQ ID NO: 2562915 - RNA, 16 nt, Human
gccaaacucaccugcc

SEQ ID NO: 2562916 - RNA, 14 nt, Human
gccaaacucaccug

SEQ ID NO: 2562917 - RNA, 18 nt, Human
gccaaacccuugucagug

SEQ ID NO: 2562918 - RNA, 13 nt, Human
gccaaaccucugu

SEQ ID NO: 2562919 - RNA, 22 nt, Human
gccaaacccaugaggcaauguc

SEQ ID NO: 2562920 - RNA, 15 nt, Human
gccaaacccugucug

SEQ ID NO: 2562921 - RNA, 16 nt, Human
gccaaaaaaagacagg

SEQ ID NO: 2562922 - RNA, 18 nt, Human
gcauuuguuugaacugau

SEQ ID NO: 2562923 - RNA, 23 nt, Human
gcauuuuguuugguauuguauuu

SEQ ID NO: 2562924 - RNA, 21 nt, Human
gcauuuuguuugguauuguau

SEQ ID NO: 2562925 - RNA, 18 nt, Human
gcauuuuguuugguauug

SEQ ID NO: 2562926 - RNA, 20 nt, Human
gcauuuuugauuuaugcaug

SEQ ID NO: 2562927 - RNA, 16 nt, Human
gcauuuuugcaggagc

SEQ ID NO: 2562928 - RNA, 21 nt, Human
gcauuuuugauuuaugcaugg

SEQ ID NO: 2562929 - RNA, 17 nt, Human
gcauuuuugcaggagca

SEQ ID NO: 2562930 - RNA, 18 nt, Human
gcauuuuugugaaaugaa

SEQ ID NO: 2562931 - RNA, 21 nt, Human
gcauuuuugugaaaugaaaac

SEQ ID NO: 2562932 - RNA, 14 nt, Human
gccaaaaaaagaca

SEQ ID NO: 2562933 - RNA, 13 nt, Human
gcauuauauuuau

SEQ ID NO: 2562934 - RNA, 22 nt, Human
gcauguucucugaggacacuaa

SEQ ID NO: 2562935 - RNA, 21 nt, Human
gcauguucucugaggacacua

SEQ ID NO: 2562936 - RNA, 15 nt, Human
gcauguucucugagg

SEQ ID NO: 2562937 - RNA, 20 nt, Human
gcauggcaaggacugcaggg

SEQ ID NO: 2562938 - RNA, 20 nt, Human
gcauggcacuugcaucugug

SEQ ID NO: 2562939 - RNA, 15 nt, Human
gcauggcacuugcau

SEQ ID NO: 2562940 - RNA, 14 nt, Human
gcauguucucugag

SEQ ID NO: 2562941 - RNA, 15 nt, Human
gcauggagcuggccg

SEQ ID NO: 2562942 - RNA, 12 nt, Human
gcauggagcugg

SEQ ID NO: 2562943 - RNA, 16 nt, Human
gcaugcugcuggacag

SEQ ID NO: 2562944 - RNA, 17 nt, Human
gcauggaguguguauug

SEQ ID NO: 2562945 - RNA, 18 nt, Human
gcauggaguguguauugu

SEQ ID NO: 2562946 - RNA, 19 nt, Human
gcauggaguguguauuguu

SEQ ID NO: 2562947 - RNA, 20 nt, Human
gcauggaguguguauuguuc

SEQ ID NO: 2562948 - RNA, 21 nt, Human
gcauggauguuuuagccauug

SEQ ID NO: 2562949 - RNA, 20 nt, Human
gcauggauauaguuuuacuu

SEQ ID NO: 2562950 - RNA, 22 nt, Human
gcauggaguguguauuguuccc

SEQ ID NO: 2562951 - RNA, 23 nt, Human
gcauggaguguguauuguuccca

SEQ ID NO: 2562952 - RNA, 24 nt, Human
gcauggaguguguauuguucccag

SEQ ID NO: 2562953 - RNA, 20 nt, Human
gcaugcggcccagcccggcu

SEQ ID NO: 2562954 - RNA, 19 nt, Human
gcaugcggcccagcccggc

SEQ ID NO: 2562955 - RNA, 18 nt, Human
gcaugcggcccagcccgg

SEQ ID NO: 2562956 - RNA, 17 nt, Human
gcaugcggcccagcccg

SEQ ID NO: 2562957 - RNA, 16 nt, Human
gcaugcggcccagccc

SEQ ID NO: 2562958 - RNA, 15 nt, Human
gcaugcggcccagcc

SEQ ID NO: 2562959 - RNA, 15 nt, Human
gcaugauuuuguaac

SEQ ID NO: 2562960 - RNA, 14 nt, Human
gcaugcggcccagc

SEQ ID NO: 2562961 - RNA, 18 nt, Human
gcaugcgggcuuccuccu

SEQ ID NO: 2562962 - RNA, 18 nt, Human
gcauggagauagccccac

SEQ ID NO: 2562963 - RNA, 15 nt, Human
gcaugcuggggcaag

SEQ ID NO: 2562964 - RNA, 22 nt, Human
gcaugcucucugcagccagccc

SEQ ID NO: 2562965 - RNA, 23 nt, Human
gcaugcucucugcagccagccca

SEQ ID NO: 2562966 - RNA, 13 nt, Human
gcaugcuggggca

SEQ ID NO: 2562967 - RNA, 15 nt, Human
gcaugcggcccagga

SEQ ID NO: 2562968 - RNA, 13 nt, Human
gcaugcucucugc

SEQ ID NO: 2562969 - RNA, 14 nt, Human
gcaugcucucugca

SEQ ID NO: 2562970 - RNA, 15 nt, Human
gcaugcucucugcag

SEQ ID NO: 2562971 - RNA, 17 nt, Human
gcaugcucucugcagcc

SEQ ID NO: 2562972 - RNA, 18 nt, Human
gcaugcucucugcagcca

SEQ ID NO: 2562973 - RNA, 21 nt, Human
gcaugcucucugcagccagcc

SEQ ID NO: 2562974 - RNA, 21 nt, Human
gcaugaggaacuagccaccaa

SEQ ID NO: 2562975 - RNA, 22 nt, Human
gcaugaggaacuagccaccaac

SEQ ID NO: 2562976 - RNA, 19 nt, Human
gcaugagggaucacagggc

SEQ ID NO: 2562977 - RNA, 20 nt, Human
gcaugagggaucacagggcc

SEQ ID NO: 2562978 - RNA, 21 nt, Human
gcaugagggaucacagggccc

SEQ ID NO: 2562979 - RNA, 17 nt, Human
gcaugaccugugaccag

SEQ ID NO: 2562980 - RNA, 16 nt, Human
gcaugaccugugacca

SEQ ID NO: 2562981 - RNA, 22 nt, Human
gcaugaccugugaccagcacug

SEQ ID NO: 2562982 - RNA, 20 nt, Human
gcaugauguuaaccagaaua

SEQ ID NO: 2562983 - RNA, 23 nt, Human
gcaugauagacacauaugagggg

SEQ ID NO: 2562984 - RNA, 20 nt, Human
gcaucaccuuaggcagggaa

SEQ ID NO: 2562985 - RNA, 15 nt, Human
gcaucaccuccacca

SEQ ID NO: 2562986 - RNA, 18 nt, Human
gcaucaccuuaggcaggg

SEQ ID NO: 2562987 - RNA, 22 nt, Human
gcaucaccuuaggcagggaagu

SEQ ID NO: 2562988 - RNA, 12 nt, Human
gcaucagcugcu

SEQ ID NO: 2562989 - RNA, 14 nt, Human
gcaucucuugaggc

SEQ ID NO: 2562990 - RNA, 16 nt, Human
gcaucucuugaggcca

SEQ ID NO: 2562991 - RNA, 16 nt, Human
gcaucugaaaauugau

SEQ ID NO: 2562992 - RNA, 17 nt, Human
gcaucucuugaggccag

SEQ ID NO: 2562993 - RNA, 18 nt, Human
gcaucucuugaggccagg

SEQ ID NO: 2562994 - RNA, 20 nt, Human
gcaucucuugaggccaggag

SEQ ID NO: 2562995 - RNA, 21 nt, Human
gcaucucuugaggccaggagu

SEQ ID NO: 2562996 - RNA, 19 nt, Human
gcaucugacucacaagaag

SEQ ID NO: 2562997 - RNA, 17 nt, Human
gcaucugacucacaaga

SEQ ID NO: 2562998 - RNA, 15 nt, Human
gcaucuuacugaagg

SEQ ID NO: 2562999 - RNA, 12 nt, Human
gcaucugcaccc

SEQ ID NO: 2563000 - RNA, 13 nt, Human
gcaucuguucugg

SEQ ID NO: 2563001 - RNA, 15 nt, Human
gcaucugaccagcag

SEQ ID NO: 2563002 - RNA, 17 nt, Human
gcaucugaccagcagcg

SEQ ID NO: 2563003 - RNA, 18 nt, Human
gcaucugaccagcagcgc

SEQ ID NO: 2563004 - RNA, 20 nt, Human
gcaucugaccagcagcgccu

SEQ ID NO: 2563005 - RNA, 14 nt, Human
gcaucugaccagca

SEQ ID NO: 2563006 - RNA, 22 nt, Human
gcaucuuugccuugggcugcuc

SEQ ID NO: 2563007 - RNA, 23 nt, Human
gcaucuuugccuugggcugcucc

SEQ ID NO: 2563008 - RNA, 18 nt, Human
gcaugaaguaauaugcac

SEQ ID NO: 2563009 - RNA, 20 nt, Human
gcaugaacauguacuguucu

SEQ ID NO: 2563010 - RNA, 13 nt, Human
gcaugaagguuuc

SEQ ID NO: 2563011 - RNA, 21 nt, Human
gcaucuuccagaagugugauu

SEQ ID NO: 2563012 - RNA, 13 nt, Human
gcaucuuccagaa

SEQ ID NO: 2563013 - RNA, 16 nt, Human
gcaucuuacugaaggu

SEQ ID NO: 2563014 - RNA, 23 nt, Human
gcaucuuacugaagguaaaauug

SEQ ID NO: 2563015 - RNA, 23 nt, Human
gcaucuucuggagucuccagugg

SEQ ID NO: 2563016 - RNA, 20 nt, Human
gcaucuucuggagucuccag

SEQ ID NO: 2563017 - RNA, 19 nt, Human
gcaucuucuggagucucca

SEQ ID NO: 2563018 - RNA, 13 nt, Human
gcaucuucuccau

SEQ ID NO: 2563019 - RNA, 17 nt, Human
gcaucuuccagaagugu

SEQ ID NO: 2563020 - RNA, 14 nt, Human
gcaucuucuccauc

SEQ ID NO: 2563021 - RNA, 13 nt, Human
gcaucuuugccuu

SEQ ID NO: 2563022 - RNA, 15 nt, Human
gcaucuuugccuugg

SEQ ID NO: 2563023 - RNA, 18 nt, Human
gcaucuuugccuugggcu

SEQ ID NO: 2563024 - RNA, 22 nt, Human
gcaucuuggggggguggccgcu

SEQ ID NO: 2563025 - RNA, 22 nt, Human
gcaucuugguccaggaaaugug

SEQ ID NO: 2563026 - RNA, 13 nt, Human
gcauagaaguaaa

SEQ ID NO: 2563027 - RNA, 17 nt, Human
gcaguucugaagaagau

SEQ ID NO: 2563028 - RNA, 19 nt, Human
gcaguucugggugcucccu

SEQ ID NO: 2563029 - RNA, 15 nt, Human
gcaguucugaagaag

SEQ ID NO: 2563030 - RNA, 20 nt, Human
gcagugucuuccauaaugua

SEQ ID NO: 2563031 - RNA, 17 nt, Human
gcaguuauuaacacuaa

SEQ ID NO: 2563032 - RNA, 15 nt, Human
gcagugggagcugcc

SEQ ID NO: 2563033 - RNA, 14 nt, Human
gcagugggagcugc

SEQ ID NO: 2563034 - RNA, 12 nt, Human
gcagugggagcu

SEQ ID NO: 2563035 - RNA, 13 nt, Human
gcagugggagcug

SEQ ID NO: 2563036 - RNA, 22 nt, Human
gcaguggugguuuucuguucuu

SEQ ID NO: 2563037 - RNA, 23 nt, Human
gcaguggugguuuucuguucuuu

SEQ ID NO: 2563038 - RNA, 18 nt, Human
gcaguguagcccacacuu

SEQ ID NO: 2563039 - RNA, 18 nt, Human
gcagugucaucagaagau

SEQ ID NO: 2563040 - RNA, 24 nt, Human
gcagugguuuuggcaaacgcuaaa

SEQ ID NO: 2563041 - RNA, 18 nt, Human
gcagugguguggagaagc

SEQ ID NO: 2563042 - RNA, 12 nt, Human
gcagugugaaaa

SEQ ID NO: 2563043 - RNA, 11 nt, Human
gcagugucuuc

SEQ ID NO: 2563044 - RNA, 14 nt, Human
gcagugucuuccau

SEQ ID NO: 2563045 - RNA, 15 nt, Human
gcagugucuuccaua

SEQ ID NO: 2563046 - RNA, 16 nt, Human
gcagugucuuccauaa

SEQ ID NO: 2563047 - RNA, 14 nt, Human
gcauaucacuugau

SEQ ID NO: 2563048 - RNA, 22 nt, Human
gcauaucagucucugagggcuu

SEQ ID NO: 2563049 - RNA, 21 nt, Human
gcauaucagucucugagggcu

SEQ ID NO: 2563050 - RNA, 16 nt, Human
gcauauccugagccau

SEQ ID NO: 2563051 - RNA, 18 nt, Human
gcauauccaccaccuccc

SEQ ID NO: 2563052 - RNA, 15 nt, Human
gcauauccugagcca

SEQ ID NO: 2563053 - RNA, 19 nt, Human
gcauagaugcaggugagcc

SEQ ID NO: 2563054 - RNA, 22 nt, Human
gcauagagguaccagcaauaug

SEQ ID NO: 2563055 - RNA, 21 nt, Human
gcauaggugaucucauuuaau

SEQ ID NO: 2563056 - RNA, 16 nt, Human
gcauagaugcagguga

SEQ ID NO: 2563057 - RNA, 20 nt, Human
gcauaguaccaaucauuuua

SEQ ID NO: 2563058 - RNA, 20 nt, Human
gcauaguauuccauugugug

SEQ ID NO: 2563059 - RNA, 21 nt, Human
gcauaguauuccauuguguga

SEQ ID NO: 2563060 - RNA, 22 nt, Human
gcauaguauuccauugugugag

SEQ ID NO: 2563061 - RNA, 23 nt, Human
gcauaguauuccauugugugagu

SEQ ID NO: 2563062 - RNA, 18 nt, Human
gcauaguucccauguuaa

SEQ ID NO: 2563063 - RNA, 17 nt, Human
gcauagguuuaauaauu

SEQ ID NO: 2563064 - RNA, 15 nt, Human
gcaguugaaaagacu

SEQ ID NO: 2563065 - RNA, 21 nt, Human
gcauacuucaaaaguauuuuc

SEQ ID NO: 2563066 - RNA, 22 nt, Human
gcauacuucaaaaguauuuucc

SEQ ID NO: 2563067 - RNA, 13 nt, Human
gcaguucaccugc

SEQ ID NO: 2563068 - RNA, 22 nt, Human
gcauagaggcuucuccgccagc

SEQ ID NO: 2563069 - RNA, 16 nt, Human
gcauagaggcuucucc

SEQ ID NO: 2563070 - RNA, 15 nt, Human
gcauagaaggcaggu

SEQ ID NO: 2563071 - RNA, 13 nt, Human
gcauacuuuuuaa

SEQ ID NO: 2563072 - RNA, 14 nt, Human
gcauagaaggcagg

SEQ ID NO: 2563073 - RNA, 22 nt, Human
gcauaucugccuuuauuguguu

SEQ ID NO: 2563074 - RNA, 21 nt, Human
gcauaucugccuuuauugugu

SEQ ID NO: 2563075 - RNA, 18 nt, Human
gcauaucugccuuuauug

SEQ ID NO: 2563076 - RNA, 16 nt, Human
gcauaucugccuuuau

SEQ ID NO: 2563077 - RNA, 15 nt, Human
gcauaucugccuuua

SEQ ID NO: 2563078 - RNA, 14 nt, Human
gcauaucugccuuu

SEQ ID NO: 2563079 - RNA, 12 nt, Human
gcauaucugccu

SEQ ID NO: 2563080 - RNA, 19 nt, Human
gcauauuuauaaaaauaaa

SEQ ID NO: 2563081 - RNA, 23 nt, Human
gcauauuuauagcaauccauguu

SEQ ID NO: 2563082 - RNA, 18 nt, Human
gcauauuuguauaguugc

SEQ ID NO: 2563083 - RNA, 14 nt, Human
gcauauuuguauag

SEQ ID NO: 2563084 - RNA, 13 nt, Human
gcaucaaaagaca

SEQ ID NO: 2563085 - RNA, 15 nt, Human
gcaucaccucaggcc

SEQ ID NO: 2563086 - RNA, 17 nt, Human
gcaucaccucaggccag

SEQ ID NO: 2563087 - RNA, 14 nt, Human
gcaucaccucaggc

SEQ ID NO: 2563088 - RNA, 14 nt, Human
gcaucaaaagacaa

SEQ ID NO: 2563089 - RNA, 23 nt, Human
gcagggucuuuucaucugggaaa

SEQ ID NO: 2563090 - RNA, 21 nt, Human
gcagggucuuuucaucuggga

SEQ ID NO: 2563091 - RNA, 16 nt, Human
gcagggucuuuucauc

SEQ ID NO: 2563092 - RNA, 15 nt, Human
gcagggucuuuucau

SEQ ID NO: 2563093 - RNA, 20 nt, Human
gcagggucugggcaggacuc

SEQ ID NO: 2563094 - RNA, 17 nt, Human
gcagggucugggcagga

SEQ ID NO: 2563095 - RNA, 14 nt, Human
gcagggucugggca

SEQ ID NO: 2563096 - RNA, 18 nt, Human
gcagggucucacucuguc

SEQ ID NO: 2563097 - RNA, 12 nt, Human
gcaggggcucug

SEQ ID NO: 2563098 - RNA, 19 nt, Human
gcaggggcuacaagaggga

SEQ ID NO: 2563099 - RNA, 17 nt, Human
gcaggggcuacaagagg

SEQ ID NO: 2563100 - RNA, 19 nt, Human
gcaggggcguggagggcgu

SEQ ID NO: 2563101 - RNA, 20 nt, Human
gcaggggccuggagauccuc

SEQ ID NO: 2563102 - RNA, 16 nt, Human
gcaggggccuggagau

SEQ ID NO: 2563103 - RNA, 17 nt, Human
gcagggucucacucugu

SEQ ID NO: 2563104 - RNA, 22 nt, Human
gcagggcucagcggggacagcu

SEQ ID NO: 2563105 - RNA, 14 nt, Human
gcagggcucagcgg

SEQ ID NO: 2563106 - RNA, 24 nt, Human
gcaggggauggcguggucaagcac

SEQ ID NO: 2563107 - RNA, 21 nt, Human
gcagggccuagcugcuacaaa

SEQ ID NO: 2563108 - RNA, 14 nt, Human
gcaggggccuggag

SEQ ID NO: 2563109 - RNA, 13 nt, Human
gcaggggccugga

SEQ ID NO: 2563110 - RNA, 16 nt, Human
gcaggcagccaggcca

SEQ ID NO: 2563111 - RNA, 15 nt, Human
gcaggcagccaggcc

SEQ ID NO: 2563112 - RNA, 13 nt, Human
gcagggcagucau

SEQ ID NO: 2563113 - RNA, 14 nt, Human
gcagggcaucuccu

SEQ ID NO: 2563114 - RNA, 15 nt, Human
gcagggcaucuccug

SEQ ID NO: 2563115 - RNA, 19 nt, Human
gcagggcaucuccugugca

SEQ ID NO: 2563116 - RNA, 21 nt, Human
gcagggcaucuccugugcaug

SEQ ID NO: 2563117 - RNA, 19 nt, Human
gcagggccaggacugagcc

SEQ ID NO: 2563118 - RNA, 15 nt, Human
gcagggccaggacug

SEQ ID NO: 2563119 - RNA, 14 nt, Human
gcagggccaggacu

SEQ ID NO: 2563120 - RNA, 22 nt, Human
gcagggcaucuccugugcaugg

SEQ ID NO: 2563121 - RNA, 19 nt, Human
gcagggccaacccuucucc

SEQ ID NO: 2563122 - RNA, 21 nt, Human
gcagggcucagcggggacagc

SEQ ID NO: 2563123 - RNA, 19 nt, Human
gcagggcucagcggggaca

SEQ ID NO: 2563124 - RNA, 20 nt, Human
gcagggccuagcugcuacaa

SEQ ID NO: 2563125 - RNA, 17 nt, Human
gcagggccuagcugcua

SEQ ID NO: 2563126 - RNA, 21 nt, Human
gcagggccccaggcauugcca

SEQ ID NO: 2563127 - RNA, 15 nt, Human
gcagugcaugcuguc

SEQ ID NO: 2563128 - RNA, 17 nt, Human
gcaggugagcaaccagu

SEQ ID NO: 2563129 - RNA, 19 nt, Human
gcaggugaccuucugggaa

SEQ ID NO: 2563130 - RNA, 23 nt, Human
gcagugcaagagacucuggccuc

SEQ ID NO: 2563131 - RNA, 22 nt, Human
gcagugcaagagacucuggccu

SEQ ID NO: 2563132 - RNA, 20 nt, Human
gcagugcaagagacucuggc

SEQ ID NO: 2563133 - RNA, 16 nt, Human
gcagugcaugcugucc

SEQ ID NO: 2563134 - RNA, 13 nt, Human
gcagugccucugg

SEQ ID NO: 2563135 - RNA, 23 nt, Human
gcagugccccuagcuuagagccu

SEQ ID NO: 2563136 - RNA, 18 nt, Human
gcagugcaggcacaguau

SEQ ID NO: 2563137 - RNA, 15 nt, Human
gcagugcaggcacag

SEQ ID NO: 2563138 - RNA, 15 nt, Human
gcagugccuuccaua

SEQ ID NO: 2563139 - RNA, 17 nt, Human
gcagugccucuggucug

SEQ ID NO: 2563140 - RNA, 15 nt, Human
gcaguggacaccagg

SEQ ID NO: 2563141 - RNA, 15 nt, Human
gcaggguggugcugg

SEQ ID NO: 2563142 - RNA, 22 nt, Human
gcagggugcaguaucaugcccu

SEQ ID NO: 2563143 - RNA, 19 nt, Human
gcaggguggugcugggacu

SEQ ID NO: 2563144 - RNA, 18 nt, Human
gcaggguggugcugggac

SEQ ID NO: 2563145 - RNA, 17 nt, Human
gcaggguggugcuggga

SEQ ID NO: 2563146 - RNA, 15 nt, Human
gcagggugggaugga

SEQ ID NO: 2563147 - RNA, 14 nt, Human
gcaggguguuggga

SEQ ID NO: 2563148 - RNA, 16 nt, Human
gcagguaaacuccugu

SEQ ID NO: 2563149 - RNA, 15 nt, Human
gcagguaaacaguuc

SEQ ID NO: 2563150 - RNA, 14 nt, Human
gcagguaccacuga

SEQ ID NO: 2563151 - RNA, 22 nt, Human
gcagguccaggguuugaguuca

SEQ ID NO: 2563152 - RNA, 21 nt, Human
gcaggucaacagcuaugcugg

SEQ ID NO: 2563153 - RNA, 21 nt, Human
gcagguagccagggggacuag

SEQ ID NO: 2563154 - RNA, 19 nt, Human
gcagguagccagggggacu

SEQ ID NO: 2563155 - RNA, 20 nt, Human
gcaggucuugaacuccuggc

SEQ ID NO: 2563156 - RNA, 19 nt, Human
gcaggucuugaacuccugg

SEQ ID NO: 2563157 - RNA, 17 nt, Human
gcaggugaccuucuggg

SEQ ID NO: 2563158 - RNA, 13 nt, Human
gcagguccccaga

SEQ ID NO: 2563159 - RNA, 14 nt, Human
gauaauacaccacu

SEQ ID NO: 2563160 - RNA, 18 nt, Human
gauaauacaccacuacau

SEQ ID NO: 2563161 - RNA, 21 nt, Human
gauaauacaccacuacauucu

SEQ ID NO: 2563162 - RNA, 22 nt, Human
gauaauacaccacuacauucug

SEQ ID NO: 2563163 - RNA, 23 nt, Human
gauagauaggucagugcaaauac

SEQ ID NO: 2563164 - RNA, 21 nt, Human
gauacacccaaaguaucagga

SEQ ID NO: 2563165 - RNA, 16 nt, Human
gauaaguguauuuuuc

SEQ ID NO: 2563166 - RNA, 19 nt, Human
gauacaccgggccuggaga

SEQ ID NO: 2563167 - RNA, 12 nt, Human
gauagaugcugg

SEQ ID NO: 2563168 - RNA, 16 nt, Human
gauagaugcuggccca

SEQ ID NO: 2563169 - RNA, 17 nt, Human
gauagaugcuggcccag

SEQ ID NO: 2563170 - RNA, 18 nt, Human
gauagaugcuggcccagg

SEQ ID NO: 2563171 - RNA, 20 nt, Human
gauagaugcuggcccagggc

SEQ ID NO: 2563172 - RNA, 21 nt, Human
gauagaugcuggcccagggcc

SEQ ID NO: 2563173 - RNA, 13 nt, Human
gauagaugugugg

SEQ ID NO: 2563174 - RNA, 19 nt, Human
gauacaggaaaagcugcug

SEQ ID NO: 2563175 - RNA, 20 nt, Human
gauacacugaaguuaacaga

SEQ ID NO: 2563176 - RNA, 22 nt, Human
gauacacugaaguuaacagaga

SEQ ID NO: 2563177 - RNA, 18 nt, Human
gauacaggaaaagcugcu

SEQ ID NO: 2563178 - RNA, 22 nt, Human
gauagcacagacccugcccugu

SEQ ID NO: 2563179 - RNA, 21 nt, Human
gauagcacagacccugcccug

SEQ ID NO: 2563180 - RNA, 13 nt, Human
gauagcagggcau

SEQ ID NO: 2563181 - RNA, 20 nt, Human
gauagcacagacccugcccu

SEQ ID NO: 2563182 - RNA, 20 nt, Human
gauagcacuuucuacaaugu

SEQ ID NO: 2563183 - RNA, 12 nt, Human
gauagcacuuuc

SEQ ID NO: 2563184 - RNA, 19 nt, Human
gauagcacugagcaaagca

SEQ ID NO: 2563185 - RNA, 21 nt, Human
gaggaaggaaacccagcucug

SEQ ID NO: 2563186 - RNA, 20 nt, Human
gaggaaggaaacccagcucu

SEQ ID NO: 2563187 - RNA, 19 nt, Human
gaggaaggaaacccagcuc

SEQ ID NO: 2563188 - RNA, 13 nt, Human
gaggaaggaaacc

SEQ ID NO: 2563189 - RNA, 17 nt, Human
gauaaaguaguaaaaau

SEQ ID NO: 2563190 - RNA, 15 nt, Human
gauaaaguaguaaaa

SEQ ID NO: 2563191 - RNA, 19 nt, Human
gauaaagccacugaaaauu

SEQ ID NO: 2563192 - RNA, 17 nt, Human
gauaaagccacugaaaa

SEQ ID NO: 2563193 - RNA, 19 nt, Human
gauaaaguugguaaaccuu

SEQ ID NO: 2563194 - RNA, 13 nt, Human
gauaaagauuucu

SEQ ID NO: 2563195 - RNA, 16 nt, Human
gauaaagauuucuuga

SEQ ID NO: 2563196 - RNA, 22 nt, Human
gaggaagccagguccacggucu

SEQ ID NO: 2563197 - RNA, 22 nt, Human
gaggaagcagaauaaagcaauu

SEQ ID NO: 2563198 - RNA, 19 nt, Human
gaggaagcccuaagacguc

SEQ ID NO: 2563199 - RNA, 20 nt, Human
gaggaagcgugaaggccgag

SEQ ID NO: 2563200 - RNA, 13 nt, Human
gauaaagaugauc

SEQ ID NO: 2563201 - RNA, 22 nt, Human
gauaaagaugcaaggaccagga

SEQ ID NO: 2563202 - RNA, 22 nt, Human
gauaaauaguuuaugauuccac

SEQ ID NO: 2563203 - RNA, 21 nt, Human
gauaaauaacuuuuuuuuaag

SEQ ID NO: 2563204 - RNA, 16 nt, Human
gauaaauaacuuuuuu

SEQ ID NO: 2563205 - RNA, 15 nt, Human
gauaaauauuauauu

SEQ ID NO: 2563206 - RNA, 15 nt, Human
gauaaaguuucucag

SEQ ID NO: 2563207 - RNA, 14 nt, Human
gauaaaguuucuca

SEQ ID NO: 2563208 - RNA, 16 nt, Human
gauaaaguuucucaga

SEQ ID NO: 2563209 - RNA, 18 nt, Human
gauaaauaaucggcccac

SEQ ID NO: 2563210 - RNA, 22 nt, Human
gauaaauauuauauuauauaua

SEQ ID NO: 2563211 - RNA, 23 nt, Human
gauaagguaccuuucacauagag

SEQ ID NO: 2563212 - RNA, 22 nt, Human
gauaagaguagaaacugcaggg

SEQ ID NO: 2563213 - RNA, 20 nt, Human
gauaagagggcacacacugu

SEQ ID NO: 2563214 - RNA, 12 nt, Human
gauaaagaugau

SEQ ID NO: 2563215 - RNA, 12 nt, Human
gaucaugcauug

SEQ ID NO: 2563216 - RNA, 13 nt, Human
gaucaugcauugu

SEQ ID NO: 2563217 - RNA, 14 nt, Human
gaucaugcauuguu

SEQ ID NO: 2563218 - RNA, 15 nt, Human
gaucaugcauuguug

SEQ ID NO: 2563219 - RNA, 23 nt, Human
gaucaugguguaauaagacauaa

SEQ ID NO: 2563220 - RNA, 21 nt, Human
gaucaugguguaauaagacau

SEQ ID NO: 2563221 - RNA, 20 nt, Human
gaucaugguguaauaagaca

SEQ ID NO: 2563222 - RNA, 18 nt, Human
gaucaugguguaauaaga

SEQ ID NO: 2563223 - RNA, 15 nt, Human
gaucaugguguaaua

SEQ ID NO: 2563224 - RNA, 14 nt, Human
gaucauggcaucca

SEQ ID NO: 2563225 - RNA, 14 nt, Human
gaucaugguguaau

SEQ ID NO: 2563226 - RNA, 21 nt, Human
gaucauccacugugccaugug

SEQ ID NO: 2563227 - RNA, 21 nt, Human
gaucauccuuuccagcaugag

SEQ ID NO: 2563228 - RNA, 16 nt, Human
gaucauccacugugcc

SEQ ID NO: 2563229 - RNA, 19 nt, Human
gaucauccacugugccaug

SEQ ID NO: 2563230 - RNA, 17 nt, Human
gaucauccacugugcca

SEQ ID NO: 2563231 - RNA, 20 nt, Human
gaucaguauaauuuuuuaaa

SEQ ID NO: 2563232 - RNA, 23 nt, Human
gaucagugggccuccaaggaggg

SEQ ID NO: 2563233 - RNA, 23 nt, Human
gaucaguccuuugaucaguauaa

SEQ ID NO: 2563234 - RNA, 20 nt, Human
gaucaguguaccauuugccu

SEQ ID NO: 2563235 - RNA, 18 nt, Human
gaucaguuauaaguagca

SEQ ID NO: 2563236 - RNA, 20 nt, Human
gauccccaagccuggcaagg

SEQ ID NO: 2563237 - RNA, 13 nt, Human
gaucauuuucuua

SEQ ID NO: 2563238 - RNA, 18 nt, Human
gaucauuuuccccccacu

SEQ ID NO: 2563239 - RNA, 19 nt, Human
gaucauuuuccccccacuc

SEQ ID NO: 2563240 - RNA, 20 nt, Human
gauccccaagugugaacaaa

SEQ ID NO: 2563241 - RNA, 18 nt, Human
gauccccaagugugaaca

SEQ ID NO: 2563242 - RNA, 14 nt, Human
gauccccaagugug

SEQ ID NO: 2563243 - RNA, 21 nt, Human
gaucauuugcccuuaaggaca

SEQ ID NO: 2563244 - RNA, 23 nt, Human
gaucauuuuccccccacucuccc

SEQ ID NO: 2563245 - RNA, 14 nt, Human
gaucauuaucagcc

SEQ ID NO: 2563246 - RNA, 14 nt, Human
gaucauugugaaau

SEQ ID NO: 2563247 - RNA, 20 nt, Human
gaucauugugaaauuauuca

SEQ ID NO: 2563248 - RNA, 18 nt, Human
gaucauuuguuggaauga

SEQ ID NO: 2563249 - RNA, 14 nt, Human
gaucauuuuccccc

SEQ ID NO: 2563250 - RNA, 15 nt, Human
gaucauuuucccccc

SEQ ID NO: 2563251 - RNA, 22 nt, Human
gaucagucugauucccaagcuc

SEQ ID NO: 2563252 - RNA, 11 nt, Human
gaucaggucau

SEQ ID NO: 2563253 - RNA, 13 nt, Human
gaucaggugggga

SEQ ID NO: 2563254 - RNA, 14 nt, Human
gaucagguggggag

SEQ ID NO: 2563255 - RNA, 12 nt, Human
gaucagccuggg

SEQ ID NO: 2563256 - RNA, 15 nt, Human
gaucagccugggcaa

SEQ ID NO: 2563257 - RNA, 22 nt, Human
gaucacgcuccccgccuguucc

SEQ ID NO: 2563258 - RNA, 14 nt, Human
gaucacgcuccccg

SEQ ID NO: 2563259 - RNA, 13 nt, Human
gaucacgcucccc

SEQ ID NO: 2563260 - RNA, 15 nt, Human
gaucagauugcaugu

SEQ ID NO: 2563261 - RNA, 19 nt, Human
gaucagcaaaccggggccu

SEQ ID NO: 2563262 - RNA, 23 nt, Human
gaucagauugcaugugacucuga

SEQ ID NO: 2563263 - RNA, 12 nt, Human
gaucacggcuca

SEQ ID NO: 2563264 - RNA, 15 nt, Human
gaucaauuaaaugua

SEQ ID NO: 2563265 - RNA, 16 nt, Human
gaucaauuaaauguag

SEQ ID NO: 2563266 - RNA, 23 nt, Human
gaucacgccacugcacuccagcc

SEQ ID NO: 2563267 - RNA, 24 nt, Human
gaucacgccacugcacuccagccu

SEQ ID NO: 2563268 - RNA, 14 nt, Human
gaucaauaaaaugu

SEQ ID NO: 2563269 - RNA, 18 nt, Human
gaucaauaaaaugugauu

SEQ ID NO: 2563270 - RNA, 21 nt, Human
gaucaauaaaaugugauuuuu

SEQ ID NO: 2563271 - RNA, 23 nt, Human
gaucaauggcgcagugccucugg

SEQ ID NO: 2563272 - RNA, 22 nt, Human
gaucaauggcgcagugccucug

SEQ ID NO: 2563273 - RNA, 18 nt, Human
gaucaaugacagagccuu

SEQ ID NO: 2563274 - RNA, 14 nt, Human
gaucaaugacagag

SEQ ID NO: 2563275 - RNA, 13 nt, Human
gaucaaugaaaug

SEQ ID NO: 2563276 - RNA, 12 nt, Human
gaucaaugacag

SEQ ID NO: 2563277 - RNA, 19 nt, Human
gaucaauaaaaugugauuu

SEQ ID NO: 2563278 - RNA, 18 nt, Human
gaucacgccacugcacua

SEQ ID NO: 2563279 - RNA, 16 nt, Human
gaucacgccacugcac

SEQ ID NO: 2563280 - RNA, 23 nt, Human
gauagugggcaccccacugcaau

SEQ ID NO: 2563281 - RNA, 16 nt, Human
gaucaaggagaggagg

SEQ ID NO: 2563282 - RNA, 18 nt, Human
gaucaaggagaggaggca

SEQ ID NO: 2563283 - RNA, 22 nt, Human
gauagucuuucaguuaaggaga

SEQ ID NO: 2563284 - RNA, 23 nt, Human
gauagucuuuugcuuuuggcaaa

SEQ ID NO: 2563285 - RNA, 15 nt, Human
gauaguaacaaugaa

SEQ ID NO: 2563286 - RNA, 14 nt, Human
gauaguagcuuccu

SEQ ID NO: 2563287 - RNA, 14 nt, Human
gauagcacuuucua

SEQ ID NO: 2563288 - RNA, 14 nt, Human
gauagucuuucagu

SEQ ID NO: 2563289 - RNA, 18 nt, Human
gauaguagcauacauuua

SEQ ID NO: 2563290 - RNA, 16 nt, Human
gauaguauugugcaua

SEQ ID NO: 2563291 - RNA, 22 nt, Human
gauccugagccagauuucacuc

SEQ ID NO: 2563292 - RNA, 21 nt, Human
gauccugagccagauuucacu

SEQ ID NO: 2563293 - RNA, 13 nt, Human
gauccuggaaauc

SEQ ID NO: 2563294 - RNA, 19 nt, Human
gaucccuagcugugaccuc

SEQ ID NO: 2563295 - RNA, 21 nt, Human
gaucccuagcugugaccucuc

SEQ ID NO: 2563296 - RNA, 16 nt, Human
gaucccucauccucau

SEQ ID NO: 2563297 - RNA, 15 nt, Human
gaucccucauccuca

SEQ ID NO: 2563298 - RNA, 17 nt, Human
gauccccucaggacugc

SEQ ID NO: 2563299 - RNA, 15 nt, Human
gaucccuagcuguga

SEQ ID NO: 2563300 - RNA, 21 nt, Human
gaucccgccucuucuucuuca

SEQ ID NO: 2563301 - RNA, 14 nt, Human
gauccccucaggac

SEQ ID NO: 2563302 - RNA, 13 nt, Human
gauccccucagga

SEQ ID NO: 2563303 - RNA, 14 nt, Human
gauccccagcuguu

SEQ ID NO: 2563304 - RNA, 14 nt, Human
gaucucaggggcug

SEQ ID NO: 2563305 - RNA, 15 nt, Human
gaucgugcuaaauuu

SEQ ID NO: 2563306 - RNA, 16 nt, Human
gaucuaucaauaguca

SEQ ID NO: 2563307 - RNA, 18 nt, Human
gaucgucugacugguguu

SEQ ID NO: 2563308 - RNA, 16 nt, Human
gaucgugacgcugaau

SEQ ID NO: 2563309 - RNA, 18 nt, Human
gaucgugcuaaauuuuca

SEQ ID NO: 2563310 - RNA, 20 nt, Human
gaucgugacgcugaauaaau

SEQ ID NO: 2563311 - RNA, 19 nt, Human
gaucgugacgcugaauaaa

SEQ ID NO: 2563312 - RNA, 22 nt, Human
gaucgugacgcugaauaaaugu

SEQ ID NO: 2563313 - RNA, 23 nt, Human
gaucgugccguuacucuccaacc

SEQ ID NO: 2563314 - RNA, 18 nt, Human
gauccugcggguggggcu

SEQ ID NO: 2563315 - RNA, 17 nt, Human
gauccugcggguggggc

SEQ ID NO: 2563316 - RNA, 20 nt, Human
gaucggagccuccucucuca

SEQ ID NO: 2563317 - RNA, 22 nt, Human
gaucggaggcuugucagagcug

SEQ ID NO: 2563318 - RNA, 17 nt, Human
gaucggagccuccucuc

SEQ ID NO: 2563319 - RNA, 23 nt, Human
gaucgcgccacuacacuccagcc

SEQ ID NO: 2563320 - RNA, 21 nt, Human
gaucgcggcggagcuggcccc

SEQ ID NO: 2563321 - RNA, 17 nt, Human
gaucuuugcagacaggc

SEQ ID NO: 2563322 - RNA, 18 nt, Human
gaucuuugcagacaggca

SEQ ID NO: 2563323 - RNA, 21 nt, Human
gaucuuuggacagaagcagcu

SEQ ID NO: 2563324 - RNA, 11 nt, Human
gaucuuugugg

SEQ ID NO: 2563325 - RNA, 14 nt, Human
gaucuuuguggcca

SEQ ID NO: 2563326 - RNA, 16 nt, Human
gaucuuuguggccaag

SEQ ID NO: 2563327 - RNA, 13 nt, Human
gaucuuuggacag

SEQ ID NO: 2563328 - RNA, 18 nt, Human
gaucuguuuugaaggcaa

SEQ ID NO: 2563329 - RNA, 20 nt, Human
gaucuguuguguacguggag

SEQ ID NO: 2563330 - RNA, 19 nt, Human
gaucucaggggcuguuuga

SEQ ID NO: 2563331 - RNA, 18 nt, Human
gaucucaggggcuguuug

SEQ ID NO: 2563332 - RNA, 17 nt, Human
gaucucaggggcuguuu

SEQ ID NO: 2563333 - RNA, 13 nt, Human
gaucucagguucu

SEQ ID NO: 2563334 - RNA, 21 nt, Human
gaucugugaggggcucucuca

SEQ ID NO: 2563335 - RNA, 16 nt, Human
gaucugugcccagaga

SEQ ID NO: 2563336 - RNA, 13 nt, Human
gaucugugcccca

SEQ ID NO: 2563337 - RNA, 21 nt, Human
gaucuguugcaaacucagccu

SEQ ID NO: 2563338 - RNA, 14 nt, Human
gaucuguugcaaac

SEQ ID NO: 2563339 - RNA, 23 nt, Human
gaucugugcuuuccagcucaccc

SEQ ID NO: 2563340 - RNA, 20 nt, Human
gaucugugcuuuccagcuca

SEQ ID NO: 2563341 - RNA, 13 nt, Human
gaucuguuuugaa

SEQ ID NO: 2563342 - RNA, 17 nt, Human
gaucuguuuugaaggca

SEQ ID NO: 2563343 - RNA, 19 nt, Human
gaucugugcuuuccagcuc

SEQ ID NO: 2563344 - RNA, 18 nt, Human
gaucugugcuuuccagcu

SEQ ID NO: 2563345 - RNA, 19 nt, Human
gaucugugcccagagaugg

SEQ ID NO: 2563346 - RNA, 14 nt, Human
gaucugugccccau

SEQ ID NO: 2563347 - RNA, 18 nt, Human
gaucugugccccaugccu

SEQ ID NO: 2563348 - RNA, 15 nt, Human
gaugaaaauauuuaa

SEQ ID NO: 2563349 - RNA, 16 nt, Human
gaugaaaauauuuaaa

SEQ ID NO: 2563350 - RNA, 15 nt, Human
gaucuuuguggccaa

SEQ ID NO: 2563351 - RNA, 14 nt, Human
gaugaaaauauuua

SEQ ID NO: 2563352 - RNA, 14 nt, Human
gaugaaaauauuug

SEQ ID NO: 2563353 - RNA, 17 nt, Human
gaugaaaauauuuaaag

SEQ ID NO: 2563354 - RNA, 22 nt, Human
gaugaacucuuagaaaugaagg

SEQ ID NO: 2563355 - RNA, 18 nt, Human
gaugaacucuuagaaaug

SEQ ID NO: 2563356 - RNA, 20 nt, Human
gaugaaaucuuacagcuggg

SEQ ID NO: 2563357 - RNA, 19 nt, Human
gaugaaaucuuacagcugg

SEQ ID NO: 2563358 - RNA, 18 nt, Human
gaugaaauaacuccuucu

SEQ ID NO: 2563359 - RNA, 14 nt, Human
gaugaaagaggagg

SEQ ID NO: 2563360 - RNA, 19 nt, Human
gaugaaagagaaggugggu

SEQ ID NO: 2563361 - RNA, 20 nt, Human
gaugaagaaaagugggccag

SEQ ID NO: 2563362 - RNA, 14 nt, Human
gaugaagagugaga

SEQ ID NO: 2563363 - RNA, 13 nt, Human
gaugaacuuucuc

SEQ ID NO: 2563364 - RNA, 19 nt, Human
gaugaacuuauucuguaga

SEQ ID NO: 2563365 - RNA, 17 nt, Human
gaugaacuuauucugua

SEQ ID NO: 2563366 - RNA, 21 nt, Human
gaugaagagugagagggcaug

SEQ ID NO: 2563367 - RNA, 15 nt, Human
gaugaagcaaacaca

SEQ ID NO: 2563368 - RNA, 16 nt, Human
gaugaagcaaacacau

SEQ ID NO: 2563369 - RNA, 19 nt, Human
gaugaagcaaacacauuaa

SEQ ID NO: 2563370 - RNA, 22 nt, Human
gauggggcccugccuccuuugu

SEQ ID NO: 2563371 - RNA, 14 nt, Human
gauggggcccugcc

SEQ ID NO: 2563372 - RNA, 13 nt, Human
gauggggcccugc

SEQ ID NO: 2563373 - RNA, 14 nt, Human
gauggcuccucuca

SEQ ID NO: 2563374 - RNA, 20 nt, Human
gauggcugugccucugccug

SEQ ID NO: 2563375 - RNA, 19 nt, Human
gauggcugugccucugccu

SEQ ID NO: 2563376 - RNA, 18 nt, Human
gauggcugugccucugcc

SEQ ID NO: 2563377 - RNA, 17 nt, Human
gauggcugugccucugc

SEQ ID NO: 2563378 - RNA, 13 nt, Human
gauggcugugccu

SEQ ID NO: 2563379 - RNA, 21 nt, Human
gauggcuaguaucaaaagaaa

SEQ ID NO: 2563380 - RNA, 12 nt, Human
gauggcuccucu

SEQ ID NO: 2563381 - RNA, 13 nt, Human
gauggcuccucuc

SEQ ID NO: 2563382 - RNA, 19 nt, Human
gauggcgugggcugcguga

SEQ ID NO: 2563383 - RNA, 21 nt, Human
gauggcuaaaaccaucauagu

SEQ ID NO: 2563384 - RNA, 19 nt, Human
gaugccugguggcagcugc

SEQ ID NO: 2563385 - RNA, 18 nt, Human
gaugccugguggcagcug

SEQ ID NO: 2563386 - RNA, 20 nt, Human
gaugccugguggcagcugcg

SEQ ID NO: 2563387 - RNA, 23 nt, Human
gauggaugccaauauuaaaucug

SEQ ID NO: 2563388 - RNA, 21 nt, Human
gauggauuccaaccccaacuc

SEQ ID NO: 2563389 - RNA, 12 nt, Human
gauggauuccaa

SEQ ID NO: 2563390 - RNA, 22 nt, Human
gauggauuccaaccccaacucc

SEQ ID NO: 2563391 - RNA, 14 nt, Human
gauggauucucaga

SEQ ID NO: 2563392 - RNA, 22 nt, Human
gauggauuuccagccaaagccu

SEQ ID NO: 2563393 - RNA, 15 nt, Human
gauggauuugaagca

SEQ ID NO: 2563394 - RNA, 17 nt, Human
gauggauucuccacuca

SEQ ID NO: 2563395 - RNA, 14 nt, Human
gauggauuugccug

SEQ ID NO: 2563396 - RNA, 19 nt, Human
gauggauuugccugugcca

SEQ ID NO: 2563397 - RNA, 16 nt, Human
gauggauucucagaua

SEQ ID NO: 2563398 - RNA, 18 nt, Human
gauggauucucagauauu

SEQ ID NO: 2563399 - RNA, 19 nt, Human
gauggauucucagauauuu

SEQ ID NO: 2563400 - RNA, 22 nt, Human
gauggauucucagauauuuaua

SEQ ID NO: 2563401 - RNA, 16 nt, Human
gauggcgggugggggu

SEQ ID NO: 2563402 - RNA, 15 nt, Human
gauggcggguggggg

SEQ ID NO: 2563403 - RNA, 14 nt, Human
gauggcgggugggg

SEQ ID NO: 2563404 - RNA, 21 nt, Human
gauggccuggccagggccugg

SEQ ID NO: 2563405 - RNA, 20 nt, Human
gauggccuggccagggccug

SEQ ID NO: 2563406 - RNA, 14 nt, Human
gauggcgcuaggca

SEQ ID NO: 2563407 - RNA, 20 nt, Human
gauggcaaagaaggagagca

SEQ ID NO: 2563408 - RNA, 14 nt, Human
gauggccuggccag

SEQ ID NO: 2563409 - RNA, 13 nt, Human
gauggccugagaa

SEQ ID NO: 2563410 - RNA, 20 nt, Human
gaugccaaguuguuugagaa

SEQ ID NO: 2563411 - RNA, 19 nt, Human
gaugccaauauuaaaucug

SEQ ID NO: 2563412 - RNA, 15 nt, Human
gaugccacacaagga

SEQ ID NO: 2563413 - RNA, 15 nt, Human
gaugccaaccucugg

SEQ ID NO: 2563414 - RNA, 21 nt, Human
gaugccaagaaguuuaaggaa

SEQ ID NO: 2563415 - RNA, 22 nt, Human
gaugccacaccaagcugugcca

SEQ ID NO: 2563416 - RNA, 21 nt, Human
gaugccacaccaagcugugcc

SEQ ID NO: 2563417 - RNA, 19 nt, Human
gaugccacaccaagcugug

SEQ ID NO: 2563418 - RNA, 16 nt, Human
gaugccacaccaagcu

SEQ ID NO: 2563419 - RNA, 15 nt, Human
gaugccacaccaagc

SEQ ID NO: 2563420 - RNA, 22 nt, Human
gaugccaaccucuggagcaaug

SEQ ID NO: 2563421 - RNA, 17 nt, Human
gaugccacacagagugg

SEQ ID NO: 2563422 - RNA, 14 nt, Human
gaugcagccucaca

SEQ ID NO: 2563423 - RNA, 17 nt, Human
gaugcagcaaaauguga

SEQ ID NO: 2563424 - RNA, 19 nt, Human
gaugcagccucacaguccu

SEQ ID NO: 2563425 - RNA, 12 nt, Human
gaugcagccuca

SEQ ID NO: 2563426 - RNA, 16 nt, Human
gaugcagcauuaugau

SEQ ID NO: 2563427 - RNA, 23 nt, Human
gaugcagagguaaaagugugagc

SEQ ID NO: 2563428 - RNA, 23 nt, Human
gaugcagagagccauuuugugaa

SEQ ID NO: 2563429 - RNA, 21 nt, Human
gaugcagcauuuuguauuugu

SEQ ID NO: 2563430 - RNA, 21 nt, Human
gaugcacagaguuguuacauu

SEQ ID NO: 2563431 - RNA, 22 nt, Human
gaugcacagaguuguuacauuu

SEQ ID NO: 2563432 - RNA, 13 nt, Human
gaugcaccagccc

SEQ ID NO: 2563433 - RNA, 16 nt, Human
gaugcaccaccaagcc

SEQ ID NO: 2563434 - RNA, 18 nt, Human
gaugacaugugacuccua

SEQ ID NO: 2563435 - RNA, 17 nt, Human
gaugacaacuucccagu

SEQ ID NO: 2563436 - RNA, 16 nt, Human
gaugaaguuuuacauu

SEQ ID NO: 2563437 - RNA, 20 nt, Human
gaugacaacuggaauaguuu

SEQ ID NO: 2563438 - RNA, 21 nt, Human
gaugacauugcuaagaugcuc

SEQ ID NO: 2563439 - RNA, 18 nt, Human
gaugacauugcuaagaug

SEQ ID NO: 2563440 - RNA, 16 nt, Human
gaugacauugcuaaga

SEQ ID NO: 2563441 - RNA, 15 nt, Human
gaugacauugcuaag

SEQ ID NO: 2563442 - RNA, 14 nt, Human
gaugacauugcuaa

SEQ ID NO: 2563443 - RNA, 14 nt, Human
gaugacagagcgag

SEQ ID NO: 2563444 - RNA, 20 nt, Human
gaugacaugcacucagcucu

SEQ ID NO: 2563445 - RNA, 21 nt, Human
gauugcaauuugcacaaguuu

SEQ ID NO: 2563446 - RNA, 14 nt, Human
gauugcaauuugca

SEQ ID NO: 2563447 - RNA, 21 nt, Human
gauugcaacaggcugggcuuc

SEQ ID NO: 2563448 - RNA, 16 nt, Human
gauugcaccacugcac

SEQ ID NO: 2563449 - RNA, 23 nt, Human
gauugcaccacugcacuccagcc

SEQ ID NO: 2563450 - RNA, 17 nt, Human
gauucuuuccugaggcu

SEQ ID NO: 2563451 - RNA, 16 nt, Human
gauucuuuccugaggc

SEQ ID NO: 2563452 - RNA, 18 nt, Human
gauucuuuccugaggcug

SEQ ID NO: 2563453 - RNA, 20 nt, Human
gauugcaacaggcugggcuu

SEQ ID NO: 2563454 - RNA, 20 nt, Human
gauucccaagcucugcuccu

SEQ ID NO: 2563455 - RNA, 19 nt, Human
gauucccaagcucugcucc

SEQ ID NO: 2563456 - RNA, 15 nt, Human
gauuccuuccuguuc

SEQ ID NO: 2563457 - RNA, 13 nt, Human
gauuccuuccugu

SEQ ID NO: 2563458 - RNA, 21 nt, Human
gauucccaagcucugcuccuc

SEQ ID NO: 2563459 - RNA, 12 nt, Human
gauucuuuccug

SEQ ID NO: 2563460 - RNA, 17 nt, Human
gauucgguaucccccca

SEQ ID NO: 2563461 - RNA, 16 nt, Human
gauucgguaucccccc

SEQ ID NO: 2563462 - RNA, 13 nt, Human
gauucggcugucu

SEQ ID NO: 2563463 - RNA, 18 nt, Human
gauucgcccaaagccaga

SEQ ID NO: 2563464 - RNA, 17 nt, Human
gauuccuuugaagagga

SEQ ID NO: 2563465 - RNA, 21 nt, Human
gauuccuuugaagaggaaaau

SEQ ID NO: 2563466 - RNA, 23 nt, Human
gauggggcugcaccggcuggccu

SEQ ID NO: 2563467 - RNA, 21 nt, Human
gaugggggaaagcacaggugg

SEQ ID NO: 2563468 - RNA, 17 nt, Human
gaugggggaaagcacag

SEQ ID NO: 2563469 - RNA, 16 nt, Human
gaugggggaacucaga

SEQ ID NO: 2563470 - RNA, 19 nt, Human
gaugggggaacucagaucc

SEQ ID NO: 2563471 - RNA, 20 nt, Human
gaugggggaacucagaucca

SEQ ID NO: 2563472 - RNA, 22 nt, Human
gaugggggaacucagauccagg

SEQ ID NO: 2563473 - RNA, 21 nt, Human
gaugggggagucugaagcaga

SEQ ID NO: 2563474 - RNA, 19 nt, Human
gauucagacagcugccugg

SEQ ID NO: 2563475 - RNA, 23 nt, Human
gauggggucucacaguguugccc

SEQ ID NO: 2563476 - RNA, 13 nt, Human
gauucagcucugc

SEQ ID NO: 2563477 - RNA, 15 nt, Human
gauucagcucugcaa

SEQ ID NO: 2563478 - RNA, 22 nt, Human
gauuccagagaguggcuccucc

SEQ ID NO: 2563479 - RNA, 21 nt, Human
gauuccacuacaccuggcuga

SEQ ID NO: 2563480 - RNA, 20 nt, Human
gauuccagagaguggcuccu

SEQ ID NO: 2563481 - RNA, 19 nt, Human
gauuccagagaguggcucc

SEQ ID NO: 2563482 - RNA, 22 nt, Human
gauuccauuuggcagagcuucu

SEQ ID NO: 2563483 - RNA, 18 nt, Human
gauucccaagcucugcuc

SEQ ID NO: 2563484 - RNA, 17 nt, Human
gauuccagguggcauca

SEQ ID NO: 2563485 - RNA, 19 nt, Human
gauucauaguaacuucuua

SEQ ID NO: 2563486 - RNA, 18 nt, Human
gauucagauuguuaucua

SEQ ID NO: 2563487 - RNA, 17 nt, Human
gauucauauuuacuucu

SEQ ID NO: 2563488 - RNA, 18 nt, Human
gauucauauuuacuucuu

SEQ ID NO: 2563489 - RNA, 19 nt, Human
gauucauauuuacuucuua

SEQ ID NO: 2563490 - RNA, 18 nt, Human
gauuuucaaagcuuuuuc

SEQ ID NO: 2563491 - RNA, 19 nt, Human
gauuuucaaagcuuuuucc

SEQ ID NO: 2563492 - RNA, 15 nt, Human
gauuuuauuugacaa

SEQ ID NO: 2563493 - RNA, 14 nt, Human
gauuuuaugcuuua

SEQ ID NO: 2563494 - RNA, 19 nt, Human
gauuuuaugcuuuaaacau

SEQ ID NO: 2563495 - RNA, 20 nt, Human
gauuugugaacucagccaag

SEQ ID NO: 2563496 - RNA, 13 nt, Human
gauuuuaugcuuu

SEQ ID NO: 2563497 - RNA, 14 nt, Human
gauuuguacugaaa

SEQ ID NO: 2563498 - RNA, 14 nt, Human
gauuugucccaggu

SEQ ID NO: 2563499 - RNA, 11 nt, Human
gauuugugaac

SEQ ID NO: 2563500 - RNA, 15 nt, Human
gauuuuccugaaaac

SEQ ID NO: 2563501 - RNA, 13 nt, Human
gauuuuccaaaug

SEQ ID NO: 2563502 - RNA, 19 nt, Human
gauuuuccuuuuuuauaca

SEQ ID NO: 2563503 - RNA, 18 nt, Human
gauuuuccuuuuuuauac

SEQ ID NO: 2563504 - RNA, 23 nt, Human
gauuuuucuggagguugauaacu

SEQ ID NO: 2563505 - RNA, 18 nt, Human
gauuuuucucaaaguuuu

SEQ ID NO: 2563506 - RNA, 13 nt, Human
gauuuuucucaaa

SEQ ID NO: 2563507 - RNA, 12 nt, Human
gauuuuucucaa

SEQ ID NO: 2563508 - RNA, 16 nt, Human
gauuuucuuuaaaaga

SEQ ID NO: 2563509 - RNA, 22 nt, Human
gauuuucuauuguuacucuggu

SEQ ID NO: 2563510 - RNA, 17 nt, Human
gauuuucuauuguuacu

SEQ ID NO: 2563511 - RNA, 12 nt, Human
gauuuucuauug

SEQ ID NO: 2563512 - RNA, 21 nt, Human
gauuuuccuuuuuuauacaca

SEQ ID NO: 2563513 - RNA, 13 nt, Human
gauuuucuuuaaa

SEQ ID NO: 2563514 - RNA, 18 nt, Human
gauuuucuauuguuacuc

SEQ ID NO: 2563515 - RNA, 20 nt, Human
gauuuuuaccguuucuuccc

SEQ ID NO: 2563516 - RNA, 22 nt, Human
gauuuggucaacacuaacauga

SEQ ID NO: 2563517 - RNA, 12 nt, Human
gauuugggcugg

SEQ ID NO: 2563518 - RNA, 13 nt, Human
gauuuggggugga

SEQ ID NO: 2563519 - RNA, 19 nt, Human
gauuugguguacaauucag

SEQ ID NO: 2563520 - RNA, 23 nt, Human
gauuugggcuggaacagauucac

SEQ ID NO: 2563521 - RNA, 20 nt, Human
gauuuggggcucagaguggg

SEQ ID NO: 2563522 - RNA, 15 nt, Human
gauuuggaagggaaa

SEQ ID NO: 2563523 - RNA, 23 nt, Human
gauuugcucagugucuggcugca

SEQ ID NO: 2563524 - RNA, 12 nt, Human
gauuuggaaaaa

SEQ ID NO: 2563525 - RNA, 21 nt, Human
gauuugcugggcaguuuuucu

SEQ ID NO: 2563526 - RNA, 11 nt, Human
gauuucuguuu

SEQ ID NO: 2563527 - RNA, 19 nt, Human
gauuucuguuuagauaaua

SEQ ID NO: 2563528 - RNA, 17 nt, Human
gauuucugccuuccuug

SEQ ID NO: 2563529 - RNA, 21 nt, Human
gauuugcauugaacacaaacu

SEQ ID NO: 2563530 - RNA, 15 nt, Human
gauuugccugugcca

SEQ ID NO: 2563531 - RNA, 17 nt, Human
gauuugcauugaacaca

SEQ ID NO: 2563532 - RNA, 16 nt, Human
gauuucugccuuccuu

SEQ ID NO: 2563533 - RNA, 13 nt, Human
gauuucugccuuc

SEQ ID NO: 2563534 - RNA, 17 nt, Human
gauuucugcagguucuu

SEQ ID NO: 2563535 - RNA, 18 nt, Human
gauuuccguuaaaauacc

SEQ ID NO: 2563536 - RNA, 11 nt, Human
gauuucuccca

SEQ ID NO: 2563537 - RNA, 20 nt, Human
gauuucucccagcucuagac

SEQ ID NO: 2563538 - RNA, 15 nt, Human
gauuuccguuaaaau

SEQ ID NO: 2563539 - RNA, 22 nt, Human
gauuucccguggccccagccug

SEQ ID NO: 2563540 - RNA, 21 nt, Human
gauuucccguggccccagccu

SEQ ID NO: 2563541 - RNA, 18 nt, Human
gauuucccguggccccag

SEQ ID NO: 2563542 - RNA, 16 nt, Human
gauuucccguggcccc

SEQ ID NO: 2563543 - RNA, 17 nt, Human
gauugcacguggccucu

SEQ ID NO: 2563544 - RNA, 16 nt, Human
gauugcacguggccuc

SEQ ID NO: 2563545 - RNA, 15 nt, Human
gauugcacguggccu

SEQ ID NO: 2563546 - RNA, 22 nt, Human
gauugcaauuugcacaaguuuu

SEQ ID NO: 2563547 - RNA, 20 nt, Human
gauugcacguggccucuuga

SEQ ID NO: 2563548 - RNA, 19 nt, Human
gauugcacguggccucuug

SEQ ID NO: 2563549 - RNA, 23 nt, Human
gauugcacguggccucuugagca

SEQ ID NO: 2563550 - RNA, 19 nt, Human
gauuuccagccagggcugc

SEQ ID NO: 2563551 - RNA, 18 nt, Human
gauuuccagccagggcug

SEQ ID NO: 2563552 - RNA, 22 nt, Human
gauuuccagucuccaccaggaa

SEQ ID NO: 2563553 - RNA, 23 nt, Human
gcaaacagaggaagaauuuguua

SEQ ID NO: 2563554 - RNA, 23 nt, Human
gcaaagcacugacuucuaaguaa

SEQ ID NO: 2563555 - RNA, 21 nt, Human
gcaaagccccaugcuggagcc

SEQ ID NO: 2563556 - RNA, 20 nt, Human
gcaaagccccaugcuggagc

SEQ ID NO: 2563557 - RNA, 19 nt, Human
gcaaagccccaugcuggag

SEQ ID NO: 2563558 - RNA, 18 nt, Human
gcaaagccccaugcugga

SEQ ID NO: 2563559 - RNA, 21 nt, Human
gcaaagcccagcuugaaaccu

SEQ ID NO: 2563560 - RNA, 13 nt, Human
gcaaagcccagcu

SEQ ID NO: 2563561 - RNA, 12 nt, Human
gcaaagcauuga

SEQ ID NO: 2563562 - RNA, 13 nt, Human
gcaaaauugcaaa

SEQ ID NO: 2563563 - RNA, 17 nt, Human
gcaaaauugcaaaucuu

SEQ ID NO: 2563564 - RNA, 20 nt, Human
gcaaaauuugaugccaggac

SEQ ID NO: 2563565 - RNA, 15 nt, Human
gcaaaauuugaugcc

SEQ ID NO: 2563566 - RNA, 21 nt, Human
gcaaaauuguuuuugguugga

SEQ ID NO: 2563567 - RNA, 10 nt, Human
gcaaaauuuc

SEQ ID NO: 2563568 - RNA, 22 nt, Human
gcaaaauuugaugccaggacac

SEQ ID NO: 2563569 - RNA, 21 nt, Human
gcaaaauuugaugccaggaca

SEQ ID NO: 2563570 - RNA, 16 nt, Human
gcaaaauuuuauagcu

SEQ ID NO: 2563571 - RNA, 17 nt, Human
gcaaacacacaaaggua

SEQ ID NO: 2563572 - RNA, 15 nt, Human
gauuuuuguaagaca

SEQ ID NO: 2563573 - RNA, 17 nt, Human
gcaaaauugauguguuu

SEQ ID NO: 2563574 - RNA, 13 nt, Human
gauuuuugccucu

SEQ ID NO: 2563575 - RNA, 15 nt, Human
gauuuuugucuugug

SEQ ID NO: 2563576 - RNA, 19 nt, Human
gcaaagguuccaacuguau

SEQ ID NO: 2563577 - RNA, 12 nt, Human
gcaaaucaaugc

SEQ ID NO: 2563578 - RNA, 13 nt, Human
gcaaaucagaaac

SEQ ID NO: 2563579 - RNA, 15 nt, Human
gcaaaucagaaacuu

SEQ ID NO: 2563580 - RNA, 20 nt, Human
gcaaauccuugugggaaaag

SEQ ID NO: 2563581 - RNA, 15 nt, Human
gcaaauccuauguga

SEQ ID NO: 2563582 - RNA, 15 nt, Human
gcaaaucauagcugg

SEQ ID NO: 2563583 - RNA, 18 nt, Human
gcaaaucaguuacuaaga

SEQ ID NO: 2563584 - RNA, 20 nt, Human
gcaaaucagaaacuugugaa

SEQ ID NO: 2563585 - RNA, 22 nt, Human
gcaaaucagaaacuugugaagu

SEQ ID NO: 2563586 - RNA, 23 nt, Human
gcaaagccccaugcuggagccug

SEQ ID NO: 2563587 - RNA, 22 nt, Human
gcaaagccccaugcuggagccu

SEQ ID NO: 2563588 - RNA, 19 nt, Human
gcaaagggcugaaagccau

SEQ ID NO: 2563589 - RNA, 15 nt, Human
gcaaagggcugaaag

SEQ ID NO: 2563590 - RNA, 14 nt, Human
gcaaagggcugaaa

SEQ ID NO: 2563591 - RNA, 20 nt, Human
gcaaaggggcugaaagaaca

SEQ ID NO: 2563592 - RNA, 22 nt, Human
gcaaagggcugaaagccauuug

SEQ ID NO: 2563593 - RNA, 16 nt, Human
gcaaaguaucccuacu

SEQ ID NO: 2563594 - RNA, 20 nt, Human
gcaaaggggucccauagagg

SEQ ID NO: 2563595 - RNA, 23 nt, Human
gcaaaggggucccauagagguga

SEQ ID NO: 2563596 - RNA, 21 nt, Human
gcaaagguuccaacuguauau

SEQ ID NO: 2563597 - RNA, 18 nt, Human
gcaaagguggcucuccag

SEQ ID NO: 2563598 - RNA, 22 nt, Human
gcaagacgcugugcugcccugc

SEQ ID NO: 2563599 - RNA, 21 nt, Human
gcaagacgcugugcugcccug

SEQ ID NO: 2563600 - RNA, 20 nt, Human
gcaagacgcugugcugcccu

SEQ ID NO: 2563601 - RNA, 14 nt, Human
gcaagacgcugugc

SEQ ID NO: 2563602 - RNA, 23 nt, Human
gcaagacgcugugcugcccugcc

SEQ ID NO: 2563603 - RNA, 15 nt, Human
gcaagaauuugaucg

SEQ ID NO: 2563604 - RNA, 18 nt, Human
gcaagacuguugcucaaa

SEQ ID NO: 2563605 - RNA, 20 nt, Human
gcaagagacucuggccucca

SEQ ID NO: 2563606 - RNA, 19 nt, Human
gcaagagaauugcuugaac

SEQ ID NO: 2563607 - RNA, 17 nt, Human
gcaagagagauguuuug

SEQ ID NO: 2563608 - RNA, 14 nt, Human
gcaagagagauguu

SEQ ID NO: 2563609 - RNA, 13 nt, Human
gcaagagccuugg

SEQ ID NO: 2563610 - RNA, 20 nt, Human
gcaagaggggguggaggggu

SEQ ID NO: 2563611 - RNA, 22 nt, Human
gcaagagccuugguguccaccu

SEQ ID NO: 2563612 - RNA, 23 nt, Human
gcaagagccuugguguccaccug

SEQ ID NO: 2563613 - RNA, 17 nt, Human
gcaagaauugaagcagg

SEQ ID NO: 2563614 - RNA, 21 nt, Human
gcaagaagaucacgcuccccg

SEQ ID NO: 2563615 - RNA, 19 nt, Human
gcaagaagaucacgcuccc

SEQ ID NO: 2563616 - RNA, 14 nt, Human
gcaagaaggaauug

SEQ ID NO: 2563617 - RNA, 14 nt, Human
gcaacagaucugga

SEQ ID NO: 2563618 - RNA, 16 nt, Human
gcaacagaucuggaac

SEQ ID NO: 2563619 - RNA, 17 nt, Human
gcaacagaucuggaacc

SEQ ID NO: 2563620 - RNA, 18 nt, Human
gcaacagaucuggaaccu

SEQ ID NO: 2563621 - RNA, 20 nt, Human
gcaacagaucuggaaccuca

SEQ ID NO: 2563622 - RNA, 17 nt, Human
gcaagaaagaaacccga

SEQ ID NO: 2563623 - RNA, 23 nt, Human
gcaaauccuaugugauuuuaacu

SEQ ID NO: 2563624 - RNA, 17 nt, Human
gcaaauccuaugugauu

SEQ ID NO: 2563625 - RNA, 19 nt, Human
gcaaauccuaugugauuuu

SEQ ID NO: 2563626 - RNA, 22 nt, Human
gcaaauccuugugggaaaagaa

SEQ ID NO: 2563627 - RNA, 17 nt, Human
gcaacacucuauauuua

SEQ ID NO: 2563628 - RNA, 12 nt, Human
gcaacagaucug

SEQ ID NO: 2563629 - RNA, 13 nt, Human
gcaacagaucugg

SEQ ID NO: 2563630 - RNA, 19 nt, Human
gcaacagagugagacccug

SEQ ID NO: 2563631 - RNA, 13 nt, Human
gcaacagaaaaaa

SEQ ID NO: 2563632 - RNA, 14 nt, Human
gcaacagagugaga

SEQ ID NO: 2563633 - RNA, 23 nt, Human
gcaaugcuggcuguuggcugggg

SEQ ID NO: 2563634 - RNA, 22 nt, Human
gcaaugcuggcuguuggcuggg

SEQ ID NO: 2563635 - RNA, 14 nt, Human
gcaaugcuggcugu

SEQ ID NO: 2563636 - RNA, 13 nt, Human
gcaaugcuggcug

SEQ ID NO: 2563637 - RNA, 23 nt, Human
gcaaugaccuuucaauaggaaaa

SEQ ID NO: 2563638 - RNA, 16 nt, Human
gcaaugaugaaugaga

SEQ ID NO: 2563639 - RNA, 17 nt, Human
gcaaugaugaaugagaa

SEQ ID NO: 2563640 - RNA, 13 nt, Human
gcaauccauguua

SEQ ID NO: 2563641 - RNA, 20 nt, Human
gcaauccauguuaguuuuua

SEQ ID NO: 2563642 - RNA, 21 nt, Human
gcaauccauguuaguuuuuac

SEQ ID NO: 2563643 - RNA, 22 nt, Human
gcaauccauguuaguuuuuacu

SEQ ID NO: 2563644 - RNA, 15 nt, Human
gcaaugccaucaucu

SEQ ID NO: 2563645 - RNA, 18 nt, Human
gcaaugccaucaucuccu

SEQ ID NO: 2563646 - RNA, 19 nt, Human
gcaaugccaucaucuccug

SEQ ID NO: 2563647 - RNA, 11 nt, Human
gcaaugcauuu

SEQ ID NO: 2563648 - RNA, 16 nt, Human
gcaaugauuacucuuu

SEQ ID NO: 2563649 - RNA, 15 nt, Human
gcaaugauguccaga

SEQ ID NO: 2563650 - RNA, 10 nt, Human
gcaauccuaa

SEQ ID NO: 2563651 - RNA, 17 nt, Human
gcaaugauguccagaag

SEQ ID NO: 2563652 - RNA, 14 nt, Human
gcaaugauuacucu

SEQ ID NO: 2563653 - RNA, 22 nt, Human
gcaaugaccuuucaauaggaaa

SEQ ID NO: 2563654 - RNA, 20 nt, Human
gcaaugaccuuucaauagga

SEQ ID NO: 2563655 - RNA, 17 nt, Human
gcaaugaccuuucaaua

SEQ ID NO: 2563656 - RNA, 15 nt, Human
gcaaugaccuuucaa

SEQ ID NO: 2563657 - RNA, 15 nt, Human
gcaaucaaaucugcu

SEQ ID NO: 2563658 - RNA, 19 nt, Human
gcaauauuuccucauguga

SEQ ID NO: 2563659 - RNA, 18 nt, Human
gcaauccacaaucugaca

SEQ ID NO: 2563660 - RNA, 17 nt, Human
gcaaucaaaucugcuuu

SEQ ID NO: 2563661 - RNA, 22 nt, Human
gcaaggcaggugccuccaggug

SEQ ID NO: 2563662 - RNA, 21 nt, Human
gcaaggcaggugccuccaggu

SEQ ID NO: 2563663 - RNA, 11 nt, Human
gcaaggcuguc

SEQ ID NO: 2563664 - RNA, 20 nt, Human
gcaaggccgcuguucaccca

SEQ ID NO: 2563665 - RNA, 21 nt, Human
gcaaggccgcuguucacccac

SEQ ID NO: 2563666 - RNA, 19 nt, Human
gcaagggccaugcugaagg

SEQ ID NO: 2563667 - RNA, 15 nt, Human
gcaagggccaugcug

SEQ ID NO: 2563668 - RNA, 14 nt, Human
gcaagggcucccca

SEQ ID NO: 2563669 - RNA, 15 nt, Human
gcaaggggaaaaucu

SEQ ID NO: 2563670 - RNA, 14 nt, Human
gcaagggugauggg

SEQ ID NO: 2563671 - RNA, 16 nt, Human
gcaaggguucccucaa

SEQ ID NO: 2563672 - RNA, 16 nt, Human
gcaaggggaaaaucuc

SEQ ID NO: 2563673 - RNA, 18 nt, Human
gcaaggguucccucaaga

SEQ ID NO: 2563674 - RNA, 20 nt, Human
gcaaggcaggugccuccagg

SEQ ID NO: 2563675 - RNA, 19 nt, Human
gcaaggcaggugccuccag

SEQ ID NO: 2563676 - RNA, 18 nt, Human
gcaaggcaggugccucca

SEQ ID NO: 2563677 - RNA, 13 nt, Human
gcaaggcaggugc

SEQ ID NO: 2563678 - RNA, 11 nt, Human
gcaaggcaggu

SEQ ID NO: 2563679 - RNA, 14 nt, Human
gcaaggcaccugca

SEQ ID NO: 2563680 - RNA, 20 nt, Human
gcaaggaggcuggcuggggc

SEQ ID NO: 2563681 - RNA, 19 nt, Human
gcaaggaggcuggcugggg

SEQ ID NO: 2563682 - RNA, 16 nt, Human
gcaaggaggcuggcug

SEQ ID NO: 2563683 - RNA, 15 nt, Human
gcaaggaggcuggcu

SEQ ID NO: 2563684 - RNA, 14 nt, Human
gcaaggaggcuggc

SEQ ID NO: 2563685 - RNA, 13 nt, Human
gcaaggaggcugg

SEQ ID NO: 2563686 - RNA, 22 nt, Human
gcaaggacuacguuaagggaag

SEQ ID NO: 2563687 - RNA, 19 nt, Human
gcaagcucccaagggaugg

SEQ ID NO: 2563688 - RNA, 21 nt, Human
gcaaggaccaggacucccucc

SEQ ID NO: 2563689 - RNA, 18 nt, Human
gcaaggagauuuacaacu

SEQ ID NO: 2563690 - RNA, 10 nt, Human
gcaagccaga

SEQ ID NO: 2563691 - RNA, 17 nt, Human
gcaagagggguggagac

SEQ ID NO: 2563692 - RNA, 23 nt, Human
gcaagaggggguggaggggugug

SEQ ID NO: 2563693 - RNA, 22 nt, Human
gcaagaggggguggaggggugu

SEQ ID NO: 2563694 - RNA, 13 nt, Human
gcaagaggggugg

SEQ ID NO: 2563695 - RNA, 20 nt, Human
gcaagcauuuauguuuauuu

SEQ ID NO: 2563696 - RNA, 11 nt, Human
gcaagccugcg

SEQ ID NO: 2563697 - RNA, 24 nt, Human
gcaagccugcguucuugugacaga

SEQ ID NO: 2563698 - RNA, 19 nt, Human
gcaagccuguaaucccagc

SEQ ID NO: 2563699 - RNA, 13 nt, Human
gcaagcucccaag

SEQ ID NO: 2563700 - RNA, 19 nt, Human
gcaagcuagaaccuggagg

SEQ ID NO: 2563701 - RNA, 20 nt, Human
gcaagccuguaaucccagcu

SEQ ID NO: 2563702 - RNA, 15 nt, Human
gcaagcccuguugac

SEQ ID NO: 2563703 - RNA, 23 nt, Human
gcaagcccuguugacacaggucu

SEQ ID NO: 2563704 - RNA, 15 nt, Human
gcaagccccugcucc

SEQ ID NO: 2563705 - RNA, 21 nt, Human
gccccaccuuuauuaaaaucu

SEQ ID NO: 2563706 - RNA, 23 nt, Human
gccccaccuuuauuaaaaucuua

SEQ ID NO: 2563707 - RNA, 23 nt, Human
gccccacccugggcccugggcug

SEQ ID NO: 2563708 - RNA, 22 nt, Human
gccccacccugggcccugggcu

SEQ ID NO: 2563709 - RNA, 24 nt, Human
gccccacccugggcccugggcugg

SEQ ID NO: 2563710 - RNA, 15 nt, Human
gccccaccuuuauua

SEQ ID NO: 2563711 - RNA, 20 nt, Human
gccccaccuuuauuaaaauc

SEQ ID NO: 2563712 - RNA, 15 nt, Human
gccccagaaggcagg

SEQ ID NO: 2563713 - RNA, 13 nt, Human
gccccacugggga

SEQ ID NO: 2563714 - RNA, 14 nt, Human
gccccacuggggaa

SEQ ID NO: 2563715 - RNA, 15 nt, Human
gccccacuggggaaa

SEQ ID NO: 2563716 - RNA, 18 nt, Human
gccccagaaggcagggaa

SEQ ID NO: 2563717 - RNA, 11 nt, Human
gccccagagac

SEQ ID NO: 2563718 - RNA, 15 nt, Human
gccccagagacucag

SEQ ID NO: 2563719 - RNA, 22 nt, Human
gccccagagcaggguguuggga

SEQ ID NO: 2563720 - RNA, 17 nt, Human
gccccagagacucagag

SEQ ID NO: 2563721 - RNA, 12 nt, Human
gccccagagcug

SEQ ID NO: 2563722 - RNA, 13 nt, Human
gccccagagcugu

SEQ ID NO: 2563723 - RNA, 14 nt, Human
gccccagagcuguu

SEQ ID NO: 2563724 - RNA, 22 nt, Human
gccccagagcuguuuauggccu

SEQ ID NO: 2563725 - RNA, 23 nt, Human
gccccagagcuguuuauggccuc

SEQ ID NO: 2563726 - RNA, 15 nt, Human
gcccaggggagcccu

SEQ ID NO: 2563727 - RNA, 19 nt, Human
gcccaggggcccacaggga

SEQ ID NO: 2563728 - RNA, 16 nt, Human
gcccaggggagcccuc

SEQ ID NO: 2563729 - RNA, 20 nt, Human
gcccaggggcccacagggaa

SEQ ID NO: 2563730 - RNA, 18 nt, Human
gcccaggggugcccccuc

SEQ ID NO: 2563731 - RNA, 17 nt, Human
gcccaggggugcccccu

SEQ ID NO: 2563732 - RNA, 15 nt, Human
gcccaggggugcccc

SEQ ID NO: 2563733 - RNA, 14 nt, Human
gcccaggggugccc

SEQ ID NO: 2563734 - RNA, 20 nt, Human
gcccaggggugcccccuccu

SEQ ID NO: 2563735 - RNA, 19 nt, Human
gcccaggggugcccccucc

SEQ ID NO: 2563736 - RNA, 22 nt, Human
gcccaggggugcccccuccucu

SEQ ID NO: 2563737 - RNA, 21 nt, Human
gcccaguuucugccucugagg

SEQ ID NO: 2563738 - RNA, 17 nt, Human
gcccaguuucugccucu

SEQ ID NO: 2563739 - RNA, 15 nt, Human
gcccaguuucugccu

SEQ ID NO: 2563740 - RNA, 17 nt, Human
gcccaguuucagggcua

SEQ ID NO: 2563741 - RNA, 16 nt, Human
gcccaguuucagggcu

SEQ ID NO: 2563742 - RNA, 14 nt, Human
gcccaggguggacu

SEQ ID NO: 2563743 - RNA, 23 nt, Human
gcccaggguggacuuagaaagca

SEQ ID NO: 2563744 - RNA, 16 nt, Human
gcccaggguuccccca

SEQ ID NO: 2563745 - RNA, 22 nt, Human
gcccaguuggguggaugccugg

SEQ ID NO: 2563746 - RNA, 20 nt, Human
gccccacccugggcccuggg

SEQ ID NO: 2563747 - RNA, 19 nt, Human
gccccacccugggcccugg

SEQ ID NO: 2563748 - RNA, 16 nt, Human
gccccacccugggccc

SEQ ID NO: 2563749 - RNA, 15 nt, Human
gccccacccugggcc

SEQ ID NO: 2563750 - RNA, 21 nt, Human
gcccaucaguguacccccgcc

SEQ ID NO: 2563751 - RNA, 20 nt, Human
gcccaucaguguacccccgc

SEQ ID NO: 2563752 - RNA, 22 nt, Human
gcccaucaguguacccccgccc

SEQ ID NO: 2563753 - RNA, 14 nt, Human
gccccacccugggc

SEQ ID NO: 2563754 - RNA, 17 nt, Human
gcccaucaauuauagaa

SEQ ID NO: 2563755 - RNA, 13 nt, Human
gcccaucacaggg

SEQ ID NO: 2563756 - RNA, 17 nt, Human
gcccaucacaggguugg

SEQ ID NO: 2563757 - RNA, 21 nt, Human
gcccaucacaggguugggccc

SEQ ID NO: 2563758 - RNA, 22 nt, Human
gcccaucacaggguugggccca

SEQ ID NO: 2563759 - RNA, 20 nt, Human
gcccaggcuggagugcagug

SEQ ID NO: 2563760 - RNA, 19 nt, Human
gcccaggcuggagugcagu

SEQ ID NO: 2563761 - RNA, 12 nt, Human
gcccaggcuggc

SEQ ID NO: 2563762 - RNA, 21 nt, Human
gcccagggacaccagccaggc

SEQ ID NO: 2563763 - RNA, 20 nt, Human
gcccagggacaccagccagg

SEQ ID NO: 2563764 - RNA, 17 nt, Human
gcccaggcuggccagcc

SEQ ID NO: 2563765 - RNA, 16 nt, Human
gcccaggcuggccagc

SEQ ID NO: 2563766 - RNA, 15 nt, Human
gcccaggcuggccag

SEQ ID NO: 2563767 - RNA, 14 nt, Human
gcccaggcuggcca

SEQ ID NO: 2563768 - RNA, 13 nt, Human
gcccaggcuggcc

SEQ ID NO: 2563769 - RNA, 23 nt, Human
gcccagggacaccagccaggcuc

SEQ ID NO: 2563770 - RNA, 22 nt, Human
gcccagggacaccagccaggcu

SEQ ID NO: 2563771 - RNA, 24 nt, Human
gcccagggacaccagccaggcucu

SEQ ID NO: 2563772 - RNA, 18 nt, Human
gcccagggagaggccaug

SEQ ID NO: 2563773 - RNA, 19 nt, Human
gcccagggagaggccauga

SEQ ID NO: 2563774 - RNA, 16 nt, Human
gcccagggagcggaaa

SEQ ID NO: 2563775 - RNA, 17 nt, Human
gcccagggagcggaaag

SEQ ID NO: 2563776 - RNA, 20 nt, Human
gcccagggagcggaaagcag

SEQ ID NO: 2563777 - RNA, 13 nt, Human
gcccagggccacu

SEQ ID NO: 2563778 - RNA, 15 nt, Human
gcccagggccacucu

SEQ ID NO: 2563779 - RNA, 18 nt, Human
gcccagggccacucugcc

SEQ ID NO: 2563780 - RNA, 21 nt, Human
gcccagggagcggaaagcagc

SEQ ID NO: 2563781 - RNA, 23 nt, Human
gcccagggagcggaaagcagcuc

SEQ ID NO: 2563782 - RNA, 14 nt, Human
gcccagggcuccug

SEQ ID NO: 2563783 - RNA, 12 nt, Human
gcccagggcucc

SEQ ID NO: 2563784 - RNA, 19 nt, Human
gcccagggccacucugccu

SEQ ID NO: 2563785 - RNA, 20 nt, Human
gcccagggccacucugccuc

SEQ ID NO: 2563786 - RNA, 18 nt, Human
gcccagggcucagccugg

SEQ ID NO: 2563787 - RNA, 16 nt, Human
gcccagggcuccugca

SEQ ID NO: 2563788 - RNA, 15 nt, Human
gcccagggcuccugc

SEQ ID NO: 2563789 - RNA, 18 nt, Human
gcccagggcuccugcacu

SEQ ID NO: 2563790 - RNA, 22 nt, Human
gcccagggccacucugccucug

SEQ ID NO: 2563791 - RNA, 23 nt, Human
gcccaggccccugccacccuggg

SEQ ID NO: 2563792 - RNA, 19 nt, Human
gcccagagaugccuccacc

SEQ ID NO: 2563793 - RNA, 20 nt, Human
gcccagagaugccuccaccg

SEQ ID NO: 2563794 - RNA, 22 nt, Human
gcccagagaugccuccaccgcu

SEQ ID NO: 2563795 - RNA, 21 nt, Human
gcccagagaugggacugggag

SEQ ID NO: 2563796 - RNA, 16 nt, Human
gcccagagcaggaagc

SEQ ID NO: 2563797 - RNA, 15 nt, Human
gcccagagcaggaag

SEQ ID NO: 2563798 - RNA, 14 nt, Human
gcccagagcaggaa

SEQ ID NO: 2563799 - RNA, 22 nt, Human
gcccagagaugggacugggagg

SEQ ID NO: 2563800 - RNA, 16 nt, Human
gcccagagaugccucc

SEQ ID NO: 2563801 - RNA, 17 nt, Human
gcccagagaugccucca

SEQ ID NO: 2563802 - RNA, 18 nt, Human
gcccagagaugccuccac

SEQ ID NO: 2563803 - RNA, 15 nt, Human
gcccagagagggugg

SEQ ID NO: 2563804 - RNA, 21 nt, Human
gcccagagaggguggugaccu

SEQ ID NO: 2563805 - RNA, 13 nt, Human
gcccaggccccuu

SEQ ID NO: 2563806 - RNA, 23 nt, Human
gcccaggccgggguggagcaugg

SEQ ID NO: 2563807 - RNA, 22 nt, Human
gcccaggccgggguggagcaug

SEQ ID NO: 2563808 - RNA, 21 nt, Human
gcccaggccgggguggagcau

SEQ ID NO: 2563809 - RNA, 18 nt, Human
gcccagagcaggaagcau

SEQ ID NO: 2563810 - RNA, 13 nt, Human
gcccaggccuccu

SEQ ID NO: 2563811 - RNA, 20 nt, Human
gcccaggcuggagugcaaug

SEQ ID NO: 2563812 - RNA, 15 nt, Human
gcccaggcuggagug

SEQ ID NO: 2563813 - RNA, 19 nt, Human
gccccaucaggacucuugu

SEQ ID NO: 2563814 - RNA, 14 nt, Human
gccccaucagugcu

SEQ ID NO: 2563815 - RNA, 14 nt, Human
gccccauccuccag

SEQ ID NO: 2563816 - RNA, 16 nt, Human
gccccauccuccagca

SEQ ID NO: 2563817 - RNA, 17 nt, Human
gccccauccuccagcag

SEQ ID NO: 2563818 - RNA, 18 nt, Human
gccccauccuccagcagg

SEQ ID NO: 2563819 - RNA, 18 nt, Human
gccccaucccaaacccuu

SEQ ID NO: 2563820 - RNA, 19 nt, Human
gccccaguuguauuuauuu

SEQ ID NO: 2563821 - RNA, 21 nt, Human
gccccauaauuuuuuuuuucc

SEQ ID NO: 2563822 - RNA, 17 nt, Human
gccccaucagcuccagc

SEQ ID NO: 2563823 - RNA, 16 nt, Human
gccccaucagcuccag

SEQ ID NO: 2563824 - RNA, 18 nt, Human
gccccaguucaaucuccc

SEQ ID NO: 2563825 - RNA, 15 nt, Human
gccccaucagcucca

SEQ ID NO: 2563826 - RNA, 14 nt, Human
gccccagugcccac

SEQ ID NO: 2563827 - RNA, 13 nt, Human
gccccagugccca

SEQ ID NO: 2563828 - RNA, 22 nt, Human
gccccagucagccucucuccca

SEQ ID NO: 2563829 - RNA, 20 nt, Human
gccccagucagccucucucc

SEQ ID NO: 2563830 - RNA, 18 nt, Human
gccccagucagccucucu

SEQ ID NO: 2563831 - RNA, 17 nt, Human
gccccagucagccucuc

SEQ ID NO: 2563832 - RNA, 19 nt, Human
gccccaguggcuguucugg

SEQ ID NO: 2563833 - RNA, 23 nt, Human
gccccagucagccucucucccag

SEQ ID NO: 2563834 - RNA, 14 nt, Human
gccccagugccaag

SEQ ID NO: 2563835 - RNA, 12 nt, Human
gccccagugccc

SEQ ID NO: 2563836 - RNA, 16 nt, Human
gccccagucagccucu

SEQ ID NO: 2563837 - RNA, 15 nt, Human
gccccagucagccuc

SEQ ID NO: 2563838 - RNA, 14 nt, Human
gccccagucagccu

SEQ ID NO: 2563839 - RNA, 13 nt, Human
gccccagucagcc

SEQ ID NO: 2563840 - RNA, 23 nt, Human
gccccagggucuucccuaccuca

SEQ ID NO: 2563841 - RNA, 15 nt, Human
gccccaggccugaaa

SEQ ID NO: 2563842 - RNA, 16 nt, Human
gccccagggcuacccu

SEQ ID NO: 2563843 - RNA, 18 nt, Human
gccccagggcuacccucc

SEQ ID NO: 2563844 - RNA, 16 nt, Human
gccccagggucuuccc

SEQ ID NO: 2563845 - RNA, 17 nt, Human
gccccagggucuucccu

SEQ ID NO: 2563846 - RNA, 20 nt, Human
gccccagggucuucccuacc

SEQ ID NO: 2563847 - RNA, 21 nt, Human
gccccagggucuucccuaccu

SEQ ID NO: 2563848 - RNA, 19 nt, Human
gccccagaucaccagcccg

SEQ ID NO: 2563849 - RNA, 18 nt, Human
gccccagaucaccagccc

SEQ ID NO: 2563850 - RNA, 20 nt, Human
gccccagauaccagccccug

SEQ ID NO: 2563851 - RNA, 19 nt, Human
gccccagauaccagccccu

SEQ ID NO: 2563852 - RNA, 17 nt, Human
gccccagauaccagccc

SEQ ID NO: 2563853 - RNA, 19 nt, Human
gccccagaggccucucucu

SEQ ID NO: 2563854 - RNA, 15 nt, Human
gccccagaggccucu

SEQ ID NO: 2563855 - RNA, 12 nt, Human
gccccagaggcc

SEQ ID NO: 2563856 - RNA, 20 nt, Human
gccccagcacagcuugaccu

SEQ ID NO: 2563857 - RNA, 13 nt, Human
gccccagcacagc

SEQ ID NO: 2563858 - RNA, 20 nt, Human
gccccagaucaccagcccgg

SEQ ID NO: 2563859 - RNA, 12 nt, Human
gccccagcacua

SEQ ID NO: 2563860 - RNA, 17 nt, Human
gccccagcacuaaagca

SEQ ID NO: 2563861 - RNA, 19 nt, Human
gccccagcacuaaagcagu

SEQ ID NO: 2563862 - RNA, 23 nt, Human
gccccagcacuaaagcaguggac

SEQ ID NO: 2563863 - RNA, 19 nt, Human
gccccagcacuaacguaaa

SEQ ID NO: 2563864 - RNA, 10 nt, Human
gccccagcca

SEQ ID NO: 2563865 - RNA, 12 nt, Human
gccccaggccug

SEQ ID NO: 2563866 - RNA, 14 nt, Human
gccccaggccucug

SEQ ID NO: 2563867 - RNA, 22 nt, Human
gccccaggcagggccaacccuu

SEQ ID NO: 2563868 - RNA, 23 nt, Human
gccccaugcuggagccuguguaa

SEQ ID NO: 2563869 - RNA, 22 nt, Human
gccccaugcuggagccugugua

SEQ ID NO: 2563870 - RNA, 21 nt, Human
gccccaugcuggagccugugu

SEQ ID NO: 2563871 - RNA, 20 nt, Human
gccccaugcuggagccugug

SEQ ID NO: 2563872 - RNA, 19 nt, Human
gccccaugcuggagccugu

SEQ ID NO: 2563873 - RNA, 18 nt, Human
gccccaugcuggagccug

SEQ ID NO: 2563874 - RNA, 17 nt, Human
gccccaugcuggagccu

SEQ ID NO: 2563875 - RNA, 16 nt, Human
gccccaugcuggagcc

SEQ ID NO: 2563876 - RNA, 22 nt, Human
gccccauccucuguacagagcc

SEQ ID NO: 2563877 - RNA, 14 nt, Human
gccccauccucugu

SEQ ID NO: 2563878 - RNA, 13 nt, Human
gccccauccucug

SEQ ID NO: 2563879 - RNA, 12 nt, Human
gccccauuccug

SEQ ID NO: 2563880 - RNA, 15 nt, Human
gccccauuccuggga

SEQ ID NO: 2563881 - RNA, 18 nt, Human
gccccaugucucucagaa

SEQ ID NO: 2563882 - RNA, 15 nt, Human
gccccaugucucuca

SEQ ID NO: 2563883 - RNA, 16 nt, Human
gccccaugucucucag

SEQ ID NO: 2563884 - RNA, 14 nt, Human
gccccauucugccu

SEQ ID NO: 2563885 - RNA, 15 nt, Human
gccccauucugccug

SEQ ID NO: 2563886 - RNA, 15 nt, Human
gcccccaaauaagaa

SEQ ID NO: 2563887 - RNA, 23 nt, Human
gccccauucuuuuguaauuuaaa

SEQ ID NO: 2563888 - RNA, 20 nt, Human
gccccauuuauccaccucca

SEQ ID NO: 2563889 - RNA, 22 nt, Human
gccccauucuuuuguaauuuaa

SEQ ID NO: 2563890 - RNA, 13 nt, Human
gcccccuggccuc

SEQ ID NO: 2563891 - RNA, 14 nt, Human
gcccccuggccucu

SEQ ID NO: 2563892 - RNA, 15 nt, Human
gcccccuggccucug

SEQ ID NO: 2563893 - RNA, 16 nt, Human
gcccccuggccucugu

SEQ ID NO: 2563894 - RNA, 13 nt, Human
gcccccugcuggc

SEQ ID NO: 2563895 - RNA, 13 nt, Human
gcccccugccccc

SEQ ID NO: 2563896 - RNA, 20 nt, Human
gcccccugcuggcucuucug

SEQ ID NO: 2563897 - RNA, 15 nt, Human
gccccaugcuggagc

SEQ ID NO: 2563898 - RNA, 15 nt, Human
gcccccugcuggcuc

SEQ ID NO: 2563899 - RNA, 17 nt, Human
gcccccuggucucuggu

SEQ ID NO: 2563900 - RNA, 16 nt, Human
gcccccuggucucugg

SEQ ID NO: 2563901 - RNA, 14 nt, Human
gcccccuggucucu

SEQ ID NO: 2563902 - RNA, 13 nt, Human
gcccccuggucuc

SEQ ID NO: 2563903 - RNA, 17 nt, Human
gcccccuggccucugug

SEQ ID NO: 2563904 - RNA, 19 nt, Human
gcccccuggccucugugcc

SEQ ID NO: 2563905 - RNA, 23 nt, Human
gcccccugguggacaguccuggg

SEQ ID NO: 2563906 - RNA, 21 nt, Human
gcccccugguggacaguccug

SEQ ID NO: 2563907 - RNA, 22 nt, Human
gcccccugguggacaguccugg

SEQ ID NO: 2563908 - RNA, 23 nt, Human
gcccccacagaaagacugagcuc

SEQ ID NO: 2563909 - RNA, 15 nt, Human
gcccccacagugcug

SEQ ID NO: 2563910 - RNA, 14 nt, Human
gcccccaagccugc

SEQ ID NO: 2563911 - RNA, 17 nt, Human
gcccccacccacuuccc

SEQ ID NO: 2563912 - RNA, 22 nt, Human
gcccccaccacggccacuggcc

SEQ ID NO: 2563913 - RNA, 21 nt, Human
gcccccaccacuaggacucug

SEQ ID NO: 2563914 - RNA, 14 nt, Human
gcccccugcccccc

SEQ ID NO: 2563915 - RNA, 22 nt, Human
gcccccaccccggggacccugu

SEQ ID NO: 2563916 - RNA, 21 nt, Human
gcccccaccccggggacccug

SEQ ID NO: 2563917 - RNA, 17 nt, Human
gcccccaccccggggac

SEQ ID NO: 2563918 - RNA, 19 nt, Human
gcccccugcccuccccucu

SEQ ID NO: 2563919 - RNA, 14 nt, Human
gcccccugcccucc

SEQ ID NO: 2563920 - RNA, 18 nt, Human
gcccccugccccccagcc

SEQ ID NO: 2563921 - RNA, 12 nt, Human
gcccccugcccu

SEQ ID NO: 2563922 - RNA, 19 nt, Human
gccccgaggacccagaccc

SEQ ID NO: 2563923 - RNA, 18 nt, Human
gccccgaggacccagacc

SEQ ID NO: 2563924 - RNA, 17 nt, Human
gccccgaggacccagac

SEQ ID NO: 2563925 - RNA, 22 nt, Human
gccccgaggacccagacccagu

SEQ ID NO: 2563926 - RNA, 21 nt, Human
gccccgaggacccagacccag

SEQ ID NO: 2563927 - RNA, 18 nt, Human
gccccucacccugccuua

SEQ ID NO: 2563928 - RNA, 14 nt, Human
gccccucagggucc

SEQ ID NO: 2563929 - RNA, 18 nt, Human
gccccgaggccuucucug

SEQ ID NO: 2563930 - RNA, 19 nt, Human
gcccccuuugggcccaggg

SEQ ID NO: 2563931 - RNA, 18 nt, Human
gcccccuuugggcccagg

SEQ ID NO: 2563932 - RNA, 21 nt, Human
gcccccuuugggcccagggac

SEQ ID NO: 2563933 - RNA, 15 nt, Human
gccccgaggccuucu

SEQ ID NO: 2563934 - RNA, 15 nt, Human
gcccccuucucccac

SEQ ID NO: 2563935 - RNA, 16 nt, Human
gcccccuucucccaca

SEQ ID NO: 2563936 - RNA, 17 nt, Human
gcccccuucucccacac

SEQ ID NO: 2563937 - RNA, 18 nt, Human
gcccccuucucccacacu

SEQ ID NO: 2563938 - RNA, 19 nt, Human
gcccccuucucccacacug

SEQ ID NO: 2563939 - RNA, 23 nt, Human
gcccccuuucagaugucuucugc

SEQ ID NO: 2563940 - RNA, 18 nt, Human
gcccccuuucagaugucu

SEQ ID NO: 2563941 - RNA, 16 nt, Human
gcccccuuucagaugu

SEQ ID NO: 2563942 - RNA, 20 nt, Human
gcccccuucucccacacugc

SEQ ID NO: 2563943 - RNA, 22 nt, Human
gcccccuucucccacacugcua

SEQ ID NO: 2563944 - RNA, 19 nt, Human
gccccucuggucgcuccug

SEQ ID NO: 2563945 - RNA, 18 nt, Human
gccccucuggucgcuccu

SEQ ID NO: 2563946 - RNA, 14 nt, Human
gccccucuggucgc

SEQ ID NO: 2563947 - RNA, 20 nt, Human
gccccucugcccagcuuggg

SEQ ID NO: 2563948 - RNA, 19 nt, Human
gccccucugcccagcuugg

SEQ ID NO: 2563949 - RNA, 16 nt, Human
gccccucccccugcca

SEQ ID NO: 2563950 - RNA, 22 nt, Human
gccccucccccaacccccaccc

SEQ ID NO: 2563951 - RNA, 23 nt, Human
gccccucccccaacccccacccc

SEQ ID NO: 2563952 - RNA, 13 nt, Human
gccccucccgccc

SEQ ID NO: 2563953 - RNA, 16 nt, Human
gccccucccaccacag

SEQ ID NO: 2563954 - RNA, 16 nt, Human
gccccucccgccccuu

SEQ ID NO: 2563955 - RNA, 18 nt, Human
gccccucagggucccugg

SEQ ID NO: 2563956 - RNA, 16 nt, Human
gccccucagggucccu

SEQ ID NO: 2563957 - RNA, 14 nt, Human
gccccucaccuggg

SEQ ID NO: 2563958 - RNA, 20 nt, Human
gccccucaccugggcaccug

SEQ ID NO: 2563959 - RNA, 17 nt, Human
gccccucaccugggcac

SEQ ID NO: 2563960 - RNA, 18 nt, Human
gccccucccacagcgcug

SEQ ID NO: 2563961 - RNA, 12 nt, Human
gccccucccacc

SEQ ID NO: 2563962 - RNA, 13 nt, Human
gccccucccacca

SEQ ID NO: 2563963 - RNA, 14 nt, Human
gccccucccaccac

SEQ ID NO: 2563964 - RNA, 15 nt, Human
gccccucccaccaca

SEQ ID NO: 2563965 - RNA, 12 nt, Human
gccccuccccca

SEQ ID NO: 2563966 - RNA, 15 nt, Human
gccccucccccaacc

SEQ ID NO: 2563967 - RNA, 21 nt, Human
gccccucccccaacccccacc

SEQ ID NO: 2563968 - RNA, 21 nt, Human
gccccugggcuuggccugcug

SEQ ID NO: 2563969 - RNA, 20 nt, Human
gccccugggcuuggccugcu

SEQ ID NO: 2563970 - RNA, 19 nt, Human
gccccugggcuuggccugc

SEQ ID NO: 2563971 - RNA, 18 nt, Human
gccccugggcuuggccug

SEQ ID NO: 2563972 - RNA, 23 nt, Human
gccccugggcuuggccugcugug

SEQ ID NO: 2563973 - RNA, 22 nt, Human
gccccugggcuuggccugcugu

SEQ ID NO: 2563974 - RNA, 16 nt, Human
gccccugagaucucug

SEQ ID NO: 2563975 - RNA, 22 nt, Human
gccccugagacaaauggaggcc

SEQ ID NO: 2563976 - RNA, 16 nt, Human
gccccugaacaagaau

SEQ ID NO: 2563977 - RNA, 19 nt, Human
gccccucuugccccccacc

SEQ ID NO: 2563978 - RNA, 21 nt, Human
gccccucuugccccccacccc

SEQ ID NO: 2563979 - RNA, 22 nt, Human
gccccucuggucgcuccugccc

SEQ ID NO: 2563980 - RNA, 20 nt, Human
gccccucuggucgcuccugc

SEQ ID NO: 2563981 - RNA, 21 nt, Human
gccccucugcccagcuugggc

SEQ ID NO: 2563982 - RNA, 13 nt, Human
gccccucuugccc

SEQ ID NO: 2563983 - RNA, 16 nt, Human
gccccucuugcccccc

SEQ ID NO: 2563984 - RNA, 18 nt, Human
gccccucuugccccccac

SEQ ID NO: 2563985 - RNA, 14 nt, Human
gccccuucugcuca

SEQ ID NO: 2563986 - RNA, 15 nt, Human
gccccuucugcucag

SEQ ID NO: 2563987 - RNA, 17 nt, Human
gccccuucugcucagcu

SEQ ID NO: 2563988 - RNA, 18 nt, Human
gccccuucugcucagcuc

SEQ ID NO: 2563989 - RNA, 17 nt, Human
gccccuguucuggcaga

SEQ ID NO: 2563990 - RNA, 21 nt, Human
gccccuggguggguggugggg

SEQ ID NO: 2563991 - RNA, 20 nt, Human
gccccugggugggugguggg

SEQ ID NO: 2563992 - RNA, 21 nt, Human
gccccugggucagucuggugg

SEQ ID NO: 2563993 - RNA, 16 nt, Human
gccccugguccugagg

SEQ ID NO: 2563994 - RNA, 17 nt, Human
gccccuguauggcacug

SEQ ID NO: 2563995 - RNA, 22 nt, Human
gccccuggguggguggugggga

SEQ ID NO: 2563996 - RNA, 18 nt, Human
gccccugucuagagaggg

SEQ ID NO: 2563997 - RNA, 19 nt, Human
gccccugucuagagaggga

SEQ ID NO: 2563998 - RNA, 13 nt, Human
gccccuguucucu

SEQ ID NO: 2563999 - RNA, 18 nt, Human
gccccuguggagacuggg

SEQ ID NO: 2564000 - RNA, 22 nt, Human
gccccuguuaccuaauuagagc

SEQ ID NO: 2564001 - RNA, 14 nt, Human
gcccgcacagagcu

SEQ ID NO: 2564002 - RNA, 22 nt, Human
gcccgagcuggugcauuacaga

SEQ ID NO: 2564003 - RNA, 21 nt, Human
gcccgaauacaaacaccugga

SEQ ID NO: 2564004 - RNA, 15 nt, Human
gcccgagcuggugca

SEQ ID NO: 2564005 - RNA, 13 nt, Human
gcccgaauacaaa

SEQ ID NO: 2564006 - RNA, 15 nt, Human
gcccgacagccuggc

SEQ ID NO: 2564007 - RNA, 14 nt, Human
gcccgacagccugg

SEQ ID NO: 2564008 - RNA, 12 nt, Human
gcccgacagccu

SEQ ID NO: 2564009 - RNA, 21 nt, Human
gccccuuuucacucccuccau

SEQ ID NO: 2564010 - RNA, 16 nt, Human
gccccuuuuuacuccc

SEQ ID NO: 2564011 - RNA, 18 nt, Human
gccccuuuuuacuccccu

SEQ ID NO: 2564012 - RNA, 19 nt, Human
gccccuuuuuacuccccuu

SEQ ID NO: 2564013 - RNA, 20 nt, Human
gccccuuuuuacuccccuug

SEQ ID NO: 2564014 - RNA, 23 nt, Human
gccccuuuuucauauguugcuca

SEQ ID NO: 2564015 - RNA, 21 nt, Human
gccccuuuuuacuccccuuga

SEQ ID NO: 2564016 - RNA, 19 nt, Human
gccccuucugcucagcucu

SEQ ID NO: 2564017 - RNA, 20 nt, Human
gccccuucugcucagcucug

SEQ ID NO: 2564018 - RNA, 23 nt, Human
gccccuucugcucagcucugggc

SEQ ID NO: 2564019 - RNA, 20 nt, Human
gccccuugcucuccccugcc

SEQ ID NO: 2564020 - RNA, 22 nt, Human
gccccuuuacggacacccccuc

SEQ ID NO: 2564021 - RNA, 20 nt, Human
gccccuuuacggacaccccc

SEQ ID NO: 2564022 - RNA, 15 nt, Human
gccccuuuacggaca

SEQ ID NO: 2564023 - RNA, 15 nt, Human
gcccugcagagggca

SEQ ID NO: 2564024 - RNA, 22 nt, Human
gcccugagcucgguggacccag

SEQ ID NO: 2564025 - RNA, 14 nt, Human
gcccugcagagggc

SEQ ID NO: 2564026 - RNA, 13 nt, Human
gcccugcagaggg

SEQ ID NO: 2564027 - RNA, 14 nt, Human
gcccugagcuuucu

SEQ ID NO: 2564028 - RNA, 15 nt, Human
gcccugagcucggug

SEQ ID NO: 2564029 - RNA, 16 nt, Human
gcccugagcucggugg

SEQ ID NO: 2564030 - RNA, 19 nt, Human
gcccugaccucccagcccu

SEQ ID NO: 2564031 - RNA, 13 nt, Human
gcccugagcucgg

SEQ ID NO: 2564032 - RNA, 14 nt, Human
gcccugacccugug

SEQ ID NO: 2564033 - RNA, 17 nt, Human
gcccugaccucccagcc

SEQ ID NO: 2564034 - RNA, 16 nt, Human
gcccugaccucccagc

SEQ ID NO: 2564035 - RNA, 15 nt, Human
gcccugaccucccag

SEQ ID NO: 2564036 - RNA, 13 nt, Human
gcccugaccuccc

SEQ ID NO: 2564037 - RNA, 12 nt, Human
gcccugaccucc

SEQ ID NO: 2564038 - RNA, 17 nt, Human
gcccugacauuggagcc

SEQ ID NO: 2564039 - RNA, 17 nt, Human
gcccugacccuguggaa

SEQ ID NO: 2564040 - RNA, 19 nt, Human
gcccucugcccacucccug

SEQ ID NO: 2564041 - RNA, 18 nt, Human
gcccucugcccacucccu

SEQ ID NO: 2564042 - RNA, 16 nt, Human
gcccucugcccacucc

SEQ ID NO: 2564043 - RNA, 13 nt, Human
gcccucugcccac

SEQ ID NO: 2564044 - RNA, 19 nt, Human
gcccuccccagagcacugg

SEQ ID NO: 2564045 - RNA, 17 nt, Human
gcccuccccagagcacu

SEQ ID NO: 2564046 - RNA, 17 nt, Human
gcccuccccaucccaug

SEQ ID NO: 2564047 - RNA, 21 nt, Human
gcccucccugccccucccuuc

SEQ ID NO: 2564048 - RNA, 18 nt, Human
gcccucccuguuccccag

SEQ ID NO: 2564049 - RNA, 20 nt, Human
gcccucccuguuccccagag

SEQ ID NO: 2564050 - RNA, 14 nt, Human
gcccucccuguccu

SEQ ID NO: 2564051 - RNA, 16 nt, Human
gcccucccuguccucc

SEQ ID NO: 2564052 - RNA, 18 nt, Human
gcccucccuguccuccuc

SEQ ID NO: 2564053 - RNA, 21 nt, Human
gcccucccuguccuccucgga

SEQ ID NO: 2564054 - RNA, 22 nt, Human
gcccucccuguuccccagagaa

SEQ ID NO: 2564055 - RNA, 21 nt, Human
gcccucccuuggaaaccugcc

SEQ ID NO: 2564056 - RNA, 19 nt, Human
gcccucccuuggaaaccug

SEQ ID NO: 2564057 - RNA, 21 nt, Human
gcccucccuguuccccagaga

SEQ ID NO: 2564058 - RNA, 22 nt, Human
gcccuccgacagcccccucugc

SEQ ID NO: 2564059 - RNA, 18 nt, Human
gcccuccgacagcccccu

SEQ ID NO: 2564060 - RNA, 14 nt, Human
gcccuccgacagcc

SEQ ID NO: 2564061 - RNA, 23 nt, Human
gcccucccuuggaaaccugcccu

SEQ ID NO: 2564062 - RNA, 23 nt, Human
gcccuccgccauucucaagcccu

SEQ ID NO: 2564063 - RNA, 17 nt, Human
gcccuccuacccugcgc

SEQ ID NO: 2564064 - RNA, 20 nt, Human
gcccgggaaggucaccagca

SEQ ID NO: 2564065 - RNA, 18 nt, Human
gcccgggaaggucaccag

SEQ ID NO: 2564066 - RNA, 14 nt, Human
gcccggcugguuuu

SEQ ID NO: 2564067 - RNA, 15 nt, Human
gcccgcacccccacc

SEQ ID NO: 2564068 - RNA, 16 nt, Human
gcccgcacccccaccc

SEQ ID NO: 2564069 - RNA, 17 nt, Human
gcccgcacccccacccu

SEQ ID NO: 2564070 - RNA, 21 nt, Human
gcccgcacccccacccuuugg

SEQ ID NO: 2564071 - RNA, 19 nt, Human
gcccgcacccccacccuuu

SEQ ID NO: 2564072 - RNA, 21 nt, Human
gcccuccaagaccuucuccuu

SEQ ID NO: 2564073 - RNA, 19 nt, Human
gcccuccaagaccuucucc

SEQ ID NO: 2564074 - RNA, 19 nt, Human
gcccgggagcugcugcccu

SEQ ID NO: 2564075 - RNA, 14 nt, Human
gcccgggagcugcu

SEQ ID NO: 2564076 - RNA, 23 nt, Human
gcccgggaaggucaccagcacca

SEQ ID NO: 2564077 - RNA, 18 nt, Human
gcccgggcgcggccagcc

SEQ ID NO: 2564078 - RNA, 19 nt, Human
gcccucauggccccucuga

SEQ ID NO: 2564079 - RNA, 18 nt, Human
gcccucauggccccucug

SEQ ID NO: 2564080 - RNA, 22 nt, Human
gcccucauggccccucugaccu

SEQ ID NO: 2564081 - RNA, 23 nt, Human
gcccuccaagaccuucuccuuca

SEQ ID NO: 2564082 - RNA, 22 nt, Human
gcccuccaagaccuucuccuuc

SEQ ID NO: 2564083 - RNA, 14 nt, Human
gcccuccaaaagca

SEQ ID NO: 2564084 - RNA, 19 nt, Human
gcccgggcgcggccagccc

SEQ ID NO: 2564085 - RNA, 15 nt, Human
gcccuccaaaagcac

SEQ ID NO: 2564086 - RNA, 14 nt, Human
gcccuccacagccg

SEQ ID NO: 2564087 - RNA, 20 nt, Human
gcccuccacagccgcagccu

SEQ ID NO: 2564088 - RNA, 17 nt, Human
gcccuccacaucccuga

SEQ ID NO: 2564089 - RNA, 23 nt, Human
gcccuccacagccgcagccuccc

SEQ ID NO: 2564090 - RNA, 17 nt, Human
gcccuccagcucuuucc

SEQ ID NO: 2564091 - RNA, 21 nt, Human
gcccuccagcucuuuccuccu

SEQ ID NO: 2564092 - RNA, 20 nt, Human
gcccuccaucuaaacugccc

SEQ ID NO: 2564093 - RNA, 21 nt, Human
gcccuccacgccggcucuucc

SEQ ID NO: 2564094 - RNA, 21 nt, Human
gcccuccaucuaaacugcccc

SEQ ID NO: 2564095 - RNA, 16 nt, Human
gcccuccaucccgaca

SEQ ID NO: 2564096 - RNA, 22 nt, Human
gcccuccaucccgacauggacc

SEQ ID NO: 2564097 - RNA, 16 nt, Human
gcccuccccagagcac

SEQ ID NO: 2564098 - RNA, 15 nt, Human
gcccuccccagagca

SEQ ID NO: 2564099 - RNA, 13 nt, Human
gcccuccccagag

SEQ ID NO: 2564100 - RNA, 14 nt, Human
gcccucccaucccg

SEQ ID NO: 2564101 - RNA, 12 nt, Human
gcccucccaggc

SEQ ID NO: 2564102 - RNA, 21 nt, Human
gcccucccaggcucucaacag

SEQ ID NO: 2564103 - RNA, 17 nt, Human
gcccaccuuggcucaag

SEQ ID NO: 2564104 - RNA, 16 nt, Human
gcccaccuuggcucaa

SEQ ID NO: 2564105 - RNA, 15 nt, Human
gcccaccuuggcuca

SEQ ID NO: 2564106 - RNA, 13 nt, Human
gcccaccuuggcu

SEQ ID NO: 2564107 - RNA, 14 nt, Human
gcccacuucugcca

SEQ ID NO: 2564108 - RNA, 19 nt, Human
gcccagaaaaggacagaaa

SEQ ID NO: 2564109 - RNA, 16 nt, Human
gcccagaauaaguuau

SEQ ID NO: 2564110 - RNA, 16 nt, Human
gcccagaaaaggacag

SEQ ID NO: 2564111 - RNA, 22 nt, Human
gcccacuugucccacuaucugg

SEQ ID NO: 2564112 - RNA, 22 nt, Human
gcccaccugucaaacaaagcca

SEQ ID NO: 2564113 - RNA, 23 nt, Human
gcccagaauaaguuauugcaguu

SEQ ID NO: 2564114 - RNA, 20 nt, Human
gcccagaauaaguuauugca

SEQ ID NO: 2564115 - RNA, 16 nt, Human
gcccagaaugaggcug

SEQ ID NO: 2564116 - RNA, 17 nt, Human
gcccagaaugaggcugc

SEQ ID NO: 2564117 - RNA, 18 nt, Human
gcccagaaaaggacagaa

SEQ ID NO: 2564118 - RNA, 24 nt, Human
gcccaccuggccucugcacucccc

SEQ ID NO: 2564119 - RNA, 21 nt, Human
gcccaccuggccucugcacuc

SEQ ID NO: 2564120 - RNA, 20 nt, Human
gcccaccuggccucugcacu

SEQ ID NO: 2564121 - RNA, 17 nt, Human
gcccaccuggccucugc

SEQ ID NO: 2564122 - RNA, 16 nt, Human
gcccaccuggccucug

SEQ ID NO: 2564123 - RNA, 15 nt, Human
gcccaccuggccucu

SEQ ID NO: 2564124 - RNA, 14 nt, Human
gcccaccccccuca

SEQ ID NO: 2564125 - RNA, 20 nt, Human
gcccaccuggccaccugagg

SEQ ID NO: 2564126 - RNA, 19 nt, Human
gcccaccuggccaccugag

SEQ ID NO: 2564127 - RNA, 18 nt, Human
gcccaccuggccaccuga

SEQ ID NO: 2564128 - RNA, 17 nt, Human
gcccaccuggccaccug

SEQ ID NO: 2564129 - RNA, 16 nt, Human
gcccaccuggccaccu

SEQ ID NO: 2564130 - RNA, 14 nt, Human
gcccaccuggccac

SEQ ID NO: 2564131 - RNA, 13 nt, Human
gcccaccuggcca

SEQ ID NO: 2564132 - RNA, 13 nt, Human
gcccaccccccuc

SEQ ID NO: 2564133 - RNA, 14 nt, Human
gccaugguaccccc

SEQ ID NO: 2564134 - RNA, 19 nt, Human
gccaugguacccccuucug

SEQ ID NO: 2564135 - RNA, 17 nt, Human
gccaugguacccccuuc

SEQ ID NO: 2564136 - RNA, 16 nt, Human
gccaugguacccccuu

SEQ ID NO: 2564137 - RNA, 24 nt, Human
gcccaaccugcucuccucuugcca

SEQ ID NO: 2564138 - RNA, 22 nt, Human
gcccaagaauagaugcugacug

SEQ ID NO: 2564139 - RNA, 21 nt, Human
gcccaagaauagaugcugacu

SEQ ID NO: 2564140 - RNA, 19 nt, Human
gcccaagacagaugcccca

SEQ ID NO: 2564141 - RNA, 20 nt, Human
gcccaagacagaugccccag

SEQ ID NO: 2564142 - RNA, 21 nt, Human
gcccaagacagaugccccaga

SEQ ID NO: 2564143 - RNA, 23 nt, Human
gcccaagacagaugccccagagc

SEQ ID NO: 2564144 - RNA, 16 nt, Human
gccaugggccuccugu

SEQ ID NO: 2564145 - RNA, 15 nt, Human
gccaugggccuccug

SEQ ID NO: 2564146 - RNA, 19 nt, Human
gccaugggcacugugggua

SEQ ID NO: 2564147 - RNA, 24 nt, Human
gccaugcuccuggcccacugcauc

SEQ ID NO: 2564148 - RNA, 23 nt, Human
gcccaagccagaggcuggguuca

SEQ ID NO: 2564149 - RNA, 21 nt, Human
gcccaagccagaggcuggguu

SEQ ID NO: 2564150 - RNA, 18 nt, Human
gcccaagccagaggcugg

SEQ ID NO: 2564151 - RNA, 17 nt, Human
gcccaagccagaggcug

SEQ ID NO: 2564152 - RNA, 16 nt, Human
gcccaagccagaggcu

SEQ ID NO: 2564153 - RNA, 13 nt, Human
gcccaagaugcuu

SEQ ID NO: 2564154 - RNA, 15 nt, Human
gcccaagccagaggc

SEQ ID NO: 2564155 - RNA, 18 nt, Human
gcccaaggcggccccucc

SEQ ID NO: 2564156 - RNA, 17 nt, Human
gcccaaggcggccccuc

SEQ ID NO: 2564157 - RNA, 23 nt, Human
gcccaagggaaagaaaaggaagg

SEQ ID NO: 2564158 - RNA, 15 nt, Human
gcccaagggaucugg

SEQ ID NO: 2564159 - RNA, 18 nt, Human
gcccaagggaucuggucc

SEQ ID NO: 2564160 - RNA, 19 nt, Human
gcccaagggaucugguccu

SEQ ID NO: 2564161 - RNA, 16 nt, Human
gcccaaggcggccccu

SEQ ID NO: 2564162 - RNA, 15 nt, Human
gcccaaggcggcccc

SEQ ID NO: 2564163 - RNA, 12 nt, Human
gcccaagcucuu

SEQ ID NO: 2564164 - RNA, 20 nt, Human
gcccaagcccgacuugcugu

SEQ ID NO: 2564165 - RNA, 20 nt, Human
gcccaagcucagaaggcucu

SEQ ID NO: 2564166 - RNA, 17 nt, Human
gcccaccaacaucccau

SEQ ID NO: 2564167 - RNA, 16 nt, Human
gcccacauuggaccca

SEQ ID NO: 2564168 - RNA, 13 nt, Human
gcccaccccaccc

SEQ ID NO: 2564169 - RNA, 14 nt, Human
gcccaccagugacu

SEQ ID NO: 2564170 - RNA, 14 nt, Human
gcccaccagagcug

SEQ ID NO: 2564171 - RNA, 13 nt, Human
gcccaccagagcu

SEQ ID NO: 2564172 - RNA, 21 nt, Human
gcccaccaacaucccauugcc

SEQ ID NO: 2564173 - RNA, 14 nt, Human
gcccacaucccagg

SEQ ID NO: 2564174 - RNA, 15 nt, Human
gcccacaucccaggc

SEQ ID NO: 2564175 - RNA, 20 nt, Human
gcccacauagugaugguucc

SEQ ID NO: 2564176 - RNA, 13 nt, Human
gcccaagucccug

SEQ ID NO: 2564177 - RNA, 19 nt, Human
gcccaaguccaaauguuua

SEQ ID NO: 2564178 - RNA, 16 nt, Human
gcccaaguccaaaugu

SEQ ID NO: 2564179 - RNA, 15 nt, Human
gcccaaguccaaaug

SEQ ID NO: 2564180 - RNA, 21 nt, Human
gccaguaagggaaauagaaaa

SEQ ID NO: 2564181 - RNA, 22 nt, Human
gccaguaacgcgucuuccugag

SEQ ID NO: 2564182 - RNA, 21 nt, Human
gccaguaacgcgucuuccuga

SEQ ID NO: 2564183 - RNA, 20 nt, Human
gccaguaacgcgucuuccug

SEQ ID NO: 2564184 - RNA, 23 nt, Human
gccaguaucuauauauguguaug

SEQ ID NO: 2564185 - RNA, 22 nt, Human
gccaguaucuauauauguguau

SEQ ID NO: 2564186 - RNA, 23 nt, Human
gccaguaagggaaauagaaaaac

SEQ ID NO: 2564187 - RNA, 21 nt, Human
gccaguaucuauauaugugua

SEQ ID NO: 2564188 - RNA, 21 nt, Human
gccaguccaggcugccguggg

SEQ ID NO: 2564189 - RNA, 20 nt, Human
gccaguccaggcugccgugg

SEQ ID NO: 2564190 - RNA, 14 nt, Human
gccaguccaggcug

SEQ ID NO: 2564191 - RNA, 13 nt, Human
gccaguccaggcu

SEQ ID NO: 2564192 - RNA, 21 nt, Human
gccagucaccccggccaccug

SEQ ID NO: 2564193 - RNA, 16 nt, Human
gccagucccugaggca

SEQ ID NO: 2564194 - RNA, 22 nt, Human
gccagucccugaggcagguccc

SEQ ID NO: 2564195 - RNA, 16 nt, Human
gccaguccuagcugca

SEQ ID NO: 2564196 - RNA, 16 nt, Human
gccagucccaggggca

SEQ ID NO: 2564197 - RNA, 13 nt, Human
gccagucccaggg

SEQ ID NO: 2564198 - RNA, 22 nt, Human
gccaguccuagcugcacagggc

SEQ ID NO: 2564199 - RNA, 19 nt, Human
gccaguccuagcugcacag

SEQ ID NO: 2564200 - RNA, 14 nt, Human
gccaguccugccug

SEQ ID NO: 2564201 - RNA, 19 nt, Human
gccaucauaggaagggacc

SEQ ID NO: 2564202 - RNA, 23 nt, Human
gccaucaucuccugccuuccucc

SEQ ID NO: 2564203 - RNA, 16 nt, Human
gccaguccugccuggc

SEQ ID NO: 2564204 - RNA, 17 nt, Human
gccaguccugccuggcc

SEQ ID NO: 2564205 - RNA, 23 nt, Human
gccaguaaaugggggugcauuug

SEQ ID NO: 2564206 - RNA, 19 nt, Human
gccaguaacgcgucuuccu

SEQ ID NO: 2564207 - RNA, 12 nt, Human
gccaguaaaugg

SEQ ID NO: 2564208 - RNA, 18 nt, Human
gccaggcugaccacagca

SEQ ID NO: 2564209 - RNA, 19 nt, Human
gccaggcugaccacagcac

SEQ ID NO: 2564210 - RNA, 21 nt, Human
gccaggcucugugcugacccu

SEQ ID NO: 2564211 - RNA, 20 nt, Human
gccaggcugaccacagcaca

SEQ ID NO: 2564212 - RNA, 15 nt, Human
gccaggcuggucuca

SEQ ID NO: 2564213 - RNA, 20 nt, Human
gccaggcucugugcugaccc

SEQ ID NO: 2564214 - RNA, 16 nt, Human
gccaggcucugugcug

SEQ ID NO: 2564215 - RNA, 15 nt, Human
gccaggcugaccaca

SEQ ID NO: 2564216 - RNA, 16 nt, Human
gccaggcugaccacag

SEQ ID NO: 2564217 - RNA, 17 nt, Human
gccaggcugaccacagc

SEQ ID NO: 2564218 - RNA, 17 nt, Human
gccaggcugggucgccc

SEQ ID NO: 2564219 - RNA, 23 nt, Human
gccaggcugggucgcccuggacu

SEQ ID NO: 2564220 - RNA, 13 nt, Human
gccaggcuggucu

SEQ ID NO: 2564221 - RNA, 17 nt, Human
gccaugauggcaacaga

SEQ ID NO: 2564222 - RNA, 19 nt, Human
gccaugauggcaacagauc

SEQ ID NO: 2564223 - RNA, 21 nt, Human
gccaugauggcaacagaucug

SEQ ID NO: 2564224 - RNA, 23 nt, Human
gccaugauggcaacagaucugga

SEQ ID NO: 2564225 - RNA, 22 nt, Human
gccaugauggaaauauuuauuu

SEQ ID NO: 2564226 - RNA, 20 nt, Human
gccaugaggccucaguggac

SEQ ID NO: 2564227 - RNA, 16 nt, Human
gccaugaggccucagu

SEQ ID NO: 2564228 - RNA, 19 nt, Human
gccaugaggccucagugga

SEQ ID NO: 2564229 - RNA, 20 nt, Human
gccaugaggaacaaggcaag

SEQ ID NO: 2564230 - RNA, 20 nt, Human
gccaugaggaguugcuguuu

SEQ ID NO: 2564231 - RNA, 15 nt, Human
gccaugauguggagu

SEQ ID NO: 2564232 - RNA, 22 nt, Human
gccaugauggugcugaccucug

SEQ ID NO: 2564233 - RNA, 21 nt, Human
gccaugauggugcugaccucu

SEQ ID NO: 2564234 - RNA, 22 nt, Human
gccaugauguggaguggggcag

SEQ ID NO: 2564235 - RNA, 17 nt, Human
gccaugauguggagugg

SEQ ID NO: 2564236 - RNA, 20 nt, Human
gccaugauucgcccaaagcc

SEQ ID NO: 2564237 - RNA, 14 nt, Human
gccaugccucagcc

SEQ ID NO: 2564238 - RNA, 13 nt, Human
gccaugccucagc

SEQ ID NO: 2564239 - RNA, 14 nt, Human
gccaugcuccuggc

SEQ ID NO: 2564240 - RNA, 20 nt, Human
gccaugcgcccccuccgccc

SEQ ID NO: 2564241 - RNA, 21 nt, Human
gccaugccucagcccugaccc

SEQ ID NO: 2564242 - RNA, 17 nt, Human
gccaugccucagcccug

SEQ ID NO: 2564243 - RNA, 21 nt, Human
gccaucccucgugguccccaa

SEQ ID NO: 2564244 - RNA, 14 nt, Human
gccaucccucgugg

SEQ ID NO: 2564245 - RNA, 21 nt, Human
gccauccaaauaagaaaccua

SEQ ID NO: 2564246 - RNA, 19 nt, Human
gccaucaucaguggagcca

SEQ ID NO: 2564247 - RNA, 20 nt, Human
gccauccaaauaagaaaccu

SEQ ID NO: 2564248 - RNA, 17 nt, Human
gccaucauguuuacaga

SEQ ID NO: 2564249 - RNA, 21 nt, Human
gccaucauguuuacagaggac

SEQ ID NO: 2564250 - RNA, 14 nt, Human
gccauccagguuca

SEQ ID NO: 2564251 - RNA, 23 nt, Human
gccauccucaaacacugcaggca

SEQ ID NO: 2564252 - RNA, 21 nt, Human
gccauccucaaacacugcagg

SEQ ID NO: 2564253 - RNA, 20 nt, Human
gccauccucaaacacugcag

SEQ ID NO: 2564254 - RNA, 19 nt, Human
gccauccucaaacacugca

SEQ ID NO: 2564255 - RNA, 18 nt, Human
gccauccucaaacacugc

SEQ ID NO: 2564256 - RNA, 22 nt, Human
gccauccggcccccagagcgcc

SEQ ID NO: 2564257 - RNA, 19 nt, Human
gccauccggcccccagagc

SEQ ID NO: 2564258 - RNA, 22 nt, Human
gccaucuugguaaauuucccca

SEQ ID NO: 2564259 - RNA, 16 nt, Human
gccaucuugguaaauu

SEQ ID NO: 2564260 - RNA, 15 nt, Human
gccaucuugguaaau

SEQ ID NO: 2564261 - RNA, 14 nt, Human
gccaucuugguaaa

SEQ ID NO: 2564262 - RNA, 14 nt, Human
gccaucuucccagc

SEQ ID NO: 2564263 - RNA, 17 nt, Human
gccaucuuccagguggg

SEQ ID NO: 2564264 - RNA, 17 nt, Human
gccaucugugggcacgc

SEQ ID NO: 2564265 - RNA, 12 nt, Human
gccaucuguggg

SEQ ID NO: 2564266 - RNA, 13 nt, Human
gccaucugugggc

SEQ ID NO: 2564267 - RNA, 15 nt, Human
gccaucugugggcac

SEQ ID NO: 2564268 - RNA, 21 nt, Human
gccaucugggcuccuccaggg

SEQ ID NO: 2564269 - RNA, 21 nt, Human
gccagagacacaagccuucgg

SEQ ID NO: 2564270 - RNA, 22 nt, Human
gccacugcaccgggccacagag

SEQ ID NO: 2564271 - RNA, 22 nt, Human
gccagagacacaagccuucggc

SEQ ID NO: 2564272 - RNA, 20 nt, Human
gccagagacggaagccuuuu

SEQ ID NO: 2564273 - RNA, 22 nt, Human
gccacucccggcacuccaugcu

SEQ ID NO: 2564274 - RNA, 21 nt, Human
gccacuccucugacucagggc

SEQ ID NO: 2564275 - RNA, 19 nt, Human
gccacugcaccgggccaca

SEQ ID NO: 2564276 - RNA, 13 nt, Human
gccacuccucuga

SEQ ID NO: 2564277 - RNA, 14 nt, Human
gccacuccucugac

SEQ ID NO: 2564278 - RNA, 15 nt, Human
gccacuccucugacu

SEQ ID NO: 2564279 - RNA, 17 nt, Human
gccacuccucugacuca

SEQ ID NO: 2564280 - RNA, 21 nt, Human
gccacuccgagaggugggcca

SEQ ID NO: 2564281 - RNA, 22 nt, Human
gccacuccagaccccuggcuuu

SEQ ID NO: 2564282 - RNA, 21 nt, Human
gccacugcaccgggccacaga

SEQ ID NO: 2564283 - RNA, 20 nt, Human
gccacugcaccgggccacag

SEQ ID NO: 2564284 - RNA, 20 nt, Human
gccaaggccaaaggaagcac

SEQ ID NO: 2564285 - RNA, 21 nt, Human
gccaacacgcaccugccucag

SEQ ID NO: 2564286 - RNA, 23 nt, Human
gccaacacgcaccugccucagga

SEQ ID NO: 2564287 - RNA, 20 nt, Human
gccaacacucaagaagcagg

SEQ ID NO: 2564288 - RNA, 17 nt, Human
gccaacagaagcuucca

SEQ ID NO: 2564289 - RNA, 17 nt, Human
gccaacacgcaccugcc

SEQ ID NO: 2564290 - RNA, 20 nt, Human
gccaacacgcaccugccuca

SEQ ID NO: 2564291 - RNA, 16 nt, Human
gccaacaacuucucca

SEQ ID NO: 2564292 - RNA, 18 nt, Human
gccaacaaagcuguugau

SEQ ID NO: 2564293 - RNA, 14 nt, Human
gccaacaccaggga

SEQ ID NO: 2564294 - RNA, 19 nt, Human
gccaaauuauuuguguaau

SEQ ID NO: 2564295 - RNA, 18 nt, Human
gccaaauuauuuguguaa

SEQ ID NO: 2564296 - RNA, 15 nt, Human
gccaacaaagcuguu

SEQ ID NO: 2564297 - RNA, 13 nt, Human
gccaacaaagcug

SEQ ID NO: 2564298 - RNA, 23 nt, Human
gccaaauuauuuguguaauagaa

SEQ ID NO: 2564299 - RNA, 14 nt, Human
gccaaauuuuggcc

SEQ ID NO: 2564300 - RNA, 24 nt, Human
gccaaggccaaaggaagcacaugc

SEQ ID NO: 2564301 - RNA, 20 nt, Human
gccaaggccagaguggccug

SEQ ID NO: 2564302 - RNA, 21 nt, Human
gccaaggccagaguggccugg

SEQ ID NO: 2564303 - RNA, 20 nt, Human
gccacuccagaccccuggcu

SEQ ID NO: 2564304 - RNA, 21 nt, Human
gccacuccagaccccuggcuu

SEQ ID NO: 2564305 - RNA, 20 nt, Human
gccaaggccgaagcucuggc

SEQ ID NO: 2564306 - RNA, 19 nt, Human
gccaaggccgaagcucugg

SEQ ID NO: 2564307 - RNA, 18 nt, Human
gccaaggccgaagcucug

SEQ ID NO: 2564308 - RNA, 16 nt, Human
gccaacacucaagaag

SEQ ID NO: 2564309 - RNA, 15 nt, Human
gccaaggccuucucc

SEQ ID NO: 2564310 - RNA, 14 nt, Human
gccaaggccuucuc

SEQ ID NO: 2564311 - RNA, 18 nt, Human
gccaaggccuucuccucc

SEQ ID NO: 2564312 - RNA, 13 nt, Human
gccagauuucacu

SEQ ID NO: 2564313 - RNA, 24 nt, Human
gccagauucuuuccugaggcuggg

SEQ ID NO: 2564314 - RNA, 20 nt, Human
gccagauucuuuccugaggc

SEQ ID NO: 2564315 - RNA, 15 nt, Human
gccagaugcaccagc

SEQ ID NO: 2564316 - RNA, 19 nt, Human
gccagauucuuuccugagg

SEQ ID NO: 2564317 - RNA, 22 nt, Human
gccagccgagauagccaaggcc

SEQ ID NO: 2564318 - RNA, 14 nt, Human
gccagccuccucug

SEQ ID NO: 2564319 - RNA, 13 nt, Human
gccagccuccucu

SEQ ID NO: 2564320 - RNA, 12 nt, Human
gccagccuccuc

SEQ ID NO: 2564321 - RNA, 21 nt, Human
gccagccuccgagagggagag

SEQ ID NO: 2564322 - RNA, 20 nt, Human
gccagccuccgagagggaga

SEQ ID NO: 2564323 - RNA, 18 nt, Human
gccagccuccgagaggga

SEQ ID NO: 2564324 - RNA, 21 nt, Human
gccagccgugaugcucaggcu

SEQ ID NO: 2564325 - RNA, 20 nt, Human
gccagccgugaugcucaggc

SEQ ID NO: 2564326 - RNA, 18 nt, Human
gccagccgugaugcucag

SEQ ID NO: 2564327 - RNA, 15 nt, Human
gccagauccagccug

SEQ ID NO: 2564328 - RNA, 16 nt, Human
gccagauccagccugg

SEQ ID NO: 2564329 - RNA, 17 nt, Human
gccagauccagccuggg

SEQ ID NO: 2564330 - RNA, 20 nt, Human
gccagauccagccugggguc

SEQ ID NO: 2564331 - RNA, 13 nt, Human
gccagaggcuggg

SEQ ID NO: 2564332 - RNA, 12 nt, Human
gccagaggcugg

SEQ ID NO: 2564333 - RNA, 17 nt, Human
gccagagggagugacag

SEQ ID NO: 2564334 - RNA, 14 nt, Human
gccagaugcaccag

SEQ ID NO: 2564335 - RNA, 15 nt, Human
gccagauccucuugg

SEQ ID NO: 2564336 - RNA, 16 nt, Human
gccagauccucuuggu

SEQ ID NO: 2564337 - RNA, 19 nt, Human
gccagaggcccccagccca

SEQ ID NO: 2564338 - RNA, 18 nt, Human
gccagaggcccccagccc

SEQ ID NO: 2564339 - RNA, 16 nt, Human
gccagaggcccccagc

SEQ ID NO: 2564340 - RNA, 15 nt, Human
gccagaggcccccag

SEQ ID NO: 2564341 - RNA, 23 nt, Human
gccagaggcccccagcccagggc

SEQ ID NO: 2564342 - RNA, 20 nt, Human
gccagaggcccccagcccag

SEQ ID NO: 2564343 - RNA, 24 nt, Human
gccagaggcccccagcccagggcu

SEQ ID NO: 2564344 - RNA, 22 nt, Human
gccagaggcucguugacuggcu

SEQ ID NO: 2564345 - RNA, 16 nt, Human
gccagagauccaaaag

SEQ ID NO: 2564346 - RNA, 20 nt, Human
gccagagauccaaaagaagc

SEQ ID NO: 2564347 - RNA, 13 nt, Human
gccagagauccaa

SEQ ID NO: 2564348 - RNA, 21 nt, Human
gccagagagccuggugcugcu

SEQ ID NO: 2564349 - RNA, 21 nt, Human
gccagagauccaaaagaagcc

SEQ ID NO: 2564350 - RNA, 14 nt, Human
gccagaggccccca

SEQ ID NO: 2564351 - RNA, 17 nt, Human
gccaggaauuucccagg

SEQ ID NO: 2564352 - RNA, 18 nt, Human
gccaggaauuucccagga

SEQ ID NO: 2564353 - RNA, 19 nt, Human
gccaggaauuucccaggac

SEQ ID NO: 2564354 - RNA, 20 nt, Human
gccaggaauuucccaggacc

SEQ ID NO: 2564355 - RNA, 15 nt, Human
gccaggaagccagca

SEQ ID NO: 2564356 - RNA, 17 nt, Human
gccaggacugagccccg

SEQ ID NO: 2564357 - RNA, 16 nt, Human
gccaggacugagcccc

SEQ ID NO: 2564358 - RNA, 15 nt, Human
gccaggacugagccc

SEQ ID NO: 2564359 - RNA, 22 nt, Human
gccaggacuccccaggccaggc

SEQ ID NO: 2564360 - RNA, 21 nt, Human
gccaggacuccccaggccagg

SEQ ID NO: 2564361 - RNA, 19 nt, Human
gccaggacuccccaggcca

SEQ ID NO: 2564362 - RNA, 17 nt, Human
gccaggacuccccaggc

SEQ ID NO: 2564363 - RNA, 23 nt, Human
gccaggaauuucccaggacccug

SEQ ID NO: 2564364 - RNA, 21 nt, Human
gccaggaauuucccaggaccc

SEQ ID NO: 2564365 - RNA, 22 nt, Human
gccaggaauuucccaggacccu

SEQ ID NO: 2564366 - RNA, 14 nt, Human
gccaggacaggccc

SEQ ID NO: 2564367 - RNA, 15 nt, Human
gccaggacaggcccg

SEQ ID NO: 2564368 - RNA, 22 nt, Human
gccaggaccagucaaccugggc

SEQ ID NO: 2564369 - RNA, 15 nt, Human
gccaggacuccccag

SEQ ID NO: 2564370 - RNA, 22 nt, Human
gccaggagcaaauguuucugca

SEQ ID NO: 2564371 - RNA, 20 nt, Human
gccaggagcaaauguuucug

SEQ ID NO: 2564372 - RNA, 15 nt, Human
gccaggagcaaaugu

SEQ ID NO: 2564373 - RNA, 19 nt, Human
gccaggacugagccccgca

SEQ ID NO: 2564374 - RNA, 16 nt, Human
gccaggagccuccugc

SEQ ID NO: 2564375 - RNA, 14 nt, Human
gccaggagccuccu

SEQ ID NO: 2564376 - RNA, 20 nt, Human
gccaggagccuccugcccuu

SEQ ID NO: 2564377 - RNA, 19 nt, Human
gccaggagccuccugcccu

SEQ ID NO: 2564378 - RNA, 16 nt, Human
gccaggcgggcucaag

SEQ ID NO: 2564379 - RNA, 16 nt, Human
gccaggcgagaugggg

SEQ ID NO: 2564380 - RNA, 21 nt, Human
gccaggccugggucugugucu

SEQ ID NO: 2564381 - RNA, 12 nt, Human
gccaggcucugu

SEQ ID NO: 2564382 - RNA, 20 nt, Human
gccaggcuccuuccugucuu

SEQ ID NO: 2564383 - RNA, 21 nt, Human
gccaggcuccuuccugucuuc

SEQ ID NO: 2564384 - RNA, 14 nt, Human
gccaggcuccuucc

SEQ ID NO: 2564385 - RNA, 15 nt, Human
gccaggcuccuuccu

SEQ ID NO: 2564386 - RNA, 18 nt, Human
gccaggcuccuuccuguc

SEQ ID NO: 2564387 - RNA, 19 nt, Human
gccaggcuccuuccugucu

SEQ ID NO: 2564388 - RNA, 14 nt, Human
gccaggaagccagc

SEQ ID NO: 2564389 - RNA, 13 nt, Human
gccaggaagccag

SEQ ID NO: 2564390 - RNA, 12 nt, Human
gccaggaagcca

SEQ ID NO: 2564391 - RNA, 20 nt, Human
gccagcugcuugggcuucau

SEQ ID NO: 2564392 - RNA, 18 nt, Human
gccagcugcuugggcuuc

SEQ ID NO: 2564393 - RNA, 17 nt, Human
gccagcugcuugggcuu

SEQ ID NO: 2564394 - RNA, 20 nt, Human
gccagcugccgaccagagcc

SEQ ID NO: 2564395 - RNA, 18 nt, Human
gccagcugccccagccag

SEQ ID NO: 2564396 - RNA, 16 nt, Human
gccagcugcuugggcu

SEQ ID NO: 2564397 - RNA, 15 nt, Human
gccagcugccgacca

SEQ ID NO: 2564398 - RNA, 17 nt, Human
gccagcugccccagcca

SEQ ID NO: 2564399 - RNA, 12 nt, Human
gccagccuggcu

SEQ ID NO: 2564400 - RNA, 16 nt, Human
gccagccuggcuucug

SEQ ID NO: 2564401 - RNA, 17 nt, Human
gccagccuggcuucugg

SEQ ID NO: 2564402 - RNA, 18 nt, Human
gccagccuggcuucugga

SEQ ID NO: 2564403 - RNA, 19 nt, Human
gccagccuggcuucuggag

SEQ ID NO: 2564404 - RNA, 16 nt, Human
gccagccuccucugga

SEQ ID NO: 2564405 - RNA, 15 nt, Human
gccagccuccucugg

SEQ ID NO: 2564406 - RNA, 19 nt, Human
gccagccugcuccuuccca

SEQ ID NO: 2564407 - RNA, 17 nt, Human
gccagccuccucuggac

SEQ ID NO: 2564408 - RNA, 11 nt, Human
gccagccuggc

SEQ ID NO: 2564409 - RNA, 23 nt, Human
gccagcucuguaucaggacccag

SEQ ID NO: 2564410 - RNA, 15 nt, Human
gccagcucuguauca

SEQ ID NO: 2564411 - RNA, 20 nt, Human
gccagccuggcuucuggagc

SEQ ID NO: 2564412 - RNA, 21 nt, Human
gccagccuggcuucuggagcc

SEQ ID NO: 2564413 - RNA, 22 nt, Human
gccagccuggcuucuggagccc

SEQ ID NO: 2564414 - RNA, 20 nt, Human
gccagcugcacugaugcugc

SEQ ID NO: 2564415 - RNA, 14 nt, Human
gccagcugcacuga

SEQ ID NO: 2564416 - RNA, 13 nt, Human
gccuguuuaagag

SEQ ID NO: 2564417 - RNA, 20 nt, Human
gccugguggaaggaggcgca

SEQ ID NO: 2564418 - RNA, 20 nt, Human
gccuguuuuagaagguucuc

SEQ ID NO: 2564419 - RNA, 12 nt, Human
gccuguuuaaga

SEQ ID NO: 2564420 - RNA, 13 nt, Human
gccuggugggccu

SEQ ID NO: 2564421 - RNA, 15 nt, Human
gccuggugggccucc

SEQ ID NO: 2564422 - RNA, 21 nt, Human
gccuguugggccaggagccuc

SEQ ID NO: 2564423 - RNA, 21 nt, Human
gccuuacacaaugguuuucuu

SEQ ID NO: 2564424 - RNA, 18 nt, Human
gccuuacccucauguucu

SEQ ID NO: 2564425 - RNA, 20 nt, Human
gccuuacacaaugguuuucu

SEQ ID NO: 2564426 - RNA, 13 nt, Human
gccuuaaaacuuu

SEQ ID NO: 2564427 - RNA, 14 nt, Human
gccuuaaaaccaaa

SEQ ID NO: 2564428 - RNA, 12 nt, Human
gccuuaaaacuu

SEQ ID NO: 2564429 - RNA, 18 nt, Human
gccuuagaagucacacag

SEQ ID NO: 2564430 - RNA, 17 nt, Human
gccuuagaagucacaca

SEQ ID NO: 2564431 - RNA, 19 nt, Human
gccuuagaagucacacagu

SEQ ID NO: 2564432 - RNA, 17 nt, Human
gccuuagaaccuuucuu

SEQ ID NO: 2564433 - RNA, 14 nt, Human
gccuuauggaacac

SEQ ID NO: 2564434 - RNA, 10 nt, Human
gccuuaugga

SEQ ID NO: 2564435 - RNA, 13 nt, Human
gccuuauccucug

SEQ ID NO: 2564436 - RNA, 20 nt, Human
gccuuaucaagugucuucca

SEQ ID NO: 2564437 - RNA, 19 nt, Human
gccuuaucaagugucuucc

SEQ ID NO: 2564438 - RNA, 17 nt, Human
gccuuaucaagugucuu

SEQ ID NO: 2564439 - RNA, 14 nt, Human
gccuuaucaagugu

SEQ ID NO: 2564440 - RNA, 13 nt, Human
gccuuaucaagug

SEQ ID NO: 2564441 - RNA, 17 nt, Human
gccuuaaaaccaaagag

SEQ ID NO: 2564442 - RNA, 16 nt, Human
gccuuauccucugauc

SEQ ID NO: 2564443 - RNA, 15 nt, Human
gccuuauccucugau

SEQ ID NO: 2564444 - RNA, 22 nt, Human
gccuuaucuugcaccccaaagc

SEQ ID NO: 2564445 - RNA, 23 nt, Human
gccuuaucuccaagaccagagau

SEQ ID NO: 2564446 - RNA, 15 nt, Human
gccugcaauuucaua

SEQ ID NO: 2564447 - RNA, 15 nt, Human
gccugccacucaggc

SEQ ID NO: 2564448 - RNA, 14 nt, Human
gccugccagcugca

SEQ ID NO: 2564449 - RNA, 15 nt, Human
gccugccagcugcac

SEQ ID NO: 2564450 - RNA, 23 nt, Human
gccugccacucaggcccaaagcc

SEQ ID NO: 2564451 - RNA, 14 nt, Human
gccugccaguccua

SEQ ID NO: 2564452 - RNA, 18 nt, Human
gccugccagcugcacuga

SEQ ID NO: 2564453 - RNA, 16 nt, Human
gccugggggugccagg

SEQ ID NO: 2564454 - RNA, 17 nt, Human
gccugggggugccagga

SEQ ID NO: 2564455 - RNA, 22 nt, Human
gccugggguaccaagagacucc

SEQ ID NO: 2564456 - RNA, 15 nt, Human
gccugccaguccuag

SEQ ID NO: 2564457 - RNA, 21 nt, Human
gccugggggugccaggaccag

SEQ ID NO: 2564458 - RNA, 22 nt, Human
gccugggggcugggcagaggaa

SEQ ID NO: 2564459 - RNA, 14 nt, Human
gccugguggcagcu

SEQ ID NO: 2564460 - RNA, 13 nt, Human
gccuggugcugcu

SEQ ID NO: 2564461 - RNA, 18 nt, Human
gccugguggcagcugcgg

SEQ ID NO: 2564462 - RNA, 21 nt, Human
gccugguggcagcugcggucc

SEQ ID NO: 2564463 - RNA, 19 nt, Human
gccugguggcagcugcggu

SEQ ID NO: 2564464 - RNA, 13 nt, Human
gccuggugcagug

SEQ ID NO: 2564465 - RNA, 13 nt, Human
gccugguggcagc

SEQ ID NO: 2564466 - RNA, 14 nt, Human
gccugggguggggu

SEQ ID NO: 2564467 - RNA, 16 nt, Human
gccuggggugggguca

SEQ ID NO: 2564468 - RNA, 14 nt, Human
gccuggggucugga

SEQ ID NO: 2564469 - RNA, 17 nt, Human
gccugguccucacacuc

SEQ ID NO: 2564470 - RNA, 22 nt, Human
gccugggguggggucaugcccu

SEQ ID NO: 2564471 - RNA, 13 nt, Human
gccuuccuugcua

SEQ ID NO: 2564472 - RNA, 19 nt, Human
gccuuccuguuuuucacau

SEQ ID NO: 2564473 - RNA, 22 nt, Human
gccuucgauacaccgggccugg

SEQ ID NO: 2564474 - RNA, 18 nt, Human
gccuucgauacaccgggc

SEQ ID NO: 2564475 - RNA, 20 nt, Human
gccuuggagggucccaagcu

SEQ ID NO: 2564476 - RNA, 19 nt, Human
gccuuggagggucccaagc

SEQ ID NO: 2564477 - RNA, 19 nt, Human
gccuuggaaguugcauggc

SEQ ID NO: 2564478 - RNA, 14 nt, Human
gccuugcuggacgg

SEQ ID NO: 2564479 - RNA, 22 nt, Human
gccuugcucccaaccccacacg

SEQ ID NO: 2564480 - RNA, 19 nt, Human
gccuugcuaccucaagggg

SEQ ID NO: 2564481 - RNA, 11 nt, Human
gccuuccuugc

SEQ ID NO: 2564482 - RNA, 19 nt, Human
gccuuccugcccuacagag

SEQ ID NO: 2564483 - RNA, 23 nt, Human
gccuucgauacaccgggccugga

SEQ ID NO: 2564484 - RNA, 16 nt, Human
gccuuccagggguggg

SEQ ID NO: 2564485 - RNA, 15 nt, Human
gccuuccaggggugg

SEQ ID NO: 2564486 - RNA, 21 nt, Human
gccuuccaggggugggacacc

SEQ ID NO: 2564487 - RNA, 18 nt, Human
gccuuccagcacccugca

SEQ ID NO: 2564488 - RNA, 21 nt, Human
gccuuccucugcagcugaccu

SEQ ID NO: 2564489 - RNA, 20 nt, Human
gccuuccucugcagcugacc

SEQ ID NO: 2564490 - RNA, 19 nt, Human
gccuuccucugcagcugac

SEQ ID NO: 2564491 - RNA, 17 nt, Human
gccuuccucugcagcug

SEQ ID NO: 2564492 - RNA, 16 nt, Human
gccuuccucugcagcu

SEQ ID NO: 2564493 - RNA, 13 nt, Human
gccuuccucugca

SEQ ID NO: 2564494 - RNA, 22 nt, Human
gccuuccacuuggcuacacagg

SEQ ID NO: 2564495 - RNA, 23 nt, Human
gccuuccacgcugucuccagacc

SEQ ID NO: 2564496 - RNA, 20 nt, Human
gccuuauggaacacucugag

SEQ ID NO: 2564497 - RNA, 19 nt, Human
gccuuauggaacacucuga

SEQ ID NO: 2564498 - RNA, 18 nt, Human
gccuuauggaacacucug

SEQ ID NO: 2564499 - RNA, 16 nt, Human
gccuuauggaacacuc

SEQ ID NO: 2564500 - RNA, 13 nt, Human
gccuucagggagu

SEQ ID NO: 2564501 - RNA, 21 nt, Human
gccuucagggagugagggauu

SEQ ID NO: 2564502 - RNA, 17 nt, Human
gccuuauccucugaucu

SEQ ID NO: 2564503 - RNA, 13 nt, Human
gccuucaucuccc

SEQ ID NO: 2564504 - RNA, 12 nt, Human
gccuuccagggg

SEQ ID NO: 2564505 - RNA, 13 nt, Human
gccuucauuaccu

SEQ ID NO: 2564506 - RNA, 19 nt, Human
gccuuccacgcugucucca

SEQ ID NO: 2564507 - RNA, 22 nt, Human
gccuuccacgcugucuccagac

SEQ ID NO: 2564508 - RNA, 22 nt, Human
gccuuuggaaacagcucgacuu

SEQ ID NO: 2564509 - RNA, 13 nt, Human
gccuuugcuccuc

SEQ ID NO: 2564510 - RNA, 20 nt, Human
gccuuuggaugaccagaaca

SEQ ID NO: 2564511 - RNA, 15 nt, Human
gccuuugccuccccg

SEQ ID NO: 2564512 - RNA, 18 nt, Human
gccuuugagcccacaaag

SEQ ID NO: 2564513 - RNA, 23 nt, Human
gccuuugagacaguuucuuagcu

SEQ ID NO: 2564514 - RNA, 22 nt, Human
gccuuugaguuuccucaggcug

SEQ ID NO: 2564515 - RNA, 17 nt, Human
gccuuugaucagguggg

SEQ ID NO: 2564516 - RNA, 23 nt, Human
gccuuugagcccacaaagccuua

SEQ ID NO: 2564517 - RNA, 21 nt, Human
gccuuugagacaguuucuuag

SEQ ID NO: 2564518 - RNA, 20 nt, Human
gccuuugagacaguuucuua

SEQ ID NO: 2564519 - RNA, 19 nt, Human
gccuuugagacaguuucuu

SEQ ID NO: 2564520 - RNA, 14 nt, Human
gccuuugagacagu

SEQ ID NO: 2564521 - RNA, 16 nt, Human
gccuuugaccugccuc

SEQ ID NO: 2564522 - RNA, 14 nt, Human
gccuuggcucagac

SEQ ID NO: 2564523 - RNA, 15 nt, Human
gccuuggcucagaca

SEQ ID NO: 2564524 - RNA, 16 nt, Human
gccuuggcucagacau

SEQ ID NO: 2564525 - RNA, 12 nt, Human
gccuuggcucag

SEQ ID NO: 2564526 - RNA, 20 nt, Human
gccuuggccuccccugcuga

SEQ ID NO: 2564527 - RNA, 21 nt, Human
gccuuggauaaugcuguugcc

SEQ ID NO: 2564528 - RNA, 21 nt, Human
gccuuggagggucccaagcug

SEQ ID NO: 2564529 - RNA, 19 nt, Human
gccuuggauaaugcuguug

SEQ ID NO: 2564530 - RNA, 23 nt, Human
gccuuggauaaugcuguugccuc

SEQ ID NO: 2564531 - RNA, 23 nt, Human
gccuuuuuucacggaaguuuuca

SEQ ID NO: 2564532 - RNA, 20 nt, Human
gccuuuuuucacggaaguuu

SEQ ID NO: 2564533 - RNA, 19 nt, Human
gccuuuuuucacggaaguu

SEQ ID NO: 2564534 - RNA, 16 nt, Human
gccuuuggcucuggag

SEQ ID NO: 2564535 - RNA, 23 nt, Human
gcgacaaugcaaaccaucauuga

SEQ ID NO: 2564536 - RNA, 23 nt, Human
gcgaaaggauguaaacagugccu

SEQ ID NO: 2564537 - RNA, 15 nt, Human
gccuuuggcucugga

SEQ ID NO: 2564538 - RNA, 13 nt, Human
gccuuuggcucug

SEQ ID NO: 2564539 - RNA, 13 nt, Human
gccuuuggcuuca

SEQ ID NO: 2564540 - RNA, 15 nt, Human
gccuuuggcaggugc

SEQ ID NO: 2564541 - RNA, 13 nt, Human
gccuuuggcaggu

SEQ ID NO: 2564542 - RNA, 16 nt, Human
gccuuuggcagaguuc

SEQ ID NO: 2564543 - RNA, 15 nt, Human
gcuaggaacacuccu

SEQ ID NO: 2564544 - RNA, 23 nt, Human
gcuagcuucugcuuuucugcccu

SEQ ID NO: 2564545 - RNA, 18 nt, Human
gcuagcuucugcuuuucu

SEQ ID NO: 2564546 - RNA, 17 nt, Human
gcuagcuucugcuuuuc

SEQ ID NO: 2564547 - RNA, 19 nt, Human
gcuaggaaauccagggugg

SEQ ID NO: 2564548 - RNA, 15 nt, Human
gcuagcuucugcuuu

SEQ ID NO: 2564549 - RNA, 22 nt, Human
gcuagaauucccucucucugac

SEQ ID NO: 2564550 - RNA, 19 nt, Human
gcuagaaucuggagagcua

SEQ ID NO: 2564551 - RNA, 17 nt, Human
gcuagaauauccuacuu

SEQ ID NO: 2564552 - RNA, 21 nt, Human
gcuagaagugggccaggacag

SEQ ID NO: 2564553 - RNA, 15 nt, Human
gcuagaagcuggagg

SEQ ID NO: 2564554 - RNA, 14 nt, Human
gcuagaagcuggag

SEQ ID NO: 2564555 - RNA, 21 nt, Human
gcuaccuugugacccagcacu

SEQ ID NO: 2564556 - RNA, 15 nt, Human
gcuagaaggccacau

SEQ ID NO: 2564557 - RNA, 13 nt, Human
gcuagaaggccac

SEQ ID NO: 2564558 - RNA, 17 nt, Human
gcuagaaggccacaugu

SEQ ID NO: 2564559 - RNA, 20 nt, Human
gcuagaagugggccaggaca

SEQ ID NO: 2564560 - RNA, 13 nt, Human
gcuauaggugcua

SEQ ID NO: 2564561 - RNA, 17 nt, Human
gcuauagcucaggaccu

SEQ ID NO: 2564562 - RNA, 16 nt, Human
gcuauagcucaggacc

SEQ ID NO: 2564563 - RNA, 16 nt, Human
gcuauaggcuggagaa

SEQ ID NO: 2564564 - RNA, 16 nt, Human
gcuauagcuacaggaa

SEQ ID NO: 2564565 - RNA, 18 nt, Human
gcuauagcuacaggaagc

SEQ ID NO: 2564566 - RNA, 16 nt, Human
gcuaggaacacuccuu

SEQ ID NO: 2564567 - RNA, 22 nt, Human
gcuaggaaauccaggguggugg

SEQ ID NO: 2564568 - RNA, 17 nt, Human
gcuauagccuggggugg

SEQ ID NO: 2564569 - RNA, 22 nt, Human
gcuagcuucugcuuuucugccc

SEQ ID NO: 2564570 - RNA, 19 nt, Human
gcuauagacccgaggaaac

SEQ ID NO: 2564571 - RNA, 23 nt, Human
gcuauagacccgaggaaacucag

SEQ ID NO: 2564572 - RNA, 20 nt, Human
gcuaccuugugacccagcac

SEQ ID NO: 2564573 - RNA, 19 nt, Human
gcuagaacucccuuucaac

SEQ ID NO: 2564574 - RNA, 16 nt, Human
gcuaccuuuguauucu

SEQ ID NO: 2564575 - RNA, 20 nt, Human
gcuaccuuuguauucucucc

SEQ ID NO: 2564576 - RNA, 20 nt, Human
gcuacagguuacaacagauu

SEQ ID NO: 2564577 - RNA, 19 nt, Human
gcuacagguuacaacagau

SEQ ID NO: 2564578 - RNA, 18 nt, Human
gcuacagguuacaacaga

SEQ ID NO: 2564579 - RNA, 16 nt, Human
gcuacagguuacaaca

SEQ ID NO: 2564580 - RNA, 15 nt, Human
gcuacagguuacaac

SEQ ID NO: 2564581 - RNA, 22 nt, Human
gcuacaggaagcaccccaugcc

SEQ ID NO: 2564582 - RNA, 23 nt, Human
gcuacaggaagcaccccaugcca

SEQ ID NO: 2564583 - RNA, 14 nt, Human
gcuacagguuacaa

SEQ ID NO: 2564584 - RNA, 23 nt, Human
gcuacaggggaagguggccucug

SEQ ID NO: 2564585 - RNA, 12 nt, Human
gcuacagguuac

SEQ ID NO: 2564586 - RNA, 13 nt, Human
gcuacacacugca

SEQ ID NO: 2564587 - RNA, 20 nt, Human
gcuacacacugcauguuugu

SEQ ID NO: 2564588 - RNA, 20 nt, Human
gcuaagagggagggagggcu

SEQ ID NO: 2564589 - RNA, 18 nt, Human
gcuaagagcuagcgcugc

SEQ ID NO: 2564590 - RNA, 14 nt, Human
gcuacacaggggaa

SEQ ID NO: 2564591 - RNA, 14 nt, Human
gcuacacagggaug

SEQ ID NO: 2564592 - RNA, 16 nt, Human
gcuacacagaucacag

SEQ ID NO: 2564593 - RNA, 20 nt, Human
gcuaagagcuagcgcugccg

SEQ ID NO: 2564594 - RNA, 19 nt, Human
gcuacaggaagcaccccau

SEQ ID NO: 2564595 - RNA, 20 nt, Human
gcuacaggaagcaccccaug

SEQ ID NO: 2564596 - RNA, 21 nt, Human
gcuacaggaagcaccccaugc

SEQ ID NO: 2564597 - RNA, 16 nt, Human
gcgucuguucccccuu

SEQ ID NO: 2564598 - RNA, 23 nt, Human
gcgucuggaggggccccugcuuc

SEQ ID NO: 2564599 - RNA, 21 nt, Human
gcgucuggaggggccccugcu

SEQ ID NO: 2564600 - RNA, 20 nt, Human
gcgucuggaggggccccugc

SEQ ID NO: 2564601 - RNA, 18 nt, Human
gcgucuggaggggccccu

SEQ ID NO: 2564602 - RNA, 17 nt, Human
gcgucuguucccccuuc

SEQ ID NO: 2564603 - RNA, 18 nt, Human
gcgucugucuucaagggc

SEQ ID NO: 2564604 - RNA, 17 nt, Human
gcgucuggaggggcccc

SEQ ID NO: 2564605 - RNA, 21 nt, Human
gcgucuccuguuuuucugggu

SEQ ID NO: 2564606 - RNA, 21 nt, Human
gcgucuggaaguccaaugugg

SEQ ID NO: 2564607 - RNA, 20 nt, Human
gcgucuccuguuuuucuggg

SEQ ID NO: 2564608 - RNA, 11 nt, Human
gcgucuccugu

SEQ ID NO: 2564609 - RNA, 23 nt, Human
gcuaaagagcccuugccucccca

SEQ ID NO: 2564610 - RNA, 22 nt, Human
gcuaaagagcccuugccucccc

SEQ ID NO: 2564611 - RNA, 18 nt, Human
gcuaaagagcccuugccu

SEQ ID NO: 2564612 - RNA, 17 nt, Human
gcuaaagcaauaugcau

SEQ ID NO: 2564613 - RNA, 19 nt, Human
gcuaaagcaauaugcauuu

SEQ ID NO: 2564614 - RNA, 13 nt, Human
gcuaaagaaaaag

SEQ ID NO: 2564615 - RNA, 14 nt, Human
gcuaaagagcccuu

SEQ ID NO: 2564616 - RNA, 13 nt, Human
gcuaagagggagg

SEQ ID NO: 2564617 - RNA, 17 nt, Human
gcuaagaauauuugaau

SEQ ID NO: 2564618 - RNA, 16 nt, Human
gcuaagaauauuugaa

SEQ ID NO: 2564619 - RNA, 14 nt, Human
gcgggcagcacagc

SEQ ID NO: 2564620 - RNA, 20 nt, Human
gcgggcaccuauagucccag

SEQ ID NO: 2564621 - RNA, 16 nt, Human
gcgggaugguccuggg

SEQ ID NO: 2564622 - RNA, 17 nt, Human
gcgggaugguccugggg

SEQ ID NO: 2564623 - RNA, 15 nt, Human
gcgggaugguccugg

SEQ ID NO: 2564624 - RNA, 16 nt, Human
gcgcucagggccaugc

SEQ ID NO: 2564625 - RNA, 15 nt, Human
gcggacagccacggc

SEQ ID NO: 2564626 - RNA, 13 nt, Human
gcgggccaaggac

SEQ ID NO: 2564627 - RNA, 15 nt, Human
gcgggccaaggacug

SEQ ID NO: 2564628 - RNA, 17 nt, Human
gcgggccaaggacugcc

SEQ ID NO: 2564629 - RNA, 20 nt, Human
gcgggccaaggacugccgac

SEQ ID NO: 2564630 - RNA, 15 nt, Human
gcgggcagcacagca

SEQ ID NO: 2564631 - RNA, 16 nt, Human
gcgggcagcacagcaa

SEQ ID NO: 2564632 - RNA, 21 nt, Human
gcgggccagccaggcgggcuc

SEQ ID NO: 2564633 - RNA, 19 nt, Human
gcgggccagccaggcgggc

SEQ ID NO: 2564634 - RNA, 16 nt, Human
gcgggccagccaggcg

SEQ ID NO: 2564635 - RNA, 15 nt, Human
gcgggccagccaggc

SEQ ID NO: 2564636 - RNA, 20 nt, Human
gcgggcgccuguagucccag

SEQ ID NO: 2564637 - RNA, 20 nt, Human
gcgggccccucaucgcgucc

SEQ ID NO: 2564638 - RNA, 13 nt, Human
gcgggucacagga

SEQ ID NO: 2564639 - RNA, 15 nt, Human
gcgggucacaggagg

SEQ ID NO: 2564640 - RNA, 15 nt, Human
gcgggggccagggaa

SEQ ID NO: 2564641 - RNA, 13 nt, Human
gcggggggaggga

SEQ ID NO: 2564642 - RNA, 20 nt, Human
gcggggcgaagcccaggccc

SEQ ID NO: 2564643 - RNA, 14 nt, Human
gcgguggaaggccc

SEQ ID NO: 2564644 - RNA, 22 nt, Human
gcgggugaacaaagcagccacg

SEQ ID NO: 2564645 - RNA, 21 nt, Human
gcgggugaacaaagcagccac

SEQ ID NO: 2564646 - RNA, 19 nt, Human
gcgggucacaggagggagg

SEQ ID NO: 2564647 - RNA, 20 nt, Human
gcgggucacaggagggaggg

SEQ ID NO: 2564648 - RNA, 23 nt, Human
gcgguuaugaaauucacccccuu

SEQ ID NO: 2564649 - RNA, 15 nt, Human
gcgguggcccugucc

SEQ ID NO: 2564650 - RNA, 14 nt, Human
gcgguggcccuguc

SEQ ID NO: 2564651 - RNA, 18 nt, Human
gcgguggaaggcccgagg

SEQ ID NO: 2564652 - RNA, 18 nt, Human
gcggugcuguccucaggu

SEQ ID NO: 2564653 - RNA, 18 nt, Human
gcggugggcacccacccu

SEQ ID NO: 2564654 - RNA, 14 nt, Human
gcgguuuggggagc

SEQ ID NO: 2564655 - RNA, 19 nt, Human
gcgucucauacucaccuca

SEQ ID NO: 2564656 - RNA, 15 nt, Human
gcguagaaguuuuug

SEQ ID NO: 2564657 - RNA, 17 nt, Human
gcgucgcccucccaggc

SEQ ID NO: 2564658 - RNA, 17 nt, Human
gcgcggggagcccgucg

SEQ ID NO: 2564659 - RNA, 23 nt, Human
gcgcggccagccccggcccuggg

SEQ ID NO: 2564660 - RNA, 21 nt, Human
gcgcggccagccccggcccug

SEQ ID NO: 2564661 - RNA, 15 nt, Human
gcgcgucccccugcc

SEQ ID NO: 2564662 - RNA, 16 nt, Human
gcgcggccagccccgg

SEQ ID NO: 2564663 - RNA, 15 nt, Human
gcgcggccagccccg

SEQ ID NO: 2564664 - RNA, 14 nt, Human
gcgcggccagcccc

SEQ ID NO: 2564665 - RNA, 13 nt, Human
gcgcggccagccc

SEQ ID NO: 2564666 - RNA, 14 nt, Human
gcgcgccacucgcu

SEQ ID NO: 2564667 - RNA, 22 nt, Human
gcgcucagggccaugcugaggc

SEQ ID NO: 2564668 - RNA, 13 nt, Human
gcgcucagggcca

SEQ ID NO: 2564669 - RNA, 13 nt, Human
gcgcuacccacuu

SEQ ID NO: 2564670 - RNA, 16 nt, Human
gcgcuacccacuucua

SEQ ID NO: 2564671 - RNA, 13 nt, Human
gcggacagccacg

SEQ ID NO: 2564672 - RNA, 11 nt, Human
gcggacagcca

SEQ ID NO: 2564673 - RNA, 22 nt, Human
gcgccgugaguucucagggcuc

SEQ ID NO: 2564674 - RNA, 20 nt, Human
gcgccgugaguucucagggc

SEQ ID NO: 2564675 - RNA, 14 nt, Human
gcgccuuucccaac

SEQ ID NO: 2564676 - RNA, 15 nt, Human
gcgccuuucccaacu

SEQ ID NO: 2564677 - RNA, 20 nt, Human
gcgcgagggccucaaaggcc

SEQ ID NO: 2564678 - RNA, 16 nt, Human
gcgccuuucccaacuc

SEQ ID NO: 2564679 - RNA, 23 nt, Human
gcgccgugaguucucagggcucc

SEQ ID NO: 2564680 - RNA, 19 nt, Human
gcgccgugaguucucaggg

SEQ ID NO: 2564681 - RNA, 18 nt, Human
gcgccggcgggcgggccg

SEQ ID NO: 2564682 - RNA, 22 nt, Human
gcgccgucuccaggggcugcuu

SEQ ID NO: 2564683 - RNA, 15 nt, Human
gcgccuacaggagug

SEQ ID NO: 2564684 - RNA, 23 nt, Human
gcgacagagcgagagucugucuc

SEQ ID NO: 2564685 - RNA, 19 nt, Human
gcgccgcaaaccacacugg

SEQ ID NO: 2564686 - RNA, 15 nt, Human
gcgccgucuccaggg

SEQ ID NO: 2564687 - RNA, 13 nt, Human
gcgccgucuccag

SEQ ID NO: 2564688 - RNA, 17 nt, Human
gcgccggcgggcgggcc

SEQ ID NO: 2564689 - RNA, 23 nt, Human
gcgccggcaaaacuuuggcacug

SEQ ID NO: 2564690 - RNA, 21 nt, Human
gcgccgcaaaccacacuggac

SEQ ID NO: 2564691 - RNA, 12 nt, Human
gcgacagugaga

SEQ ID NO: 2564692 - RNA, 19 nt, Human
gcgacagagcgagagucug

SEQ ID NO: 2564693 - RNA, 15 nt, Human
gcgaaccaauauuug

SEQ ID NO: 2564694 - RNA, 17 nt, Human
gccgaagcucuggcuga

SEQ ID NO: 2564695 - RNA, 14 nt, Human
gccgaagcucuggc

SEQ ID NO: 2564696 - RNA, 12 nt, Human
gccgaagcucug

SEQ ID NO: 2564697 - RNA, 15 nt, Human
gccgaaugcccucag

SEQ ID NO: 2564698 - RNA, 20 nt, Human
gccgaauccccucccuguca

SEQ ID NO: 2564699 - RNA, 19 nt, Human
gccgaagcucuggcugaac

SEQ ID NO: 2564700 - RNA, 14 nt, Human
gccgaccagagccc

SEQ ID NO: 2564701 - RNA, 14 nt, Human
gccgaaugugcagg

SEQ ID NO: 2564702 - RNA, 17 nt, Human
gccgaccagagccccac

SEQ ID NO: 2564703 - RNA, 19 nt, Human
gccgaaccaggagcugcuc

SEQ ID NO: 2564704 - RNA, 12 nt, Human
gccgaaccagga

SEQ ID NO: 2564705 - RNA, 19 nt, Human
gccgaagaaggguccuucc

SEQ ID NO: 2564706 - RNA, 22 nt, Human
gccgaagaaggguccuucccuc

SEQ ID NO: 2564707 - RNA, 12 nt, Human
gcccuuggccag

SEQ ID NO: 2564708 - RNA, 14 nt, Human
gcccuugccucccc

SEQ ID NO: 2564709 - RNA, 13 nt, Human
gcccuugccuccc

SEQ ID NO: 2564710 - RNA, 21 nt, Human
gcccuugcccugaccucccag

SEQ ID NO: 2564711 - RNA, 18 nt, Human
gcccuugcccugaccucc

SEQ ID NO: 2564712 - RNA, 16 nt, Human
gcccuugcccugaccu

SEQ ID NO: 2564713 - RNA, 15 nt, Human
gcccuugcccugacc

SEQ ID NO: 2564714 - RNA, 14 nt, Human
gcccuugcccugac

SEQ ID NO: 2564715 - RNA, 13 nt, Human
gcccuugucugag

SEQ ID NO: 2564716 - RNA, 21 nt, Human
gcccuugucccacucaagcca

SEQ ID NO: 2564717 - RNA, 24 nt, Human
gcccuugucccacucaagccaagc

SEQ ID NO: 2564718 - RNA, 12 nt, Human
gcccuuguccca

SEQ ID NO: 2564719 - RNA, 16 nt, Human
gcccuugccuccccau

SEQ ID NO: 2564720 - RNA, 16 nt, Human
gcccuuggaggccagc

SEQ ID NO: 2564721 - RNA, 18 nt, Human
gcccuucucuccagcccc

SEQ ID NO: 2564722 - RNA, 17 nt, Human
gcccuucucuccagccc

SEQ ID NO: 2564723 - RNA, 16 nt, Human
gcccuucucuccagcc

SEQ ID NO: 2564724 - RNA, 14 nt, Human
gcccuucucuccag

SEQ ID NO: 2564725 - RNA, 20 nt, Human
gcccugcuggccgccucacc

SEQ ID NO: 2564726 - RNA, 18 nt, Human
gcccugcuggccgccuca

SEQ ID NO: 2564727 - RNA, 14 nt, Human
gcccugcuggccgc

SEQ ID NO: 2564728 - RNA, 11 nt, Human
gcccugcuggc

SEQ ID NO: 2564729 - RNA, 23 nt, Human
gcccugcuggccgccucaccccc

SEQ ID NO: 2564730 - RNA, 22 nt, Human
gcccugcuggccgccucacccc

SEQ ID NO: 2564731 - RNA, 21 nt, Human
gcccugcuggccgccucaccc

SEQ ID NO: 2564732 - RNA, 18 nt, Human
gcccugcuuugggcugcc

SEQ ID NO: 2564733 - RNA, 16 nt, Human
gcccugcuuugggcug

SEQ ID NO: 2564734 - RNA, 20 nt, Human
gccgggcgugguggugagug

SEQ ID NO: 2564735 - RNA, 14 nt, Human
gccgguaccuggga

SEQ ID NO: 2564736 - RNA, 21 nt, Human
gccgggcgcgguggcucacgc

SEQ ID NO: 2564737 - RNA, 12 nt, Human
gccgggccuggg

SEQ ID NO: 2564738 - RNA, 19 nt, Human
gccgggcgugguggcgggc

SEQ ID NO: 2564739 - RNA, 13 nt, Human
gccggcuggaaau

SEQ ID NO: 2564740 - RNA, 18 nt, Human
gccggcgagcccugugga

SEQ ID NO: 2564741 - RNA, 15 nt, Human
gccggcgagcccugu

SEQ ID NO: 2564742 - RNA, 17 nt, Human
gccggcgagcccugugg

SEQ ID NO: 2564743 - RNA, 22 nt, Human
gccggcuggaaaugcugggcug

SEQ ID NO: 2564744 - RNA, 19 nt, Human
gccggcuucaugccagcua

SEQ ID NO: 2564745 - RNA, 17 nt, Human
gccggcggcccaagccc

SEQ ID NO: 2564746 - RNA, 20 nt, Human
gccgggaacagacaacagaa

SEQ ID NO: 2564747 - RNA, 19 nt, Human
gccgggaccccgagccugg

SEQ ID NO: 2564748 - RNA, 23 nt, Human
gccgggaccccgagccuggcucc

SEQ ID NO: 2564749 - RNA, 18 nt, Human
gccgggaccccgagccug

SEQ ID NO: 2564750 - RNA, 22 nt, Human
gccgggaacagacaacagaagu

SEQ ID NO: 2564751 - RNA, 21 nt, Human
gccgagaucacgccacugcac

SEQ ID NO: 2564752 - RNA, 20 nt, Human
gccgagaucacgccacugca

SEQ ID NO: 2564753 - RNA, 22 nt, Human
gccgagaucacgccacugcacu

SEQ ID NO: 2564754 - RNA, 22 nt, Human
gccgaccgaggcuggagcuggc

SEQ ID NO: 2564755 - RNA, 11 nt, Human
gccgaccucag

SEQ ID NO: 2564756 - RNA, 12 nt, Human
gccgcagcccug

SEQ ID NO: 2564757 - RNA, 23 nt, Human
gccggccucucuggccucccacc

SEQ ID NO: 2564758 - RNA, 12 nt, Human
gccgcagagcug

SEQ ID NO: 2564759 - RNA, 20 nt, Human
gccggccucucuggccuccc

SEQ ID NO: 2564760 - RNA, 11 nt, Human
gccgcagcccu

SEQ ID NO: 2564761 - RNA, 23 nt, Human
gccgcaccccagagugugggaag

SEQ ID NO: 2564762 - RNA, 15 nt, Human
gccgcaccccagagu

SEQ ID NO: 2564763 - RNA, 16 nt, Human
gccgcaccccagagug

SEQ ID NO: 2564764 - RNA, 16 nt, Human
gccgcaauacaggaac

SEQ ID NO: 2564765 - RNA, 17 nt, Human
gccgcaagucugcagcc

SEQ ID NO: 2564766 - RNA, 13 nt, Human
gccgcaccccaga

SEQ ID NO: 2564767 - RNA, 17 nt, Human
gccucacaguccuuacc

SEQ ID NO: 2564768 - RNA, 13 nt, Human
gccucacaguccu

SEQ ID NO: 2564769 - RNA, 17 nt, Human
gccucaaccuccugggc

SEQ ID NO: 2564770 - RNA, 13 nt, Human
gccucaaggacuu

SEQ ID NO: 2564771 - RNA, 13 nt, Human
gcccuugcccuga

SEQ ID NO: 2564772 - RNA, 16 nt, Human
gccucacagaagaaua

SEQ ID NO: 2564773 - RNA, 20 nt, Human
gccuauuauauuaaaauaug

SEQ ID NO: 2564774 - RNA, 15 nt, Human
gccuauuauauuaaa

SEQ ID NO: 2564775 - RNA, 22 nt, Human
gccuauuaguaguuaauucugu

SEQ ID NO: 2564776 - RNA, 22 nt, Human
gccuaugugcaugcagcaucua

SEQ ID NO: 2564777 - RNA, 19 nt, Human
gccucaaccuccugggcua

SEQ ID NO: 2564778 - RNA, 18 nt, Human
gccucaaccuccugggcu

SEQ ID NO: 2564779 - RNA, 22 nt, Human
gccuaugcacauauggacucug

SEQ ID NO: 2564780 - RNA, 20 nt, Human
gccuaugcacauauggacuc

SEQ ID NO: 2564781 - RNA, 23 nt, Human
gccuaugcacauauggacucugc

SEQ ID NO: 2564782 - RNA, 14 nt, Human
gccuaugcacauau

SEQ ID NO: 2564783 - RNA, 18 nt, Human
gccuaugaucccagcacu

SEQ ID NO: 2564784 - RNA, 15 nt, Human
gccuaugaucccagc

SEQ ID NO: 2564785 - RNA, 16 nt, Human
gccuaacaccagcguu

SEQ ID NO: 2564786 - RNA, 16 nt, Human
gccgugguccuuuggg

SEQ ID NO: 2564787 - RNA, 14 nt, Human
gccguuacucucca

SEQ ID NO: 2564788 - RNA, 15 nt, Human
gccguuacucuccaa

SEQ ID NO: 2564789 - RNA, 18 nt, Human
gccguuacucuccaaccu

SEQ ID NO: 2564790 - RNA, 20 nt, Human
gccguuacucuccaaccugg

SEQ ID NO: 2564791 - RNA, 19 nt, Human
gccgugccuucagcucuac

SEQ ID NO: 2564792 - RNA, 17 nt, Human
gccgugccuucagcucu

SEQ ID NO: 2564793 - RNA, 15 nt, Human
gccgugccuucagcu

SEQ ID NO: 2564794 - RNA, 14 nt, Human
gccgugccuucagc

SEQ ID NO: 2564795 - RNA, 17 nt, Human
gccgugcucgccccagc

SEQ ID NO: 2564796 - RNA, 15 nt, Human
gccgugcccaggggc

SEQ ID NO: 2564797 - RNA, 21 nt, Human
gccgugcucgccccagcaggu

SEQ ID NO: 2564798 - RNA, 19 nt, Human
gccguggcuucccgcucag

SEQ ID NO: 2564799 - RNA, 15 nt, Human
gccguggcuucccgc

SEQ ID NO: 2564800 - RNA, 22 nt, Human
gccguggcuucccgcucagccc

SEQ ID NO: 2564801 - RNA, 21 nt, Human
gccguggcuucccgcucagcc

SEQ ID NO: 2564802 - RNA, 15 nt, Human
gccgugggccugggg

SEQ ID NO: 2564803 - RNA, 20 nt, Human
gccgugcucgccccagcagg

SEQ ID NO: 2564804 - RNA, 14 nt, Human
gccgugcccugccc

SEQ ID NO: 2564805 - RNA, 20 nt, Human
gccguguaaccauggaccca

SEQ ID NO: 2564806 - RNA, 23 nt, Human
gccguggggccgccgccucuuuc

SEQ ID NO: 2564807 - RNA, 20 nt, Human
gccguggggccgccgccucu

SEQ ID NO: 2564808 - RNA, 17 nt, Human
gccgucuaccugagggg

SEQ ID NO: 2564809 - RNA, 16 nt, Human
gccgucuaccugaggg

SEQ ID NO: 2564810 - RNA, 18 nt, Human
gccguccucccgggcccu

SEQ ID NO: 2564811 - RNA, 14 nt, Human
gccguccucccggg

SEQ ID NO: 2564812 - RNA, 20 nt, Human
gccguccucccgggcccucc

SEQ ID NO: 2564813 - RNA, 19 nt, Human
gccguccucccgggcccuc

SEQ ID NO: 2564814 - RNA, 21 nt, Human
gccguccucccgggcccuccc

SEQ ID NO: 2564815 - RNA, 15 nt, Human
gccgucuaccugagg

SEQ ID NO: 2564816 - RNA, 18 nt, Human
gccgucagccaaauguaa

SEQ ID NO: 2564817 - RNA, 19 nt, Human
gccguaccccacccucagc

SEQ ID NO: 2564818 - RNA, 18 nt, Human
gccguaccccacccucag

SEQ ID NO: 2564819 - RNA, 16 nt, Human
gccguaccccacccuc

SEQ ID NO: 2564820 - RNA, 15 nt, Human
gccguaccccacccu

SEQ ID NO: 2564821 - RNA, 22 nt, Human
gccguaccccacccucagcacc

SEQ ID NO: 2564822 - RNA, 14 nt, Human
gccgguuugaguga

SEQ ID NO: 2564823 - RNA, 14 nt, Human
gccguaccccaccc

SEQ ID NO: 2564824 - RNA, 19 nt, Human
gccggucugcaagucagag

SEQ ID NO: 2564825 - RNA, 18 nt, Human
gccggucugcaagucaga

SEQ ID NO: 2564826 - RNA, 17 nt, Human
gccggugagaauaagag

SEQ ID NO: 2564827 - RNA, 20 nt, Human
gccggucugcaagucagagg

SEQ ID NO: 2564828 - RNA, 22 nt, Human
gccugagaagagagaucaaaug

SEQ ID NO: 2564829 - RNA, 15 nt, Human
gccugagaggcaggc

SEQ ID NO: 2564830 - RNA, 14 nt, Human
gccugagaggcagg

SEQ ID NO: 2564831 - RNA, 13 nt, Human
gccugagaggcag

SEQ ID NO: 2564832 - RNA, 13 nt, Human
gccugaccuugag

SEQ ID NO: 2564833 - RNA, 13 nt, Human
gccucugccucug

SEQ ID NO: 2564834 - RNA, 12 nt, Human
gccucugccucu

SEQ ID NO: 2564835 - RNA, 20 nt, Human
gccucugagggaaagcccag

SEQ ID NO: 2564836 - RNA, 17 nt, Human
gccucugcaaaggaaau

SEQ ID NO: 2564837 - RNA, 15 nt, Human
gccucugcauucagg

SEQ ID NO: 2564838 - RNA, 23 nt, Human
gccucugccaaaggaugugauau

SEQ ID NO: 2564839 - RNA, 15 nt, Human
gccucugccccgucu

SEQ ID NO: 2564840 - RNA, 16 nt, Human
gccucugccccgucuc

SEQ ID NO: 2564841 - RNA, 18 nt, Human
gccugaggucuguacguu

SEQ ID NO: 2564842 - RNA, 13 nt, Human
gccugaggucugu

SEQ ID NO: 2564843 - RNA, 16 nt, Human
gccugaguagaaaggc

SEQ ID NO: 2564844 - RNA, 21 nt, Human
gccugaguagaaaggccuuua

SEQ ID NO: 2564845 - RNA, 21 nt, Human
gccugcaaacucacugcucaa

SEQ ID NO: 2564846 - RNA, 21 nt, Human
gccugcaaacgcugccugccc

SEQ ID NO: 2564847 - RNA, 19 nt, Human
gccugcaaacgcugccugc

SEQ ID NO: 2564848 - RNA, 20 nt, Human
gccugcaaacgcugccugcc

SEQ ID NO: 2564849 - RNA, 15 nt, Human
gccugcaagggagug

SEQ ID NO: 2564850 - RNA, 13 nt, Human
gccugcaagggag

SEQ ID NO: 2564851 - RNA, 20 nt, Human
gccugaggucuggcugcuug

SEQ ID NO: 2564852 - RNA, 19 nt, Human
gccugaggucuggcugcuu

SEQ ID NO: 2564853 - RNA, 18 nt, Human
gccugaggucuggcugcu

SEQ ID NO: 2564854 - RNA, 16 nt, Human
gccugaggucuggcug

SEQ ID NO: 2564855 - RNA, 21 nt, Human
gccugaggucucgcugaugcu

SEQ ID NO: 2564856 - RNA, 17 nt, Human
gccugaggucucgcuga

SEQ ID NO: 2564857 - RNA, 21 nt, Human
gccugaggucaggaguucaag

SEQ ID NO: 2564858 - RNA, 17 nt, Human
gccugaggguggagacu

SEQ ID NO: 2564859 - RNA, 15 nt, Human
gccugaggguggaga

SEQ ID NO: 2564860 - RNA, 14 nt, Human
gccugaggguggag

SEQ ID NO: 2564861 - RNA, 12 nt, Human
gccugagggugg

SEQ ID NO: 2564862 - RNA, 20 nt, Human
gccugagaggcaggcauaga

SEQ ID NO: 2564863 - RNA, 19 nt, Human
gccugagaggcaggcauag

SEQ ID NO: 2564864 - RNA, 18 nt, Human
gccugagaggcaggcaua

SEQ ID NO: 2564865 - RNA, 16 nt, Human
gccugagaggcaggca

SEQ ID NO: 2564866 - RNA, 15 nt, Human
gccugagggccccuc

SEQ ID NO: 2564867 - RNA, 19 nt, Human
gccugagggccccucugcc

SEQ ID NO: 2564868 - RNA, 18 nt, Human
gccugagggccccucugc

SEQ ID NO: 2564869 - RNA, 17 nt, Human
gccugagggccccucug

SEQ ID NO: 2564870 - RNA, 16 nt, Human
gccugagggccccucu

SEQ ID NO: 2564871 - RNA, 21 nt, Human
gccugagggccccucugccca

SEQ ID NO: 2564872 - RNA, 20 nt, Human
gccugagggccccucugccc

SEQ ID NO: 2564873 - RNA, 22 nt, Human
gccugagggccccucugcccag

SEQ ID NO: 2564874 - RNA, 23 nt, Human
gccugagggcgaggggagggugg

SEQ ID NO: 2564875 - RNA, 15 nt, Human
gccucugagauuugg

SEQ ID NO: 2564876 - RNA, 22 nt, Human
gccucugaccccuccucacugg

SEQ ID NO: 2564877 - RNA, 21 nt, Human
gccucugaccccuccucacug

SEQ ID NO: 2564878 - RNA, 20 nt, Human
gccucugaccccuccucacu

SEQ ID NO: 2564879 - RNA, 19 nt, Human
gccucugaccccuccucac

SEQ ID NO: 2564880 - RNA, 19 nt, Human
gccucugacuuaagcugcc

SEQ ID NO: 2564881 - RNA, 22 nt, Human
gccucugagggaaagcccagaa

SEQ ID NO: 2564882 - RNA, 14 nt, Human
gccucugcacuccc

SEQ ID NO: 2564883 - RNA, 18 nt, Human
gccucugaccccuccuca

SEQ ID NO: 2564884 - RNA, 17 nt, Human
gccucugaccccuccuc

SEQ ID NO: 2564885 - RNA, 16 nt, Human
gccucugaccccuccu

SEQ ID NO: 2564886 - RNA, 15 nt, Human
gccucugaccccucc

SEQ ID NO: 2564887 - RNA, 14 nt, Human
gccucugaccccuc

SEQ ID NO: 2564888 - RNA, 13 nt, Human
gccucugaccccu

SEQ ID NO: 2564889 - RNA, 15 nt, Human
gccucucucccaguc

SEQ ID NO: 2564890 - RNA, 13 nt, Human
gccucucucccag

SEQ ID NO: 2564891 - RNA, 21 nt, Human
gccucugacacacagcucugu

SEQ ID NO: 2564892 - RNA, 20 nt, Human
gccucugacacacagcucug

SEQ ID NO: 2564893 - RNA, 19 nt, Human
gccucugacacacagcucu

SEQ ID NO: 2564894 - RNA, 16 nt, Human
gccucucucccagucu

SEQ ID NO: 2564895 - RNA, 12 nt, Human
gccucucuccca

SEQ ID NO: 2564896 - RNA, 16 nt, Human
gccucucucaggccaa

SEQ ID NO: 2564897 - RNA, 18 nt, Human
gccucugacacacagcuc

SEQ ID NO: 2564898 - RNA, 17 nt, Human
gccucugacacacagcu

SEQ ID NO: 2564899 - RNA, 14 nt, Human
gccucucucaggcc

SEQ ID NO: 2564900 - RNA, 13 nt, Human
gccucucucaggc

SEQ ID NO: 2564901 - RNA, 20 nt, Human
gccucucauuccagaggaag

SEQ ID NO: 2564902 - RNA, 13 nt, Human
gccucccaacuca

SEQ ID NO: 2564903 - RNA, 19 nt, Human
gccucccaaagugcuggga

SEQ ID NO: 2564904 - RNA, 18 nt, Human
gccucccaaagugcuggg

SEQ ID NO: 2564905 - RNA, 16 nt, Human
gccucagcauccuggc

SEQ ID NO: 2564906 - RNA, 15 nt, Human
gccucagcauccugg

SEQ ID NO: 2564907 - RNA, 18 nt, Human
gccucacaguccuuacca

SEQ ID NO: 2564908 - RNA, 19 nt, Human
gccucccaacucaccccag

SEQ ID NO: 2564909 - RNA, 18 nt, Human
gccucccaacucacccca

SEQ ID NO: 2564910 - RNA, 17 nt, Human
gccucccaacucacccc

SEQ ID NO: 2564911 - RNA, 16 nt, Human
gccucccaacucaccc

SEQ ID NO: 2564912 - RNA, 16 nt, Human
gccucccaucacccgc

SEQ ID NO: 2564913 - RNA, 14 nt, Human
gccucccaucaccc

SEQ ID NO: 2564914 - RNA, 13 nt, Human
gccucccagccug

SEQ ID NO: 2564915 - RNA, 14 nt, Human
gccucccagccugg

SEQ ID NO: 2564916 - RNA, 10 nt, Human
gccucccagc

SEQ ID NO: 2564917 - RNA, 14 nt, Human
gccucccacugggg

SEQ ID NO: 2564918 - RNA, 15 nt, Human
gccucccaaaugagc

SEQ ID NO: 2564919 - RNA, 13 nt, Human
gccucccacuggg

SEQ ID NO: 2564920 - RNA, 16 nt, Human
gccuccucacccccag

SEQ ID NO: 2564921 - RNA, 17 nt, Human
gccuccucacccccagc

SEQ ID NO: 2564922 - RNA, 18 nt, Human
gccuccucacccccagcu

SEQ ID NO: 2564923 - RNA, 19 nt, Human
gccuccucacccccagcuu

SEQ ID NO: 2564924 - RNA, 20 nt, Human
gccuccuacagcccaccugg

SEQ ID NO: 2564925 - RNA, 14 nt, Human
gccuccucaccccc

SEQ ID NO: 2564926 - RNA, 16 nt, Human
gccucucaucaacuga

SEQ ID NO: 2564927 - RNA, 23 nt, Human
gccucucaccuguacucuuccga

SEQ ID NO: 2564928 - RNA, 21 nt, Human
gccuccucacccccagcuuug

SEQ ID NO: 2564929 - RNA, 18 nt, Human
gccucucaucaacugaau

SEQ ID NO: 2564930 - RNA, 19 nt, Human
gccucucaucaacugaaug

SEQ ID NO: 2564931 - RNA, 19 nt, Human
gccucucauuccagaggaa

SEQ ID NO: 2564932 - RNA, 15 nt, Human
gccucccuucaugca

SEQ ID NO: 2564933 - RNA, 18 nt, Human
gccucccuucaugcaugg

SEQ ID NO: 2564934 - RNA, 20 nt, Human
gccucccuucaugcauggaa

SEQ ID NO: 2564935 - RNA, 22 nt, Human
gccucccuucaugcauggaaau

SEQ ID NO: 2564936 - RNA, 15 nt, Human
gccuccgagagggag

SEQ ID NO: 2564937 - RNA, 23 nt, Human
gccucccuucaugcauggaaauu

SEQ ID NO: 2564938 - RNA, 18 nt, Human
gccuccgagagggagaga

SEQ ID NO: 2564939 - RNA, 16 nt, Human
gccuccgagagggaga

SEQ ID NO: 2564940 - RNA, 19 nt, Human
gccuccggcgucagccucc

SEQ ID NO: 2564941 - RNA, 18 nt, Human
gccuccggcgucagccuc

SEQ ID NO: 2564942 - RNA, 17 nt, Human
gccuccggcgucagccu

SEQ ID NO: 2564943 - RNA, 16 nt, Human
gccuccggccuccccu

SEQ ID NO: 2564944 - RNA, 12 nt, Human
gccuccggccuc

SEQ ID NO: 2564945 - RNA, 21 nt, Human
gccuccggcgucagccuccag

SEQ ID NO: 2564946 - RNA, 20 nt, Human
gccuccggcgucagccucca

SEQ ID NO: 2564947 - RNA, 23 nt, Human
gccuccggcgucagccuccagcc

SEQ ID NO: 2564948 - RNA, 16 nt, Human
gccuccguauuucaga

SEQ ID NO: 2564949 - RNA, 17 nt, Human
gccucccgaguagcugg

SEQ ID NO: 2564950 - RNA, 17 nt, Human
gccucccaucacccgcu

SEQ ID NO: 2564951 - RNA, 19 nt, Human
gccucccgaguagcuggga

SEQ ID NO: 2564952 - RNA, 18 nt, Human
gccucccgaguagcuggg

SEQ ID NO: 2564953 - RNA, 20 nt, Human
gccucccgaguagcugggac

SEQ ID NO: 2564954 - RNA, 20 nt, Human
gccucccuguugaagcucug

SEQ ID NO: 2564955 - RNA, 21 nt, Human
gccucccuguugaagcucugg

SEQ ID NO: 2564956 - RNA, 16 nt, Human
gccucccuggucccuu

SEQ ID NO: 2564957 - RNA, 14 nt, Human
uuuuccugaaaacc

SEQ ID NO: 2564958 - RNA, 21 nt, Human
uuuuaauuccaugaaucgcuu

SEQ ID NO: 2564959 - RNA, 15 nt, Human
uuuuaauuccaugaa

SEQ ID NO: 2564960 - RNA, 22 nt, Human
uuuuaauuccaauaugaugacu

SEQ ID NO: 2564961 - RNA, 19 nt, Human
uuuuaauuccaauaugaug

SEQ ID NO: 2564962 - RNA, 18 nt, Human
uuuuaauuccaauaugau

SEQ ID NO: 2564963 - RNA, 11 nt, Human
uuuuaauucca

SEQ ID NO: 2564964 - RNA, 18 nt, Human
uuuuaauuccaugaaucg

SEQ ID NO: 2564965 - RNA, 15 nt, Human
uuuuaauugauuauu

SEQ ID NO: 2564966 - RNA, 16 nt, Human
uuuuaauuauuauucu

SEQ ID NO: 2564967 - RNA, 11 nt, Human
uuuuaauuauu

SEQ ID NO: 2564968 - RNA, 13 nt, Human
uuuuaauuaaaug

SEQ ID NO: 2564969 - RNA, 22 nt, Human
uuuuaauuaaugaaauaucugu

SEQ ID NO: 2564970 - RNA, 20 nt, Human
uuuuaauuauuauuuauaua

SEQ ID NO: 2564971 - RNA, 17 nt, Human
uuuuaauuauuauucuu

SEQ ID NO: 2564972 - RNA, 23 nt, Human
uuuuaauuauuauuuauauaugu

SEQ ID NO: 2564973 - RNA, 20 nt, Human
uuuuaauucaccaaaguauu

SEQ ID NO: 2564974 - RNA, 12 nt, Human
uuuucuuugugu

SEQ ID NO: 2564975 - RNA, 19 nt, Human
uuuucuuuguguagcuuug

SEQ ID NO: 2564976 - RNA, 16 nt, Human
uuuucuuuguguagcu

SEQ ID NO: 2564977 - RNA, 17 nt, Human
uuuucuacccuagccau

SEQ ID NO: 2564978 - RNA, 16 nt, Human
uuuucuacccuagcca

SEQ ID NO: 2564979 - RNA, 18 nt, Human
uuuucuacagugguuuua

SEQ ID NO: 2564980 - RNA, 14 nt, Human
uuuucuacaguggu

SEQ ID NO: 2564981 - RNA, 13 nt, Human
uuuucuacaguua

SEQ ID NO: 2564982 - RNA, 17 nt, Human
uuuucuuugaaugcuuu

SEQ ID NO: 2564983 - RNA, 14 nt, Human
uuuucuuugaaauu

SEQ ID NO: 2564984 - RNA, 18 nt, Human
uuuucuaaaguaaaaaca

SEQ ID NO: 2564985 - RNA, 13 nt, Human
uuuucuaagagaa

SEQ ID NO: 2564986 - RNA, 21 nt, Human
uuuucuaaugugguuauuucu

SEQ ID NO: 2564987 - RNA, 15 nt, Human
uuuucuaaugugguu

SEQ ID NO: 2564988 - RNA, 15 nt, Human
uuuucuaagagaagu

SEQ ID NO: 2564989 - RNA, 13 nt, Human
uuuucuacagugg

SEQ ID NO: 2564990 - RNA, 14 nt, Human
uuuuggucauugua

SEQ ID NO: 2564991 - RNA, 21 nt, Human
uuuugguccaaguugugcuua

SEQ ID NO: 2564992 - RNA, 23 nt, Human
uuuugguauuacacuguauuugu

SEQ ID NO: 2564993 - RNA, 19 nt, Human
uuuugguacuuauuacugc

SEQ ID NO: 2564994 - RNA, 17 nt, Human
uuuugguauuacacugu

SEQ ID NO: 2564995 - RNA, 18 nt, Human
uuuuggucuggagggaag

SEQ ID NO: 2564996 - RNA, 15 nt, Human
uuuuggucuguguga

SEQ ID NO: 2564997 - RNA, 14 nt, Human
uuuuggcugcugaa

SEQ ID NO: 2564998 - RNA, 22 nt, Human
uuuuggcugaaauucuccugga

SEQ ID NO: 2564999 - RNA, 19 nt, Human
uuuuggcccccgagcuggg

SEQ ID NO: 2565000 - RNA, 19 nt, Human
uuuugggguuguguuguca

SEQ ID NO: 2565001 - RNA, 19 nt, Human
uuuugguaaagacuggcuu

SEQ ID NO: 2565002 - RNA, 21 nt, Human
uuuuggggauaugcuuaguaa

SEQ ID NO: 2565003 - RNA, 18 nt, Human
uuuuggggauaugcuuag

SEQ ID NO: 2565004 - RNA, 23 nt, Human
uuuuggggggccccccuccuugc

SEQ ID NO: 2565005 - RNA, 18 nt, Human
uuuuggggaagugaggaa

SEQ ID NO: 2565006 - RNA, 22 nt, Human
uuuugggcuccuuuuucucccu

SEQ ID NO: 2565007 - RNA, 13 nt, Human
uuuugaaucaaua

SEQ ID NO: 2565008 - RNA, 13 nt, Human
uuuucuuuucuau

SEQ ID NO: 2565009 - RNA, 20 nt, Human
uuuugacaaggggcaguggu

SEQ ID NO: 2565010 - RNA, 18 nt, Human
uuuugaaugcuuccugac

SEQ ID NO: 2565011 - RNA, 16 nt, Human
uuuugaauccaugcuu

SEQ ID NO: 2565012 - RNA, 14 nt, Human
uuuugaauguuauu

SEQ ID NO: 2565013 - RNA, 18 nt, Human
uuuugaaugguguuguau

SEQ ID NO: 2565014 - RNA, 22 nt, Human
uuuugaaugcuuccugacaauc

SEQ ID NO: 2565015 - RNA, 17 nt, Human
uuuuggccaaaguguua

SEQ ID NO: 2565016 - RNA, 15 nt, Human
uuuuggccaaagugu

SEQ ID NO: 2565017 - RNA, 16 nt, Human
uuuuggccaaaguguu

SEQ ID NO: 2565018 - RNA, 19 nt, Human
uuuuggcaaaacucuacuu

SEQ ID NO: 2565019 - RNA, 19 nt, Human
uuuuggcaaacgcuaaaga

SEQ ID NO: 2565020 - RNA, 19 nt, Human
uuuuggcacugagauauuu

SEQ ID NO: 2565021 - RNA, 19 nt, Human
uuuugacacuauaucugua

SEQ ID NO: 2565022 - RNA, 16 nt, Human
uuuugacacuauaucu

SEQ ID NO: 2565023 - RNA, 13 nt, Human
uuuugaauguuau

SEQ ID NO: 2565024 - RNA, 18 nt, Human
uuuugacacuauaucugu

SEQ ID NO: 2565025 - RNA, 16 nt, Human
uuuuggaugcagugcu

SEQ ID NO: 2565026 - RNA, 16 nt, Human
uuuuggauuguauauu

SEQ ID NO: 2565027 - RNA, 20 nt, Human
uuuuguauguaaaugugcau

SEQ ID NO: 2565028 - RNA, 17 nt, Human
uuuuguauucucugagc

SEQ ID NO: 2565029 - RNA, 15 nt, Human
uuuuguauuuuuaau

SEQ ID NO: 2565030 - RNA, 19 nt, Human
uuuuguauuuuccaagugu

SEQ ID NO: 2565031 - RNA, 10 nt, Human
uuuuguauuu

SEQ ID NO: 2565032 - RNA, 16 nt, Human
uuuugucauauaagau

SEQ ID NO: 2565033 - RNA, 18 nt, Human
uuuugucauuuucuccau

SEQ ID NO: 2565034 - RNA, 22 nt, Human
uuuugucgaauuuuuauuauuu

SEQ ID NO: 2565035 - RNA, 18 nt, Human
uuuuguauuuuuaauggg

SEQ ID NO: 2565036 - RNA, 13 nt, Human
uuuugucuuauau

SEQ ID NO: 2565037 - RNA, 13 nt, Human
uuuugucuugugu

SEQ ID NO: 2565038 - RNA, 18 nt, Human
uuuuuaaaaaagaaacau

SEQ ID NO: 2565039 - RNA, 18 nt, Human
uuuugugaaaaugucaaa

SEQ ID NO: 2565040 - RNA, 13 nt, Human
uuuugucuugaau

SEQ ID NO: 2565041 - RNA, 12 nt, Human
uuuugucuugaa

SEQ ID NO: 2565042 - RNA, 23 nt, Human
uuuuuaaaaaucauaaacugugu

SEQ ID NO: 2565043 - RNA, 20 nt, Human
uuuuuaaaaaugcaaauccu

SEQ ID NO: 2565044 - RNA, 22 nt, Human
uuuuuaaaaguuucaaugugau

SEQ ID NO: 2565045 - RNA, 19 nt, Human
uuuuuaaaaguuucaaugu

SEQ ID NO: 2565046 - RNA, 17 nt, Human
uuuuuaaaauaucuuuu

SEQ ID NO: 2565047 - RNA, 16 nt, Human
uuuuuaaaauauuuau

SEQ ID NO: 2565048 - RNA, 17 nt, Human
uuuuuaaaauauuuauu

SEQ ID NO: 2565049 - RNA, 16 nt, Human
uuuuuaaaauuuuaau

SEQ ID NO: 2565050 - RNA, 17 nt, Human
uuuuuaaagacagaguc

SEQ ID NO: 2565051 - RNA, 13 nt, Human
uuuuuaaagacuu

SEQ ID NO: 2565052 - RNA, 12 nt, Human
uuuuuaaagacu

SEQ ID NO: 2565053 - RNA, 18 nt, Human
uuuuuaaagacuuuuaug

SEQ ID NO: 2565054 - RNA, 16 nt, Human
uuuuuaaauaaaagca

SEQ ID NO: 2565055 - RNA, 20 nt, Human
uuuuuaaaguguuucuguua

SEQ ID NO: 2565056 - RNA, 20 nt, Human
uuuugguuguauucuuugau

SEQ ID NO: 2565057 - RNA, 12 nt, Human
uuuugguuguau

SEQ ID NO: 2565058 - RNA, 16 nt, Human
uuuugguugcuuuaau

SEQ ID NO: 2565059 - RNA, 22 nt, Human
uuuugguuugcagaugacaaaa

SEQ ID NO: 2565060 - RNA, 22 nt, Human
uuuugguugucaauauuaaaua

SEQ ID NO: 2565061 - RNA, 14 nt, Human
uuuugguuuuguuc

SEQ ID NO: 2565062 - RNA, 16 nt, Human
uuuugguuuuguuccc

SEQ ID NO: 2565063 - RNA, 20 nt, Human
uuuugguuuuguuccccucc

SEQ ID NO: 2565064 - RNA, 15 nt, Human
uuuugguugcuuuaa

SEQ ID NO: 2565065 - RNA, 20 nt, Human
uuuugguugaauaaacuaga

SEQ ID NO: 2565066 - RNA, 16 nt, Human
uuuugguucuuaguuc

SEQ ID NO: 2565067 - RNA, 15 nt, Human
uuuugguugaauaaa

SEQ ID NO: 2565068 - RNA, 20 nt, Human
uuuuggugguuuuagugauu

SEQ ID NO: 2565069 - RNA, 18 nt, Human
uuuuguaaacucaaaaua

SEQ ID NO: 2565070 - RNA, 21 nt, Human
uuuuguaaagaugccggguuu

SEQ ID NO: 2565071 - RNA, 15 nt, Human
uuuuguaaagaugcc

SEQ ID NO: 2565072 - RNA, 20 nt, Human
uuuuguaagaugcuggguug

SEQ ID NO: 2565073 - RNA, 15 nt, Human
uuuuguaagaugcug

SEQ ID NO: 2565074 - RNA, 13 nt, Human
uuuuguaaagugu

SEQ ID NO: 2565075 - RNA, 14 nt, Human
uuuuguaagacaaa

SEQ ID NO: 2565076 - RNA, 19 nt, Human
uuuuguaucuacaucuuuu

SEQ ID NO: 2565077 - RNA, 13 nt, Human
uuuuguauauauc

SEQ ID NO: 2565078 - RNA, 14 nt, Human
uuuuguaucuacau

SEQ ID NO: 2565079 - RNA, 14 nt, Human
uuuuguauguaaau

SEQ ID NO: 2565080 - RNA, 23 nt, Human
uuuuguauaguuguggacauuua

SEQ ID NO: 2565081 - RNA, 18 nt, Human
uuuuguauaguaaaguga

SEQ ID NO: 2565082 - RNA, 16 nt, Human
uuuuguauaguaaagu

SEQ ID NO: 2565083 - RNA, 17 nt, Human
uuuuguauaguaaagug

SEQ ID NO: 2565084 - RNA, 16 nt, Human
uuuuguauaauuguau

SEQ ID NO: 2565085 - RNA, 15 nt, Human
uuuuguauaauugua

SEQ ID NO: 2565086 - RNA, 17 nt, Human
uuuuguacuguaaagag

SEQ ID NO: 2565087 - RNA, 16 nt, Human
uuuuguacuguaaaga

SEQ ID NO: 2565088 - RNA, 13 nt, Human
uuuuguacuguaa

SEQ ID NO: 2565089 - RNA, 17 nt, Human
uuuuguaauuauuguga

SEQ ID NO: 2565090 - RNA, 23 nt, Human
uuuuguaggggucaaagaaaugc

SEQ ID NO: 2565091 - RNA, 14 nt, Human
uuuuguagaugaaa

SEQ ID NO: 2565092 - RNA, 22 nt, Human
uuuuguaggggucaaagaaaug

SEQ ID NO: 2565093 - RNA, 19 nt, Human
uuuuguagagccagggucu

SEQ ID NO: 2565094 - RNA, 15 nt, Human
uuuuguaauuauugu

SEQ ID NO: 2565095 - RNA, 14 nt, Human
uuuuguaauuuaaa

SEQ ID NO: 2565096 - RNA, 13 nt, Human
uuuuuuguuucau

SEQ ID NO: 2565097 - RNA, 12 nt, Human
uuuuuugauaaa

SEQ ID NO: 2565098 - RNA, 15 nt, Human
uuuuuugcaagugaa

SEQ ID NO: 2565099 - RNA, 23 nt, Human
uuuuuuggggauaugcuuaguaa

SEQ ID NO: 2565100 - RNA, 13 nt, Human
uuuuuuguauuau

SEQ ID NO: 2565101 - RNA, 12 nt, Human
uuuuuuguuuca

SEQ ID NO: 2565102 - RNA, 11 nt, Human
uuuuucugauu

SEQ ID NO: 2565103 - RNA, 18 nt, Human
uuuuucugacuccagugg

SEQ ID NO: 2565104 - RNA, 13 nt, Human
uuuuucuuguaau

SEQ ID NO: 2565105 - RNA, 14 nt, Human
uuuuucuuuaagau

SEQ ID NO: 2565106 - RNA, 13 nt, Human
uuuuucuuuauaa

SEQ ID NO: 2565107 - RNA, 16 nt, Human
uuuuucuuuauaaacu

SEQ ID NO: 2565108 - RNA, 17 nt, Human
uuuuucuuuauaaacuu

SEQ ID NO: 2565109 - RNA, 23 nt, Human
uuuuugaaaggcauguuccucug

SEQ ID NO: 2565110 - RNA, 14 nt, Human
uuuuugaaauaaua

SEQ ID NO: 2565111 - RNA, 13 nt, Human
uuuuugaaaacau

SEQ ID NO: 2565112 - RNA, 11 nt, Human
uuuuuaaaugc

SEQ ID NO: 2565113 - RNA, 20 nt, Human
uuuuuaagauaauaauauau

SEQ ID NO: 2565114 - RNA, 18 nt, Human
uuuuuaaaguuacuuugu

SEQ ID NO: 2565115 - RNA, 14 nt, Human
uuuuuaagcuguaa

SEQ ID NO: 2565116 - RNA, 16 nt, Human
uuuuuaagauuuuucu

SEQ ID NO: 2565117 - RNA, 13 nt, Human
uuuuuaagauuuu

SEQ ID NO: 2565118 - RNA, 18 nt, Human
uuuuuaagccuuaaagga

SEQ ID NO: 2565119 - RNA, 18 nt, Human
uuuuuaagcuguuuccau

SEQ ID NO: 2565120 - RNA, 23 nt, Human
uuuuuaagcuguaaaaagagaga

SEQ ID NO: 2565121 - RNA, 16 nt, Human
uuuuuaaguauuuaua

SEQ ID NO: 2565122 - RNA, 11 nt, Human
uuuuuccuuca

SEQ ID NO: 2565123 - RNA, 15 nt, Human
uuuuuccuuaaucca

SEQ ID NO: 2565124 - RNA, 20 nt, Human
uuuuuccuuaauccagcuga

SEQ ID NO: 2565125 - RNA, 17 nt, Human
uuuuuaagguuauuuau

SEQ ID NO: 2565126 - RNA, 18 nt, Human
uuuuuccuagcccucuca

SEQ ID NO: 2565127 - RNA, 14 nt, Human
uuuuuccuguccuu

SEQ ID NO: 2565128 - RNA, 14 nt, Human
uuuuucucccucug

SEQ ID NO: 2565129 - RNA, 18 nt, Human
uuuuucucaaaguuuuga

SEQ ID NO: 2565130 - RNA, 19 nt, Human
uuuuucucaugaaucugca

SEQ ID NO: 2565131 - RNA, 16 nt, Human
uuuuucucaaaguuuu

SEQ ID NO: 2565132 - RNA, 18 nt, Human
uuuuucuacuuuuaaaga

SEQ ID NO: 2565133 - RNA, 16 nt, Human
uuuuucuaagagaagu

SEQ ID NO: 2565134 - RNA, 15 nt, Human
uuuuucuaagagaag

SEQ ID NO: 2565135 - RNA, 19 nt, Human
uuuuucucuaggaaauauu

SEQ ID NO: 2565136 - RNA, 11 nt, Human
uuuuucucuaa

SEQ ID NO: 2565137 - RNA, 19 nt, Human
uuuuuccuucagugccuua

SEQ ID NO: 2565138 - RNA, 16 nt, Human
uuuuuccuucccuucu

SEQ ID NO: 2565139 - RNA, 11 nt, Human
uuuuuccuuua

SEQ ID NO: 2565140 - RNA, 22 nt, Human
uuuuucuaaaacuaaauagcau

SEQ ID NO: 2565141 - RNA, 18 nt, Human
uuuuucuaaaacuaaaua

SEQ ID NO: 2565142 - RNA, 11 nt, Human
uuuuuccuuuu

SEQ ID NO: 2565143 - RNA, 17 nt, Human
uuuuuccuuguauuuaa

SEQ ID NO: 2565144 - RNA, 22 nt, Human
uuuuuccuuguccccacacucc

SEQ ID NO: 2565145 - RNA, 15 nt, Human
uuugguuuuguuccc

SEQ ID NO: 2565146 - RNA, 14 nt, Human
uuugguuuuguucc

SEQ ID NO: 2565147 - RNA, 15 nt, Human
uuugguggagauaaa

SEQ ID NO: 2565148 - RNA, 20 nt, Human
uuugguggggguagagcuga

SEQ ID NO: 2565149 - RNA, 15 nt, Human
uuugguggcuuugca

SEQ ID NO: 2565150 - RNA, 16 nt, Human
uuuguauaaaauaauu

SEQ ID NO: 2565151 - RNA, 14 nt, Human
uuuguauaaaauaa

SEQ ID NO: 2565152 - RNA, 13 nt, Human
uuuguauaaaaua

SEQ ID NO: 2565153 - RNA, 19 nt, Human
uuugguuuuguuccccucc

SEQ ID NO: 2565154 - RNA, 16 nt, Human
uuugguuuuguucccc

SEQ ID NO: 2565155 - RNA, 21 nt, Human
uuugguuuuguuccccuccuc

SEQ ID NO: 2565156 - RNA, 21 nt, Human
uuuguaaaaacagcauugcuu

SEQ ID NO: 2565157 - RNA, 17 nt, Human
uuuggaguccccucacc

SEQ ID NO: 2565158 - RNA, 14 nt, Human
uuuggaggugcuua

SEQ ID NO: 2565159 - RNA, 20 nt, Human
uuuggagucagacagaugug

SEQ ID NO: 2565160 - RNA, 18 nt, Human
uuuggagaguuuccugaa

SEQ ID NO: 2565161 - RNA, 11 nt, Human
uuuggaaugug

SEQ ID NO: 2565162 - RNA, 21 nt, Human
uuuggaauuuugugcccccau

SEQ ID NO: 2565163 - RNA, 21 nt, Human
uuuggaugggagugagacaga

SEQ ID NO: 2565164 - RNA, 19 nt, Human
uuuggaugggagugagaca

SEQ ID NO: 2565165 - RNA, 20 nt, Human
uuuggaguccccucaccucc

SEQ ID NO: 2565166 - RNA, 20 nt, Human
uuuggauauaggucagugag

SEQ ID NO: 2565167 - RNA, 21 nt, Human
uuuggucuuuuuuuguauuau

SEQ ID NO: 2565168 - RNA, 20 nt, Human
uuuggucuuuaaugaaaagc

SEQ ID NO: 2565169 - RNA, 14 nt, Human
uuuggucugggacu

SEQ ID NO: 2565170 - RNA, 22 nt, Human
uuugcauggcuccagaaauguc

SEQ ID NO: 2565171 - RNA, 23 nt, Human
uuugcauggcacuugcaucugug

SEQ ID NO: 2565172 - RNA, 14 nt, Human
uuugcauguuccac

SEQ ID NO: 2565173 - RNA, 21 nt, Human
uuugcaugugaaaaucaaaua

SEQ ID NO: 2565174 - RNA, 22 nt, Human
uuugcauggcacuugcaucugu

SEQ ID NO: 2565175 - RNA, 20 nt, Human
uuugcauggcacuugcaucu

SEQ ID NO: 2565176 - RNA, 18 nt, Human
uuugcauggcacuugcau

SEQ ID NO: 2565177 - RNA, 21 nt, Human
uuugcauggaauuuguaaguu

SEQ ID NO: 2565178 - RNA, 15 nt, Human
uuugcuuugugauuu

SEQ ID NO: 2565179 - RNA, 16 nt, Human
uuugcuuugugauuuu

SEQ ID NO: 2565180 - RNA, 14 nt, Human
uuuggaauuuugug

SEQ ID NO: 2565181 - RNA, 12 nt, Human
uuuggaaugcuu

SEQ ID NO: 2565182 - RNA, 14 nt, Human
uuugcuuuuugcua

SEQ ID NO: 2565183 - RNA, 14 nt, Human
uuugcuuuuucuga

SEQ ID NO: 2565184 - RNA, 12 nt, Human
uuugcuuuuucu

SEQ ID NO: 2565185 - RNA, 15 nt, Human
uuugcuuugcccagc

SEQ ID NO: 2565186 - RNA, 15 nt, Human
uuugcuuucugcuca

SEQ ID NO: 2565187 - RNA, 15 nt, Human
uuugcuuugcuuucu

SEQ ID NO: 2565188 - RNA, 18 nt, Human
uuugcuuugcuuucugcu

SEQ ID NO: 2565189 - RNA, 22 nt, Human
uuugcuuuuccuuuguuuuuau

SEQ ID NO: 2565190 - RNA, 18 nt, Human
uuugaauguuaaauaaau

SEQ ID NO: 2565191 - RNA, 16 nt, Human
uuugaauguuaaauaa

SEQ ID NO: 2565192 - RNA, 13 nt, Human
uuugaauguuaaa

SEQ ID NO: 2565193 - RNA, 22 nt, Human
uuugaauguuaaauaaauugua

SEQ ID NO: 2565194 - RNA, 23 nt, Human
uuugcauaguaccaaucauuuua

SEQ ID NO: 2565195 - RNA, 21 nt, Human
uuugaauguuaaauaaauugu

SEQ ID NO: 2565196 - RNA, 15 nt, Human
uuugcaucugaaaau

SEQ ID NO: 2565197 - RNA, 15 nt, Human
uuugcauauguauga

SEQ ID NO: 2565198 - RNA, 16 nt, Human
uuugaaugcauuuugu

SEQ ID NO: 2565199 - RNA, 14 nt, Human
uuugaaugcauuuu

SEQ ID NO: 2565200 - RNA, 17 nt, Human
uuugaauguaugcuuca

SEQ ID NO: 2565201 - RNA, 22 nt, Human
uuugaauguaugcuucauacag

SEQ ID NO: 2565202 - RNA, 22 nt, Human
uuugaaugugauuuuaaagagu

SEQ ID NO: 2565203 - RNA, 16 nt, Human
uuugaaugcuuccuga

SEQ ID NO: 2565204 - RNA, 13 nt, Human
uuugaaugcauuu

SEQ ID NO: 2565205 - RNA, 14 nt, Human
uuugaaugacaaag

SEQ ID NO: 2565206 - RNA, 24 nt, Human
uuugaaugaaaaauuuaagcauug

SEQ ID NO: 2565207 - RNA, 15 nt, Human
uuugaaugaaaaauu

SEQ ID NO: 2565208 - RNA, 21 nt, Human
uuugaaugaaaaauuuaagca

SEQ ID NO: 2565209 - RNA, 22 nt, Human
uuugaaugaaaaauuuaagcau

SEQ ID NO: 2565210 - RNA, 23 nt, Human
uuugaaugaaaaauuuaagcauu

SEQ ID NO: 2565211 - RNA, 13 nt, Human
uuugaaugaaaaa

SEQ ID NO: 2565212 - RNA, 14 nt, Human
uuugaaugaaaaau

SEQ ID NO: 2565213 - RNA, 21 nt, Human
uuugaaucuugucucaaugcu

SEQ ID NO: 2565214 - RNA, 23 nt, Human
uuuuaaaagacaagacuucagua

SEQ ID NO: 2565215 - RNA, 15 nt, Human
uuuuaaaagacaaga

SEQ ID NO: 2565216 - RNA, 14 nt, Human
uuuuaaaagacaag

SEQ ID NO: 2565217 - RNA, 20 nt, Human
uuuuaaaagaugcaauguag

SEQ ID NO: 2565218 - RNA, 21 nt, Human
uuuuaaaagaaugauuaugaa

SEQ ID NO: 2565219 - RNA, 19 nt, Human
uuuguucucagcucccccu

SEQ ID NO: 2565220 - RNA, 15 nt, Human
uuuguugaaauuaug

SEQ ID NO: 2565221 - RNA, 18 nt, Human
uuuuaaagacuuuuauga

SEQ ID NO: 2565222 - RNA, 15 nt, Human
uuuuaaaaguuucaa

SEQ ID NO: 2565223 - RNA, 13 nt, Human
uuuuaaaaguuuc

SEQ ID NO: 2565224 - RNA, 17 nt, Human
uuuuaaagaaugcucuu

SEQ ID NO: 2565225 - RNA, 12 nt, Human
uuuuaaaaguuu

SEQ ID NO: 2565226 - RNA, 16 nt, Human
uuuuaaaaguuauuaa

SEQ ID NO: 2565227 - RNA, 16 nt, Human
uuuguauauuauuucu

SEQ ID NO: 2565228 - RNA, 12 nt, Human
uuuguauauugu

SEQ ID NO: 2565229 - RNA, 21 nt, Human
uuuguauaguugcuugccuga

SEQ ID NO: 2565230 - RNA, 15 nt, Human
uuuguauaguugcuu

SEQ ID NO: 2565231 - RNA, 21 nt, Human
uuuguaucugcaggcagacac

SEQ ID NO: 2565232 - RNA, 13 nt, Human
uuuguaucugaag

SEQ ID NO: 2565233 - RNA, 21 nt, Human
uuuguaucucugaagcauguu

SEQ ID NO: 2565234 - RNA, 20 nt, Human
uuuguaucucugaagcaugu

SEQ ID NO: 2565235 - RNA, 22 nt, Human
uuuguaucugcaggcagacacg

SEQ ID NO: 2565236 - RNA, 17 nt, Human
uuuguauaguaaaguga

SEQ ID NO: 2565237 - RNA, 23 nt, Human
uuuguaaaagaacaguaaacauu

SEQ ID NO: 2565238 - RNA, 16 nt, Human
uuuguauaguaaagug

SEQ ID NO: 2565239 - RNA, 21 nt, Human
uuuguaaaagaacaguaaaca

SEQ ID NO: 2565240 - RNA, 22 nt, Human
uuuguaaaaacagcauugcuuu

SEQ ID NO: 2565241 - RNA, 20 nt, Human
uuuguucgcauggucacaca

SEQ ID NO: 2565242 - RNA, 16 nt, Human
uuuguucuaguuuuca

SEQ ID NO: 2565243 - RNA, 19 nt, Human
uuuguuccccuccuccacu

SEQ ID NO: 2565244 - RNA, 21 nt, Human
uuuguucuggcucuuccaggc

SEQ ID NO: 2565245 - RNA, 15 nt, Human
uuuguucuucuuaaa

SEQ ID NO: 2565246 - RNA, 14 nt, Human
uuuguucuuuuuau

SEQ ID NO: 2565247 - RNA, 20 nt, Human
uuuuaacaaaagcaagacug

SEQ ID NO: 2565248 - RNA, 16 nt, Human
uuuuaacaaaagcaag

SEQ ID NO: 2565249 - RNA, 13 nt, Human
uuuuaaauuuuau

SEQ ID NO: 2565250 - RNA, 20 nt, Human
uuuuaauaauguuucaaaca

SEQ ID NO: 2565251 - RNA, 12 nt, Human
uuuuaauacagg

SEQ ID NO: 2565252 - RNA, 14 nt, Human
uuuuaauauaaauu

SEQ ID NO: 2565253 - RNA, 18 nt, Human
uuuuaauagaauaaaaua

SEQ ID NO: 2565254 - RNA, 21 nt, Human
uuuuaauagaauauaauuauc

SEQ ID NO: 2565255 - RNA, 14 nt, Human
uuuuaaucaugaaa

SEQ ID NO: 2565256 - RNA, 12 nt, Human
uuuuaaucauga

SEQ ID NO: 2565257 - RNA, 22 nt, Human
uuuuaaucagacaaaguaauuc

SEQ ID NO: 2565258 - RNA, 20 nt, Human
uuuuaaucaugaaauuacuu

SEQ ID NO: 2565259 - RNA, 16 nt, Human
uuuuaaucaugaaauu

SEQ ID NO: 2565260 - RNA, 17 nt, Human
uuuuaaugcuccaaaug

SEQ ID NO: 2565261 - RNA, 23 nt, Human
uuuuaauggggguagcagcugga

SEQ ID NO: 2565262 - RNA, 22 nt, Human
uuuuaauggggguagcagcugg

SEQ ID NO: 2565263 - RNA, 20 nt, Human
uuuuaauggggguagcagcu

SEQ ID NO: 2565264 - RNA, 12 nt, Human
uuuuaaugugcu

SEQ ID NO: 2565265 - RNA, 11 nt, Human
uuuuaaugugc

SEQ ID NO: 2565266 - RNA, 18 nt, Human
uuuuaaugugcuguguaa

SEQ ID NO: 2565267 - RNA, 17 nt, Human
uuuuaaugugcugugua

SEQ ID NO: 2565268 - RNA, 15 nt, Human
uuuuaaugugcugug

SEQ ID NO: 2565269 - RNA, 13 nt, Human
uuuuaaugugcug

SEQ ID NO: 2565270 - RNA, 21 nt, Human
uuuuaaugugcuguguaaagu

SEQ ID NO: 2565271 - RNA, 19 nt, Human
uuuuaaugugcuguguaaa

SEQ ID NO: 2565272 - RNA, 13 nt, Human
uuuuaauuaaaua

SEQ ID NO: 2565273 - RNA, 21 nt, Human
uuuuaaauuauaacuuaaaau

SEQ ID NO: 2565274 - RNA, 21 nt, Human
uuuuaaaugcaccuggaauau

SEQ ID NO: 2565275 - RNA, 19 nt, Human
uuuuaaaugcauaaaugca

SEQ ID NO: 2565276 - RNA, 19 nt, Human
uuuuaaauggguagagaaa

SEQ ID NO: 2565277 - RNA, 11 nt, Human
uuuuaaaugca

SEQ ID NO: 2565278 - RNA, 12 nt, Human
uuuuaaaugcac

SEQ ID NO: 2565279 - RNA, 18 nt, Human
uuuuaaauauuuuuucuu

SEQ ID NO: 2565280 - RNA, 20 nt, Human
uuuuaaagagugaaaaauga

SEQ ID NO: 2565281 - RNA, 13 nt, Human
uuuuaaagacaug

SEQ ID NO: 2565282 - RNA, 21 nt, Human
uuuuaaagaccugacaccuuu

SEQ ID NO: 2565283 - RNA, 11 nt, Human
uuucucugcca

SEQ ID NO: 2565284 - RNA, 20 nt, Human
uuucucugauuugcaaaaaa

SEQ ID NO: 2565285 - RNA, 20 nt, Human
uuucucugggguauuugggg

SEQ ID NO: 2565286 - RNA, 13 nt, Human
uuucugagaaaga

SEQ ID NO: 2565287 - RNA, 20 nt, Human
uuucuguucuuucuggcuau

SEQ ID NO: 2565288 - RNA, 15 nt, Human
uuucugagaaagacu

SEQ ID NO: 2565289 - RNA, 15 nt, Human
uuucugaaguggacu

SEQ ID NO: 2565290 - RNA, 20 nt, Human
uuucuaaaggcuaccuuugu

SEQ ID NO: 2565291 - RNA, 21 nt, Human
uuucuaaaggcuaccuuugua

SEQ ID NO: 2565292 - RNA, 12 nt, Human
uuucuaaaguaa

SEQ ID NO: 2565293 - RNA, 20 nt, Human
uuucuagaacaucccugcca

SEQ ID NO: 2565294 - RNA, 22 nt, Human
uuucuagaacaucccugccagc

SEQ ID NO: 2565295 - RNA, 21 nt, Human
uuucuagaauuuaucacacuu

SEQ ID NO: 2565296 - RNA, 16 nt, Human
uuucuagacuugugcu

SEQ ID NO: 2565297 - RNA, 16 nt, Human
uuucuagacuuucugu

SEQ ID NO: 2565298 - RNA, 15 nt, Human
uuucuagacuuucug

SEQ ID NO: 2565299 - RNA, 23 nt, Human
uuucuacucgaguuacagacaaa

SEQ ID NO: 2565300 - RNA, 17 nt, Human
uuucuacucugaacuaa

SEQ ID NO: 2565301 - RNA, 15 nt, Human
uuucuacucugaacu

SEQ ID NO: 2565302 - RNA, 18 nt, Human
uuucuacuuugaagucau

SEQ ID NO: 2565303 - RNA, 22 nt, Human
uuucuacuuugaagucauacca

SEQ ID NO: 2565304 - RNA, 16 nt, Human
uuucuacuuuuaaaga

SEQ ID NO: 2565305 - RNA, 21 nt, Human
uuuccuggacauccucuucug

SEQ ID NO: 2565306 - RNA, 20 nt, Human
uuuccuggacauccucuucu

SEQ ID NO: 2565307 - RNA, 20 nt, Human
uuuccuggacacucagaccu

SEQ ID NO: 2565308 - RNA, 16 nt, Human
uuuccuggacacucag

SEQ ID NO: 2565309 - RNA, 17 nt, Human
uuuccugccuucuucuu

SEQ ID NO: 2565310 - RNA, 16 nt, Human
uuuccugccuucuucu

SEQ ID NO: 2565311 - RNA, 17 nt, Human
uuuccugcccuuccuca

SEQ ID NO: 2565312 - RNA, 22 nt, Human
uuuccugagcuuggccagaagg

SEQ ID NO: 2565313 - RNA, 16 nt, Human
uuuccugaggcugggc

SEQ ID NO: 2565314 - RNA, 12 nt, Human
uuuccugcccug

SEQ ID NO: 2565315 - RNA, 13 nt, Human
uuuccugcccugg

SEQ ID NO: 2565316 - RNA, 12 nt, Human
uuuccucccuuc

SEQ ID NO: 2565317 - RNA, 13 nt, Human
uuuccucccuucu

SEQ ID NO: 2565318 - RNA, 14 nt, Human
uuuccucccuucug

SEQ ID NO: 2565319 - RNA, 17 nt, Human
uuuccucccuucugcua

SEQ ID NO: 2565320 - RNA, 13 nt, Human
uuuccucccucag

SEQ ID NO: 2565321 - RNA, 11 nt, Human
uuuccucccuu

SEQ ID NO: 2565322 - RNA, 16 nt, Human
uuuccuccccagcagg

SEQ ID NO: 2565323 - RNA, 16 nt, Human
uuuccucaucugucca

SEQ ID NO: 2565324 - RNA, 19 nt, Human
uuuccucauuccugaaaga

SEQ ID NO: 2565325 - RNA, 12 nt, Human
uuuccuccccag

SEQ ID NO: 2565326 - RNA, 14 nt, Human
uuuccuccccagca

SEQ ID NO: 2565327 - RNA, 15 nt, Human
uuaccacccccacac

SEQ ID NO: 2565328 - RNA, 12 nt, Human
uuaccaccccca

SEQ ID NO: 2565329 - RNA, 13 nt, Human
uuaccacccccac

SEQ ID NO: 2565330 - RNA, 14 nt, Human
uuuccucaucuguc

SEQ ID NO: 2565331 - RNA, 12 nt, Human
uuuccucaucug

SEQ ID NO: 2565332 - RNA, 21 nt, Human
uuuccucaggcugcuggagga

SEQ ID NO: 2565333 - RNA, 21 nt, Human
uuacauuuuuacaauaaauaa

SEQ ID NO: 2565334 - RNA, 15 nt, Human
uuacauuuuuacaau

SEQ ID NO: 2565335 - RNA, 14 nt, Human
uuacauuuuuacaa

SEQ ID NO: 2565336 - RNA, 13 nt, Human
uuacauuuuuaca

SEQ ID NO: 2565337 - RNA, 12 nt, Human
uuaccaaccugu

SEQ ID NO: 2565338 - RNA, 13 nt, Human
uuaccaaccuguu

SEQ ID NO: 2565339 - RNA, 17 nt, Human
uuacauuuuuacaauaa

SEQ ID NO: 2565340 - RNA, 16 nt, Human
uuacauuuuuacaaua

SEQ ID NO: 2565341 - RNA, 18 nt, Human
uuacauuuuuacaauaaa

SEQ ID NO: 2565342 - RNA, 14 nt, Human
uuaccacagacaua

SEQ ID NO: 2565343 - RNA, 17 nt, Human
uuaccacagacauacua

SEQ ID NO: 2565344 - RNA, 18 nt, Human
uuaccaacuuucuguaaa

SEQ ID NO: 2565345 - RNA, 16 nt, Human
uuaccaacuuucugua

SEQ ID NO: 2565346 - RNA, 15 nt, Human
uuaccaacuuucugu

SEQ ID NO: 2565347 - RNA, 14 nt, Human
uuaccaacuuucug

SEQ ID NO: 2565348 - RNA, 20 nt, Human
uuaccaaccuguuaccuacu

SEQ ID NO: 2565349 - RNA, 13 nt, Human
uuaccaacuuucu

SEQ ID NO: 2565350 - RNA, 14 nt, Human
uuaccaagaagccu

SEQ ID NO: 2565351 - RNA, 13 nt, Human
uuaccaagaagcc

SEQ ID NO: 2565352 - RNA, 18 nt, Human
uuugaaucaucaagucuu

SEQ ID NO: 2565353 - RNA, 19 nt, Human
uuugaauauaaacacuaua

SEQ ID NO: 2565354 - RNA, 22 nt, Human
uuugaagaugccgcauuuggau

SEQ ID NO: 2565355 - RNA, 19 nt, Human
uuugaauccucucucugug

SEQ ID NO: 2565356 - RNA, 12 nt, Human
uuugaaucuugu

SEQ ID NO: 2565357 - RNA, 18 nt, Human
uuugaaucuugucucaau

SEQ ID NO: 2565358 - RNA, 16 nt, Human
uuugaaucuugucuca

SEQ ID NO: 2565359 - RNA, 19 nt, Human
uuugaaucaauaauauauu

SEQ ID NO: 2565360 - RNA, 17 nt, Human
uuugaauccaugcuugg

SEQ ID NO: 2565361 - RNA, 19 nt, Human
uuugaagaaugaacaaauu

SEQ ID NO: 2565362 - RNA, 15 nt, Human
uuugaagaggaaaau

SEQ ID NO: 2565363 - RNA, 17 nt, Human
uuugaagaacaugugag

SEQ ID NO: 2565364 - RNA, 18 nt, Human
uuugaagaacaugugaga

SEQ ID NO: 2565365 - RNA, 16 nt, Human
uuugaacucagaucug

SEQ ID NO: 2565366 - RNA, 21 nt, Human
uuugaacucagaucugucuga

SEQ ID NO: 2565367 - RNA, 17 nt, Human
uuugaacugauaaagau

SEQ ID NO: 2565368 - RNA, 19 nt, Human
uuugaacugauaaagauga

SEQ ID NO: 2565369 - RNA, 15 nt, Human
uuugaacugauaaag

SEQ ID NO: 2565370 - RNA, 14 nt, Human
uuugaacucuucaa

SEQ ID NO: 2565371 - RNA, 13 nt, Human
uuucuucuucccu

SEQ ID NO: 2565372 - RNA, 12 nt, Human
uuucuucuuccc

SEQ ID NO: 2565373 - RNA, 22 nt, Human
uuucuugagguacucugcacau

SEQ ID NO: 2565374 - RNA, 22 nt, Human
uuucuugacucuuguuuucagu

SEQ ID NO: 2565375 - RNA, 21 nt, Human
uuucuugaucaacaucuuuuc

SEQ ID NO: 2565376 - RNA, 23 nt, Human
uuucuugccaaugaggucugaaa

SEQ ID NO: 2565377 - RNA, 16 nt, Human
uuucuugcagaucaaa

SEQ ID NO: 2565378 - RNA, 15 nt, Human
uuucuguugguguau

SEQ ID NO: 2565379 - RNA, 20 nt, Human
uuucugaccaaucacugagu

SEQ ID NO: 2565380 - RNA, 15 nt, Human
uuucuguugaaguuu

SEQ ID NO: 2565381 - RNA, 18 nt, Human
uuucuguuuccuuuuuua

SEQ ID NO: 2565382 - RNA, 18 nt, Human
uuucuguugucauugcug

SEQ ID NO: 2565383 - RNA, 17 nt, Human
uuucuguugucauugcu

SEQ ID NO: 2565384 - RNA, 13 nt, Human
uuucuguugucau

SEQ ID NO: 2565385 - RNA, 22 nt, Human
uuucuguucuguggaaagugua

SEQ ID NO: 2565386 - RNA, 14 nt, Human
uuucuguugccaca

SEQ ID NO: 2565387 - RNA, 22 nt, Human
uuucuuagcuuuuuaauuguug

SEQ ID NO: 2565388 - RNA, 21 nt, Human
uuucuuagcuuuuuaauuguu

SEQ ID NO: 2565389 - RNA, 20 nt, Human
uuucuuagcuuuuuaauugu

SEQ ID NO: 2565390 - RNA, 19 nt, Human
uuucuuagcuuuuuaauug

SEQ ID NO: 2565391 - RNA, 16 nt, Human
uuucuuaaaccuucag

SEQ ID NO: 2565392 - RNA, 23 nt, Human
uuucuguugucauugcuguuguc

SEQ ID NO: 2565393 - RNA, 12 nt, Human
uuucuguuuucu

SEQ ID NO: 2565394 - RNA, 16 nt, Human
uuucuuaaacaaaugu

SEQ ID NO: 2565395 - RNA, 18 nt, Human
uuucuuagggaaggauac

SEQ ID NO: 2565396 - RNA, 23 nt, Human
uuucuuagggaaggauacaaaag

SEQ ID NO: 2565397 - RNA, 17 nt, Human
uuucuuauuucauuucu

SEQ ID NO: 2565398 - RNA, 16 nt, Human
uuucuuagugccugug

SEQ ID NO: 2565399 - RNA, 18 nt, Human
uuucuuauuuaacuuaac

SEQ ID NO: 2565400 - RNA, 17 nt, Human
uuucuuaucuucugcaa

SEQ ID NO: 2565401 - RNA, 13 nt, Human
uuucuucucccuc

SEQ ID NO: 2565402 - RNA, 13 nt, Human
uuucuucucugcu

SEQ ID NO: 2565403 - RNA, 23 nt, Human
uuucuucuguauuuuuuuuucua

SEQ ID NO: 2565404 - RNA, 12 nt, Human
uuucuucuauuu

SEQ ID NO: 2565405 - RNA, 16 nt, Human
uuucuuccucugcuga

SEQ ID NO: 2565406 - RNA, 14 nt, Human
uuucuuccucugcu

SEQ ID NO: 2565407 - RNA, 12 nt, Human
uuucuucucccu

SEQ ID NO: 2565408 - RNA, 13 nt, Human
uuucuuccucugc

SEQ ID NO: 2565409 - RNA, 11 nt, Human
uuucuuccucu

SEQ ID NO: 2565410 - RNA, 18 nt, Human
uuucuucccuguauuuuc

SEQ ID NO: 2565411 - RNA, 18 nt, Human
uuucuucaugcaaugaca

SEQ ID NO: 2565412 - RNA, 19 nt, Human
uuucuucaugcaaugacau

SEQ ID NO: 2565413 - RNA, 22 nt, Human
uuucuucaugcaaugacaucuu

SEQ ID NO: 2565414 - RNA, 14 nt, Human
uuucuucccaucac

SEQ ID NO: 2565415 - RNA, 21 nt, Human
uuucuucacuguugaaaauua

SEQ ID NO: 2565416 - RNA, 16 nt, Human
uuucuucaugcaauga

SEQ ID NO: 2565417 - RNA, 18 nt, Human
uuucuucaacaucaaugu

SEQ ID NO: 2565418 - RNA, 21 nt, Human
uuucuucaacaucaauguuca

SEQ ID NO: 2565419 - RNA, 18 nt, Human
guauagaugcaagauauu

SEQ ID NO: 2565420 - RNA, 14 nt, Human
guauagaugcaaga

SEQ ID NO: 2565421 - RNA, 15 nt, Human
guauagagauaugca

SEQ ID NO: 2565422 - RNA, 16 nt, Human
guauagacuccugaaa

SEQ ID NO: 2565423 - RNA, 16 nt, Human
guauagaugcaagaua

SEQ ID NO: 2565424 - RNA, 14 nt, Human
guauagcuguauug

SEQ ID NO: 2565425 - RNA, 17 nt, Human
guauagcuguauugaau

SEQ ID NO: 2565426 - RNA, 16 nt, Human
guauagcuguauugaa

SEQ ID NO: 2565427 - RNA, 15 nt, Human
guauagcuguauuga

SEQ ID NO: 2565428 - RNA, 23 nt, Human
guauagcuguauugaaucaugua

SEQ ID NO: 2565429 - RNA, 19 nt, Human
guauagcuguauugaauca

SEQ ID NO: 2565430 - RNA, 19 nt, Human
guauaguacuggcauggua

SEQ ID NO: 2565431 - RNA, 23 nt, Human
guauagaaaugcugguuuuucag

SEQ ID NO: 2565432 - RNA, 22 nt, Human
guauagaaaugcugguuuuuca

SEQ ID NO: 2565433 - RNA, 15 nt, Human
guauagaaaugcugg

SEQ ID NO: 2565434 - RNA, 14 nt, Human
guauagaaaugcug

SEQ ID NO: 2565435 - RNA, 16 nt, Human
guauaguguaaaauaa

SEQ ID NO: 2565436 - RNA, 15 nt, Human
guauaguguaaaaua

SEQ ID NO: 2565437 - RNA, 14 nt, Human
guauaguguaaaau

SEQ ID NO: 2565438 - RNA, 13 nt, Human
guauaguguaaaa

SEQ ID NO: 2565439 - RNA, 19 nt, Human
guauaguuaggauagcauu

SEQ ID NO: 2565440 - RNA, 18 nt, Human
guauagguagauguucag

SEQ ID NO: 2565441 - RNA, 16 nt, Human
guauauaaaauauuuu

SEQ ID NO: 2565442 - RNA, 17 nt, Human
guauaguugcuugccug

SEQ ID NO: 2565443 - RNA, 18 nt, Human
guauaguugcuugccuga

SEQ ID NO: 2565444 - RNA, 16 nt, Human
guauaguugcuugccu

SEQ ID NO: 2565445 - RNA, 12 nt, Human
guauaguugcuu

SEQ ID NO: 2565446 - RNA, 22 nt, Human
guauauaaaggaaaaaagagaa

SEQ ID NO: 2565447 - RNA, 16 nt, Human
guauauacgcaucuau

SEQ ID NO: 2565448 - RNA, 14 nt, Human
guauauauucccaa

SEQ ID NO: 2565449 - RNA, 13 nt, Human
guauauauuccca

SEQ ID NO: 2565450 - RNA, 20 nt, Human
guauauauguguguuuaaau

SEQ ID NO: 2565451 - RNA, 19 nt, Human
guauauauguguguuuaaa

SEQ ID NO: 2565452 - RNA, 18 nt, Human
guauauauguguguuuaa

SEQ ID NO: 2565453 - RNA, 16 nt, Human
guauauauguguguuu

SEQ ID NO: 2565454 - RNA, 14 nt, Human
guauauaugugugu

SEQ ID NO: 2565455 - RNA, 13 nt, Human
guauauaugugug

SEQ ID NO: 2565456 - RNA, 22 nt, Human
guauauaucugcuucaguggag

SEQ ID NO: 2565457 - RNA, 12 nt, Human
guauauaugugu

SEQ ID NO: 2565458 - RNA, 20 nt, Human
guauauauaugccaugaugg

SEQ ID NO: 2565459 - RNA, 21 nt, Human
guauauauaugccaugaugga

SEQ ID NO: 2565460 - RNA, 13 nt, Human
guauauacuuuuu

SEQ ID NO: 2565461 - RNA, 14 nt, Human
guauauauagaauc

SEQ ID NO: 2565462 - RNA, 20 nt, Human
guauauaaugguuucaaaga

SEQ ID NO: 2565463 - RNA, 12 nt, Human
guauauacuuuu

SEQ ID NO: 2565464 - RNA, 15 nt, Human
guauauagcccagcc

SEQ ID NO: 2565465 - RNA, 16 nt, Human
guauauguugggugca

SEQ ID NO: 2565466 - RNA, 21 nt, Human
guauaugucucaggucccugc

SEQ ID NO: 2565467 - RNA, 15 nt, Human
guauaugucucaggu

SEQ ID NO: 2565468 - RNA, 13 nt, Human
guauaugucucag

SEQ ID NO: 2565469 - RNA, 23 nt, Human
guauccuccagguuuuucaauua

SEQ ID NO: 2565470 - RNA, 21 nt, Human
guauccuccagguuuuucaau

SEQ ID NO: 2565471 - RNA, 17 nt, Human
guauccuggggcucccu

SEQ ID NO: 2565472 - RNA, 13 nt, Human
guauccuggggcu

SEQ ID NO: 2565473 - RNA, 16 nt, Human
guauauguaugugugu

SEQ ID NO: 2565474 - RNA, 17 nt, Human
guauauguaugugugua

SEQ ID NO: 2565475 - RNA, 21 nt, Human
guauaucuggacaagccaacu

SEQ ID NO: 2565476 - RNA, 18 nt, Human
guauaucuggacaagcca

SEQ ID NO: 2565477 - RNA, 22 nt, Human
guauaugucaagccauaauugu

SEQ ID NO: 2565478 - RNA, 17 nt, Human
guauaucuggacaagcc

SEQ ID NO: 2565479 - RNA, 19 nt, Human
guauaucagaaaagggaag

SEQ ID NO: 2565480 - RNA, 14 nt, Human
guauaucagaaaag

SEQ ID NO: 2565481 - RNA, 13 nt, Human
guaucuccaggau

SEQ ID NO: 2565482 - RNA, 14 nt, Human
guaucuccaggauu

SEQ ID NO: 2565483 - RNA, 17 nt, Human
guaucuaugcauuuucu

SEQ ID NO: 2565484 - RNA, 20 nt, Human
guaucuauauauguguaugu

SEQ ID NO: 2565485 - RNA, 18 nt, Human
guaucuagugcagcugau

SEQ ID NO: 2565486 - RNA, 14 nt, Human
guaucugaaggaga

SEQ ID NO: 2565487 - RNA, 11 nt, Human
guaucugaagg

SEQ ID NO: 2565488 - RNA, 20 nt, Human
guaucucugaagcauguuuc

SEQ ID NO: 2565489 - RNA, 19 nt, Human
guaucucugaagcauguuu

SEQ ID NO: 2565490 - RNA, 17 nt, Human
guaucucugaagcaugu

SEQ ID NO: 2565491 - RNA, 20 nt, Human
guaucucggaccuuucagcu

SEQ ID NO: 2565492 - RNA, 15 nt, Human
guaucuccucgcaag

SEQ ID NO: 2565493 - RNA, 18 nt, Human
guauccugggggacccaa

SEQ ID NO: 2565494 - RNA, 20 nt, Human
guauccugugacauguaaca

SEQ ID NO: 2565495 - RNA, 15 nt, Human
guaucgauguuaugu

SEQ ID NO: 2565496 - RNA, 14 nt, Human
guaucggagacagu

SEQ ID NO: 2565497 - RNA, 15 nt, Human
guaucggagacagug

SEQ ID NO: 2565498 - RNA, 15 nt, Human
guaucguaaccagcc

SEQ ID NO: 2565499 - RNA, 17 nt, Human
guaucggagacagugau

SEQ ID NO: 2565500 - RNA, 16 nt, Human
guaucguauagcugua

SEQ ID NO: 2565501 - RNA, 15 nt, Human
guaucguauagcugu

SEQ ID NO: 2565502 - RNA, 17 nt, Human
guaucguaaccagccag

SEQ ID NO: 2565503 - RNA, 16 nt, Human
guaucguaaccagcca

SEQ ID NO: 2565504 - RNA, 20 nt, Human
guaucuagacccaucuucuu

SEQ ID NO: 2565505 - RNA, 24 nt, Human
guaucuagcaaucacaacacuggc

SEQ ID NO: 2565506 - RNA, 15 nt, Human
guaucuagugcagcu

SEQ ID NO: 2565507 - RNA, 16 nt, Human
guaucuagugcagcug

SEQ ID NO: 2565508 - RNA, 17 nt, Human
guaucuagugcagcuga

SEQ ID NO: 2565509 - RNA, 13 nt, Human
guaucuagugcag

SEQ ID NO: 2565510 - RNA, 14 nt, Human
guaucuagcaauca

SEQ ID NO: 2565511 - RNA, 19 nt, Human
guaugaauaaagacaccua

SEQ ID NO: 2565512 - RNA, 18 nt, Human
guaugaauaaagacaccu

SEQ ID NO: 2565513 - RNA, 13 nt, Human
guaugaggcauuu

SEQ ID NO: 2565514 - RNA, 15 nt, Human
guaugaggcauuugu

SEQ ID NO: 2565515 - RNA, 15 nt, Human
guaugaaucuaugcc

SEQ ID NO: 2565516 - RNA, 20 nt, Human
guaugaaucuaugccaaaga

SEQ ID NO: 2565517 - RNA, 16 nt, Human
guaugaaucuaugcca

SEQ ID NO: 2565518 - RNA, 21 nt, Human
guaugaaucuaugccaaagau

SEQ ID NO: 2565519 - RNA, 15 nt, Human
guaugaaugcagugg

SEQ ID NO: 2565520 - RNA, 14 nt, Human
guaugacuaaagag

SEQ ID NO: 2565521 - RNA, 18 nt, Human
guaugacuaaagagagaa

SEQ ID NO: 2565522 - RNA, 12 nt, Human
guaugagcugag

SEQ ID NO: 2565523 - RNA, 20 nt, Human
guaugacuaaagagagaaug

SEQ ID NO: 2565524 - RNA, 14 nt, Human
guaucuucauguau

SEQ ID NO: 2565525 - RNA, 15 nt, Human
guaucuguucuuuaa

SEQ ID NO: 2565526 - RNA, 21 nt, Human
guaucuugggggacagggcug

SEQ ID NO: 2565527 - RNA, 23 nt, Human
guaucuuguuuuuccacuacugc

SEQ ID NO: 2565528 - RNA, 16 nt, Human
guaucuuuuuucaaaa

SEQ ID NO: 2565529 - RNA, 23 nt, Human
guaugaaagauggcugugccucu

SEQ ID NO: 2565530 - RNA, 22 nt, Human
guaugaaagauggcugugccuc

SEQ ID NO: 2565531 - RNA, 12 nt, Human
guaucuggugac

SEQ ID NO: 2565532 - RNA, 12 nt, Human
guaucugagcag

SEQ ID NO: 2565533 - RNA, 19 nt, Human
guaucuggugacuuuccuc

SEQ ID NO: 2565534 - RNA, 17 nt, Human
guaucugcaggcagaca

SEQ ID NO: 2565535 - RNA, 16 nt, Human
guaucugcaggcagac

SEQ ID NO: 2565536 - RNA, 19 nt, Human
guaucugcaggcagacacg

SEQ ID NO: 2565537 - RNA, 18 nt, Human
guaucugcaggcagacac

SEQ ID NO: 2565538 - RNA, 16 nt, Human
guaucuguaucucucu

SEQ ID NO: 2565539 - RNA, 14 nt, Human
guaucugggaacug

SEQ ID NO: 2565540 - RNA, 17 nt, Human
guaugaggcauuuguuu

SEQ ID NO: 2565541 - RNA, 20 nt, Human
guaugaggcauuuguuugaa

SEQ ID NO: 2565542 - RNA, 20 nt, Human
guaugagucaaugugcagug

SEQ ID NO: 2565543 - RNA, 14 nt, Human
guaugagcugaggg

SEQ ID NO: 2565544 - RNA, 21 nt, Human
guaugagucaaugugcagugu

SEQ ID NO: 2565545 - RNA, 20 nt, Human
guaugaucacggcucacugc

SEQ ID NO: 2565546 - RNA, 17 nt, Human
guauguuagugcaaauu

SEQ ID NO: 2565547 - RNA, 16 nt, Human
guauguguguguaugc

SEQ ID NO: 2565548 - RNA, 18 nt, Human
guauguguguguaugcua

SEQ ID NO: 2565549 - RNA, 15 nt, Human
guauguguguguaug

SEQ ID NO: 2565550 - RNA, 13 nt, Human
guauguguguaga

SEQ ID NO: 2565551 - RNA, 14 nt, Human
guauguguguaugg

SEQ ID NO: 2565552 - RNA, 21 nt, Human
guaugaucacggcucacugca

SEQ ID NO: 2565553 - RNA, 11 nt, Human
guauguugucc

SEQ ID NO: 2565554 - RNA, 17 nt, Human
guauguugucaaagaga

SEQ ID NO: 2565555 - RNA, 16 nt, Human
guauguugucaaagag

SEQ ID NO: 2565556 - RNA, 13 nt, Human
guauguugucaaa

SEQ ID NO: 2565557 - RNA, 17 nt, Human
guauguugaagccuuug

SEQ ID NO: 2565558 - RNA, 18 nt, Human
guauguuaagcucuuuau

SEQ ID NO: 2565559 - RNA, 17 nt, Human
guauguguuugugugug

SEQ ID NO: 2565560 - RNA, 16 nt, Human
guauguguuugugugu

SEQ ID NO: 2565561 - RNA, 21 nt, Human
guauguuugcacacuugugug

SEQ ID NO: 2565562 - RNA, 14 nt, Human
guauguuuuagcau

SEQ ID NO: 2565563 - RNA, 16 nt, Human
guauguuuuagcaugu

SEQ ID NO: 2565564 - RNA, 14 nt, Human
guauguuugcacac

SEQ ID NO: 2565565 - RNA, 21 nt, Human
guauguuguccaauuguugac

SEQ ID NO: 2565566 - RNA, 18 nt, Human
guauguuguccaauuguu

SEQ ID NO: 2565567 - RNA, 18 nt, Human
guauuaagaaaaucuauu

SEQ ID NO: 2565568 - RNA, 13 nt, Human
guauuaaagacag

SEQ ID NO: 2565569 - RNA, 19 nt, Human
guauuaaaaaaaacaaaaa

SEQ ID NO: 2565570 - RNA, 22 nt, Human
guauuaaaaaaaacaaaaagaa

SEQ ID NO: 2565571 - RNA, 19 nt, Human
guauguuuuuguguauuug

SEQ ID NO: 2565572 - RNA, 15 nt, Human
guauuaaaaaaaaca

SEQ ID NO: 2565573 - RNA, 23 nt, Human
guauguuuuuguguauuuguuaa

SEQ ID NO: 2565574 - RNA, 19 nt, Human
guaguaaaaauuaaaaaaa

SEQ ID NO: 2565575 - RNA, 20 nt, Human
guagguuggaagcuagcucc

SEQ ID NO: 2565576 - RNA, 17 nt, Human
guagguucagccaaggu

SEQ ID NO: 2565577 - RNA, 14 nt, Human
guagguugggagaa

SEQ ID NO: 2565578 - RNA, 16 nt, Human
guaguaccaaaugcuu

SEQ ID NO: 2565579 - RNA, 15 nt, Human
guaguaauugacaug

SEQ ID NO: 2565580 - RNA, 19 nt, Human
guaguaccaaaugcuuuaa

SEQ ID NO: 2565581 - RNA, 21 nt, Human
guaguacuccugcaaaauuuu

SEQ ID NO: 2565582 - RNA, 21 nt, Human
guaguagcccuuucugugugc

SEQ ID NO: 2565583 - RNA, 20 nt, Human
guaguagcccuuucugugug

SEQ ID NO: 2565584 - RNA, 17 nt, Human
guaguagcccuuucugu

SEQ ID NO: 2565585 - RNA, 22 nt, Human
guaguacuccugcaaaauuuua

SEQ ID NO: 2565586 - RNA, 14 nt, Human
guagucaggugccu

SEQ ID NO: 2565587 - RNA, 13 nt, Human
guaguaugauggg

SEQ ID NO: 2565588 - RNA, 14 nt, Human
guaguaucaaauau

SEQ ID NO: 2565589 - RNA, 22 nt, Human
guaguagucucauuacuuuuga

SEQ ID NO: 2565590 - RNA, 16 nt, Human
guaguauaaagaaaag

SEQ ID NO: 2565591 - RNA, 18 nt, Human
guaguagggucaggccac

SEQ ID NO: 2565592 - RNA, 17 nt, Human
guagggugggccuucag

SEQ ID NO: 2565593 - RNA, 22 nt, Human
guagggugggccuucagggagu

SEQ ID NO: 2565594 - RNA, 16 nt, Human
guaggguuauaauaau

SEQ ID NO: 2565595 - RNA, 23 nt, Human
guaggguuuaauccccaguaaaa

SEQ ID NO: 2565596 - RNA, 16 nt, Human
guagguucagccaagg

SEQ ID NO: 2565597 - RNA, 15 nt, Human
guagguucagccaag

SEQ ID NO: 2565598 - RNA, 23 nt, Human
guagguaucauuuucugcauuua

SEQ ID NO: 2565599 - RNA, 22 nt, Human
guaggggagggguugccacagg

SEQ ID NO: 2565600 - RNA, 20 nt, Human
guaggggucaaagaaaugcu

SEQ ID NO: 2565601 - RNA, 15 nt, Human
guaggggugugugug

SEQ ID NO: 2565602 - RNA, 22 nt, Human
guaggguaauuaguaacaugug

SEQ ID NO: 2565603 - RNA, 17 nt, Human
guaggguaaggugccuu

SEQ ID NO: 2565604 - RNA, 14 nt, Human
guagggugggccuu

SEQ ID NO: 2565605 - RNA, 22 nt, Human
guagggucaggccacggcagcc

SEQ ID NO: 2565606 - RNA, 21 nt, Human
guagggucaggccacggcagc

SEQ ID NO: 2565607 - RNA, 17 nt, Human
guauaauucacauugua

SEQ ID NO: 2565608 - RNA, 18 nt, Human
guauaauuguaucguaua

SEQ ID NO: 2565609 - RNA, 19 nt, Human
guauacaacccuggcauua

SEQ ID NO: 2565610 - RNA, 22 nt, Human
guauaauuuuuuaaaguuacuu

SEQ ID NO: 2565611 - RNA, 15 nt, Human
guauaccugauuuuu

SEQ ID NO: 2565612 - RNA, 15 nt, Human
guauacuguaggcac

SEQ ID NO: 2565613 - RNA, 21 nt, Human
guauacaguggauuaauuaaa

SEQ ID NO: 2565614 - RNA, 12 nt, Human
guauacaugcca

SEQ ID NO: 2565615 - RNA, 15 nt, Human
guaguguuggagaag

SEQ ID NO: 2565616 - RNA, 14 nt, Human
guaguguuggagaa

SEQ ID NO: 2565617 - RNA, 16 nt, Human
guagucuugaugacca

SEQ ID NO: 2565618 - RNA, 14 nt, Human
guagugagauagca

SEQ ID NO: 2565619 - RNA, 14 nt, Human
guagucucugugcu

SEQ ID NO: 2565620 - RNA, 12 nt, Human
guagucuugaug

SEQ ID NO: 2565621 - RNA, 18 nt, Human
guagucucauuacuuuug

SEQ ID NO: 2565622 - RNA, 12 nt, Human
guagucccagcc

SEQ ID NO: 2565623 - RNA, 16 nt, Human
guaguccgugcugaca

SEQ ID NO: 2565624 - RNA, 22 nt, Human
guaguccgugcugacagcugcu

SEQ ID NO: 2565625 - RNA, 23 nt, Human
guaguccgugcugacagcugcuc

SEQ ID NO: 2565626 - RNA, 12 nt, Human
guaguccuguga

SEQ ID NO: 2565627 - RNA, 22 nt, Human
guaguccucauaaaaagcaaaa

SEQ ID NO: 2565628 - RNA, 12 nt, Human
guagucccagcu

SEQ ID NO: 2565629 - RNA, 13 nt, Human
guagucccagcua

SEQ ID NO: 2565630 - RNA, 17 nt, Human
guagucaagauuguguu

SEQ ID NO: 2565631 - RNA, 16 nt, Human
guagggcgggaggaug

SEQ ID NO: 2565632 - RNA, 23 nt, Human
guaggcuccugccaguguggaac

SEQ ID NO: 2565633 - RNA, 19 nt, Human
guaggcucaacuagggagu

SEQ ID NO: 2565634 - RNA, 17 nt, Human
guaggcucaacuaggga

SEQ ID NO: 2565635 - RNA, 15 nt, Human
guagggaacucuggg

SEQ ID NO: 2565636 - RNA, 18 nt, Human
guagcccccuggccucug

SEQ ID NO: 2565637 - RNA, 19 nt, Human
guagcccccuggccucugu

SEQ ID NO: 2565638 - RNA, 23 nt, Human
guagcccccuggccucugugccu

SEQ ID NO: 2565639 - RNA, 22 nt, Human
guagggcgggaggauguucugg

SEQ ID NO: 2565640 - RNA, 21 nt, Human
guagggcgggaggauguucug

SEQ ID NO: 2565641 - RNA, 13 nt, Human
guagggagggcgg

SEQ ID NO: 2565642 - RNA, 12 nt, Human
guagggcugacu

SEQ ID NO: 2565643 - RNA, 21 nt, Human
guagggcugccaccaagguga

SEQ ID NO: 2565644 - RNA, 23 nt, Human
guagggcgggaggauguucuggg

SEQ ID NO: 2565645 - RNA, 14 nt, Human
guagccaugggacc

SEQ ID NO: 2565646 - RNA, 23 nt, Human
guagccaucccaugaacacacug

SEQ ID NO: 2565647 - RNA, 20 nt, Human
guagccaucccaugaacaca

SEQ ID NO: 2565648 - RNA, 23 nt, Human
guagccagggggacuagccccug

SEQ ID NO: 2565649 - RNA, 23 nt, Human
guagccaggguguggcccugcca

SEQ ID NO: 2565650 - RNA, 22 nt, Human
guagccagggggacuagccccu

SEQ ID NO: 2565651 - RNA, 19 nt, Human
guagccagggggacuagcc

SEQ ID NO: 2565652 - RNA, 19 nt, Human
guagccagcacacagggca

SEQ ID NO: 2565653 - RNA, 21 nt, Human
guagccagcacacagggcagu

SEQ ID NO: 2565654 - RNA, 16 nt, Human
guagcccccuggccuc

SEQ ID NO: 2565655 - RNA, 17 nt, Human
guagcccccuggccucu

SEQ ID NO: 2565656 - RNA, 21 nt, Human
guagcccacacuugagaggau

SEQ ID NO: 2565657 - RNA, 15 nt, Human
guagccaugggacca

SEQ ID NO: 2565658 - RNA, 16 nt, Human
guagcccacucugcuc

SEQ ID NO: 2565659 - RNA, 20 nt, Human
guagcccacucugcucgccu

SEQ ID NO: 2565660 - RNA, 15 nt, Human
guagccagcacacag

SEQ ID NO: 2565661 - RNA, 18 nt, Human
guagccagcacacagggc

SEQ ID NO: 2565662 - RNA, 14 nt, Human
guagccaaagguuc

SEQ ID NO: 2565663 - RNA, 19 nt, Human
guagcauuucauucuucuc

SEQ ID NO: 2565664 - RNA, 17 nt, Human
guagcauuucauucuuc

SEQ ID NO: 2565665 - RNA, 18 nt, Human
guagccaaggugggcuga

SEQ ID NO: 2565666 - RNA, 19 nt, Human
guagccaaggugggcugag

SEQ ID NO: 2565667 - RNA, 21 nt, Human
guagcauguugagccaggccu

SEQ ID NO: 2565668 - RNA, 15 nt, Human
guagcauuacagugg

SEQ ID NO: 2565669 - RNA, 18 nt, Human
guagcagguaccacugau

SEQ ID NO: 2565670 - RNA, 13 nt, Human
guagcauacauuu

SEQ ID NO: 2565671 - RNA, 16 nt, Human
guagcaucuucuggag

SEQ ID NO: 2565672 - RNA, 12 nt, Human
guagcaugagag

SEQ ID NO: 2565673 - RNA, 15 nt, Human
guagcauuucauucu

SEQ ID NO: 2565674 - RNA, 13 nt, Human
guagcauuucauu

SEQ ID NO: 2565675 - RNA, 15 nt, Human
guagauuuucuuuaa

SEQ ID NO: 2565676 - RNA, 13 nt, Human
guagauuuucuuu

SEQ ID NO: 2565677 - RNA, 14 nt, Human
guagauuuuccaaa

SEQ ID NO: 2565678 - RNA, 16 nt, Human
guagauuuucuuuaaa

SEQ ID NO: 2565679 - RNA, 19 nt, Human
guagauuuauuucaucaua

SEQ ID NO: 2565680 - RNA, 21 nt, Human
guagauuuauuucaucauauu

SEQ ID NO: 2565681 - RNA, 21 nt, Human
guagauuuuaaaaguuauuaa

SEQ ID NO: 2565682 - RNA, 16 nt, Human
guagauucuguggaac

SEQ ID NO: 2565683 - RNA, 13 nt, Human
guagauucugugg

SEQ ID NO: 2565684 - RNA, 19 nt, Human
guagauucuguggaacaag

SEQ ID NO: 2565685 - RNA, 12 nt, Human
guagauuuauuu

SEQ ID NO: 2565686 - RNA, 16 nt, Human
guagauuuauuucauc

SEQ ID NO: 2565687 - RNA, 21 nt, Human
guagcaaguucuagagaagag

SEQ ID NO: 2565688 - RNA, 20 nt, Human
guagcaaguucuagagaaga

SEQ ID NO: 2565689 - RNA, 15 nt, Human
guagcagggaaaaua

SEQ ID NO: 2565690 - RNA, 17 nt, Human
guagcagguaccacuga

SEQ ID NO: 2565691 - RNA, 15 nt, Human
guagcaguagaugca

SEQ ID NO: 2565692 - RNA, 14 nt, Human
guagcagcuggacu

SEQ ID NO: 2565693 - RNA, 13 nt, Human
guagcagcuggac

SEQ ID NO: 2565694 - RNA, 12 nt, Human
guagcagcugga

SEQ ID NO: 2565695 - RNA, 11 nt, Human
guagcagcugg

SEQ ID NO: 2565696 - RNA, 13 nt, Human
guagcacuuacug

SEQ ID NO: 2565697 - RNA, 18 nt, Human
guagaguuaagaagcugu

SEQ ID NO: 2565698 - RNA, 17 nt, Human
guagaguuaagaagcug

SEQ ID NO: 2565699 - RNA, 16 nt, Human
guagaguuaagaagcu

SEQ ID NO: 2565700 - RNA, 15 nt, Human
guagaguuaagaagc

SEQ ID NO: 2565701 - RNA, 14 nt, Human
guagaguuaagaag

SEQ ID NO: 2565702 - RNA, 12 nt, Human
guagaguuaaga

SEQ ID NO: 2565703 - RNA, 19 nt, Human
gcuauaggcuggagaagcu

SEQ ID NO: 2565704 - RNA, 18 nt, Human
gcuauaggugcuacaaaa

SEQ ID NO: 2565705 - RNA, 15 nt, Human
guagagugugccuga

SEQ ID NO: 2565706 - RNA, 14 nt, Human
guagauagaaauaa

SEQ ID NO: 2565707 - RNA, 20 nt, Human
guagaguuugaaggagguga

SEQ ID NO: 2565708 - RNA, 12 nt, Human
guagauagaaau

SEQ ID NO: 2565709 - RNA, 17 nt, Human
guagaucaguggucucc

SEQ ID NO: 2565710 - RNA, 19 nt, Human
guagaucaccagaauaaac

SEQ ID NO: 2565711 - RNA, 17 nt, Human
guagaucaccagaauaa

SEQ ID NO: 2565712 - RNA, 19 nt, Human
guagauauuuuuucugaau

SEQ ID NO: 2565713 - RNA, 13 nt, Human
guagauagaaaua

SEQ ID NO: 2565714 - RNA, 23 nt, Human
guagaugaaaaagcauguacagu

SEQ ID NO: 2565715 - RNA, 22 nt, Human
guagaugaaaaagcauguacag

SEQ ID NO: 2565716 - RNA, 21 nt, Human
guagaugaaaaagcauguaca

SEQ ID NO: 2565717 - RNA, 17 nt, Human
guagaucagagcagcag

SEQ ID NO: 2565718 - RNA, 17 nt, Human
guagaugggagggaggc

SEQ ID NO: 2565719 - RNA, 21 nt, Human
guagaugggagggaggcucag

SEQ ID NO: 2565720 - RNA, 21 nt, Human
guagaugugcauuuuugugaa

SEQ ID NO: 2565721 - RNA, 23 nt, Human
guagauguucagauugcuuugau

SEQ ID NO: 2565722 - RNA, 17 nt, Human
guccccaccgcagacag

SEQ ID NO: 2565723 - RNA, 17 nt, Human
guccccaccccugcccc

SEQ ID NO: 2565724 - RNA, 16 nt, Human
guccccaccccugccc

SEQ ID NO: 2565725 - RNA, 15 nt, Human
guccccaccccugcc

SEQ ID NO: 2565726 - RNA, 14 nt, Human
guccccaccccugc

SEQ ID NO: 2565727 - RNA, 12 nt, Human
guccccaccccu

SEQ ID NO: 2565728 - RNA, 17 nt, Human
gucccuaauaaagcugu

SEQ ID NO: 2565729 - RNA, 16 nt, Human
gucccuaauaaagcug

SEQ ID NO: 2565730 - RNA, 18 nt, Human
gucccauuucucacugag

SEQ ID NO: 2565731 - RNA, 16 nt, Human
gucccauuucucacug

SEQ ID NO: 2565732 - RNA, 17 nt, Human
guccccaaaccugcaag

SEQ ID NO: 2565733 - RNA, 18 nt, Human
guccccaaaccugcaagg

SEQ ID NO: 2565734 - RNA, 22 nt, Human
guccccaaauccgaaccuccuc

SEQ ID NO: 2565735 - RNA, 12 nt, Human
guccccacacuc

SEQ ID NO: 2565736 - RNA, 11 nt, Human
guccccacacu

SEQ ID NO: 2565737 - RNA, 21 nt, Human
guccccaagauucacaccuga

SEQ ID NO: 2565738 - RNA, 24 nt, Human
guccccacacuccuacaccuaacu

SEQ ID NO: 2565739 - RNA, 13 nt, Human
gucccauguggug

SEQ ID NO: 2565740 - RNA, 22 nt, Human
gucccauggacacuccagugcc

SEQ ID NO: 2565741 - RNA, 21 nt, Human
gucccauggacacuccagugc

SEQ ID NO: 2565742 - RNA, 17 nt, Human
gucccaugaucccugug

SEQ ID NO: 2565743 - RNA, 23 nt, Human
gucccauggacacuccagugcca

SEQ ID NO: 2565744 - RNA, 17 nt, Human
gucccauccaggcaguc

SEQ ID NO: 2565745 - RNA, 16 nt, Human
gucccauccaggcagu

SEQ ID NO: 2565746 - RNA, 15 nt, Human
gucccauccaggcag

SEQ ID NO: 2565747 - RNA, 14 nt, Human
gucccauccaggca

SEQ ID NO: 2565748 - RNA, 13 nt, Human
gucccauccaggc

SEQ ID NO: 2565749 - RNA, 18 nt, Human
gucccauauccugccuca

SEQ ID NO: 2565750 - RNA, 16 nt, Human
gucccauauccugccu

SEQ ID NO: 2565751 - RNA, 15 nt, Human
gucccauauccugcc

SEQ ID NO: 2565752 - RNA, 23 nt, Human
gucccaugacccaccccugugcu

SEQ ID NO: 2565753 - RNA, 22 nt, Human
gucccaugacccaccccugugc

SEQ ID NO: 2565754 - RNA, 20 nt, Human
gucccaugacccaccccugu

SEQ ID NO: 2565755 - RNA, 19 nt, Human
gucccaugacccaccccug

SEQ ID NO: 2565756 - RNA, 18 nt, Human
gucccaugacccaccccu

SEQ ID NO: 2565757 - RNA, 17 nt, Human
gucccaugacccacccc

SEQ ID NO: 2565758 - RNA, 16 nt, Human
gucccaugacccaccc

SEQ ID NO: 2565759 - RNA, 20 nt, Human
gucccaggagcugcccagag

SEQ ID NO: 2565760 - RNA, 14 nt, Human
gucccauauccugc

SEQ ID NO: 2565761 - RNA, 18 nt, Human
gucccaggcugagccuca

SEQ ID NO: 2565762 - RNA, 19 nt, Human
gucccaggcugagccucag

SEQ ID NO: 2565763 - RNA, 16 nt, Human
gucccaggcugagccu

SEQ ID NO: 2565764 - RNA, 17 nt, Human
gucccaggcugagccuc

SEQ ID NO: 2565765 - RNA, 15 nt, Human
gucccaggcugagcc

SEQ ID NO: 2565766 - RNA, 17 nt, Human
gucccacuaucugggug

SEQ ID NO: 2565767 - RNA, 20 nt, Human
gucccacgaauuugcugggg

SEQ ID NO: 2565768 - RNA, 12 nt, Human
gucccaggcaga

SEQ ID NO: 2565769 - RNA, 23 nt, Human
gucccaccuuggcugcagggagu

SEQ ID NO: 2565770 - RNA, 22 nt, Human
gucccacgaauuugcuggggaa

SEQ ID NO: 2565771 - RNA, 20 nt, Human
gucccaccuuggcugcaggg

SEQ ID NO: 2565772 - RNA, 21 nt, Human
gucccugcacuugcagacucu

SEQ ID NO: 2565773 - RNA, 19 nt, Human
gucccugcacuugcagacu

SEQ ID NO: 2565774 - RNA, 16 nt, Human
gucccugcacuugcag

SEQ ID NO: 2565775 - RNA, 22 nt, Human
gucccugaggcagguccccaga

SEQ ID NO: 2565776 - RNA, 20 nt, Human
gucccugacucucugugacc

SEQ ID NO: 2565777 - RNA, 22 nt, Human
gucccucuguguauuugcuuuu

SEQ ID NO: 2565778 - RNA, 14 nt, Human
gucccucuguguau

SEQ ID NO: 2565779 - RNA, 16 nt, Human
gucccugaagagaagg

SEQ ID NO: 2565780 - RNA, 18 nt, Human
gucccugaggcagguccc

SEQ ID NO: 2565781 - RNA, 17 nt, Human
gucccugacucucugug

SEQ ID NO: 2565782 - RNA, 18 nt, Human
gucccugacucucuguga

SEQ ID NO: 2565783 - RNA, 13 nt, Human
gucccucugugua

SEQ ID NO: 2565784 - RNA, 12 nt, Human
gucccucugugu

SEQ ID NO: 2565785 - RNA, 11 nt, Human
gucccucugug

SEQ ID NO: 2565786 - RNA, 20 nt, Human
gucccucugccccauccucc

SEQ ID NO: 2565787 - RNA, 21 nt, Human
gucccucugccccauccucca

SEQ ID NO: 2565788 - RNA, 11 nt, Human
gucccucugcc

SEQ ID NO: 2565789 - RNA, 14 nt, Human
gucccucugcccca

SEQ ID NO: 2565790 - RNA, 16 nt, Human
gucccucucaggcaug

SEQ ID NO: 2565791 - RNA, 21 nt, Human
gucccucucggaaggcuggcu

SEQ ID NO: 2565792 - RNA, 13 nt, Human
gucccucucaggc

SEQ ID NO: 2565793 - RNA, 14 nt, Human
gucccucucaggca

SEQ ID NO: 2565794 - RNA, 20 nt, Human
gucccuaauaaagcugugug

SEQ ID NO: 2565795 - RNA, 18 nt, Human
gucccuaauaaagcugug

SEQ ID NO: 2565796 - RNA, 23 nt, Human
gucccuaccgagucucuucucca

SEQ ID NO: 2565797 - RNA, 22 nt, Human
gucccuaccgagucucuucucc

SEQ ID NO: 2565798 - RNA, 21 nt, Human
gucccuaccgagucucuucuc

SEQ ID NO: 2565799 - RNA, 16 nt, Human
gucccuacaccccucc

SEQ ID NO: 2565800 - RNA, 21 nt, Human
gucccuacaccccuccccugc

SEQ ID NO: 2565801 - RNA, 16 nt, Human
gucccucccaccucug

SEQ ID NO: 2565802 - RNA, 15 nt, Human
gucccucccaccucu

SEQ ID NO: 2565803 - RNA, 14 nt, Human
gucccucccaccuc

SEQ ID NO: 2565804 - RNA, 13 nt, Human
gucccucccaccu

SEQ ID NO: 2565805 - RNA, 18 nt, Human
gucccucccaccucugug

SEQ ID NO: 2565806 - RNA, 17 nt, Human
gucccucccaccucugu

SEQ ID NO: 2565807 - RNA, 16 nt, Human
gucccucccccuuguc

SEQ ID NO: 2565808 - RNA, 21 nt, Human
gucccuccugggaucugcucg

SEQ ID NO: 2565809 - RNA, 14 nt, Human
gucccuccugggau

SEQ ID NO: 2565810 - RNA, 13 nt, Human
gucccuccuggga

SEQ ID NO: 2565811 - RNA, 12 nt, Human
gucccuccuggg

SEQ ID NO: 2565812 - RNA, 21 nt, Human
gucccucccaccucugugacc

SEQ ID NO: 2565813 - RNA, 23 nt, Human
gucccuccgggaccuggugcugc

SEQ ID NO: 2565814 - RNA, 20 nt, Human
gucccucaaaugacccaaag

SEQ ID NO: 2565815 - RNA, 22 nt, Human
gucccuauguauuugcaguuca

SEQ ID NO: 2565816 - RNA, 15 nt, Human
gucccuaugcauauc

SEQ ID NO: 2565817 - RNA, 12 nt, Human
gucccucccacc

SEQ ID NO: 2565818 - RNA, 23 nt, Human
gucccucaaaugacccaaagacc

SEQ ID NO: 2565819 - RNA, 21 nt, Human
gucccuccacguucaccccuc

SEQ ID NO: 2565820 - RNA, 20 nt, Human
gucccuccacguucaccccu

SEQ ID NO: 2565821 - RNA, 19 nt, Human
gucccuccacguucacccc

SEQ ID NO: 2565822 - RNA, 15 nt, Human
gucagcucccuucuc

SEQ ID NO: 2565823 - RNA, 16 nt, Human
gucagcuugcugcccu

SEQ ID NO: 2565824 - RNA, 20 nt, Human
gucagcuugcugcccuaggc

SEQ ID NO: 2565825 - RNA, 16 nt, Human
gucagcuuugccuucc

SEQ ID NO: 2565826 - RNA, 17 nt, Human
gucagcuuugccuucca

SEQ ID NO: 2565827 - RNA, 23 nt, Human
gucagcuuugccuuccacgcugu

SEQ ID NO: 2565828 - RNA, 15 nt, Human
gucauguuuaagaaa

SEQ ID NO: 2565829 - RNA, 11 nt, Human
gucauuaaaug

SEQ ID NO: 2565830 - RNA, 12 nt, Human
gucauuaaaggu

SEQ ID NO: 2565831 - RNA, 14 nt, Human
gucauuaaaauaaa

SEQ ID NO: 2565832 - RNA, 18 nt, Human
gucagcuuugccuuccac

SEQ ID NO: 2565833 - RNA, 22 nt, Human
gucauuaaaauaaauaaaugca

SEQ ID NO: 2565834 - RNA, 21 nt, Human
gucagcuccccucggagaaga

SEQ ID NO: 2565835 - RNA, 22 nt, Human
gucagcuccccucggagaagag

SEQ ID NO: 2565836 - RNA, 23 nt, Human
gucagcuccccucggagaagagc

SEQ ID NO: 2565837 - RNA, 16 nt, Human
gucagcucccuucucu

SEQ ID NO: 2565838 - RNA, 17 nt, Human
gucagcuacuaaugaug

SEQ ID NO: 2565839 - RNA, 16 nt, Human
gucauucguucugugg

SEQ ID NO: 2565840 - RNA, 14 nt, Human
gucauucagaaaaa

SEQ ID NO: 2565841 - RNA, 15 nt, Human
gucauucaauaaauu

SEQ ID NO: 2565842 - RNA, 21 nt, Human
gucauuagccugaguagaaag

SEQ ID NO: 2565843 - RNA, 19 nt, Human
gucauuagccugaguagaa

SEQ ID NO: 2565844 - RNA, 16 nt, Human
gucauuagacuccucc

SEQ ID NO: 2565845 - RNA, 13 nt, Human
gucauuagccuga

SEQ ID NO: 2565846 - RNA, 19 nt, Human
gucauuauccuugcuauga

SEQ ID NO: 2565847 - RNA, 22 nt, Human
gucauuauagaucccccagacu

SEQ ID NO: 2565848 - RNA, 21 nt, Human
gucauuaugagaggcaaugau

SEQ ID NO: 2565849 - RNA, 17 nt, Human
gucauuggcuuuauccu

SEQ ID NO: 2565850 - RNA, 14 nt, Human
gucauuggcuuuau

SEQ ID NO: 2565851 - RNA, 18 nt, Human
gucauugcuguugucccu

SEQ ID NO: 2565852 - RNA, 22 nt, Human
gucauugcuguugucccucugc

SEQ ID NO: 2565853 - RNA, 21 nt, Human
guccaggggccccuccagcuu

SEQ ID NO: 2565854 - RNA, 20 nt, Human
guccaggggccccuccagcu

SEQ ID NO: 2565855 - RNA, 23 nt, Human
guccaggggccccuccagcuugu

SEQ ID NO: 2565856 - RNA, 21 nt, Human
gucccaccuuggcugcaggga

SEQ ID NO: 2565857 - RNA, 17 nt, Human
guccagcccuggcugaa

SEQ ID NO: 2565858 - RNA, 16 nt, Human
guccagcccuggcuga

SEQ ID NO: 2565859 - RNA, 14 nt, Human
guccagcccuggcu

SEQ ID NO: 2565860 - RNA, 21 nt, Human
guccagauuuacacugggaga

SEQ ID NO: 2565861 - RNA, 22 nt, Human
guccagauuuacacugggagag

SEQ ID NO: 2565862 - RNA, 23 nt, Human
guccagcccuggcugaaggacug

SEQ ID NO: 2565863 - RNA, 20 nt, Human
guccagcccuggcugaagga

SEQ ID NO: 2565864 - RNA, 19 nt, Human
guccagcccuggcugaagg

SEQ ID NO: 2565865 - RNA, 18 nt, Human
guccagcccuggcugaag

SEQ ID NO: 2565866 - RNA, 20 nt, Human
guccagccgccauugccacc

SEQ ID NO: 2565867 - RNA, 22 nt, Human
guccagccgccauugccaccag

SEQ ID NO: 2565868 - RNA, 20 nt, Human
guccagggcccugagcucgg

SEQ ID NO: 2565869 - RNA, 11 nt, Human
guccagccugg

SEQ ID NO: 2565870 - RNA, 13 nt, Human
guccagccugggc

SEQ ID NO: 2565871 - RNA, 19 nt, Human
guccaggggccccuccagc

SEQ ID NO: 2565872 - RNA, 18 nt, Human
guccaggggccccuccag

SEQ ID NO: 2565873 - RNA, 14 nt, Human
guccaggggccccu

SEQ ID NO: 2565874 - RNA, 11 nt, Human
guccaggggau

SEQ ID NO: 2565875 - RNA, 18 nt, Human
guccagggcuagugacuu

SEQ ID NO: 2565876 - RNA, 19 nt, Human
guccagauuuacacuggga

SEQ ID NO: 2565877 - RNA, 17 nt, Human
guccagauuuacacugg

SEQ ID NO: 2565878 - RNA, 15 nt, Human
guccagauuuacacu

SEQ ID NO: 2565879 - RNA, 23 nt, Human
guccagagagagaagugccccug

SEQ ID NO: 2565880 - RNA, 16 nt, Human
guccagacagccugua

SEQ ID NO: 2565881 - RNA, 12 nt, Human
guccacugucac

SEQ ID NO: 2565882 - RNA, 20 nt, Human
guccagagagagaagugccc

SEQ ID NO: 2565883 - RNA, 21 nt, Human
guccagaccuuguucacacuc

SEQ ID NO: 2565884 - RNA, 22 nt, Human
guccagagagagaagugccccu

SEQ ID NO: 2565885 - RNA, 15 nt, Human
guccacgacugucuc

SEQ ID NO: 2565886 - RNA, 16 nt, Human
guccacgacugucucc

SEQ ID NO: 2565887 - RNA, 18 nt, Human
guccacgacugucuccau

SEQ ID NO: 2565888 - RNA, 15 nt, Human
guccacucccagugc

SEQ ID NO: 2565889 - RNA, 12 nt, Human
guccacucccag

SEQ ID NO: 2565890 - RNA, 16 nt, Human
guccacucccagugcu

SEQ ID NO: 2565891 - RNA, 15 nt, Human
guccacggcucuagg

SEQ ID NO: 2565892 - RNA, 22 nt, Human
guccaccugagcugccauccag

SEQ ID NO: 2565893 - RNA, 11 nt, Human
guccacccagc

SEQ ID NO: 2565894 - RNA, 20 nt, Human
guccacccaccuaugugcca

SEQ ID NO: 2565895 - RNA, 14 nt, Human
guccacccagcaaa

SEQ ID NO: 2565896 - RNA, 21 nt, Human
guccaccuggccccaugucuc

SEQ ID NO: 2565897 - RNA, 23 nt, Human
guccacccaggagccccgaggcc

SEQ ID NO: 2565898 - RNA, 12 nt, Human
guccacccagga

SEQ ID NO: 2565899 - RNA, 13 nt, Human
guccacaggaagu

SEQ ID NO: 2565900 - RNA, 21 nt, Human
guccaccaugggguccuacca

SEQ ID NO: 2565901 - RNA, 22 nt, Human
gucagaugcugugcaaauguua

SEQ ID NO: 2565902 - RNA, 18 nt, Human
gucagaugggaagacaug

SEQ ID NO: 2565903 - RNA, 14 nt, Human
gucagauuuccagu

SEQ ID NO: 2565904 - RNA, 19 nt, Human
gucagcuccccucggagaa

SEQ ID NO: 2565905 - RNA, 16 nt, Human
gucagcaaaaagcaaa

SEQ ID NO: 2565906 - RNA, 15 nt, Human
gucagcaaaaagcaa

SEQ ID NO: 2565907 - RNA, 21 nt, Human
gucagauuuccagucuccacc

SEQ ID NO: 2565908 - RNA, 22 nt, Human
gucagcaaaaagcaaaaucauu

SEQ ID NO: 2565909 - RNA, 20 nt, Human
gucagcaaaaagcaaaauca

SEQ ID NO: 2565910 - RNA, 19 nt, Human
gucagcuacuaaugauguu

SEQ ID NO: 2565911 - RNA, 21 nt, Human
gucagaggcuaauucugcaga

SEQ ID NO: 2565912 - RNA, 21 nt, Human
gucagaggauggccagugucu

SEQ ID NO: 2565913 - RNA, 20 nt, Human
gucagaggauggccaguguc

SEQ ID NO: 2565914 - RNA, 15 nt, Human
gucagauacaaugua

SEQ ID NO: 2565915 - RNA, 14 nt, Human
gucagagccugcag

SEQ ID NO: 2565916 - RNA, 22 nt, Human
gucagacuggcuggcugcagug

SEQ ID NO: 2565917 - RNA, 16 nt, Human
gucagacuuuaaagaa

SEQ ID NO: 2565918 - RNA, 16 nt, Human
gucagagacugcugug

SEQ ID NO: 2565919 - RNA, 15 nt, Human
gucagacuuuaaaga

SEQ ID NO: 2565920 - RNA, 12 nt, Human
gucagagagaau

SEQ ID NO: 2565921 - RNA, 17 nt, Human
gucagagaggagucaga

SEQ ID NO: 2565922 - RNA, 14 nt, Human
gucagacugcuggg

SEQ ID NO: 2565923 - RNA, 15 nt, Human
gucagacugcuggga

SEQ ID NO: 2565924 - RNA, 16 nt, Human
gucagacugcugggac

SEQ ID NO: 2565925 - RNA, 20 nt, Human
gucagacugcugggacuggc

SEQ ID NO: 2565926 - RNA, 22 nt, Human
gucagacugcugggacuggcca

SEQ ID NO: 2565927 - RNA, 24 nt, Human
gucagacugcugggacuggccagg

SEQ ID NO: 2565928 - RNA, 14 nt, Human
gucagacuggcugg

SEQ ID NO: 2565929 - RNA, 18 nt, Human
gucagacuggcuggcugc

SEQ ID NO: 2565930 - RNA, 16 nt, Human
gucagagccugcaguu

SEQ ID NO: 2565931 - RNA, 15 nt, Human
gucagagccugcagu

SEQ ID NO: 2565932 - RNA, 19 nt, Human
gucagagaggagucagaga

SEQ ID NO: 2565933 - RNA, 21 nt, Human
gucagagaggagucagagaga

SEQ ID NO: 2565934 - RNA, 14 nt, Human
gucagagcugggag

SEQ ID NO: 2565935 - RNA, 19 nt, Human
gucagaggauggccagugu

SEQ ID NO: 2565936 - RNA, 16 nt, Human
gucagaggauggccag

SEQ ID NO: 2565937 - RNA, 15 nt, Human
gucagaggauggcca

SEQ ID NO: 2565938 - RNA, 14 nt, Human
gucagaggauggcc

SEQ ID NO: 2565939 - RNA, 12 nt, Human
gucagagcuggg

SEQ ID NO: 2565940 - RNA, 13 nt, Human
gucagaggauggc

SEQ ID NO: 2565941 - RNA, 13 nt, Human
gucagagcuggga

SEQ ID NO: 2565942 - RNA, 16 nt, Human
gucacucuggcagcuc

SEQ ID NO: 2565943 - RNA, 14 nt, Human
gucacucuggcagc

SEQ ID NO: 2565944 - RNA, 13 nt, Human
gucacucuggcag

SEQ ID NO: 2565945 - RNA, 12 nt, Human
gucacucuggca

SEQ ID NO: 2565946 - RNA, 19 nt, Human
gucacucuggcagcucaga

SEQ ID NO: 2565947 - RNA, 17 nt, Human
gucacucuggcagcuca

SEQ ID NO: 2565948 - RNA, 16 nt, Human
gucagacgccugagga

SEQ ID NO: 2565949 - RNA, 17 nt, Human
gucagacgccugaggaa

SEQ ID NO: 2565950 - RNA, 18 nt, Human
gucagacgccugaggaac

SEQ ID NO: 2565951 - RNA, 22 nt, Human
gucacucuggcagcucagagag

SEQ ID NO: 2565952 - RNA, 18 nt, Human
gucacucccaagcccccu

SEQ ID NO: 2565953 - RNA, 12 nt, Human
gucacuccuggg

SEQ ID NO: 2565954 - RNA, 13 nt, Human
gucacuccugggg

SEQ ID NO: 2565955 - RNA, 21 nt, Human
gucacuccuggggccucuugg

SEQ ID NO: 2565956 - RNA, 18 nt, Human
gucaccccggccaccugc

SEQ ID NO: 2565957 - RNA, 17 nt, Human
gucaccccggccaccug

SEQ ID NO: 2565958 - RNA, 22 nt, Human
gucaccccggccaccugcggug

SEQ ID NO: 2565959 - RNA, 20 nt, Human
gucaccccuccaggaaugau

SEQ ID NO: 2565960 - RNA, 15 nt, Human
gucaccccuccagga

SEQ ID NO: 2565961 - RNA, 18 nt, Human
gucacucauugcugagcc

SEQ ID NO: 2565962 - RNA, 19 nt, Human
gucacucauugcugagccu

SEQ ID NO: 2565963 - RNA, 20 nt, Human
gucacucauugcugagccuc

SEQ ID NO: 2565964 - RNA, 21 nt, Human
gucacucauugcugagccucu

SEQ ID NO: 2565965 - RNA, 22 nt, Human
gucacucauugcugagccucug

SEQ ID NO: 2565966 - RNA, 23 nt, Human
gucacucauugcugagccucugc

SEQ ID NO: 2565967 - RNA, 14 nt, Human
gucacucccaagcc

SEQ ID NO: 2565968 - RNA, 11 nt, Human
gucacucccaa

SEQ ID NO: 2565969 - RNA, 24 nt, Human
gucacucauugcugagccucugcu

SEQ ID NO: 2565970 - RNA, 14 nt, Human
gucacucauugcug

SEQ ID NO: 2565971 - RNA, 23 nt, Human
gucacucagauggaaccgcagga

SEQ ID NO: 2565972 - RNA, 23 nt, Human
gucacuacgugacuguggcacac

SEQ ID NO: 2565973 - RNA, 14 nt, Human
gucacuacucacag

SEQ ID NO: 2565974 - RNA, 17 nt, Human
gucacuacucacagucu

SEQ ID NO: 2565975 - RNA, 22 nt, Human
gucacuacucacagucucuuua

SEQ ID NO: 2565976 - RNA, 15 nt, Human
gucaaugcagccccc

SEQ ID NO: 2565977 - RNA, 19 nt, Human
gucaauccugugggugaag

SEQ ID NO: 2565978 - RNA, 17 nt, Human
gucaauccccucauuca

SEQ ID NO: 2565979 - RNA, 22 nt, Human
gucaauccccucauucaggaaa

SEQ ID NO: 2565980 - RNA, 15 nt, Human
gucaauccugugggu

SEQ ID NO: 2565981 - RNA, 16 nt, Human
gucaauccugugggug

SEQ ID NO: 2565982 - RNA, 12 nt, Human
gucaauauuuaa

SEQ ID NO: 2565983 - RNA, 23 nt, Human
gucaauauuaaauacagacacua

SEQ ID NO: 2565984 - RNA, 22 nt, Human
gucaauccaagagucugaugau

SEQ ID NO: 2565985 - RNA, 13 nt, Human
gucaauauuuaaa

SEQ ID NO: 2565986 - RNA, 16 nt, Human
gucaauccccucauuc

SEQ ID NO: 2565987 - RNA, 22 nt, Human
gucaauauuaaauacagacacu

SEQ ID NO: 2565988 - RNA, 20 nt, Human
gucaauauuaaauacagaca

SEQ ID NO: 2565989 - RNA, 18 nt, Human
gucaauauuaaauacaga

SEQ ID NO: 2565990 - RNA, 17 nt, Human
gucaauauuaaauacag

SEQ ID NO: 2565991 - RNA, 16 nt, Human
gucaauauuaaauaca

SEQ ID NO: 2565992 - RNA, 15 nt, Human
gucaauauuaaauac

SEQ ID NO: 2565993 - RNA, 14 nt, Human
gucaauauuaaaua

SEQ ID NO: 2565994 - RNA, 21 nt, Human
gucaauacaguacaggcagca

SEQ ID NO: 2565995 - RNA, 14 nt, Human
gucaccagcuccuc

SEQ ID NO: 2565996 - RNA, 23 nt, Human
gucaccaggaauguuaaagucag

SEQ ID NO: 2565997 - RNA, 16 nt, Human
gucaccagcuccuccc

SEQ ID NO: 2565998 - RNA, 18 nt, Human
gucaccaggaauguuaaa

SEQ ID NO: 2565999 - RNA, 22 nt, Human
gucaccaccuucccagcucucc

SEQ ID NO: 2566000 - RNA, 19 nt, Human
gucaccaccuucccagcuc

SEQ ID NO: 2566001 - RNA, 20 nt, Human
gucaccaccuucccagcucu

SEQ ID NO: 2566002 - RNA, 13 nt, Human
gucaccaccucuc

SEQ ID NO: 2566003 - RNA, 11 nt, Human
gucaccaccuu

SEQ ID NO: 2566004 - RNA, 14 nt, Human
gucaccaccuuccc

SEQ ID NO: 2566005 - RNA, 15 nt, Human
gucaccaccuuccca

SEQ ID NO: 2566006 - RNA, 16 nt, Human
gucaccaccuucccag

SEQ ID NO: 2566007 - RNA, 17 nt, Human
gucaccaccuucccagc

SEQ ID NO: 2566008 - RNA, 23 nt, Human
gucaauaaaauccauacauuugu

SEQ ID NO: 2566009 - RNA, 19 nt, Human
gucaauacaguacaggcag

SEQ ID NO: 2566010 - RNA, 20 nt, Human
gucaauacaguacaggcagc

SEQ ID NO: 2566011 - RNA, 21 nt, Human
gucaagucucugcuggcccag

SEQ ID NO: 2566012 - RNA, 22 nt, Human
gucaauaaaauccauacauuug

SEQ ID NO: 2566013 - RNA, 15 nt, Human
gucaagugaaaaagg

SEQ ID NO: 2566014 - RNA, 19 nt, Human
guauuuuguuuuugucuua

SEQ ID NO: 2566015 - RNA, 14 nt, Human
gucaaguaagaaga

SEQ ID NO: 2566016 - RNA, 15 nt, Human
gucaaguaagaagac

SEQ ID NO: 2566017 - RNA, 13 nt, Human
gucaagucaacca

SEQ ID NO: 2566018 - RNA, 14 nt, Human
gucaagucucugcu

SEQ ID NO: 2566019 - RNA, 17 nt, Human
gucaagucucugcuggc

SEQ ID NO: 2566020 - RNA, 20 nt, Human
guauuuuaaaagaaugauua

SEQ ID NO: 2566021 - RNA, 13 nt, Human
guauuuuaaucac

SEQ ID NO: 2566022 - RNA, 13 nt, Human
guauuacacugua

SEQ ID NO: 2566023 - RNA, 18 nt, Human
guauuuuaaaagaaugau

SEQ ID NO: 2566024 - RNA, 14 nt, Human
guauuaauauucau

SEQ ID NO: 2566025 - RNA, 16 nt, Human
guauuaagaaugaaau

SEQ ID NO: 2566026 - RNA, 22 nt, Human
guauuaaguuguuaauaaaagu

SEQ ID NO: 2566027 - RNA, 23 nt, Human
guauuuuaucuuugauucuccuu

SEQ ID NO: 2566028 - RNA, 13 nt, Human
guauuuuauugua

SEQ ID NO: 2566029 - RNA, 22 nt, Human
guauuuuaucuuugauucuccu

SEQ ID NO: 2566030 - RNA, 14 nt, Human
guauuuuacuaaua

SEQ ID NO: 2566031 - RNA, 19 nt, Human
guauuuuaggcagggauuu

SEQ ID NO: 2566032 - RNA, 21 nt, Human
guauuuuaguaagagauuccu

SEQ ID NO: 2566033 - RNA, 14 nt, Human
guauuuuggagaaa

SEQ ID NO: 2566034 - RNA, 18 nt, Human
guauuuucuuucucuacu

SEQ ID NO: 2566035 - RNA, 18 nt, Human
guauuuuguauuguuuca

SEQ ID NO: 2566036 - RNA, 17 nt, Human
guauuuuggagaaauua

SEQ ID NO: 2566037 - RNA, 15 nt, Human
guauuuucuuucucu

SEQ ID NO: 2566038 - RNA, 13 nt, Human
guauuuucuuucu

SEQ ID NO: 2566039 - RNA, 20 nt, Human
guauuuuccaagugugcaua

SEQ ID NO: 2566040 - RNA, 17 nt, Human
guauuuuccaagugugc

SEQ ID NO: 2566041 - RNA, 16 nt, Human
guauuuuccaagugug

SEQ ID NO: 2566042 - RNA, 17 nt, Human
guauuuuauuguaacag

SEQ ID NO: 2566043 - RNA, 16 nt, Human
guauuuuccuguaaaa

SEQ ID NO: 2566044 - RNA, 11 nt, Human
guauuuuccug

SEQ ID NO: 2566045 - RNA, 22 nt, Human
guauuuucccccuuuucugcau

SEQ ID NO: 2566046 - RNA, 18 nt, Human
gucgucaaagcugaaaug

SEQ ID NO: 2566047 - RNA, 15 nt, Human
gucgucgcacagucu

SEQ ID NO: 2566048 - RNA, 20 nt, Human
gucguagccaaggugggcug

SEQ ID NO: 2566049 - RNA, 16 nt, Human
gucgggggcuggccua

SEQ ID NO: 2566050 - RNA, 17 nt, Human
gucggggggacagcucc

SEQ ID NO: 2566051 - RNA, 17 nt, Human
gucgugccuguguccau

SEQ ID NO: 2566052 - RNA, 15 nt, Human
gucgugccugugucc

SEQ ID NO: 2566053 - RNA, 14 nt, Human
gucgugccuguguc

SEQ ID NO: 2566054 - RNA, 13 nt, Human
gucgugccugugu

SEQ ID NO: 2566055 - RNA, 21 nt, Human
gucgugccuccuuccaccucc

SEQ ID NO: 2566056 - RNA, 19 nt, Human
gucgucgcacagucucucu

SEQ ID NO: 2566057 - RNA, 12 nt, Human
gucgugccugug

SEQ ID NO: 2566058 - RNA, 17 nt, Human
gucgucgcacagucucu

SEQ ID NO: 2566059 - RNA, 17 nt, Human
gucgugagcucuuguga

SEQ ID NO: 2566060 - RNA, 17 nt, Human
gucguggagaugucuuc

SEQ ID NO: 2566061 - RNA, 18 nt, Human
gucgugccuguguccaug

SEQ ID NO: 2566062 - RNA, 23 nt, Human
gucguggcagauaaucagccucu

SEQ ID NO: 2566063 - RNA, 15 nt, Human
gucguggcagauaau

SEQ ID NO: 2566064 - RNA, 22 nt, Human
gucguggcagauaaucagccuc

SEQ ID NO: 2566065 - RNA, 21 nt, Human
gucuaagauaguaacaaugaa

SEQ ID NO: 2566066 - RNA, 16 nt, Human
gucuaaauaaguuugc

SEQ ID NO: 2566067 - RNA, 17 nt, Human
gucuaaaguuuacagua

SEQ ID NO: 2566068 - RNA, 16 nt, Human
gucuaaaguuuacagu

SEQ ID NO: 2566069 - RNA, 15 nt, Human
gucuaaaguuuacag

SEQ ID NO: 2566070 - RNA, 11 nt, Human
gucuaaaguuu

SEQ ID NO: 2566071 - RNA, 13 nt, Human
gucuaaauuugaa

SEQ ID NO: 2566072 - RNA, 13 nt, Human
gucuaaauauuuc

SEQ ID NO: 2566073 - RNA, 16 nt, Human
gucuaaauauuuccuu

SEQ ID NO: 2566074 - RNA, 15 nt, Human
gucuaaaugcugaaa

SEQ ID NO: 2566075 - RNA, 23 nt, Human
gucuaaauauuuccuuaaacugu

SEQ ID NO: 2566076 - RNA, 19 nt, Human
gucucacuauguugcccag

SEQ ID NO: 2566077 - RNA, 11 nt, Human
gucucacucug

SEQ ID NO: 2566078 - RNA, 18 nt, Human
gucucacuauguugccca

SEQ ID NO: 2566079 - RNA, 19 nt, Human
guccuuaccagcagagcac

SEQ ID NO: 2566080 - RNA, 18 nt, Human
guccuuaccagcagagca

SEQ ID NO: 2566081 - RNA, 12 nt, Human
gucccugccuca

SEQ ID NO: 2566082 - RNA, 15 nt, Human
guccuuagaacauuu

SEQ ID NO: 2566083 - RNA, 21 nt, Human
guccuuaccagcagagcaccu

SEQ ID NO: 2566084 - RNA, 14 nt, Human
gucccugccaaugg

SEQ ID NO: 2566085 - RNA, 11 nt, Human
gucccugccaa

SEQ ID NO: 2566086 - RNA, 15 nt, Human
gucccugccaaugga

SEQ ID NO: 2566087 - RNA, 18 nt, Human
gucccugccccagcaaga

SEQ ID NO: 2566088 - RNA, 21 nt, Human
gucggaaaacaugcuacacac

SEQ ID NO: 2566089 - RNA, 17 nt, Human
guccuuagaacauuuua

SEQ ID NO: 2566090 - RNA, 23 nt, Human
gucggccucuaaccccaggcccc

SEQ ID NO: 2566091 - RNA, 22 nt, Human
gucggccucuaaccccaggccc

SEQ ID NO: 2566092 - RNA, 21 nt, Human
gucggccucuaaccccaggcc

SEQ ID NO: 2566093 - RNA, 20 nt, Human
gucggccucuaaccccaggc

SEQ ID NO: 2566094 - RNA, 16 nt, Human
gucggaggcuugggac

SEQ ID NO: 2566095 - RNA, 17 nt, Human
gucggaggcuugggacc

SEQ ID NO: 2566096 - RNA, 14 nt, Human
gucggaggcuuggg

SEQ ID NO: 2566097 - RNA, 16 nt, Human
gucgggcaugacacga

SEQ ID NO: 2566098 - RNA, 18 nt, Human
gucggcugaccaugcuca

SEQ ID NO: 2566099 - RNA, 17 nt, Human
gucggcugaccaugcuc

SEQ ID NO: 2566100 - RNA, 14 nt, Human
gucggcugaccaug

SEQ ID NO: 2566101 - RNA, 23 nt, Human
gucggguuuuauuguuuaaaauc

SEQ ID NO: 2566102 - RNA, 18 nt, Human
gucgggaguucgagacca

SEQ ID NO: 2566103 - RNA, 15 nt, Human
gucgggggcuggccu

SEQ ID NO: 2566104 - RNA, 14 nt, Human
gucucuucugagcu

SEQ ID NO: 2566105 - RNA, 22 nt, Human
gucucuucugagcuauuucauc

SEQ ID NO: 2566106 - RNA, 13 nt, Human
gucugacuguuuc

SEQ ID NO: 2566107 - RNA, 13 nt, Human
gucucuugaggga

SEQ ID NO: 2566108 - RNA, 23 nt, Human
gucucuugagggagcuuagccaa

SEQ ID NO: 2566109 - RNA, 16 nt, Human
gucucugguuccuccc

SEQ ID NO: 2566110 - RNA, 17 nt, Human
gucucugguuccucccc

SEQ ID NO: 2566111 - RNA, 18 nt, Human
gucucuucuccacuggau

SEQ ID NO: 2566112 - RNA, 21 nt, Human
gucucuggauuauauuaugaa

SEQ ID NO: 2566113 - RNA, 13 nt, Human
gucucuggccugu

SEQ ID NO: 2566114 - RNA, 12 nt, Human
gucucuggccug

SEQ ID NO: 2566115 - RNA, 21 nt, Human
gucucuggcaguucuggaaug

SEQ ID NO: 2566116 - RNA, 16 nt, Human
gucucuggcaguucug

SEQ ID NO: 2566117 - RNA, 20 nt, Human
gucucugcuggcccagccaa

SEQ ID NO: 2566118 - RNA, 21 nt, Human
gucucucuggggccacacaga

SEQ ID NO: 2566119 - RNA, 19 nt, Human
gucucucucucucuacaaa

SEQ ID NO: 2566120 - RNA, 21 nt, Human
gucucugagggcuuccuuugg

SEQ ID NO: 2566121 - RNA, 14 nt, Human
gucucugagggcuu

SEQ ID NO: 2566122 - RNA, 21 nt, Human
gucucugaagugaaacugcuu

SEQ ID NO: 2566123 - RNA, 13 nt, Human
gucucugagcauu

SEQ ID NO: 2566124 - RNA, 15 nt, Human
gucucugaagugaaa

SEQ ID NO: 2566125 - RNA, 17 nt, Human
gucucuggaauuugaaa

SEQ ID NO: 2566126 - RNA, 13 nt, Human
gucucugcuggcc

SEQ ID NO: 2566127 - RNA, 15 nt, Human
gucucugcuggccca

SEQ ID NO: 2566128 - RNA, 16 nt, Human
gucucugcuggcccag

SEQ ID NO: 2566129 - RNA, 17 nt, Human
gucucugcuggcccagc

SEQ ID NO: 2566130 - RNA, 18 nt, Human
gucucugccucccucacc

SEQ ID NO: 2566131 - RNA, 17 nt, Human
gucucugccggcucuuu

SEQ ID NO: 2566132 - RNA, 14 nt, Human
gucucugcugccgc

SEQ ID NO: 2566133 - RNA, 13 nt, Human
gucucugcugccg

SEQ ID NO: 2566134 - RNA, 12 nt, Human
gucucugcugcc

SEQ ID NO: 2566135 - RNA, 12 nt, Human
gucucugccucc

SEQ ID NO: 2566136 - RNA, 18 nt, Human
gucucugccggcucuuuc

SEQ ID NO: 2566137 - RNA, 12 nt, Human
gucucugcugaa

SEQ ID NO: 2566138 - RNA, 21 nt, Human
gucucacugaaacauuuaaau

SEQ ID NO: 2566139 - RNA, 15 nt, Human
gucucacugaaacau

SEQ ID NO: 2566140 - RNA, 23 nt, Human
gucucacgggcaugggcacuccc

SEQ ID NO: 2566141 - RNA, 22 nt, Human
gucucacucugucgcccagucu

SEQ ID NO: 2566142 - RNA, 19 nt, Human
gucucacucugucgcccag

SEQ ID NO: 2566143 - RNA, 18 nt, Human
gucucacucugucgccca

SEQ ID NO: 2566144 - RNA, 16 nt, Human
gucucacucugucgcc

SEQ ID NO: 2566145 - RNA, 15 nt, Human
gucucacucugucgc

SEQ ID NO: 2566146 - RNA, 17 nt, Human
gucucucucccauggag

SEQ ID NO: 2566147 - RNA, 16 nt, Human
gucucucucccaugga

SEQ ID NO: 2566148 - RNA, 13 nt, Human
gucucucucccau

SEQ ID NO: 2566149 - RNA, 17 nt, Human
gucucuaggcuggggaa

SEQ ID NO: 2566150 - RNA, 14 nt, Human
gucucucucucucu

SEQ ID NO: 2566151 - RNA, 23 nt, Human
gucucucucccauggagccccag

SEQ ID NO: 2566152 - RNA, 15 nt, Human
gucucucucucucua

SEQ ID NO: 2566153 - RNA, 12 nt, Human
gucucucuccca

SEQ ID NO: 2566154 - RNA, 15 nt, Human
gucucuaggcugggg

SEQ ID NO: 2566155 - RNA, 14 nt, Human
gucucuaggcuggg

SEQ ID NO: 2566156 - RNA, 13 nt, Human
gucucuaggcugg

SEQ ID NO: 2566157 - RNA, 16 nt, Human
gucucuagccacuuug

SEQ ID NO: 2566158 - RNA, 14 nt, Human
gucucuagccacuu

SEQ ID NO: 2566159 - RNA, 18 nt, Human
gucucuagagcagggauu

SEQ ID NO: 2566160 - RNA, 14 nt, Human
gucucuagugcugu

SEQ ID NO: 2566161 - RNA, 16 nt, Human
gucucuagugcuguga

SEQ ID NO: 2566162 - RNA, 17 nt, Human
gucucuagugcugugaa

SEQ ID NO: 2566163 - RNA, 18 nt, Human
gucucuagugcugugaaa

SEQ ID NO: 2566164 - RNA, 21 nt, Human
gucucagcagcgaccaccccu

SEQ ID NO: 2566165 - RNA, 23 nt, Human
gucucacugugggaaggccagcu

SEQ ID NO: 2566166 - RNA, 22 nt, Human
gucucacugugggaaggccagc

SEQ ID NO: 2566167 - RNA, 13 nt, Human
gucucagccuccc

SEQ ID NO: 2566168 - RNA, 22 nt, Human
gucucagcagcgaccaccccug

SEQ ID NO: 2566169 - RNA, 15 nt, Human
gucucaggaccuagg

SEQ ID NO: 2566170 - RNA, 13 nt, Human
gucucgugguagg

SEQ ID NO: 2566171 - RNA, 12 nt, Human
gucucaggagca

SEQ ID NO: 2566172 - RNA, 16 nt, Human
gucucaggagcauggg

SEQ ID NO: 2566173 - RNA, 12 nt, Human
gucucuagagca

SEQ ID NO: 2566174 - RNA, 19 nt, Human
gucucgugguaggacugua

SEQ ID NO: 2566175 - RNA, 15 nt, Human
gucugugagaugcua

SEQ ID NO: 2566176 - RNA, 16 nt, Human
gucugugagaugcuag

SEQ ID NO: 2566177 - RNA, 17 nt, Human
gucugugagaugcuaga

SEQ ID NO: 2566178 - RNA, 21 nt, Human
gucugugagaugcuagaacuc

SEQ ID NO: 2566179 - RNA, 22 nt, Human
gucugugagaugcuagaacucc

SEQ ID NO: 2566180 - RNA, 23 nt, Human
gucugugagaugcuagaacuccc

SEQ ID NO: 2566181 - RNA, 18 nt, Human
gucugugccauuuuguau

SEQ ID NO: 2566182 - RNA, 21 nt, Human
gucugugaauuggaccauccu

SEQ ID NO: 2566183 - RNA, 12 nt, Human
gucugugcuagg

SEQ ID NO: 2566184 - RNA, 17 nt, Human
gucugcccuucacccca

SEQ ID NO: 2566185 - RNA, 11 nt, Human
gucugccucuu

SEQ ID NO: 2566186 - RNA, 10 nt, Human
gucugcccuu

SEQ ID NO: 2566187 - RNA, 17 nt, Human
gucugcuauauuuucau

SEQ ID NO: 2566188 - RNA, 15 nt, Human
gucugcuauauuuuc

SEQ ID NO: 2566189 - RNA, 18 nt, Human
gucugcuauauuuucaug

SEQ ID NO: 2566190 - RNA, 16 nt, Human
gucugucuucacagcu

SEQ ID NO: 2566191 - RNA, 22 nt, Human
gucugucuucacagcucugugu

SEQ ID NO: 2566192 - RNA, 23 nt, Human
gucugagacucucuuaggagcag

SEQ ID NO: 2566193 - RNA, 16 nt, Human
gucugccagccagcag

SEQ ID NO: 2566194 - RNA, 17 nt, Human
gucugccagccagcagc

SEQ ID NO: 2566195 - RNA, 18 nt, Human
gucugccagccagcagcc

SEQ ID NO: 2566196 - RNA, 13 nt, Human
gucugccagggcc

SEQ ID NO: 2566197 - RNA, 12 nt, Human
gucugccagggc

SEQ ID NO: 2566198 - RNA, 11 nt, Human
gucugccaggg

SEQ ID NO: 2566199 - RNA, 11 nt, Human
gucugugugug

SEQ ID NO: 2566200 - RNA, 12 nt, Human
gucugugugugu

SEQ ID NO: 2566201 - RNA, 16 nt, Human
gucuguguguguguau

SEQ ID NO: 2566202 - RNA, 20 nt, Human
gucuguguguguguaugugg

SEQ ID NO: 2566203 - RNA, 14 nt, Human
gucugugcugaggc

SEQ ID NO: 2566204 - RNA, 13 nt, Human
gucugugcugagg

SEQ ID NO: 2566205 - RNA, 12 nt, Human
gucugugcugag

SEQ ID NO: 2566206 - RNA, 13 nt, Human
gucuguggaucag

SEQ ID NO: 2566207 - RNA, 20 nt, Human
gucuguggcuuucagccucu

SEQ ID NO: 2566208 - RNA, 21 nt, Human
gucuguggcuuucagccucug

SEQ ID NO: 2566209 - RNA, 20 nt, Human
gucugugugaugaacuuucu

SEQ ID NO: 2566210 - RNA, 17 nt, Human
gucugugugcaagugug

SEQ ID NO: 2566211 - RNA, 11 nt, Human
gucuguguguu

SEQ ID NO: 2566212 - RNA, 21 nt, Human
gucuguguguuuaugugugug

SEQ ID NO: 2566213 - RNA, 22 nt, Human
gucuguguguuuaugugugugu

SEQ ID NO: 2566214 - RNA, 20 nt, Human
gucuguguuccaaccacuga

SEQ ID NO: 2566215 - RNA, 12 nt, Human
gucuguuagcca

SEQ ID NO: 2566216 - RNA, 20 nt, Human
gucuguuaccaugucacugu

SEQ ID NO: 2566217 - RNA, 16 nt, Human
gucuguuaugcuguga

SEQ ID NO: 2566218 - RNA, 21 nt, Human
gucuguuccccauggccacuu

SEQ ID NO: 2566219 - RNA, 17 nt, Human
gucuguucacuuuuccu

SEQ ID NO: 2566220 - RNA, 14 nt, Human
gucuguguuuuaau

SEQ ID NO: 2566221 - RNA, 22 nt, Human
gucuguguugcgugucgugggu

SEQ ID NO: 2566222 - RNA, 15 nt, Human
gucuguuaccauguc

SEQ ID NO: 2566223 - RNA, 14 nt, Human
gucuguuacacugg

SEQ ID NO: 2566224 - RNA, 16 nt, Human
gucuguuaacuuaaua

SEQ ID NO: 2566225 - RNA, 14 nt, Human
gucuguucuuucca

SEQ ID NO: 2566226 - RNA, 17 nt, Human
gucuguucuuuccaaag

SEQ ID NO: 2566227 - RNA, 19 nt, Human
gucuguuggcaggcuggcc

SEQ ID NO: 2566228 - RNA, 18 nt, Human
gucuguuggcaggcuggc

SEQ ID NO: 2566229 - RNA, 16 nt, Human
gucuguuggcaggcug

SEQ ID NO: 2566230 - RNA, 14 nt, Human
gucuguuggcaggc

SEQ ID NO: 2566231 - RNA, 15 nt, Human
gucuguucuugaagc

SEQ ID NO: 2566232 - RNA, 13 nt, Human
gucuguucuugaa

SEQ ID NO: 2566233 - RNA, 17 nt, Human
gucuguuuauaaacauu

SEQ ID NO: 2566234 - RNA, 21 nt, Human
gucuguuggcaggcuggccag

SEQ ID NO: 2566235 - RNA, 20 nt, Human
gucuguuggcaggcuggcca

SEQ ID NO: 2566236 - RNA, 22 nt, Human
gucuguuggcaggcuggccagu

SEQ ID NO: 2566237 - RNA, 13 nt, Human
gucuguuuuauga

SEQ ID NO: 2566238 - RNA, 15 nt, Human
gucuguuuuaugacu

SEQ ID NO: 2566239 - RNA, 12 nt, Human
gucuguuuuccu

SEQ ID NO: 2566240 - RNA, 21 nt, Human
gucuguuuuccuuucucaccg

SEQ ID NO: 2566241 - RNA, 20 nt, Human
gucuguuuuccuuucucacc

SEQ ID NO: 2566242 - RNA, 16 nt, Human
gucuguuuuccuuucu

SEQ ID NO: 2566243 - RNA, 14 nt, Human
gucuguuuuccuuu

SEQ ID NO: 2566244 - RNA, 20 nt, Human
gucuuggcuuucauguuauu

SEQ ID NO: 2566245 - RNA, 16 nt, Human
gucuuggcuuucaugu

SEQ ID NO: 2566246 - RNA, 23 nt, Human
gucuuggcggcagcagccaucau

SEQ ID NO: 2566247 - RNA, 18 nt, Human
gucuuggcggcagcagcc

SEQ ID NO: 2566248 - RNA, 16 nt, Human
gucuuggcggcagcag

SEQ ID NO: 2566249 - RNA, 15 nt, Human
gucuuggcggcagca

SEQ ID NO: 2566250 - RNA, 22 nt, Human
gucuuggcagcaccugucuccu

SEQ ID NO: 2566251 - RNA, 23 nt, Human
gucuuggagcugagccucucacc

SEQ ID NO: 2566252 - RNA, 18 nt, Human
gucuuggagcugagccuc

SEQ ID NO: 2566253 - RNA, 20 nt, Human
gucuuggcagcaccugucuc

SEQ ID NO: 2566254 - RNA, 17 nt, Human
gucuuggagcugagccu

SEQ ID NO: 2566255 - RNA, 18 nt, Human
gucuuggacacuguacaa

SEQ ID NO: 2566256 - RNA, 20 nt, Human
gucuugggcagagcuggcuc

SEQ ID NO: 2566257 - RNA, 19 nt, Human
gucuugggcagagcuggcu

SEQ ID NO: 2566258 - RNA, 21 nt, Human
gucuugggaaauaugaaugcc

SEQ ID NO: 2566259 - RNA, 16 nt, Human
gucuugggaaauauga

SEQ ID NO: 2566260 - RNA, 16 nt, Human
gucuugggcagagcug

SEQ ID NO: 2566261 - RNA, 22 nt, Human
gucuugggcagagcuggcucug

SEQ ID NO: 2566262 - RNA, 21 nt, Human
gucuugggcagagcuggcucu

SEQ ID NO: 2566263 - RNA, 16 nt, Human
gucuugguuccagccu

SEQ ID NO: 2566264 - RNA, 16 nt, Human
gucuuuuuucacuaca

SEQ ID NO: 2566265 - RNA, 17 nt, Human
gucuugguuccagccug

SEQ ID NO: 2566266 - RNA, 19 nt, Human
gucuugguuccagccugcc

SEQ ID NO: 2566267 - RNA, 15 nt, Human
gucuugguauucuua

SEQ ID NO: 2566268 - RNA, 21 nt, Human
gucuugcaauggcagccuugg

SEQ ID NO: 2566269 - RNA, 20 nt, Human
gucuugcaauggcagccuug

SEQ ID NO: 2566270 - RNA, 23 nt, Human
gucuugcaauggcagccuuggca

SEQ ID NO: 2566271 - RNA, 18 nt, Human
gucuugaugaccaaaguc

SEQ ID NO: 2566272 - RNA, 15 nt, Human
gucuuggacacugua

SEQ ID NO: 2566273 - RNA, 14 nt, Human
gucuuggacacugu

SEQ ID NO: 2566274 - RNA, 18 nt, Human
gucuugcuaccucaguca

SEQ ID NO: 2566275 - RNA, 22 nt, Human
gucuugcuauggggagaaaaga

SEQ ID NO: 2566276 - RNA, 19 nt, Human
gucuugcaauggcagccuu

SEQ ID NO: 2566277 - RNA, 18 nt, Human
gucuugcaauggcagccu

SEQ ID NO: 2566278 - RNA, 17 nt, Human
gucuugcaauggcagcc

SEQ ID NO: 2566279 - RNA, 16 nt, Human
gucuugcaauggcagc

SEQ ID NO: 2566280 - RNA, 20 nt, Human
gucuugaacuccuggccuca

SEQ ID NO: 2566281 - RNA, 18 nt, Human
gucuugaacuccuggccu

SEQ ID NO: 2566282 - RNA, 21 nt, Human
gucuugaacuccuggccucaa

SEQ ID NO: 2566283 - RNA, 19 nt, Human
gucuugaaugucuuuugaa

SEQ ID NO: 2566284 - RNA, 17 nt, Human
gucuugaaugucuuuug

SEQ ID NO: 2566285 - RNA, 15 nt, Human
gucuugaaugucuuu

SEQ ID NO: 2566286 - RNA, 12 nt, Human
gucuugaaagau

SEQ ID NO: 2566287 - RNA, 20 nt, Human
gucuucuuugcccacaaugc

SEQ ID NO: 2566288 - RNA, 17 nt, Human
gucuucugccuguuaua

SEQ ID NO: 2566289 - RNA, 15 nt, Human
gucuucugccuguua

SEQ ID NO: 2566290 - RNA, 14 nt, Human
gucuucugccuguu

SEQ ID NO: 2566291 - RNA, 13 nt, Human
gucuucugccugu

SEQ ID NO: 2566292 - RNA, 16 nt, Human
gucuucuuacaugcau

SEQ ID NO: 2566293 - RNA, 14 nt, Human
gucuucuucagggu

SEQ ID NO: 2566294 - RNA, 17 nt, Human
gucuucuuugcccacaa

SEQ ID NO: 2566295 - RNA, 17 nt, Human
gucuugaacuccuggcc

SEQ ID NO: 2566296 - RNA, 16 nt, Human
gucuugaacuccuggc

SEQ ID NO: 2566297 - RNA, 13 nt, Human
gucuucuccccag

SEQ ID NO: 2566298 - RNA, 12 nt, Human
gucuucucccca

SEQ ID NO: 2566299 - RNA, 17 nt, Human
gucuucuccaccacgcu

SEQ ID NO: 2566300 - RNA, 20 nt, Human
gucuucuccaccacgcuggg

SEQ ID NO: 2566301 - RNA, 18 nt, Human
gucuucucaggcucugcc

SEQ ID NO: 2566302 - RNA, 19 nt, Human
gucuucucaggcucugccc

SEQ ID NO: 2566303 - RNA, 22 nt, Human
gucuucucaggcucugcccugc

SEQ ID NO: 2566304 - RNA, 16 nt, Human
gucuucucauagcauu

SEQ ID NO: 2566305 - RNA, 17 nt, Human
gucuucucauagcauua

SEQ ID NO: 2566306 - RNA, 19 nt, Human
gucuucucauagcauuaac

SEQ ID NO: 2566307 - RNA, 20 nt, Human
gucuucucauagcauuaacu

SEQ ID NO: 2566308 - RNA, 23 nt, Human
gucuucucauagcauuaacuaau

SEQ ID NO: 2566309 - RNA, 21 nt, Human
gucuuaaaaaguggaaaaaua

SEQ ID NO: 2566310 - RNA, 15 nt, Human
gucuucucaggcucu

SEQ ID NO: 2566311 - RNA, 15 nt, Human
gugcagaaaacauug

SEQ ID NO: 2566312 - RNA, 14 nt, Human
gugcagaaaacauu

SEQ ID NO: 2566313 - RNA, 23 nt, Human
gugcacugucacuuugcucuggg

SEQ ID NO: 2566314 - RNA, 15 nt, Human
gugcacugucacuuu

SEQ ID NO: 2566315 - RNA, 13 nt, Human
gugcacugucacu

SEQ ID NO: 2566316 - RNA, 17 nt, Human
gugcagaaaacauuguu

SEQ ID NO: 2566317 - RNA, 16 nt, Human
gugcagaaaacauugu

SEQ ID NO: 2566318 - RNA, 14 nt, Human
gugcagacuggagg

SEQ ID NO: 2566319 - RNA, 23 nt, Human
gugcagaggaaguggaaggcauc

SEQ ID NO: 2566320 - RNA, 23 nt, Human
gugcagacuggaggggacgcugg

SEQ ID NO: 2566321 - RNA, 15 nt, Human
gugcagacuggaggg

SEQ ID NO: 2566322 - RNA, 21 nt, Human
gugcacugcccauggacaggc

SEQ ID NO: 2566323 - RNA, 19 nt, Human
gugcacugcccauggacag

SEQ ID NO: 2566324 - RNA, 20 nt, Human
gugcacugcccauggacagg

SEQ ID NO: 2566325 - RNA, 15 nt, Human
gugcacugcccaugg

SEQ ID NO: 2566326 - RNA, 14 nt, Human
gugauuuuuuuguc

SEQ ID NO: 2566327 - RNA, 14 nt, Human
gugauuuuuuucuu

SEQ ID NO: 2566328 - RNA, 19 nt, Human
gugauuuuaacucugucuu

SEQ ID NO: 2566329 - RNA, 21 nt, Human
gugcaaaaagcugaguauggu

SEQ ID NO: 2566330 - RNA, 20 nt, Human
gugcaaaacagcguuuaaga

SEQ ID NO: 2566331 - RNA, 13 nt, Human
gugauuuuuguaa

SEQ ID NO: 2566332 - RNA, 18 nt, Human
gugauuuuuguaauuuuu

SEQ ID NO: 2566333 - RNA, 22 nt, Human
gugauuugacuguuuuuaccca

SEQ ID NO: 2566334 - RNA, 21 nt, Human
gugauuugacuguuuuuaccc

SEQ ID NO: 2566335 - RNA, 19 nt, Human
gugauuugacuguuuuuac

SEQ ID NO: 2566336 - RNA, 14 nt, Human
gugauuugacuguu

SEQ ID NO: 2566337 - RNA, 22 nt, Human
gugauuucccguggccccagcc

SEQ ID NO: 2566338 - RNA, 13 nt, Human
gugauuugacugu

SEQ ID NO: 2566339 - RNA, 14 nt, Human
gugauuuuaacucu

SEQ ID NO: 2566340 - RNA, 16 nt, Human
gugauuuuaacucugu

SEQ ID NO: 2566341 - RNA, 17 nt, Human
gugauuuuaacucuguc

SEQ ID NO: 2566342 - RNA, 18 nt, Human
gugauuuuaacucugucu

SEQ ID NO: 2566343 - RNA, 23 nt, Human
gugauuucccguggccccagccu

SEQ ID NO: 2566344 - RNA, 21 nt, Human
gugauuucccguggccccagc

SEQ ID NO: 2566345 - RNA, 20 nt, Human
gugauuucccguggccccag

SEQ ID NO: 2566346 - RNA, 18 nt, Human
gugauuucccguggcccc

SEQ ID NO: 2566347 - RNA, 19 nt, Human
gugauuucagagagggcag

SEQ ID NO: 2566348 - RNA, 23 nt, Human
gugauuuagaacuguaugucaga

SEQ ID NO: 2566349 - RNA, 21 nt, Human
gugauuuagaacuguauguca

SEQ ID NO: 2566350 - RNA, 18 nt, Human
gugauuuagaacuguaug

SEQ ID NO: 2566351 - RNA, 18 nt, Human
gugauuuacgcucauugu

SEQ ID NO: 2566352 - RNA, 24 nt, Human
gugauccacccaccucagccuccc

SEQ ID NO: 2566353 - RNA, 23 nt, Human
gugauccacccaccucagccucc

SEQ ID NO: 2566354 - RNA, 21 nt, Human
gugccaggacuccccaggcca

SEQ ID NO: 2566355 - RNA, 18 nt, Human
gugccaggacuccccagg

SEQ ID NO: 2566356 - RNA, 17 nt, Human
gugccaggacuccccag

SEQ ID NO: 2566357 - RNA, 18 nt, Human
gugccagccuuccucugc

SEQ ID NO: 2566358 - RNA, 13 nt, Human
gugccaggaccag

SEQ ID NO: 2566359 - RNA, 16 nt, Human
gugccaggaccaguca

SEQ ID NO: 2566360 - RNA, 19 nt, Human
gugccagccuuccucugca

SEQ ID NO: 2566361 - RNA, 13 nt, Human
gugccagccuucc

SEQ ID NO: 2566362 - RNA, 22 nt, Human
gugccagccgugaugcucaggc

SEQ ID NO: 2566363 - RNA, 20 nt, Human
gugcauccgggggcagcucu

SEQ ID NO: 2566364 - RNA, 18 nt, Human
gugcauccgggggcagcu

SEQ ID NO: 2566365 - RNA, 18 nt, Human
gugcauauuguacacuuu

SEQ ID NO: 2566366 - RNA, 15 nt, Human
gugcauauuguacac

SEQ ID NO: 2566367 - RNA, 14 nt, Human
gugcauauuguaca

SEQ ID NO: 2566368 - RNA, 13 nt, Human
gugcauauuguac

SEQ ID NO: 2566369 - RNA, 20 nt, Human
gugcauauuguacacuuuuu

SEQ ID NO: 2566370 - RNA, 12 nt, Human
gugcauccaaag

SEQ ID NO: 2566371 - RNA, 13 nt, Human
gugcaucucagcc

SEQ ID NO: 2566372 - RNA, 21 nt, Human
gugccagcaacugaauaaaua

SEQ ID NO: 2566373 - RNA, 21 nt, Human
gugcauauuccuuucuaucau

SEQ ID NO: 2566374 - RNA, 16 nt, Human
gugcauauuccuuucu

SEQ ID NO: 2566375 - RNA, 19 nt, Human
gugcaguugacagcaggug

SEQ ID NO: 2566376 - RNA, 20 nt, Human
gugcaguugacagcaggugg

SEQ ID NO: 2566377 - RNA, 22 nt, Human
gugcauaccacuuuuguucuug

SEQ ID NO: 2566378 - RNA, 15 nt, Human
gugcaguugacagca

SEQ ID NO: 2566379 - RNA, 20 nt, Human
gugcaguucuaguuugcauu

SEQ ID NO: 2566380 - RNA, 19 nt, Human
gugcaguucuaguuugcau

SEQ ID NO: 2566381 - RNA, 24 nt, Human
gugcaguucccccaaccucagacu

SEQ ID NO: 2566382 - RNA, 18 nt, Human
gugcaggccugcucaggg

SEQ ID NO: 2566383 - RNA, 22 nt, Human
gugcaguucccccaaccucaga

SEQ ID NO: 2566384 - RNA, 15 nt, Human
gugcaggcuggcacc

SEQ ID NO: 2566385 - RNA, 17 nt, Human
gugcagcuucuguccug

SEQ ID NO: 2566386 - RNA, 12 nt, Human
gugcagcugauu

SEQ ID NO: 2566387 - RNA, 13 nt, Human
gugcagcugauuu

SEQ ID NO: 2566388 - RNA, 14 nt, Human
gugcagcugauuuu

SEQ ID NO: 2566389 - RNA, 16 nt, Human
gugcagcugauuuuaa

SEQ ID NO: 2566390 - RNA, 16 nt, Human
gugcagcuucuguccu

SEQ ID NO: 2566391 - RNA, 15 nt, Human
gugcagcuucugucc

SEQ ID NO: 2566392 - RNA, 18 nt, Human
gugcagcugauuuuaaca

SEQ ID NO: 2566393 - RNA, 23 nt, Human
gugcagcugauuuuaacaauaac

SEQ ID NO: 2566394 - RNA, 23 nt, Human
gugcaguggugcgaucuggguuc

SEQ ID NO: 2566395 - RNA, 20 nt, Human
gugcaguggugcgaucuggg

SEQ ID NO: 2566396 - RNA, 21 nt, Human
gugcagccuguccugggcugg

SEQ ID NO: 2566397 - RNA, 15 nt, Human
gugcagccuguccug

SEQ ID NO: 2566398 - RNA, 18 nt, Human
gugcagccgcugagcgag

SEQ ID NO: 2566399 - RNA, 22 nt, Human
gugcagcucaaggaaaggccug

SEQ ID NO: 2566400 - RNA, 23 nt, Human
gugcagcucaaggaaaggccuga

SEQ ID NO: 2566401 - RNA, 17 nt, Human
gugcagccgcugagcga

SEQ ID NO: 2566402 - RNA, 20 nt, Human
gugcagcccguguggccccu

SEQ ID NO: 2566403 - RNA, 21 nt, Human
gugcagcccguguggccccuu

SEQ ID NO: 2566404 - RNA, 19 nt, Human
gugcagcccccacugccuu

SEQ ID NO: 2566405 - RNA, 22 nt, Human
gugcagccccgccuccaggcca

SEQ ID NO: 2566406 - RNA, 19 nt, Human
gugcagcccguguggcccc

SEQ ID NO: 2566407 - RNA, 17 nt, Human
gugcagaugagguugcu

SEQ ID NO: 2566408 - RNA, 16 nt, Human
gugcagagugcccaga

SEQ ID NO: 2566409 - RNA, 18 nt, Human
gugcagagugcccagaac

SEQ ID NO: 2566410 - RNA, 15 nt, Human
gugcagcauaugagg

SEQ ID NO: 2566411 - RNA, 17 nt, Human
gugcagcauaugaggau

SEQ ID NO: 2566412 - RNA, 22 nt, Human
gugcuaaaaaugggacuucuuu

SEQ ID NO: 2566413 - RNA, 21 nt, Human
gugcuaaaaaugggacuucuu

SEQ ID NO: 2566414 - RNA, 18 nt, Human
gugcuaaaaaugggacuu

SEQ ID NO: 2566415 - RNA, 14 nt, Human
gugcuaaaaauggg

SEQ ID NO: 2566416 - RNA, 22 nt, Human
gugcuaaauggucgcccaggag

SEQ ID NO: 2566417 - RNA, 13 nt, Human
gugcuaaauuuuc

SEQ ID NO: 2566418 - RNA, 23 nt, Human
gugcuaaccacgucugucuucac

SEQ ID NO: 2566419 - RNA, 17 nt, Human
gugcguguguagaguua

SEQ ID NO: 2566420 - RNA, 15 nt, Human
gugcguguguagagu

SEQ ID NO: 2566421 - RNA, 13 nt, Human
gugcguguguaga

SEQ ID NO: 2566422 - RNA, 13 nt, Human
gugcuaaaaaugg

SEQ ID NO: 2566423 - RNA, 14 nt, Human
gugcguguuugcac

SEQ ID NO: 2566424 - RNA, 13 nt, Human
gugcgugugucca

SEQ ID NO: 2566425 - RNA, 13 nt, Human
gugcgugugugca

SEQ ID NO: 2566426 - RNA, 14 nt, Human
gugcgugggugaag

SEQ ID NO: 2566427 - RNA, 12 nt, Human
gugcguggguga

SEQ ID NO: 2566428 - RNA, 12 nt, Human
gugcgugcucag

SEQ ID NO: 2566429 - RNA, 21 nt, Human
gugcgugaaacacaccaggcu

SEQ ID NO: 2566430 - RNA, 16 nt, Human
gugcuaagugugaacu

SEQ ID NO: 2566431 - RNA, 14 nt, Human
gugcuaagugugaa

SEQ ID NO: 2566432 - RNA, 13 nt, Human
gugcuaaguguga

SEQ ID NO: 2566433 - RNA, 18 nt, Human
gugcuaagugugaacugg

SEQ ID NO: 2566434 - RNA, 17 nt, Human
gugcuaagugugaacug

SEQ ID NO: 2566435 - RNA, 17 nt, Human
gugcuaauaacagugca

SEQ ID NO: 2566436 - RNA, 20 nt, Human
gugcuaagugugaacuggac

SEQ ID NO: 2566437 - RNA, 16 nt, Human
gugcuaaauuuucagu

SEQ ID NO: 2566438 - RNA, 14 nt, Human
gugcgccuacagga

SEQ ID NO: 2566439 - RNA, 15 nt, Human
gugcgauucuggaua

SEQ ID NO: 2566440 - RNA, 14 nt, Human
gugcgagugugugc

SEQ ID NO: 2566441 - RNA, 23 nt, Human
gugcgagugugugcaugugugug

SEQ ID NO: 2566442 - RNA, 22 nt, Human
gugcgccgagucugucucuguc

SEQ ID NO: 2566443 - RNA, 22 nt, Human
gugcgcugacaaccaccgcucc

SEQ ID NO: 2566444 - RNA, 15 nt, Human
gugcguccacgagcu

SEQ ID NO: 2566445 - RNA, 15 nt, Human
gugcgguggcucacg

SEQ ID NO: 2566446 - RNA, 14 nt, Human
gugcggcugugcag

SEQ ID NO: 2566447 - RNA, 14 nt, Human
gugcgugaaacaca

SEQ ID NO: 2566448 - RNA, 15 nt, Human
gugcgugaaacacac

SEQ ID NO: 2566449 - RNA, 19 nt, Human
gugcggcagggacacccga

SEQ ID NO: 2566450 - RNA, 14 nt, Human
gugcggccuuuggc

SEQ ID NO: 2566451 - RNA, 20 nt, Human
gugccccugcugccucccca

SEQ ID NO: 2566452 - RNA, 15 nt, Human
gugccuucagcucua

SEQ ID NO: 2566453 - RNA, 20 nt, Human
gugcccuccacagccgcagc

SEQ ID NO: 2566454 - RNA, 14 nt, Human
gugcccucgcugcu

SEQ ID NO: 2566455 - RNA, 11 nt, Human
gugccuucauu

SEQ ID NO: 2566456 - RNA, 12 nt, Human
gugccuucauuu

SEQ ID NO: 2566457 - RNA, 14 nt, Human
gugccuucauuugg

SEQ ID NO: 2566458 - RNA, 12 nt, Human
gugccuuccaua

SEQ ID NO: 2566459 - RNA, 12 nt, Human
gugccuuccaac

SEQ ID NO: 2566460 - RNA, 15 nt, Human
gugccuuccauaauu

SEQ ID NO: 2566461 - RNA, 21 nt, Human
gugccuuccaugucggccucu

SEQ ID NO: 2566462 - RNA, 20 nt, Human
gugccuuccaugucggccuc

SEQ ID NO: 2566463 - RNA, 17 nt, Human
gugccuuccauaauuau

SEQ ID NO: 2566464 - RNA, 22 nt, Human
gugccuuccauaauuaugacag

SEQ ID NO: 2566465 - RNA, 20 nt, Human
gugcgaccccaucugcccag

SEQ ID NO: 2566466 - RNA, 18 nt, Human
gugcgaccccaucugccc

SEQ ID NO: 2566467 - RNA, 16 nt, Human
gugcgaccccaucugc

SEQ ID NO: 2566468 - RNA, 22 nt, Human
gugccuuuuuucacggaaguuu

SEQ ID NO: 2566469 - RNA, 18 nt, Human
gugccuuuuuucacggaa

SEQ ID NO: 2566470 - RNA, 21 nt, Human
gugccuuuugcaccccuccca

SEQ ID NO: 2566471 - RNA, 22 nt, Human
gugccuuuugcaccccucccau

SEQ ID NO: 2566472 - RNA, 21 nt, Human
gugcgaucuggguucacugca

SEQ ID NO: 2566473 - RNA, 19 nt, Human
gugccuuuugcaccccucc

SEQ ID NO: 2566474 - RNA, 19 nt, Human
gugccuuggggaauuuccu

SEQ ID NO: 2566475 - RNA, 18 nt, Human
gugccuuuugcaccccuc

SEQ ID NO: 2566476 - RNA, 23 nt, Human
gugccuuggagggucccaagcug

SEQ ID NO: 2566477 - RNA, 14 nt, Human
gugccuuuugccau

SEQ ID NO: 2566478 - RNA, 20 nt, Human
gugccuucgcgguggaaggc

SEQ ID NO: 2566479 - RNA, 22 nt, Human
gugccuuccaugucggccucua

SEQ ID NO: 2566480 - RNA, 23 nt, Human
gugccuuccuguuuuucacauuu

SEQ ID NO: 2566481 - RNA, 19 nt, Human
gugccuucuuauucucacu

SEQ ID NO: 2566482 - RNA, 23 nt, Human
gugccuucuuauucucacuccac

SEQ ID NO: 2566483 - RNA, 16 nt, Human
gugccaugugccaggu

SEQ ID NO: 2566484 - RNA, 14 nt, Human
gugccaugugccag

SEQ ID NO: 2566485 - RNA, 20 nt, Human
gugccagguuuucugggugu

SEQ ID NO: 2566486 - RNA, 16 nt, Human
gugccagguccuugcc

SEQ ID NO: 2566487 - RNA, 16 nt, Human
gugccagggcagcacu

SEQ ID NO: 2566488 - RNA, 19 nt, Human
gugccaggcccggggcugg

SEQ ID NO: 2566489 - RNA, 20 nt, Human
gugccaggcccggggcuggc

SEQ ID NO: 2566490 - RNA, 21 nt, Human
gugccaggauggaaugauggg

SEQ ID NO: 2566491 - RNA, 23 nt, Human
gugccaggacuccccaggccagg

SEQ ID NO: 2566492 - RNA, 12 nt, Human
gugccaggcccg

SEQ ID NO: 2566493 - RNA, 13 nt, Human
gugccaggcccgg

SEQ ID NO: 2566494 - RNA, 17 nt, Human
gugccaggcccggggcu

SEQ ID NO: 2566495 - RNA, 20 nt, Human
gugcccaagaauagaugcug

SEQ ID NO: 2566496 - RNA, 13 nt, Human
gugccccccuugc

SEQ ID NO: 2566497 - RNA, 20 nt, Human
gugccccccuugccagacau

SEQ ID NO: 2566498 - RNA, 22 nt, Human
gugccccccauccuggcccauc

SEQ ID NO: 2566499 - RNA, 13 nt, Human
gugccccuagcuu

SEQ ID NO: 2566500 - RNA, 17 nt, Human
gugccccgccuccccga

SEQ ID NO: 2566501 - RNA, 16 nt, Human
gugccccgccuccccg

SEQ ID NO: 2566502 - RNA, 13 nt, Human
gugccccugcugc

SEQ ID NO: 2566503 - RNA, 19 nt, Human
gugccccugcugccucccc

SEQ ID NO: 2566504 - RNA, 17 nt, Human
gugcccccucuaccauu

SEQ ID NO: 2566505 - RNA, 14 nt, Human
gugcccccucuacc

SEQ ID NO: 2566506 - RNA, 20 nt, Human
gugcccccuccucucccauc

SEQ ID NO: 2566507 - RNA, 18 nt, Human
gugcccccuccucuccca

SEQ ID NO: 2566508 - RNA, 17 nt, Human
gugcccccuccucuccc

SEQ ID NO: 2566509 - RNA, 14 nt, Human
gugcccccuccucu

SEQ ID NO: 2566510 - RNA, 13 nt, Human
gugcccccuccuc

SEQ ID NO: 2566511 - RNA, 17 nt, Human
gugacuaauuguauaac

SEQ ID NO: 2566512 - RNA, 15 nt, Human
gugacuaauuguaua

SEQ ID NO: 2566513 - RNA, 21 nt, Human
gugacuaauuguauaacaggu

SEQ ID NO: 2566514 - RNA, 20 nt, Human
gugacuaauuguauaacagg

SEQ ID NO: 2566515 - RNA, 19 nt, Human
gugacuaauuguauaacag

SEQ ID NO: 2566516 - RNA, 18 nt, Human
gugacuaauuguauaaca

SEQ ID NO: 2566517 - RNA, 23 nt, Human
gugacuaauuguauaacagguua

SEQ ID NO: 2566518 - RNA, 22 nt, Human
gugacuaauuguauaacagguu

SEQ ID NO: 2566519 - RNA, 21 nt, Human
gugacuauggagcugagcagg

SEQ ID NO: 2566520 - RNA, 14 nt, Human
gugacuaugaacuu

SEQ ID NO: 2566521 - RNA, 20 nt, Human
gugacuauauagagauguuu

SEQ ID NO: 2566522 - RNA, 17 nt, Human
gugacuauauagagaug

SEQ ID NO: 2566523 - RNA, 15 nt, Human
gugacuauauagaga

SEQ ID NO: 2566524 - RNA, 20 nt, Human
gugagccacugcaccgggcc

SEQ ID NO: 2566525 - RNA, 15 nt, Human
gugagccacugcacc

SEQ ID NO: 2566526 - RNA, 14 nt, Human
gugagccccugguc

SEQ ID NO: 2566527 - RNA, 17 nt, Human
gugagcccauggcccuc

SEQ ID NO: 2566528 - RNA, 18 nt, Human
gugagcccauggcccucc

SEQ ID NO: 2566529 - RNA, 18 nt, Human
gugagcccagcuggguca

SEQ ID NO: 2566530 - RNA, 20 nt, Human
gugagcccagcugggucagg

SEQ ID NO: 2566531 - RNA, 15 nt, Human
gugagcccagcuggg

SEQ ID NO: 2566532 - RNA, 20 nt, Human
gugagccagguaaugaggga

SEQ ID NO: 2566533 - RNA, 15 nt, Human
gugacucacccaagc

SEQ ID NO: 2566534 - RNA, 14 nt, Human
gugagccacugcac

SEQ ID NO: 2566535 - RNA, 19 nt, Human
gugagccgagaucacgcca

SEQ ID NO: 2566536 - RNA, 23 nt, Human
gugagccuggcucuugugcugga

SEQ ID NO: 2566537 - RNA, 16 nt, Human
gugagccuggcucuug

SEQ ID NO: 2566538 - RNA, 14 nt, Human
gugagccuggcucu

SEQ ID NO: 2566539 - RNA, 13 nt, Human
gugagccuggcuc

SEQ ID NO: 2566540 - RNA, 17 nt, Human
gugagccccugguccug

SEQ ID NO: 2566541 - RNA, 12 nt, Human
gugagccgcauc

SEQ ID NO: 2566542 - RNA, 18 nt, Human
gugagccgcaucuucucc

SEQ ID NO: 2566543 - RNA, 21 nt, Human
gugagccgcaucuucuccauc

SEQ ID NO: 2566544 - RNA, 13 nt, Human
gugaggagcuggg

SEQ ID NO: 2566545 - RNA, 18 nt, Human
gugaggagcugcuggcuu

SEQ ID NO: 2566546 - RNA, 14 nt, Human
gugagccuuggcug

SEQ ID NO: 2566547 - RNA, 17 nt, Human
gugaggagcugcuggcu

SEQ ID NO: 2566548 - RNA, 15 nt, Human
gugaggagcugcugg

SEQ ID NO: 2566549 - RNA, 17 nt, Human
gugaggaugaaaaaaua

SEQ ID NO: 2566550 - RNA, 18 nt, Human
gugaggagcuugaaaccc

SEQ ID NO: 2566551 - RNA, 15 nt, Human
gugaguguggcuccc

SEQ ID NO: 2566552 - RNA, 16 nt, Human
gugaguguaaguguga

SEQ ID NO: 2566553 - RNA, 15 nt, Human
gugaggaugucuggg

SEQ ID NO: 2566554 - RNA, 18 nt, Human
gugaggaugucacucaga

SEQ ID NO: 2566555 - RNA, 22 nt, Human
gugaggaugucacucagaugga

SEQ ID NO: 2566556 - RNA, 16 nt, Human
gugagcggagaucgca

SEQ ID NO: 2566557 - RNA, 21 nt, Human
gugaggauggccucugcuaag

SEQ ID NO: 2566558 - RNA, 17 nt, Human
gugaggaugggaaggag

SEQ ID NO: 2566559 - RNA, 19 nt, Human
gugaggaugggaaggaggg

SEQ ID NO: 2566560 - RNA, 15 nt, Human
gugauacaaugcugu

SEQ ID NO: 2566561 - RNA, 18 nt, Human
gugaguuugagcugccuu

SEQ ID NO: 2566562 - RNA, 17 nt, Human
gugauacaaugcugugc

SEQ ID NO: 2566563 - RNA, 13 nt, Human
gugauaaacuuug

SEQ ID NO: 2566564 - RNA, 14 nt, Human
gugauaaacuuugc

SEQ ID NO: 2566565 - RNA, 20 nt, Human
gugauacaacuucaagugca

SEQ ID NO: 2566566 - RNA, 21 nt, Human
gugaguuugagcugccuuccc

SEQ ID NO: 2566567 - RNA, 17 nt, Human
gugaguuugagcugccu

SEQ ID NO: 2566568 - RNA, 15 nt, Human
gugaguuugagcugc

SEQ ID NO: 2566569 - RNA, 20 nt, Human
gugaguuuaguaaggcugug

SEQ ID NO: 2566570 - RNA, 17 nt, Human
gugaguugauagcacag

SEQ ID NO: 2566571 - RNA, 17 nt, Human
gugaguuacagcgagag

SEQ ID NO: 2566572 - RNA, 16 nt, Human
gugaguguggcucccc

SEQ ID NO: 2566573 - RNA, 22 nt, Human
gugaguguguccaagugugugu

SEQ ID NO: 2566574 - RNA, 23 nt, Human
gugaguguguccaagugugugug

SEQ ID NO: 2566575 - RNA, 13 nt, Human
gugagugugugca

SEQ ID NO: 2566576 - RNA, 20 nt, Human
gugaguucucagggcuccug

SEQ ID NO: 2566577 - RNA, 18 nt, Human
gugaguucucagggcucc

SEQ ID NO: 2566578 - RNA, 17 nt, Human
gugaguucucagggcuc

SEQ ID NO: 2566579 - RNA, 15 nt, Human
gugaguucucagggc

SEQ ID NO: 2566580 - RNA, 14 nt, Human
gugaguucucaggg

SEQ ID NO: 2566581 - RNA, 15 nt, Human
gugagugugugcaag

SEQ ID NO: 2566582 - RNA, 23 nt, Human
gugauauauaaguguacauaugu

SEQ ID NO: 2566583 - RNA, 21 nt, Human
gugauauauaaguguacauau

SEQ ID NO: 2566584 - RNA, 13 nt, Human
gugauauauuuaa

SEQ ID NO: 2566585 - RNA, 19 nt, Human
gugauauggcagaagacac

SEQ ID NO: 2566586 - RNA, 16 nt, Human
gugauauggcagaaga

SEQ ID NO: 2566587 - RNA, 13 nt, Human
gugauauggagcc

SEQ ID NO: 2566588 - RNA, 19 nt, Human
gugauauaaguguguguuu

SEQ ID NO: 2566589 - RNA, 22 nt, Human
gugauagucuuuugcuuuuggc

SEQ ID NO: 2566590 - RNA, 18 nt, Human
gugauagcuaacauuuua

SEQ ID NO: 2566591 - RNA, 14 nt, Human
gugauagcacuuuc

SEQ ID NO: 2566592 - RNA, 13 nt, Human
gugauagcacuuu

SEQ ID NO: 2566593 - RNA, 20 nt, Human
gugauacccauagcuuccau

SEQ ID NO: 2566594 - RNA, 20 nt, Human
gugaucagaccauaauguua

SEQ ID NO: 2566595 - RNA, 17 nt, Human
gugaucacagcagcuuc

SEQ ID NO: 2566596 - RNA, 22 nt, Human
gugauccacccaccucagccuc

SEQ ID NO: 2566597 - RNA, 16 nt, Human
gugaucaauaaaaugu

SEQ ID NO: 2566598 - RNA, 17 nt, Human
gugaucaauaaaaugug

SEQ ID NO: 2566599 - RNA, 19 nt, Human
gugaucaauaaaaugugau

SEQ ID NO: 2566600 - RNA, 18 nt, Human
gugaucaauaaaauguga

SEQ ID NO: 2566601 - RNA, 17 nt, Human
gugaucaauuaaaugua

SEQ ID NO: 2566602 - RNA, 13 nt, Human
gugaucaaagcca

SEQ ID NO: 2566603 - RNA, 14 nt, Human
gugacagaggcagc

SEQ ID NO: 2566604 - RNA, 13 nt, Human
gugacagaggcag

SEQ ID NO: 2566605 - RNA, 12 nt, Human
gugacagaggca

SEQ ID NO: 2566606 - RNA, 20 nt, Human
gugacagacuccugaggaca

SEQ ID NO: 2566607 - RNA, 19 nt, Human
gugacagacuccugaggac

SEQ ID NO: 2566608 - RNA, 16 nt, Human
gugacagacuccugag

SEQ ID NO: 2566609 - RNA, 15 nt, Human
gugacagacuccuga

SEQ ID NO: 2566610 - RNA, 17 nt, Human
gugacagacaggcucuu

SEQ ID NO: 2566611 - RNA, 23 nt, Human
gugacagaccacaucuuuaucug

SEQ ID NO: 2566612 - RNA, 22 nt, Human
gugacacuucagagagcuggua

SEQ ID NO: 2566613 - RNA, 19 nt, Human
gugacacagcagcuucacc

SEQ ID NO: 2566614 - RNA, 12 nt, Human
gugacacagcag

SEQ ID NO: 2566615 - RNA, 23 nt, Human
gugacaccagccuuucucccagg

SEQ ID NO: 2566616 - RNA, 16 nt, Human
gugacagacaggcucu

SEQ ID NO: 2566617 - RNA, 15 nt, Human
gugacagacaggcuc

SEQ ID NO: 2566618 - RNA, 22 nt, Human
gugacacagcagcuucaccaga

SEQ ID NO: 2566619 - RNA, 18 nt, Human
gugacacuucagagagcu

SEQ ID NO: 2566620 - RNA, 20 nt, Human
gugacacuucagagagcugg

SEQ ID NO: 2566621 - RNA, 21 nt, Human
gugacacuucagagagcuggu

SEQ ID NO: 2566622 - RNA, 14 nt, Human
gugacaauaaaaca

SEQ ID NO: 2566623 - RNA, 16 nt, Human
gugacaauuuuguaca

SEQ ID NO: 2566624 - RNA, 12 nt, Human
gugacaauaaaa

SEQ ID NO: 2566625 - RNA, 18 nt, Human
gugacaaggccccagaga

SEQ ID NO: 2566626 - RNA, 19 nt, Human
gugacaaggccccagagac

SEQ ID NO: 2566627 - RNA, 23 nt, Human
gugacaagcuccuggucuugaga

SEQ ID NO: 2566628 - RNA, 13 nt, Human
gugacaaggcccc

SEQ ID NO: 2566629 - RNA, 14 nt, Human
gugacaaggcccca

SEQ ID NO: 2566630 - RNA, 17 nt, Human
gugacaaggccccagag

SEQ ID NO: 2566631 - RNA, 14 nt, Human
gugaccucugccug

SEQ ID NO: 2566632 - RNA, 13 nt, Human
gugaccucugccu

SEQ ID NO: 2566633 - RNA, 15 nt, Human
gugacagaggcagcc

SEQ ID NO: 2566634 - RNA, 12 nt, Human
gugaccucugcc

SEQ ID NO: 2566635 - RNA, 21 nt, Human
gugaccuuccaagagccugag

SEQ ID NO: 2566636 - RNA, 22 nt, Human
gugaccuuccaagagccugaga

SEQ ID NO: 2566637 - RNA, 15 nt, Human
gugaccucugccuga

SEQ ID NO: 2566638 - RNA, 15 nt, Human
gugacggucccacac

SEQ ID NO: 2566639 - RNA, 13 nt, Human
gugacggucccac

SEQ ID NO: 2566640 - RNA, 19 nt, Human
gugacgcugaauaaauguc

SEQ ID NO: 2566641 - RNA, 22 nt, Human
gugacggucccacacuggugac

SEQ ID NO: 2566642 - RNA, 19 nt, Human
gugacggucccacacuggu

SEQ ID NO: 2566643 - RNA, 18 nt, Human
gugacgcugaauaaaugu

SEQ ID NO: 2566644 - RNA, 17 nt, Human
gugacgcugaauaaaug

SEQ ID NO: 2566645 - RNA, 15 nt, Human
gugacgcugaauaaa

SEQ ID NO: 2566646 - RNA, 17 nt, Human
gugacgccugcccuccc

SEQ ID NO: 2566647 - RNA, 15 nt, Human
gugaccuucugggaa

SEQ ID NO: 2566648 - RNA, 22 nt, Human
gugacagacuccugaggacagc

SEQ ID NO: 2566649 - RNA, 19 nt, Human
gugaaaacaagugcuggca

SEQ ID NO: 2566650 - RNA, 18 nt, Human
gugaaaaaaaaaaugcug

SEQ ID NO: 2566651 - RNA, 15 nt, Human
gugaaaacaagugcu

SEQ ID NO: 2566652 - RNA, 14 nt, Human
gugaaaaaaaaaau

SEQ ID NO: 2566653 - RNA, 15 nt, Human
gugaaaaaaaaaaug

SEQ ID NO: 2566654 - RNA, 22 nt, Human
gucuuuuuuuuaaugugcugug

SEQ ID NO: 2566655 - RNA, 19 nt, Human
gucuuuuuuuuaaugugcu

SEQ ID NO: 2566656 - RNA, 18 nt, Human
gucuuuuuuuuaaugugc

SEQ ID NO: 2566657 - RNA, 17 nt, Human
gucuuuuuuuuaaugug

SEQ ID NO: 2566658 - RNA, 16 nt, Human
gucuuuuuuuuaaugu

SEQ ID NO: 2566659 - RNA, 21 nt, Human
gucuuuuuuuguauuauaaaa

SEQ ID NO: 2566660 - RNA, 17 nt, Human
gucuuuuuuuguauuau

SEQ ID NO: 2566661 - RNA, 13 nt, Human
gucuuuuuuugua

SEQ ID NO: 2566662 - RNA, 15 nt, Human
gucuuguacaugugu

SEQ ID NO: 2566663 - RNA, 13 nt, Human
gugaacacaucag

SEQ ID NO: 2566664 - RNA, 13 nt, Human
gugaaugaacacu

SEQ ID NO: 2566665 - RNA, 15 nt, Human
gugaaucuaaaagcu

SEQ ID NO: 2566666 - RNA, 19 nt, Human
gugaacaaaagaugcucuu

SEQ ID NO: 2566667 - RNA, 21 nt, Human
gugaacaaauuuacagagaca

SEQ ID NO: 2566668 - RNA, 17 nt, Human
gugaacaaagcagccac

SEQ ID NO: 2566669 - RNA, 18 nt, Human
gugaacaaaagaugcucu

SEQ ID NO: 2566670 - RNA, 18 nt, Human
gugaacaaagcagccacg

SEQ ID NO: 2566671 - RNA, 20 nt, Human
gugaaugcugggacucagcc

SEQ ID NO: 2566672 - RNA, 15 nt, Human
gugaaugcugggacu

SEQ ID NO: 2566673 - RNA, 13 nt, Human
gugaaugcuggga

SEQ ID NO: 2566674 - RNA, 21 nt, Human
gugaaugaugauccuaggcau

SEQ ID NO: 2566675 - RNA, 18 nt, Human
gugaauucuugaaggaaa

SEQ ID NO: 2566676 - RNA, 21 nt, Human
gugaaugcugggacucagccu

SEQ ID NO: 2566677 - RNA, 14 nt, Human
gugaauggauugga

SEQ ID NO: 2566678 - RNA, 20 nt, Human
gugaauggauuggauuauuu

SEQ ID NO: 2566679 - RNA, 15 nt, Human
gugaauggauuggau

SEQ ID NO: 2566680 - RNA, 20 nt, Human
gugacaaggauugcuacugu

SEQ ID NO: 2566681 - RNA, 14 nt, Human
gugaauuugaauga

SEQ ID NO: 2566682 - RNA, 16 nt, Human
gugaauuugaaugaaa

SEQ ID NO: 2566683 - RNA, 18 nt, Human
gugaauuugaaugaaaaa

SEQ ID NO: 2566684 - RNA, 22 nt, Human
gugaauucuugaaggaaaauga

SEQ ID NO: 2566685 - RNA, 22 nt, Human
gugaauugccugcagagagaag

SEQ ID NO: 2566686 - RNA, 20 nt, Human
gugaauugccugcagagaga

SEQ ID NO: 2566687 - RNA, 23 nt, Human
gugaauugccugcagagagaagc

SEQ ID NO: 2566688 - RNA, 19 nt, Human
gugaauugugaccaaguua

SEQ ID NO: 2566689 - RNA, 13 nt, Human
gugaauuugaaug

SEQ ID NO: 2566690 - RNA, 19 nt, Human
gugaauuucuucacuguug

SEQ ID NO: 2566691 - RNA, 15 nt, Human
gugucgggcaugaca

SEQ ID NO: 2566692 - RNA, 21 nt, Human
guguccuguaguugcguggac

SEQ ID NO: 2566693 - RNA, 23 nt, Human
guguccuggugcucucugccacu

SEQ ID NO: 2566694 - RNA, 16 nt, Human
guguccuuagaacauu

SEQ ID NO: 2566695 - RNA, 15 nt, Human
guguccuucccugca

SEQ ID NO: 2566696 - RNA, 12 nt, Human
guguccuucccu

SEQ ID NO: 2566697 - RNA, 17 nt, Human
guguccuugcaccugca

SEQ ID NO: 2566698 - RNA, 18 nt, Human
guguccuugcaccugcau

SEQ ID NO: 2566699 - RNA, 16 nt, Human
guguccuggugcucuc

SEQ ID NO: 2566700 - RNA, 13 nt, Human
guguccuggugcu

SEQ ID NO: 2566701 - RNA, 20 nt, Human
guguccugaccacccucccc

SEQ ID NO: 2566702 - RNA, 18 nt, Human
guguccugaccacccucc

SEQ ID NO: 2566703 - RNA, 17 nt, Human
guguccugaccacccuc

SEQ ID NO: 2566704 - RNA, 16 nt, Human
guguccugaccacccu

SEQ ID NO: 2566705 - RNA, 13 nt, Human
guguccugaccac

SEQ ID NO: 2566706 - RNA, 15 nt, Human
guguccucacggugc

SEQ ID NO: 2566707 - RNA, 20 nt, Human
guguccccuccacugucaca

SEQ ID NO: 2566708 - RNA, 14 nt, Human
guguccuaggagua

SEQ ID NO: 2566709 - RNA, 23 nt, Human
gugucccugcacuugcagacucu

SEQ ID NO: 2566710 - RNA, 14 nt, Human
guguccggucccug

SEQ ID NO: 2566711 - RNA, 17 nt, Human
gugucucccuucauccu

SEQ ID NO: 2566712 - RNA, 17 nt, Human
gugucuccaacccccca

SEQ ID NO: 2566713 - RNA, 13 nt, Human
gugucuccaaccc

SEQ ID NO: 2566714 - RNA, 22 nt, Human
gugucucaguccaccugagcug

SEQ ID NO: 2566715 - RNA, 14 nt, Human
gugucucuuggucc

SEQ ID NO: 2566716 - RNA, 19 nt, Human
gugucuccaaccccccagc

SEQ ID NO: 2566717 - RNA, 18 nt, Human
gugucuccaaccccccag

SEQ ID NO: 2566718 - RNA, 21 nt, Human
gugucuccaaccccccagcac

SEQ ID NO: 2566719 - RNA, 14 nt, Human
gugucuacagagaa

SEQ ID NO: 2566720 - RNA, 19 nt, Human
gugucuaggcaggaccugu

SEQ ID NO: 2566721 - RNA, 13 nt, Human
gugucuaaacugc

SEQ ID NO: 2566722 - RNA, 17 nt, Human
guguccuuucccuccac

SEQ ID NO: 2566723 - RNA, 14 nt, Human
gugucuaaaaacac

SEQ ID NO: 2566724 - RNA, 17 nt, Human
gugucuaaaaacaccaa

SEQ ID NO: 2566725 - RNA, 14 nt, Human
guguccuugugcau

SEQ ID NO: 2566726 - RNA, 19 nt, Human
guguccuugcaccugcauc

SEQ ID NO: 2566727 - RNA, 20 nt, Human
guguccuugugcaugagcua

SEQ ID NO: 2566728 - RNA, 16 nt, Human
guguccuuucccucca

SEQ ID NO: 2566729 - RNA, 15 nt, Human
gugucguagccaagg

SEQ ID NO: 2566730 - RNA, 23 nt, Human
gugucgcucugcuggccuggccg

SEQ ID NO: 2566731 - RNA, 14 nt, Human
gugugagugugugc

SEQ ID NO: 2566732 - RNA, 21 nt, Human
gugucuggauucccaggauga

SEQ ID NO: 2566733 - RNA, 17 nt, Human
gugucuggauucccagg

SEQ ID NO: 2566734 - RNA, 11 nt, Human
gugugagugug

SEQ ID NO: 2566735 - RNA, 20 nt, Human
gugugagucaccaagcccag

SEQ ID NO: 2566736 - RNA, 16 nt, Human
gugugauugacagcuu

SEQ ID NO: 2566737 - RNA, 21 nt, Human
gugugauugacagcuuugcug

SEQ ID NO: 2566738 - RNA, 21 nt, Human
gugugauugggaauaaauaug

SEQ ID NO: 2566739 - RNA, 23 nt, Human
gugugauugacagcuuugcugcu

SEQ ID NO: 2566740 - RNA, 16 nt, Human
gugugauugaaucuga

SEQ ID NO: 2566741 - RNA, 22 nt, Human
gugugaugaacuuucucuucau

SEQ ID NO: 2566742 - RNA, 17 nt, Human
gugugaugaacuuucuc

SEQ ID NO: 2566743 - RNA, 14 nt, Human
gugugaucgucuga

SEQ ID NO: 2566744 - RNA, 17 nt, Human
gugugaucccaagugcc

SEQ ID NO: 2566745 - RNA, 19 nt, Human
gugugaucccaagugccag

SEQ ID NO: 2566746 - RNA, 18 nt, Human
gugugcauauuguacacu

SEQ ID NO: 2566747 - RNA, 16 nt, Human
gugugcauauuguaca

SEQ ID NO: 2566748 - RNA, 15 nt, Human
gugugcauauuguac

SEQ ID NO: 2566749 - RNA, 14 nt, Human
gugugcauauugua

SEQ ID NO: 2566750 - RNA, 13 nt, Human
gugugcagugaag

SEQ ID NO: 2566751 - RNA, 22 nt, Human
gugugcaccuuaccaacuuucu

SEQ ID NO: 2566752 - RNA, 23 nt, Human
gugugcacuaaggggcccggcca

SEQ ID NO: 2566753 - RNA, 22 nt, Human
gugugcauauuguacacuuuuu

SEQ ID NO: 2566754 - RNA, 21 nt, Human
gugugcauauuguacacuuuu

SEQ ID NO: 2566755 - RNA, 12 nt, Human
gugugcaugugu

SEQ ID NO: 2566756 - RNA, 21 nt, Human
gugugccauagaguuuaacac

SEQ ID NO: 2566757 - RNA, 16 nt, Human
gugugcauugcuguga

SEQ ID NO: 2566758 - RNA, 18 nt, Human
gugugcaugugugugcuc

SEQ ID NO: 2566759 - RNA, 20 nt, Human
gugugcaugugugugcucag

SEQ ID NO: 2566760 - RNA, 19 nt, Human
gugugcaaugucugaguga

SEQ ID NO: 2566761 - RNA, 16 nt, Human
gugugcaagugugugc

SEQ ID NO: 2566762 - RNA, 16 nt, Human
gugugcaaguauguga

SEQ ID NO: 2566763 - RNA, 14 nt, Human
gugugauuuuucug

SEQ ID NO: 2566764 - RNA, 16 nt, Human
gugugcaccaggguug

SEQ ID NO: 2566765 - RNA, 17 nt, Human
gugugcacuaaggggcc

SEQ ID NO: 2566766 - RNA, 20 nt, Human
gugugcacaaauauuuauuu

SEQ ID NO: 2566767 - RNA, 22 nt, Human
gugugcacacacaccacacaua

SEQ ID NO: 2566768 - RNA, 21 nt, Human
gugucucuugguccugcugca

SEQ ID NO: 2566769 - RNA, 20 nt, Human
gugucucuugguccugcugc

SEQ ID NO: 2566770 - RNA, 19 nt, Human
gugucucuugguccugcug

SEQ ID NO: 2566771 - RNA, 18 nt, Human
gugucucuugguccugcu

SEQ ID NO: 2566772 - RNA, 14 nt, Human
gugucuggcugcag

SEQ ID NO: 2566773 - RNA, 21 nt, Human
gugucugcacccagggguggg

SEQ ID NO: 2566774 - RNA, 22 nt, Human
gugucucuuuucucuuucuccu

SEQ ID NO: 2566775 - RNA, 15 nt, Human
gugucugcucaguaa

SEQ ID NO: 2566776 - RNA, 22 nt, Human
gugucucuugguccugcugcag

SEQ ID NO: 2566777 - RNA, 21 nt, Human
gugucucggagggauuccccu

SEQ ID NO: 2566778 - RNA, 18 nt, Human
gugucucuuuucucuuuc

SEQ ID NO: 2566779 - RNA, 19 nt, Human
gugucucuuuucucuuucu

SEQ ID NO: 2566780 - RNA, 22 nt, Human
gugucugagcccucaaagugag

SEQ ID NO: 2566781 - RNA, 14 nt, Human
gugucugcacccag

SEQ ID NO: 2566782 - RNA, 12 nt, Human
guguguugugug

SEQ ID NO: 2566783 - RNA, 14 nt, Human
guguguugugugug

SEQ ID NO: 2566784 - RNA, 19 nt, Human
guguguuuaaauaaaguau

SEQ ID NO: 2566785 - RNA, 18 nt, Human
guguguuuaaauaaagua

SEQ ID NO: 2566786 - RNA, 16 nt, Human
guguguuuaaauaaag

SEQ ID NO: 2566787 - RNA, 15 nt, Human
guguguuuaaauaaa

SEQ ID NO: 2566788 - RNA, 17 nt, Human
guguguuguguguggga

SEQ ID NO: 2566789 - RNA, 18 nt, Human
guguguugucuugaaaga

SEQ ID NO: 2566790 - RNA, 16 nt, Human
guguguugucuugaaa

SEQ ID NO: 2566791 - RNA, 13 nt, Human
guguguugucuug

SEQ ID NO: 2566792 - RNA, 16 nt, Human
guguguugucucuuga

SEQ ID NO: 2566793 - RNA, 14 nt, Human
guguguugucucuu

SEQ ID NO: 2566794 - RNA, 15 nt, Human
guguguugccacagg

SEQ ID NO: 2566795 - RNA, 14 nt, Human
guguguuuaugugu

SEQ ID NO: 2566796 - RNA, 15 nt, Human
guguguuuaugugug

SEQ ID NO: 2566797 - RNA, 15 nt, Human
guguguuucugaucu

SEQ ID NO: 2566798 - RNA, 12 nt, Human
guguguuuuaaa

SEQ ID NO: 2566799 - RNA, 16 nt, Human
guguguuuaugugugu

SEQ ID NO: 2566800 - RNA, 14 nt, Human
guguguuucacuuu

SEQ ID NO: 2566801 - RNA, 22 nt, Human
guguguuuaaauaaaguaucau

SEQ ID NO: 2566802 - RNA, 14 nt, Human
guguguuugugauu

SEQ ID NO: 2566803 - RNA, 21 nt, Human
guguggagaagcggcuggcag

SEQ ID NO: 2566804 - RNA, 23 nt, Human
guguggagaagccacaggccuga

SEQ ID NO: 2566805 - RNA, 22 nt, Human
guguggagaagccacaggccug

SEQ ID NO: 2566806 - RNA, 16 nt, Human
guguggacugugaugc

SEQ ID NO: 2566807 - RNA, 20 nt, Human
guguggaaauuaagaagaaa

SEQ ID NO: 2566808 - RNA, 18 nt, Human
guguggacucaaguccuu

SEQ ID NO: 2566809 - RNA, 15 nt, Human
guguggacugugaug

SEQ ID NO: 2566810 - RNA, 13 nt, Human
guguggagaagcg

SEQ ID NO: 2566811 - RNA, 14 nt, Human
guguggcagugguu

SEQ ID NO: 2566812 - RNA, 14 nt, Human
guguggcuccuucc

SEQ ID NO: 2566813 - RNA, 13 nt, Human
guguggcugagga

SEQ ID NO: 2566814 - RNA, 15 nt, Human
guguggcuccccucu

SEQ ID NO: 2566815 - RNA, 12 nt, Human
guguggcagugg

SEQ ID NO: 2566816 - RNA, 15 nt, Human
guguggccccuucac

SEQ ID NO: 2566817 - RNA, 14 nt, Human
guguggcccugcca

SEQ ID NO: 2566818 - RNA, 19 nt, Human
guguggcucacguguguga

SEQ ID NO: 2566819 - RNA, 17 nt, Human
gugugggaguguguaau

SEQ ID NO: 2566820 - RNA, 14 nt, Human
gugugggcuguguc

SEQ ID NO: 2566821 - RNA, 13 nt, Human
gugugggaaggga

SEQ ID NO: 2566822 - RNA, 16 nt, Human
gugugggaagggagag

SEQ ID NO: 2566823 - RNA, 20 nt, Human
guguggcugaggaggccucc

SEQ ID NO: 2566824 - RNA, 15 nt, Human
guguggcugaggagg

SEQ ID NO: 2566825 - RNA, 23 nt, Human
gugugccccccauccuggcccau

SEQ ID NO: 2566826 - RNA, 22 nt, Human
gugugccccccauccuggccca

SEQ ID NO: 2566827 - RNA, 21 nt, Human
gugugccccccauccuggccc

SEQ ID NO: 2566828 - RNA, 20 nt, Human
gugugccccccauccuggcc

SEQ ID NO: 2566829 - RNA, 19 nt, Human
gugugccccccauccuggc

SEQ ID NO: 2566830 - RNA, 18 nt, Human
gugugccccccauccugg

SEQ ID NO: 2566831 - RNA, 17 nt, Human
gugugccccccauccug

SEQ ID NO: 2566832 - RNA, 16 nt, Human
gugugccccccauccu

SEQ ID NO: 2566833 - RNA, 13 nt, Human
gugugccugcagc

SEQ ID NO: 2566834 - RNA, 14 nt, Human
gugugccugcagcc

SEQ ID NO: 2566835 - RNA, 15 nt, Human
gugugccugcagccc

SEQ ID NO: 2566836 - RNA, 16 nt, Human
gugugccugcagcccc

SEQ ID NO: 2566837 - RNA, 17 nt, Human
gugugcucaggagcccu

SEQ ID NO: 2566838 - RNA, 16 nt, Human
gugugcucaggagccc

SEQ ID NO: 2566839 - RNA, 22 nt, Human
gugugccugucuguuacacugg

SEQ ID NO: 2566840 - RNA, 13 nt, Human
gugugccugucug

SEQ ID NO: 2566841 - RNA, 18 nt, Human
gugugccugcagccccgc

SEQ ID NO: 2566842 - RNA, 19 nt, Human
gugugcucaggagcccugg

SEQ ID NO: 2566843 - RNA, 18 nt, Human
gugugcucaggagcccug

SEQ ID NO: 2566844 - RNA, 16 nt, Human
gugugcguguuugcac

SEQ ID NO: 2566845 - RNA, 12 nt, Human
gugugcucugau

SEQ ID NO: 2566846 - RNA, 22 nt, Human
gugugcucugaucauccacugu

SEQ ID NO: 2566847 - RNA, 15 nt, Human
gugugcucugaucau

SEQ ID NO: 2566848 - RNA, 19 nt, Human
gugugcugggagcuccacu

SEQ ID NO: 2566849 - RNA, 12 nt, Human
gugugcugggag

SEQ ID NO: 2566850 - RNA, 18 nt, Human
gugugcuuuaugcugaaa

SEQ ID NO: 2566851 - RNA, 22 nt, Human
gugugcuuuaugcugaaacaga

SEQ ID NO: 2566852 - RNA, 19 nt, Human
guguggaaauuaagaagaa

SEQ ID NO: 2566853 - RNA, 11 nt, Human
gugugcuggga

SEQ ID NO: 2566854 - RNA, 14 nt, Human
gugugcuggaggac

SEQ ID NO: 2566855 - RNA, 17 nt, Human
gugugcucuucuucuuu

SEQ ID NO: 2566856 - RNA, 13 nt, Human
gugugcucuucuu

SEQ ID NO: 2566857 - RNA, 20 nt, Human
guuaaaagaugaaaauauuu

SEQ ID NO: 2566858 - RNA, 22 nt, Human
guuaaaauaccagccaguaaau

SEQ ID NO: 2566859 - RNA, 14 nt, Human
guuaaacauugaag

SEQ ID NO: 2566860 - RNA, 20 nt, Human
guuaaaagagguuuuucuua

SEQ ID NO: 2566861 - RNA, 21 nt, Human
guuaaaagagguuuuucuuaa

SEQ ID NO: 2566862 - RNA, 21 nt, Human
guuaaaauaacuaguguugcu

SEQ ID NO: 2566863 - RNA, 14 nt, Human
guuaaaagaugaaa

SEQ ID NO: 2566864 - RNA, 16 nt, Human
guuaaaagaugaaaau

SEQ ID NO: 2566865 - RNA, 20 nt, Human
guuaaaaaaaggcauuguuu

SEQ ID NO: 2566866 - RNA, 14 nt, Human
guuaaaagagguuu

SEQ ID NO: 2566867 - RNA, 12 nt, Human
guuaaaacuguc

SEQ ID NO: 2566868 - RNA, 19 nt, Human
guuaaauaaauuguauauu

SEQ ID NO: 2566869 - RNA, 18 nt, Human
guuaaauaaauuguauau

SEQ ID NO: 2566870 - RNA, 17 nt, Human
guuaaauaaauuguaua

SEQ ID NO: 2566871 - RNA, 13 nt, Human
guuaaauaaauug

SEQ ID NO: 2566872 - RNA, 23 nt, Human
guuaaaggcucgauuuuguaucu

SEQ ID NO: 2566873 - RNA, 13 nt, Human
guuaaaggaaaaa

SEQ ID NO: 2566874 - RNA, 20 nt, Human
guuaaagucagugggaacgu

SEQ ID NO: 2566875 - RNA, 21 nt, Human
guuaaauaaauuguauauuca

SEQ ID NO: 2566876 - RNA, 20 nt, Human
guuaaauaaauuguauauuc

SEQ ID NO: 2566877 - RNA, 22 nt, Human
guuaaauaaauuguauauucac

SEQ ID NO: 2566878 - RNA, 20 nt, Human
guuaaauagaguauaugcac

SEQ ID NO: 2566879 - RNA, 19 nt, Human
guuaaauagaguauaugca

SEQ ID NO: 2566880 - RNA, 21 nt, Human
guuaaauagaguauaugcacu

SEQ ID NO: 2566881 - RNA, 12 nt, Human
guuaaauauuua

SEQ ID NO: 2566882 - RNA, 22 nt, Human
guuaaacuagcauaucugccuu

SEQ ID NO: 2566883 - RNA, 21 nt, Human
guuaaacuagcauaucugccu

SEQ ID NO: 2566884 - RNA, 20 nt, Human
guuaaacuagcauaucugcc

SEQ ID NO: 2566885 - RNA, 19 nt, Human
guuaaacuagcauaucugc

SEQ ID NO: 2566886 - RNA, 15 nt, Human
guuaaacuagcauau

SEQ ID NO: 2566887 - RNA, 21 nt, Human
guuaaaccauccauguauuuu

SEQ ID NO: 2566888 - RNA, 15 nt, Human
guuaaaauuccaucc

SEQ ID NO: 2566889 - RNA, 23 nt, Human
guuaaacuagcauaucugccuuu

SEQ ID NO: 2566890 - RNA, 17 nt, Human
guuaaacucgcucacug

SEQ ID NO: 2566891 - RNA, 15 nt, Human
guuaaagcugccggc

SEQ ID NO: 2566892 - RNA, 19 nt, Human
guuaaacuuacuuaguguu

SEQ ID NO: 2566893 - RNA, 22 nt, Human
guuacagaaaguggugcucagu

SEQ ID NO: 2566894 - RNA, 21 nt, Human
guuacagaaaguggugcucag

SEQ ID NO: 2566895 - RNA, 19 nt, Human
guuacagaaaguggugcuc

SEQ ID NO: 2566896 - RNA, 13 nt, Human
guuacagaaagug

SEQ ID NO: 2566897 - RNA, 13 nt, Human
guuacagacaaag

SEQ ID NO: 2566898 - RNA, 12 nt, Human
guuacagaaagu

SEQ ID NO: 2566899 - RNA, 13 nt, Human
guuacacuugugc

SEQ ID NO: 2566900 - RNA, 23 nt, Human
guuacacuggaggagagaagaau

SEQ ID NO: 2566901 - RNA, 22 nt, Human
guuacacuggaggagagaagaa

SEQ ID NO: 2566902 - RNA, 17 nt, Human
guuacacauuuuucaga

SEQ ID NO: 2566903 - RNA, 15 nt, Human
guuacacuaaaaggu

SEQ ID NO: 2566904 - RNA, 16 nt, Human
guuacacuaaaaggug

SEQ ID NO: 2566905 - RNA, 18 nt, Human
guuaacugagugccuuuu

SEQ ID NO: 2566906 - RNA, 17 nt, Human
guuaacuuuaagacuga

SEQ ID NO: 2566907 - RNA, 23 nt, Human
guuaacuuuaagacugagcaccu

SEQ ID NO: 2566908 - RNA, 16 nt, Human
guuacacauuuuucag

SEQ ID NO: 2566909 - RNA, 18 nt, Human
guuaaauuuguaaguuuc

SEQ ID NO: 2566910 - RNA, 17 nt, Human
guuaaauuuguaaguuu

SEQ ID NO: 2566911 - RNA, 16 nt, Human
guuaaauuuguaaguu

SEQ ID NO: 2566912 - RNA, 15 nt, Human
guuaaauuuguaagu

SEQ ID NO: 2566913 - RNA, 14 nt, Human
guuaaauuuguaag

SEQ ID NO: 2566914 - RNA, 13 nt, Human
guuaaauuuguaa

SEQ ID NO: 2566915 - RNA, 17 nt, Human
guuaaauuucuggaccu

SEQ ID NO: 2566916 - RNA, 17 nt, Human
guuaaauugcuguguau

SEQ ID NO: 2566917 - RNA, 14 nt, Human
guuaacaaugauau

SEQ ID NO: 2566918 - RNA, 12 nt, Human
guuaacacauuu

SEQ ID NO: 2566919 - RNA, 23 nt, Human
guuaaauuuguaaguuucaggug

SEQ ID NO: 2566920 - RNA, 19 nt, Human
guuaaauuuguaaguuuca

SEQ ID NO: 2566921 - RNA, 20 nt, Human
guuaaaugaaauuguaaaac

SEQ ID NO: 2566922 - RNA, 18 nt, Human
guuaaaugaaauuguaaa

SEQ ID NO: 2566923 - RNA, 17 nt, Human
guuaaaugaaauuguaa

SEQ ID NO: 2566924 - RNA, 15 nt, Human
guuaaaugaaauugu

SEQ ID NO: 2566925 - RNA, 13 nt, Human
guuaaauauuuac

SEQ ID NO: 2566926 - RNA, 15 nt, Human
guuaaauauuuacau

SEQ ID NO: 2566927 - RNA, 16 nt, Human
guuaaauauuuacaua

SEQ ID NO: 2566928 - RNA, 22 nt, Human
guuaaauauuuacauaugaaau

SEQ ID NO: 2566929 - RNA, 18 nt, Human
guuaacacauuuuguaua

SEQ ID NO: 2566930 - RNA, 16 nt, Human
guuaacacauuuugua

SEQ ID NO: 2566931 - RNA, 15 nt, Human
guuaacacauuuugu

SEQ ID NO: 2566932 - RNA, 13 nt, Human
guuaacacauuuu

SEQ ID NO: 2566933 - RNA, 23 nt, Human
guuaacacauuuuguauaauugu

SEQ ID NO: 2566934 - RNA, 19 nt, Human
guuaacacauuuuguauaa

SEQ ID NO: 2566935 - RNA, 12 nt, Human
guuaacagauuu

SEQ ID NO: 2566936 - RNA, 23 nt, Human
guuaacagagacagauaacucuc

SEQ ID NO: 2566937 - RNA, 17 nt, Human
guuaaccucagugucau

SEQ ID NO: 2566938 - RNA, 20 nt, Human
guuaaccagaauaaaguucu

SEQ ID NO: 2566939 - RNA, 21 nt, Human
guuaacuauuuuauuuucuaa

SEQ ID NO: 2566940 - RNA, 21 nt, Human
guguuaggccuggcacagugu

SEQ ID NO: 2566941 - RNA, 19 nt, Human
guguuaggccuggcacagu

SEQ ID NO: 2566942 - RNA, 18 nt, Human
guguuaggccuggcacag

SEQ ID NO: 2566943 - RNA, 15 nt, Human
guguuaggccuggca

SEQ ID NO: 2566944 - RNA, 16 nt, Human
guguuagggaagggcc

SEQ ID NO: 2566945 - RNA, 22 nt, Human
guguuagggaagggccugccac

SEQ ID NO: 2566946 - RNA, 19 nt, Human
guguuacuguaauuccuca

SEQ ID NO: 2566947 - RNA, 14 nt, Human
guguuaggccuggc

SEQ ID NO: 2566948 - RNA, 15 nt, Human
guguuacuguaauuc

SEQ ID NO: 2566949 - RNA, 18 nt, Human
guguuaugacuccagaau

SEQ ID NO: 2566950 - RNA, 23 nt, Human
guguuagggaagggccugccaca

SEQ ID NO: 2566951 - RNA, 12 nt, Human
guguuaguuccc

SEQ ID NO: 2566952 - RNA, 24 nt, Human
guguuaggccuggcacagugucug

SEQ ID NO: 2566953 - RNA, 20 nt, Human
guguuauaauggguaauaua

SEQ ID NO: 2566954 - RNA, 12 nt, Human
guguuacuaagu

SEQ ID NO: 2566955 - RNA, 23 nt, Human
guguuacccaguaacucaucugu

SEQ ID NO: 2566956 - RNA, 16 nt, Human
guguuaccugaaaaca

SEQ ID NO: 2566957 - RNA, 14 nt, Human
guguuacuaaguuu

SEQ ID NO: 2566958 - RNA, 19 nt, Human
guguuaauacuaguuguga

SEQ ID NO: 2566959 - RNA, 15 nt, Human
guguuaaucaauuua

SEQ ID NO: 2566960 - RNA, 16 nt, Human
guguuaaucauuucau

SEQ ID NO: 2566961 - RNA, 18 nt, Human
guguuaaucaauuuaaac

SEQ ID NO: 2566962 - RNA, 14 nt, Human
guguguuuuucaua

SEQ ID NO: 2566963 - RNA, 21 nt, Human
guguuaaaugugaugaauacu

SEQ ID NO: 2566964 - RNA, 19 nt, Human
guguuaaaugaaauuguaa

SEQ ID NO: 2566965 - RNA, 16 nt, Human
guguguuuuaaaauga

SEQ ID NO: 2566966 - RNA, 13 nt, Human
guguguuuuaaaa

SEQ ID NO: 2566967 - RNA, 19 nt, Human
guguguuuuaaaaugagaa

SEQ ID NO: 2566968 - RNA, 14 nt, Human
guguguuuguguga

SEQ ID NO: 2566969 - RNA, 17 nt, Human
guguguuuucauaauaa

SEQ ID NO: 2566970 - RNA, 21 nt, Human
guguguuuugagaguauauua

SEQ ID NO: 2566971 - RNA, 20 nt, Human
guguguuuugagaguauauu

SEQ ID NO: 2566972 - RNA, 18 nt, Human
guguguuuucauaauaaa

SEQ ID NO: 2566973 - RNA, 16 nt, Human
guguucuccuuuuccu

SEQ ID NO: 2566974 - RNA, 11 nt, Human
guguucuccuu

SEQ ID NO: 2566975 - RNA, 19 nt, Human
guguuccuggcaguuuaaa

SEQ ID NO: 2566976 - RNA, 21 nt, Human
guguucccauuucagcugauc

SEQ ID NO: 2566977 - RNA, 18 nt, Human
guguuccccuuccacuga

SEQ ID NO: 2566978 - RNA, 19 nt, Human
guguuccccuuccacugag

SEQ ID NO: 2566979 - RNA, 22 nt, Human
guguuccccuuccacugagggc

SEQ ID NO: 2566980 - RNA, 23 nt, Human
guguuccccuuccacugagggca

SEQ ID NO: 2566981 - RNA, 10 nt, Human
guguuccugg

SEQ ID NO: 2566982 - RNA, 15 nt, Human
guguuccuggcaaua

SEQ ID NO: 2566983 - RNA, 18 nt, Human
guguuccuggcaauagug

SEQ ID NO: 2566984 - RNA, 17 nt, Human
guguucauacauuugag

SEQ ID NO: 2566985 - RNA, 12 nt, Human
guguucauacau

SEQ ID NO: 2566986 - RNA, 19 nt, Human
guguuccccaucugggucc

SEQ ID NO: 2566987 - RNA, 17 nt, Human
guguucccauuucagcu

SEQ ID NO: 2566988 - RNA, 15 nt, Human
guguuccaacaacca

SEQ ID NO: 2566989 - RNA, 16 nt, Human
guguuauuuaaagaag

SEQ ID NO: 2566990 - RNA, 17 nt, Human
guguuauuuaaaugagu

SEQ ID NO: 2566991 - RNA, 17 nt, Human
guguuauuuaaagaaga

SEQ ID NO: 2566992 - RNA, 23 nt, Human
guguucaaggccauccuucccug

SEQ ID NO: 2566993 - RNA, 18 nt, Human
guguuuucugaauaacau

SEQ ID NO: 2566994 - RNA, 12 nt, Human
guguuuugcugu

SEQ ID NO: 2566995 - RNA, 19 nt, Human
guguuuucugaauaacauu

SEQ ID NO: 2566996 - RNA, 13 nt, Human
guguuuucugaau

SEQ ID NO: 2566997 - RNA, 15 nt, Human
guguuuucauaauaa

SEQ ID NO: 2566998 - RNA, 16 nt, Human
guguuuucauaauaaa

SEQ ID NO: 2566999 - RNA, 14 nt, Human
guguuuuaauuuaa

SEQ ID NO: 2567000 - RNA, 14 nt, Human
guguucucucuuau

SEQ ID NO: 2567001 - RNA, 16 nt, Human
guguucugauuagaaa

SEQ ID NO: 2567002 - RNA, 18 nt, Human
guguucuggugaggccuu

SEQ ID NO: 2567003 - RNA, 15 nt, Human
guguuuuaauuuaaa

SEQ ID NO: 2567004 - RNA, 13 nt, Human
guguuuucauaau

SEQ ID NO: 2567005 - RNA, 14 nt, Human
guguuuucauaaua

SEQ ID NO: 2567006 - RNA, 14 nt, Human
guguuuuucugcuu

SEQ ID NO: 2567007 - RNA, 21 nt, Human
guguuuuuguaaagugugguc

SEQ ID NO: 2567008 - RNA, 19 nt, Human
guguuuuucugcuuuugaa

SEQ ID NO: 2567009 - RNA, 15 nt, Human
guguuuuugaaauau

SEQ ID NO: 2567010 - RNA, 14 nt, Human
guguuuuuguaaag

SEQ ID NO: 2567011 - RNA, 18 nt, Human
guguuuuucauaaagcag

SEQ ID NO: 2567012 - RNA, 15 nt, Human
guguuuuuaacucaa

SEQ ID NO: 2567013 - RNA, 21 nt, Human
guggugagaggcauccaguau

SEQ ID NO: 2567014 - RNA, 17 nt, Human
guggugaccucugccug

SEQ ID NO: 2567015 - RNA, 14 nt, Human
guggugaccucugc

SEQ ID NO: 2567016 - RNA, 23 nt, Human
guggucuguuggcaggcuggcca

SEQ ID NO: 2567017 - RNA, 22 nt, Human
guggucuguuggcaggcuggcc

SEQ ID NO: 2567018 - RNA, 21 nt, Human
guggucuguuggcaggcuggc

SEQ ID NO: 2567019 - RNA, 20 nt, Human
guggucuguuggcaggcugg

SEQ ID NO: 2567020 - RNA, 15 nt, Human
guggugaagaaaacu

SEQ ID NO: 2567021 - RNA, 19 nt, Human
guggucuuuguaagagugu

SEQ ID NO: 2567022 - RNA, 15 nt, Human
guggucuuuguaaga

SEQ ID NO: 2567023 - RNA, 16 nt, Human
guggucuuucuggaga

SEQ ID NO: 2567024 - RNA, 17 nt, Human
guggucuuucuggagag

SEQ ID NO: 2567025 - RNA, 19 nt, Human
guggucuguuggcaggcug

SEQ ID NO: 2567026 - RNA, 17 nt, Human
guggucuguuggcaggc

SEQ ID NO: 2567027 - RNA, 22 nt, Human
guggucugcucgggcccaggcc

SEQ ID NO: 2567028 - RNA, 19 nt, Human
guggucugcucgggcccag

SEQ ID NO: 2567029 - RNA, 13 nt, Human
guggucuguuggc

SEQ ID NO: 2567030 - RNA, 20 nt, Human
guggucugaauguucugaca

SEQ ID NO: 2567031 - RNA, 23 nt, Human
guggucugaauguucugacauua

SEQ ID NO: 2567032 - RNA, 14 nt, Human
guggucugcaggca

SEQ ID NO: 2567033 - RNA, 24 nt, Human
guggucugaauguucugacauuaa

SEQ ID NO: 2567034 - RNA, 15 nt, Human
guggucugcaggcag

SEQ ID NO: 2567035 - RNA, 18 nt, Human
guggucugcucgggccca

SEQ ID NO: 2567036 - RNA, 16 nt, Human
guggucugcaggcagg

SEQ ID NO: 2567037 - RNA, 23 nt, Human
guggugagcagaaguggagcugg

SEQ ID NO: 2567038 - RNA, 19 nt, Human
guggugaucaauuaaaugu

SEQ ID NO: 2567039 - RNA, 13 nt, Human
guggugagaucau

SEQ ID NO: 2567040 - RNA, 19 nt, Human
guggugcgaucuggguuca

SEQ ID NO: 2567041 - RNA, 21 nt, Human
guguaaguagauaggccaugg

SEQ ID NO: 2567042 - RNA, 21 nt, Human
guguaaguauucuuauuuaau

SEQ ID NO: 2567043 - RNA, 15 nt, Human
guguaauaagacaua

SEQ ID NO: 2567044 - RNA, 13 nt, Human
guguaauaagaca

SEQ ID NO: 2567045 - RNA, 22 nt, Human
guguaagugugaguaagagcug

SEQ ID NO: 2567046 - RNA, 16 nt, Human
guguaaucaauaaacg

SEQ ID NO: 2567047 - RNA, 15 nt, Human
guguaaucaauaaac

SEQ ID NO: 2567048 - RNA, 14 nt, Human
guguaaucaauaaa

SEQ ID NO: 2567049 - RNA, 14 nt, Human
guguaauaagacau

SEQ ID NO: 2567050 - RNA, 19 nt, Human
guguaaucaauaaacgauu

SEQ ID NO: 2567051 - RNA, 17 nt, Human
guguaaucaauaaacga

SEQ ID NO: 2567052 - RNA, 19 nt, Human
guguaaucauuucuugggc

SEQ ID NO: 2567053 - RNA, 21 nt, Human
guguaaucauuucuugggccc

SEQ ID NO: 2567054 - RNA, 16 nt, Human
guggucccaccccaca

SEQ ID NO: 2567055 - RNA, 15 nt, Human
guggucccaccccac

SEQ ID NO: 2567056 - RNA, 14 nt, Human
guggucccacccca

SEQ ID NO: 2567057 - RNA, 15 nt, Human
guggucacugcuguc

SEQ ID NO: 2567058 - RNA, 14 nt, Human
guggucacugcugu

SEQ ID NO: 2567059 - RNA, 18 nt, Human
gugguccauggaaugcuu

SEQ ID NO: 2567060 - RNA, 22 nt, Human
guggucaggcguagaucaccag

SEQ ID NO: 2567061 - RNA, 16 nt, Human
guggucauuaagcauu

SEQ ID NO: 2567062 - RNA, 18 nt, Human
gugguccuaaucuucuga

SEQ ID NO: 2567063 - RNA, 17 nt, Human
guggucccaccccacac

SEQ ID NO: 2567064 - RNA, 18 nt, Human
guggucuccacuggggau

SEQ ID NO: 2567065 - RNA, 24 nt, Human
guggucccaacaggaggacaauuc

SEQ ID NO: 2567066 - RNA, 23 nt, Human
guggucccaacaggaggacaauu

SEQ ID NO: 2567067 - RNA, 13 nt, Human
gugguccccaaca

SEQ ID NO: 2567068 - RNA, 12 nt, Human
gugguccugacu

SEQ ID NO: 2567069 - RNA, 17 nt, Human
guggucuccuuggaaau

SEQ ID NO: 2567070 - RNA, 15 nt, Human
gugguccugagaccu

SEQ ID NO: 2567071 - RNA, 13 nt, Human
guggucugaaugu

SEQ ID NO: 2567072 - RNA, 14 nt, Human
guggucugaauguu

SEQ ID NO: 2567073 - RNA, 17 nt, Human
guggucugaauguucug

SEQ ID NO: 2567074 - RNA, 18 nt, Human
guggucugaauguucuga

SEQ ID NO: 2567075 - RNA, 14 nt, Human
gugguacccucugg

SEQ ID NO: 2567076 - RNA, 17 nt, Human
gugguagagugugccug

SEQ ID NO: 2567077 - RNA, 16 nt, Human
gugguaagcucuggcu

SEQ ID NO: 2567078 - RNA, 20 nt, Human
gugguacacacagauuacug

SEQ ID NO: 2567079 - RNA, 22 nt, Human
guggucacagcggaggugugga

SEQ ID NO: 2567080 - RNA, 18 nt, Human
guggucacagcggaggug

SEQ ID NO: 2567081 - RNA, 16 nt, Human
guggucacagcggagg

SEQ ID NO: 2567082 - RNA, 15 nt, Human
guggucacagcggag

SEQ ID NO: 2567083 - RNA, 22 nt, Human
guggucaaaccgcacucaccca

SEQ ID NO: 2567084 - RNA, 20 nt, Human
gugguauccugugacaugua

SEQ ID NO: 2567085 - RNA, 12 nt, Human
gugguaugugug

SEQ ID NO: 2567086 - RNA, 15 nt, Human
gugguaugugugugu

SEQ ID NO: 2567087 - RNA, 19 nt, Human
gugguaugaucacggcuca

SEQ ID NO: 2567088 - RNA, 16 nt, Human
gugguauccugugaca

SEQ ID NO: 2567089 - RNA, 14 nt, Human
gugguauagaaaug

SEQ ID NO: 2567090 - RNA, 17 nt, Human
guguauauguaugugug

SEQ ID NO: 2567091 - RNA, 13 nt, Human
guguauaucagaa

SEQ ID NO: 2567092 - RNA, 14 nt, Human
guguauacaugcca

SEQ ID NO: 2567093 - RNA, 14 nt, Human
guguauauguaugu

SEQ ID NO: 2567094 - RNA, 22 nt, Human
guguauccccccccuguauagu

SEQ ID NO: 2567095 - RNA, 21 nt, Human
guguauccccccccuguauag

SEQ ID NO: 2567096 - RNA, 23 nt, Human
guguauccauuaucauguguaau

SEQ ID NO: 2567097 - RNA, 22 nt, Human
guguauccauuaucauguguaa

SEQ ID NO: 2567098 - RNA, 20 nt, Human
guguauccauuaucaugugu

SEQ ID NO: 2567099 - RNA, 16 nt, Human
guguauccauuaucau

SEQ ID NO: 2567100 - RNA, 20 nt, Human
guguauccuggggcucccuu

SEQ ID NO: 2567101 - RNA, 15 nt, Human
guguauccuggggcu

SEQ ID NO: 2567102 - RNA, 14 nt, Human
guguauccuggggc

SEQ ID NO: 2567103 - RNA, 13 nt, Human
guguauccugggg

SEQ ID NO: 2567104 - RNA, 15 nt, Human
guguaugacuaaaga

SEQ ID NO: 2567105 - RNA, 18 nt, Human
guguaucguaaccagcca

SEQ ID NO: 2567106 - RNA, 16 nt, Human
guguaugacuaaagag

SEQ ID NO: 2567107 - RNA, 14 nt, Human
guguaggcagacac

SEQ ID NO: 2567108 - RNA, 13 nt, Human
guguaggcagaca

SEQ ID NO: 2567109 - RNA, 12 nt, Human
guguaggcagac

SEQ ID NO: 2567110 - RNA, 14 nt, Human
guguagcuuugcuc

SEQ ID NO: 2567111 - RNA, 18 nt, Human
guguauagaaguagauua

SEQ ID NO: 2567112 - RNA, 15 nt, Human
guguaguugaacuga

SEQ ID NO: 2567113 - RNA, 17 nt, Human
guguaguugaacugaua

SEQ ID NO: 2567114 - RNA, 15 nt, Human
guguaggcagacaca

SEQ ID NO: 2567115 - RNA, 18 nt, Human
gugucccugcacuugcag

SEQ ID NO: 2567116 - RNA, 16 nt, Human
gugucccugcacuugc

SEQ ID NO: 2567117 - RNA, 13 nt, Human
gugucccugcacu

SEQ ID NO: 2567118 - RNA, 18 nt, Human
gugucccccucuguccag

SEQ ID NO: 2567119 - RNA, 14 nt, Human
gugucccccucugu

SEQ ID NO: 2567120 - RNA, 13 nt, Human
guguccccuccac

SEQ ID NO: 2567121 - RNA, 22 nt, Human
gugucccaugacccaccccugu

SEQ ID NO: 2567122 - RNA, 21 nt, Human
gugucccaugacccaccccug

SEQ ID NO: 2567123 - RNA, 19 nt, Human
gugucccaugacccacccc

SEQ ID NO: 2567124 - RNA, 23 nt, Human
gugucccaugacccaccccugug

SEQ ID NO: 2567125 - RNA, 16 nt, Human
guguaugggugugugu

SEQ ID NO: 2567126 - RNA, 22 nt, Human
guguauggguguguguuugugu

SEQ ID NO: 2567127 - RNA, 16 nt, Human
guguaugugcgugugu

SEQ ID NO: 2567128 - RNA, 19 nt, Human
guguauggaaauaaaugua

SEQ ID NO: 2567129 - RNA, 20 nt, Human
guguauggagagaaaacaga

SEQ ID NO: 2567130 - RNA, 19 nt, Human
guguaugcuacuacaaaaa

SEQ ID NO: 2567131 - RNA, 15 nt, Human
guguaauuucuuugc

SEQ ID NO: 2567132 - RNA, 13 nt, Human
guguaauuucuuu

SEQ ID NO: 2567133 - RNA, 13 nt, Human
guguacaaagaaa

SEQ ID NO: 2567134 - RNA, 23 nt, Human
guguaauuuuguucuaguuuuca

SEQ ID NO: 2567135 - RNA, 19 nt, Human
guguacacugacaccuuug

SEQ ID NO: 2567136 - RNA, 21 nt, Human
guguacacgggacugacgcaa

SEQ ID NO: 2567137 - RNA, 15 nt, Human
guguacacgggacug

SEQ ID NO: 2567138 - RNA, 18 nt, Human
guguacagaauucugcua

SEQ ID NO: 2567139 - RNA, 22 nt, Human
guguaauuuaaaauugugaugu

SEQ ID NO: 2567140 - RNA, 23 nt, Human
guguaauuuaaaauugugaugug

SEQ ID NO: 2567141 - RNA, 20 nt, Human
guguaauuuaaaauugugau

SEQ ID NO: 2567142 - RNA, 23 nt, Human
guguaaucauuucuugggcccuc

SEQ ID NO: 2567143 - RNA, 22 nt, Human
guguacaucccauguaacagaa

SEQ ID NO: 2567144 - RNA, 19 nt, Human
guguacaucccauguaaca

SEQ ID NO: 2567145 - RNA, 15 nt, Human
guguacauaugugcu

SEQ ID NO: 2567146 - RNA, 12 nt, Human
guguacauaugu

SEQ ID NO: 2567147 - RNA, 16 nt, Human
guguacauaacugaaa

SEQ ID NO: 2567148 - RNA, 17 nt, Human
guguacauggaauaaca

SEQ ID NO: 2567149 - RNA, 14 nt, Human
guguacauaacuga

SEQ ID NO: 2567150 - RNA, 12 nt, Human
guguacagugug

SEQ ID NO: 2567151 - RNA, 22 nt, Human
guguacagucuuguauuaaguu

SEQ ID NO: 2567152 - RNA, 16 nt, Human
guguacagucuuguau

SEQ ID NO: 2567153 - RNA, 13 nt, Human
guguacagucuug

SEQ ID NO: 2567154 - RNA, 14 nt, Human
guguagccugugca

SEQ ID NO: 2567155 - RNA, 16 nt, Human
guguagccuugcccgg

SEQ ID NO: 2567156 - RNA, 17 nt, Human
guguagccuugcccgga

SEQ ID NO: 2567157 - RNA, 14 nt, Human
guguagccaagguc

SEQ ID NO: 2567158 - RNA, 18 nt, Human
guguagaguuaagaagcu

SEQ ID NO: 2567159 - RNA, 17 nt, Human
guguagaguuaagaagc

SEQ ID NO: 2567160 - RNA, 20 nt, Human
guguagaguuaagaagcugu

SEQ ID NO: 2567161 - RNA, 17 nt, Human
guguagaagcauuccuu

SEQ ID NO: 2567162 - RNA, 14 nt, Human
guguagaagcauuc

SEQ ID NO: 2567163 - RNA, 13 nt, Human
guguagaagcauu

SEQ ID NO: 2567164 - RNA, 23 nt, Human
guguagaagcauuccuucuuuga

SEQ ID NO: 2567165 - RNA, 19 nt, Human
guguagaagcauuccuucu

SEQ ID NO: 2567166 - RNA, 15 nt, Human
guguagaguuaagaa

SEQ ID NO: 2567167 - RNA, 19 nt, Human
guguacccccgcccaggcu

SEQ ID NO: 2567168 - RNA, 17 nt, Human
guguaccauuugccucc

SEQ ID NO: 2567169 - RNA, 17 nt, Human
guguacccccgcccagg

SEQ ID NO: 2567170 - RNA, 22 nt, Human
guguacauggaauaacauguaa

SEQ ID NO: 2567171 - RNA, 20 nt, Human
guguacguggagagggauga

SEQ ID NO: 2567172 - RNA, 16 nt, Human
guguacguggagaggg

SEQ ID NO: 2567173 - RNA, 15 nt, Human
guguacuuaacuauu

SEQ ID NO: 2567174 - RNA, 17 nt, Human
gugggcccaaugcacuu

SEQ ID NO: 2567175 - RNA, 16 nt, Human
gugggccagucugugg

SEQ ID NO: 2567176 - RNA, 15 nt, Human
gugggccagucugug

SEQ ID NO: 2567177 - RNA, 19 nt, Human
gugggccagccccucccac

SEQ ID NO: 2567178 - RNA, 14 nt, Human
gugggccaggacag

SEQ ID NO: 2567179 - RNA, 18 nt, Human
gugggccaggacaggccc

SEQ ID NO: 2567180 - RNA, 18 nt, Human
gugggcaggugguggcac

SEQ ID NO: 2567181 - RNA, 17 nt, Human
gugggcaggugguggca

SEQ ID NO: 2567182 - RNA, 20 nt, Human
gugggcaggugggagcuuga

SEQ ID NO: 2567183 - RNA, 17 nt, Human
gugggccaacaaagaac

SEQ ID NO: 2567184 - RNA, 20 nt, Human
gugggcauugauggggaagg

SEQ ID NO: 2567185 - RNA, 12 nt, Human
gugggccagccc

SEQ ID NO: 2567186 - RNA, 13 nt, Human
gugggccagcccc

SEQ ID NO: 2567187 - RNA, 15 nt, Human
gugggccagccccuc

SEQ ID NO: 2567188 - RNA, 17 nt, Human
gugggccagccccuccc

SEQ ID NO: 2567189 - RNA, 22 nt, Human
gugggccucugguuuggggcga

SEQ ID NO: 2567190 - RNA, 12 nt, Human
gugggccucugg

SEQ ID NO: 2567191 - RNA, 23 nt, Human
gugggccucugguuuggggcgag

SEQ ID NO: 2567192 - RNA, 13 nt, Human
gugggccuggcca

SEQ ID NO: 2567193 - RNA, 15 nt, Human
gugggccuccucugu

SEQ ID NO: 2567194 - RNA, 20 nt, Human
gugggccuccucuguccagg

SEQ ID NO: 2567195 - RNA, 23 nt, Human
gugggccuccucuguccagggcc

SEQ ID NO: 2567196 - RNA, 11 nt, Human
gugggccucug

SEQ ID NO: 2567197 - RNA, 19 nt, Human
gugggccucaaggacuuga

SEQ ID NO: 2567198 - RNA, 21 nt, Human
gugggcccaggaccagcuggg

SEQ ID NO: 2567199 - RNA, 20 nt, Human
gugggcccaggaccagcugg

SEQ ID NO: 2567200 - RNA, 19 nt, Human
gugggcccaggaccagcug

SEQ ID NO: 2567201 - RNA, 14 nt, Human
gugggcccaggacc

SEQ ID NO: 2567202 - RNA, 23 nt, Human
gugggcccaggaccagcuggggc

SEQ ID NO: 2567203 - RNA, 22 nt, Human
gugggcccaggaccagcugggg

SEQ ID NO: 2567204 - RNA, 18 nt, Human
gugggcccuccgacagcc

SEQ ID NO: 2567205 - RNA, 18 nt, Human
gugggccagucuguggau

SEQ ID NO: 2567206 - RNA, 17 nt, Human
gugggccagucugugga

SEQ ID NO: 2567207 - RNA, 11 nt, Human
gugggcccagg

SEQ ID NO: 2567208 - RNA, 17 nt, Human
gugggccagugugggaa

SEQ ID NO: 2567209 - RNA, 13 nt, Human
gugggcucccuga

SEQ ID NO: 2567210 - RNA, 14 nt, Human
gugggcucccugac

SEQ ID NO: 2567211 - RNA, 15 nt, Human
gugggcucccugacu

SEQ ID NO: 2567212 - RNA, 13 nt, Human
gugggcugagccc

SEQ ID NO: 2567213 - RNA, 14 nt, Human
gugggcugagcccu

SEQ ID NO: 2567214 - RNA, 15 nt, Human
gugggcugagcccug

SEQ ID NO: 2567215 - RNA, 16 nt, Human
gugggcugagcccugg

SEQ ID NO: 2567216 - RNA, 15 nt, Human
gugggcuaguugggc

SEQ ID NO: 2567217 - RNA, 14 nt, Human
gugggcuaauuaaa

SEQ ID NO: 2567218 - RNA, 17 nt, Human
gugggcguggucacugc

SEQ ID NO: 2567219 - RNA, 12 nt, Human
gugggcuaagca

SEQ ID NO: 2567220 - RNA, 19 nt, Human
gugggccuucagggaguga

SEQ ID NO: 2567221 - RNA, 20 nt, Human
gugggccuuguccccugccu

SEQ ID NO: 2567222 - RNA, 18 nt, Human
gugggccuugcuggggac

SEQ ID NO: 2567223 - RNA, 17 nt, Human
gugggccuugcugggga

SEQ ID NO: 2567224 - RNA, 15 nt, Human
gugggccuugcuggg

SEQ ID NO: 2567225 - RNA, 16 nt, Human
gugggcggcagagagg

SEQ ID NO: 2567226 - RNA, 13 nt, Human
gugggcggcagag

SEQ ID NO: 2567227 - RNA, 21 nt, Human
gugggcgugagaccugccccu

SEQ ID NO: 2567228 - RNA, 22 nt, Human
gugggcgugagaccugccccuc

SEQ ID NO: 2567229 - RNA, 18 nt, Human
gugggcgugagaccugcc

SEQ ID NO: 2567230 - RNA, 18 nt, Human
gugggcgggcagcacagc

SEQ ID NO: 2567231 - RNA, 19 nt, Human
gugggcggcacagccuucu

SEQ ID NO: 2567232 - RNA, 19 nt, Human
gugggcgggcagcacagca

SEQ ID NO: 2567233 - RNA, 14 nt, Human
guggguggugggga

SEQ ID NO: 2567234 - RNA, 16 nt, Human
gugggugguggaucug

SEQ ID NO: 2567235 - RNA, 12 nt, Human
guggguggugga

SEQ ID NO: 2567236 - RNA, 16 nt, Human
guggguuauucuggag

SEQ ID NO: 2567237 - RNA, 16 nt, Human
gugggugguggggagg

SEQ ID NO: 2567238 - RNA, 23 nt, Human
guggguuucuaaagcugccagcc

SEQ ID NO: 2567239 - RNA, 12 nt, Human
gugguaacccug

SEQ ID NO: 2567240 - RNA, 21 nt, Human
guggguuuucaucaagacugg

SEQ ID NO: 2567241 - RNA, 16 nt, Human
guggguuuucuuccca

SEQ ID NO: 2567242 - RNA, 17 nt, Human
guggggcagcuugaggg

SEQ ID NO: 2567243 - RNA, 13 nt, Human
guggggcagcuug

SEQ ID NO: 2567244 - RNA, 23 nt, Human
guggggcagcacagagagggggc

SEQ ID NO: 2567245 - RNA, 19 nt, Human
guggggcagcacagagagg

SEQ ID NO: 2567246 - RNA, 14 nt, Human
guggggcagcacag

SEQ ID NO: 2567247 - RNA, 12 nt, Human
guggggcagcac

SEQ ID NO: 2567248 - RNA, 18 nt, Human
guggggaccucaggccug

SEQ ID NO: 2567249 - RNA, 15 nt, Human
guggggaccucaggc

SEQ ID NO: 2567250 - RNA, 22 nt, Human
gugggcuggugacccagucaga

SEQ ID NO: 2567251 - RNA, 14 nt, Human
gugggcugugagug

SEQ ID NO: 2567252 - RNA, 23 nt, Human
gugggcuucccaguggcugcugc

SEQ ID NO: 2567253 - RNA, 22 nt, Human
gugggcuucccaguggcugcug

SEQ ID NO: 2567254 - RNA, 16 nt, Human
gugggcuucccagugg

SEQ ID NO: 2567255 - RNA, 13 nt, Human
gugggcugugagu

SEQ ID NO: 2567256 - RNA, 15 nt, Human
gugggcugcaucugg

SEQ ID NO: 2567257 - RNA, 21 nt, Human
gugggcugcacucugugccca

SEQ ID NO: 2567258 - RNA, 20 nt, Human
gugggcugcacucugugccc

SEQ ID NO: 2567259 - RNA, 19 nt, Human
gugggcugcacucugugcc

SEQ ID NO: 2567260 - RNA, 18 nt, Human
gugggcucugugcaguca

SEQ ID NO: 2567261 - RNA, 18 nt, Human
gugggcugagcccuggca

SEQ ID NO: 2567262 - RNA, 13 nt, Human
guggggaggggcu

SEQ ID NO: 2567263 - RNA, 13 nt, Human
guggggaggggcg

SEQ ID NO: 2567264 - RNA, 11 nt, Human
guggggagggg

SEQ ID NO: 2567265 - RNA, 22 nt, Human
guggggacguccugccaccugg

SEQ ID NO: 2567266 - RNA, 18 nt, Human
guggggaucucaggggcu

SEQ ID NO: 2567267 - RNA, 19 nt, Human
guggggaucucaggggcug

SEQ ID NO: 2567268 - RNA, 15 nt, Human
guggggauugcccau

SEQ ID NO: 2567269 - RNA, 16 nt, Human
guggggauuucuccca

SEQ ID NO: 2567270 - RNA, 18 nt, Human
guggggcaagauuuuccu

SEQ ID NO: 2567271 - RNA, 17 nt, Human
guggggauuucucccag

SEQ ID NO: 2567272 - RNA, 13 nt, Human
guggggacagggc

SEQ ID NO: 2567273 - RNA, 14 nt, Human
gugggcuugauucu

SEQ ID NO: 2567274 - RNA, 11 nt, Human
guggggacagg

SEQ ID NO: 2567275 - RNA, 17 nt, Human
guggggagacugggcug

SEQ ID NO: 2567276 - RNA, 13 nt, Human
guggggagggccg

SEQ ID NO: 2567277 - RNA, 22 nt, Human
guggcugcuucaaggauccuga

SEQ ID NO: 2567278 - RNA, 19 nt, Human
guggcugcuucaaggaucc

SEQ ID NO: 2567279 - RNA, 16 nt, Human
guggcugcuucaagga

SEQ ID NO: 2567280 - RNA, 15 nt, Human
guggcugcuucaagg

SEQ ID NO: 2567281 - RNA, 17 nt, Human
guggcuggaagauccug

SEQ ID NO: 2567282 - RNA, 12 nt, Human
guggcuggaaga

SEQ ID NO: 2567283 - RNA, 17 nt, Human
guggcuggaucugugag

SEQ ID NO: 2567284 - RNA, 23 nt, Human
guggcugcuucaaggauccugag

SEQ ID NO: 2567285 - RNA, 19 nt, Human
guggcuggguuggagggug

SEQ ID NO: 2567286 - RNA, 20 nt, Human
guggcuggaagauccugcgg

SEQ ID NO: 2567287 - RNA, 11 nt, Human
guggcuggggg

SEQ ID NO: 2567288 - RNA, 16 nt, Human
guggcugggggcagga

SEQ ID NO: 2567289 - RNA, 17 nt, Human
guggcugguccagggcu

SEQ ID NO: 2567290 - RNA, 21 nt, Human
guggcuggguccaggggaugg

SEQ ID NO: 2567291 - RNA, 14 nt, Human
guggcugucagcag

SEQ ID NO: 2567292 - RNA, 15 nt, Human
guggcugucagcagg

SEQ ID NO: 2567293 - RNA, 15 nt, Human
guggcuguccagugc

SEQ ID NO: 2567294 - RNA, 19 nt, Human
guggcugucagcaggaagc

SEQ ID NO: 2567295 - RNA, 15 nt, Human
guggcugguccaggg

SEQ ID NO: 2567296 - RNA, 18 nt, Human
guggcuggguuuacacgc

SEQ ID NO: 2567297 - RNA, 17 nt, Human
guggcugggggcaggag

SEQ ID NO: 2567298 - RNA, 22 nt, Human
guggcugggggcaggagggccc

SEQ ID NO: 2567299 - RNA, 22 nt, Human
guggcuuaaaacaacacucaca

SEQ ID NO: 2567300 - RNA, 19 nt, Human
guggcuguccagugcccau

SEQ ID NO: 2567301 - RNA, 18 nt, Human
guggcuguccagugccca

SEQ ID NO: 2567302 - RNA, 17 nt, Human
guggcuguccagugccc

SEQ ID NO: 2567303 - RNA, 20 nt, Human
guggcuuacuacauguggga

SEQ ID NO: 2567304 - RNA, 12 nt, Human
gugggcaggugg

SEQ ID NO: 2567305 - RNA, 14 nt, Human
gugggcaggaaaag

SEQ ID NO: 2567306 - RNA, 13 nt, Human
gugggcaggaaaa

SEQ ID NO: 2567307 - RNA, 21 nt, Human
gugggcacgcugugggcaggu

SEQ ID NO: 2567308 - RNA, 20 nt, Human
gugggcacgcugugggcagg

SEQ ID NO: 2567309 - RNA, 23 nt, Human
gugggcacgcugugggcaggugg

SEQ ID NO: 2567310 - RNA, 21 nt, Human
guggcuucauuagagcaggcg

SEQ ID NO: 2567311 - RNA, 17 nt, Human
gugggcaaacaggcagu

SEQ ID NO: 2567312 - RNA, 20 nt, Human
gugggcacccacccugggac

SEQ ID NO: 2567313 - RNA, 16 nt, Human
gugggcacccacccug

SEQ ID NO: 2567314 - RNA, 20 nt, Human
guggcuucccgcucagcccu

SEQ ID NO: 2567315 - RNA, 19 nt, Human
guggcuucccgcucagccc

SEQ ID NO: 2567316 - RNA, 18 nt, Human
guggcuucccgcucagcc

SEQ ID NO: 2567317 - RNA, 20 nt, Human
guggcuucauuagagcaggc

SEQ ID NO: 2567318 - RNA, 19 nt, Human
guggcuucauuagagcagg

SEQ ID NO: 2567319 - RNA, 15 nt, Human
gugcuacaaaaacac

SEQ ID NO: 2567320 - RNA, 20 nt, Human
gugcuacaaaaacacagcaa

SEQ ID NO: 2567321 - RNA, 15 nt, Human
gugcuaauuuugaaa

SEQ ID NO: 2567322 - RNA, 13 nt, Human
gugcuaauuuuga

SEQ ID NO: 2567323 - RNA, 14 nt, Human
guggcucacgccug

SEQ ID NO: 2567324 - RNA, 19 nt, Human
guggcuagucaagcuccuc

SEQ ID NO: 2567325 - RNA, 20 nt, Human
guggcuagucaagcuccucc

SEQ ID NO: 2567326 - RNA, 21 nt, Human
guggcuagucaagcuccuccu

SEQ ID NO: 2567327 - RNA, 22 nt, Human
guggcuagucaagcuccuccuc

SEQ ID NO: 2567328 - RNA, 23 nt, Human
guggcuagucaagcuccuccucc

SEQ ID NO: 2567329 - RNA, 17 nt, Human
guggcuagucagagaga

SEQ ID NO: 2567330 - RNA, 19 nt, Human
guggcuagucagagagagu

SEQ ID NO: 2567331 - RNA, 12 nt, Human
guggcuaggcag

SEQ ID NO: 2567332 - RNA, 18 nt, Human
guggcuagucaagcuccu

SEQ ID NO: 2567333 - RNA, 21 nt, Human
gugcuacaaaaacacagcaag

SEQ ID NO: 2567334 - RNA, 21 nt, Human
gugcuaauaacagugcauauu

SEQ ID NO: 2567335 - RNA, 14 nt, Human
guggcugcuucaag

SEQ ID NO: 2567336 - RNA, 12 nt, Human
guggcugcuuca

SEQ ID NO: 2567337 - RNA, 15 nt, Human
guggcugcugcccag

SEQ ID NO: 2567338 - RNA, 13 nt, Human
guggcugcugccc

SEQ ID NO: 2567339 - RNA, 16 nt, Human
guggcugcugcccagg

SEQ ID NO: 2567340 - RNA, 12 nt, Human
guggcugcugcc

SEQ ID NO: 2567341 - RNA, 19 nt, Human
guggcugcuagcacuugga

SEQ ID NO: 2567342 - RNA, 13 nt, Human
guggcuccuuccc

SEQ ID NO: 2567343 - RNA, 16 nt, Human
guggcugccucauuua

SEQ ID NO: 2567344 - RNA, 20 nt, Human
guggcugccucauuuagaga

SEQ ID NO: 2567345 - RNA, 17 nt, Human
guggcugcuagcacuug

SEQ ID NO: 2567346 - RNA, 18 nt, Human
guggcugcggcacccuug

SEQ ID NO: 2567347 - RNA, 16 nt, Human
guggcugcccacacac

SEQ ID NO: 2567348 - RNA, 20 nt, Human
guggcuccucccggugccca

SEQ ID NO: 2567349 - RNA, 13 nt, Human
guggcuccucccg

SEQ ID NO: 2567350 - RNA, 20 nt, Human
guggcuccuaucuguguuuu

SEQ ID NO: 2567351 - RNA, 18 nt, Human
guggcuccuaucuguguu

SEQ ID NO: 2567352 - RNA, 22 nt, Human
guggcuccccucuauuuagcau

SEQ ID NO: 2567353 - RNA, 23 nt, Human
guggcuccccucuauuuagcaug

SEQ ID NO: 2567354 - RNA, 14 nt, Human
guggcucaugccug

SEQ ID NO: 2567355 - RNA, 15 nt, Human
guggcucagccagca

SEQ ID NO: 2567356 - RNA, 15 nt, Human
guggcuccagcacca

SEQ ID NO: 2567357 - RNA, 19 nt, Human
guggcucaugccuguaauc

SEQ ID NO: 2567358 - RNA, 12 nt, Human
guggcuccccuc

SEQ ID NO: 2567359 - RNA, 14 nt, Human
guggcuccccucua

SEQ ID NO: 2567360 - RNA, 22 nt, Human
guggcucacgccuguaauccca

SEQ ID NO: 2567361 - RNA, 23 nt, Human
guggcucacgccuguaaucccag

SEQ ID NO: 2567362 - RNA, 20 nt, Human
guggcucacgugugugacuc

SEQ ID NO: 2567363 - RNA, 20 nt, Human
guucuggcucuuccaggcug

SEQ ID NO: 2567364 - RNA, 16 nt, Human
guucuggcucuuccag

SEQ ID NO: 2567365 - RNA, 19 nt, Human
guucugcuggccuggaucu

SEQ ID NO: 2567366 - RNA, 16 nt, Human
guucugcuggccugga

SEQ ID NO: 2567367 - RNA, 14 nt, Human
guucugcuggccug

SEQ ID NO: 2567368 - RNA, 12 nt, Human
guucuggccaga

SEQ ID NO: 2567369 - RNA, 13 nt, Human
guucuggccagaa

SEQ ID NO: 2567370 - RNA, 12 nt, Human
guucuggcucuu

SEQ ID NO: 2567371 - RNA, 18 nt, Human
guucugcucaucauucuc

SEQ ID NO: 2567372 - RNA, 23 nt, Human
guucugcucaucauucucugucu

SEQ ID NO: 2567373 - RNA, 15 nt, Human
guucugcucaucauu

SEQ ID NO: 2567374 - RNA, 22 nt, Human
guucugcaaaaauauuuauaaa

SEQ ID NO: 2567375 - RNA, 15 nt, Human
guucugcuccucucc

SEQ ID NO: 2567376 - RNA, 14 nt, Human
guucugcuccucuc

SEQ ID NO: 2567377 - RNA, 13 nt, Human
guucugcuccucu

SEQ ID NO: 2567378 - RNA, 11 nt, Human
guucugcuccu

SEQ ID NO: 2567379 - RNA, 19 nt, Human
guucugcuccucuccaggc

SEQ ID NO: 2567380 - RNA, 18 nt, Human
guucugcuccucuccagg

SEQ ID NO: 2567381 - RNA, 17 nt, Human
guucugcuccucuccag

SEQ ID NO: 2567382 - RNA, 16 nt, Human
guucugcuccucucca

SEQ ID NO: 2567383 - RNA, 13 nt, Human
guucugcuggccu

SEQ ID NO: 2567384 - RNA, 22 nt, Human
guucugcuccucuccaggcacc

SEQ ID NO: 2567385 - RNA, 23 nt, Human
guucuggcagaguugaagacaga

SEQ ID NO: 2567386 - RNA, 18 nt, Human
guucuuucacccuuuucu

SEQ ID NO: 2567387 - RNA, 17 nt, Human
guucuuuaggagauuuu

SEQ ID NO: 2567388 - RNA, 23 nt, Human
guucugggacacaguucaauucu

SEQ ID NO: 2567389 - RNA, 16 nt, Human
guucugggacacaguu

SEQ ID NO: 2567390 - RNA, 15 nt, Human
guucugggacacagu

SEQ ID NO: 2567391 - RNA, 14 nt, Human
guucugggacacag

SEQ ID NO: 2567392 - RNA, 12 nt, Human
guucugggacac

SEQ ID NO: 2567393 - RNA, 11 nt, Human
guucugggaca

SEQ ID NO: 2567394 - RNA, 16 nt, Human
guucuggccagaaugc

SEQ ID NO: 2567395 - RNA, 15 nt, Human
guucuggcccucacc

SEQ ID NO: 2567396 - RNA, 22 nt, Human
guucuggcugccccaaccugcu

SEQ ID NO: 2567397 - RNA, 20 nt, Human
guucuggcugccccaaccug

SEQ ID NO: 2567398 - RNA, 21 nt, Human
guucuggcccucaccccugcc

SEQ ID NO: 2567399 - RNA, 23 nt, Human
guucuggcccucaccccugcccu

SEQ ID NO: 2567400 - RNA, 13 nt, Human
guucuuuccaaag

SEQ ID NO: 2567401 - RNA, 14 nt, Human
guucuuuccaaagu

SEQ ID NO: 2567402 - RNA, 18 nt, Human
guucuuuccaaaguacac

SEQ ID NO: 2567403 - RNA, 20 nt, Human
guucuuuccaaaguacacug

SEQ ID NO: 2567404 - RNA, 15 nt, Human
guucuuucuggaguc

SEQ ID NO: 2567405 - RNA, 15 nt, Human
guucuuucuuccucu

SEQ ID NO: 2567406 - RNA, 14 nt, Human
guucuuucuuccuc

SEQ ID NO: 2567407 - RNA, 19 nt, Human
guucuuucuuccucugcug

SEQ ID NO: 2567408 - RNA, 18 nt, Human
guucuuucuuccucugcu

SEQ ID NO: 2567409 - RNA, 17 nt, Human
guucuuucuuccucugc

SEQ ID NO: 2567410 - RNA, 16 nt, Human
guucuuucuuccucug

SEQ ID NO: 2567411 - RNA, 18 nt, Human
guucuuuggaaggaguga

SEQ ID NO: 2567412 - RNA, 15 nt, Human
guucuuugggccaga

SEQ ID NO: 2567413 - RNA, 16 nt, Human
guucuuugggccagac

SEQ ID NO: 2567414 - RNA, 20 nt, Human
guucuuuguucauagcccag

SEQ ID NO: 2567415 - RNA, 13 nt, Human
guucuuuguucau

SEQ ID NO: 2567416 - RNA, 17 nt, Human
guucuuugggccagaca

SEQ ID NO: 2567417 - RNA, 22 nt, Human
guucuuugggccagacaugcca

SEQ ID NO: 2567418 - RNA, 21 nt, Human
guucuuuguucauagcccagu

SEQ ID NO: 2567419 - RNA, 13 nt, Human
guucuuuuaaagg

SEQ ID NO: 2567420 - RNA, 17 nt, Human
guugaaaaacagcugag

SEQ ID NO: 2567421 - RNA, 17 nt, Human
guugaaaagacuccaaa

SEQ ID NO: 2567422 - RNA, 22 nt, Human
guugaaaagacuccaaagaaau

SEQ ID NO: 2567423 - RNA, 23 nt, Human
guugaaaagacuccaaagaaaug

SEQ ID NO: 2567424 - RNA, 18 nt, Human
guugaaaauucaaaaagu

SEQ ID NO: 2567425 - RNA, 19 nt, Human
guugaaaauuauuuuaaac

SEQ ID NO: 2567426 - RNA, 16 nt, Human
guucuaagucuuucca

SEQ ID NO: 2567427 - RNA, 19 nt, Human
guucuaaaaauugugauca

SEQ ID NO: 2567428 - RNA, 14 nt, Human
guucguucuguuua

SEQ ID NO: 2567429 - RNA, 14 nt, Human
guucuaaagaugga

SEQ ID NO: 2567430 - RNA, 20 nt, Human
guucuaaagauggaaaaacc

SEQ ID NO: 2567431 - RNA, 17 nt, Human
guucuaaagauggaaaa

SEQ ID NO: 2567432 - RNA, 23 nt, Human
guucuaaagauggaaaaaccacc

SEQ ID NO: 2567433 - RNA, 14 nt, Human
guucgcauggucac

SEQ ID NO: 2567434 - RNA, 20 nt, Human
guucgcauggucacacacug

SEQ ID NO: 2567435 - RNA, 18 nt, Human
guucggauuuggggugga

SEQ ID NO: 2567436 - RNA, 16 nt, Human
guucgggugugcaaug

SEQ ID NO: 2567437 - RNA, 13 nt, Human
guucguagcuuuc

SEQ ID NO: 2567438 - RNA, 13 nt, Human
guucguucuguuu

SEQ ID NO: 2567439 - RNA, 17 nt, Human
guucguggaaagggugc

SEQ ID NO: 2567440 - RNA, 19 nt, Human
guucgagaccagucuggcc

SEQ ID NO: 2567441 - RNA, 16 nt, Human
guucgagaccagucug

SEQ ID NO: 2567442 - RNA, 20 nt, Human
guucgagaccagccuggcca

SEQ ID NO: 2567443 - RNA, 18 nt, Human
guucgagaccagccuggc

SEQ ID NO: 2567444 - RNA, 19 nt, Human
guucgagaccagccuggcc

SEQ ID NO: 2567445 - RNA, 17 nt, Human
guucgagaccagccugg

SEQ ID NO: 2567446 - RNA, 16 nt, Human
guucgagaccagccug

SEQ ID NO: 2567447 - RNA, 18 nt, Human
guuccuuccucugagccu

SEQ ID NO: 2567448 - RNA, 19 nt, Human
guuccuuccucugagccuu

SEQ ID NO: 2567449 - RNA, 17 nt, Human
guuccuuccucugagcc

SEQ ID NO: 2567450 - RNA, 20 nt, Human
guuccuucuggugucugcuu

SEQ ID NO: 2567451 - RNA, 23 nt, Human
guuccuugaucuguauauacaau

SEQ ID NO: 2567452 - RNA, 16 nt, Human
guucgacucagccuca

SEQ ID NO: 2567453 - RNA, 14 nt, Human
guucgacucagccu

SEQ ID NO: 2567454 - RNA, 19 nt, Human
guucgagaccaaccugacc

SEQ ID NO: 2567455 - RNA, 22 nt, Human
guucgacgagacggucgagcag

SEQ ID NO: 2567456 - RNA, 17 nt, Human
guucugccugccagcug

SEQ ID NO: 2567457 - RNA, 19 nt, Human
guucugccugccagcugca

SEQ ID NO: 2567458 - RNA, 22 nt, Human
guucugccugccagcugcacug

SEQ ID NO: 2567459 - RNA, 23 nt, Human
guucugccugccagcugcacuga

SEQ ID NO: 2567460 - RNA, 13 nt, Human
guucugccugcca

SEQ ID NO: 2567461 - RNA, 15 nt, Human
guucugccugccagc

SEQ ID NO: 2567462 - RNA, 15 nt, Human
guucugcacacagca

SEQ ID NO: 2567463 - RNA, 16 nt, Human
guucugcacacagcac

SEQ ID NO: 2567464 - RNA, 16 nt, Human
guucugcaaaaauauu

SEQ ID NO: 2567465 - RNA, 20 nt, Human
guucugauuagaaaugacca

SEQ ID NO: 2567466 - RNA, 13 nt, Human
guucugauuagaa

SEQ ID NO: 2567467 - RNA, 14 nt, Human
guucugauuagaaa

SEQ ID NO: 2567468 - RNA, 16 nt, Human
guucugauuagaaaug

SEQ ID NO: 2567469 - RNA, 18 nt, Human
guucugauuagaaaugac

SEQ ID NO: 2567470 - RNA, 19 nt, Human
guucugauccuaguuccac

SEQ ID NO: 2567471 - RNA, 22 nt, Human
guucugagauuauuuuaaucua

SEQ ID NO: 2567472 - RNA, 18 nt, Human
guucugaugaugugccug

SEQ ID NO: 2567473 - RNA, 17 nt, Human
guucugaugaugugccu

SEQ ID NO: 2567474 - RNA, 14 nt, Human
guucugaguguuuu

SEQ ID NO: 2567475 - RNA, 13 nt, Human
guucugaagaaga

SEQ ID NO: 2567476 - RNA, 12 nt, Human
guucugaagaag

SEQ ID NO: 2567477 - RNA, 17 nt, Human
guucuaagucuuuccau

SEQ ID NO: 2567478 - RNA, 19 nt, Human
guucuaagucuuuccauug

SEQ ID NO: 2567479 - RNA, 18 nt, Human
guucuaauuuuggaugga

SEQ ID NO: 2567480 - RNA, 15 nt, Human
guucugaagaagaug

SEQ ID NO: 2567481 - RNA, 14 nt, Human
guucugaagaagau

SEQ ID NO: 2567482 - RNA, 18 nt, Human
guucugaauaauuucuua

SEQ ID NO: 2567483 - RNA, 16 nt, Human
guucugaauaauuucu

SEQ ID NO: 2567484 - RNA, 15 nt, Human
guucugaauaauuuc

SEQ ID NO: 2567485 - RNA, 14 nt, Human
guucucuucuugaa

SEQ ID NO: 2567486 - RNA, 20 nt, Human
guucugaauaugcugcucau

SEQ ID NO: 2567487 - RNA, 15 nt, Human
guucugacauuaaca

SEQ ID NO: 2567488 - RNA, 16 nt, Human
guucugacauuaacag

SEQ ID NO: 2567489 - RNA, 17 nt, Human
guucugacauuaacagu

SEQ ID NO: 2567490 - RNA, 21 nt, Human
guucugacauuaacaguuuuc

SEQ ID NO: 2567491 - RNA, 23 nt, Human
guucugacauuaacaguuuucca

SEQ ID NO: 2567492 - RNA, 13 nt, Human
guucugacuugac

SEQ ID NO: 2567493 - RNA, 23 nt, Human
guugccagucaccccggccaccu

SEQ ID NO: 2567494 - RNA, 18 nt, Human
guugccagucaccccggc

SEQ ID NO: 2567495 - RNA, 17 nt, Human
guugccagucaccccgg

SEQ ID NO: 2567496 - RNA, 16 nt, Human
guugccagucaccccg

SEQ ID NO: 2567497 - RNA, 19 nt, Human
guugccaagcuccaagccc

SEQ ID NO: 2567498 - RNA, 18 nt, Human
guugccaagcuccaagcc

SEQ ID NO: 2567499 - RNA, 15 nt, Human
guugccaagcuccaa

SEQ ID NO: 2567500 - RNA, 21 nt, Human
guugccaaauauguccugggg

SEQ ID NO: 2567501 - RNA, 11 nt, Human
guugccacagg

SEQ ID NO: 2567502 - RNA, 13 nt, Human
guugccaagcugg

SEQ ID NO: 2567503 - RNA, 13 nt, Human
guugccacaggac

SEQ ID NO: 2567504 - RNA, 14 nt, Human
guugccacaggaca

SEQ ID NO: 2567505 - RNA, 15 nt, Human
guugccacaggccuc

SEQ ID NO: 2567506 - RNA, 12 nt, Human
guugccacaggc

SEQ ID NO: 2567507 - RNA, 15 nt, Human
guugccacaggacac

SEQ ID NO: 2567508 - RNA, 16 nt, Human
guugccacaggacaca

SEQ ID NO: 2567509 - RNA, 14 nt, Human
guugccagucaccc

SEQ ID NO: 2567510 - RNA, 13 nt, Human
guugccagucacc

SEQ ID NO: 2567511 - RNA, 18 nt, Human
guuggacccgcucuggac

SEQ ID NO: 2567512 - RNA, 17 nt, Human
guuggacccgcucugga

SEQ ID NO: 2567513 - RNA, 16 nt, Human
guuggacccgcucugg

SEQ ID NO: 2567514 - RNA, 15 nt, Human
guuggacccgcucug

SEQ ID NO: 2567515 - RNA, 20 nt, Human
guuggacccgcucuggacca

SEQ ID NO: 2567516 - RNA, 19 nt, Human
guuggagagcuagaaccug

SEQ ID NO: 2567517 - RNA, 13 nt, Human
guuggaucuucaa

SEQ ID NO: 2567518 - RNA, 19 nt, Human
guuggagccugcagggugg

SEQ ID NO: 2567519 - RNA, 16 nt, Human
guuggagccugcaggg

SEQ ID NO: 2567520 - RNA, 14 nt, Human
guuggagccugcag

SEQ ID NO: 2567521 - RNA, 22 nt, Human
guuggagagcuagaaccuggag

SEQ ID NO: 2567522 - RNA, 12 nt, Human
guuggagccugc

SEQ ID NO: 2567523 - RNA, 14 nt, Human
guugcccaggcagg

SEQ ID NO: 2567524 - RNA, 12 nt, Human
guugcccaggca

SEQ ID NO: 2567525 - RNA, 19 nt, Human
guugccacaggccucccug

SEQ ID NO: 2567526 - RNA, 17 nt, Human
guugccacaggccuccc

SEQ ID NO: 2567527 - RNA, 16 nt, Human
guugccacaggccucc

SEQ ID NO: 2567528 - RNA, 17 nt, Human
guugccagagauggagg

SEQ ID NO: 2567529 - RNA, 11 nt, Human
guugccagaga

SEQ ID NO: 2567530 - RNA, 15 nt, Human
guugccagagaugga

SEQ ID NO: 2567531 - RNA, 14 nt, Human
guuggccaguguga

SEQ ID NO: 2567532 - RNA, 19 nt, Human
guuggccaggcuggucuca

SEQ ID NO: 2567533 - RNA, 19 nt, Human
guuggccaggcugcucuug

SEQ ID NO: 2567534 - RNA, 18 nt, Human
guuggccaggcuggucuc

SEQ ID NO: 2567535 - RNA, 17 nt, Human
guuggccaggcuggucu

SEQ ID NO: 2567536 - RNA, 14 nt, Human
guuggccaggcugg

SEQ ID NO: 2567537 - RNA, 15 nt, Human
guuggccaggcuggu

SEQ ID NO: 2567538 - RNA, 14 nt, Human
guuggccaggcugc

SEQ ID NO: 2567539 - RNA, 20 nt, Human
guuggccacgucuuccuucu

SEQ ID NO: 2567540 - RNA, 13 nt, Human
guuggccaggcug

SEQ ID NO: 2567541 - RNA, 20 nt, Human
guuggcaggcuggccagucc

SEQ ID NO: 2567542 - RNA, 17 nt, Human
guuggcaggcuggccag

SEQ ID NO: 2567543 - RNA, 16 nt, Human
guuggcaggcuggcca

SEQ ID NO: 2567544 - RNA, 15 nt, Human
guuggcaggcuggcc

SEQ ID NO: 2567545 - RNA, 14 nt, Human
guuggcaggcuggc

SEQ ID NO: 2567546 - RNA, 13 nt, Human
guuggcaggcugg

SEQ ID NO: 2567547 - RNA, 19 nt, Human
guuggcacucacagaccug

SEQ ID NO: 2567548 - RNA, 15 nt, Human
guuggcacucacaga

SEQ ID NO: 2567549 - RNA, 20 nt, Human
guuggcacucacagaccugg

SEQ ID NO: 2567550 - RNA, 23 nt, Human
guuggcagugagugagccuggcu

SEQ ID NO: 2567551 - RNA, 22 nt, Human
guuggcagugagugagccuggc

SEQ ID NO: 2567552 - RNA, 16 nt, Human
guuggcagugagugag

SEQ ID NO: 2567553 - RNA, 23 nt, Human
guuggccaaagccaaagcuaggc

SEQ ID NO: 2567554 - RNA, 18 nt, Human
guuggcaaaaaggcagga

SEQ ID NO: 2567555 - RNA, 12 nt, Human
guuggauuuguu

SEQ ID NO: 2567556 - RNA, 20 nt, Human
guuggauuuuugucuugugu

SEQ ID NO: 2567557 - RNA, 14 nt, Human
guuggcaaaaaggc

SEQ ID NO: 2567558 - RNA, 21 nt, Human
guuggauuuauaaaugcuauu

SEQ ID NO: 2567559 - RNA, 18 nt, Human
guuggauuuauaaaugcu

SEQ ID NO: 2567560 - RNA, 14 nt, Human
guuggauuuuuguc

SEQ ID NO: 2567561 - RNA, 23 nt, Human
guugcacccagcccuggucucag

SEQ ID NO: 2567562 - RNA, 20 nt, Human
guugcacccagcccuggucu

SEQ ID NO: 2567563 - RNA, 18 nt, Human
guugcacccagcccuggu

SEQ ID NO: 2567564 - RNA, 17 nt, Human
guugcacccagcccugg

SEQ ID NO: 2567565 - RNA, 16 nt, Human
guugcacccagcccug

SEQ ID NO: 2567566 - RNA, 15 nt, Human
guugcacccagcccu

SEQ ID NO: 2567567 - RNA, 14 nt, Human
guugcacccagccc

SEQ ID NO: 2567568 - RNA, 13 nt, Human
guugcacccagcc

SEQ ID NO: 2567569 - RNA, 15 nt, Human
guugcaggaccucag

SEQ ID NO: 2567570 - RNA, 14 nt, Human
guugcacugauauu

SEQ ID NO: 2567571 - RNA, 19 nt, Human
guugcacuuaugauuucau

SEQ ID NO: 2567572 - RNA, 19 nt, Human
guugcacuuggccucugga

SEQ ID NO: 2567573 - RNA, 15 nt, Human
guugcagugagcuga

SEQ ID NO: 2567574 - RNA, 20 nt, Human
guugcaugucgugaccaacu

SEQ ID NO: 2567575 - RNA, 16 nt, Human
guugcaugauguauuu

SEQ ID NO: 2567576 - RNA, 13 nt, Human
guugcagugagcu

SEQ ID NO: 2567577 - RNA, 20 nt, Human
guugcauuaaaaaugcauau

SEQ ID NO: 2567578 - RNA, 17 nt, Human
guugccaaacagccaca

SEQ ID NO: 2567579 - RNA, 18 nt, Human
guugccaaacagccacac

SEQ ID NO: 2567580 - RNA, 20 nt, Human
guugccaaauauguccuggg

SEQ ID NO: 2567581 - RNA, 19 nt, Human
guugccaaauauguccugg

SEQ ID NO: 2567582 - RNA, 16 nt, Human
guugcaacuuuguaua

SEQ ID NO: 2567583 - RNA, 14 nt, Human
guugcaaccacugc

SEQ ID NO: 2567584 - RNA, 13 nt, Human
guugcaaccacug

SEQ ID NO: 2567585 - RNA, 15 nt, Human
guugcaaacucagcc

SEQ ID NO: 2567586 - RNA, 15 nt, Human
guugcaaggccgcug

SEQ ID NO: 2567587 - RNA, 16 nt, Human
guugcacagcuaugaa

SEQ ID NO: 2567588 - RNA, 22 nt, Human
guugcaauagaacagagaaaga

SEQ ID NO: 2567589 - RNA, 20 nt, Human
guugcacacccacucagcuc

SEQ ID NO: 2567590 - RNA, 16 nt, Human
guugcaaggccgcugu

SEQ ID NO: 2567591 - RNA, 17 nt, Human
guugcaaggccgcuguu

SEQ ID NO: 2567592 - RNA, 23 nt, Human
guugcaaggccgcuguucaccca

SEQ ID NO: 2567593 - RNA, 17 nt, Human
guugcaaguacugcugu

SEQ ID NO: 2567594 - RNA, 14 nt, Human
guugcaacuuugua

SEQ ID NO: 2567595 - RNA, 18 nt, Human
guugauuucuuuccagag

SEQ ID NO: 2567596 - RNA, 20 nt, Human
guugauugcuaaauguaaca

SEQ ID NO: 2567597 - RNA, 18 nt, Human
guugauugcuaaauguaa

SEQ ID NO: 2567598 - RNA, 22 nt, Human
guugauugcuaaauguaacagu

SEQ ID NO: 2567599 - RNA, 23 nt, Human
guugauucgguauccccccaucu

SEQ ID NO: 2567600 - RNA, 13 nt, Human
guugauugcuaaa

SEQ ID NO: 2567601 - RNA, 12 nt, Human
guugauugcuaa

SEQ ID NO: 2567602 - RNA, 17 nt, Human
guugauugcuaaaugua

SEQ ID NO: 2567603 - RNA, 16 nt, Human
guugauugcuaaaugu

SEQ ID NO: 2567604 - RNA, 15 nt, Human
guugauugcuaaaug

SEQ ID NO: 2567605 - RNA, 14 nt, Human
guugauugcuaaau

SEQ ID NO: 2567606 - RNA, 23 nt, Human
guugauuucagcaccuacagugu

SEQ ID NO: 2567607 - RNA, 20 nt, Human
guugauggugguauguuuuc

SEQ ID NO: 2567608 - RNA, 21 nt, Human
guugauggugguauguuuuca

SEQ ID NO: 2567609 - RNA, 16 nt, Human
guugauguuggcuggg

SEQ ID NO: 2567610 - RNA, 17 nt, Human
guugauggguucuaauu

SEQ ID NO: 2567611 - RNA, 17 nt, Human
guugauguuggcuggga

SEQ ID NO: 2567612 - RNA, 13 nt, Human
guugaagccuuug

SEQ ID NO: 2567613 - RNA, 14 nt, Human
guugaagccuuugu

SEQ ID NO: 2567614 - RNA, 14 nt, Human
guugaagcucuggu

SEQ ID NO: 2567615 - RNA, 22 nt, Human
guugaagcuaagauuuagagau

SEQ ID NO: 2567616 - RNA, 13 nt, Human
guugaagcucugg

SEQ ID NO: 2567617 - RNA, 19 nt, Human
guugaaugacaacagaagc

SEQ ID NO: 2567618 - RNA, 16 nt, Human
guugaauggccugccu

SEQ ID NO: 2567619 - RNA, 13 nt, Human
guugaauacuuuu

SEQ ID NO: 2567620 - RNA, 17 nt, Human
guugaauacuuuuuaca

SEQ ID NO: 2567621 - RNA, 15 nt, Human
guugaaugacaacag

SEQ ID NO: 2567622 - RNA, 20 nt, Human
guugaaauuauguauguuua

SEQ ID NO: 2567623 - RNA, 22 nt, Human
guugaaaauucaaaaaguguuu

SEQ ID NO: 2567624 - RNA, 15 nt, Human
guugaaagaguccua

SEQ ID NO: 2567625 - RNA, 15 nt, Human
guugaagaggaaggg

SEQ ID NO: 2567626 - RNA, 21 nt, Human
guugaacugauaguuacuguu

SEQ ID NO: 2567627 - RNA, 16 nt, Human
guugaagacagagcua

SEQ ID NO: 2567628 - RNA, 17 nt, Human
guuacagacaaagcgug

SEQ ID NO: 2567629 - RNA, 15 nt, Human
guuacagacaaagcg

SEQ ID NO: 2567630 - RNA, 21 nt, Human
guuacagcgagaggcagagaa

SEQ ID NO: 2567631 - RNA, 19 nt, Human
guuacagcgagaggcagag

SEQ ID NO: 2567632 - RNA, 18 nt, Human
guuacagccuguuaguaa

SEQ ID NO: 2567633 - RNA, 21 nt, Human
guuacagccuguuaguaacau

SEQ ID NO: 2567634 - RNA, 22 nt, Human
guuacaggcaccgagaauguug

SEQ ID NO: 2567635 - RNA, 22 nt, Human
guuacaugcauacuucaaaagu

SEQ ID NO: 2567636 - RNA, 21 nt, Human
guuacaugcauacuucaaaag

SEQ ID NO: 2567637 - RNA, 23 nt, Human
guuacaugcauacuucaaaagua

SEQ ID NO: 2567638 - RNA, 16 nt, Human
guuacauuaauguuaa

SEQ ID NO: 2567639 - RNA, 14 nt, Human
guuacauuaauguu

SEQ ID NO: 2567640 - RNA, 13 nt, Human
guuacauuaaugu

SEQ ID NO: 2567641 - RNA, 17 nt, Human
guuacaucacaguguuu

SEQ ID NO: 2567642 - RNA, 19 nt, Human
guuacaugcauacuucaaa

SEQ ID NO: 2567643 - RNA, 18 nt, Human
guuacauaagauaaaugu

SEQ ID NO: 2567644 - RNA, 19 nt, Human
guuacauaagauaaaugug

SEQ ID NO: 2567645 - RNA, 23 nt, Human
guuaccauuuugggguacccacu

SEQ ID NO: 2567646 - RNA, 21 nt, Human
guuacauuuuuaagugcugca

SEQ ID NO: 2567647 - RNA, 18 nt, Human
guuaccaugucacugugg

SEQ ID NO: 2567648 - RNA, 15 nt, Human
guuaccaugucacug

SEQ ID NO: 2567649 - RNA, 23 nt, Human
guuaccucugccucagaaaacaa

SEQ ID NO: 2567650 - RNA, 22 nt, Human
guuaccugaaaacacugugcac

SEQ ID NO: 2567651 - RNA, 15 nt, Human
guuaccuccuauaaa

SEQ ID NO: 2567652 - RNA, 17 nt, Human
guuaccuccuauaaacu

SEQ ID NO: 2567653 - RNA, 17 nt, Human
guuacccuccuguaaau

SEQ ID NO: 2567654 - RNA, 20 nt, Human
guuacccaguaacucaucug

SEQ ID NO: 2567655 - RNA, 13 nt, Human
guuacccagagaa

SEQ ID NO: 2567656 - RNA, 13 nt, Human
guuaccuacuuug

SEQ ID NO: 2567657 - RNA, 16 nt, Human
guuaccuacuuugacu

SEQ ID NO: 2567658 - RNA, 19 nt, Human
guuaccuaauuagagcaga

SEQ ID NO: 2567659 - RNA, 10 nt, Human
guuaccuaau

SEQ ID NO: 2567660 - RNA, 16 nt, Human
guuauaaaagugauug

SEQ ID NO: 2567661 - RNA, 17 nt, Human
guuauaaaucaauguca

SEQ ID NO: 2567662 - RNA, 18 nt, Human
guuauaaaucaaugucac

SEQ ID NO: 2567663 - RNA, 19 nt, Human
guuauacugucgguuuuuu

SEQ ID NO: 2567664 - RNA, 22 nt, Human
guuauaaaagugauuguuggca

SEQ ID NO: 2567665 - RNA, 14 nt, Human
guuauaaaagugau

SEQ ID NO: 2567666 - RNA, 14 nt, Human
guuauaaagauaca

SEQ ID NO: 2567667 - RNA, 15 nt, Human
guuauaaagauacag

SEQ ID NO: 2567668 - RNA, 13 nt, Human
guuaguucccaac

SEQ ID NO: 2567669 - RNA, 12 nt, Human
guuauaaaagug

SEQ ID NO: 2567670 - RNA, 14 nt, Human
guuaguuuuuacuu

SEQ ID NO: 2567671 - RNA, 19 nt, Human
guuaguuucuccaagcagg

SEQ ID NO: 2567672 - RNA, 16 nt, Human
guuaguuucuccaagc

SEQ ID NO: 2567673 - RNA, 22 nt, Human
guuaguuucuccaagcaggaca

SEQ ID NO: 2567674 - RNA, 16 nt, Human
guuaguuucuuuggga

SEQ ID NO: 2567675 - RNA, 15 nt, Human
guuacucagaauucu

SEQ ID NO: 2567676 - RNA, 14 nt, Human
guuacuaucugcuu

SEQ ID NO: 2567677 - RNA, 20 nt, Human
guuacuagguaacuucauau

SEQ ID NO: 2567678 - RNA, 12 nt, Human
guuacucagccc

SEQ ID NO: 2567679 - RNA, 13 nt, Human
guuacucagcccu

SEQ ID NO: 2567680 - RNA, 14 nt, Human
guuacucagcccug

SEQ ID NO: 2567681 - RNA, 15 nt, Human
guuacucagcccugg

SEQ ID NO: 2567682 - RNA, 16 nt, Human
guuacuccagugccaa

SEQ ID NO: 2567683 - RNA, 22 nt, Human
guuacuccagugccaacaaucc

SEQ ID NO: 2567684 - RNA, 14 nt, Human
guuacucuccaacc

SEQ ID NO: 2567685 - RNA, 16 nt, Human
guuacucagcccuggg

SEQ ID NO: 2567686 - RNA, 17 nt, Human
guuacucagcccugggc

SEQ ID NO: 2567687 - RNA, 18 nt, Human
guuacucagcccugggcc

SEQ ID NO: 2567688 - RNA, 17 nt, Human
guuacucuccaaccugg

SEQ ID NO: 2567689 - RNA, 18 nt, Human
guuacucuccaaccugga

SEQ ID NO: 2567690 - RNA, 22 nt, Human
guuacucuccaaccuggacaac

SEQ ID NO: 2567691 - RNA, 11 nt, Human
guuacucugaa

SEQ ID NO: 2567692 - RNA, 14 nt, Human
guuacucugaaggg

SEQ ID NO: 2567693 - RNA, 14 nt, Human
guuacuaagaagaa

SEQ ID NO: 2567694 - RNA, 13 nt, Human
guuacuaagaaga

SEQ ID NO: 2567695 - RNA, 17 nt, Human
guuacuaacuaaacucu

SEQ ID NO: 2567696 - RNA, 16 nt, Human
guuacuaacuaaacuc

SEQ ID NO: 2567697 - RNA, 21 nt, Human
guuaccugaucaaugacagag

SEQ ID NO: 2567698 - RNA, 23 nt, Human
guuacgcacacguacuuaaauga

SEQ ID NO: 2567699 - RNA, 22 nt, Human
guuacuaaguuuuuauggcuuu

SEQ ID NO: 2567700 - RNA, 15 nt, Human
guuacuacaugcacu

SEQ ID NO: 2567701 - RNA, 23 nt, Human
guuacuaauuggccucuuuaaga

SEQ ID NO: 2567702 - RNA, 16 nt, Human
guuacuagguaacuuc

SEQ ID NO: 2567703 - RNA, 13 nt, Human
guuacuauaugcc

SEQ ID NO: 2567704 - RNA, 22 nt, Human
guuaucaccgugggcucccuga

SEQ ID NO: 2567705 - RNA, 20 nt, Human
guuaucaccgugggcucccu

SEQ ID NO: 2567706 - RNA, 23 nt, Human
guuaucaaacuucagcuguacuu

SEQ ID NO: 2567707 - RNA, 14 nt, Human
guuauaucaacaga

SEQ ID NO: 2567708 - RNA, 17 nt, Human
guuauauauuuuuugua

SEQ ID NO: 2567709 - RNA, 19 nt, Human
guuauauugaaaaaauaga

SEQ ID NO: 2567710 - RNA, 20 nt, Human
guuauauuuuacuacugugg

SEQ ID NO: 2567711 - RNA, 13 nt, Human
guuauauagguuu

SEQ ID NO: 2567712 - RNA, 12 nt, Human
guuauauaaaug

SEQ ID NO: 2567713 - RNA, 13 nt, Human
guuauauaaaugg

SEQ ID NO: 2567714 - RNA, 10 nt, Human
guuauauaaa

SEQ ID NO: 2567715 - RNA, 19 nt, Human
guuauaguauaucuggaca

SEQ ID NO: 2567716 - RNA, 16 nt, Human
guuauaguauaucugg

SEQ ID NO: 2567717 - RNA, 15 nt, Human
guuauaguauaucug

SEQ ID NO: 2567718 - RNA, 17 nt, Human
guuauaggucacuccug

SEQ ID NO: 2567719 - RNA, 22 nt, Human
guuauagagggucuaagauuca

SEQ ID NO: 2567720 - RNA, 20 nt, Human
guuaugaaauucacccccuu

SEQ ID NO: 2567721 - RNA, 15 nt, Human
guuaugaaauaaaga

SEQ ID NO: 2567722 - RNA, 23 nt, Human
guuaugaauauuuacguuuuugu

SEQ ID NO: 2567723 - RNA, 12 nt, Human
guuaugaauauu

SEQ ID NO: 2567724 - RNA, 21 nt, Human
guuaugacuccagaauuuccc

SEQ ID NO: 2567725 - RNA, 14 nt, Human
guuaucucuguguu

SEQ ID NO: 2567726 - RNA, 13 nt, Human
guuaucucugugu

SEQ ID NO: 2567727 - RNA, 12 nt, Human
guuaucucugug

SEQ ID NO: 2567728 - RNA, 16 nt, Human
guuaucuaaaagaaau

SEQ ID NO: 2567729 - RNA, 21 nt, Human
guuaucgaaauaacaauguua

SEQ ID NO: 2567730 - RNA, 18 nt, Human
guuaucgaaauaacaaug

SEQ ID NO: 2567731 - RNA, 23 nt, Human
guuaucgaaauaacaauguuaag

SEQ ID NO: 2567732 - RNA, 15 nt, Human
guuaucuaaaagaaa

SEQ ID NO: 2567733 - RNA, 17 nt, Human
guuaucgaaauaacaau

SEQ ID NO: 2567734 - RNA, 15 nt, Human
guuaucgaaauaaca

SEQ ID NO: 2567735 - RNA, 14 nt, Human
guuaucgaaauaac

SEQ ID NO: 2567736 - RNA, 21 nt, Human
guuaucccuuccuuuuagccu

SEQ ID NO: 2567737 - RNA, 21 nt, Human
guuauuaaacguaugcaugug

SEQ ID NO: 2567738 - RNA, 14 nt, Human
guuauguguguaua

SEQ ID NO: 2567739 - RNA, 19 nt, Human
guuauguguguauauguau

SEQ ID NO: 2567740 - RNA, 22 nt, Human
guuauuagagauuaccuccuga

SEQ ID NO: 2567741 - RNA, 21 nt, Human
guuauuagggugguauuuagu

SEQ ID NO: 2567742 - RNA, 22 nt, Human
guuauuaaacguaugcauguga

SEQ ID NO: 2567743 - RNA, 21 nt, Human
guuauuacccagaguuuuuau

SEQ ID NO: 2567744 - RNA, 19 nt, Human
guucaagcgauucuucugc

SEQ ID NO: 2567745 - RNA, 19 nt, Human
guuauuaaaaaucucaaau

SEQ ID NO: 2567746 - RNA, 22 nt, Human
guuaugugaaugaucucucuga

SEQ ID NO: 2567747 - RNA, 15 nt, Human
guuaugguguuucuc

SEQ ID NO: 2567748 - RNA, 19 nt, Human
guuaugcggucuagggaau

SEQ ID NO: 2567749 - RNA, 21 nt, Human
guuauguaaaaggccaaaccu

SEQ ID NO: 2567750 - RNA, 20 nt, Human
guuaugauuuuuuuuucaua

SEQ ID NO: 2567751 - RNA, 22 nt, Human
guuaugcaagggacuguguguu

SEQ ID NO: 2567752 - RNA, 13 nt, Human
guuaugcugugac

SEQ ID NO: 2567753 - RNA, 23 nt, Human
guuauggaaacuguugccagaga

SEQ ID NO: 2567754 - RNA, 19 nt, Human
guucaaugaucuagguuua

SEQ ID NO: 2567755 - RNA, 17 nt, Human
guucaaugaucuagguu

SEQ ID NO: 2567756 - RNA, 14 nt, Human
guucaaugaucuag

SEQ ID NO: 2567757 - RNA, 13 nt, Human
guucaaugaucua

SEQ ID NO: 2567758 - RNA, 12 nt, Human
guucaaugaucu

SEQ ID NO: 2567759 - RNA, 10 nt, Human
guucaaugau

SEQ ID NO: 2567760 - RNA, 16 nt, Human
guucaauucucauuug

SEQ ID NO: 2567761 - RNA, 17 nt, Human
guucaauggcugcugaa

SEQ ID NO: 2567762 - RNA, 22 nt, Human
guucaaugaucuagguuuaacu

SEQ ID NO: 2567763 - RNA, 21 nt, Human
guucaaugaucuagguuuaac

SEQ ID NO: 2567764 - RNA, 20 nt, Human
guucaaugaucuagguuuaa

SEQ ID NO: 2567765 - RNA, 13 nt, Human
guucaauuagaau

SEQ ID NO: 2567766 - RNA, 23 nt, Human
guucaauucucauuugucacaca

SEQ ID NO: 2567767 - RNA, 20 nt, Human
guucaagcgauucuucugcu

SEQ ID NO: 2567768 - RNA, 18 nt, Human
guuauuauaauuguauca

SEQ ID NO: 2567769 - RNA, 16 nt, Human
guuauuauaauuguau

SEQ ID NO: 2567770 - RNA, 14 nt, Human
guuauuauaauugu

SEQ ID NO: 2567771 - RNA, 13 nt, Human
guuauuauaauug

SEQ ID NO: 2567772 - RNA, 18 nt, Human
guucaaggccauccuucc

SEQ ID NO: 2567773 - RNA, 18 nt, Human
guucaauaauaaauauuu

SEQ ID NO: 2567774 - RNA, 18 nt, Human
guucaaucucccgcugcu

SEQ ID NO: 2567775 - RNA, 23 nt, Human
guucaagugauucucaugccuca

SEQ ID NO: 2567776 - RNA, 20 nt, Human
guucaaguaauucugcuguc

SEQ ID NO: 2567777 - RNA, 19 nt, Human
guucaaggccauccuuccc

SEQ ID NO: 2567778 - RNA, 18 nt, Human
guucacucuuggagccug

SEQ ID NO: 2567779 - RNA, 19 nt, Human
guucacucuuggagccugc

SEQ ID NO: 2567780 - RNA, 17 nt, Human
guucacucuuggagccu

SEQ ID NO: 2567781 - RNA, 20 nt, Human
guucacucuuggagccugca

SEQ ID NO: 2567782 - RNA, 24 nt, Human
guucacucuuggagccugcagagc

SEQ ID NO: 2567783 - RNA, 19 nt, Human
guucacugcaaccuccgcc

SEQ ID NO: 2567784 - RNA, 15 nt, Human
guucacuaaagcagu

SEQ ID NO: 2567785 - RNA, 24 nt, Human
guucacucuacuuagcaugucccu

SEQ ID NO: 2567786 - RNA, 19 nt, Human
guucacgugcagcucaagg

SEQ ID NO: 2567787 - RNA, 22 nt, Human
guucaccuugaagaaccucuca

SEQ ID NO: 2567788 - RNA, 12 nt, Human
guucacauuuuu

SEQ ID NO: 2567789 - RNA, 16 nt, Human
guucacccacagggcu

SEQ ID NO: 2567790 - RNA, 11 nt, Human
guucaccagcc

SEQ ID NO: 2567791 - RNA, 12 nt, Human
guucaccagccu

SEQ ID NO: 2567792 - RNA, 16 nt, Human
guucaccccuccaccc

SEQ ID NO: 2567793 - RNA, 14 nt, Human
guucaccccuccac

SEQ ID NO: 2567794 - RNA, 12 nt, Human
guucaccccucc

SEQ ID NO: 2567795 - RNA, 22 nt, Human
guucagagacucagggccccag

SEQ ID NO: 2567796 - RNA, 16 nt, Human
guucagagacucaggg

SEQ ID NO: 2567797 - RNA, 17 nt, Human
guucagagacucagggc

SEQ ID NO: 2567798 - RNA, 21 nt, Human
guucagaaaugcugccugccu

SEQ ID NO: 2567799 - RNA, 19 nt, Human
guucagaaaugcugccugc

SEQ ID NO: 2567800 - RNA, 16 nt, Human
guucacuuuugacaaa

SEQ ID NO: 2567801 - RNA, 20 nt, Human
guucacuuuugacaaaggca

SEQ ID NO: 2567802 - RNA, 18 nt, Human
guucagaaaugcugccug

SEQ ID NO: 2567803 - RNA, 17 nt, Human
guucagaaaugcugccu

SEQ ID NO: 2567804 - RNA, 21 nt, Human
guucacuucaucuucucagcu

SEQ ID NO: 2567805 - RNA, 16 nt, Human
guucacuucaucuucu

SEQ ID NO: 2567806 - RNA, 24 nt, Human
guucauguuugcuucauaaaugaa

SEQ ID NO: 2567807 - RNA, 14 nt, Human
guucauguuugcuu

SEQ ID NO: 2567808 - RNA, 14 nt, Human
guucaugagaaucu

SEQ ID NO: 2567809 - RNA, 16 nt, Human
guucaugccaccaugg

SEQ ID NO: 2567810 - RNA, 19 nt, Human
guucaugagaaucuauauu

SEQ ID NO: 2567811 - RNA, 12 nt, Human
guucaugagaau

SEQ ID NO: 2567812 - RNA, 20 nt, Human
guucaucugagcaagagcug

SEQ ID NO: 2567813 - RNA, 13 nt, Human
guucaucuugaau

SEQ ID NO: 2567814 - RNA, 12 nt, Human
guucaucuugaa

SEQ ID NO: 2567815 - RNA, 18 nt, Human
guucaucuugaauuguaa

SEQ ID NO: 2567816 - RNA, 17 nt, Human
guucaucguauaacaca

SEQ ID NO: 2567817 - RNA, 22 nt, Human
guucauccaauccucacugggu

SEQ ID NO: 2567818 - RNA, 16 nt, Human
guucauccauucuauu

SEQ ID NO: 2567819 - RNA, 20 nt, Human
guucauccaauccucacugg

SEQ ID NO: 2567820 - RNA, 21 nt, Human
guucauccaauccucacuggg

SEQ ID NO: 2567821 - RNA, 22 nt, Human
guucauauguaccauguacaug

SEQ ID NO: 2567822 - RNA, 15 nt, Human
guucauccaauccuc

SEQ ID NO: 2567823 - RNA, 18 nt, Human
guucauccaauccucacu

SEQ ID NO: 2567824 - RNA, 19 nt, Human
guucauccaauccucacug

SEQ ID NO: 2567825 - RNA, 16 nt, Human
guucaucaaugaauga

SEQ ID NO: 2567826 - RNA, 17 nt, Human
guucaucauccuaagcu

SEQ ID NO: 2567827 - RNA, 22 nt, Human
guucagcacugucccuugccuc

SEQ ID NO: 2567828 - RNA, 16 nt, Human
guucagcacugucccu

SEQ ID NO: 2567829 - RNA, 15 nt, Human
guucagcacuguccc

SEQ ID NO: 2567830 - RNA, 16 nt, Human
guucagauugcuuuga

SEQ ID NO: 2567831 - RNA, 16 nt, Human
guucagcaccacccua

SEQ ID NO: 2567832 - RNA, 14 nt, Human
guucagcacugucc

SEQ ID NO: 2567833 - RNA, 17 nt, Human
guucagcaccacccuag

SEQ ID NO: 2567834 - RNA, 18 nt, Human
guucagcacugucccuug

SEQ ID NO: 2567835 - RNA, 12 nt, Human
guucagccaagg

SEQ ID NO: 2567836 - RNA, 19 nt, Human
guucauauuccauauuuau

SEQ ID NO: 2567837 - RNA, 14 nt, Human
guucagccccuccu

SEQ ID NO: 2567838 - RNA, 15 nt, Human
guucagccccuccuc

SEQ ID NO: 2567839 - RNA, 15 nt, Human
guucagccaagguuu

SEQ ID NO: 2567840 - RNA, 15 nt, Human
guuccaauaaacagg

SEQ ID NO: 2567841 - RNA, 14 nt, Human
guuccaauaaacag

SEQ ID NO: 2567842 - RNA, 21 nt, Human
guuccaagacauugucaauaa

SEQ ID NO: 2567843 - RNA, 15 nt, Human
guuccaagacauugu

SEQ ID NO: 2567844 - RNA, 16 nt, Human
guuccaagacauuguc

SEQ ID NO: 2567845 - RNA, 17 nt, Human
guuccaagacauuguca

SEQ ID NO: 2567846 - RNA, 19 nt, Human
guuccaagacauugucaau

SEQ ID NO: 2567847 - RNA, 17 nt, Human
guucauuuugagcugaa

SEQ ID NO: 2567848 - RNA, 20 nt, Human
guucauuucaaauacaucuu

SEQ ID NO: 2567849 - RNA, 19 nt, Human
guuccaaaugaauguuguc

SEQ ID NO: 2567850 - RNA, 15 nt, Human
guuccaaaugaaugu

SEQ ID NO: 2567851 - RNA, 17 nt, Human
guuccaaccacugaauc

SEQ ID NO: 2567852 - RNA, 13 nt, Human
guuccaagacauu

SEQ ID NO: 2567853 - RNA, 14 nt, Human
guuccaagacauug

SEQ ID NO: 2567854 - RNA, 22 nt, Human
guucauuauuggaauuaaccug

SEQ ID NO: 2567855 - RNA, 15 nt, Human
guucauguuugcuuc

SEQ ID NO: 2567856 - RNA, 15 nt, Human
guucauuauuggaau

SEQ ID NO: 2567857 - RNA, 16 nt, Human
guucauuaaagcauga

SEQ ID NO: 2567858 - RNA, 20 nt, Human
guucauuaaagcaugaaugg

SEQ ID NO: 2567859 - RNA, 16 nt, Human
guucauugcacuuuga

SEQ ID NO: 2567860 - RNA, 14 nt, Human
guucauuguaaugu

SEQ ID NO: 2567861 - RNA, 18 nt, Human
guucauuguaauguuacu

SEQ ID NO: 2567862 - RNA, 19 nt, Human
guucauuguaauguuacug

SEQ ID NO: 2567863 - RNA, 13 nt, Human
guucauuugugua

SEQ ID NO: 2567864 - RNA, 13 nt, Human
guucauuuccuca

SEQ ID NO: 2567865 - RNA, 20 nt, Human
guucauuguaauguuacuga

SEQ ID NO: 2567866 - RNA, 21 nt, Human
guucauuguaauguuacugau

SEQ ID NO: 2567867 - RNA, 22 nt, Human
guucauuguaauguuacugauc

SEQ ID NO: 2567868 - RNA, 23 nt, Human
guucauuguaauguuacugauca

SEQ ID NO: 2567869 - RNA, 13 nt, Human
guuccagccugcc

SEQ ID NO: 2567870 - RNA, 14 nt, Human
guuccagccugcca

SEQ ID NO: 2567871 - RNA, 14 nt, Human
guuccagcaccaca

SEQ ID NO: 2567872 - RNA, 23 nt, Human
guuccagcaauucuccugccuca

SEQ ID NO: 2567873 - RNA, 20 nt, Human
guuccagcaauucuccugcc

SEQ ID NO: 2567874 - RNA, 21 nt, Human
guuccagcaauucuccugccu

SEQ ID NO: 2567875 - RNA, 16 nt, Human
guuccacugagcucca

SEQ ID NO: 2567876 - RNA, 15 nt, Human
guuccacugagcucc

SEQ ID NO: 2567877 - RNA, 18 nt, Human
guuccacugagcuccaug

SEQ ID NO: 2567878 - RNA, 14 nt, Human
guuccacugagcuc

SEQ ID NO: 2567879 - RNA, 13 nt, Human
guuccacugagcu

SEQ ID NO: 2567880 - RNA, 20 nt, Human
guuccaccaucaagccacca

SEQ ID NO: 2567881 - RNA, 17 nt, Human
guuccaccaucaagcca

SEQ ID NO: 2567882 - RNA, 12 nt, Human
guuccacuaacc

SEQ ID NO: 2567883 - RNA, 16 nt, Human
guuccacguguuuuau

SEQ ID NO: 2567884 - RNA, 21 nt, Human
guuccacgucccccuggggcu

SEQ ID NO: 2567885 - RNA, 20 nt, Human
guuccacgucccccuggggc

SEQ ID NO: 2567886 - RNA, 14 nt, Human
guuccuaauccucu

SEQ ID NO: 2567887 - RNA, 21 nt, Human
guuccagggucccucugugua

SEQ ID NO: 2567888 - RNA, 20 nt, Human
guuccagggucccucugugu

SEQ ID NO: 2567889 - RNA, 15 nt, Human
guuccagccugccac

SEQ ID NO: 2567890 - RNA, 12 nt, Human
guuccagcucuu

SEQ ID NO: 2567891 - RNA, 19 nt, Human
guuccagggucccucugug

SEQ ID NO: 2567892 - RNA, 17 nt, Human
guuccagggucccucug

SEQ ID NO: 2567893 - RNA, 14 nt, Human
guuccagcucuuug

SEQ ID NO: 2567894 - RNA, 16 nt, Human
guuccagcucuuugaa

SEQ ID NO: 2567895 - RNA, 15 nt, Human
guuccuauugucauu

SEQ ID NO: 2567896 - RNA, 14 nt, Human
guuccuauugucau

SEQ ID NO: 2567897 - RNA, 22 nt, Human
guuccuauggcuggccacugca

SEQ ID NO: 2567898 - RNA, 22 nt, Human
guuccucauuagcauuuugcua

SEQ ID NO: 2567899 - RNA, 16 nt, Human
guuccuagccaccgcc

SEQ ID NO: 2567900 - RNA, 15 nt, Human
guuccuagaguagag

SEQ ID NO: 2567901 - RNA, 19 nt, Human
guuccuaagagugcugggc

SEQ ID NO: 2567902 - RNA, 23 nt, Human
guuccuggcaguuuaaaaaaauu

SEQ ID NO: 2567903 - RNA, 13 nt, Human
guuccuuagaccu

SEQ ID NO: 2567904 - RNA, 14 nt, Human
guuccuuacugcag

SEQ ID NO: 2567905 - RNA, 15 nt, Human
guuccuuacugcaga

SEQ ID NO: 2567906 - RNA, 14 nt, Human
guuccuggcaguuu

SEQ ID NO: 2567907 - RNA, 21 nt, Human
guuccuggcaauaguguguuc

SEQ ID NO: 2567908 - RNA, 13 nt, Human
guuccuggcaaua

SEQ ID NO: 2567909 - RNA, 12 nt, Human
guuccuggcaau

SEQ ID NO: 2567910 - RNA, 12 nt, Human
guuccugcaugc

SEQ ID NO: 2567911 - RNA, 16 nt, Human
guuccugaaccugaug

SEQ ID NO: 2567912 - RNA, 20 nt, Human
guuccugcggagugaagagg

SEQ ID NO: 2567913 - RNA, 19 nt, Human
guuccugcggagugaagag

SEQ ID NO: 2567914 - RNA, 21 nt, Human
guuccugaauucuauuugcug

SEQ ID NO: 2567915 - RNA, 14 nt, Human
guuccucuuugcau

SEQ ID NO: 2567916 - RNA, 15 nt, Human
guuccugcaaugaag

SEQ ID NO: 2567917 - RNA, 13 nt, Human
guuccucuuugca

SEQ ID NO: 2567918 - RNA, 15 nt, Human
guuccucugccugcc

SEQ ID NO: 2567919 - RNA, 16 nt, Human
guuccucugccugccc

SEQ ID NO: 2567920 - RNA, 14 nt, Human
guuccucugccugc

SEQ ID NO: 2567921 - RNA, 13 nt, Human
guuccucugccug

SEQ ID NO: 2567922 - RNA, 12 nt, Human
guuccucugccu

SEQ ID NO: 2567923 - RNA, 18 nt, Human
guuccuauugucauuaaa

SEQ ID NO: 2567924 - RNA, 23 nt, Human
guuccuccccuccuccuggacuc

SEQ ID NO: 2567925 - RNA, 13 nt, Human
guuccucgcccug

SEQ ID NO: 2567926 - RNA, 15 nt, Human
guuccucgcccuggg

SEQ ID NO: 2567927 - RNA, 16 nt, Human
guuccucgcccugggu

SEQ ID NO: 2567928 - RNA, 14 nt, Human
guuugaaaucuuuu

SEQ ID NO: 2567929 - RNA, 17 nt, Human
guuugaaacaaagaagg

SEQ ID NO: 2567930 - RNA, 16 nt, Human
guuugaauguuaaaua

SEQ ID NO: 2567931 - RNA, 15 nt, Human
guuugaauguuaaau

SEQ ID NO: 2567932 - RNA, 15 nt, Human
guuugaaacaaagaa

SEQ ID NO: 2567933 - RNA, 19 nt, Human
guuucuuuguaaugaaaac

SEQ ID NO: 2567934 - RNA, 17 nt, Human
guuucuuuaagaaagua

SEQ ID NO: 2567935 - RNA, 13 nt, Human
guuucccauaauu

SEQ ID NO: 2567936 - RNA, 16 nt, Human
guuucuuuagcaguuu

SEQ ID NO: 2567937 - RNA, 21 nt, Human
guuucuuuuguauguaaaugu

SEQ ID NO: 2567938 - RNA, 20 nt, Human
guuucuuuuguauguaaaug

SEQ ID NO: 2567939 - RNA, 17 nt, Human
guuucuuuuguauguaa

SEQ ID NO: 2567940 - RNA, 17 nt, Human
guuugaauguuaaauaa

SEQ ID NO: 2567941 - RNA, 16 nt, Human
guuugacuagaugaug

SEQ ID NO: 2567942 - RNA, 18 nt, Human
guuugacuagaugaugga

SEQ ID NO: 2567943 - RNA, 17 nt, Human
guuugagaucagccugg

SEQ ID NO: 2567944 - RNA, 23 nt, Human
guuugauuaaauucuugcaaagu

SEQ ID NO: 2567945 - RNA, 16 nt, Human
guuugaaacaaagaag

SEQ ID NO: 2567946 - RNA, 19 nt, Human
guuugacuagaugauggau

SEQ ID NO: 2567947 - RNA, 18 nt, Human
guuugagaucagccuggg

SEQ ID NO: 2567948 - RNA, 16 nt, Human
guuucuuagcuuuuua

SEQ ID NO: 2567949 - RNA, 13 nt, Human
guuucuuagcuuu

SEQ ID NO: 2567950 - RNA, 13 nt, Human
guuucuuccaaag

SEQ ID NO: 2567951 - RNA, 20 nt, Human
guuucuucaacaggagaauu

SEQ ID NO: 2567952 - RNA, 23 nt, Human
guuucuucauccggcagccugga

SEQ ID NO: 2567953 - RNA, 11 nt, Human
guuucuuccaa

SEQ ID NO: 2567954 - RNA, 18 nt, Human
guuucuuuguaaugaaaa

SEQ ID NO: 2567955 - RNA, 16 nt, Human
guuucuuuaguuuuug

SEQ ID NO: 2567956 - RNA, 14 nt, Human
guuuccucaggcug

SEQ ID NO: 2567957 - RNA, 16 nt, Human
guuuccucaggcugcu

SEQ ID NO: 2567958 - RNA, 21 nt, Human
guuucccaucccacugcuccc

SEQ ID NO: 2567959 - RNA, 19 nt, Human
guuucccaucccacugcuc

SEQ ID NO: 2567960 - RNA, 20 nt, Human
guuucccauaauuuucuuca

SEQ ID NO: 2567961 - RNA, 21 nt, Human
guuucccauaauuuucuucau

SEQ ID NO: 2567962 - RNA, 18 nt, Human
guuuccucuaguucuuug

SEQ ID NO: 2567963 - RNA, 18 nt, Human
guuuccucaggcugcugg

SEQ ID NO: 2567964 - RNA, 19 nt, Human
guuuccucaggcugcugga

SEQ ID NO: 2567965 - RNA, 22 nt, Human
guuuccucaggcugcuggagga

SEQ ID NO: 2567966 - RNA, 20 nt, Human
guuuccucauuccugaaaga

SEQ ID NO: 2567967 - RNA, 22 nt, Human
guuuccucuaguucuuuguuca

SEQ ID NO: 2567968 - RNA, 18 nt, Human
guuugagacacugguuua

SEQ ID NO: 2567969 - RNA, 15 nt, Human
guuugagaagcacug

SEQ ID NO: 2567970 - RNA, 20 nt, Human
guuugagaagaaaacaucua

SEQ ID NO: 2567971 - RNA, 21 nt, Human
guuugauucagacagcugccu

SEQ ID NO: 2567972 - RNA, 20 nt, Human
guuugauucagacagcugcc

SEQ ID NO: 2567973 - RNA, 16 nt, Human
guuugauucagacagc

SEQ ID NO: 2567974 - RNA, 17 nt, Human
guuuggggcgaggcaga

SEQ ID NO: 2567975 - RNA, 16 nt, Human
guuuggggcgaggcag

SEQ ID NO: 2567976 - RNA, 11 nt, Human
guuuggggcga

SEQ ID NO: 2567977 - RNA, 15 nt, Human
guuugguauuguauu

SEQ ID NO: 2567978 - RNA, 18 nt, Human
guuuggggcgaggcagag

SEQ ID NO: 2567979 - RNA, 16 nt, Human
guuuggguauauucau

SEQ ID NO: 2567980 - RNA, 22 nt, Human
guuugguggggguagagcugau

SEQ ID NO: 2567981 - RNA, 23 nt, Human
guuuggucugggacuuccuugcu

SEQ ID NO: 2567982 - RNA, 20 nt, Human
guuuguaaauuaacuuuuau

SEQ ID NO: 2567983 - RNA, 18 nt, Human
guuugguauuguauuuau

SEQ ID NO: 2567984 - RNA, 17 nt, Human
guuugguauuguauuua

SEQ ID NO: 2567985 - RNA, 15 nt, Human
guuuguauaacuucu

SEQ ID NO: 2567986 - RNA, 15 nt, Human
guuugguguguuccc

SEQ ID NO: 2567987 - RNA, 20 nt, Human
guuuguauguguguagacaa

SEQ ID NO: 2567988 - RNA, 16 nt, Human
guuuguauguauaauu

SEQ ID NO: 2567989 - RNA, 14 nt, Human
guuuguauguauaa

SEQ ID NO: 2567990 - RNA, 16 nt, Human
guuuguauaacuucuu

SEQ ID NO: 2567991 - RNA, 13 nt, Human
guuuguauauugu

SEQ ID NO: 2567992 - RNA, 21 nt, Human
guuugucauuagccugaguag

SEQ ID NO: 2567993 - RNA, 15 nt, Human
guuugucauuagccu

SEQ ID NO: 2567994 - RNA, 17 nt, Human
guuugucacaugaaaca

SEQ ID NO: 2567995 - RNA, 13 nt, Human
guuugucauuagc

SEQ ID NO: 2567996 - RNA, 18 nt, Human
guuugucgcucaugugug

SEQ ID NO: 2567997 - RNA, 15 nt, Human
guuuguggccucaga

SEQ ID NO: 2567998 - RNA, 13 nt, Human
guuuguaugugug

SEQ ID NO: 2567999 - RNA, 16 nt, Human
guuuguggccucagaa

SEQ ID NO: 2568000 - RNA, 18 nt, Human
guuuguuucugaaaggga

SEQ ID NO: 2568001 - RNA, 20 nt, Human
guuuguguguugucucuuga

SEQ ID NO: 2568002 - RNA, 15 nt, Human
guuuguguguugucu

SEQ ID NO: 2568003 - RNA, 15 nt, Human
guuugugugucuuaa

SEQ ID NO: 2568004 - RNA, 14 nt, Human
guuugugugucuua

SEQ ID NO: 2568005 - RNA, 13 nt, Human
guuugugugucuu

SEQ ID NO: 2568006 - RNA, 22 nt, Human
guuuguguauuuacgcuuugau

SEQ ID NO: 2568007 - RNA, 20 nt, Human
guuuguggcugggggcagga

SEQ ID NO: 2568008 - RNA, 22 nt, Human
guuuguggcugggggcaggagg

SEQ ID NO: 2568009 - RNA, 13 nt, Human
guuuguggcuggg

SEQ ID NO: 2568010 - RNA, 13 nt, Human
guuuucaagucaa

SEQ ID NO: 2568011 - RNA, 15 nt, Human
guuuucaagucaaau

SEQ ID NO: 2568012 - RNA, 17 nt, Human
guuuucaagucaaauua

SEQ ID NO: 2568013 - RNA, 18 nt, Human
guuuucaagucaaauuaa

SEQ ID NO: 2568014 - RNA, 21 nt, Human
guuuuauuuuuuauuguuuuc

SEQ ID NO: 2568015 - RNA, 20 nt, Human
guuuucaaaauuguuacaaa

SEQ ID NO: 2568016 - RNA, 17 nt, Human
guuuucaaaauaaaaau

SEQ ID NO: 2568017 - RNA, 12 nt, Human
guuuucacucuu

SEQ ID NO: 2568018 - RNA, 11 nt, Human
guuuucacucu

SEQ ID NO: 2568019 - RNA, 13 nt, Human
guuuucaaugaug

SEQ ID NO: 2568020 - RNA, 19 nt, Human
guuuucagaaccucuuccc

SEQ ID NO: 2568021 - RNA, 20 nt, Human
guuuucagaaccucuucccc

SEQ ID NO: 2568022 - RNA, 21 nt, Human
guuuucagaaccucuucccca

SEQ ID NO: 2568023 - RNA, 14 nt, Human
guuuucagacucag

SEQ ID NO: 2568024 - RNA, 16 nt, Human
guuuuaaaaugagaaa

SEQ ID NO: 2568025 - RNA, 15 nt, Human
guuuuaaaaugagaa

SEQ ID NO: 2568026 - RNA, 21 nt, Human
guuuuaaaaaaauaaaacauu

SEQ ID NO: 2568027 - RNA, 20 nt, Human
guuuuaaaaaaauaaaacau

SEQ ID NO: 2568028 - RNA, 22 nt, Human
guuuuaaaaaaauaaaacauuu

SEQ ID NO: 2568029 - RNA, 21 nt, Human
guuuuaaaauaaaaauucuga

SEQ ID NO: 2568030 - RNA, 24 nt, Human
guuuuaaaauaaaaauucugaaug

SEQ ID NO: 2568031 - RNA, 20 nt, Human
guuuguuucugaaagggacg

SEQ ID NO: 2568032 - RNA, 14 nt, Human
guuuguucaucugu

SEQ ID NO: 2568033 - RNA, 21 nt, Human
guuuguguguugucuugaaag

SEQ ID NO: 2568034 - RNA, 17 nt, Human
guuuguuacauagguau

SEQ ID NO: 2568035 - RNA, 19 nt, Human
guuuuaaaaaaauaaaaca

SEQ ID NO: 2568036 - RNA, 15 nt, Human
guuuuaaaaaaauaa

SEQ ID NO: 2568037 - RNA, 14 nt, Human
guuuguuuguuuca

SEQ ID NO: 2568038 - RNA, 21 nt, Human
guuuuguuccccuccuccacu

SEQ ID NO: 2568039 - RNA, 20 nt, Human
guuuuguuccccuccuccac

SEQ ID NO: 2568040 - RNA, 22 nt, Human
guuuuguuccccuccuccacuc

SEQ ID NO: 2568041 - RNA, 15 nt, Human
guuuuguucuuuaaa

SEQ ID NO: 2568042 - RNA, 17 nt, Human
guuuuguuccccuccuc

SEQ ID NO: 2568043 - RNA, 16 nt, Human
guuuuguuccccuccu

SEQ ID NO: 2568044 - RNA, 15 nt, Human
guuuuguuccccucc

SEQ ID NO: 2568045 - RNA, 14 nt, Human
guuuuguuccccuc

SEQ ID NO: 2568046 - RNA, 18 nt, Human
guuuuguaagaugcuggg

SEQ ID NO: 2568047 - RNA, 21 nt, Human
guuuugguaucuguucuuuaa

SEQ ID NO: 2568048 - RNA, 17 nt, Human
guuuuggugguuuuagu

SEQ ID NO: 2568049 - RNA, 16 nt, Human
guuuugguugcuuuaa

SEQ ID NO: 2568050 - RNA, 23 nt, Human
guuuuguaagaugcuggguuggu

SEQ ID NO: 2568051 - RNA, 17 nt, Human
guuuuguaagaugcugg

SEQ ID NO: 2568052 - RNA, 16 nt, Human
guuuuguaagaugcug

SEQ ID NO: 2568053 - RNA, 20 nt, Human
guuuuccaugaguccccugu

SEQ ID NO: 2568054 - RNA, 19 nt, Human
guuuuccaugaguccccug

SEQ ID NO: 2568055 - RNA, 20 nt, Human
guuuuccagguuuaagcugu

SEQ ID NO: 2568056 - RNA, 14 nt, Human
guuuuccaugaaaa

SEQ ID NO: 2568057 - RNA, 15 nt, Human
guuuuccaugaaaac

SEQ ID NO: 2568058 - RNA, 17 nt, Human
guuuuccaugaaaacgu

SEQ ID NO: 2568059 - RNA, 18 nt, Human
guuuuccaugaaaacguu

SEQ ID NO: 2568060 - RNA, 13 nt, Human
guuuuccaugaaa

SEQ ID NO: 2568061 - RNA, 17 nt, Human
guuuucagacucagacu

SEQ ID NO: 2568062 - RNA, 14 nt, Human
guuuuccucccuuc

SEQ ID NO: 2568063 - RNA, 13 nt, Human
guuuuccucccuu

SEQ ID NO: 2568064 - RNA, 15 nt, Human
guuuuccucccuucu

SEQ ID NO: 2568065 - RNA, 18 nt, Human
guuuuccucccuucugcu

SEQ ID NO: 2568066 - RNA, 22 nt, Human
guuuuccucccuucugcuacug

SEQ ID NO: 2568067 - RNA, 13 nt, Human
guuuuccugaaga

SEQ ID NO: 2568068 - RNA, 22 nt, Human
guuuucccgagcaaagucuaaa

SEQ ID NO: 2568069 - RNA, 17 nt, Human
guuuuccccucccuggg

SEQ ID NO: 2568070 - RNA, 17 nt, Human
guuuuccauuguuugaa

SEQ ID NO: 2568071 - RNA, 23 nt, Human
guuuucccgagcaaagucuaaag

SEQ ID NO: 2568072 - RNA, 21 nt, Human
guuuucccugaccucccucua

SEQ ID NO: 2568073 - RNA, 16 nt, Human
guuuuccuaaaugcag

SEQ ID NO: 2568074 - RNA, 17 nt, Human
guuuuccuaaaugcagu

SEQ ID NO: 2568075 - RNA, 22 nt, Human
guuuuccuauaauauaauaaau

SEQ ID NO: 2568076 - RNA, 20 nt, Human
guuuucccuugaggaaacaa

SEQ ID NO: 2568077 - RNA, 18 nt, Human
guuguuugagaaauuaag

SEQ ID NO: 2568078 - RNA, 22 nt, Human
guuguuugaugcauuaaaagaa

SEQ ID NO: 2568079 - RNA, 22 nt, Human
guuuacuagggaucccucaucu

SEQ ID NO: 2568080 - RNA, 16 nt, Human
guuuacuaugccugug

SEQ ID NO: 2568081 - RNA, 17 nt, Human
guuuacuaugccugugu

SEQ ID NO: 2568082 - RNA, 20 nt, Human
guuuacuaugccugugucuu

SEQ ID NO: 2568083 - RNA, 22 nt, Human
guuuaccugaauaaaugguagu

SEQ ID NO: 2568084 - RNA, 16 nt, Human
guuuaccugaauaaau

SEQ ID NO: 2568085 - RNA, 12 nt, Human
guuuaccuugua

SEQ ID NO: 2568086 - RNA, 16 nt, Human
guuuaccugugaaaua

SEQ ID NO: 2568087 - RNA, 14 nt, Human
guuuagauaauaca

SEQ ID NO: 2568088 - RNA, 15 nt, Human
guuuagauaauacac

SEQ ID NO: 2568089 - RNA, 16 nt, Human
guuuagaagaagugug

SEQ ID NO: 2568090 - RNA, 23 nt, Human
guuuaccuuuuaauuaaugaaau

SEQ ID NO: 2568091 - RNA, 13 nt, Human
guuuacuauuuua

SEQ ID NO: 2568092 - RNA, 20 nt, Human
guuguuuacuuaaagauuua

SEQ ID NO: 2568093 - RNA, 16 nt, Human
guuguuguuaaauauc

SEQ ID NO: 2568094 - RNA, 24 nt, Human
guuguuguuaaugaaaaugucaga

SEQ ID NO: 2568095 - RNA, 20 nt, Human
guuguuugauucagacagcu

SEQ ID NO: 2568096 - RNA, 15 nt, Human
guuguuucuuucuag

SEQ ID NO: 2568097 - RNA, 14 nt, Human
guuguuucuuucua

SEQ ID NO: 2568098 - RNA, 13 nt, Human
guuguuucuuucu

SEQ ID NO: 2568099 - RNA, 11 nt, Human
guuguuucuuu

SEQ ID NO: 2568100 - RNA, 14 nt, Human
guuguuacauuuuu

SEQ ID NO: 2568101 - RNA, 15 nt, Human
guuguuacauuuuua

SEQ ID NO: 2568102 - RNA, 21 nt, Human
guuguuacuaacuaaacucuc

SEQ ID NO: 2568103 - RNA, 20 nt, Human
guuguuacuaacuaaacucu

SEQ ID NO: 2568104 - RNA, 19 nt, Human
guuguuacuaacuaaacuc

SEQ ID NO: 2568105 - RNA, 16 nt, Human
guuguuauggaaacug

SEQ ID NO: 2568106 - RNA, 21 nt, Human
guuuagcuggaaaaguauguu

SEQ ID NO: 2568107 - RNA, 20 nt, Human
guuuagcuggaaaaguaugu

SEQ ID NO: 2568108 - RNA, 19 nt, Human
guuuaggaacuacugagga

SEQ ID NO: 2568109 - RNA, 20 nt, Human
guuuauauaagcuuguauuc

SEQ ID NO: 2568110 - RNA, 21 nt, Human
guuuauagagggccaagacuu

SEQ ID NO: 2568111 - RNA, 20 nt, Human
guuuauagagggccaagacu

SEQ ID NO: 2568112 - RNA, 20 nt, Human
guuuauagcaaacuuggaau

SEQ ID NO: 2568113 - RNA, 12 nt, Human
guuuauauaaau

SEQ ID NO: 2568114 - RNA, 15 nt, Human
guuuaguuaaaugag

SEQ ID NO: 2568115 - RNA, 18 nt, Human
guuuaguggcucaacauu

SEQ ID NO: 2568116 - RNA, 15 nt, Human
guuuauaccuuugcc

SEQ ID NO: 2568117 - RNA, 20 nt, Human
guuuaucauucaaguguaaa

SEQ ID NO: 2568118 - RNA, 17 nt, Human
guuuaucauucaagugu

SEQ ID NO: 2568119 - RNA, 16 nt, Human
guuuaucauucaagug

SEQ ID NO: 2568120 - RNA, 15 nt, Human
guuuaucauucaagu

SEQ ID NO: 2568121 - RNA, 14 nt, Human
guuuaucauucaag

SEQ ID NO: 2568122 - RNA, 19 nt, Human
guuuauaucucucaugcau

SEQ ID NO: 2568123 - RNA, 13 nt, Human
guuucauauuucu

SEQ ID NO: 2568124 - RNA, 17 nt, Human
guuucauacucuagauu

SEQ ID NO: 2568125 - RNA, 22 nt, Human
guuucagugucaaauaaacacu

SEQ ID NO: 2568126 - RNA, 18 nt, Human
guuucauacucuagauuu

SEQ ID NO: 2568127 - RNA, 20 nt, Human
guuucaggugacaugugaaa

SEQ ID NO: 2568128 - RNA, 16 nt, Human
guuucaggugacaugu

SEQ ID NO: 2568129 - RNA, 15 nt, Human
guuucaggugacaug

SEQ ID NO: 2568130 - RNA, 14 nt, Human
guuucaggugacau

SEQ ID NO: 2568131 - RNA, 23 nt, Human
guuucagugucaaauaaacacug

SEQ ID NO: 2568132 - RNA, 21 nt, Human
guuucagugucaaauaaacac

SEQ ID NO: 2568133 - RNA, 18 nt, Human
guuucauguaauccucaa

SEQ ID NO: 2568134 - RNA, 16 nt, Human
guuucauccuuuucau

SEQ ID NO: 2568135 - RNA, 14 nt, Human
guuucauauuucuu

SEQ ID NO: 2568136 - RNA, 18 nt, Human
guuucauguuuugugacu

SEQ ID NO: 2568137 - RNA, 15 nt, Human
guuucauucuccugc

SEQ ID NO: 2568138 - RNA, 19 nt, Human
guuucauguuuugugacua

SEQ ID NO: 2568139 - RNA, 16 nt, Human
guuucauucuccugcc

SEQ ID NO: 2568140 - RNA, 15 nt, Human
guuucccauaauuuu

SEQ ID NO: 2568141 - RNA, 22 nt, Human
guuguggauuuaacagaaaugu

SEQ ID NO: 2568142 - RNA, 15 nt, Human
guugugggugggaga

SEQ ID NO: 2568143 - RNA, 19 nt, Human
guuguggaaagccucugcu

SEQ ID NO: 2568144 - RNA, 21 nt, Human
guuguggagagugcaacagua

SEQ ID NO: 2568145 - RNA, 14 nt, Human
guuguguauagaug

SEQ ID NO: 2568146 - RNA, 17 nt, Human
guuguggugcugacaaa

SEQ ID NO: 2568147 - RNA, 16 nt, Human
guugugggugggagag

SEQ ID NO: 2568148 - RNA, 16 nt, Human
guuguguacguggaga

SEQ ID NO: 2568149 - RNA, 14 nt, Human
guugugguuaaucu

SEQ ID NO: 2568150 - RNA, 12 nt, Human
guuguguguggg

SEQ ID NO: 2568151 - RNA, 13 nt, Human
guuguguguggga

SEQ ID NO: 2568152 - RNA, 14 nt, Human
guugugugugggag

SEQ ID NO: 2568153 - RNA, 16 nt, Human
guugugugugggagug

SEQ ID NO: 2568154 - RNA, 12 nt, Human
guuguguuguca

SEQ ID NO: 2568155 - RNA, 14 nt, Human
guuguguugucacc

SEQ ID NO: 2568156 - RNA, 22 nt, Human
guugugugugggaguguguaau

SEQ ID NO: 2568157 - RNA, 16 nt, Human
guuguuaaugaaaaug

SEQ ID NO: 2568158 - RNA, 17 nt, Human
guuguuaaugaaaaugu

SEQ ID NO: 2568159 - RNA, 18 nt, Human
guuguuaaugaaaauguc

SEQ ID NO: 2568160 - RNA, 19 nt, Human
guuguuaaugaaaauguca

SEQ ID NO: 2568161 - RNA, 15 nt, Human
guuguuaauaaaagu

SEQ ID NO: 2568162 - RNA, 19 nt, Human
guugucucccuggcccuca

SEQ ID NO: 2568163 - RNA, 17 nt, Human
guugucucccuggcccu

SEQ ID NO: 2568164 - RNA, 16 nt, Human
guugucucccuggccc

SEQ ID NO: 2568165 - RNA, 15 nt, Human
guugucucccuggcc

SEQ ID NO: 2568166 - RNA, 18 nt, Human
guugucucuagagcaggg

SEQ ID NO: 2568167 - RNA, 14 nt, Human
guugucucccuggc

SEQ ID NO: 2568168 - RNA, 13 nt, Human
guugucucccugg

SEQ ID NO: 2568169 - RNA, 19 nt, Human
guugucugaagucacugca

SEQ ID NO: 2568170 - RNA, 22 nt, Human
guugucugaagucacugcacag

SEQ ID NO: 2568171 - RNA, 14 nt, Human
guugugaauguugu

SEQ ID NO: 2568172 - RNA, 17 nt, Human
guugugaccugaaguuc

SEQ ID NO: 2568173 - RNA, 13 nt, Human
guugugaccugaa

SEQ ID NO: 2568174 - RNA, 14 nt, Human
guugugaggccugg

SEQ ID NO: 2568175 - RNA, 13 nt, Human
guugugaggccug

SEQ ID NO: 2568176 - RNA, 17 nt, Human
guugugaccuuaguguu

SEQ ID NO: 2568177 - RNA, 18 nt, Human
guugugaccugaaguuca

SEQ ID NO: 2568178 - RNA, 21 nt, Human
guugugauagcuaacauuuua

SEQ ID NO: 2568179 - RNA, 20 nt, Human
guugugaguuuaccuuguau

SEQ ID NO: 2568180 - RNA, 17 nt, Human
guugugcaaauuaacag

SEQ ID NO: 2568181 - RNA, 16 nt, Human
guugugccccuuucca

SEQ ID NO: 2568182 - RNA, 22 nt, Human
guugugaggccuggccaggcac

SEQ ID NO: 2568183 - RNA, 12 nt, Human
guuggcuggggg

SEQ ID NO: 2568184 - RNA, 13 nt, Human
guuggcuggccuu

SEQ ID NO: 2568185 - RNA, 12 nt, Human
guuggcuggccu

SEQ ID NO: 2568186 - RNA, 14 nt, Human
guuggcuggaugaa

SEQ ID NO: 2568187 - RNA, 17 nt, Human
guuggcugggaacucac

SEQ ID NO: 2568188 - RNA, 13 nt, Human
guuggcugggccc

SEQ ID NO: 2568189 - RNA, 14 nt, Human
guuggcugggccca

SEQ ID NO: 2568190 - RNA, 16 nt, Human
guuggcugggcccaga

SEQ ID NO: 2568191 - RNA, 21 nt, Human
guuggcgcacccuccccuccc

SEQ ID NO: 2568192 - RNA, 19 nt, Human
guuggcgcacccuccccuc

SEQ ID NO: 2568193 - RNA, 18 nt, Human
guuggcgagaggaggggc

SEQ ID NO: 2568194 - RNA, 13 nt, Human
guuggccuccggc

SEQ ID NO: 2568195 - RNA, 20 nt, Human
guuggcugacuuccacaccu

SEQ ID NO: 2568196 - RNA, 14 nt, Human
guuggccccugccc

SEQ ID NO: 2568197 - RNA, 13 nt, Human
guuggccccugcc

SEQ ID NO: 2568198 - RNA, 17 nt, Human
guuggcccaagcucuug

SEQ ID NO: 2568199 - RNA, 13 nt, Human
guuggccucugca

SEQ ID NO: 2568200 - RNA, 13 nt, Human
guuggccugcacu

SEQ ID NO: 2568201 - RNA, 20 nt, Human
guuggccccugcccggcugc

SEQ ID NO: 2568202 - RNA, 12 nt, Human
guugucagcuga

SEQ ID NO: 2568203 - RNA, 17 nt, Human
guugucccucugcuacg

SEQ ID NO: 2568204 - RNA, 13 nt, Human
guugucccucugc

SEQ ID NO: 2568205 - RNA, 22 nt, Human
guuguccaauuguugacaguuc

SEQ ID NO: 2568206 - RNA, 20 nt, Human
guugucauugcuguuguccc

SEQ ID NO: 2568207 - RNA, 19 nt, Human
guuguccuccccuugggcg

SEQ ID NO: 2568208 - RNA, 16 nt, Human
guuguccuccccuugg

SEQ ID NO: 2568209 - RNA, 15 nt, Human
guuguccuaugggag

SEQ ID NO: 2568210 - RNA, 19 nt, Human
guuggcugggggccucagu

SEQ ID NO: 2568211 - RNA, 17 nt, Human
guugucaagucucugcu

SEQ ID NO: 2568212 - RNA, 22 nt, Human
guugucaagucucugcuggccc

SEQ ID NO: 2568213 - RNA, 15 nt, Human
guugucaauauuaaa

SEQ ID NO: 2568214 - RNA, 17 nt, Human
guuggcugggcccagaa

SEQ ID NO: 2568215 - RNA, 21 nt, Human
guugucaauauuaaauacaga

SEQ ID NO: 2568216 - RNA, 19 nt, Human
guugucaauauuaaauaca

SEQ ID NO: 2568217 - RNA, 17 nt, Human
guugucaauauuaaaua

SEQ ID NO: 2568218 - RNA, 16 nt, Human
guugucaauauuaaau

SEQ ID NO: 2568219 - RNA, 23 nt, Human
guugucaauauuaaauacagaca

SEQ ID NO: 2568220 - RNA, 18 nt, Human
uaaaaaugguuuaaaugg

SEQ ID NO: 2568221 - RNA, 19 nt, Human
uaaaaaugguuuaaauggu

SEQ ID NO: 2568222 - RNA, 13 nt, Human
uaaaaagauuugu

SEQ ID NO: 2568223 - RNA, 18 nt, Human
uaaaaauguaaauauucu

SEQ ID NO: 2568224 - RNA, 13 nt, Human
uaaaaauguaaau

SEQ ID NO: 2568225 - RNA, 14 nt, Human
uaaaaagaucacuu

SEQ ID NO: 2568226 - RNA, 18 nt, Human
uaaaaagauugaaguauu

SEQ ID NO: 2568227 - RNA, 20 nt, Human
uaaaaagauugaaguauuuu

SEQ ID NO: 2568228 - RNA, 21 nt, Human
uaaaaagaaggaaaaugaucu

SEQ ID NO: 2568229 - RNA, 20 nt, Human
uaaaaagaaggaaaaugauc

SEQ ID NO: 2568230 - RNA, 13 nt, Human
uaaaaagaaggaa

SEQ ID NO: 2568231 - RNA, 20 nt, Human
uaaaaagagagaaaacuuau

SEQ ID NO: 2568232 - RNA, 19 nt, Human
uaaaaagagagaaaacuua

SEQ ID NO: 2568233 - RNA, 21 nt, Human
uaaaaagacauucuuccaaaa

SEQ ID NO: 2568234 - RNA, 19 nt, Human
uaaaaagaaacaagaugcu

SEQ ID NO: 2568235 - RNA, 18 nt, Human
uaaaaagaaacaagaugc

SEQ ID NO: 2568236 - RNA, 16 nt, Human
uaaaaagaaacaagau

SEQ ID NO: 2568237 - RNA, 16 nt, Human
uaaaaacagcauugcu

SEQ ID NO: 2568238 - RNA, 22 nt, Human
uaaaaacaaaggagauaaaucu

SEQ ID NO: 2568239 - RNA, 20 nt, Human
guuuuuacccauauccccuc

SEQ ID NO: 2568240 - RNA, 18 nt, Human
guuuuuacccauaucccc

SEQ ID NO: 2568241 - RNA, 16 nt, Human
guuuuuacccauaucc

SEQ ID NO: 2568242 - RNA, 14 nt, Human
guuuuuacccauau

SEQ ID NO: 2568243 - RNA, 13 nt, Human
guuuuuacccaua

SEQ ID NO: 2568244 - RNA, 17 nt, Human
uaaaaacaaagaaauua

SEQ ID NO: 2568245 - RNA, 21 nt, Human
uaaaaacaaagaaauuaugug

SEQ ID NO: 2568246 - RNA, 19 nt, Human
guuuuguuuccuuucacug

SEQ ID NO: 2568247 - RNA, 18 nt, Human
guuuuguuugcuaucuua

SEQ ID NO: 2568248 - RNA, 15 nt, Human
guuuuguuugcuauc

SEQ ID NO: 2568249 - RNA, 19 nt, Human
guuuuuaagcuguuuccau

SEQ ID NO: 2568250 - RNA, 15 nt, Human
guuuuuaagcuguuu

SEQ ID NO: 2568251 - RNA, 14 nt, Human
guuuuuaagcuguu

SEQ ID NO: 2568252 - RNA, 13 nt, Human
guuuuuaagcugu

SEQ ID NO: 2568253 - RNA, 18 nt, Human
guuuuuaauauaaagccu

SEQ ID NO: 2568254 - RNA, 21 nt, Human
guuuuuaaggguuuguggaaa

SEQ ID NO: 2568255 - RNA, 17 nt, Human
guuuuuaauaaagacag

SEQ ID NO: 2568256 - RNA, 22 nt, Human
uaaaaauguuaaaauguauucu

SEQ ID NO: 2568257 - RNA, 17 nt, Human
uaaaaauucugaaugua

SEQ ID NO: 2568258 - RNA, 14 nt, Human
uaaaaauucugaau

SEQ ID NO: 2568259 - RNA, 20 nt, Human
uaaaaauguaaauauucuau

SEQ ID NO: 2568260 - RNA, 19 nt, Human
uaaaaauguaaauauucua

SEQ ID NO: 2568261 - RNA, 21 nt, Human
uaaaaauguaaauauucuaua

SEQ ID NO: 2568262 - RNA, 22 nt, Human
uaaaaauuguuaauuuuuccua

SEQ ID NO: 2568263 - RNA, 17 nt, Human
uaaaaauugugaucaga

SEQ ID NO: 2568264 - RNA, 15 nt, Human
uaaaaauucugaaug

SEQ ID NO: 2568265 - RNA, 23 nt, Human
uaaaaauuguuucaaaauaaaaa

SEQ ID NO: 2568266 - RNA, 17 nt, Human
uaaaacaaaauuuguuu

SEQ ID NO: 2568267 - RNA, 16 nt, Human
uaaaacaaaagcucau

SEQ ID NO: 2568268 - RNA, 22 nt, Human
uaaaacaagcacuaaacaaaga

SEQ ID NO: 2568269 - RNA, 15 nt, Human
uaaaacaacacucac

SEQ ID NO: 2568270 - RNA, 23 nt, Human
uaaaacacaacaucuuuuucuac

SEQ ID NO: 2568271 - RNA, 22 nt, Human
uaaaacacaacaucuuuuucua

SEQ ID NO: 2568272 - RNA, 17 nt, Human
uaaaacacaacaucuuu

SEQ ID NO: 2568273 - RNA, 23 nt, Human
uaaaacaauaaaauuuuuuuuca

SEQ ID NO: 2568274 - RNA, 14 nt, Human
uaaaacaauauugu

SEQ ID NO: 2568275 - RNA, 18 nt, Human
uaaaacaauauuguuucu

SEQ ID NO: 2568276 - RNA, 13 nt, Human
uaaaacagacacu

SEQ ID NO: 2568277 - RNA, 15 nt, Human
uaaaacagacacugg

SEQ ID NO: 2568278 - RNA, 17 nt, Human
uaaaacagacacuggca

SEQ ID NO: 2568279 - RNA, 18 nt, Human
uaaaacagacacuggcau

SEQ ID NO: 2568280 - RNA, 19 nt, Human
uaaaacagacacuggcaug

SEQ ID NO: 2568281 - RNA, 19 nt, Human
uaaaacacuuccauaaucu

SEQ ID NO: 2568282 - RNA, 21 nt, Human
uaaaacacaccuaagagaaaa

SEQ ID NO: 2568283 - RNA, 14 nt, Human
uaaaacagaagccu

SEQ ID NO: 2568284 - RNA, 18 nt, Human
uaaaaucauuucugcauc

SEQ ID NO: 2568285 - RNA, 22 nt, Human
uaaaaucauuucugcaucagcu

SEQ ID NO: 2568286 - RNA, 17 nt, Human
uaaaauccauacauuug

SEQ ID NO: 2568287 - RNA, 15 nt, Human
uaaaauccauacauu

SEQ ID NO: 2568288 - RNA, 10 nt, Human
uaaaaucauu

SEQ ID NO: 2568289 - RNA, 13 nt, Human
uaaaaucauuucu

SEQ ID NO: 2568290 - RNA, 22 nt, Human
uaaaagguauuaaauugauguu

SEQ ID NO: 2568291 - RNA, 19 nt, Human
uaaaaggugaccaaugaug

SEQ ID NO: 2568292 - RNA, 12 nt, Human
uaaaaggugacc

SEQ ID NO: 2568293 - RNA, 20 nt, Human
uaaaagggcucuuuagccag

SEQ ID NO: 2568294 - RNA, 21 nt, Human
uaaaagggauuacccaagcaa

SEQ ID NO: 2568295 - RNA, 20 nt, Human
uaaaagggauuacccaagca

SEQ ID NO: 2568296 - RNA, 19 nt, Human
uaaaagggauuacccaagc

SEQ ID NO: 2568297 - RNA, 18 nt, Human
uaaaaggccaaaccucug

SEQ ID NO: 2568298 - RNA, 21 nt, Human
uaaaagguaugcaaucaaauc

SEQ ID NO: 2568299 - RNA, 18 nt, Human
uaaaaggcaaauguguac

SEQ ID NO: 2568300 - RNA, 19 nt, Human
uaaaaggcaaauguguaca

SEQ ID NO: 2568301 - RNA, 15 nt, Human
uaaaaggccaaaccu

SEQ ID NO: 2568302 - RNA, 14 nt, Human
uaaaaggaagccaa

SEQ ID NO: 2568303 - RNA, 12 nt, Human
uaaaaggagcca

SEQ ID NO: 2568304 - RNA, 11 nt, Human
uaaaagcagca

SEQ ID NO: 2568305 - RNA, 20 nt, Human
uaaaagcagcaucugcuaau

SEQ ID NO: 2568306 - RNA, 19 nt, Human
uaaaaggaagccaaagagu

SEQ ID NO: 2568307 - RNA, 21 nt, Human
uaaaaggaaaucucaccccau

SEQ ID NO: 2568308 - RNA, 17 nt, Human
uaaaagcaauuccaacc

SEQ ID NO: 2568309 - RNA, 11 nt, Human
uaaaagcacac

SEQ ID NO: 2568310 - RNA, 19 nt, Human
uaaaagagguuuuucuuaa

SEQ ID NO: 2568311 - RNA, 21 nt, Human
uaaaagagguuuuucuuaaau

SEQ ID NO: 2568312 - RNA, 17 nt, Human
uaaaagauaaauauuau

SEQ ID NO: 2568313 - RNA, 14 nt, Human
uaaaagauacaguu

SEQ ID NO: 2568314 - RNA, 17 nt, Human
uaaaagauacaguuacu

SEQ ID NO: 2568315 - RNA, 20 nt, Human
uaaaagauacaguuacucag

SEQ ID NO: 2568316 - RNA, 20 nt, Human
uaaaagauauaagugcugua

SEQ ID NO: 2568317 - RNA, 19 nt, Human
uaaaagauauaagugcugu

SEQ ID NO: 2568318 - RNA, 18 nt, Human
uaaaagauauaagugcug

SEQ ID NO: 2568319 - RNA, 20 nt, Human
uaaaagauucauuuuuaauc

SEQ ID NO: 2568320 - RNA, 19 nt, Human
uaaaagauucauuuuuaau

SEQ ID NO: 2568321 - RNA, 14 nt, Human
uaaaagauucauuu

SEQ ID NO: 2568322 - RNA, 12 nt, Human
uaaaagauucau

SEQ ID NO: 2568323 - RNA, 21 nt, Human
uaaaagauacaguuacucaga

SEQ ID NO: 2568324 - RNA, 16 nt, Human
uaaaagauauaagugc

SEQ ID NO: 2568325 - RNA, 13 nt, Human
uaaaagauauaag

SEQ ID NO: 2568326 - RNA, 12 nt, Human
uaaaagauauaa

SEQ ID NO: 2568327 - RNA, 23 nt, Human
uaaaagauaacaagaucuuucag

SEQ ID NO: 2568328 - RNA, 17 nt, Human
uaaaagagauuucaaga

SEQ ID NO: 2568329 - RNA, 16 nt, Human
uaaaagagauuucaag

SEQ ID NO: 2568330 - RNA, 13 nt, Human
uaaaaccaaagag

SEQ ID NO: 2568331 - RNA, 20 nt, Human
uaaaagagauuucaagagau

SEQ ID NO: 2568332 - RNA, 18 nt, Human
uaaaagagauuucaagag

SEQ ID NO: 2568333 - RNA, 18 nt, Human
uaaaagagguuuuucuua

SEQ ID NO: 2568334 - RNA, 13 nt, Human
uaaaaccacagca

SEQ ID NO: 2568335 - RNA, 11 nt, Human
uaaaaccaaag

SEQ ID NO: 2568336 - RNA, 22 nt, Human
uaaaacauuuuaaauggacaga

SEQ ID NO: 2568337 - RNA, 18 nt, Human
uaaaacauuuucacacaa

SEQ ID NO: 2568338 - RNA, 14 nt, Human
uaaaacauuuuaaa

SEQ ID NO: 2568339 - RNA, 21 nt, Human
uaaaacauuuuaaauggacag

SEQ ID NO: 2568340 - RNA, 18 nt, Human
uaaaacauuuuaaaugga

SEQ ID NO: 2568341 - RNA, 17 nt, Human
uaaaacauuuuaaaugg

SEQ ID NO: 2568342 - RNA, 16 nt, Human
uaaaacauuuuaaaug

SEQ ID NO: 2568343 - RNA, 15 nt, Human
uaaaacauuuucaca

SEQ ID NO: 2568344 - RNA, 17 nt, Human
uaaaacauuuucacaca

SEQ ID NO: 2568345 - RNA, 17 nt, Human
uaaaacauuaagaaaau

SEQ ID NO: 2568346 - RNA, 16 nt, Human
uaaaacauuaagaaaa

SEQ ID NO: 2568347 - RNA, 14 nt, Human
uaaaacauuaagaa

SEQ ID NO: 2568348 - RNA, 12 nt, Human
uaaaacauuaau

SEQ ID NO: 2568349 - RNA, 13 nt, Human
uaaaacauuaaga

SEQ ID NO: 2568350 - RNA, 14 nt, Human
uaaaacauguaaua

SEQ ID NO: 2568351 - RNA, 12 nt, Human
uaaaacauguaa

SEQ ID NO: 2568352 - RNA, 16 nt, Human
uaaagcagcguuucua

SEQ ID NO: 2568353 - RNA, 17 nt, Human
uaaagcagcguuucuau

SEQ ID NO: 2568354 - RNA, 19 nt, Human
uaaagcagcguuucuauga

SEQ ID NO: 2568355 - RNA, 18 nt, Human
uaaagcaggcagaacuca

SEQ ID NO: 2568356 - RNA, 12 nt, Human
uaaagccuccuc

SEQ ID NO: 2568357 - RNA, 13 nt, Human
uaaagcauuuaua

SEQ ID NO: 2568358 - RNA, 22 nt, Human
uaaagcacagucugaugacaca

SEQ ID NO: 2568359 - RNA, 20 nt, Human
uaaagcagagggacuuugua

SEQ ID NO: 2568360 - RNA, 23 nt, Human
uaaagcaauuuuccuugaagccg

SEQ ID NO: 2568361 - RNA, 22 nt, Human
uaaagcaauuuuccuugaagcc

SEQ ID NO: 2568362 - RNA, 21 nt, Human
uaaagcaauuuuccuugaagc

SEQ ID NO: 2568363 - RNA, 20 nt, Human
uaaagcaauuuuccuugaag

SEQ ID NO: 2568364 - RNA, 19 nt, Human
uaaagcaauuuuccuugaa

SEQ ID NO: 2568365 - RNA, 17 nt, Human
uaaagcaauuuuccuug

SEQ ID NO: 2568366 - RNA, 16 nt, Human
uaaagcaauuuuccuu

SEQ ID NO: 2568367 - RNA, 15 nt, Human
uaaagcaauuuuccu

SEQ ID NO: 2568368 - RNA, 14 nt, Human
uaaagcaauuuucc

SEQ ID NO: 2568369 - RNA, 13 nt, Human
uaaagcaauuuuc

SEQ ID NO: 2568370 - RNA, 12 nt, Human
uaaagcaauuuu

SEQ ID NO: 2568371 - RNA, 11 nt, Human
uaaagcaauuu

SEQ ID NO: 2568372 - RNA, 15 nt, Human
uaaagcaauaugcau

SEQ ID NO: 2568373 - RNA, 17 nt, Human
uaaagcaauaugcauuu

SEQ ID NO: 2568374 - RNA, 22 nt, Human
uaaagcaacuguuaugaaauaa

SEQ ID NO: 2568375 - RNA, 20 nt, Human
uaaagcaacuguuaugaaau

SEQ ID NO: 2568376 - RNA, 23 nt, Human
uaaagcaacugucuauuucugcu

SEQ ID NO: 2568377 - RNA, 23 nt, Human
uaaagcaauaauggucccaucca

SEQ ID NO: 2568378 - RNA, 13 nt, Human
uaaagaaagagag

SEQ ID NO: 2568379 - RNA, 14 nt, Human
uaaagaaagagaga

SEQ ID NO: 2568380 - RNA, 22 nt, Human
uaaagcaacugucuauuucugc

SEQ ID NO: 2568381 - RNA, 12 nt, Human
uaaagaaagaga

SEQ ID NO: 2568382 - RNA, 19 nt, Human
uaaagaaaauaucugaaau

SEQ ID NO: 2568383 - RNA, 12 nt, Human
uaaagaaaacug

SEQ ID NO: 2568384 - RNA, 18 nt, Human
uaaagaaaaucucuguga

SEQ ID NO: 2568385 - RNA, 21 nt, Human
uaaaggcccuaucuguuuaca

SEQ ID NO: 2568386 - RNA, 15 nt, Human
uaaaggcuaccuuug

SEQ ID NO: 2568387 - RNA, 13 nt, Human
uaaaggaaaugau

SEQ ID NO: 2568388 - RNA, 16 nt, Human
uaaaggaaaugauuga

SEQ ID NO: 2568389 - RNA, 20 nt, Human
uaaagccugaguuugcuuuc

SEQ ID NO: 2568390 - RNA, 14 nt, Human
uaaagcugaaaacu

SEQ ID NO: 2568391 - RNA, 16 nt, Human
uaaagcugccuguagu

SEQ ID NO: 2568392 - RNA, 17 nt, Human
uaaagcugccuguaguu

SEQ ID NO: 2568393 - RNA, 19 nt, Human
uaaagcuugcaacaaaauu

SEQ ID NO: 2568394 - RNA, 23 nt, Human
uaaagcugccuguaguuaggaaa

SEQ ID NO: 2568395 - RNA, 18 nt, Human
uaaagcugccuguaguua

SEQ ID NO: 2568396 - RNA, 21 nt, Human
uaaagcugccuguaguuagga

SEQ ID NO: 2568397 - RNA, 14 nt, Human
uaaaguguuugaaa

SEQ ID NO: 2568398 - RNA, 17 nt, Human
uaaaggcuaccuuugua

SEQ ID NO: 2568399 - RNA, 22 nt, Human
uaaaguguccauugacauguac

SEQ ID NO: 2568400 - RNA, 21 nt, Human
uaaaguguccauugacaugua

SEQ ID NO: 2568401 - RNA, 20 nt, Human
uaaaguguccauugacaugu

SEQ ID NO: 2568402 - RNA, 18 nt, Human
uaaaguguccauugacau

SEQ ID NO: 2568403 - RNA, 20 nt, Human
uaaaggccucuuccuugcug

SEQ ID NO: 2568404 - RNA, 16 nt, Human
uaaaguuacuuuguca

SEQ ID NO: 2568405 - RNA, 17 nt, Human
uaaaguguuucuguuau

SEQ ID NO: 2568406 - RNA, 18 nt, Human
uaaaguguguuguugcuu

SEQ ID NO: 2568407 - RNA, 17 nt, Human
uaaaguguguuguugcu

SEQ ID NO: 2568408 - RNA, 20 nt, Human
uaaaguguggucccaacagg

SEQ ID NO: 2568409 - RNA, 18 nt, Human
uaaaguguggucccaaca

SEQ ID NO: 2568410 - RNA, 23 nt, Human
uaaaguguccauugacauguaca

SEQ ID NO: 2568411 - RNA, 17 nt, Human
uaaaguguguuucuaug

SEQ ID NO: 2568412 - RNA, 20 nt, Human
uaaaguuagucuacucuuaa

SEQ ID NO: 2568413 - RNA, 16 nt, Human
uaaaguuagucuacuc

SEQ ID NO: 2568414 - RNA, 18 nt, Human
uaaaguguuucuguuauu

SEQ ID NO: 2568415 - RNA, 15 nt, Human
uaaaguuagucuacu

SEQ ID NO: 2568416 - RNA, 23 nt, Human
uaaacacccaugaaucaaagaca

SEQ ID NO: 2568417 - RNA, 22 nt, Human
uaaacacccaugaaucaaagac

SEQ ID NO: 2568418 - RNA, 18 nt, Human
uaaacacgccugcaaacg

SEQ ID NO: 2568419 - RNA, 17 nt, Human
uaaacacucuugaaaaa

SEQ ID NO: 2568420 - RNA, 15 nt, Human
uaaacacucuugaaa

SEQ ID NO: 2568421 - RNA, 18 nt, Human
uaaacacucuugaaaaau

SEQ ID NO: 2568422 - RNA, 16 nt, Human
uaaacaucacacacac

SEQ ID NO: 2568423 - RNA, 18 nt, Human
uaaacacccuucacauac

SEQ ID NO: 2568424 - RNA, 15 nt, Human
uaaacaucacacaca

SEQ ID NO: 2568425 - RNA, 20 nt, Human
uaaacauccaauauuuucuu

SEQ ID NO: 2568426 - RNA, 17 nt, Human
uaaacauccaauauuuu

SEQ ID NO: 2568427 - RNA, 17 nt, Human
uaaacauccuucaagaa

SEQ ID NO: 2568428 - RNA, 23 nt, Human
uaaaaucagccaauuauguuaaa

SEQ ID NO: 2568429 - RNA, 15 nt, Human
uaaaaucauguacau

SEQ ID NO: 2568430 - RNA, 18 nt, Human
uaaaaucauguacauuuc

SEQ ID NO: 2568431 - RNA, 19 nt, Human
uaaaaucauguacauuucu

SEQ ID NO: 2568432 - RNA, 13 nt, Human
uaaaaucugucac

SEQ ID NO: 2568433 - RNA, 14 nt, Human
uaaaaucugucacg

SEQ ID NO: 2568434 - RNA, 13 nt, Human
uaaaaucuuaaac

SEQ ID NO: 2568435 - RNA, 19 nt, Human
uaaaaucuuggcacagaaa

SEQ ID NO: 2568436 - RNA, 16 nt, Human
uaaaaucuugaaaaug

SEQ ID NO: 2568437 - RNA, 21 nt, Human
uaaacaagaccacguuucuaa

SEQ ID NO: 2568438 - RNA, 22 nt, Human
uaaacaagaccacguuucuaaa

SEQ ID NO: 2568439 - RNA, 20 nt, Human
uaaacaagaccacguuucua

SEQ ID NO: 2568440 - RNA, 19 nt, Human
uaaacaagaccacguuucu

SEQ ID NO: 2568441 - RNA, 20 nt, Human
uaaaaucuuggcacagaaac

SEQ ID NO: 2568442 - RNA, 17 nt, Human
uaaagaaaaagucaucc

SEQ ID NO: 2568443 - RNA, 18 nt, Human
uaaacuuuuuuuugagaa

SEQ ID NO: 2568444 - RNA, 17 nt, Human
uaaacuuuuuuuugaga

SEQ ID NO: 2568445 - RNA, 21 nt, Human
uaaacuucucugaagggaggu

SEQ ID NO: 2568446 - RNA, 20 nt, Human
uaaacuucucugaagggagg

SEQ ID NO: 2568447 - RNA, 17 nt, Human
uaaacuucucugaaggg

SEQ ID NO: 2568448 - RNA, 14 nt, Human
uaaacuucucugaa

SEQ ID NO: 2568449 - RNA, 18 nt, Human
uaaacuuccccaucuucu

SEQ ID NO: 2568450 - RNA, 22 nt, Human
uaaacuugguuuuuaaaaaacu

SEQ ID NO: 2568451 - RNA, 21 nt, Human
uaaacuuagaauaaaauugua

SEQ ID NO: 2568452 - RNA, 20 nt, Human
uaaacuuagaauaaaauugu

SEQ ID NO: 2568453 - RNA, 19 nt, Human
uaaacuuagaauaaaauug

SEQ ID NO: 2568454 - RNA, 22 nt, Human
uaaacuguguggacugugaugc

SEQ ID NO: 2568455 - RNA, 13 nt, Human
uaaacuguguuua

SEQ ID NO: 2568456 - RNA, 20 nt, Human
uaaacuucauggucaugggu

SEQ ID NO: 2568457 - RNA, 22 nt, Human
uaaacuuagugcggacaaguuu

SEQ ID NO: 2568458 - RNA, 12 nt, Human
uaaacugugcac

SEQ ID NO: 2568459 - RNA, 14 nt, Human
uaaacugugcacca

SEQ ID NO: 2568460 - RNA, 19 nt, Human
uaaacauugguucuuguau

SEQ ID NO: 2568461 - RNA, 15 nt, Human
uaaacuguguacaua

SEQ ID NO: 2568462 - RNA, 18 nt, Human
uaaacuguguacauaacu

SEQ ID NO: 2568463 - RNA, 17 nt, Human
uaaacuguguauuccaa

SEQ ID NO: 2568464 - RNA, 22 nt, Human
uaaacuguguauuccaagacau

SEQ ID NO: 2568465 - RNA, 13 nt, Human
uaaacugugugca

SEQ ID NO: 2568466 - RNA, 20 nt, Human
uaaacuguguggacugugau

SEQ ID NO: 2568467 - RNA, 12 nt, Human
uaaacuguguuu

SEQ ID NO: 2568468 - RNA, 15 nt, Human
uaaacauguguuuua

SEQ ID NO: 2568469 - RNA, 12 nt, Human
uaaacauguguu

SEQ ID NO: 2568470 - RNA, 18 nt, Human
uaaacaugguuacaauca

SEQ ID NO: 2568471 - RNA, 13 nt, Human
uaaacauguguuu

SEQ ID NO: 2568472 - RNA, 16 nt, Human
uaaacaugguuacaau

SEQ ID NO: 2568473 - RNA, 20 nt, Human
uaaacauuaguguucauagc

SEQ ID NO: 2568474 - RNA, 22 nt, Human
uaaacauuaaucaaucaucugu

SEQ ID NO: 2568475 - RNA, 18 nt, Human
uaaacauugaaguaauga

SEQ ID NO: 2568476 - RNA, 21 nt, Human
uaaacauugguucuuguauua

SEQ ID NO: 2568477 - RNA, 16 nt, Human
uaaaccaaaaacugaa

SEQ ID NO: 2568478 - RNA, 22 nt, Human
uaaaugucucuuuaaugucaca

SEQ ID NO: 2568479 - RNA, 20 nt, Human
uaaaugucuaguuguaacac

SEQ ID NO: 2568480 - RNA, 19 nt, Human
uaaauguaucuuauucaca

SEQ ID NO: 2568481 - RNA, 14 nt, Human
uaaauguaacaguc

SEQ ID NO: 2568482 - RNA, 13 nt, Human
uaaauguaacagu

SEQ ID NO: 2568483 - RNA, 17 nt, Human
uaaauguaaagauauuu

SEQ ID NO: 2568484 - RNA, 18 nt, Human
uaaauguaacagucugau

SEQ ID NO: 2568485 - RNA, 17 nt, Human
uaaauguaacagucuga

SEQ ID NO: 2568486 - RNA, 19 nt, Human
uaaauguaacagucugauc

SEQ ID NO: 2568487 - RNA, 13 nt, Human
uaaauguaaagau

SEQ ID NO: 2568488 - RNA, 16 nt, Human
uaaauguaaagauauu

SEQ ID NO: 2568489 - RNA, 21 nt, Human
uaaaugguguacauaauguau

SEQ ID NO: 2568490 - RNA, 16 nt, Human
uaaauguagguaugaa

SEQ ID NO: 2568491 - RNA, 18 nt, Human
uaaaugggggugcauuug

SEQ ID NO: 2568492 - RNA, 19 nt, Human
uaaaugggggugcauuuga

SEQ ID NO: 2568493 - RNA, 17 nt, Human
uaaaugguguacauaau

SEQ ID NO: 2568494 - RNA, 16 nt, Human
uaaaugguguacauaa

SEQ ID NO: 2568495 - RNA, 15 nt, Human
uaaaugguguacaua

SEQ ID NO: 2568496 - RNA, 20 nt, Human
uaaaugguauagcaaauguu

SEQ ID NO: 2568497 - RNA, 14 nt, Human
uaaaugguuaaaag

SEQ ID NO: 2568498 - RNA, 17 nt, Human
uaaauggggcucacaaa

SEQ ID NO: 2568499 - RNA, 16 nt, Human
uaaauggguagagaaa

SEQ ID NO: 2568500 - RNA, 14 nt, Human
uaaaugguauagca

SEQ ID NO: 2568501 - RNA, 17 nt, Human
uaaauggucgcccagga

SEQ ID NO: 2568502 - RNA, 14 nt, Human
uaaaugggggugca

SEQ ID NO: 2568503 - RNA, 17 nt, Human
uaaaugggggugcauuu

SEQ ID NO: 2568504 - RNA, 20 nt, Human
uaaauggcuuccuggcaaua

SEQ ID NO: 2568505 - RNA, 23 nt, Human
uaaauggccucauguggcuggaa

SEQ ID NO: 2568506 - RNA, 11 nt, Human
uaaauggcugc

SEQ ID NO: 2568507 - RNA, 13 nt, Human
uaaaugcccagcc

SEQ ID NO: 2568508 - RNA, 16 nt, Human
uaaaguuuacaguaaa

SEQ ID NO: 2568509 - RNA, 14 nt, Human
uaaaguuuacagua

SEQ ID NO: 2568510 - RNA, 13 nt, Human
uaaaguuuacagu

SEQ ID NO: 2568511 - RNA, 23 nt, Human
uaaaguuuacaguaaauaaauug

SEQ ID NO: 2568512 - RNA, 17 nt, Human
uaaaguuuacaguaaau

SEQ ID NO: 2568513 - RNA, 16 nt, Human
uaaaguugguaaaccu

SEQ ID NO: 2568514 - RNA, 17 nt, Human
uaaaguugguaaaccuu

SEQ ID NO: 2568515 - RNA, 23 nt, Human
uaaaguucuguacucaaauguag

SEQ ID NO: 2568516 - RNA, 17 nt, Human
uaaaguucugaguguuu

SEQ ID NO: 2568517 - RNA, 17 nt, Human
uaaaugcccagccccuu

SEQ ID NO: 2568518 - RNA, 16 nt, Human
uaaaugcccagccccu

SEQ ID NO: 2568519 - RNA, 15 nt, Human
uaaaugcccagcccc

SEQ ID NO: 2568520 - RNA, 14 nt, Human
uaaaugcccagccc

SEQ ID NO: 2568521 - RNA, 17 nt, Human
uaaauggaaaaaaugau

SEQ ID NO: 2568522 - RNA, 21 nt, Human
uaaaugcuuugugugauugaa

SEQ ID NO: 2568523 - RNA, 17 nt, Human
uaaaugcuuuaugcaaa

SEQ ID NO: 2568524 - RNA, 23 nt, Human
uaaaugcuauuuuuuauuuuacu

SEQ ID NO: 2568525 - RNA, 15 nt, Human
uaaaugcuauuuuuu

SEQ ID NO: 2568526 - RNA, 14 nt, Human
uaaaugcuauuuuu

SEQ ID NO: 2568527 - RNA, 13 nt, Human
uaaaugcuauuuu

SEQ ID NO: 2568528 - RNA, 16 nt, Human
uaaauggaaccacucu

SEQ ID NO: 2568529 - RNA, 22 nt, Human
uaaauggccucauguggcugga

SEQ ID NO: 2568530 - RNA, 16 nt, Human
uaaauggccucaugug

SEQ ID NO: 2568531 - RNA, 12 nt, Human
uaaauggccuca

SEQ ID NO: 2568532 - RNA, 16 nt, Human
uaaaugugccuucauu

SEQ ID NO: 2568533 - RNA, 19 nt, Human
uaaaugugaugaauacugu

SEQ ID NO: 2568534 - RNA, 23 nt, Human
uaaaugucuuuuuuuuaaugugc

SEQ ID NO: 2568535 - RNA, 22 nt, Human
uaaaugucuuuuuuuuaaugug

SEQ ID NO: 2568536 - RNA, 21 nt, Human
uaaaugucuuuuuuuuaaugu

SEQ ID NO: 2568537 - RNA, 12 nt, Human
uaaaugucuguu

SEQ ID NO: 2568538 - RNA, 16 nt, Human
uaaaugucuaauguau

SEQ ID NO: 2568539 - RNA, 15 nt, Human
uaaaugucuaaugua

SEQ ID NO: 2568540 - RNA, 12 nt, Human
uaaaugucuaau

SEQ ID NO: 2568541 - RNA, 21 nt, Human
uaaaugugcauucuuuuaaaa

SEQ ID NO: 2568542 - RNA, 16 nt, Human
uaaaugugcauucuuu

SEQ ID NO: 2568543 - RNA, 16 nt, Human
uaaaugugcuuuuaaa

SEQ ID NO: 2568544 - RNA, 11 nt, Human
uaaauuauuuu

SEQ ID NO: 2568545 - RNA, 20 nt, Human
uaaauucaaccacuguaaaa

SEQ ID NO: 2568546 - RNA, 23 nt, Human
uaaaugugcauucuuuuaaaaga

SEQ ID NO: 2568547 - RNA, 16 nt, Human
uaaauucacaaacuuu

SEQ ID NO: 2568548 - RNA, 23 nt, Human
uaaauucaaccacuguaaaauga

SEQ ID NO: 2568549 - RNA, 18 nt, Human
uaaauucacaaacuuuua

SEQ ID NO: 2568550 - RNA, 22 nt, Human
uaaauucaccuagucuaaggau

SEQ ID NO: 2568551 - RNA, 17 nt, Human
uaaauucacaauagaaa

SEQ ID NO: 2568552 - RNA, 18 nt, Human
uaaauucagauauauuuu

SEQ ID NO: 2568553 - RNA, 20 nt, Human
uaaauucagauauauuuuuc

SEQ ID NO: 2568554 - RNA, 23 nt, Human
uaaauucagauauauuuuucaca

SEQ ID NO: 2568555 - RNA, 17 nt, Human
uaaauucuugcaaagua

SEQ ID NO: 2568556 - RNA, 18 nt, Human
uaaauucuugcaaaguau

SEQ ID NO: 2568557 - RNA, 22 nt, Human
uaaauucuugcaaaguaucccu

SEQ ID NO: 2568558 - RNA, 20 nt, Human
uaaauuccucuuugcuuugc

SEQ ID NO: 2568559 - RNA, 16 nt, Human
uaaauuccucuuugcu

SEQ ID NO: 2568560 - RNA, 17 nt, Human
uaaauuccucuuugcuu

SEQ ID NO: 2568561 - RNA, 18 nt, Human
uaaauuccucuuugcuuu

SEQ ID NO: 2568562 - RNA, 19 nt, Human
uaaauuccucuuugcuuug

SEQ ID NO: 2568563 - RNA, 16 nt, Human
uaaauucuugcaaagu

SEQ ID NO: 2568564 - RNA, 12 nt, Human
uaaauuccucuu

SEQ ID NO: 2568565 - RNA, 14 nt, Human
uaaauuccucuuug

SEQ ID NO: 2568566 - RNA, 16 nt, Human
uaaauuccacuggacu

SEQ ID NO: 2568567 - RNA, 20 nt, Human
uaaauucauuuuaauuuugu

SEQ ID NO: 2568568 - RNA, 13 nt, Human
uaaauucauuuua

SEQ ID NO: 2568569 - RNA, 18 nt, Human
uaaauucaguccuaagaa

SEQ ID NO: 2568570 - RNA, 14 nt, Human
uaaauucaguccua

SEQ ID NO: 2568571 - RNA, 13 nt, Human
uaaauuccacugg

SEQ ID NO: 2568572 - RNA, 14 nt, Human
uaaauuccacugga

SEQ ID NO: 2568573 - RNA, 13 nt, Human
uaaauuuauguga

SEQ ID NO: 2568574 - RNA, 17 nt, Human
uaaauugaauaauggua

SEQ ID NO: 2568575 - RNA, 16 nt, Human
uaaauugaauaauggu

SEQ ID NO: 2568576 - RNA, 13 nt, Human
uaaauugaauaau

SEQ ID NO: 2568577 - RNA, 12 nt, Human
uaaauugaauaa

SEQ ID NO: 2568578 - RNA, 23 nt, Human
uaaauugacacuuaaaaaugguu

SEQ ID NO: 2568579 - RNA, 20 nt, Human
uaaauugacacuuaaaaaug

SEQ ID NO: 2568580 - RNA, 23 nt, Human
uaaauuuccccaacagugugaag

SEQ ID NO: 2568581 - RNA, 21 nt, Human
uaaauuuccccaacaguguga

SEQ ID NO: 2568582 - RNA, 20 nt, Human
uaaauuuccccaacagugug

SEQ ID NO: 2568583 - RNA, 14 nt, Human
uaaauuugaauguu

SEQ ID NO: 2568584 - RNA, 22 nt, Human
uaaauuuccccaacagugugaa

SEQ ID NO: 2568585 - RNA, 22 nt, Human
uaaauuugaauguuaagcagau

SEQ ID NO: 2568586 - RNA, 19 nt, Human
uaaauugaaucaguauaaa

SEQ ID NO: 2568587 - RNA, 22 nt, Human
uaaauugaaucaguauaaacaa

SEQ ID NO: 2568588 - RNA, 14 nt, Human
uaaauuuauuuacu

SEQ ID NO: 2568589 - RNA, 15 nt, Human
uaaauuuauuuacug

SEQ ID NO: 2568590 - RNA, 18 nt, Human
uaaauuuauuuacugcua

SEQ ID NO: 2568591 - RNA, 15 nt, Human
uaaauuuauuucaaa

SEQ ID NO: 2568592 - RNA, 19 nt, Human
uaaauuuccccaacagugu

SEQ ID NO: 2568593 - RNA, 18 nt, Human
uaaauuuccccaacagug

SEQ ID NO: 2568594 - RNA, 17 nt, Human
uaaauuuccccaacagu

SEQ ID NO: 2568595 - RNA, 17 nt, Human
uaaauuuauuucaaaaa

SEQ ID NO: 2568596 - RNA, 18 nt, Human
uaacaccaugauuaacca

SEQ ID NO: 2568597 - RNA, 23 nt, Human
uaacacauuuuguauaauuguau

SEQ ID NO: 2568598 - RNA, 18 nt, Human
uaacacauuuuguauaau

SEQ ID NO: 2568599 - RNA, 17 nt, Human
uaacacauuuuguauaa

SEQ ID NO: 2568600 - RNA, 17 nt, Human
uaacacauuugauucug

SEQ ID NO: 2568601 - RNA, 14 nt, Human
uaacacauuuugua

SEQ ID NO: 2568602 - RNA, 22 nt, Human
uaacacauuaucgggagcagug

SEQ ID NO: 2568603 - RNA, 23 nt, Human
uaaauuuguaaguuucaggugac

SEQ ID NO: 2568604 - RNA, 20 nt, Human
uaaauuuguaaguuucaggu

SEQ ID NO: 2568605 - RNA, 19 nt, Human
uaaauuuguaaguuucagg

SEQ ID NO: 2568606 - RNA, 18 nt, Human
uaaauuuguaaguuucag

SEQ ID NO: 2568607 - RNA, 17 nt, Human
uaaauuuguaaguuuca

SEQ ID NO: 2568608 - RNA, 16 nt, Human
uaaauuuguaaguuuc

SEQ ID NO: 2568609 - RNA, 15 nt, Human
uaaauuuguaaguuu

SEQ ID NO: 2568610 - RNA, 13 nt, Human
uaaauuuguaagu

SEQ ID NO: 2568611 - RNA, 12 nt, Human
uaaauuuguaag

SEQ ID NO: 2568612 - RNA, 15 nt, Human
uaacacuauuuuaug

SEQ ID NO: 2568613 - RNA, 14 nt, Human
uaacacuauuuuau

SEQ ID NO: 2568614 - RNA, 19 nt, Human
uaacacuauguuuauuuac

SEQ ID NO: 2568615 - RNA, 16 nt, Human
uaacacuauaaagguu

SEQ ID NO: 2568616 - RNA, 13 nt, Human
uaacacuggcccc

SEQ ID NO: 2568617 - RNA, 15 nt, Human
uaacacuggccccua

SEQ ID NO: 2568618 - RNA, 17 nt, Human
uaacaccugauguguac

SEQ ID NO: 2568619 - RNA, 16 nt, Human
uaacaccugaugugua

SEQ ID NO: 2568620 - RNA, 14 nt, Human
uaacaccugaugug

SEQ ID NO: 2568621 - RNA, 19 nt, Human
uaacacauuuuguauaauu

SEQ ID NO: 2568622 - RNA, 21 nt, Human
uaacaccagguuuauggaaaa

SEQ ID NO: 2568623 - RNA, 15 nt, Human
uaacuggaaacuuca

SEQ ID NO: 2568624 - RNA, 17 nt, Human
uaacugugaaguuuaca

SEQ ID NO: 2568625 - RNA, 18 nt, Human
uaacuggagccccaucag

SEQ ID NO: 2568626 - RNA, 18 nt, Human
uaacuuuuguaagacaaa

SEQ ID NO: 2568627 - RNA, 13 nt, Human
uaacuuuuguaag

SEQ ID NO: 2568628 - RNA, 20 nt, Human
uaacuuuuguaaauacacau

SEQ ID NO: 2568629 - RNA, 16 nt, Human
uaacuguuauuuauaa

SEQ ID NO: 2568630 - RNA, 17 nt, Human
uaacuguuauuuauaau

SEQ ID NO: 2568631 - RNA, 22 nt, Human
uaacuguuaaauugcuguguau

SEQ ID NO: 2568632 - RNA, 18 nt, Human
uaacugugaaguuuacau

SEQ ID NO: 2568633 - RNA, 22 nt, Human
uaacuggaagcauguaggagaa

SEQ ID NO: 2568634 - RNA, 19 nt, Human
uaagaaaaaggaugcacag

SEQ ID NO: 2568635 - RNA, 23 nt, Human
uaagaaaaaggaugcacagaguu

SEQ ID NO: 2568636 - RNA, 17 nt, Human
uaagaaaaaucauguuu

SEQ ID NO: 2568637 - RNA, 14 nt, Human
uaagaaaaaucaug

SEQ ID NO: 2568638 - RNA, 22 nt, Human
uaagaaaagagauauuuuaaaa

SEQ ID NO: 2568639 - RNA, 18 nt, Human
uaagaaaagagauauuuu

SEQ ID NO: 2568640 - RNA, 16 nt, Human
uaagaaaagauguaga

SEQ ID NO: 2568641 - RNA, 14 nt, Human
uaagaaaagagaua

SEQ ID NO: 2568642 - RNA, 16 nt, Human
uaagaaaaaucauguu

SEQ ID NO: 2568643 - RNA, 16 nt, Human
uaagaaaacaucacug

SEQ ID NO: 2568644 - RNA, 16 nt, Human
uaagaaaaaggaugca

SEQ ID NO: 2568645 - RNA, 18 nt, Human
uaagaaaaaggaugcaca

SEQ ID NO: 2568646 - RNA, 20 nt, Human
uaagaaaaaauaacacacau

SEQ ID NO: 2568647 - RNA, 13 nt, Human
uaagagagaauga

SEQ ID NO: 2568648 - RNA, 21 nt, Human
uaagagacagucaccccagga

SEQ ID NO: 2568649 - RNA, 14 nt, Human
uaagaaccuggaac

SEQ ID NO: 2568650 - RNA, 19 nt, Human
uaagaaccuuuugagugcc

SEQ ID NO: 2568651 - RNA, 22 nt, Human
uaagaacaaagagaaaaaauac

SEQ ID NO: 2568652 - RNA, 23 nt, Human
uaagagagaaugagagacacacu

SEQ ID NO: 2568653 - RNA, 14 nt, Human
uaagagagaaugag

SEQ ID NO: 2568654 - RNA, 15 nt, Human
uaagaggcagcguga

SEQ ID NO: 2568655 - RNA, 23 nt, Human
uaagaggcagaaaauugcacaau

SEQ ID NO: 2568656 - RNA, 20 nt, Human
uaagaggcagaaaauugcac

SEQ ID NO: 2568657 - RNA, 21 nt, Human
uaagaggacauaauggggucc

SEQ ID NO: 2568658 - RNA, 17 nt, Human
uaagaggcagaaaauug

SEQ ID NO: 2568659 - RNA, 17 nt, Human
uaagagcuggugucuga

SEQ ID NO: 2568660 - RNA, 24 nt, Human
uaagaaaucuaguauuucaugcug

SEQ ID NO: 2568661 - RNA, 19 nt, Human
uaagaaaucaaagagagaa

SEQ ID NO: 2568662 - RNA, 18 nt, Human
uaagaaacccagacugaa

SEQ ID NO: 2568663 - RNA, 23 nt, Human
uaagaaacacacugaggcaggga

SEQ ID NO: 2568664 - RNA, 21 nt, Human
uaagaaaauaucacuugucaa

SEQ ID NO: 2568665 - RNA, 19 nt, Human
uaagaaaagauuuuaauca

SEQ ID NO: 2568666 - RNA, 22 nt, Human
uaagaaaauauuuugucuaaaa

SEQ ID NO: 2568667 - RNA, 21 nt, Human
uaagaaaauauuuugucuaaa

SEQ ID NO: 2568668 - RNA, 20 nt, Human
uaagaaaauauuuugucuaa

SEQ ID NO: 2568669 - RNA, 17 nt, Human
uaagaaaauauuuuguc

SEQ ID NO: 2568670 - RNA, 14 nt, Human
uaagaaaagauuuu

SEQ ID NO: 2568671 - RNA, 12 nt, Human
uaagaaaagauu

SEQ ID NO: 2568672 - RNA, 21 nt, Human
uaagaaaagauacgacuuuau

SEQ ID NO: 2568673 - RNA, 23 nt, Human
uaagaaaauauuuugucuaaaau

SEQ ID NO: 2568674 - RNA, 20 nt, Human
uaagaaacaacucuuugaga

SEQ ID NO: 2568675 - RNA, 21 nt, Human
uaagaaacaacucuuugagaa

SEQ ID NO: 2568676 - RNA, 20 nt, Human
uaagaaacacacugaggcag

SEQ ID NO: 2568677 - RNA, 21 nt, Human
uaagaaacacacugaggcagg

SEQ ID NO: 2568678 - RNA, 11 nt, Human
uaacagaaaug

SEQ ID NO: 2568679 - RNA, 23 nt, Human
uaacagaaagggcaacaauaaaa

SEQ ID NO: 2568680 - RNA, 21 nt, Human
uaacagaaagggcaacaauaa

SEQ ID NO: 2568681 - RNA, 11 nt, Human
uaacagaaagg

SEQ ID NO: 2568682 - RNA, 15 nt, Human
uaacacuuuacaaug

SEQ ID NO: 2568683 - RNA, 20 nt, Human
uaacauugggaaaucuuaua

SEQ ID NO: 2568684 - RNA, 21 nt, Human
uaacauuuuaaauaaaagaaa

SEQ ID NO: 2568685 - RNA, 13 nt, Human
uaacauuuuaaau

SEQ ID NO: 2568686 - RNA, 16 nt, Human
uaacauuucaagggca

SEQ ID NO: 2568687 - RNA, 20 nt, Human
uaacauuggguccugggucu

SEQ ID NO: 2568688 - RNA, 22 nt, Human
uaacauucuguaaaaugucugu

SEQ ID NO: 2568689 - RNA, 20 nt, Human
uaaccaaaaagaccagacua

SEQ ID NO: 2568690 - RNA, 17 nt, Human
uaaccaaaaagaccaga

SEQ ID NO: 2568691 - RNA, 15 nt, Human
uaaccacggaaaaga

SEQ ID NO: 2568692 - RNA, 19 nt, Human
uaaccacgucugucuucac

SEQ ID NO: 2568693 - RNA, 19 nt, Human
uaaccacuuaaaaaauguc

SEQ ID NO: 2568694 - RNA, 20 nt, Human
uaaccacuuaaaaaaugucc

SEQ ID NO: 2568695 - RNA, 20 nt, Human
uaaccacgucugucuucaca

SEQ ID NO: 2568696 - RNA, 17 nt, Human
uaaccaggggccaugaa

SEQ ID NO: 2568697 - RNA, 23 nt, Human
uaaccaguguuguggauuuaaca

SEQ ID NO: 2568698 - RNA, 13 nt, Human
uaaccagaucauu

SEQ ID NO: 2568699 - RNA, 16 nt, Human
uaaccacuucagcuga

SEQ ID NO: 2568700 - RNA, 16 nt, Human
uaacccaacucuccug

SEQ ID NO: 2568701 - RNA, 14 nt, Human
uaaccauuugcacu

SEQ ID NO: 2568702 - RNA, 14 nt, Human
uaacccaacucucc

SEQ ID NO: 2568703 - RNA, 13 nt, Human
uaacccagauuuu

SEQ ID NO: 2568704 - RNA, 11 nt, Human
uaaccccaccc

SEQ ID NO: 2568705 - RNA, 13 nt, Human
uaaccccagcucc

SEQ ID NO: 2568706 - RNA, 19 nt, Human
uaaccccagcucccuagga

SEQ ID NO: 2568707 - RNA, 17 nt, Human
uaaccaucacugguugc

SEQ ID NO: 2568708 - RNA, 23 nt, Human
uaaccauugucuuguucugugau

SEQ ID NO: 2568709 - RNA, 20 nt, Human
uaaccauugucuuguucugu

SEQ ID NO: 2568710 - RNA, 19 nt, Human
uaaccauugucuuguucug

SEQ ID NO: 2568711 - RNA, 18 nt, Human
uaaccauugucuuguucu

SEQ ID NO: 2568712 - RNA, 15 nt, Human
uaaccauuaaaacug

SEQ ID NO: 2568713 - RNA, 13 nt, Human
uaacugacaacuu

SEQ ID NO: 2568714 - RNA, 14 nt, Human
uaacugaaggagaa

SEQ ID NO: 2568715 - RNA, 15 nt, Human
uaacugaaggagaag

SEQ ID NO: 2568716 - RNA, 16 nt, Human
uaacugaaggagaagg

SEQ ID NO: 2568717 - RNA, 14 nt, Human
uaacugaaaaugug

SEQ ID NO: 2568718 - RNA, 16 nt, Human
uaacucuugucuauuu

SEQ ID NO: 2568719 - RNA, 15 nt, Human
uaacucugucuucac

SEQ ID NO: 2568720 - RNA, 14 nt, Human
uaacucuugucuau

SEQ ID NO: 2568721 - RNA, 11 nt, Human
uaacucugucu

SEQ ID NO: 2568722 - RNA, 14 nt, Human
uaacucugucuuca

SEQ ID NO: 2568723 - RNA, 20 nt, Human
uaacugaaaaugugcuauac

SEQ ID NO: 2568724 - RNA, 21 nt, Human
uaacugaaaaugugcuauacu

SEQ ID NO: 2568725 - RNA, 16 nt, Human
uaacucuaaaagaucc

SEQ ID NO: 2568726 - RNA, 14 nt, Human
uaacucuaaaagau

SEQ ID NO: 2568727 - RNA, 14 nt, Human
uaacuccuucuugu

SEQ ID NO: 2568728 - RNA, 21 nt, Human
uaacucugcacuacuccucug

SEQ ID NO: 2568729 - RNA, 18 nt, Human
uaacucuaaaagauccuu

SEQ ID NO: 2568730 - RNA, 17 nt, Human
uaacucuaaaagauccu

SEQ ID NO: 2568731 - RNA, 23 nt, Human
uaacucuaaaagauccuuuuuaa

SEQ ID NO: 2568732 - RNA, 22 nt, Human
uaacucuaauucccauuuugca

SEQ ID NO: 2568733 - RNA, 22 nt, Human
uaacucaauauuuuccaugaaa

SEQ ID NO: 2568734 - RNA, 14 nt, Human
uaacucaauauuuu

SEQ ID NO: 2568735 - RNA, 19 nt, Human
uaacuauuuuauuuucuaa

SEQ ID NO: 2568736 - RNA, 17 nt, Human
uaacuauugcccagguu

SEQ ID NO: 2568737 - RNA, 16 nt, Human
uaacucaccuaacuca

SEQ ID NO: 2568738 - RNA, 15 nt, Human
uaacuccccacccca

SEQ ID NO: 2568739 - RNA, 19 nt, Human
uaacuccagugauguucuu

SEQ ID NO: 2568740 - RNA, 16 nt, Human
uaacuauguugauaaa

SEQ ID NO: 2568741 - RNA, 17 nt, Human
uaacccuuaucaccagc

SEQ ID NO: 2568742 - RNA, 18 nt, Human
uaacccucccauggcacc

SEQ ID NO: 2568743 - RNA, 20 nt, Human
uaacccuggugguugcuguu

SEQ ID NO: 2568744 - RNA, 12 nt, Human
uaaccccuuucc

SEQ ID NO: 2568745 - RNA, 13 nt, Human
uaaccccuuuccu

SEQ ID NO: 2568746 - RNA, 23 nt, Human
uaacccgcucaucacuggaugaa

SEQ ID NO: 2568747 - RNA, 16 nt, Human
uaaccccuuuccugcg

SEQ ID NO: 2568748 - RNA, 14 nt, Human
uaaccccaggcccc

SEQ ID NO: 2568749 - RNA, 13 nt, Human
uaaccccaggccc

SEQ ID NO: 2568750 - RNA, 12 nt, Human
uaaccccaggcc

SEQ ID NO: 2568751 - RNA, 15 nt, Human
uaaccccgggcgggu

SEQ ID NO: 2568752 - RNA, 15 nt, Human
uaaccccaggccccg

SEQ ID NO: 2568753 - RNA, 18 nt, Human
uaaccccgggcggguggc

SEQ ID NO: 2568754 - RNA, 15 nt, Human
uaauaugcacacauu

SEQ ID NO: 2568755 - RNA, 16 nt, Human
uaauaugcacacauuu

SEQ ID NO: 2568756 - RNA, 17 nt, Human
uaauaugcacacauuuu

SEQ ID NO: 2568757 - RNA, 18 nt, Human
uaauaugcacacauuuuu

SEQ ID NO: 2568758 - RNA, 22 nt, Human
uaauauggcucuucauaauucu

SEQ ID NO: 2568759 - RNA, 18 nt, Human
uaauauggcaaaaauggc

SEQ ID NO: 2568760 - RNA, 16 nt, Human
uaauauggcaaaaaug

SEQ ID NO: 2568761 - RNA, 15 nt, Human
uaauauggcaaaaau

SEQ ID NO: 2568762 - RNA, 22 nt, Human
uaauauggccacaguagucuug

SEQ ID NO: 2568763 - RNA, 19 nt, Human
uaauaugcacacauuuuuu

SEQ ID NO: 2568764 - RNA, 16 nt, Human
uaauaugcugccaaau

SEQ ID NO: 2568765 - RNA, 10 nt, Human
uaauaugcau

SEQ ID NO: 2568766 - RNA, 18 nt, Human
uaauaugcugccaaauuu

SEQ ID NO: 2568767 - RNA, 14 nt, Human
uaauaugaaaacuu

SEQ ID NO: 2568768 - RNA, 15 nt, Human
uaauaugaaaacuua

SEQ ID NO: 2568769 - RNA, 16 nt, Human
uaauaugaaaacuuau

SEQ ID NO: 2568770 - RNA, 12 nt, Human
uaauaugagaau

SEQ ID NO: 2568771 - RNA, 18 nt, Human
uaauaucccuacauguau

SEQ ID NO: 2568772 - RNA, 17 nt, Human
uaauaucccuacaugua

SEQ ID NO: 2568773 - RNA, 23 nt, Human
uaauaucaucaguauugaagcau

SEQ ID NO: 2568774 - RNA, 15 nt, Human
uaauaauguuuaaua

SEQ ID NO: 2568775 - RNA, 23 nt, Human
uaauaaucuuauuagggagaaaa

SEQ ID NO: 2568776 - RNA, 23 nt, Human
uaauaaucauuggauucugagag

SEQ ID NO: 2568777 - RNA, 16 nt, Human
uaauaauauauguuua

SEQ ID NO: 2568778 - RNA, 14 nt, Human
uaauaauguuucaa

SEQ ID NO: 2568779 - RNA, 20 nt, Human
uaauaaucuuauuagggaga

SEQ ID NO: 2568780 - RNA, 13 nt, Human
uaauaaugugaau

SEQ ID NO: 2568781 - RNA, 15 nt, Human
uaauaucaauagaag

SEQ ID NO: 2568782 - RNA, 18 nt, Human
uaaucugggccagaauuu

SEQ ID NO: 2568783 - RNA, 23 nt, Human
uaaucugggccagaauuucaaac

SEQ ID NO: 2568784 - RNA, 20 nt, Human
uaaucuguagggcuggaccu

SEQ ID NO: 2568785 - RNA, 17 nt, Human
uaaucuguagggcugga

SEQ ID NO: 2568786 - RNA, 16 nt, Human
uaaucuguagggcugg

SEQ ID NO: 2568787 - RNA, 17 nt, Human
uaaucugggaagggaag

SEQ ID NO: 2568788 - RNA, 22 nt, Human
uaaucuggacuccucuguccag

SEQ ID NO: 2568789 - RNA, 21 nt, Human
uaaucuggacuccucugucca

SEQ ID NO: 2568790 - RNA, 20 nt, Human
uaaucuggacuccucugucc

SEQ ID NO: 2568791 - RNA, 19 nt, Human
uaaucuggacuccucuguc

SEQ ID NO: 2568792 - RNA, 22 nt, Human
uaaucuagauaucgacuuguuu

SEQ ID NO: 2568793 - RNA, 17 nt, Human
uaaucuagauaucgacu

SEQ ID NO: 2568794 - RNA, 22 nt, Human
uaaucuagaacacaggcaaaau

SEQ ID NO: 2568795 - RNA, 14 nt, Human
uaaucuagaacaca

SEQ ID NO: 2568796 - RNA, 17 nt, Human
uaaucuaauucuaagga

SEQ ID NO: 2568797 - RNA, 22 nt, Human
uaaucuacuccuuguaaagacu

SEQ ID NO: 2568798 - RNA, 15 nt, Human
uaaucuggacuccuc

SEQ ID NO: 2568799 - RNA, 21 nt, Human
uaaucugcaaagaaugagaag

SEQ ID NO: 2568800 - RNA, 16 nt, Human
uaaucuauuggguuca

SEQ ID NO: 2568801 - RNA, 21 nt, Human
uaaucugauggcuucuccagg

SEQ ID NO: 2568802 - RNA, 18 nt, Human
uaaucuggacuccucugu

SEQ ID NO: 2568803 - RNA, 17 nt, Human
uaaucuggacuccucug

SEQ ID NO: 2568804 - RNA, 16 nt, Human
uaauauuaaauauaug

SEQ ID NO: 2568805 - RNA, 15 nt, Human
uaauaugggcauugu

SEQ ID NO: 2568806 - RNA, 23 nt, Human
uaauauggcucuucauaauucua

SEQ ID NO: 2568807 - RNA, 21 nt, Human
uaauccccaguaaaauugcca

SEQ ID NO: 2568808 - RNA, 20 nt, Human
uaauauuaaggaagacaaug

SEQ ID NO: 2568809 - RNA, 20 nt, Human
uaauccucuaggaggucucu

SEQ ID NO: 2568810 - RNA, 12 nt, Human
uaaucuaaaugg

SEQ ID NO: 2568811 - RNA, 13 nt, Human
uaaucuaaaugga

SEQ ID NO: 2568812 - RNA, 21 nt, Human
uaauccgaaucucuuuuugcu

SEQ ID NO: 2568813 - RNA, 22 nt, Human
uaaucccugggcauugcuuucc

SEQ ID NO: 2568814 - RNA, 19 nt, Human
uaauccgaaucucuuuuug

SEQ ID NO: 2568815 - RNA, 19 nt, Human
uaaucccugggcauugcuu

SEQ ID NO: 2568816 - RNA, 20 nt, Human
uaaucccugggcauugcuuu

SEQ ID NO: 2568817 - RNA, 17 nt, Human
uaaucccgauucacccu

SEQ ID NO: 2568818 - RNA, 14 nt, Human
uaaucccugggcau

SEQ ID NO: 2568819 - RNA, 23 nt, Human
uaauggacaugagauaauguuag

SEQ ID NO: 2568820 - RNA, 19 nt, Human
uaauggacaugagauaaug

SEQ ID NO: 2568821 - RNA, 19 nt, Human
uaauggccaugguaccccc

SEQ ID NO: 2568822 - RNA, 16 nt, Human
uaauggccaugguacc

SEQ ID NO: 2568823 - RNA, 17 nt, Human
uaauggccggcuggaaa

SEQ ID NO: 2568824 - RNA, 21 nt, Human
uaauggccaugguacccccuu

SEQ ID NO: 2568825 - RNA, 23 nt, Human
uaauggccggcuggaaaugcugg

SEQ ID NO: 2568826 - RNA, 15 nt, Human
uaauggggcggugag

SEQ ID NO: 2568827 - RNA, 14 nt, Human
uaaugcuuuuauau

SEQ ID NO: 2568828 - RNA, 21 nt, Human
uaaugcuucuuucauuuucug

SEQ ID NO: 2568829 - RNA, 20 nt, Human
uaaugcuuagagaauguucu

SEQ ID NO: 2568830 - RNA, 19 nt, Human
uaaugcuuagagaauguuc

SEQ ID NO: 2568831 - RNA, 16 nt, Human
uaaugcuguugccuca

SEQ ID NO: 2568832 - RNA, 15 nt, Human
uaaugcuacugucuc

SEQ ID NO: 2568833 - RNA, 13 nt, Human
uaaugcuacuguc

SEQ ID NO: 2568834 - RNA, 22 nt, Human
uaaugcuacgugugauuuuucu

SEQ ID NO: 2568835 - RNA, 18 nt, Human
uaaugcuacgugugauuu

SEQ ID NO: 2568836 - RNA, 17 nt, Human
uaaugcuacgugugauu

SEQ ID NO: 2568837 - RNA, 16 nt, Human
uaaugcuacgugugau

SEQ ID NO: 2568838 - RNA, 13 nt, Human
uaaugcuccuugu

SEQ ID NO: 2568839 - RNA, 18 nt, Human
uaaugcuccuuguuccua

SEQ ID NO: 2568840 - RNA, 14 nt, Human
uaaugcuguugccu

SEQ ID NO: 2568841 - RNA, 17 nt, Human
uaaugcuguugccucau

SEQ ID NO: 2568842 - RNA, 22 nt, Human
uaaugauaacuggaaacuucag

SEQ ID NO: 2568843 - RNA, 17 nt, Human
uaaugauaacuggaaac

SEQ ID NO: 2568844 - RNA, 23 nt, Human
uaaugauaacuggaaacuucagc

SEQ ID NO: 2568845 - RNA, 15 nt, Human
uaaugcgugcauacc

SEQ ID NO: 2568846 - RNA, 19 nt, Human
uaaugcgugcauaccacuu

SEQ ID NO: 2568847 - RNA, 22 nt, Human
uaaugcgugcauaccacuuuug

SEQ ID NO: 2568848 - RNA, 23 nt, Human
uaaugcgugcauaccacuuuugu

SEQ ID NO: 2568849 - RNA, 20 nt, Human
uaaugcuaaagaaaaaguca

SEQ ID NO: 2568850 - RNA, 22 nt, Human
uaauguuucaaacauauauaac

SEQ ID NO: 2568851 - RNA, 18 nt, Human
uaauguuguuauuuaaag

SEQ ID NO: 2568852 - RNA, 14 nt, Human
uaauguuguuauuu

SEQ ID NO: 2568853 - RNA, 21 nt, Human
uaauguuguaugucuuguuua

SEQ ID NO: 2568854 - RNA, 20 nt, Human
uaauguuguaugucuuguuu

SEQ ID NO: 2568855 - RNA, 20 nt, Human
uaauggggguagcagcugga

SEQ ID NO: 2568856 - RNA, 18 nt, Human
uaauggggguagcagcug

SEQ ID NO: 2568857 - RNA, 17 nt, Human
uaauggggguagcagcu

SEQ ID NO: 2568858 - RNA, 15 nt, Human
uaauggggguagcag

SEQ ID NO: 2568859 - RNA, 15 nt, Human
uaaugggauuuucuu

SEQ ID NO: 2568860 - RNA, 18 nt, Human
uaaugggcuuagagcagu

SEQ ID NO: 2568861 - RNA, 21 nt, Human
uaauggggguagcagcuggac

SEQ ID NO: 2568862 - RNA, 15 nt, Human
uaaugggguccuggc

SEQ ID NO: 2568863 - RNA, 17 nt, Human
uaaugggguccuggcca

SEQ ID NO: 2568864 - RNA, 18 nt, Human
uaaugggguccuggccau

SEQ ID NO: 2568865 - RNA, 16 nt, Human
uaaugguaccagauaa

SEQ ID NO: 2568866 - RNA, 14 nt, Human
uaaugguaccagau

SEQ ID NO: 2568867 - RNA, 18 nt, Human
uaauggguuucauauuuc

SEQ ID NO: 2568868 - RNA, 22 nt, Human
uaaugggguccuggccauccca

SEQ ID NO: 2568869 - RNA, 20 nt, Human
uaauguucugaauaauuucu

SEQ ID NO: 2568870 - RNA, 22 nt, Human
uaauguucugaauaauuucuua

SEQ ID NO: 2568871 - RNA, 23 nt, Human
uaauguuacugaucaugcauugu

SEQ ID NO: 2568872 - RNA, 18 nt, Human
uaaugguaccagauaaaa

SEQ ID NO: 2568873 - RNA, 17 nt, Human
uaaugguaccagauaaa

SEQ ID NO: 2568874 - RNA, 19 nt, Human
uaaugguaccagauaaaau

SEQ ID NO: 2568875 - RNA, 15 nt, Human
uaauguuacugauca

SEQ ID NO: 2568876 - RNA, 21 nt, Human
uaauguuacugaucaugcauu

SEQ ID NO: 2568877 - RNA, 12 nt, Human
uaauguuugcua

SEQ ID NO: 2568878 - RNA, 14 nt, Human
uaauuaaaaaauuu

SEQ ID NO: 2568879 - RNA, 13 nt, Human
uaauguuugcuau

SEQ ID NO: 2568880 - RNA, 11 nt, Human
uaauguuuccu

SEQ ID NO: 2568881 - RNA, 14 nt, Human
uaauuaaguacuau

SEQ ID NO: 2568882 - RNA, 17 nt, Human
uaauuaaguacuaugua

SEQ ID NO: 2568883 - RNA, 20 nt, Human
uaauuaaguacuauguauca

SEQ ID NO: 2568884 - RNA, 22 nt, Human
uaauuagagcagaugaccccuc

SEQ ID NO: 2568885 - RNA, 16 nt, Human
uaaggauguucuagca

SEQ ID NO: 2568886 - RNA, 12 nt, Human
uaaggauuuuau

SEQ ID NO: 2568887 - RNA, 13 nt, Human
uaaggauuuuaug

SEQ ID NO: 2568888 - RNA, 17 nt, Human
uaaggauuuuaugcuuu

SEQ ID NO: 2568889 - RNA, 19 nt, Human
uaaggauuuuaugcuuuaa

SEQ ID NO: 2568890 - RNA, 15 nt, Human
uaaggauugugauau

SEQ ID NO: 2568891 - RNA, 14 nt, Human
uaagcuauucagua

SEQ ID NO: 2568892 - RNA, 14 nt, Human
uaaggcaaucaugg

SEQ ID NO: 2568893 - RNA, 22 nt, Human
uaaggauuuuaugcuuuaaaca

SEQ ID NO: 2568894 - RNA, 20 nt, Human
uaaggauuuuaugcuuuaaa

SEQ ID NO: 2568895 - RNA, 14 nt, Human
uaagggaaauagaa

SEQ ID NO: 2568896 - RNA, 21 nt, Human
uaaggcugcaagguuuaggcu

SEQ ID NO: 2568897 - RNA, 20 nt, Human
uaaggcugaggaaaggccag

SEQ ID NO: 2568898 - RNA, 13 nt, Human
uaaggcugaggaa

SEQ ID NO: 2568899 - RNA, 21 nt, Human
uaagcuaaagaggcugaaaga

SEQ ID NO: 2568900 - RNA, 16 nt, Human
uaagcuaacccccuuc

SEQ ID NO: 2568901 - RNA, 22 nt, Human
uaagcuaacccccuucuacuga

SEQ ID NO: 2568902 - RNA, 22 nt, Human
uaagcccugucgagacacuugc

SEQ ID NO: 2568903 - RNA, 20 nt, Human
uaagcccugucgagacacuu

SEQ ID NO: 2568904 - RNA, 16 nt, Human
uaagcccugucgagac

SEQ ID NO: 2568905 - RNA, 11 nt, Human
uaagcccuguc

SEQ ID NO: 2568906 - RNA, 19 nt, Human
uaagcccucuuccaucaug

SEQ ID NO: 2568907 - RNA, 13 nt, Human
uaagcccccgcug

SEQ ID NO: 2568908 - RNA, 17 nt, Human
uaagccucauauuuaaa

SEQ ID NO: 2568909 - RNA, 17 nt, Human
uaagccuaccugcucuc

SEQ ID NO: 2568910 - RNA, 16 nt, Human
uaagccucauauuuaa

SEQ ID NO: 2568911 - RNA, 16 nt, Human
uaagccuaaaaguggg

SEQ ID NO: 2568912 - RNA, 15 nt, Human
uaagccuaccugcuc

SEQ ID NO: 2568913 - RNA, 14 nt, Human
uaagcccuugaaga

SEQ ID NO: 2568914 - RNA, 15 nt, Human
uaagaggcagggucu

SEQ ID NO: 2568915 - RNA, 12 nt, Human
uaagaggcaggg

SEQ ID NO: 2568916 - RNA, 22 nt, Human
uaagccccagcaagcaauccua

SEQ ID NO: 2568917 - RNA, 17 nt, Human
uaagccccagcaagcaa

SEQ ID NO: 2568918 - RNA, 16 nt, Human
uaagccccagcaagca

SEQ ID NO: 2568919 - RNA, 20 nt, Human
uaagccauucugacucauau

SEQ ID NO: 2568920 - RNA, 19 nt, Human
uaagccauucugacucaua

SEQ ID NO: 2568921 - RNA, 15 nt, Human
uaagccaugggagac

SEQ ID NO: 2568922 - RNA, 14 nt, Human
uaaguauuucccag

SEQ ID NO: 2568923 - RNA, 17 nt, Human
uaaguauuugaaacuga

SEQ ID NO: 2568924 - RNA, 15 nt, Human
uaagucaaccugccu

SEQ ID NO: 2568925 - RNA, 17 nt, Human
uaagucaaccugccuga

SEQ ID NO: 2568926 - RNA, 19 nt, Human
uaaggugaaggugaaucua

SEQ ID NO: 2568927 - RNA, 18 nt, Human
uaaggugauauauuuaaa

SEQ ID NO: 2568928 - RNA, 20 nt, Human
uaaggugauauauuuaaaaa

SEQ ID NO: 2568929 - RNA, 20 nt, Human
uaagguggguacgggagggu

SEQ ID NO: 2568930 - RNA, 12 nt, Human
uaaggugcaguu

SEQ ID NO: 2568931 - RNA, 13 nt, Human
uaaggugccuucu

SEQ ID NO: 2568932 - RNA, 15 nt, Human
uaaggugugcucuga

SEQ ID NO: 2568933 - RNA, 13 nt, Human
uaagggaagaauu

SEQ ID NO: 2568934 - RNA, 21 nt, Human
uaagggaaggaacucuggcuu

SEQ ID NO: 2568935 - RNA, 20 nt, Human
uaagggacauguuuugauaa

SEQ ID NO: 2568936 - RNA, 14 nt, Human
uaagggagaaaaaa

SEQ ID NO: 2568937 - RNA, 13 nt, Human
uaaggggcagcuu

SEQ ID NO: 2568938 - RNA, 16 nt, Human
uaaggggcccggccag

SEQ ID NO: 2568939 - RNA, 14 nt, Human
uaagggcagaguca

SEQ ID NO: 2568940 - RNA, 13 nt, Human
uaagggcagaguc

SEQ ID NO: 2568941 - RNA, 22 nt, Human
uaagggcuggucucugcugaag

SEQ ID NO: 2568942 - RNA, 17 nt, Human
uaaggguaucuggugac

SEQ ID NO: 2568943 - RNA, 15 nt, Human
uaaggguuaagaaaa

SEQ ID NO: 2568944 - RNA, 20 nt, Human
uaaggguuaguuuacaauca

SEQ ID NO: 2568945 - RNA, 21 nt, Human
uaagguaccuuucacauagag

SEQ ID NO: 2568946 - RNA, 13 nt, Human
uaaggguuuuaga

SEQ ID NO: 2568947 - RNA, 18 nt, Human
uaaggucauuaccacagg

SEQ ID NO: 2568948 - RNA, 20 nt, Human
uaaguccuuuauguggaaaa

SEQ ID NO: 2568949 - RNA, 17 nt, Human
uaaguccuuuaugugga

SEQ ID NO: 2568950 - RNA, 15 nt, Human
uaaguccuuuaugug

SEQ ID NO: 2568951 - RNA, 18 nt, Human
uaagucuaaauauuuccu

SEQ ID NO: 2568952 - RNA, 21 nt, Human
uaagucauguuccuucaagau

SEQ ID NO: 2568953 - RNA, 19 nt, Human
uaagucauguuccuucaag

SEQ ID NO: 2568954 - RNA, 22 nt, Human
uaagucauguuccuucaagauc

SEQ ID NO: 2568955 - RNA, 20 nt, Human
uaaguccuugcaagaaucag

SEQ ID NO: 2568956 - RNA, 13 nt, Human
uaagucuguuuua

SEQ ID NO: 2568957 - RNA, 16 nt, Human
uaagucuguuuuauga

SEQ ID NO: 2568958 - RNA, 19 nt, Human
uaagucuguuuuaugacuu

SEQ ID NO: 2568959 - RNA, 20 nt, Human
uaagucuguuuuaugacuuc

SEQ ID NO: 2568960 - RNA, 21 nt, Human
uaagucuguuuuaugacuuca

SEQ ID NO: 2568961 - RNA, 20 nt, Human
uaagucuuaucaagcagcca

SEQ ID NO: 2568962 - RNA, 22 nt, Human
uaagucuuaucaagcagccaag

SEQ ID NO: 2568963 - RNA, 13 nt, Human
uaagugaaauaag

SEQ ID NO: 2568964 - RNA, 16 nt, Human
uaagugaaaaggucau

SEQ ID NO: 2568965 - RNA, 23 nt, Human
uaagugaggaugaaaaaauaaca

SEQ ID NO: 2568966 - RNA, 12 nt, Human
uaagugagagag

SEQ ID NO: 2568967 - RNA, 22 nt, Human
uaagugauugcugguuuuaguu

SEQ ID NO: 2568968 - RNA, 19 nt, Human
uaagugcguguguagaguu

SEQ ID NO: 2568969 - RNA, 18 nt, Human
uaagugcguguguagagu

SEQ ID NO: 2568970 - RNA, 17 nt, Human
uaagugcguguguagag

SEQ ID NO: 2568971 - RNA, 16 nt, Human
uaagugcguguguaga

SEQ ID NO: 2568972 - RNA, 16 nt, Human
uaagugccuuccaugu

SEQ ID NO: 2568973 - RNA, 14 nt, Human
uaagugccuuccau

SEQ ID NO: 2568974 - RNA, 13 nt, Human
uaagugccuucca

SEQ ID NO: 2568975 - RNA, 14 nt, Human
uaagugcugcauuu

SEQ ID NO: 2568976 - RNA, 22 nt, Human
uaagugcacaacauuacaggga

SEQ ID NO: 2568977 - RNA, 14 nt, Human
uaagugcacaacau

SEQ ID NO: 2568978 - RNA, 18 nt, Human
uaagugauuuuuuugucc

SEQ ID NO: 2568979 - RNA, 16 nt, Human
uaagugauuguaugaa

SEQ ID NO: 2568980 - RNA, 22 nt, Human
uaagugccaggauggaaugaug

SEQ ID NO: 2568981 - RNA, 15 nt, Human
uaagugcugcauuua

SEQ ID NO: 2568982 - RNA, 16 nt, Human
uaagugcugcauuuaa

SEQ ID NO: 2568983 - RNA, 18 nt, Human
uaagugcugcauuuaaaa

SEQ ID NO: 2568984 - RNA, 22 nt, Human
uaagugcugcauuuaaaagaua

SEQ ID NO: 2568985 - RNA, 16 nt, Human
uaagugguguguguau

SEQ ID NO: 2568986 - RNA, 23 nt, Human
uaagugcguguguagaguuaaga

SEQ ID NO: 2568987 - RNA, 12 nt, Human
uaagugcuguau

SEQ ID NO: 2568988 - RNA, 15 nt, Human
uaaguggugugugua

SEQ ID NO: 2568989 - RNA, 15 nt, Human
uaagugugaacugga

SEQ ID NO: 2568990 - RNA, 14 nt, Human
uaagugugaacugg

SEQ ID NO: 2568991 - RNA, 12 nt, Human
uaagugugaacu

SEQ ID NO: 2568992 - RNA, 18 nt, Human
uaaguguauuuuucaaua

SEQ ID NO: 2568993 - RNA, 20 nt, Human
uaaguguauuuuucaauaaa

SEQ ID NO: 2568994 - RNA, 14 nt, Human
uaaguguacauaug

SEQ ID NO: 2568995 - RNA, 21 nt, Human
uaagugcguguguagaguuaa

SEQ ID NO: 2568996 - RNA, 18 nt, Human
uaaguguacauaugugcu

SEQ ID NO: 2568997 - RNA, 13 nt, Human
uaaguguauuuuu

SEQ ID NO: 2568998 - RNA, 22 nt, Human
uaauaagacauaacguuuuucc

SEQ ID NO: 2568999 - RNA, 20 nt, Human
uaauaagacauaacguuuuu

SEQ ID NO: 2569000 - RNA, 19 nt, Human
uaauaagacauaacguuuu

SEQ ID NO: 2569001 - RNA, 17 nt, Human
uaauaagacauaacguu

SEQ ID NO: 2569002 - RNA, 14 nt, Human
uaauaagacauaac

SEQ ID NO: 2569003 - RNA, 12 nt, Human
uaauaagacaua

SEQ ID NO: 2569004 - RNA, 19 nt, Human
uaauaagaaugguugccuu

SEQ ID NO: 2569005 - RNA, 21 nt, Human
uaauaacugugaaguuuacau

SEQ ID NO: 2569006 - RNA, 19 nt, Human
uaauaaauauuuuugccau

SEQ ID NO: 2569007 - RNA, 22 nt, Human
uaauaauauacuuguggacuaa

SEQ ID NO: 2569008 - RNA, 13 nt, Human
uaauaauauaugu

SEQ ID NO: 2569009 - RNA, 18 nt, Human
uaauaagcuaaagaggcu

SEQ ID NO: 2569010 - RNA, 12 nt, Human
uaauaaagcugu

SEQ ID NO: 2569011 - RNA, 22 nt, Human
uaagugugaacuggacccuguu

SEQ ID NO: 2569012 - RNA, 11 nt, Human
uaauaaagcug

SEQ ID NO: 2569013 - RNA, 12 nt, Human
uaauaaauauga

SEQ ID NO: 2569014 - RNA, 23 nt, Human
uaaguguauuuuucaauaaagca

SEQ ID NO: 2569015 - RNA, 15 nt, Human
uaauaaauauuuaug

SEQ ID NO: 2569016 - RNA, 16 nt, Human
uaauaaauauuuaugu

SEQ ID NO: 2569017 - RNA, 14 nt, Human
uaucauagaaaugu

SEQ ID NO: 2569018 - RNA, 15 nt, Human
uaucauagaaaugua

SEQ ID NO: 2569019 - RNA, 20 nt, Human
uaucaguuuguccuguagag

SEQ ID NO: 2569020 - RNA, 20 nt, Human
uaucagucaauauuuuuaga

SEQ ID NO: 2569021 - RNA, 21 nt, Human
uaucagucaauauuuuuagau

SEQ ID NO: 2569022 - RNA, 23 nt, Human
uaucaguuugcuagcagaaaucu

SEQ ID NO: 2569023 - RNA, 20 nt, Human
uaucaggugcugccauccag

SEQ ID NO: 2569024 - RNA, 9 nt, Human
uaucaguag

SEQ ID NO: 2569025 - RNA, 16 nt, Human
uaucaaacugaagcca

SEQ ID NO: 2569026 - RNA, 13 nt, Human
uaucaaacugaag

SEQ ID NO: 2569027 - RNA, 19 nt, Human
uaucaggugcugccaucca

SEQ ID NO: 2569028 - RNA, 14 nt, Human
uaucaaaagaaaga

SEQ ID NO: 2569029 - RNA, 20 nt, Human
uaucaaacagaauuuuaaag

SEQ ID NO: 2569030 - RNA, 14 nt, Human
uaucaugacauguu

SEQ ID NO: 2569031 - RNA, 13 nt, Human
uaucaugacaugu

SEQ ID NO: 2569032 - RNA, 17 nt, Human
uaucaugacaaagacug

SEQ ID NO: 2569033 - RNA, 16 nt, Human
uaucaugagugaauaa

SEQ ID NO: 2569034 - RNA, 15 nt, Human
uaucaugcaaaugcu

SEQ ID NO: 2569035 - RNA, 16 nt, Human
uaucaugcaaaugcug

SEQ ID NO: 2569036 - RNA, 17 nt, Human
uaucaugcaaaugcugu

SEQ ID NO: 2569037 - RNA, 15 nt, Human
uaucauauugguauu

SEQ ID NO: 2569038 - RNA, 21 nt, Human
uaucaucagcauaccuuuauu

SEQ ID NO: 2569039 - RNA, 14 nt, Human
uaucaucaguauug

SEQ ID NO: 2569040 - RNA, 15 nt, Human
uaucaucaguauuga

SEQ ID NO: 2569041 - RNA, 23 nt, Human
uaucauagaaauguaacuuuugu

SEQ ID NO: 2569042 - RNA, 18 nt, Human
uaucauagaaauguaacu

SEQ ID NO: 2569043 - RNA, 14 nt, Human
uaucauucaagugu

SEQ ID NO: 2569044 - RNA, 13 nt, Human
uaucauucaagug

SEQ ID NO: 2569045 - RNA, 14 nt, Human
uaucauuaaaguuc

SEQ ID NO: 2569046 - RNA, 13 nt, Human
uaucauuaaaguu

SEQ ID NO: 2569047 - RNA, 12 nt, Human
uaucauuaaagu

SEQ ID NO: 2569048 - RNA, 22 nt, Human
uaucauguguaaucaauaaacg

SEQ ID NO: 2569049 - RNA, 20 nt, Human
uaucauguguaaucaauaaa

SEQ ID NO: 2569050 - RNA, 17 nt, Human
uaucauggucucaguca

SEQ ID NO: 2569051 - RNA, 17 nt, Human
uaucaugcauguccugu

SEQ ID NO: 2569052 - RNA, 19 nt, Human
uaucaugcauguccuguaa

SEQ ID NO: 2569053 - RNA, 14 nt, Human
uaucaugcccugug

SEQ ID NO: 2569054 - RNA, 12 nt, Human
uaucaugcauuc

SEQ ID NO: 2569055 - RNA, 12 nt, Human
uaucauggucuc

SEQ ID NO: 2569056 - RNA, 18 nt, Human
uaucaugccccuguacuc

SEQ ID NO: 2569057 - RNA, 15 nt, Human
uaucauggagugacg

SEQ ID NO: 2569058 - RNA, 19 nt, Human
uaucaaaacuuucuuuucu

SEQ ID NO: 2569059 - RNA, 21 nt, Human
uauauuuuuuguuaaaugauu

SEQ ID NO: 2569060 - RNA, 13 nt, Human
uauauuuuuauau

SEQ ID NO: 2569061 - RNA, 19 nt, Human
uauauuuuuaagauaauaa

SEQ ID NO: 2569062 - RNA, 17 nt, Human
uauauuuuuaagauaau

SEQ ID NO: 2569063 - RNA, 20 nt, Human
uauauuuuuaagauaauaau

SEQ ID NO: 2569064 - RNA, 15 nt, Human
uauauuuuuaagaua

SEQ ID NO: 2569065 - RNA, 14 nt, Human
uauauuuucuguuu

SEQ ID NO: 2569066 - RNA, 12 nt, Human
uauauuuuggga

SEQ ID NO: 2569067 - RNA, 13 nt, Human
uauauuuugggaa

SEQ ID NO: 2569068 - RNA, 24 nt, Human
uauauuuucaugacuuuuccaugu

SEQ ID NO: 2569069 - RNA, 14 nt, Human
uauauuuguacaaa

SEQ ID NO: 2569070 - RNA, 21 nt, Human
uauauuugugauagcacuuuc

SEQ ID NO: 2569071 - RNA, 23 nt, Human
uauauuuucaugacuuuuccaug

SEQ ID NO: 2569072 - RNA, 15 nt, Human
uauauuuguacaaaa

SEQ ID NO: 2569073 - RNA, 13 nt, Human
uauauuuguacaa

SEQ ID NO: 2569074 - RNA, 12 nt, Human
uauauuuguaca

SEQ ID NO: 2569075 - RNA, 20 nt, Human
uauauuuguaaauuuaugug

SEQ ID NO: 2569076 - RNA, 22 nt, Human
uauauuugggccugcuccagac

SEQ ID NO: 2569077 - RNA, 14 nt, Human
uauauuugcuuuuu

SEQ ID NO: 2569078 - RNA, 20 nt, Human
uauauuugaaauauugacuu

SEQ ID NO: 2569079 - RNA, 13 nt, Human
uauauggauaaug

SEQ ID NO: 2569080 - RNA, 18 nt, Human
uauauggaugauucagaa

SEQ ID NO: 2569081 - RNA, 16 nt, Human
uauauggaugauucag

SEQ ID NO: 2569082 - RNA, 19 nt, Human
uauauggaugauucagaaa

SEQ ID NO: 2569083 - RNA, 16 nt, Human
uauaugcuucuguuuu

SEQ ID NO: 2569084 - RNA, 19 nt, Human
uauaugaagaaaaucacuu

SEQ ID NO: 2569085 - RNA, 14 nt, Human
uauaugcuucuguu

SEQ ID NO: 2569086 - RNA, 14 nt, Human
uauaucuuuuucca

SEQ ID NO: 2569087 - RNA, 18 nt, Human
uauaugaagaaaaucacu

SEQ ID NO: 2569088 - RNA, 22 nt, Human
uauauaagauggaagcuuccag

SEQ ID NO: 2569089 - RNA, 18 nt, Human
uauauaagauggaagcuu

SEQ ID NO: 2569090 - RNA, 13 nt, Human
uauaucugcuguc

SEQ ID NO: 2569091 - RNA, 12 nt, Human
uauaucuuguuu

SEQ ID NO: 2569092 - RNA, 14 nt, Human
uauaucuguauaua

SEQ ID NO: 2569093 - RNA, 17 nt, Human
uauaucugcuucagugg

SEQ ID NO: 2569094 - RNA, 16 nt, Human
uauaucugcuucagug

SEQ ID NO: 2569095 - RNA, 17 nt, Human
uauaucugcuguccaga

SEQ ID NO: 2569096 - RNA, 15 nt, Human
uauaucuguauauaa

SEQ ID NO: 2569097 - RNA, 19 nt, Human
uauauaacaaugcuguauu

SEQ ID NO: 2569098 - RNA, 17 nt, Human
uauauaacaaugcugua

SEQ ID NO: 2569099 - RNA, 22 nt, Human
uauauaaaccuaaaaaagauau

SEQ ID NO: 2569100 - RNA, 21 nt, Human
uauauaaaccuaaaaaagaua

SEQ ID NO: 2569101 - RNA, 17 nt, Human
uauauaaaccuaaaaaa

SEQ ID NO: 2569102 - RNA, 15 nt, Human
uauauaaaccuaaaa

SEQ ID NO: 2569103 - RNA, 14 nt, Human
uauauaaaccuaaa

SEQ ID NO: 2569104 - RNA, 21 nt, Human
uauauaaaauauuuucauaca

SEQ ID NO: 2569105 - RNA, 23 nt, Human
uauauaaaauaaauauauauaaa

SEQ ID NO: 2569106 - RNA, 23 nt, Human
uauauaaaggaaaaaagagaagu

SEQ ID NO: 2569107 - RNA, 20 nt, Human
uauagguuuuguuugcuauc

SEQ ID NO: 2569108 - RNA, 18 nt, Human
uauagguuuuguuugcua

SEQ ID NO: 2569109 - RNA, 22 nt, Human
uauagagauguuuuuaaaaguu

SEQ ID NO: 2569110 - RNA, 21 nt, Human
uauagaggcuagcuucugcuu

SEQ ID NO: 2569111 - RNA, 18 nt, Human
uauaguauaucuggacaa

SEQ ID NO: 2569112 - RNA, 13 nt, Human
uauaguauaucug

SEQ ID NO: 2569113 - RNA, 22 nt, Human
uauauaaaauaaauauauauaa

SEQ ID NO: 2569114 - RNA, 19 nt, Human
uauauaaaauaaauauaua

SEQ ID NO: 2569115 - RNA, 18 nt, Human
uauauaaaauaaauauau

SEQ ID NO: 2569116 - RNA, 17 nt, Human
uauauaaaauaaauaua

SEQ ID NO: 2569117 - RNA, 16 nt, Human
uauauaaaauaaauau

SEQ ID NO: 2569118 - RNA, 23 nt, Human
uauauaaaaagaaaagauaaaga

SEQ ID NO: 2569119 - RNA, 20 nt, Human
uauauaaaaagaaaagauaa

SEQ ID NO: 2569120 - RNA, 19 nt, Human
uauauaaaaagaaaagaua

SEQ ID NO: 2569121 - RNA, 18 nt, Human
uauauaaaaagaaaagau

SEQ ID NO: 2569122 - RNA, 12 nt, Human
uauauaaaaaga

SEQ ID NO: 2569123 - RNA, 22 nt, Human
uauaguuuuacuuuuaaacugu

SEQ ID NO: 2569124 - RNA, 23 nt, Human
uauaguuuuacuuuuaaacugug

SEQ ID NO: 2569125 - RNA, 13 nt, Human
uauagugauguaa

SEQ ID NO: 2569126 - RNA, 18 nt, Human
uauagugauguaaucuug

SEQ ID NO: 2569127 - RNA, 17 nt, Human
uauaguuuuacuuuuaa

SEQ ID NO: 2569128 - RNA, 13 nt, Human
uauaguccagcuu

SEQ ID NO: 2569129 - RNA, 20 nt, Human
uauagucccagcuacucaga

SEQ ID NO: 2569130 - RNA, 11 nt, Human
uauacuuuuuu

SEQ ID NO: 2569131 - RNA, 17 nt, Human
uauaaauaggagaggau

SEQ ID NO: 2569132 - RNA, 13 nt, Human
uauaaauaggaga

SEQ ID NO: 2569133 - RNA, 14 nt, Human
uauagaaacacgaa

SEQ ID NO: 2569134 - RNA, 17 nt, Human
uauacuuuuuucuuauu

SEQ ID NO: 2569135 - RNA, 21 nt, Human
uauacuuuuuucuuauuuaac

SEQ ID NO: 2569136 - RNA, 19 nt, Human
uauacuuuuuucuuauuua

SEQ ID NO: 2569137 - RNA, 15 nt, Human
uauaaauaaauauau

SEQ ID NO: 2569138 - RNA, 14 nt, Human
uauaaauaaauaua

SEQ ID NO: 2569139 - RNA, 13 nt, Human
uauaaauaaauau

SEQ ID NO: 2569140 - RNA, 12 nt, Human
uauaaauaaaua

SEQ ID NO: 2569141 - RNA, 17 nt, Human
uauaaauaaauauauau

SEQ ID NO: 2569142 - RNA, 16 nt, Human
uauaaauaaauauaua

SEQ ID NO: 2569143 - RNA, 18 nt, Human
uauaaauaaauauauaua

SEQ ID NO: 2569144 - RNA, 16 nt, Human
uauaaaguaguccugu

SEQ ID NO: 2569145 - RNA, 18 nt, Human
uauaaaguaguccuguga

SEQ ID NO: 2569146 - RNA, 16 nt, Human
uauaaaguaaagcuaa

SEQ ID NO: 2569147 - RNA, 15 nt, Human
uauaaaguaaagcua

SEQ ID NO: 2569148 - RNA, 19 nt, Human
uauaaacuaucaguuuguc

SEQ ID NO: 2569149 - RNA, 22 nt, Human
uauaaaccucuaauuuauuuug

SEQ ID NO: 2569150 - RNA, 23 nt, Human
uauaaacuuagugcggacaaguu

SEQ ID NO: 2569151 - RNA, 16 nt, Human
uauaaagguugacaau

SEQ ID NO: 2569152 - RNA, 15 nt, Human
uauagaauauuuauu

SEQ ID NO: 2569153 - RNA, 21 nt, Human
uauagaauauuuauuaccucu

SEQ ID NO: 2569154 - RNA, 16 nt, Human
uauagacaaauaauaa

SEQ ID NO: 2569155 - RNA, 11 nt, Human
uauagacucua

SEQ ID NO: 2569156 - RNA, 21 nt, Human
uauagagauaugcagaaggaa

SEQ ID NO: 2569157 - RNA, 17 nt, Human
uauagagauaugcagaa

SEQ ID NO: 2569158 - RNA, 15 nt, Human
uauagagauaugcag

SEQ ID NO: 2569159 - RNA, 16 nt, Human
uauagacccgaggaaa

SEQ ID NO: 2569160 - RNA, 18 nt, Human
uauagaacugaaugagaa

SEQ ID NO: 2569161 - RNA, 17 nt, Human
uauagaacugaaugaga

SEQ ID NO: 2569162 - RNA, 11 nt, Human
uauagaaaugc

SEQ ID NO: 2569163 - RNA, 15 nt, Human
uauaaacuuuaccuu

SEQ ID NO: 2569164 - RNA, 16 nt, Human
uauaaacuuuaccuuu

SEQ ID NO: 2569165 - RNA, 19 nt, Human
uauaaaccucuaauuuauu

SEQ ID NO: 2569166 - RNA, 20 nt, Human
uauaaaccuaaaaaagauau

SEQ ID NO: 2569167 - RNA, 19 nt, Human
uauaaaccuaaaaaagaua

SEQ ID NO: 2569168 - RNA, 18 nt, Human
uauaaaccuaaaaaagau

SEQ ID NO: 2569169 - RNA, 17 nt, Human
uauaaacuuuaccuuuu

SEQ ID NO: 2569170 - RNA, 13 nt, Human
uauaaacuuuacc

SEQ ID NO: 2569171 - RNA, 14 nt, Human
uauaaacuuuaccu

SEQ ID NO: 2569172 - RNA, 16 nt, Human
uauaaaccuaaaaaag

SEQ ID NO: 2569173 - RNA, 15 nt, Human
uauaaaccuaaaaaa

SEQ ID NO: 2569174 - RNA, 11 nt, Human
uauaaacuuua

SEQ ID NO: 2569175 - RNA, 16 nt, Human
uaguuugauuaaauuc

SEQ ID NO: 2569176 - RNA, 21 nt, Human
uaguuugauuaaauucuugca

SEQ ID NO: 2569177 - RNA, 12 nt, Human
uaguuucuugug

SEQ ID NO: 2569178 - RNA, 20 nt, Human
uaguuucuguucuguggaaa

SEQ ID NO: 2569179 - RNA, 17 nt, Human
uaguuuaccucuuuaaa

SEQ ID NO: 2569180 - RNA, 15 nt, Human
uaguuugauuaaauu

SEQ ID NO: 2569181 - RNA, 14 nt, Human
uauaaacaucacac

SEQ ID NO: 2569182 - RNA, 22 nt, Human
uauaaacaugcuugcauuauau

SEQ ID NO: 2569183 - RNA, 18 nt, Human
uauaaacaucacacacac

SEQ ID NO: 2569184 - RNA, 17 nt, Human
uauaaacaucacacaca

SEQ ID NO: 2569185 - RNA, 14 nt, Human
uaguuucuuuggga

SEQ ID NO: 2569186 - RNA, 14 nt, Human
uauaaacacuauau

SEQ ID NO: 2569187 - RNA, 23 nt, Human
uaguggauuacugccauucacuu

SEQ ID NO: 2569188 - RNA, 16 nt, Human
uaguauuuauuuaaug

SEQ ID NO: 2569189 - RNA, 18 nt, Human
uagugggcaccccacugc

SEQ ID NO: 2569190 - RNA, 20 nt, Human
uaguggcuucauuagagcag

SEQ ID NO: 2569191 - RNA, 14 nt, Human
uaguggcuucaaaa

SEQ ID NO: 2569192 - RNA, 13 nt, Human
uaguggcugucca

SEQ ID NO: 2569193 - RNA, 20 nt, Human
uaguggcuuaaaacaacacu

SEQ ID NO: 2569194 - RNA, 17 nt, Human
uaguauuguccaggucu

SEQ ID NO: 2569195 - RNA, 15 nt, Human
uaguaugaggcauuu

SEQ ID NO: 2569196 - RNA, 16 nt, Human
uaguaugguggcuggg

SEQ ID NO: 2569197 - RNA, 20 nt, Human
uaguuguuugauucagacag

SEQ ID NO: 2569198 - RNA, 16 nt, Human
uaguugagccagcaga

SEQ ID NO: 2569199 - RNA, 22 nt, Human
uaguuguuugauucagacagcu

SEQ ID NO: 2569200 - RNA, 21 nt, Human
uaguuguuugauucagacagc

SEQ ID NO: 2569201 - RNA, 16 nt, Human
uaguggucuuuguaag

SEQ ID NO: 2569202 - RNA, 18 nt, Human
uaguggggucucccucuc

SEQ ID NO: 2569203 - RNA, 20 nt, Human
uaguggggucucccucuccu

SEQ ID NO: 2569204 - RNA, 21 nt, Human
uaguggggucucccucuccug

SEQ ID NO: 2569205 - RNA, 22 nt, Human
uaguggggucucccucuccugc

SEQ ID NO: 2569206 - RNA, 15 nt, Human
uaguggucuuuguaa

SEQ ID NO: 2569207 - RNA, 14 nt, Human
uaguggucuuugua

SEQ ID NO: 2569208 - RNA, 13 nt, Human
uaguggucuuugu

SEQ ID NO: 2569209 - RNA, 23 nt, Human
uaguggggucucccucuccugcc

SEQ ID NO: 2569210 - RNA, 22 nt, Human
uaguugaacugauaguuacugu

SEQ ID NO: 2569211 - RNA, 20 nt, Human
uaguugaacugauaguuacu

SEQ ID NO: 2569212 - RNA, 18 nt, Human
uaguugaacugauaguua

SEQ ID NO: 2569213 - RNA, 15 nt, Human
uaguucuuuggaaau

SEQ ID NO: 2569214 - RNA, 14 nt, Human
uaguugaacugaua

SEQ ID NO: 2569215 - RNA, 16 nt, Human
uaggugacagagugag

SEQ ID NO: 2569216 - RNA, 11 nt, Human
uaggugacaga

SEQ ID NO: 2569217 - RNA, 14 nt, Human
uaggucucuucccc

SEQ ID NO: 2569218 - RNA, 19 nt, Human
uaggucucggacuaagccu

SEQ ID NO: 2569219 - RNA, 17 nt, Human
uaggucugauauucaaa

SEQ ID NO: 2569220 - RNA, 11 nt, Human
uagggaaaaac

SEQ ID NO: 2569221 - RNA, 15 nt, Human
uaggucucaauaccu

SEQ ID NO: 2569222 - RNA, 20 nt, Human
uaggugcuacaaaaacacag

SEQ ID NO: 2569223 - RNA, 22 nt, Human
uaggugcuacaaaaacacagca

SEQ ID NO: 2569224 - RNA, 23 nt, Human
uaggugcuacaaaaacacagcaa

SEQ ID NO: 2569225 - RNA, 21 nt, Human
uaggucuuaauacacacaguu

SEQ ID NO: 2569226 - RNA, 16 nt, Human
uagguggaucaccuga

SEQ ID NO: 2569227 - RNA, 18 nt, Human
uagcuguacaaauauaag

SEQ ID NO: 2569228 - RNA, 16 nt, Human
uagcuguacaaauaua

SEQ ID NO: 2569229 - RNA, 12 nt, Human
uagcuguacaaa

SEQ ID NO: 2569230 - RNA, 14 nt, Human
uagcuguauugaau

SEQ ID NO: 2569231 - RNA, 12 nt, Human
uagcuguauuga

SEQ ID NO: 2569232 - RNA, 15 nt, Human
uagcugucuagagua

SEQ ID NO: 2569233 - RNA, 17 nt, Human
uagcuguaaggcaugaa

SEQ ID NO: 2569234 - RNA, 19 nt, Human
uagcuguaaggcaugaagg

SEQ ID NO: 2569235 - RNA, 12 nt, Human
uagcuguaaggc

SEQ ID NO: 2569236 - RNA, 22 nt, Human
uagcugguuuccucauuccuga

SEQ ID NO: 2569237 - RNA, 22 nt, Human
uagcuggucuuauuuguaaagc

SEQ ID NO: 2569238 - RNA, 20 nt, Human
uagcugggggugggccaggc

SEQ ID NO: 2569239 - RNA, 23 nt, Human
uagcugcauccuccaagaaucua

SEQ ID NO: 2569240 - RNA, 17 nt, Human
uagcuggugguuucacg

SEQ ID NO: 2569241 - RNA, 14 nt, Human
uagcuggugguuuc

SEQ ID NO: 2569242 - RNA, 20 nt, Human
uagcugguuggagagcuaga

SEQ ID NO: 2569243 - RNA, 21 nt, Human
uaggcuggagaagcucaccca

SEQ ID NO: 2569244 - RNA, 19 nt, Human
uaggcuggagaagcucacc

SEQ ID NO: 2569245 - RNA, 17 nt, Human
uaggcuggagaagcuca

SEQ ID NO: 2569246 - RNA, 15 nt, Human
uaggcuggagaagcu

SEQ ID NO: 2569247 - RNA, 14 nt, Human
uaggcuggagaagc

SEQ ID NO: 2569248 - RNA, 12 nt, Human
uaggcuggagaa

SEQ ID NO: 2569249 - RNA, 17 nt, Human
uagcugucuagaguagc

SEQ ID NO: 2569250 - RNA, 16 nt, Human
uagcuguauugaauca

SEQ ID NO: 2569251 - RNA, 21 nt, Human
uagcugucugcucagacagaa

SEQ ID NO: 2569252 - RNA, 18 nt, Human
uaggcuuaguuugugugu

SEQ ID NO: 2569253 - RNA, 18 nt, Human
uaggcugguggcccagga

SEQ ID NO: 2569254 - RNA, 19 nt, Human
uaggcugguggcccaggac

SEQ ID NO: 2569255 - RNA, 15 nt, Human
uaggcugguggccca

SEQ ID NO: 2569256 - RNA, 16 nt, Human
uaggcugguggcccag

SEQ ID NO: 2569257 - RNA, 16 nt, Human
uaggcuggagcccagg

SEQ ID NO: 2569258 - RNA, 19 nt, Human
uaggcuggagcccagggag

SEQ ID NO: 2569259 - RNA, 21 nt, Human
uaggugugacugaauuucuuu

SEQ ID NO: 2569260 - RNA, 23 nt, Human
uaggugugacugaauuucuuuug

SEQ ID NO: 2569261 - RNA, 19 nt, Human
uaggugugacugaauuucu

SEQ ID NO: 2569262 - RNA, 15 nt, Human
uagguggcaaggcug

SEQ ID NO: 2569263 - RNA, 16 nt, Human
uagguggcaaggcugu

SEQ ID NO: 2569264 - RNA, 16 nt, Human
uaggugggccagcccc

SEQ ID NO: 2569265 - RNA, 19 nt, Human
uaggugggccagccccucc

SEQ ID NO: 2569266 - RNA, 20 nt, Human
uaggugggccagccccuccc

SEQ ID NO: 2569267 - RNA, 21 nt, Human
uaggugggccagccccuccca

SEQ ID NO: 2569268 - RNA, 23 nt, Human
uaggugggccagccccucccacc

SEQ ID NO: 2569269 - RNA, 14 nt, Human
uagguucagccaag

SEQ ID NO: 2569270 - RNA, 17 nt, Human
uagguuaaaaaaaggca

SEQ ID NO: 2569271 - RNA, 22 nt, Human
uagguguugauuuucuguugua

SEQ ID NO: 2569272 - RNA, 22 nt, Human
uagguuaauuccaauuauauga

SEQ ID NO: 2569273 - RNA, 16 nt, Human
uaggugucauuuccau

SEQ ID NO: 2569274 - RNA, 13 nt, Human
uagguguggggga

SEQ ID NO: 2569275 - RNA, 17 nt, Human
uaggugugggggaagca

SEQ ID NO: 2569276 - RNA, 15 nt, Human
uagguucagccaagg

SEQ ID NO: 2569277 - RNA, 12 nt, Human
uagguucuaaaa

SEQ ID NO: 2569278 - RNA, 12 nt, Human
uaguagauuuua

SEQ ID NO: 2569279 - RNA, 17 nt, Human
uaguaugaggcauuugu

SEQ ID NO: 2569280 - RNA, 18 nt, Human
uaguaugaggcauuuguu

SEQ ID NO: 2569281 - RNA, 19 nt, Human
uaguagcccuuucugugug

SEQ ID NO: 2569282 - RNA, 18 nt, Human
uaguagcccuuucugugu

SEQ ID NO: 2569283 - RNA, 17 nt, Human
uaguagcccuuucugug

SEQ ID NO: 2569284 - RNA, 14 nt, Human
uaguagcauguuga

SEQ ID NO: 2569285 - RNA, 16 nt, Human
uaguagcccuuucugu

SEQ ID NO: 2569286 - RNA, 16 nt, Human
uagcauacguacacau

SEQ ID NO: 2569287 - RNA, 17 nt, Human
uagcauacguacacauu

SEQ ID NO: 2569288 - RNA, 18 nt, Human
uagcauacguacacauuu

SEQ ID NO: 2569289 - RNA, 19 nt, Human
uagcauacguacacauuuu

SEQ ID NO: 2569290 - RNA, 15 nt, Human
uagcagcuuccagau

SEQ ID NO: 2569291 - RNA, 14 nt, Human
uagcagcuuccaga

SEQ ID NO: 2569292 - RNA, 11 nt, Human
uagcagcugga

SEQ ID NO: 2569293 - RNA, 10 nt, Human
uagcagcugg

SEQ ID NO: 2569294 - RNA, 14 nt, Human
uagcagcuaucucu

SEQ ID NO: 2569295 - RNA, 11 nt, Human
uagcagggaaa

SEQ ID NO: 2569296 - RNA, 22 nt, Human
uagcagcggaacaaggagucag

SEQ ID NO: 2569297 - RNA, 23 nt, Human
uagcaucuucuggagucuccagu

SEQ ID NO: 2569298 - RNA, 22 nt, Human
uagcaucuucuggagucuccag

SEQ ID NO: 2569299 - RNA, 16 nt, Human
uagcaucuucuggagu

SEQ ID NO: 2569300 - RNA, 13 nt, Human
uagcaucuucugg

SEQ ID NO: 2569301 - RNA, 23 nt, Human
uagcauaucugccuuuauugugu

SEQ ID NO: 2569302 - RNA, 22 nt, Human
uagcauaucugccuuuauugug

SEQ ID NO: 2569303 - RNA, 21 nt, Human
uagcauaucugccuuuauugu

SEQ ID NO: 2569304 - RNA, 18 nt, Human
uagcauaucugccuuuau

SEQ ID NO: 2569305 - RNA, 12 nt, Human
uagcauaucaau

SEQ ID NO: 2569306 - RNA, 14 nt, Human
uagcauaugaguuu

SEQ ID NO: 2569307 - RNA, 22 nt, Human
uagcaggagaggagagccagag

SEQ ID NO: 2569308 - RNA, 21 nt, Human
uagcaggagaggagagccaga

SEQ ID NO: 2569309 - RNA, 19 nt, Human
uagcaggagaggagagcca

SEQ ID NO: 2569310 - RNA, 17 nt, Human
uagcaggagaggagagc

SEQ ID NO: 2569311 - RNA, 12 nt, Human
uagcagcuggac

SEQ ID NO: 2569312 - RNA, 22 nt, Human
uagcaggacugaauugucccca

SEQ ID NO: 2569313 - RNA, 17 nt, Human
uagcauaucugccuuua

SEQ ID NO: 2569314 - RNA, 16 nt, Human
uagcauaucugccuuu

SEQ ID NO: 2569315 - RNA, 14 nt, Human
uagcauaucugccu

SEQ ID NO: 2569316 - RNA, 23 nt, Human
uagauuccccauugccuccuccu

SEQ ID NO: 2569317 - RNA, 14 nt, Human
uagauuuauuucau

SEQ ID NO: 2569318 - RNA, 15 nt, Human
uagauuuauuucauc

SEQ ID NO: 2569319 - RNA, 20 nt, Human
uagauuuggcuccucugcuu

SEQ ID NO: 2569320 - RNA, 13 nt, Human
uagauuugaccua

SEQ ID NO: 2569321 - RNA, 12 nt, Human
uagauuugaccu

SEQ ID NO: 2569322 - RNA, 24 nt, Human
uagauuuggcuccucugcuucuca

SEQ ID NO: 2569323 - RNA, 18 nt, Human
uagauuagcucuggacca

SEQ ID NO: 2569324 - RNA, 16 nt, Human
uagauuagcucuggac

SEQ ID NO: 2569325 - RNA, 16 nt, Human
uagauuauggagcuuu

SEQ ID NO: 2569326 - RNA, 15 nt, Human
uagauuagcucugga

SEQ ID NO: 2569327 - RNA, 14 nt, Human
uagauuagcucugg

SEQ ID NO: 2569328 - RNA, 20 nt, Human
uagauuagaucuuuuaagcc

SEQ ID NO: 2569329 - RNA, 17 nt, Human
uagauuauggagcuuuu

SEQ ID NO: 2569330 - RNA, 21 nt, Human
uagauuacccccucauuguuu

SEQ ID NO: 2569331 - RNA, 16 nt, Human
uagaguuagacuguug

SEQ ID NO: 2569332 - RNA, 15 nt, Human
uagaguuagacuguu

SEQ ID NO: 2569333 - RNA, 17 nt, Human
uagaguuagacuguugg

SEQ ID NO: 2569334 - RNA, 16 nt, Human
uagauacuguaucaug

SEQ ID NO: 2569335 - RNA, 14 nt, Human
uagauaggccaugg

SEQ ID NO: 2569336 - RNA, 23 nt, Human
uagauagaaauaaauagcuauau

SEQ ID NO: 2569337 - RNA, 12 nt, Human
uagauagaaaua

SEQ ID NO: 2569338 - RNA, 21 nt, Human
uagauagaaauaaauagcuau

SEQ ID NO: 2569339 - RNA, 11 nt, Human
uagauagaaau

SEQ ID NO: 2569340 - RNA, 19 nt, Human
uagcugggacuacaggcac

SEQ ID NO: 2569341 - RNA, 17 nt, Human
uagcugggacuacaggc

SEQ ID NO: 2569342 - RNA, 15 nt, Human
uagcugggacuacag

SEQ ID NO: 2569343 - RNA, 12 nt, Human
uagcugggacua

SEQ ID NO: 2569344 - RNA, 12 nt, Human
uagcucaguuua

SEQ ID NO: 2569345 - RNA, 23 nt, Human
uagcugacccagccccuugagaa

SEQ ID NO: 2569346 - RNA, 21 nt, Human
uagcugacccagccccuugag

SEQ ID NO: 2569347 - RNA, 16 nt, Human
uagcugcaaaggacag

SEQ ID NO: 2569348 - RNA, 23 nt, Human
uagcugcacagggcagcugggcc

SEQ ID NO: 2569349 - RNA, 17 nt, Human
uagcugcaaaggacaga

SEQ ID NO: 2569350 - RNA, 21 nt, Human
uagcugcauccuccaagaauc

SEQ ID NO: 2569351 - RNA, 11 nt, Human
uagcugcagaa

SEQ ID NO: 2569352 - RNA, 12 nt, Human
uagcugcagaac

SEQ ID NO: 2569353 - RNA, 23 nt, Human
uagcugaugaacuuauucuguag

SEQ ID NO: 2569354 - RNA, 21 nt, Human
uagcugaugaacuuauucugu

SEQ ID NO: 2569355 - RNA, 17 nt, Human
uagcugagcgugguggc

SEQ ID NO: 2569356 - RNA, 11 nt, Human
uagcugagugu

SEQ ID NO: 2569357 - RNA, 21 nt, Human
uagcucaggugucccugcacu

SEQ ID NO: 2569358 - RNA, 20 nt, Human
uagcucaggugucccugcac

SEQ ID NO: 2569359 - RNA, 12 nt, Human
uagcucauucuc

SEQ ID NO: 2569360 - RNA, 11 nt, Human
uagcucaguuu

SEQ ID NO: 2569361 - RNA, 18 nt, Human
uagccugugccucuggga

SEQ ID NO: 2569362 - RNA, 20 nt, Human
uagccugugccucugggacu

SEQ ID NO: 2569363 - RNA, 22 nt, Human
uagccuggauauuauucuugua

SEQ ID NO: 2569364 - RNA, 14 nt, Human
uagccugggguggg

SEQ ID NO: 2569365 - RNA, 17 nt, Human
uagccugggccacaggg

SEQ ID NO: 2569366 - RNA, 20 nt, Human
uagccuaauacaacauguag

SEQ ID NO: 2569367 - RNA, 19 nt, Human
uagccagcacuuguauaua

SEQ ID NO: 2569368 - RNA, 20 nt, Human
uagccagcacacagggcagu

SEQ ID NO: 2569369 - RNA, 14 nt, Human
uagccagcugcucc

SEQ ID NO: 2569370 - RNA, 15 nt, Human
uagccagcugcuccc

SEQ ID NO: 2569371 - RNA, 18 nt, Human
uagccagcugcuccccag

SEQ ID NO: 2569372 - RNA, 22 nt, Human
uagccagggggacuagccccug

SEQ ID NO: 2569373 - RNA, 23 nt, Human
uagccaggaucaugguguaauaa

SEQ ID NO: 2569374 - RNA, 22 nt, Human
uagccaggaucaugguguaaua

SEQ ID NO: 2569375 - RNA, 20 nt, Human
uagccaggaucaugguguaa

SEQ ID NO: 2569376 - RNA, 18 nt, Human
uagccaggaucauggugu

SEQ ID NO: 2569377 - RNA, 15 nt, Human
uagccaggaucaugg

SEQ ID NO: 2569378 - RNA, 13 nt, Human
uagccaggaucau

SEQ ID NO: 2569379 - RNA, 13 nt, Human
uagccccauaauu

SEQ ID NO: 2569380 - RNA, 16 nt, Human
uagccaguugaauuua

SEQ ID NO: 2569381 - RNA, 22 nt, Human
uagccaggguguggcccugcca

SEQ ID NO: 2569382 - RNA, 19 nt, Human
uagcaugaggccacugcug

SEQ ID NO: 2569383 - RNA, 15 nt, Human
uagcaugacauuucu

SEQ ID NO: 2569384 - RNA, 16 nt, Human
uagcaugacauuucuu

SEQ ID NO: 2569385 - RNA, 21 nt, Human
uagcaugacaagccccaggca

SEQ ID NO: 2569386 - RNA, 22 nt, Human
uagcaugacaagccccaggcag

SEQ ID NO: 2569387 - RNA, 16 nt, Human
uagcaugacaagcccc

SEQ ID NO: 2569388 - RNA, 17 nt, Human
uagcaugacaagcccca

SEQ ID NO: 2569389 - RNA, 18 nt, Human
uagcaugacaagccccag

SEQ ID NO: 2569390 - RNA, 20 nt, Human
uagcaugacaagccccaggc

SEQ ID NO: 2569391 - RNA, 16 nt, Human
uagccccucuccugga

SEQ ID NO: 2569392 - RNA, 16 nt, Human
uagcccgaauacaaac

SEQ ID NO: 2569393 - RNA, 15 nt, Human
uagcccgaauacaaa

SEQ ID NO: 2569394 - RNA, 18 nt, Human
uagccccuuagcccccac

SEQ ID NO: 2569395 - RNA, 16 nt, Human
uagcccccuggccucu

SEQ ID NO: 2569396 - RNA, 17 nt, Human
uagcccccuggccucug

SEQ ID NO: 2569397 - RNA, 18 nt, Human
uagcccccuggccucugu

SEQ ID NO: 2569398 - RNA, 15 nt, Human
uagcccccuggccuc

SEQ ID NO: 2569399 - RNA, 19 nt, Human
uagcccccaggcugcugga

SEQ ID NO: 2569400 - RNA, 15 nt, Human
uagcccccacccacu

SEQ ID NO: 2569401 - RNA, 18 nt, Human
uagcccccacccacuucc

SEQ ID NO: 2569402 - RNA, 18 nt, Human
uagcccccaggcugcugg

SEQ ID NO: 2569403 - RNA, 20 nt, Human
uagccuaacacacuccaaga

SEQ ID NO: 2569404 - RNA, 12 nt, Human
uagcccgccugc

SEQ ID NO: 2569405 - RNA, 16 nt, Human
uagccgaccucagccu

SEQ ID NO: 2569406 - RNA, 17 nt, Human
uagccgaccucagccuu

SEQ ID NO: 2569407 - RNA, 14 nt, Human
uagccgagagccug

SEQ ID NO: 2569408 - RNA, 15 nt, Human
uagccgagagccugc

SEQ ID NO: 2569409 - RNA, 17 nt, Human
uagccgagagccugcuc

SEQ ID NO: 2569410 - RNA, 18 nt, Human
uagccgagagccugcucc

SEQ ID NO: 2569411 - RNA, 19 nt, Human
uagccgggcaugguggcgc

SEQ ID NO: 2569412 - RNA, 19 nt, Human
uagccgagagccugcuccc

SEQ ID NO: 2569413 - RNA, 16 nt, Human
uagaauguauuguacc

SEQ ID NO: 2569414 - RNA, 13 nt, Human
uagaauguauugu

SEQ ID NO: 2569415 - RNA, 18 nt, Human
uagaauguauuguaccuu

SEQ ID NO: 2569416 - RNA, 17 nt, Human
uagaauguauuguaccu

SEQ ID NO: 2569417 - RNA, 22 nt, Human
uagaauguauuguaccuuuuaa

SEQ ID NO: 2569418 - RNA, 13 nt, Human
uagaauguguuuu

SEQ ID NO: 2569419 - RNA, 20 nt, Human
uagaauguguuuucugaaua

SEQ ID NO: 2569420 - RNA, 18 nt, Human
uagaauguguuuucugaa

SEQ ID NO: 2569421 - RNA, 16 nt, Human
uagaaugauuucaugc

SEQ ID NO: 2569422 - RNA, 15 nt, Human
uagaauccaaacuug

SEQ ID NO: 2569423 - RNA, 23 nt, Human
uagaauccaaacuuggauuuuug

SEQ ID NO: 2569424 - RNA, 21 nt, Human
uagaaugauuucaugcuaucu

SEQ ID NO: 2569425 - RNA, 20 nt, Human
uagaaugaaaauuguauguu

SEQ ID NO: 2569426 - RNA, 12 nt, Human
uagaaugaaaau

SEQ ID NO: 2569427 - RNA, 12 nt, Human
uagaaucuggag

SEQ ID NO: 2569428 - RNA, 17 nt, Human
uagaaugaaaacucauu

SEQ ID NO: 2569429 - RNA, 15 nt, Human
uagaauuaacacaug

SEQ ID NO: 2569430 - RNA, 16 nt, Human
uagaauuaacacauga

SEQ ID NO: 2569431 - RNA, 18 nt, Human
uagaauuaacacaugauc

SEQ ID NO: 2569432 - RNA, 23 nt, Human
uagaauuaguggcacuugcuuuu

SEQ ID NO: 2569433 - RNA, 16 nt, Human
uagaauuauuuaaaca

SEQ ID NO: 2569434 - RNA, 20 nt, Human
uagaauucccucucucugac

SEQ ID NO: 2569435 - RNA, 19 nt, Human
uagaauucccucucucuga

SEQ ID NO: 2569436 - RNA, 15 nt, Human
uagaauucccucucu

SEQ ID NO: 2569437 - RNA, 15 nt, Human
uagaauuauuuaaac

SEQ ID NO: 2569438 - RNA, 12 nt, Human
uagaauuauuua

SEQ ID NO: 2569439 - RNA, 19 nt, Human
uagaauaaaauuguaaaau

SEQ ID NO: 2569440 - RNA, 15 nt, Human
uagaauaaaauugua

SEQ ID NO: 2569441 - RNA, 23 nt, Human
uagaauaccacaggaaccacaag

SEQ ID NO: 2569442 - RNA, 14 nt, Human
uagaauaaaauugu

SEQ ID NO: 2569443 - RNA, 22 nt, Human
uagaaguuuuuguacuguaaag

SEQ ID NO: 2569444 - RNA, 18 nt, Human
uagaaguuuuuguacugu

SEQ ID NO: 2569445 - RNA, 16 nt, Human
uagaaguuuuuguacu

SEQ ID NO: 2569446 - RNA, 14 nt, Human
uagaaguuuuugua

SEQ ID NO: 2569447 - RNA, 13 nt, Human
uagaaguuuuugu

SEQ ID NO: 2569448 - RNA, 18 nt, Human
uagaaguuguuugucauc

SEQ ID NO: 2569449 - RNA, 16 nt, Human
uagaaguuacugaaug

SEQ ID NO: 2569450 - RNA, 20 nt, Human
uagaaguuacugaaugcacc

SEQ ID NO: 2569451 - RNA, 15 nt, Human
uagaaguuacugaau

SEQ ID NO: 2569452 - RNA, 19 nt, Human
uagaagugggccaggacag

SEQ ID NO: 2569453 - RNA, 16 nt, Human
uagaauauccuacuuc

SEQ ID NO: 2569454 - RNA, 20 nt, Human
uagaauauuuauuaccucug

SEQ ID NO: 2569455 - RNA, 14 nt, Human
uagaauccaaacuu

SEQ ID NO: 2569456 - RNA, 21 nt, Human
uagaaucagccuaggggucag

SEQ ID NO: 2569457 - RNA, 19 nt, Human
uagaauauuuauuaccucu

SEQ ID NO: 2569458 - RNA, 15 nt, Human
uagaauauuuauuac

SEQ ID NO: 2569459 - RNA, 12 nt, Human
uagaauauuuau

SEQ ID NO: 2569460 - RNA, 23 nt, Human
uagaauaguguucugcaaaaaua

SEQ ID NO: 2569461 - RNA, 15 nt, Human
uagaauauaauuauc

SEQ ID NO: 2569462 - RNA, 18 nt, Human
uagaauauaauuaucgga

SEQ ID NO: 2569463 - RNA, 20 nt, Human
uacuuuaaaggaaaaaaugu

SEQ ID NO: 2569464 - RNA, 15 nt, Human
uacuuuaaaggaaaa

SEQ ID NO: 2569465 - RNA, 14 nt, Human
uacuuuaaaggaaa

SEQ ID NO: 2569466 - RNA, 21 nt, Human
uacuuuaaaggaaaaaauguu

SEQ ID NO: 2569467 - RNA, 16 nt, Human
uagaaguggaccagga

SEQ ID NO: 2569468 - RNA, 18 nt, Human
uagaaguggaccaggaca

SEQ ID NO: 2569469 - RNA, 19 nt, Human
uagaaguggaccaggacag

SEQ ID NO: 2569470 - RNA, 20 nt, Human
uagaaguggaccaggacagg

SEQ ID NO: 2569471 - RNA, 16 nt, Human
uagaagugggccagga

SEQ ID NO: 2569472 - RNA, 20 nt, Human
uagaagugggccaggacagg

SEQ ID NO: 2569473 - RNA, 19 nt, Human
uacuuguggacuaaaagau

SEQ ID NO: 2569474 - RNA, 16 nt, Human
uacuuguggacuaaaa

SEQ ID NO: 2569475 - RNA, 15 nt, Human
uacuuguggacuaaa

SEQ ID NO: 2569476 - RNA, 14 nt, Human
uacuuguggacaca

SEQ ID NO: 2569477 - RNA, 22 nt, Human
uacuuguucaaaauauguucuu

SEQ ID NO: 2569478 - RNA, 22 nt, Human
uacuuguggacuaaaagauaua

SEQ ID NO: 2569479 - RNA, 20 nt, Human
uacuuguggacuaaaagaua

SEQ ID NO: 2569480 - RNA, 23 nt, Human
uacuuguggacuaaaagauauaa

SEQ ID NO: 2569481 - RNA, 13 nt, Human
uacuuguucaaaa

SEQ ID NO: 2569482 - RNA, 15 nt, Human
uagaguuaagaagcu

SEQ ID NO: 2569483 - RNA, 13 nt, Human
uagaguuaagaag

SEQ ID NO: 2569484 - RNA, 12 nt, Human
uagaguuaagaa

SEQ ID NO: 2569485 - RNA, 17 nt, Human
uagaguuaacaaugaua

SEQ ID NO: 2569486 - RNA, 15 nt, Human
uagaguuaacaauga

SEQ ID NO: 2569487 - RNA, 18 nt, Human
uagaguguuguugagaau

SEQ ID NO: 2569488 - RNA, 16 nt, Human
uagaguguuguugaga

SEQ ID NO: 2569489 - RNA, 23 nt, Human
uagaguuaagaagcuguuguaca

SEQ ID NO: 2569490 - RNA, 19 nt, Human
uagaguuaagaagcuguug

SEQ ID NO: 2569491 - RNA, 17 nt, Human
uagaguuaagaagcugu

SEQ ID NO: 2569492 - RNA, 16 nt, Human
uagaguuaagaagcug

SEQ ID NO: 2569493 - RNA, 14 nt, Human
uagaguuagacugu

SEQ ID NO: 2569494 - RNA, 13 nt, Human
uagaguuagacug

SEQ ID NO: 2569495 - RNA, 14 nt, Human
uagaguugauacua

SEQ ID NO: 2569496 - RNA, 17 nt, Human
uagaguugauacuacag

SEQ ID NO: 2569497 - RNA, 14 nt, Human
uagaguccucacuc

SEQ ID NO: 2569498 - RNA, 17 nt, Human
uagagucugaacagcug

SEQ ID NO: 2569499 - RNA, 20 nt, Human
uagaguccucacucccaguc

SEQ ID NO: 2569500 - RNA, 16 nt, Human
uagaggugagggaagc

SEQ ID NO: 2569501 - RNA, 13 nt, Human
uagaguccucacu

SEQ ID NO: 2569502 - RNA, 19 nt, Human
uagagugagggccugaggu

SEQ ID NO: 2569503 - RNA, 15 nt, Human
uagagugucuuucca

SEQ ID NO: 2569504 - RNA, 16 nt, Human
uagagugagggccuga

SEQ ID NO: 2569505 - RNA, 15 nt, Human
uagagugagggccug

SEQ ID NO: 2569506 - RNA, 12 nt, Human
uagagugggagc

SEQ ID NO: 2569507 - RNA, 14 nt, Human
uagagguucaaaga

SEQ ID NO: 2569508 - RNA, 15 nt, Human
uagagguucaaagau

SEQ ID NO: 2569509 - RNA, 18 nt, Human
uagagacagaagcaggcu

SEQ ID NO: 2569510 - RNA, 15 nt, Human
uagagacagaagcag

SEQ ID NO: 2569511 - RNA, 14 nt, Human
uagagacagaagca

SEQ ID NO: 2569512 - RNA, 23 nt, Human
uagagguaccagcaauauguaaa

SEQ ID NO: 2569513 - RNA, 21 nt, Human
uagagacagaagcaggcugga

SEQ ID NO: 2569514 - RNA, 13 nt, Human
uagagaaggaccc

SEQ ID NO: 2569515 - RNA, 19 nt, Human
uagagaaguauacauaagu

SEQ ID NO: 2569516 - RNA, 22 nt, Human
uagagaaggacccggaggggcc

SEQ ID NO: 2569517 - RNA, 11 nt, Human
uagagacaggg

SEQ ID NO: 2569518 - RNA, 22 nt, Human
uagaauucuagugcugcugaag

SEQ ID NO: 2569519 - RNA, 20 nt, Human
uagaauucuagugcugcuga

SEQ ID NO: 2569520 - RNA, 19 nt, Human
uagaauucuagugcugcug

SEQ ID NO: 2569521 - RNA, 18 nt, Human
uagaauucuagugcugcu

SEQ ID NO: 2569522 - RNA, 16 nt, Human
uagaauucuagugcug

SEQ ID NO: 2569523 - RNA, 23 nt, Human
uagaauuccuucagggugaugcc

SEQ ID NO: 2569524 - RNA, 16 nt, Human
uagaauuccuucaggg

SEQ ID NO: 2569525 - RNA, 21 nt, Human
uagaauucccucucucugacu

SEQ ID NO: 2569526 - RNA, 22 nt, Human
uagaccacaaauagugcucgcu

SEQ ID NO: 2569527 - RNA, 18 nt, Human
uagaccaagcuuguccaa

SEQ ID NO: 2569528 - RNA, 20 nt, Human
uagacccacuggacucaccu

SEQ ID NO: 2569529 - RNA, 15 nt, Human
uagacccaucuucuu

SEQ ID NO: 2569530 - RNA, 23 nt, Human
uagaccauuuaucugggauuaug

SEQ ID NO: 2569531 - RNA, 16 nt, Human
uagacucuuacuuuuu

SEQ ID NO: 2569532 - RNA, 13 nt, Human
uagacucuuacuu

SEQ ID NO: 2569533 - RNA, 17 nt, Human
uagacucuuacuuuuua

SEQ ID NO: 2569534 - RNA, 23 nt, Human
uagacuguugggguggguauaaa

SEQ ID NO: 2569535 - RNA, 22 nt, Human
uagacuucugcuuuccacaccu

SEQ ID NO: 2569536 - RNA, 19 nt, Human
uagacuucugcuuuccaca

SEQ ID NO: 2569537 - RNA, 22 nt, Human
uagacuucgacucaggauccag

SEQ ID NO: 2569538 - RNA, 20 nt, Human
uagacuucgacucaggaucc

SEQ ID NO: 2569539 - RNA, 18 nt, Human
uagacuuaauagaaacau

SEQ ID NO: 2569540 - RNA, 18 nt, Human
uagacuucgacucaggau

SEQ ID NO: 2569541 - RNA, 21 nt, Human
uagacucaucuuacuguaccu

SEQ ID NO: 2569542 - RNA, 18 nt, Human
uagacucaucuuacugua

SEQ ID NO: 2569543 - RNA, 17 nt, Human
uagacucaucuuacugu

SEQ ID NO: 2569544 - RNA, 19 nt, Human
uagacucaucuuacuguac

SEQ ID NO: 2569545 - RNA, 23 nt, Human
uagacuaaggccauuauuguacu

SEQ ID NO: 2569546 - RNA, 19 nt, Human
uagaccuuguuacuucuga

SEQ ID NO: 2569547 - RNA, 17 nt, Human
uagaccuuguuacuucu

SEQ ID NO: 2569548 - RNA, 21 nt, Human
uaccgagucucuucuccacug

SEQ ID NO: 2569549 - RNA, 18 nt, Human
uaccgagucucuucucca

SEQ ID NO: 2569550 - RNA, 17 nt, Human
uaccgagucucuucucc

SEQ ID NO: 2569551 - RNA, 19 nt, Human
uaccgaaaccuugccuuuc

SEQ ID NO: 2569552 - RNA, 18 nt, Human
uaccgaaaccuugccuuu

SEQ ID NO: 2569553 - RNA, 17 nt, Human
uaccgaaaccuugccuu

SEQ ID NO: 2569554 - RNA, 19 nt, Human
uacccagccaucugcccag

SEQ ID NO: 2569555 - RNA, 18 nt, Human
uacccagccaucugccca

SEQ ID NO: 2569556 - RNA, 17 nt, Human
uacccagccaucugccc

SEQ ID NO: 2569557 - RNA, 16 nt, Human
uacccagccaucugcc

SEQ ID NO: 2569558 - RNA, 23 nt, Human
uacccagccaucugcccaggggu

SEQ ID NO: 2569559 - RNA, 20 nt, Human
uacccagccaucugcccagg

SEQ ID NO: 2569560 - RNA, 19 nt, Human
uaccgugagcgacaaagau

SEQ ID NO: 2569561 - RNA, 15 nt, Human
uaccgcguuguaaaa

SEQ ID NO: 2569562 - RNA, 16 nt, Human
uaccgcguuguaaaau

SEQ ID NO: 2569563 - RNA, 14 nt, Human
uaccgcguuguaaa

SEQ ID NO: 2569564 - RNA, 22 nt, Human
uaccgagucucuucuccacugg

SEQ ID NO: 2569565 - RNA, 22 nt, Human
uaccuaacgaaguauccuucag

SEQ ID NO: 2569566 - RNA, 15 nt, Human
uaccguuucuucccu

SEQ ID NO: 2569567 - RNA, 14 nt, Human
uaccguuucuuccc

SEQ ID NO: 2569568 - RNA, 19 nt, Human
uaccuaaaaggaaaucuca

SEQ ID NO: 2569569 - RNA, 22 nt, Human
uaccuaaaaggaaaucucaccc

SEQ ID NO: 2569570 - RNA, 23 nt, Human
uaccuaaaaggaaaucucacccc

SEQ ID NO: 2569571 - RNA, 14 nt, Human
uacccagccaucug

SEQ ID NO: 2569572 - RNA, 13 nt, Human
uacccagagcauu

SEQ ID NO: 2569573 - RNA, 20 nt, Human
uacccagagaauauauacau

SEQ ID NO: 2569574 - RNA, 15 nt, Human
uacccagagaauaua

SEQ ID NO: 2569575 - RNA, 21 nt, Human
uacccagagaagccccuuccc

SEQ ID NO: 2569576 - RNA, 19 nt, Human
uacccagagaagccccuuc

SEQ ID NO: 2569577 - RNA, 18 nt, Human
uacccagagaagccccuu

SEQ ID NO: 2569578 - RNA, 21 nt, Human
uacccacuucuaaauagcaau

SEQ ID NO: 2569579 - RNA, 16 nt, Human
uacccagagaagcccc

SEQ ID NO: 2569580 - RNA, 22 nt, Human
uaccaaaaaucucaauauuuca

SEQ ID NO: 2569581 - RNA, 15 nt, Human
uacccacugcucugg

SEQ ID NO: 2569582 - RNA, 19 nt, Human
uacauuuuuacaauaaaua

SEQ ID NO: 2569583 - RNA, 17 nt, Human
uacauuuuuacaauaaa

SEQ ID NO: 2569584 - RNA, 21 nt, Human
uacauuuuuacaauaaauaau

SEQ ID NO: 2569585 - RNA, 23 nt, Human
uacauuuuuaagugcugcauuua

SEQ ID NO: 2569586 - RNA, 16 nt, Human
uacauuuuuacaauaa

SEQ ID NO: 2569587 - RNA, 15 nt, Human
uacauuuuuacaaua

SEQ ID NO: 2569588 - RNA, 14 nt, Human
uacauuuuuacaau

SEQ ID NO: 2569589 - RNA, 22 nt, Human
uacauggcagaguuuguguguu

SEQ ID NO: 2569590 - RNA, 16 nt, Human
uacauggccaguguga

SEQ ID NO: 2569591 - RNA, 22 nt, Human
uaccucaacccccauuucuauu

SEQ ID NO: 2569592 - RNA, 17 nt, Human
uaccucaaccuauggua

SEQ ID NO: 2569593 - RNA, 13 nt, Human
uaccuauuuucau

SEQ ID NO: 2569594 - RNA, 20 nt, Human
uaccuauuuucauuguaaaa

SEQ ID NO: 2569595 - RNA, 13 nt, Human
uaccuauguaaca

SEQ ID NO: 2569596 - RNA, 23 nt, Human
uaccuauauaauaaagcuacuga

SEQ ID NO: 2569597 - RNA, 16 nt, Human
uaccuagauuuacagc

SEQ ID NO: 2569598 - RNA, 15 nt, Human
uaccucacccugcua

SEQ ID NO: 2569599 - RNA, 11 nt, Human
uaccucagccu

SEQ ID NO: 2569600 - RNA, 15 nt, Human
uaccucacugggguc

SEQ ID NO: 2569601 - RNA, 18 nt, Human
uaccucacccugcuacac

SEQ ID NO: 2569602 - RNA, 16 nt, Human
uaccucagccuagacc

SEQ ID NO: 2569603 - RNA, 12 nt, Human
uaccucagccua

SEQ ID NO: 2569604 - RNA, 14 nt, Human
uaccucagccuaga

SEQ ID NO: 2569605 - RNA, 13 nt, Human
uaccucagucagu

SEQ ID NO: 2569606 - RNA, 20 nt, Human
uaccucagguugcugguugc

SEQ ID NO: 2569607 - RNA, 14 nt, Human
uaccucagguugcu

SEQ ID NO: 2569608 - RNA, 12 nt, Human
uaccucagguug

SEQ ID NO: 2569609 - RNA, 21 nt, Human
uaccucagguugcugguugcu

SEQ ID NO: 2569610 - RNA, 15 nt, Human
uaccuccucagggau

SEQ ID NO: 2569611 - RNA, 13 nt, Human
uaccuccucaggg

SEQ ID NO: 2569612 - RNA, 16 nt, Human
uaccucaggcagcuca

SEQ ID NO: 2569613 - RNA, 14 nt, Human
uaccucaggcagcu

SEQ ID NO: 2569614 - RNA, 18 nt, Human
uaccucaggcagcucaag

SEQ ID NO: 2569615 - RNA, 17 nt, Human
uaccucaggcagcucaa

SEQ ID NO: 2569616 - RNA, 14 nt, Human
uaccucaggcagga

SEQ ID NO: 2569617 - RNA, 15 nt, Human
uaccucaggcaggaa

SEQ ID NO: 2569618 - RNA, 19 nt, Human
uaccuauaaaguaaagcua

SEQ ID NO: 2569619 - RNA, 16 nt, Human
uaccuaucaucuuaag

SEQ ID NO: 2569620 - RNA, 14 nt, Human
uaccuacuuugacu

SEQ ID NO: 2569621 - RNA, 21 nt, Human
uaccuacuuugacuuuuugca

SEQ ID NO: 2569622 - RNA, 13 nt, Human
uaccuagauuuac

SEQ ID NO: 2569623 - RNA, 13 nt, Human
uaccuacuuugac

SEQ ID NO: 2569624 - RNA, 20 nt, Human
uaccuaccacagugucugua

SEQ ID NO: 2569625 - RNA, 16 nt, Human
uaccuaccacaguguc

SEQ ID NO: 2569626 - RNA, 17 nt, Human
uaccuaccacagugucu

SEQ ID NO: 2569627 - RNA, 18 nt, Human
uaccuaccacagugucug

SEQ ID NO: 2569628 - RNA, 19 nt, Human
uaccuaaacagauauaaau

SEQ ID NO: 2569629 - RNA, 15 nt, Human
uaccuaaacagauau

SEQ ID NO: 2569630 - RNA, 14 nt, Human
uaccuaaacagaua

SEQ ID NO: 2569631 - RNA, 21 nt, Human
uaccuaaaagagauuucaaga

SEQ ID NO: 2569632 - RNA, 15 nt, Human
uaccuaacauuauuu

SEQ ID NO: 2569633 - RNA, 22 nt, Human
uaccuaaacagauauaaauggc

SEQ ID NO: 2569634 - RNA, 15 nt, Human
uaccuaauuagagca

SEQ ID NO: 2569635 - RNA, 15 nt, Human
uaccuacauacaauu

SEQ ID NO: 2569636 - RNA, 13 nt, Human
uaccuacauguau

SEQ ID NO: 2569637 - RNA, 23 nt, Human
uaccuacauguauuuguuugcau

SEQ ID NO: 2569638 - RNA, 20 nt, Human
uaccuaauuagagcagauga

SEQ ID NO: 2569639 - RNA, 17 nt, Human
uaccuaauuagagcaga

SEQ ID NO: 2569640 - RNA, 21 nt, Human
uacgaaaagaggggaagagac

SEQ ID NO: 2569641 - RNA, 18 nt, Human
uacgaaaagaggggaaga

SEQ ID NO: 2569642 - RNA, 13 nt, Human
uaccuuuuuuaua

SEQ ID NO: 2569643 - RNA, 16 nt, Human
uaccuuuuuuauacau

SEQ ID NO: 2569644 - RNA, 17 nt, Human
uaccuuuuuuauacaua

SEQ ID NO: 2569645 - RNA, 20 nt, Human
uaccuuuuuauuugcaugug

SEQ ID NO: 2569646 - RNA, 21 nt, Human
uaccuuuuuugauaaaguuuc

SEQ ID NO: 2569647 - RNA, 20 nt, Human
uacuaauagacaauuuauua

SEQ ID NO: 2569648 - RNA, 21 nt, Human
uacuaauagacaauuuauuau

SEQ ID NO: 2569649 - RNA, 19 nt, Human
uacuaagaugacauugcua

SEQ ID NO: 2569650 - RNA, 15 nt, Human
uacuaagaugacauu

SEQ ID NO: 2569651 - RNA, 22 nt, Human
uacuaagcuuugccagcugcug

SEQ ID NO: 2569652 - RNA, 18 nt, Human
uacuaaggaguaaucugu

SEQ ID NO: 2569653 - RNA, 20 nt, Human
uacuaagcauagcaaacaga

SEQ ID NO: 2569654 - RNA, 14 nt, Human
uacuaaggaaucuu

SEQ ID NO: 2569655 - RNA, 14 nt, Human
uacuaaagaaagau

SEQ ID NO: 2569656 - RNA, 18 nt, Human
uacuaaacauuuuguuau

SEQ ID NO: 2569657 - RNA, 23 nt, Human
uacuaacaaucagcuccuuccug

SEQ ID NO: 2569658 - RNA, 13 nt, Human
uacuaacuuuccu

SEQ ID NO: 2569659 - RNA, 16 nt, Human
uacuaaagaaagauua

SEQ ID NO: 2569660 - RNA, 15 nt, Human
uacuaaagaaagauu

SEQ ID NO: 2569661 - RNA, 15 nt, Human
uacuaagaagaaaau

SEQ ID NO: 2569662 - RNA, 14 nt, Human
uacuaagaagaaaa

SEQ ID NO: 2569663 - RNA, 15 nt, Human
uacuaagaaaagaua

SEQ ID NO: 2569664 - RNA, 14 nt, Human
uaccucuuauugca

SEQ ID NO: 2569665 - RNA, 16 nt, Human
uaccucuuagcugagu

SEQ ID NO: 2569666 - RNA, 15 nt, Human
uaccucuuagcugag

SEQ ID NO: 2569667 - RNA, 14 nt, Human
uaccucuuagcuga

SEQ ID NO: 2569668 - RNA, 14 nt, Human
uaccucugugugcu

SEQ ID NO: 2569669 - RNA, 12 nt, Human
uaccucugugug

SEQ ID NO: 2569670 - RNA, 20 nt, Human
uaccuuagauuagcucugga

SEQ ID NO: 2569671 - RNA, 16 nt, Human
uaccuuagauuagcuc

SEQ ID NO: 2569672 - RNA, 22 nt, Human
uaccuuacuguggaggaaggau

SEQ ID NO: 2569673 - RNA, 17 nt, Human
uaccucuuauugcaaaa

SEQ ID NO: 2569674 - RNA, 21 nt, Human
uaccucuugagccuugaacuu

SEQ ID NO: 2569675 - RNA, 17 nt, Human
uaccucugauaccucaa

SEQ ID NO: 2569676 - RNA, 15 nt, Human
uaccucugauaccuc

SEQ ID NO: 2569677 - RNA, 14 nt, Human
uaccucugauaccu

SEQ ID NO: 2569678 - RNA, 23 nt, Human
uaccucucuuauagaauauuuau

SEQ ID NO: 2569679 - RNA, 21 nt, Human
uaccucucuuauagaauauuu

SEQ ID NO: 2569680 - RNA, 17 nt, Human
uaccucucuuauagaau

SEQ ID NO: 2569681 - RNA, 18 nt, Human
uaccucggugccuuccuc

SEQ ID NO: 2569682 - RNA, 14 nt, Human
uaccuccugagaaa

SEQ ID NO: 2569683 - RNA, 11 nt, Human
uaccuccugcc

SEQ ID NO: 2569684 - RNA, 13 nt, Human
uaccuccugccca

SEQ ID NO: 2569685 - RNA, 15 nt, Human
uaccuccugucucug

SEQ ID NO: 2569686 - RNA, 14 nt, Human
uaccuccugucucu

SEQ ID NO: 2569687 - RNA, 15 nt, Human
uaccuccugcccagg

SEQ ID NO: 2569688 - RNA, 16 nt, Human
uaccuccugcccagga

SEQ ID NO: 2569689 - RNA, 23 nt, Human
uaccuccucagggauggccguug

SEQ ID NO: 2569690 - RNA, 17 nt, Human
uaccuccucagggaugg

SEQ ID NO: 2569691 - RNA, 13 nt, Human
uaccuccugagaa

SEQ ID NO: 2569692 - RNA, 11 nt, Human
uaccuccuccu

SEQ ID NO: 2569693 - RNA, 19 nt, Human
uaccuuuuuuagaguugau

SEQ ID NO: 2569694 - RNA, 22 nt, Human
uaccuuuuuuagaguugauacu

SEQ ID NO: 2569695 - RNA, 13 nt, Human
uaccuuuuuuaga

SEQ ID NO: 2569696 - RNA, 16 nt, Human
uaccuuuuaauuaaug

SEQ ID NO: 2569697 - RNA, 21 nt, Human
uaccuuuuaacaccugaugug

SEQ ID NO: 2569698 - RNA, 12 nt, Human
uaccuuccaguc

SEQ ID NO: 2569699 - RNA, 21 nt, Human
uaccuuuugaggagccccagc

SEQ ID NO: 2569700 - RNA, 22 nt, Human
uaccuuagauuagcucuggacc

SEQ ID NO: 2569701 - RNA, 21 nt, Human
uaccuuagauuagcucuggac

SEQ ID NO: 2569702 - RNA, 13 nt, Human
uaccuucaauaaa

SEQ ID NO: 2569703 - RNA, 14 nt, Human
uaccuucaauaaag

SEQ ID NO: 2569704 - RNA, 16 nt, Human
uaccuucaauaaagua

SEQ ID NO: 2569705 - RNA, 17 nt, Human
uaccuucaauaaaguau

SEQ ID NO: 2569706 - RNA, 20 nt, Human
uaccuucaauaaaguaucua

SEQ ID NO: 2569707 - RNA, 20 nt, Human
uaccuuccagucaggaugac

SEQ ID NO: 2569708 - RNA, 14 nt, Human
uaccuucauuucag

SEQ ID NO: 2569709 - RNA, 13 nt, Human
uaccuucauuuca

SEQ ID NO: 2569710 - RNA, 19 nt, Human
uacuugcucuugaugccug

SEQ ID NO: 2569711 - RNA, 18 nt, Human
uacuugcucuugaugccu

SEQ ID NO: 2569712 - RNA, 14 nt, Human
uacuugcucuugau

SEQ ID NO: 2569713 - RNA, 13 nt, Human
uacuugcucuuga

SEQ ID NO: 2569714 - RNA, 14 nt, Human
uacuugucaaagaa

SEQ ID NO: 2569715 - RNA, 18 nt, Human
uacuugaagggccagagc

SEQ ID NO: 2569716 - RNA, 19 nt, Human
uacuugaagggccagagcc

SEQ ID NO: 2569717 - RNA, 18 nt, Human
uacuugucaaagaagguu

SEQ ID NO: 2569718 - RNA, 16 nt, Human
uacuugucaaagaagg

SEQ ID NO: 2569719 - RNA, 15 nt, Human
uacuugucaaagaag

SEQ ID NO: 2569720 - RNA, 13 nt, Human
uacuugucaauau

SEQ ID NO: 2569721 - RNA, 11 nt, Human
uacuugucaau

SEQ ID NO: 2569722 - RNA, 20 nt, Human
uacuugucaauauuuaaaca

SEQ ID NO: 2569723 - RNA, 13 nt, Human
uacuuguggacac

SEQ ID NO: 2569724 - RNA, 20 nt, Human
uacuguuugucuucucccca

SEQ ID NO: 2569725 - RNA, 12 nt, Human
uacuguuugucu

SEQ ID NO: 2569726 - RNA, 13 nt, Human
uacuguuucuguc

SEQ ID NO: 2569727 - RNA, 13 nt, Human
uacuuaacuauuc

SEQ ID NO: 2569728 - RNA, 20 nt, Human
uacuuaaauggaaaaaauga

SEQ ID NO: 2569729 - RNA, 19 nt, Human
uacuuaaagauuuaucaaa

SEQ ID NO: 2569730 - RNA, 14 nt, Human
uacuuaaagauuua

SEQ ID NO: 2569731 - RNA, 12 nt, Human
uacuuaaagauu

SEQ ID NO: 2569732 - RNA, 19 nt, Human
uacuguuugucuucucccc

SEQ ID NO: 2569733 - RNA, 17 nt, Human
uacuuaaaugaaagcau

SEQ ID NO: 2569734 - RNA, 18 nt, Human
uacuuaaaugaaagcaug

SEQ ID NO: 2569735 - RNA, 11 nt, Human
uacuugaaggg

SEQ ID NO: 2569736 - RNA, 12 nt, Human
uacuugaagggc

SEQ ID NO: 2569737 - RNA, 14 nt, Human
uacuugaagggcca

SEQ ID NO: 2569738 - RNA, 15 nt, Human
uacuugaagggccag

SEQ ID NO: 2569739 - RNA, 16 nt, Human
uacuugaagggccaga

SEQ ID NO: 2569740 - RNA, 17 nt, Human
uacuugaagggccagag

SEQ ID NO: 2569741 - RNA, 22 nt, Human
uacugcgacuuucugccuggag

SEQ ID NO: 2569742 - RNA, 21 nt, Human
uacugcgacuuucugccugga

SEQ ID NO: 2569743 - RNA, 20 nt, Human
uacugcgacuuucugccugg

SEQ ID NO: 2569744 - RNA, 19 nt, Human
uacugcgacuuucugccug

SEQ ID NO: 2569745 - RNA, 18 nt, Human
uacugcgacuuucugccu

SEQ ID NO: 2569746 - RNA, 17 nt, Human
uacugcgacuuucugcc

SEQ ID NO: 2569747 - RNA, 16 nt, Human
uacugcgacuuucugc

SEQ ID NO: 2569748 - RNA, 12 nt, Human
uacugcgacuuu

SEQ ID NO: 2569749 - RNA, 21 nt, Human
uacugcuaaguauuucccagc

SEQ ID NO: 2569750 - RNA, 20 nt, Human
uacugcuaaguauuucccag

SEQ ID NO: 2569751 - RNA, 19 nt, Human
uacugcuaaguauuuccca

SEQ ID NO: 2569752 - RNA, 15 nt, Human
uacugcuacuguaau

SEQ ID NO: 2569753 - RNA, 22 nt, Human
uacugcuaaguauuucccagca

SEQ ID NO: 2569754 - RNA, 20 nt, Human
uacugcuacuguaauuuuau

SEQ ID NO: 2569755 - RNA, 19 nt, Human
uacugcuagucuuaagaac

SEQ ID NO: 2569756 - RNA, 23 nt, Human
uacugucagcuccccucggagaa

SEQ ID NO: 2569757 - RNA, 16 nt, Human
uacuguccuacccacc

SEQ ID NO: 2569758 - RNA, 16 nt, Human
uacugugcuggagcca

SEQ ID NO: 2569759 - RNA, 15 nt, Human
uacugugcuggagcc

SEQ ID NO: 2569760 - RNA, 13 nt, Human
uacugugacugau

SEQ ID NO: 2569761 - RNA, 18 nt, Human
uacugugcuggagccacu

SEQ ID NO: 2569762 - RNA, 16 nt, Human
uacuguggaaaaauau

SEQ ID NO: 2569763 - RNA, 19 nt, Human
uacuguggaaaaauauuua

SEQ ID NO: 2569764 - RNA, 20 nt, Human
uacuguggaaaaauauuuaa

SEQ ID NO: 2569765 - RNA, 21 nt, Human
uacugucugguuuuaacaauu

SEQ ID NO: 2569766 - RNA, 20 nt, Human
uacugucugguuuuaacaau

SEQ ID NO: 2569767 - RNA, 19 nt, Human
uacugucugguuuuaacaa

SEQ ID NO: 2569768 - RNA, 16 nt, Human
uacugucugguuuuaa

SEQ ID NO: 2569769 - RNA, 15 nt, Human
uacugugaaacuggc

SEQ ID NO: 2569770 - RNA, 22 nt, Human
uacugucugguuuuaacaauuu

SEQ ID NO: 2569771 - RNA, 21 nt, Human
uacugucuucaguaagccgug

SEQ ID NO: 2569772 - RNA, 22 nt, Human
uacugucucacugaaacauuua

SEQ ID NO: 2569773 - RNA, 14 nt, Human
uacugucucacuga

SEQ ID NO: 2569774 - RNA, 16 nt, Human
uacuguuaaaggaaaa

SEQ ID NO: 2569775 - RNA, 15 nt, Human
uacuguuaaaggaaa

SEQ ID NO: 2569776 - RNA, 22 nt, Human
uacuguguuccuggcaauagug

SEQ ID NO: 2569777 - RNA, 12 nt, Human
uacuguguuccu

SEQ ID NO: 2569778 - RNA, 13 nt, Human
uacuguguuccug

SEQ ID NO: 2569779 - RNA, 14 nt, Human
uacuguguuccugg

SEQ ID NO: 2569780 - RNA, 13 nt, Human
uacuguguuucag

SEQ ID NO: 2569781 - RNA, 16 nt, Human
uacuguguuccuggca

SEQ ID NO: 2569782 - RNA, 19 nt, Human
uacuguguuccuggcaaua

SEQ ID NO: 2569783 - RNA, 22 nt, Human
uacuguggaggaaggauuguaa

SEQ ID NO: 2569784 - RNA, 22 nt, Human
uacugugugugugaaugaacac

SEQ ID NO: 2569785 - RNA, 23 nt, Human
uacugugugugugaaugaacacu

SEQ ID NO: 2569786 - RNA, 23 nt, Human
uacuguggaggaaggauuguaaa

SEQ ID NO: 2569787 - RNA, 21 nt, Human
uacugugugugugaaugaaca

SEQ ID NO: 2569788 - RNA, 18 nt, Human
uacuguggaggaaggauu

SEQ ID NO: 2569789 - RNA, 16 nt, Human
uacuguggaggaagga

SEQ ID NO: 2569790 - RNA, 14 nt, Human
uacuguggaggaag

SEQ ID NO: 2569791 - RNA, 12 nt, Human
uacuguggagga

SEQ ID NO: 2569792 - RNA, 18 nt, Human
uacuguggaaaagaaaca

SEQ ID NO: 2569793 - RNA, 22 nt, Human
uacuacaguccucccaucucac

SEQ ID NO: 2569794 - RNA, 16 nt, Human
uacuaauuccacaccu

SEQ ID NO: 2569795 - RNA, 16 nt, Human
uacuaauuuucuagau

SEQ ID NO: 2569796 - RNA, 23 nt, Human
uacuaaggaguaaucuguguaca

SEQ ID NO: 2569797 - RNA, 22 nt, Human
uacuaaggaguaaucuguguac

SEQ ID NO: 2569798 - RNA, 13 nt, Human
uacuaauuccaca

SEQ ID NO: 2569799 - RNA, 16 nt, Human
uacuaaugauguuuuc

SEQ ID NO: 2569800 - RNA, 13 nt, Human
uacuaaugauguu

SEQ ID NO: 2569801 - RNA, 14 nt, Human
uacuaaugauguuu

SEQ ID NO: 2569802 - RNA, 15 nt, Human
uacuaaugauguuuu

SEQ ID NO: 2569803 - RNA, 13 nt, Human
uacuacaguuugu

SEQ ID NO: 2569804 - RNA, 14 nt, Human
uacuacaguuuguu

SEQ ID NO: 2569805 - RNA, 21 nt, Human
uacuacaguuguuuuuugaaa

SEQ ID NO: 2569806 - RNA, 14 nt, Human
uacucauguguaug

SEQ ID NO: 2569807 - RNA, 13 nt, Human
uacucauguguau

SEQ ID NO: 2569808 - RNA, 12 nt, Human
uacucaugugua

SEQ ID NO: 2569809 - RNA, 23 nt, Human
uacuacaguuguuuuuugaaaac

SEQ ID NO: 2569810 - RNA, 22 nt, Human
uacucauguguaugggcaaaaa

SEQ ID NO: 2569811 - RNA, 20 nt, Human
uacucauguguaugggcaaa

SEQ ID NO: 2569812 - RNA, 14 nt, Human
uacucauucaggga

SEQ ID NO: 2569813 - RNA, 18 nt, Human
uacucauuccccggggcg

SEQ ID NO: 2569814 - RNA, 18 nt, Human
uacucgaguuacagacaa

SEQ ID NO: 2569815 - RNA, 22 nt, Human
uacucgaguuacagacaaagcg

SEQ ID NO: 2569816 - RNA, 12 nt, Human
uacuccucccag

SEQ ID NO: 2569817 - RNA, 14 nt, Human
uacuccuaccucag

SEQ ID NO: 2569818 - RNA, 15 nt, Human
uacuccuaccucagc

SEQ ID NO: 2569819 - RNA, 16 nt, Human
uacuccuaccucagcc

SEQ ID NO: 2569820 - RNA, 17 nt, Human
uacuccuaccucagccu

SEQ ID NO: 2569821 - RNA, 15 nt, Human
uacuccccuccuuga

SEQ ID NO: 2569822 - RNA, 10 nt, Human
uacuccccuu

SEQ ID NO: 2569823 - RNA, 22 nt, Human
uacucccucaaagcacacguca

SEQ ID NO: 2569824 - RNA, 15 nt, Human
uacuccccuugagcu

SEQ ID NO: 2569825 - RNA, 16 nt, Human
uacuccccuugagcug

SEQ ID NO: 2569826 - RNA, 20 nt, Human
uacucauucauuuauucauu

SEQ ID NO: 2569827 - RNA, 19 nt, Human
uacuccaguggugaagaaa

SEQ ID NO: 2569828 - RNA, 14 nt, Human
uacuccagugguga

SEQ ID NO: 2569829 - RNA, 21 nt, Human
uacuccagugccaacaauccu

SEQ ID NO: 2569830 - RNA, 14 nt, Human
uacucccagacacc

SEQ ID NO: 2569831 - RNA, 22 nt, Human
uacucccacucccggccuguca

SEQ ID NO: 2569832 - RNA, 24 nt, Human
uacugccagaugcugauguucagu

SEQ ID NO: 2569833 - RNA, 21 nt, Human
uacugccagaugcugauguuc

SEQ ID NO: 2569834 - RNA, 18 nt, Human
uacugccagaugcugaug

SEQ ID NO: 2569835 - RNA, 17 nt, Human
uacugccagaugcugau

SEQ ID NO: 2569836 - RNA, 16 nt, Human
uacugccagaugcuga

SEQ ID NO: 2569837 - RNA, 15 nt, Human
uacugccagaugcug

SEQ ID NO: 2569838 - RNA, 14 nt, Human
uacugccagaugcu

SEQ ID NO: 2569839 - RNA, 12 nt, Human
uacugccagaug

SEQ ID NO: 2569840 - RNA, 14 nt, Human
uacugccacucuuu

SEQ ID NO: 2569841 - RNA, 22 nt, Human
uacugcccaggccugccuguuc

SEQ ID NO: 2569842 - RNA, 21 nt, Human
uacugcccaggccugccuguu

SEQ ID NO: 2569843 - RNA, 20 nt, Human
uacugcccaggccugccugu

SEQ ID NO: 2569844 - RNA, 19 nt, Human
uacugcccaggccugccug

SEQ ID NO: 2569845 - RNA, 21 nt, Human
uacugccuauuuuaauaaaca

SEQ ID NO: 2569846 - RNA, 14 nt, Human
uacugccuauuuua

SEQ ID NO: 2569847 - RNA, 23 nt, Human
uacugcccuccagcucuuuccuc

SEQ ID NO: 2569848 - RNA, 22 nt, Human
uacugcccuccagcucuuuccu

SEQ ID NO: 2569849 - RNA, 22 nt, Human
uacugcccggggcagcugccag

SEQ ID NO: 2569850 - RNA, 20 nt, Human
uacugccauucacuucauaa

SEQ ID NO: 2569851 - RNA, 23 nt, Human
uacugcccaauaugcaguucugc

SEQ ID NO: 2569852 - RNA, 19 nt, Human
uacugcccggggcagcugc

SEQ ID NO: 2569853 - RNA, 18 nt, Human
uacugcaaaugucaucag

SEQ ID NO: 2569854 - RNA, 17 nt, Human
uacugauuuuugugauu

SEQ ID NO: 2569855 - RNA, 15 nt, Human
uacugauuuuuguga

SEQ ID NO: 2569856 - RNA, 17 nt, Human
uacugauuuuuguaaga

SEQ ID NO: 2569857 - RNA, 13 nt, Human
uacugauuuuugu

SEQ ID NO: 2569858 - RNA, 21 nt, Human
uacugauuuccuuuggagcuu

SEQ ID NO: 2569859 - RNA, 15 nt, Human
uacugauuguuucau

SEQ ID NO: 2569860 - RNA, 13 nt, Human
uacugcaugcacu

SEQ ID NO: 2569861 - RNA, 22 nt, Human
uacugcagccuuugccuccccg

SEQ ID NO: 2569862 - RNA, 11 nt, Human
uacugccaaag

SEQ ID NO: 2569863 - RNA, 20 nt, Human
uacugcagccuuugccuccc

SEQ ID NO: 2569864 - RNA, 22 nt, Human
uacugcagaauacaguaagcug

SEQ ID NO: 2569865 - RNA, 19 nt, Human
uacugcaauuaaagugaua

SEQ ID NO: 2569866 - RNA, 14 nt, Human
uacugcaagaaaau

SEQ ID NO: 2569867 - RNA, 17 nt, Human
uacugcagaauacagua

SEQ ID NO: 2569868 - RNA, 15 nt, Human
uacugcaagaaaaug

SEQ ID NO: 2569869 - RNA, 20 nt, Human
uacaggaugaugacuaugga

SEQ ID NO: 2569870 - RNA, 18 nt, Human
uacaguuccuagguauaa

SEQ ID NO: 2569871 - RNA, 23 nt, Human
uacaguucggugagcuacaaaug

SEQ ID NO: 2569872 - RNA, 15 nt, Human
uacaggaaguacugg

SEQ ID NO: 2569873 - RNA, 14 nt, Human
uacaggaaguacug

SEQ ID NO: 2569874 - RNA, 22 nt, Human
uacaggaaguacuggagaaaau

SEQ ID NO: 2569875 - RNA, 15 nt, Human
uacaggagugagcac

SEQ ID NO: 2569876 - RNA, 18 nt, Human
uacaguuuguuaguauga

SEQ ID NO: 2569877 - RNA, 21 nt, Human
uacaguuugcuguacuagaga

SEQ ID NO: 2569878 - RNA, 16 nt, Human
uacaguuugcuguacu

SEQ ID NO: 2569879 - RNA, 15 nt, Human
uacaguuugcuguac

SEQ ID NO: 2569880 - RNA, 13 nt, Human
uacaguuucaaaa

SEQ ID NO: 2569881 - RNA, 12 nt, Human
uacaguuucaaa

SEQ ID NO: 2569882 - RNA, 20 nt, Human
uacaguuguuuuuugaaaac

SEQ ID NO: 2569883 - RNA, 20 nt, Human
uacaguugaaaaacagcuga

SEQ ID NO: 2569884 - RNA, 22 nt, Human
uacaguucuucgggaagagagg

SEQ ID NO: 2569885 - RNA, 21 nt, Human
uacaguucuucgggaagagag

SEQ ID NO: 2569886 - RNA, 18 nt, Human
uacaguucuucgggaaga

SEQ ID NO: 2569887 - RNA, 18 nt, Human
uacaguuguuggccuccg

SEQ ID NO: 2569888 - RNA, 16 nt, Human
uacaguuguuggccuc

SEQ ID NO: 2569889 - RNA, 19 nt, Human
uacaguuggaaauccaucc

SEQ ID NO: 2569890 - RNA, 15 nt, Human
uacaguuguuggccu

SEQ ID NO: 2569891 - RNA, 12 nt, Human
uacaguucuucg

SEQ ID NO: 2569892 - RNA, 11 nt, Human
uacaguucuuc

SEQ ID NO: 2569893 - RNA, 16 nt, Human
uacagcuguuuaagau

SEQ ID NO: 2569894 - RNA, 17 nt, Human
uacaguugaaaaacagc

SEQ ID NO: 2569895 - RNA, 19 nt, Human
uacaguugaaaaacagcug

SEQ ID NO: 2569896 - RNA, 14 nt, Human
uacacuuacuguug

SEQ ID NO: 2569897 - RNA, 21 nt, Human
uacacuuacuguuguccuaug

SEQ ID NO: 2569898 - RNA, 19 nt, Human
uacacuuacuguuguccua

SEQ ID NO: 2569899 - RNA, 18 nt, Human
uacagcuaaucagcauuc

SEQ ID NO: 2569900 - RNA, 16 nt, Human
uacagcuaaucagcau

SEQ ID NO: 2569901 - RNA, 22 nt, Human
uacacuguuucaaacuuuacua

SEQ ID NO: 2569902 - RNA, 16 nt, Human
uacacuuacacuuuau

SEQ ID NO: 2569903 - RNA, 23 nt, Human
uacacugugcugagucugaaggc

SEQ ID NO: 2569904 - RNA, 22 nt, Human
uacacugugcugagucugaagg

SEQ ID NO: 2569905 - RNA, 20 nt, Human
uacacuguuucaaacuuuac

SEQ ID NO: 2569906 - RNA, 21 nt, Human
uacagcucagaaguuucuucu

SEQ ID NO: 2569907 - RNA, 19 nt, Human
uacagcgagaggcagagaa

SEQ ID NO: 2569908 - RNA, 16 nt, Human
uacagcgagaggcaga

SEQ ID NO: 2569909 - RNA, 20 nt, Human
uacagcgagaggcagagaaa

SEQ ID NO: 2569910 - RNA, 19 nt, Human
uacagcugagcacauucug

SEQ ID NO: 2569911 - RNA, 13 nt, Human
uacagcugccugc

SEQ ID NO: 2569912 - RNA, 20 nt, Human
uacagcuggguggcacugcc

SEQ ID NO: 2569913 - RNA, 14 nt, Human
uacagcugccugca

SEQ ID NO: 2569914 - RNA, 14 nt, Human
uacagcuguuuaag

SEQ ID NO: 2569915 - RNA, 24 nt, Human
uacagcuggguggcacugccaugc

SEQ ID NO: 2569916 - RNA, 21 nt, Human
uacagcuggguggcacugcca

SEQ ID NO: 2569917 - RNA, 20 nt, Human
uacagcuugaccgugaggcc

SEQ ID NO: 2569918 - RNA, 13 nt, Human
uacaggaaguacu

SEQ ID NO: 2569919 - RNA, 18 nt, Human
uacaggaagguagaaaua

SEQ ID NO: 2569920 - RNA, 16 nt, Human
uacauaaacaaguccu

SEQ ID NO: 2569921 - RNA, 13 nt, Human
uacauaaaggugg

SEQ ID NO: 2569922 - RNA, 15 nt, Human
uacauaacugaaaau

SEQ ID NO: 2569923 - RNA, 17 nt, Human
uacauaacugaaaaugu

SEQ ID NO: 2569924 - RNA, 21 nt, Human
uacauaacugaaaaugugcua

SEQ ID NO: 2569925 - RNA, 13 nt, Human
uacauaacugaaa

SEQ ID NO: 2569926 - RNA, 21 nt, Human
uacauaaaggugguaugugug

SEQ ID NO: 2569927 - RNA, 19 nt, Human
uacaguuuguuaguaugag

SEQ ID NO: 2569928 - RNA, 21 nt, Human
uacaguuuguuaguaugaggc

SEQ ID NO: 2569929 - RNA, 16 nt, Human
uacaguuuguuuacac

SEQ ID NO: 2569930 - RNA, 15 nt, Human
uacaguuuguuuaca

SEQ ID NO: 2569931 - RNA, 17 nt, Human
uacaguuugucacauga

SEQ ID NO: 2569932 - RNA, 17 nt, Human
uacaguuugcuguacua

SEQ ID NO: 2569933 - RNA, 17 nt, Human
uacaguuuguuuacaca

SEQ ID NO: 2569934 - RNA, 17 nt, Human
uacaugaaaacacauuu

SEQ ID NO: 2569935 - RNA, 18 nt, Human
uacaugaaaacacauuuu

SEQ ID NO: 2569936 - RNA, 19 nt, Human
uacaugaaaacacauuuuu

SEQ ID NO: 2569937 - RNA, 23 nt, Human
uacaugaaaacacauuuuucuua

SEQ ID NO: 2569938 - RNA, 16 nt, Human
uacaugaaaacacauu

SEQ ID NO: 2569939 - RNA, 20 nt, Human
uacaucuuuuuucacaaauu

SEQ ID NO: 2569940 - RNA, 18 nt, Human
uacaucuuuuuucacaaa

SEQ ID NO: 2569941 - RNA, 17 nt, Human
uacaucuuuuuucacaa

SEQ ID NO: 2569942 - RNA, 20 nt, Human
uacaucuuuucaacaaguaa

SEQ ID NO: 2569943 - RNA, 17 nt, Human
uacauaaacugacuuua

SEQ ID NO: 2569944 - RNA, 15 nt, Human
uacaucuuucacauu

SEQ ID NO: 2569945 - RNA, 20 nt, Human
uacaucuuucacauuggcua

SEQ ID NO: 2569946 - RNA, 16 nt, Human
uacauaagauaaaugu

SEQ ID NO: 2569947 - RNA, 17 nt, Human
uacauaagauaaaugug

SEQ ID NO: 2569948 - RNA, 12 nt, Human
uacaugaaacag

SEQ ID NO: 2569949 - RNA, 13 nt, Human
uacaugaaacaga

SEQ ID NO: 2569950 - RNA, 14 nt, Human
uacaugaaacagaa

SEQ ID NO: 2569951 - RNA, 15 nt, Human
uacaugaaacagaaa

SEQ ID NO: 2569952 - RNA, 22 nt, Human
uacaugcaauuuauuaaaauga

SEQ ID NO: 2569953 - RNA, 21 nt, Human
uacaugcacuuggcugcauaa

SEQ ID NO: 2569954 - RNA, 21 nt, Human
uacaugaaacagaaacaaaaa

SEQ ID NO: 2569955 - RNA, 11 nt, Human
uacaugcauac

SEQ ID NO: 2569956 - RNA, 22 nt, Human
uacaugcagcccaugcccaccu

SEQ ID NO: 2569957 - RNA, 14 nt, Human
uacaugcagcccau

SEQ ID NO: 2569958 - RNA, 17 nt, Human
uacaugcagcccaugcc

SEQ ID NO: 2569959 - RNA, 19 nt, Human
uacaugcauacuucaaaag

SEQ ID NO: 2569960 - RNA, 17 nt, Human
uacaugcauacuucaaa

SEQ ID NO: 2569961 - RNA, 14 nt, Human
uacaugcauacuuc

SEQ ID NO: 2569962 - RNA, 14 nt, Human
uacaugcugcuaau

SEQ ID NO: 2569963 - RNA, 12 nt, Human
uacaugcugcua

SEQ ID NO: 2569964 - RNA, 15 nt, Human
uacaugcucuuagaa

SEQ ID NO: 2569965 - RNA, 15 nt, Human
uacaugcuuugugaa

SEQ ID NO: 2569966 - RNA, 16 nt, Human
uacaugcuuugugaac

SEQ ID NO: 2569967 - RNA, 14 nt, Human
uacaugccagugac

SEQ ID NO: 2569968 - RNA, 21 nt, Human
uacaugcauacuucaaaagua

SEQ ID NO: 2569969 - RNA, 20 nt, Human
uacaugcauuacugcaugca

SEQ ID NO: 2569970 - RNA, 22 nt, Human
uacaugcauugagcucucucau

SEQ ID NO: 2569971 - RNA, 14 nt, Human
uacaugcauuugag

SEQ ID NO: 2569972 - RNA, 19 nt, Human
uacauuuuuaagugcugca

SEQ ID NO: 2569973 - RNA, 22 nt, Human
uacauuuuuaagugcugcauuu

SEQ ID NO: 2569974 - RNA, 19 nt, Human
uacauggcagaguuugugu

SEQ ID NO: 2569975 - RNA, 16 nt, Human
uacauggcagaguuug

SEQ ID NO: 2569976 - RNA, 22 nt, Human
uacauggacaauacccccaggc

SEQ ID NO: 2569977 - RNA, 14 nt, Human
uacauuuuuaagug

SEQ ID NO: 2569978 - RNA, 14 nt, Human
uacauggaauaaca

SEQ ID NO: 2569979 - RNA, 18 nt, Human
uacauggaauaacaugua

SEQ ID NO: 2569980 - RNA, 19 nt, Human
uacauggaauaacauguaa

SEQ ID NO: 2569981 - RNA, 22 nt, Human
uacauggaauaacauguaauua

SEQ ID NO: 2569982 - RNA, 13 nt, Human
uacaaaucaauca

SEQ ID NO: 2569983 - RNA, 17 nt, Human
uacaaauauaagaauaa

SEQ ID NO: 2569984 - RNA, 16 nt, Human
uacaaauauaagaaua

SEQ ID NO: 2569985 - RNA, 14 nt, Human
uacaaauauaagaa

SEQ ID NO: 2569986 - RNA, 12 nt, Human
uacaaauauaag

SEQ ID NO: 2569987 - RNA, 18 nt, Human
uacaaaguguguauuaaa

SEQ ID NO: 2569988 - RNA, 18 nt, Human
uacaaauauaagaauaaa

SEQ ID NO: 2569989 - RNA, 16 nt, Human
uacaaaucaaguauuu

SEQ ID NO: 2569990 - RNA, 23 nt, Human
uacaaauacucuuaggaagagaa

SEQ ID NO: 2569991 - RNA, 19 nt, Human
uacaaauacucuuaggaag

SEQ ID NO: 2569992 - RNA, 17 nt, Human
uacaaauacucuuagga

SEQ ID NO: 2569993 - RNA, 12 nt, Human
uacaaauacucu

SEQ ID NO: 2569994 - RNA, 19 nt, Human
uacaaaguguguauuaaaa

SEQ ID NO: 2569995 - RNA, 15 nt, Human
uacaaaguguguauu

SEQ ID NO: 2569996 - RNA, 13 nt, Human
uacaaagugaugu

SEQ ID NO: 2569997 - RNA, 13 nt, Human
uacaaagugugua

SEQ ID NO: 2569998 - RNA, 14 nt, Human
uacaaaguagaagu

SEQ ID NO: 2569999 - RNA, 18 nt, Human
uacaaaguagaagucuua

SEQ ID NO: 2570000 - RNA, 18 nt, Human
uacaaagaagacauguuu

SEQ ID NO: 2570001 - RNA, 17 nt, Human
uacaaagaagacauguu

SEQ ID NO: 2570002 - RNA, 16 nt, Human
uacaaagaagacaugu

SEQ ID NO: 2570003 - RNA, 15 nt, Human
uacaaagaagacaug

SEQ ID NO: 2570004 - RNA, 22 nt, Human
uacaaagaagacauguuuuaga

SEQ ID NO: 2570005 - RNA, 19 nt, Human
uacaaagaagacauguuuu

SEQ ID NO: 2570006 - RNA, 19 nt, Human
uacaaacucccacuuguca

SEQ ID NO: 2570007 - RNA, 13 nt, Human
uacaaagaaauaa

SEQ ID NO: 2570008 - RNA, 14 nt, Human
uacaaagaagacau

SEQ ID NO: 2570009 - RNA, 17 nt, Human
uacaaagaaauaacaag

SEQ ID NO: 2570010 - RNA, 13 nt, Human
uacaaagaagaca

SEQ ID NO: 2570011 - RNA, 17 nt, Human
uacaaacaugugguuaa

SEQ ID NO: 2570012 - RNA, 18 nt, Human
uaauuuugugaagcaaaa

SEQ ID NO: 2570013 - RNA, 20 nt, Human
uaauucucaugugauccuuu

SEQ ID NO: 2570014 - RNA, 15 nt, Human
uaauucucaggccau

SEQ ID NO: 2570015 - RNA, 12 nt, Human
uaauuuuuauau

SEQ ID NO: 2570016 - RNA, 19 nt, Human
uaauuuuguucuaguuuuc

SEQ ID NO: 2570017 - RNA, 13 nt, Human
uaauuuuuaaagu

SEQ ID NO: 2570018 - RNA, 17 nt, Human
uaauuuuuauauuugaa

SEQ ID NO: 2570019 - RNA, 16 nt, Human
uaauuuuuauauuuga

SEQ ID NO: 2570020 - RNA, 12 nt, Human
uacaaacaaugg

SEQ ID NO: 2570021 - RNA, 17 nt, Human
uacaaacaccuggacuu

SEQ ID NO: 2570022 - RNA, 22 nt, Human
uacaaacaauggaaacugaaug

SEQ ID NO: 2570023 - RNA, 12 nt, Human
uacaaacauauu

SEQ ID NO: 2570024 - RNA, 15 nt, Human
uacaaacauauuugu

SEQ ID NO: 2570025 - RNA, 18 nt, Human
uacaaacaaaauuucuau

SEQ ID NO: 2570026 - RNA, 22 nt, Human
uaauuccucucacuaaacuuua

SEQ ID NO: 2570027 - RNA, 16 nt, Human
uaauuagugcuaagug

SEQ ID NO: 2570028 - RNA, 15 nt, Human
uaauuagugcuaagu

SEQ ID NO: 2570029 - RNA, 14 nt, Human
uaauuagugcuaag

SEQ ID NO: 2570030 - RNA, 12 nt, Human
uaauuagugcua

SEQ ID NO: 2570031 - RNA, 18 nt, Human
uaauuagggguugcuaag

SEQ ID NO: 2570032 - RNA, 17 nt, Human
uaauuagggguugcuaa

SEQ ID NO: 2570033 - RNA, 13 nt, Human
uaauuuugugaag

SEQ ID NO: 2570034 - RNA, 15 nt, Human
uaauucuaugagaua

SEQ ID NO: 2570035 - RNA, 12 nt, Human
uaauucucaggc

SEQ ID NO: 2570036 - RNA, 21 nt, Human
uaauucuaaggaauaugagcu

SEQ ID NO: 2570037 - RNA, 18 nt, Human
uaauucuaaaugaauguu

SEQ ID NO: 2570038 - RNA, 11 nt, Human
uaauucuaaau

SEQ ID NO: 2570039 - RNA, 13 nt, Human
uaauucuaaggaa

SEQ ID NO: 2570040 - RNA, 12 nt, Human
uaauucuaaagg

SEQ ID NO: 2570041 - RNA, 11 nt, Human
uaauucuaaag

SEQ ID NO: 2570042 - RNA, 19 nt, Human
uacaauuuucucccaggaa

SEQ ID NO: 2570043 - RNA, 18 nt, Human
uacaauuuucucccagga

SEQ ID NO: 2570044 - RNA, 21 nt, Human
uacaauuuucucccaggaagc

SEQ ID NO: 2570045 - RNA, 11 nt, Human
uacacacacac

SEQ ID NO: 2570046 - RNA, 17 nt, Human
uacaauuuacaaagugu

SEQ ID NO: 2570047 - RNA, 16 nt, Human
uacaauuuacaaagug

SEQ ID NO: 2570048 - RNA, 22 nt, Human
uacaauuuacaaaguguguauu

SEQ ID NO: 2570049 - RNA, 21 nt, Human
uacaauuguaaaacugaggca

SEQ ID NO: 2570050 - RNA, 15 nt, Human
uacaauuuacaaagu

SEQ ID NO: 2570051 - RNA, 17 nt, Human
uacaauuguaaaacuga

SEQ ID NO: 2570052 - RNA, 14 nt, Human
uacaauugaacuua

SEQ ID NO: 2570053 - RNA, 20 nt, Human
uacaauugaacuuaaauaaa

SEQ ID NO: 2570054 - RNA, 17 nt, Human
uacaagaaaaaaugaau

SEQ ID NO: 2570055 - RNA, 14 nt, Human
uacaacuucagcag

SEQ ID NO: 2570056 - RNA, 14 nt, Human
uacaacuucaagug

SEQ ID NO: 2570057 - RNA, 23 nt, Human
uacaaccaagcucucugcaucua

SEQ ID NO: 2570058 - RNA, 20 nt, Human
uacaaccaagcucucugcau

SEQ ID NO: 2570059 - RNA, 19 nt, Human
uacaaccaagcucucugca

SEQ ID NO: 2570060 - RNA, 14 nt, Human
uacaacugaguccu

SEQ ID NO: 2570061 - RNA, 23 nt, Human
uacaacugccucgaaacacagaa

SEQ ID NO: 2570062 - RNA, 17 nt, Human
uacaacuuaaguugguc

SEQ ID NO: 2570063 - RNA, 20 nt, Human
uacaacugaguccuuaaaca

SEQ ID NO: 2570064 - RNA, 18 nt, Human
uacaacuuaaauaauaaa

SEQ ID NO: 2570065 - RNA, 13 nt, Human
uacaaauuagaaa

SEQ ID NO: 2570066 - RNA, 12 nt, Human
uacaaaugucuu

SEQ ID NO: 2570067 - RNA, 21 nt, Human
uacaaauggacauaggacuca

SEQ ID NO: 2570068 - RNA, 15 nt, Human
uacaaauuagaaaau

SEQ ID NO: 2570069 - RNA, 14 nt, Human
uacaaauuagaaaa

SEQ ID NO: 2570070 - RNA, 15 nt, Human
uacaaauugcuuacu

SEQ ID NO: 2570071 - RNA, 19 nt, Human
uacaacaagaguuuauuuc

SEQ ID NO: 2570072 - RNA, 19 nt, Human
uacaaauugcuugaaagaa

SEQ ID NO: 2570073 - RNA, 21 nt, Human
uacaaauugcuuacuuuggaa

SEQ ID NO: 2570074 - RNA, 16 nt, Human
uacaaauugcuugaaa

SEQ ID NO: 2570075 - RNA, 16 nt, Human
uacaaauuuguuauuu

SEQ ID NO: 2570076 - RNA, 20 nt, Human
uacaacagauuugugaacuc

SEQ ID NO: 2570077 - RNA, 19 nt, Human
uacaacagauuugugaacu

SEQ ID NO: 2570078 - RNA, 18 nt, Human
uacaacagauuugugaac

SEQ ID NO: 2570079 - RNA, 17 nt, Human
uacaacagauuugugaa

SEQ ID NO: 2570080 - RNA, 16 nt, Human
uacaacagauuuguga

SEQ ID NO: 2570081 - RNA, 15 nt, Human
uacaacagauuugug

SEQ ID NO: 2570082 - RNA, 14 nt, Human
uacaacagauuugu

SEQ ID NO: 2570083 - RNA, 13 nt, Human
uacaacagauuug

SEQ ID NO: 2570084 - RNA, 12 nt, Human
uacaacagauuu

SEQ ID NO: 2570085 - RNA, 22 nt, Human
uacaacaagaguuuauuuccaa

SEQ ID NO: 2570086 - RNA, 17 nt, Human
uacaaccaagcucucug

SEQ ID NO: 2570087 - RNA, 14 nt, Human
uacaaccaagcucu

SEQ ID NO: 2570088 - RNA, 20 nt, Human
uacaacagugcuaaaaaugg

SEQ ID NO: 2570089 - RNA, 14 nt, Human
uacaacagugcuaa

SEQ ID NO: 2570090 - RNA, 13 nt, Human
uacaacagugcua

SEQ ID NO: 2570091 - RNA, 21 nt, Human
uacaacagauuugugaacuca

SEQ ID NO: 2570092 - RNA, 12 nt, Human
uacaaccugcuu

SEQ ID NO: 2570093 - RNA, 17 nt, Human
uacacacucaaaucaag

SEQ ID NO: 2570094 - RNA, 15 nt, Human
uacacacugcauguu

SEQ ID NO: 2570095 - RNA, 23 nt, Human
uacacacgugcaauuuguuugug

SEQ ID NO: 2570096 - RNA, 16 nt, Human
uacacacgugcaauuu

SEQ ID NO: 2570097 - RNA, 15 nt, Human
uacacagcucuagac

SEQ ID NO: 2570098 - RNA, 17 nt, Human
uacacagucugcaagau

SEQ ID NO: 2570099 - RNA, 16 nt, Human
uacacagucugcaaga

SEQ ID NO: 2570100 - RNA, 23 nt, Human
uacacaggauccuauucucacca

SEQ ID NO: 2570101 - RNA, 16 nt, Human
uacacacucaaaucaa

SEQ ID NO: 2570102 - RNA, 19 nt, Human
uacacacacacacacagcc

SEQ ID NO: 2570103 - RNA, 20 nt, Human
uacacacacacacacagcca

SEQ ID NO: 2570104 - RNA, 21 nt, Human
uacacacacacacacagccac

SEQ ID NO: 2570105 - RNA, 14 nt, Human
uacacacacacaca

SEQ ID NO: 2570106 - RNA, 16 nt, Human
uacacacacacacaca

SEQ ID NO: 2570107 - RNA, 17 nt, Human
uacacacacacacacag

SEQ ID NO: 2570108 - RNA, 18 nt, Human
uacacacacacacacagc

SEQ ID NO: 2570109 - RNA, 12 nt, Human
uacacacacaca

SEQ ID NO: 2570110 - RNA, 13 nt, Human
uacacacacacac

SEQ ID NO: 2570111 - RNA, 21 nt, Human
uacacugugcugagucugaag

SEQ ID NO: 2570112 - RNA, 23 nt, Human
uacacugacaccuuugcaggcau

SEQ ID NO: 2570113 - RNA, 16 nt, Human
uacacugacaccuuug

SEQ ID NO: 2570114 - RNA, 17 nt, Human
uacacugaauauuuaua

SEQ ID NO: 2570115 - RNA, 18 nt, Human
uacacugaauauuuauau

SEQ ID NO: 2570116 - RNA, 16 nt, Human
uacacucuuuguaaga

SEQ ID NO: 2570117 - RNA, 20 nt, Human
uacacugaaguuaacagaga

SEQ ID NO: 2570118 - RNA, 12 nt, Human
uacacucuuaua

SEQ ID NO: 2570119 - RNA, 13 nt, Human
uacacucuuauag

SEQ ID NO: 2570120 - RNA, 18 nt, Human
uacacauucaauaagcau

SEQ ID NO: 2570121 - RNA, 20 nt, Human
uacacauucggcucccugga

SEQ ID NO: 2570122 - RNA, 21 nt, Human
uacacauguaucuaugcauuu

SEQ ID NO: 2570123 - RNA, 14 nt, Human
uacacuccagugag

SEQ ID NO: 2570124 - RNA, 17 nt, Human
uacacaucucagacccu

SEQ ID NO: 2570125 - RNA, 19 nt, Human
uacacauaauuaaaguguc

SEQ ID NO: 2570126 - RNA, 23 nt, Human
uacacauagcauguaaugguauc

SEQ ID NO: 2570127 - RNA, 11 nt, Human
uacacaguugc

SEQ ID NO: 2570128 - RNA, 20 nt, Human
uacacagggauguacaaggc

SEQ ID NO: 2570129 - RNA, 21 nt, Human
ugaaggcuggguucugauccu

SEQ ID NO: 2570130 - RNA, 20 nt, Human
ugaaggcuggguucugaucc

SEQ ID NO: 2570131 - RNA, 14 nt, Human
ugaaggcuguacac

SEQ ID NO: 2570132 - RNA, 13 nt, Human
ugaaggcuucucu

SEQ ID NO: 2570133 - RNA, 15 nt, Human
ugaaggcuucucucu

SEQ ID NO: 2570134 - RNA, 16 nt, Human
ugaaggcuucucucug

SEQ ID NO: 2570135 - RNA, 14 nt, Human
ugaaguuuacauug

SEQ ID NO: 2570136 - RNA, 19 nt, Human
ugaaggcuucucucugugg

SEQ ID NO: 2570137 - RNA, 13 nt, Human
ugaaguuugaaug

SEQ ID NO: 2570138 - RNA, 12 nt, Human
ugaaguuugaau

SEQ ID NO: 2570139 - RNA, 15 nt, Human
ugaaguuugaauguu

SEQ ID NO: 2570140 - RNA, 14 nt, Human
ugaaguuugaaugu

SEQ ID NO: 2570141 - RNA, 17 nt, Human
ugaaguuucacuccgga

SEQ ID NO: 2570142 - RNA, 14 nt, Human
ugaaguuucacucc

SEQ ID NO: 2570143 - RNA, 14 nt, Human
ugaaguuucacaug

SEQ ID NO: 2570144 - RNA, 13 nt, Human
ugaaguuucacau

SEQ ID NO: 2570145 - RNA, 21 nt, Human
ugaaguuuccuuggcuggugc

SEQ ID NO: 2570146 - RNA, 19 nt, Human
ugaaguuuccuuggcuggu

SEQ ID NO: 2570147 - RNA, 16 nt, Human
ugaaguuuccuuggcu

SEQ ID NO: 2570148 - RNA, 20 nt, Human
ugaaguuuacauuguaaaua

SEQ ID NO: 2570149 - RNA, 16 nt, Human
ugaaguuuacauugua

SEQ ID NO: 2570150 - RNA, 17 nt, Human
ugaaguuuacaaucaaa

SEQ ID NO: 2570151 - RNA, 20 nt, Human
ugaaguuugaauguuaaaua

SEQ ID NO: 2570152 - RNA, 18 nt, Human
ugaaguuugaauguuaaa

SEQ ID NO: 2570153 - RNA, 17 nt, Human
ugaaguuugaauguuaa

SEQ ID NO: 2570154 - RNA, 16 nt, Human
ugaaguuugaauguua

SEQ ID NO: 2570155 - RNA, 21 nt, Human
ugaaguuugaauguuaaauaa

SEQ ID NO: 2570156 - RNA, 18 nt, Human
ugaaguuugaacuucaua

SEQ ID NO: 2570157 - RNA, 14 nt, Human
ugaaguuuuacauu

SEQ ID NO: 2570158 - RNA, 15 nt, Human
ugaaguuuuacauug

SEQ ID NO: 2570159 - RNA, 16 nt, Human
ugaaguuuuacauugu

SEQ ID NO: 2570160 - RNA, 17 nt, Human
ugaaguuuuacauuguu

SEQ ID NO: 2570161 - RNA, 22 nt, Human
ugaaucaauaauauauuuucug

SEQ ID NO: 2570162 - RNA, 15 nt, Human
ugaaucaccuagggg

SEQ ID NO: 2570163 - RNA, 17 nt, Human
ugaaucacguaaagcua

SEQ ID NO: 2570164 - RNA, 14 nt, Human
ugaauccucucucu

SEQ ID NO: 2570165 - RNA, 16 nt, Human
ugaauccucucucugu

SEQ ID NO: 2570166 - RNA, 17 nt, Human
ugaauccucuucuuuau

SEQ ID NO: 2570167 - RNA, 21 nt, Human
ugaauccucucucuguguuac

SEQ ID NO: 2570168 - RNA, 21 nt, Human
ugaaucccccuugccacccca

SEQ ID NO: 2570169 - RNA, 21 nt, Human
ugaaucccacgcuucucuuug

SEQ ID NO: 2570170 - RNA, 19 nt, Human
ugaaucaugguuuuucuua

SEQ ID NO: 2570171 - RNA, 16 nt, Human
ugaauccuagggccug

SEQ ID NO: 2570172 - RNA, 10 nt, Human
ugaauccuac

SEQ ID NO: 2570173 - RNA, 15 nt, Human
ugaauccuaagggcu

SEQ ID NO: 2570174 - RNA, 22 nt, Human
ugaauccuaagggcuggucucu

SEQ ID NO: 2570175 - RNA, 20 nt, Human
ugaaucaguauaaacaaagu

SEQ ID NO: 2570176 - RNA, 21 nt, Human
ugaaucaguauaaacaaaguu

SEQ ID NO: 2570177 - RNA, 22 nt, Human
ugaaucaguauaaacaaaguua

SEQ ID NO: 2570178 - RNA, 16 nt, Human
ugaaucaguauaaaca

SEQ ID NO: 2570179 - RNA, 19 nt, Human
ugaaucaguauaaacaaag

SEQ ID NO: 2570180 - RNA, 21 nt, Human
ugaaucagacccuaccccacc

SEQ ID NO: 2570181 - RNA, 22 nt, Human
ugaaucagacccuaccccacca

SEQ ID NO: 2570182 - RNA, 16 nt, Human
ugaaucaccuaggggu

SEQ ID NO: 2570183 - RNA, 16 nt, Human
ugaaucagacccuacc

SEQ ID NO: 2570184 - RNA, 18 nt, Human
ugaaucagacccuacccc

SEQ ID NO: 2570185 - RNA, 23 nt, Human
ugaaucacguaaagcuagaaaug

SEQ ID NO: 2570186 - RNA, 23 nt, Human
ugaaucugauuggacauuuucuu

SEQ ID NO: 2570187 - RNA, 15 nt, Human
ugaaucuaugccaaa

SEQ ID NO: 2570188 - RNA, 14 nt, Human
ugaaucuaugccaa

SEQ ID NO: 2570189 - RNA, 12 nt, Human
ugaaucuaugcc

SEQ ID NO: 2570190 - RNA, 23 nt, Human
ugaaucuagcuuauuuugaggcu

SEQ ID NO: 2570191 - RNA, 15 nt, Human
ugaaucuagcuuauu

SEQ ID NO: 2570192 - RNA, 20 nt, Human
ugaaucuaagcagcauuucu

SEQ ID NO: 2570193 - RNA, 15 nt, Human
ugaaucuaagcagca

SEQ ID NO: 2570194 - RNA, 15 nt, Human
ugaaucgcuucucuu

SEQ ID NO: 2570195 - RNA, 22 nt, Human
ugaaucuauuauacuguauuaa

SEQ ID NO: 2570196 - RNA, 21 nt, Human
ugaaucuauuauacuguauua

SEQ ID NO: 2570197 - RNA, 19 nt, Human
ugaaucuauuauacuguau

SEQ ID NO: 2570198 - RNA, 18 nt, Human
ugaaucuaugccaaagau

SEQ ID NO: 2570199 - RNA, 16 nt, Human
ugaaucuauuuaagua

SEQ ID NO: 2570200 - RNA, 14 nt, Human
ugaaucuauuuaag

SEQ ID NO: 2570201 - RNA, 20 nt, Human
ugaaucuugucucaaugcuc

SEQ ID NO: 2570202 - RNA, 19 nt, Human
ugaaucuugucucaaugcu

SEQ ID NO: 2570203 - RNA, 16 nt, Human
ugaaucuugucucaau

SEQ ID NO: 2570204 - RNA, 15 nt, Human
ugaaucuugucucaa

SEQ ID NO: 2570205 - RNA, 13 nt, Human
ugaaucuugucuc

SEQ ID NO: 2570206 - RNA, 16 nt, Human
ugaaucuuggugucua

SEQ ID NO: 2570207 - RNA, 23 nt, Human
ugaaucuugucucaaugcucaua

SEQ ID NO: 2570208 - RNA, 21 nt, Human
ugaaucuugucucaaugcuca

SEQ ID NO: 2570209 - RNA, 11 nt, Human
ugaaugaacac

SEQ ID NO: 2570210 - RNA, 12 nt, Human
ugaaugaacacu

SEQ ID NO: 2570211 - RNA, 15 nt, Human
ugaaugaacacucuu

SEQ ID NO: 2570212 - RNA, 15 nt, Human
ugaaugaaccuucug

SEQ ID NO: 2570213 - RNA, 16 nt, Human
ugaaugaaccuucugg

SEQ ID NO: 2570214 - RNA, 15 nt, Human
ugaaugaauggcuaa

SEQ ID NO: 2570215 - RNA, 20 nt, Human
ugaaugaauggcuaagcaaa

SEQ ID NO: 2570216 - RNA, 23 nt, Human
ugaaugaugauccuaggcauuug

SEQ ID NO: 2570217 - RNA, 16 nt, Human
ugaaugauucaguguu

SEQ ID NO: 2570218 - RNA, 19 nt, Human
ugaaugauuuccaaagaga

SEQ ID NO: 2570219 - RNA, 19 nt, Human
ugaaugcacacuagccucu

SEQ ID NO: 2570220 - RNA, 11 nt, Human
ugaauuaaaac

SEQ ID NO: 2570221 - RNA, 21 nt, Human
ugaauguuuccaaccuggagu

SEQ ID NO: 2570222 - RNA, 18 nt, Human
ugaaugcaccauggucaa

SEQ ID NO: 2570223 - RNA, 22 nt, Human
ugaauguuuccaaccuggagua

SEQ ID NO: 2570224 - RNA, 19 nt, Human
ugaauguuuauuccuugau

SEQ ID NO: 2570225 - RNA, 22 nt, Human
ugaauguuuacacucuuuguaa

SEQ ID NO: 2570226 - RNA, 19 nt, Human
ugaauguuuacacucuuug

SEQ ID NO: 2570227 - RNA, 19 nt, Human
ugaaugcaccauggucaaa

SEQ ID NO: 2570228 - RNA, 18 nt, Human
ugaacuucucucagacuu

SEQ ID NO: 2570229 - RNA, 22 nt, Human
ugaacuucucucagacuuacuu

SEQ ID NO: 2570230 - RNA, 15 nt, Human
ugaacuucucucaga

SEQ ID NO: 2570231 - RNA, 21 nt, Human
ugaacuucgcaucaaaagaca

SEQ ID NO: 2570232 - RNA, 19 nt, Human
ugaacuucgcaucaaaaga

SEQ ID NO: 2570233 - RNA, 18 nt, Human
ugaacuucgcaucaaaag

SEQ ID NO: 2570234 - RNA, 14 nt, Human
ugaacuucgcauca

SEQ ID NO: 2570235 - RNA, 16 nt, Human
ugaacuuauucuguag

SEQ ID NO: 2570236 - RNA, 21 nt, Human
ugaacuuauuuacacauaguu

SEQ ID NO: 2570237 - RNA, 22 nt, Human
ugaacuuccugcagguaaacag

SEQ ID NO: 2570238 - RNA, 20 nt, Human
ugaagacucauucuucugua

SEQ ID NO: 2570239 - RNA, 19 nt, Human
ugaagacucauucuucugu

SEQ ID NO: 2570240 - RNA, 18 nt, Human
ugaacuuaaaaugaaagu

SEQ ID NO: 2570241 - RNA, 15 nt, Human
ugaacuuaaaaugaa

SEQ ID NO: 2570242 - RNA, 17 nt, Human
ugaacuuaaauaaaugu

SEQ ID NO: 2570243 - RNA, 22 nt, Human
ugaacuuaaauaaaugucauua

SEQ ID NO: 2570244 - RNA, 13 nt, Human
ugaaacauguuuc

SEQ ID NO: 2570245 - RNA, 13 nt, Human
ugaacugguucau

SEQ ID NO: 2570246 - RNA, 23 nt, Human
ugaacuggguacuuguggacaca

SEQ ID NO: 2570247 - RNA, 13 nt, Human
ugaaacagaaaca

SEQ ID NO: 2570248 - RNA, 16 nt, Human
ugaaacacuuugcaua

SEQ ID NO: 2570249 - RNA, 21 nt, Human
ugaaacaggagagaaagggga

SEQ ID NO: 2570250 - RNA, 14 nt, Human
ugaaacagaaacaa

SEQ ID NO: 2570251 - RNA, 16 nt, Human
ugaaacagaaacaaaa

SEQ ID NO: 2570252 - RNA, 20 nt, Human
ugaaacaggagagaaagggg

SEQ ID NO: 2570253 - RNA, 20 nt, Human
ugaagagaagggcagggcug

SEQ ID NO: 2570254 - RNA, 22 nt, Human
ugaagagaagggcagggcugag

SEQ ID NO: 2570255 - RNA, 15 nt, Human
ugaagacuggaagcu

SEQ ID NO: 2570256 - RNA, 24 nt, Human
ugaagagaaccgagcaaagaucaa

SEQ ID NO: 2570257 - RNA, 16 nt, Human
ugaagagauuuuucau

SEQ ID NO: 2570258 - RNA, 16 nt, Human
ugaagagauccuucug

SEQ ID NO: 2570259 - RNA, 15 nt, Human
ugaagagauuuuuca

SEQ ID NO: 2570260 - RNA, 23 nt, Human
ugaagagaccaagacucugaaau

SEQ ID NO: 2570261 - RNA, 12 nt, Human
ugaagaggaaaa

SEQ ID NO: 2570262 - RNA, 17 nt, Human
ugaagagugagagggca

SEQ ID NO: 2570263 - RNA, 18 nt, Human
ugaagagugagagggcau

SEQ ID NO: 2570264 - RNA, 19 nt, Human
ugaagaguggguuucacaa

SEQ ID NO: 2570265 - RNA, 16 nt, Human
ugaagagugagagggc

SEQ ID NO: 2570266 - RNA, 17 nt, Human
ugaagaguccucugaau

SEQ ID NO: 2570267 - RNA, 16 nt, Human
ugaagaggaaaaugaa

SEQ ID NO: 2570268 - RNA, 23 nt, Human
ugaagaguaagucaaccugccug

SEQ ID NO: 2570269 - RNA, 23 nt, Human
ugaagaguccucugaaugaaccu

SEQ ID NO: 2570270 - RNA, 18 nt, Human
ugaaggccccgcccaggc

SEQ ID NO: 2570271 - RNA, 15 nt, Human
ugaaggaaaaugaua

SEQ ID NO: 2570272 - RNA, 16 nt, Human
ugaaggaaacaguuaa

SEQ ID NO: 2570273 - RNA, 14 nt, Human
ugaaggaaacaguu

SEQ ID NO: 2570274 - RNA, 12 nt, Human
ugaaggaaacag

SEQ ID NO: 2570275 - RNA, 16 nt, Human
ugaagcuuuuauguga

SEQ ID NO: 2570276 - RNA, 21 nt, Human
ugaaggaaaaacacaagcaaa

SEQ ID NO: 2570277 - RNA, 23 nt, Human
ugaaggaaaaacacaagcaaaaa

SEQ ID NO: 2570278 - RNA, 21 nt, Human
ugaagcuuuuaugugaaacau

SEQ ID NO: 2570279 - RNA, 20 nt, Human
ugaaggccccgcccaggcuu

SEQ ID NO: 2570280 - RNA, 19 nt, Human
ugaaggccccgcccaggcu

SEQ ID NO: 2570281 - RNA, 16 nt, Human
ugaaggaaccaaagcg

SEQ ID NO: 2570282 - RNA, 19 nt, Human
ugaaggccgagaagcaaga

SEQ ID NO: 2570283 - RNA, 19 nt, Human
ugaaggaacauuccuuagu

SEQ ID NO: 2570284 - RNA, 16 nt, Human
ugaaggcuggguucug

SEQ ID NO: 2570285 - RNA, 16 nt, Human
ugacaucacuuguaca

SEQ ID NO: 2570286 - RNA, 17 nt, Human
ugacaucacuuguacaa

SEQ ID NO: 2570287 - RNA, 18 nt, Human
ugacaucacuuguacaaa

SEQ ID NO: 2570288 - RNA, 19 nt, Human
ugacaucacuuguacaaaa

SEQ ID NO: 2570289 - RNA, 20 nt, Human
ugacaucacuuguacaaaau

SEQ ID NO: 2570290 - RNA, 21 nt, Human
ugacaucacuuguacaaaaua

SEQ ID NO: 2570291 - RNA, 22 nt, Human
ugacaucacuuguacaaaauaa

SEQ ID NO: 2570292 - RNA, 23 nt, Human
ugacaucacuuguacaaaauaaa

SEQ ID NO: 2570293 - RNA, 13 nt, Human
ugacaucacuugu

SEQ ID NO: 2570294 - RNA, 17 nt, Human
ugacaucaccacaguuu

SEQ ID NO: 2570295 - RNA, 15 nt, Human
ugacauauuuuugcu

SEQ ID NO: 2570296 - RNA, 22 nt, Human
ugacaucucaggggccagagga

SEQ ID NO: 2570297 - RNA, 21 nt, Human
ugacaucucaggggccagagg

SEQ ID NO: 2570298 - RNA, 19 nt, Human
ugacaucucaggggccaga

SEQ ID NO: 2570299 - RNA, 18 nt, Human
ugacaucucaggggccag

SEQ ID NO: 2570300 - RNA, 13 nt, Human
ugacaucucugca

SEQ ID NO: 2570301 - RNA, 14 nt, Human
ugacaucucugcaa

SEQ ID NO: 2570302 - RNA, 23 nt, Human
ugacaucucugcaaucuucucag

SEQ ID NO: 2570303 - RNA, 12 nt, Human
ugacaucucuuu

SEQ ID NO: 2570304 - RNA, 13 nt, Human
ugacaucucuuug

SEQ ID NO: 2570305 - RNA, 14 nt, Human
ugacaucucuuuga

SEQ ID NO: 2570306 - RNA, 17 nt, Human
ugacaucaguggcaugg

SEQ ID NO: 2570307 - RNA, 23 nt, Human
ugacaucaguggcauggcuccag

SEQ ID NO: 2570308 - RNA, 13 nt, Human
ugacauccaagcu

SEQ ID NO: 2570309 - RNA, 15 nt, Human
ugacaucucaggggc

SEQ ID NO: 2570310 - RNA, 14 nt, Human
ugacaucucagggg

SEQ ID NO: 2570311 - RNA, 17 nt, Human
ugacauccaagcuuccu

SEQ ID NO: 2570312 - RNA, 18 nt, Human
ugacagacacaggcccgg

SEQ ID NO: 2570313 - RNA, 17 nt, Human
ugacagacacaggcccg

SEQ ID NO: 2570314 - RNA, 15 nt, Human
ugacagacuccugag

SEQ ID NO: 2570315 - RNA, 14 nt, Human
ugacagacuccuga

SEQ ID NO: 2570316 - RNA, 22 nt, Human
ugacagaccacaucuuuaucug

SEQ ID NO: 2570317 - RNA, 19 nt, Human
ugacagacuccugaggaca

SEQ ID NO: 2570318 - RNA, 17 nt, Human
ugacagacuccugagga

SEQ ID NO: 2570319 - RNA, 14 nt, Human
ugacagacucucgu

SEQ ID NO: 2570320 - RNA, 18 nt, Human
ugacagagcaagacucug

SEQ ID NO: 2570321 - RNA, 23 nt, Human
ugacaucaacugcaucaagaugu

SEQ ID NO: 2570322 - RNA, 23 nt, Human
ugacagagccuucugaggacauu

SEQ ID NO: 2570323 - RNA, 22 nt, Human
ugacagagccuucugaggacau

SEQ ID NO: 2570324 - RNA, 22 nt, Human
ugacagagcaagugagacccug

SEQ ID NO: 2570325 - RNA, 12 nt, Human
ugacagagccag

SEQ ID NO: 2570326 - RNA, 21 nt, Human
ugacagagcaagacucugucu

SEQ ID NO: 2570327 - RNA, 16 nt, Human
ugaccacugcagaaga

SEQ ID NO: 2570328 - RNA, 17 nt, Human
ugaccacugcagaagac

SEQ ID NO: 2570329 - RNA, 18 nt, Human
ugaccacugcagaagaca

SEQ ID NO: 2570330 - RNA, 16 nt, Human
ugaccacucugucuug

SEQ ID NO: 2570331 - RNA, 20 nt, Human
ugaccagcaccaucucuccu

SEQ ID NO: 2570332 - RNA, 22 nt, Human
ugaccagccuccaugcugccuc

SEQ ID NO: 2570333 - RNA, 19 nt, Human
ugaccauccacucuacccu

SEQ ID NO: 2570334 - RNA, 22 nt, Human
ugaccauccacucuacccuccc

SEQ ID NO: 2570335 - RNA, 23 nt, Human
ugaccauccacucuacccuccca

SEQ ID NO: 2570336 - RNA, 21 nt, Human
ugaccagccuccaugcugccu

SEQ ID NO: 2570337 - RNA, 14 nt, Human
ugaccagcagcgcc

SEQ ID NO: 2570338 - RNA, 15 nt, Human
ugaccagcagcgccu

SEQ ID NO: 2570339 - RNA, 11 nt, Human
ugaccagcagc

SEQ ID NO: 2570340 - RNA, 22 nt, Human
ugaccagcagaucccagcucac

SEQ ID NO: 2570341 - RNA, 18 nt, Human
ugacauguuauauauuuu

SEQ ID NO: 2570342 - RNA, 19 nt, Human
ugacauguuauauauuuuu

SEQ ID NO: 2570343 - RNA, 18 nt, Human
ugaccagcacugucucag

SEQ ID NO: 2570344 - RNA, 17 nt, Human
ugaccagcagaucccag

SEQ ID NO: 2570345 - RNA, 18 nt, Human
ugaccagcagaucccagc

SEQ ID NO: 2570346 - RNA, 20 nt, Human
ugaccagcagaucccagcuc

SEQ ID NO: 2570347 - RNA, 21 nt, Human
ugaccagcagaucccagcuca

SEQ ID NO: 2570348 - RNA, 20 nt, Human
ugacauguggggccagguca

SEQ ID NO: 2570349 - RNA, 19 nt, Human
ugacauguggggccagguc

SEQ ID NO: 2570350 - RNA, 19 nt, Human
ugacauguguuggcagccu

SEQ ID NO: 2570351 - RNA, 18 nt, Human
ugacauguggggccaggu

SEQ ID NO: 2570352 - RNA, 17 nt, Human
ugacauguggggccagg

SEQ ID NO: 2570353 - RNA, 14 nt, Human
ugacauguggaaag

SEQ ID NO: 2570354 - RNA, 17 nt, Human
ugacauguggaaaguga

SEQ ID NO: 2570355 - RNA, 21 nt, Human
ugacauguggaaagugaauuu

SEQ ID NO: 2570356 - RNA, 22 nt, Human
ugacauguggaaagugaauuug

SEQ ID NO: 2570357 - RNA, 16 nt, Human
ugacaugugacuccua

SEQ ID NO: 2570358 - RNA, 21 nt, Human
ugacaugugaaaccuuuuuua

SEQ ID NO: 2570359 - RNA, 19 nt, Human
ugacaugugaaaccuuuuu

SEQ ID NO: 2570360 - RNA, 17 nt, Human
ugacaugugaaaccuuu

SEQ ID NO: 2570361 - RNA, 16 nt, Human
ugacaugugaaaccuu

SEQ ID NO: 2570362 - RNA, 15 nt, Human
ugacaugugaaaccu

SEQ ID NO: 2570363 - RNA, 22 nt, Human
ugacaugcgggcugggcagcug

SEQ ID NO: 2570364 - RNA, 21 nt, Human
ugacaugcgggcugggcagcu

SEQ ID NO: 2570365 - RNA, 20 nt, Human
ugacaugcgggcugggcagc

SEQ ID NO: 2570366 - RNA, 19 nt, Human
ugacaugcgggcugggcag

SEQ ID NO: 2570367 - RNA, 14 nt, Human
ugacaucuggaauc

SEQ ID NO: 2570368 - RNA, 16 nt, Human
ugacaucuguguuuca

SEQ ID NO: 2570369 - RNA, 16 nt, Human
ugacaucuucaaagcu

SEQ ID NO: 2570370 - RNA, 15 nt, Human
ugacaugauuccuuc

SEQ ID NO: 2570371 - RNA, 12 nt, Human
ugacaugaaaaa

SEQ ID NO: 2570372 - RNA, 17 nt, Human
ugacaucuuaguauuug

SEQ ID NO: 2570373 - RNA, 19 nt, Human
ugacaugauuccuuccugu

SEQ ID NO: 2570374 - RNA, 18 nt, Human
ugacaugcgggcugggca

SEQ ID NO: 2570375 - RNA, 17 nt, Human
ugacaugcgggcugggc

SEQ ID NO: 2570376 - RNA, 16 nt, Human
ugacaugauuccuucc

SEQ ID NO: 2570377 - RNA, 18 nt, Human
ugacaugauuccuuccug

SEQ ID NO: 2570378 - RNA, 22 nt, Human
ugacaugauuccuuccuguucu

SEQ ID NO: 2570379 - RNA, 18 nt, Human
ugacaugcacucagcucu

SEQ ID NO: 2570380 - RNA, 14 nt, Human
ugaauuacauuugu

SEQ ID NO: 2570381 - RNA, 13 nt, Human
ugaauuguaagga

SEQ ID NO: 2570382 - RNA, 21 nt, Human
ugaauuguaaggaaugauuaa

SEQ ID NO: 2570383 - RNA, 19 nt, Human
ugaauuguaacuguucuug

SEQ ID NO: 2570384 - RNA, 15 nt, Human
ugaauuguccccagu

SEQ ID NO: 2570385 - RNA, 23 nt, Human
ugaauuaaucaucuauaaagaag

SEQ ID NO: 2570386 - RNA, 20 nt, Human
ugaauuaaugacagagccag

SEQ ID NO: 2570387 - RNA, 21 nt, Human
ugaauuaaugacagagccagu

SEQ ID NO: 2570388 - RNA, 23 nt, Human
ugaauuaauaucccuacauguau

SEQ ID NO: 2570389 - RNA, 22 nt, Human
ugaauuaauaucccuacaugua

SEQ ID NO: 2570390 - RNA, 19 nt, Human
ugaauuaauaucccuacau

SEQ ID NO: 2570391 - RNA, 16 nt, Human
ugaauuaauaucccua

SEQ ID NO: 2570392 - RNA, 13 nt, Human
ugaauuacauuug

SEQ ID NO: 2570393 - RNA, 14 nt, Human
ugaauuaaguuuuu

SEQ ID NO: 2570394 - RNA, 17 nt, Human
ugaauuaaauaaacccu

SEQ ID NO: 2570395 - RNA, 15 nt, Human
ugaauuaaaguaauu

SEQ ID NO: 2570396 - RNA, 11 nt, Human
ugaauuaaauu

SEQ ID NO: 2570397 - RNA, 15 nt, Human
ugaauuaaauuuaau

SEQ ID NO: 2570398 - RNA, 16 nt, Human
ugaauuaaauuaggaa

SEQ ID NO: 2570399 - RNA, 23 nt, Human
ugacaacacucauugaccugagg

SEQ ID NO: 2570400 - RNA, 15 nt, Human
ugacaacagacuucu

SEQ ID NO: 2570401 - RNA, 18 nt, Human
ugacaacagacuucugaa

SEQ ID NO: 2570402 - RNA, 19 nt, Human
ugacaacagacuucugaaa

SEQ ID NO: 2570403 - RNA, 14 nt, Human
ugacaacagaagcu

SEQ ID NO: 2570404 - RNA, 13 nt, Human
ugacaacagaagc

SEQ ID NO: 2570405 - RNA, 22 nt, Human
ugacaacagaagcuucagaagu

SEQ ID NO: 2570406 - RNA, 12 nt, Human
ugacaacaucug

SEQ ID NO: 2570407 - RNA, 19 nt, Human
ugacaaccaccgcucccca

SEQ ID NO: 2570408 - RNA, 16 nt, Human
ugacaaccaccgcucc

SEQ ID NO: 2570409 - RNA, 13 nt, Human
ugacaacacucau

SEQ ID NO: 2570410 - RNA, 23 nt, Human
ugacaaauguguaucggaugcuu

SEQ ID NO: 2570411 - RNA, 20 nt, Human
ugacaaagguaaaucagacu

SEQ ID NO: 2570412 - RNA, 14 nt, Human
ugacaaaguuacug

SEQ ID NO: 2570413 - RNA, 14 nt, Human
ugaauuuaaauaua

SEQ ID NO: 2570414 - RNA, 12 nt, Human
ugaauuuaaaua

SEQ ID NO: 2570415 - RNA, 18 nt, Human
ugaauuguaacuguucuu

SEQ ID NO: 2570416 - RNA, 17 nt, Human
ugaauugugaccaaguu

SEQ ID NO: 2570417 - RNA, 13 nt, Human
ugacagacacagg

SEQ ID NO: 2570418 - RNA, 16 nt, Human
ugacagacacaggccc

SEQ ID NO: 2570419 - RNA, 14 nt, Human
ugacagacacaggc

SEQ ID NO: 2570420 - RNA, 17 nt, Human
ugacacaaguggaccuu

SEQ ID NO: 2570421 - RNA, 19 nt, Human
ugacacaaguggaccuuag

SEQ ID NO: 2570422 - RNA, 15 nt, Human
ugacacacagcucug

SEQ ID NO: 2570423 - RNA, 19 nt, Human
ugacacaaaccugccuggg

SEQ ID NO: 2570424 - RNA, 18 nt, Human
ugacacaaaccugccugg

SEQ ID NO: 2570425 - RNA, 17 nt, Human
ugacacaaaccugccug

SEQ ID NO: 2570426 - RNA, 16 nt, Human
ugacacaaguggaccu

SEQ ID NO: 2570427 - RNA, 14 nt, Human
ugacacacagcucu

SEQ ID NO: 2570428 - RNA, 16 nt, Human
ugacaauaaaacauua

SEQ ID NO: 2570429 - RNA, 14 nt, Human
ugacaauaaaacau

SEQ ID NO: 2570430 - RNA, 13 nt, Human
ugacaauaaaaca

SEQ ID NO: 2570431 - RNA, 12 nt, Human
ugacaauaaaac

SEQ ID NO: 2570432 - RNA, 20 nt, Human
ugacaagucauuuuaacuuu

SEQ ID NO: 2570433 - RNA, 14 nt, Human
ugacaagucauuuu

SEQ ID NO: 2570434 - RNA, 17 nt, Human
ugacaaggccccagaga

SEQ ID NO: 2570435 - RNA, 18 nt, Human
ugacaaggccccagagac

SEQ ID NO: 2570436 - RNA, 22 nt, Human
ugacaaggccccagagacucag

SEQ ID NO: 2570437 - RNA, 23 nt, Human
ugacaaggauugcuacuguccua

SEQ ID NO: 2570438 - RNA, 13 nt, Human
ugacaaggcccca

SEQ ID NO: 2570439 - RNA, 14 nt, Human
ugacaaggccccag

SEQ ID NO: 2570440 - RNA, 15 nt, Human
ugacaaggccccaga

SEQ ID NO: 2570441 - RNA, 16 nt, Human
ugacaaggccccagag

SEQ ID NO: 2570442 - RNA, 19 nt, Human
ugacaaccaugagaccacu

SEQ ID NO: 2570443 - RNA, 16 nt, Human
ugacaaccacuggucu

SEQ ID NO: 2570444 - RNA, 20 nt, Human
ugacaaccaccgcuccccag

SEQ ID NO: 2570445 - RNA, 21 nt, Human
ugacaaccaccgcuccccagc

SEQ ID NO: 2570446 - RNA, 17 nt, Human
ugacaaccacuggucug

SEQ ID NO: 2570447 - RNA, 21 nt, Human
ugacaacguuucagcgacucc

SEQ ID NO: 2570448 - RNA, 23 nt, Human
ugacaaccaccgcuccccagccc

SEQ ID NO: 2570449 - RNA, 22 nt, Human
ugacaacuucccagugaauucu

SEQ ID NO: 2570450 - RNA, 19 nt, Human
ugacaacuggaauaguuuu

SEQ ID NO: 2570451 - RNA, 23 nt, Human
ugacucuuuuuagggccaggcag

SEQ ID NO: 2570452 - RNA, 19 nt, Human
ugacugaagaugcagcuca

SEQ ID NO: 2570453 - RNA, 22 nt, Human
ugacucuuuuuagggccaggca

SEQ ID NO: 2570454 - RNA, 15 nt, Human
ugacugccccaacuc

SEQ ID NO: 2570455 - RNA, 16 nt, Human
ugacugccccaacucc

SEQ ID NO: 2570456 - RNA, 17 nt, Human
ugacugccccaacuccu

SEQ ID NO: 2570457 - RNA, 19 nt, Human
ugacugccccaacuccugg

SEQ ID NO: 2570458 - RNA, 22 nt, Human
ugacugcuccccagcccuggcu

SEQ ID NO: 2570459 - RNA, 21 nt, Human
ugacugcuccccagcccuggc

SEQ ID NO: 2570460 - RNA, 20 nt, Human
ugacugcuccccagcccugg

SEQ ID NO: 2570461 - RNA, 16 nt, Human
ugacugcgaucuucag

SEQ ID NO: 2570462 - RNA, 17 nt, Human
ugacugcgaucuucaga

SEQ ID NO: 2570463 - RNA, 20 nt, Human
ugacugccccaacuccugga

SEQ ID NO: 2570464 - RNA, 23 nt, Human
ugacugcuccccagcccuggcuc

SEQ ID NO: 2570465 - RNA, 15 nt, Human
ugacugcugauucuc

SEQ ID NO: 2570466 - RNA, 15 nt, Human
ugacuggcacagucu

SEQ ID NO: 2570467 - RNA, 21 nt, Human
ugacucuuucuauuguuucuu

SEQ ID NO: 2570468 - RNA, 20 nt, Human
ugacucuuguuuucaguuuc

SEQ ID NO: 2570469 - RNA, 14 nt, Human
ugacucuuggcaca

SEQ ID NO: 2570470 - RNA, 19 nt, Human
ugacucuuggcacagcaug

SEQ ID NO: 2570471 - RNA, 16 nt, Human
ugacuuuggcugcaug

SEQ ID NO: 2570472 - RNA, 16 nt, Human
ugacuuuccucuuugg

SEQ ID NO: 2570473 - RNA, 13 nt, Human
ugacuuucucagc

SEQ ID NO: 2570474 - RNA, 16 nt, Human
ugacuuugcucuuucu

SEQ ID NO: 2570475 - RNA, 16 nt, Human
ugacugggcccugccu

SEQ ID NO: 2570476 - RNA, 11 nt, Human
ugacuggauau

SEQ ID NO: 2570477 - RNA, 18 nt, Human
ugacugggcccugccucu

SEQ ID NO: 2570478 - RNA, 21 nt, Human
ugacugggcccugccucuguu

SEQ ID NO: 2570479 - RNA, 13 nt, Human
ugacuuucaggua

SEQ ID NO: 2570480 - RNA, 18 nt, Human
ugaccaugcucaucugcu

SEQ ID NO: 2570481 - RNA, 16 nt, Human
ugaccaugcucaucug

SEQ ID NO: 2570482 - RNA, 12 nt, Human
ugaccaugcuca

SEQ ID NO: 2570483 - RNA, 13 nt, Human
ugaccauucucca

SEQ ID NO: 2570484 - RNA, 14 nt, Human
ugaccauucuccac

SEQ ID NO: 2570485 - RNA, 19 nt, Human
ugaccaugcucaucugcug

SEQ ID NO: 2570486 - RNA, 23 nt, Human
ugacgugccuuuugcaccccucc

SEQ ID NO: 2570487 - RNA, 15 nt, Human
ugacuaaaaaacaaa

SEQ ID NO: 2570488 - RNA, 22 nt, Human
ugacgugccuuuugcaccccuc

SEQ ID NO: 2570489 - RNA, 14 nt, Human
ugacuaaaauauuu

SEQ ID NO: 2570490 - RNA, 22 nt, Human
ugacuaaaaaacaaagaagaca

SEQ ID NO: 2570491 - RNA, 14 nt, Human
ugacuaaaaauauu

SEQ ID NO: 2570492 - RNA, 22 nt, Human
ugacuaaaaauauuauaacuua

SEQ ID NO: 2570493 - RNA, 16 nt, Human
ugacuaaagagagaau

SEQ ID NO: 2570494 - RNA, 17 nt, Human
ugacuaaagagagaaug

SEQ ID NO: 2570495 - RNA, 15 nt, Human
ugacucuuaagaaga

SEQ ID NO: 2570496 - RNA, 14 nt, Human
ugacucuuaagaag

SEQ ID NO: 2570497 - RNA, 16 nt, Human
ugacucuuaagaagac

SEQ ID NO: 2570498 - RNA, 18 nt, Human
ugacuacagucaggaaag

SEQ ID NO: 2570499 - RNA, 13 nt, Human
ugacucuuaagaa

SEQ ID NO: 2570500 - RNA, 16 nt, Human
ugacuacagucaggaa

SEQ ID NO: 2570501 - RNA, 17 nt, Human
ugacuacagucaggaaa

SEQ ID NO: 2570502 - RNA, 23 nt, Human
ugacuaauuguauaacagguuau

SEQ ID NO: 2570503 - RNA, 22 nt, Human
ugacuaauuguauaacagguua

SEQ ID NO: 2570504 - RNA, 21 nt, Human
ugacuaauuguauaacagguu

SEQ ID NO: 2570505 - RNA, 20 nt, Human
ugacuaauuguauaacaggu

SEQ ID NO: 2570506 - RNA, 19 nt, Human
ugacuaauuguauaacagg

SEQ ID NO: 2570507 - RNA, 18 nt, Human
ugacuaauuguauaacag

SEQ ID NO: 2570508 - RNA, 17 nt, Human
ugacuaauuguauaaca

SEQ ID NO: 2570509 - RNA, 15 nt, Human
ugacuaauuguauaa

SEQ ID NO: 2570510 - RNA, 14 nt, Human
ugacuaauuguaua

SEQ ID NO: 2570511 - RNA, 13 nt, Human
ugacuaauuguau

SEQ ID NO: 2570512 - RNA, 21 nt, Human
ugagaaagucuuauuuauuca

SEQ ID NO: 2570513 - RNA, 15 nt, Human
ugagaaauauggaca

SEQ ID NO: 2570514 - RNA, 17 nt, Human
ugagaaauauggacacu

SEQ ID NO: 2570515 - RNA, 15 nt, Human
ugagacagugggaaa

SEQ ID NO: 2570516 - RNA, 13 nt, Human
ugagacaguggga

SEQ ID NO: 2570517 - RNA, 21 nt, Human
ugagaaauauggacacuuaau

SEQ ID NO: 2570518 - RNA, 19 nt, Human
ugagacaguuucuuagcuu

SEQ ID NO: 2570519 - RNA, 18 nt, Human
ugagacaguuucuuagcu

SEQ ID NO: 2570520 - RNA, 16 nt, Human
ugagacaguuucuuag

SEQ ID NO: 2570521 - RNA, 15 nt, Human
ugagacaguuucuua

SEQ ID NO: 2570522 - RNA, 14 nt, Human
ugagacaguuucuu

SEQ ID NO: 2570523 - RNA, 18 nt, Human
ugagacagugggaaauau

SEQ ID NO: 2570524 - RNA, 17 nt, Human
ugagacagugggaaaua

SEQ ID NO: 2570525 - RNA, 16 nt, Human
ugagacagugggaaau

SEQ ID NO: 2570526 - RNA, 21 nt, Human
ugagacaguuucuuagcuuuu

SEQ ID NO: 2570527 - RNA, 20 nt, Human
ugagacaguuucuuagcuuu

SEQ ID NO: 2570528 - RNA, 23 nt, Human
ugagacaguuucuuagcuuuuua

SEQ ID NO: 2570529 - RNA, 21 nt, Human
ugagaaagagcacuuaagaga

SEQ ID NO: 2570530 - RNA, 13 nt, Human
ugagaaagagcac

SEQ ID NO: 2570531 - RNA, 14 nt, Human
ugagaaagagcacu

SEQ ID NO: 2570532 - RNA, 15 nt, Human
ugagaaauaaaguuu

SEQ ID NO: 2570533 - RNA, 15 nt, Human
ugagaaagacuauuc

SEQ ID NO: 2570534 - RNA, 17 nt, Human
ugagaaaacuucuuuua

SEQ ID NO: 2570535 - RNA, 23 nt, Human
ugagaaaccuuauuguaccucuc

SEQ ID NO: 2570536 - RNA, 19 nt, Human
ugagaaaagcuuugaaccc

SEQ ID NO: 2570537 - RNA, 20 nt, Human
ugagaaacaacaauuucuac

SEQ ID NO: 2570538 - RNA, 12 nt, Human
ugagaaaacaug

SEQ ID NO: 2570539 - RNA, 16 nt, Human
ugagaaaacuucuuuu

SEQ ID NO: 2570540 - RNA, 17 nt, Human
ugacuuuuugcauuuaa

SEQ ID NO: 2570541 - RNA, 23 nt, Human
ugacuuuuugcauuuaaaacaga

SEQ ID NO: 2570542 - RNA, 22 nt, Human
ugacuuuuucuaagagcucccg

SEQ ID NO: 2570543 - RNA, 21 nt, Human
ugagaaaaauuuacauggcaa

SEQ ID NO: 2570544 - RNA, 18 nt, Human
ugagaaaaagcuccuguc

SEQ ID NO: 2570545 - RNA, 17 nt, Human
ugagaaaaagcuccugu

SEQ ID NO: 2570546 - RNA, 16 nt, Human
ugagaaaaagcuccug

SEQ ID NO: 2570547 - RNA, 19 nt, Human
ugacuuuuccauguaucua

SEQ ID NO: 2570548 - RNA, 18 nt, Human
ugacuuuuccauguaucu

SEQ ID NO: 2570549 - RNA, 22 nt, Human
ugacuuuuccauguaucuaccu

SEQ ID NO: 2570550 - RNA, 14 nt, Human
ugacuuuuugcauu

SEQ ID NO: 2570551 - RNA, 12 nt, Human
ugacuuuuguau

SEQ ID NO: 2570552 - RNA, 22 nt, Human
ugacuuuucuguccgagcuuug

SEQ ID NO: 2570553 - RNA, 13 nt, Human
ugacuuuuccaug

SEQ ID NO: 2570554 - RNA, 20 nt, Human
ugacuuuuaaggcuaaaacu

SEQ ID NO: 2570555 - RNA, 11 nt, Human
ugacuuugucu

SEQ ID NO: 2570556 - RNA, 13 nt, Human
ugagaccugcccc

SEQ ID NO: 2570557 - RNA, 14 nt, Human
ugagaccugccccu

SEQ ID NO: 2570558 - RNA, 15 nt, Human
ugagaccugccccuc

SEQ ID NO: 2570559 - RNA, 22 nt, Human
ugagaccugccccuccucucug

SEQ ID NO: 2570560 - RNA, 12 nt, Human
ugagaccugccc

SEQ ID NO: 2570561 - RNA, 16 nt, Human
ugagaccucagccaug

SEQ ID NO: 2570562 - RNA, 14 nt, Human
ugagaccaaccugg

SEQ ID NO: 2570563 - RNA, 23 nt, Human
ugagacggagucucgcucuguca

SEQ ID NO: 2570564 - RNA, 21 nt, Human
ugagacgccaccauuccugga

SEQ ID NO: 2570565 - RNA, 20 nt, Human
ugagacgccaccauuccugg

SEQ ID NO: 2570566 - RNA, 17 nt, Human
ugagaccucagccauga

SEQ ID NO: 2570567 - RNA, 19 nt, Human
ugagaccucagccaugagg

SEQ ID NO: 2570568 - RNA, 14 nt, Human
ugagaggggaacag

SEQ ID NO: 2570569 - RNA, 18 nt, Human
ugagaggggaacagacug

SEQ ID NO: 2570570 - RNA, 21 nt, Human
ugagagggcaguguuuccuuu

SEQ ID NO: 2570571 - RNA, 17 nt, Human
ugagagggcaugcgcac

SEQ ID NO: 2570572 - RNA, 22 nt, Human
ugagagggcaugcgcacaaggc

SEQ ID NO: 2570573 - RNA, 19 nt, Human
ugagaguuuuggaugcagu

SEQ ID NO: 2570574 - RNA, 15 nt, Human
ugagcaggauuuuaa

SEQ ID NO: 2570575 - RNA, 21 nt, Human
ugagcagagucuugcuaccuc

SEQ ID NO: 2570576 - RNA, 12 nt, Human
ugagcagagucu

SEQ ID NO: 2570577 - RNA, 21 nt, Human
ugagcagacuggugagcagac

SEQ ID NO: 2570578 - RNA, 23 nt, Human
ugagcagacuggugagcagacug

SEQ ID NO: 2570579 - RNA, 20 nt, Human
ugagcaggauuuuaaucuuu

SEQ ID NO: 2570580 - RNA, 17 nt, Human
ugagcagggauccuggu

SEQ ID NO: 2570581 - RNA, 22 nt, Human
ugagcagggagauccugguugg

SEQ ID NO: 2570582 - RNA, 20 nt, Human
ugagauaccagcgaggaggc

SEQ ID NO: 2570583 - RNA, 15 nt, Human
ugagauagaagaacu

SEQ ID NO: 2570584 - RNA, 16 nt, Human
ugagauagaagaacug

SEQ ID NO: 2570585 - RNA, 19 nt, Human
ugagauagaagaacugcaa

SEQ ID NO: 2570586 - RNA, 21 nt, Human
ugagauagaagaacugcaaag

SEQ ID NO: 2570587 - RNA, 23 nt, Human
ugagauaguagcauacauuuaua

SEQ ID NO: 2570588 - RNA, 23 nt, Human
ugagauagcauugugaacugaca

SEQ ID NO: 2570589 - RNA, 19 nt, Human
ugagauaguagcauacauu

SEQ ID NO: 2570590 - RNA, 19 nt, Human
ugagauagcauugugaacu

SEQ ID NO: 2570591 - RNA, 18 nt, Human
ugagauagcauugugaac

SEQ ID NO: 2570592 - RNA, 16 nt, Human
ugagauagcauuguga

SEQ ID NO: 2570593 - RNA, 16 nt, Human
ugagauaauguuagag

SEQ ID NO: 2570594 - RNA, 21 nt, Human
ugagaguuuugucuugaaugu

SEQ ID NO: 2570595 - RNA, 21 nt, Human
ugagauaccagcgaggaggcu

SEQ ID NO: 2570596 - RNA, 18 nt, Human
ugagaguuuugucuugaa

SEQ ID NO: 2570597 - RNA, 22 nt, Human
ugagauaaugugauauuauaca

SEQ ID NO: 2570598 - RNA, 22 nt, Human
ugagaguuuuggaugcagugcu

SEQ ID NO: 2570599 - RNA, 12 nt, Human
ugaggccuugcu

SEQ ID NO: 2570600 - RNA, 22 nt, Human
ugaggccuuaucauucauucuu

SEQ ID NO: 2570601 - RNA, 13 nt, Human
ugaggccuugcuc

SEQ ID NO: 2570602 - RNA, 22 nt, Human
ugaggccugggccgcugccacg

SEQ ID NO: 2570603 - RNA, 17 nt, Human
ugaggccuggccaggca

SEQ ID NO: 2570604 - RNA, 16 nt, Human
ugaggccuggccaggc

SEQ ID NO: 2570605 - RNA, 15 nt, Human
ugaggccuggccagg

SEQ ID NO: 2570606 - RNA, 14 nt, Human
ugaggccuggccag

SEQ ID NO: 2570607 - RNA, 13 nt, Human
ugaggccugggcc

SEQ ID NO: 2570608 - RNA, 12 nt, Human
ugaggccugggc

SEQ ID NO: 2570609 - RNA, 16 nt, Human
ugaggcucugcccuug

SEQ ID NO: 2570610 - RNA, 15 nt, Human
ugaggcucugcccuu

SEQ ID NO: 2570611 - RNA, 23 nt, Human
ugaggcggguggaucaccugagg

SEQ ID NO: 2570612 - RNA, 16 nt, Human
ugaggcugggcucccu

SEQ ID NO: 2570613 - RNA, 15 nt, Human
ugaggcugggcuccc

SEQ ID NO: 2570614 - RNA, 18 nt, Human
ugaggcucugcccuuggu

SEQ ID NO: 2570615 - RNA, 16 nt, Human
ugaggcucuuucuggg

SEQ ID NO: 2570616 - RNA, 17 nt, Human
ugaggcucuuucugggc

SEQ ID NO: 2570617 - RNA, 18 nt, Human
ugaggcucuuucugggcc

SEQ ID NO: 2570618 - RNA, 18 nt, Human
ugaggcagaagaauugaa

SEQ ID NO: 2570619 - RNA, 24 nt, Human
ugaggcagacagcagcucaggcac

SEQ ID NO: 2570620 - RNA, 21 nt, Human
ugaggcagcagugugaggcca

SEQ ID NO: 2570621 - RNA, 15 nt, Human
ugaggcaggcuuugu

SEQ ID NO: 2570622 - RNA, 13 nt, Human
ugaggcagguccc

SEQ ID NO: 2570623 - RNA, 13 nt, Human
ugaggcagggaag

SEQ ID NO: 2570624 - RNA, 14 nt, Human
ugaggcagggaagu

SEQ ID NO: 2570625 - RNA, 22 nt, Human
ugaggcagggaaguccccaggc

SEQ ID NO: 2570626 - RNA, 23 nt, Human
ugaggccuggacuuuccugcaac

SEQ ID NO: 2570627 - RNA, 20 nt, Human
ugaggccuggacuuuccugc

SEQ ID NO: 2570628 - RNA, 19 nt, Human
ugaggccuggacuuuccug

SEQ ID NO: 2570629 - RNA, 17 nt, Human
ugaggccuggacuuucc

SEQ ID NO: 2570630 - RNA, 14 nt, Human
ugaggccuggacuu

SEQ ID NO: 2570631 - RNA, 12 nt, Human
ugaggccuggac

SEQ ID NO: 2570632 - RNA, 11 nt, Human
ugaggccugga

SEQ ID NO: 2570633 - RNA, 21 nt, Human
ugaggccugcccucagggauc

SEQ ID NO: 2570634 - RNA, 15 nt, Human
ugaggcaggggcgga

SEQ ID NO: 2570635 - RNA, 13 nt, Human
ugaggcagaagaa

SEQ ID NO: 2570636 - RNA, 22 nt, Human
ugaggcacgaaugaucuuucuu

SEQ ID NO: 2570637 - RNA, 16 nt, Human
ugaggcaaugucagga

SEQ ID NO: 2570638 - RNA, 17 nt, Human
ugaggcaaugucaggaa

SEQ ID NO: 2570639 - RNA, 20 nt, Human
ugaggcaaugucaggaacag

SEQ ID NO: 2570640 - RNA, 21 nt, Human
ugaggcaaugucaggaacaga

SEQ ID NO: 2570641 - RNA, 12 nt, Human
ugaggcagacag

SEQ ID NO: 2570642 - RNA, 13 nt, Human
ugaggcagacagc

SEQ ID NO: 2570643 - RNA, 14 nt, Human
ugaggcagacagca

SEQ ID NO: 2570644 - RNA, 15 nt, Human
ugaggcagacagcag

SEQ ID NO: 2570645 - RNA, 16 nt, Human
ugaggcagacagcagc

SEQ ID NO: 2570646 - RNA, 17 nt, Human
ugaggcagacagcagcu

SEQ ID NO: 2570647 - RNA, 20 nt, Human
ugaggcagacagcagcucag

SEQ ID NO: 2570648 - RNA, 23 nt, Human
ugaggcagacagcagcucaggca

SEQ ID NO: 2570649 - RNA, 16 nt, Human
ugagucccagugggag

SEQ ID NO: 2570650 - RNA, 15 nt, Human
ugagucccaguggga

SEQ ID NO: 2570651 - RNA, 13 nt, Human
ugagucccagugg

SEQ ID NO: 2570652 - RNA, 15 nt, Human
ugaggugugggggcu

SEQ ID NO: 2570653 - RNA, 19 nt, Human
ugagucccagugggaggcg

SEQ ID NO: 2570654 - RNA, 20 nt, Human
ugagucccaggcugagccuc

SEQ ID NO: 2570655 - RNA, 21 nt, Human
ugagucccaggcugagccuca

SEQ ID NO: 2570656 - RNA, 18 nt, Human
ugaggugucuuaagccuu

SEQ ID NO: 2570657 - RNA, 22 nt, Human
ugagguggucugaauguucuga

SEQ ID NO: 2570658 - RNA, 19 nt, Human
ugagucccaggcugagccu

SEQ ID NO: 2570659 - RNA, 14 nt, Human
ugaggugugggggc

SEQ ID NO: 2570660 - RNA, 21 nt, Human
ugagguggucugaauguucug

SEQ ID NO: 2570661 - RNA, 21 nt, Human
ugagguggguuuucuucccau

SEQ ID NO: 2570662 - RNA, 13 nt, Human
ugagguggucuga

SEQ ID NO: 2570663 - RNA, 14 nt, Human
ugagguggucugaa

SEQ ID NO: 2570664 - RNA, 17 nt, Human
ugagguggucugaaugu

SEQ ID NO: 2570665 - RNA, 18 nt, Human
ugagguggucugaauguu

SEQ ID NO: 2570666 - RNA, 19 nt, Human
ugagguggucugaauguuc

SEQ ID NO: 2570667 - RNA, 20 nt, Human
ugagguggucugaauguucu

SEQ ID NO: 2570668 - RNA, 18 nt, Human
ugaggugggagguggaag

SEQ ID NO: 2570669 - RNA, 13 nt, Human
ugaggugggaggu

SEQ ID NO: 2570670 - RNA, 16 nt, Human
ugaggugccuguccca

SEQ ID NO: 2570671 - RNA, 20 nt, Human
ugaggugggcccaggaccag

SEQ ID NO: 2570672 - RNA, 16 nt, Human
ugaggugggcccagga

SEQ ID NO: 2570673 - RNA, 15 nt, Human
ugaggugggcccagg

SEQ ID NO: 2570674 - RNA, 14 nt, Human
ugaggugggcccag

SEQ ID NO: 2570675 - RNA, 22 nt, Human
ugaggugggagguggaagaagg

SEQ ID NO: 2570676 - RNA, 21 nt, Human
ugaggugggagguggaagaag

SEQ ID NO: 2570677 - RNA, 13 nt, Human
ugaggugggccca

SEQ ID NO: 2570678 - RNA, 11 nt, Human
ugaggugggcc

SEQ ID NO: 2570679 - RNA, 15 nt, Human
ugaggugccuguccc

SEQ ID NO: 2570680 - RNA, 14 nt, Human
ugaggugccugucc

SEQ ID NO: 2570681 - RNA, 21 nt, Human
ugaggugcccagcuagcugca

SEQ ID NO: 2570682 - RNA, 20 nt, Human
ugaggugcagagugcccaga

SEQ ID NO: 2570683 - RNA, 22 nt, Human
ugaggugcccagcuagcugcag

SEQ ID NO: 2570684 - RNA, 21 nt, Human
ugaggugcagagugcccagaa

SEQ ID NO: 2570685 - RNA, 19 nt, Human
ugaggucagagccugcagu

SEQ ID NO: 2570686 - RNA, 18 nt, Human
ugaggucagagccugcag

SEQ ID NO: 2570687 - RNA, 21 nt, Human
ugaggcugggcucccuuccca

SEQ ID NO: 2570688 - RNA, 12 nt, Human
ugaggcuguccu

SEQ ID NO: 2570689 - RNA, 10 nt, Human
ugaggcugua

SEQ ID NO: 2570690 - RNA, 18 nt, Human
ugaggcugagacugcggg

SEQ ID NO: 2570691 - RNA, 19 nt, Human
ugaggcucuuucugggcca

SEQ ID NO: 2570692 - RNA, 13 nt, Human
ugaggcugagacu

SEQ ID NO: 2570693 - RNA, 17 nt, Human
ugaggugcagagugccc

SEQ ID NO: 2570694 - RNA, 17 nt, Human
ugaggugaaagggagcu

SEQ ID NO: 2570695 - RNA, 18 nt, Human
ugaggugaaagggagcua

SEQ ID NO: 2570696 - RNA, 21 nt, Human
ugaggucuuuugacaugugga

SEQ ID NO: 2570697 - RNA, 22 nt, Human
ugaggucuuuugacauguggaa

SEQ ID NO: 2570698 - RNA, 23 nt, Human
ugaggucuuuugacauguggaaa

SEQ ID NO: 2570699 - RNA, 15 nt, Human
ugaggugaaagggag

SEQ ID NO: 2570700 - RNA, 16 nt, Human
ugaggugaaagggagc

SEQ ID NO: 2570701 - RNA, 14 nt, Human
ugaggcuguccugu

SEQ ID NO: 2570702 - RNA, 13 nt, Human
ugaggcuguccug

SEQ ID NO: 2570703 - RNA, 16 nt, Human
ugaggucaggaguucc

SEQ ID NO: 2570704 - RNA, 23 nt, Human
ugagguccagcccuggcugaagg

SEQ ID NO: 2570705 - RNA, 21 nt, Human
ugagguccagcccuggcugaa

SEQ ID NO: 2570706 - RNA, 20 nt, Human
ugagguccagcccuggcuga

SEQ ID NO: 2570707 - RNA, 16 nt, Human
ugagguccagcccugg

SEQ ID NO: 2570708 - RNA, 13 nt, Human
ugaggcuguagga

SEQ ID NO: 2570709 - RNA, 18 nt, Human
ugaggucauagcagugcu

SEQ ID NO: 2570710 - RNA, 22 nt, Human
ugaggaugaaaaaauaacacug

SEQ ID NO: 2570711 - RNA, 19 nt, Human
ugaggaucagaguaaucca

SEQ ID NO: 2570712 - RNA, 17 nt, Human
ugaggaucagaguaauc

SEQ ID NO: 2570713 - RNA, 13 nt, Human
ugaggaucagagu

SEQ ID NO: 2570714 - RNA, 13 nt, Human
ugaggauuucaag

SEQ ID NO: 2570715 - RNA, 14 nt, Human
ugaggcaagagaau

SEQ ID NO: 2570716 - RNA, 20 nt, Human
ugaggcaauaaaaaucauag

SEQ ID NO: 2570717 - RNA, 20 nt, Human
ugaggcaaccacaggcagca

SEQ ID NO: 2570718 - RNA, 16 nt, Human
ugaggauuuugaguau

SEQ ID NO: 2570719 - RNA, 16 nt, Human
ugaggauuucaagccu

SEQ ID NO: 2570720 - RNA, 20 nt, Human
ugaggauauauuuucacuuu

SEQ ID NO: 2570721 - RNA, 16 nt, Human
ugaggagugugagaau

SEQ ID NO: 2570722 - RNA, 14 nt, Human
ugaggaugaggccg

SEQ ID NO: 2570723 - RNA, 15 nt, Human
ugaggaugagcugga

SEQ ID NO: 2570724 - RNA, 17 nt, Human
ugaggaugucacucaga

SEQ ID NO: 2570725 - RNA, 16 nt, Human
ugaggaugggaaggag

SEQ ID NO: 2570726 - RNA, 20 nt, Human
ugaggaugggaaggagggag

SEQ ID NO: 2570727 - RNA, 22 nt, Human
ugaggaugauuauuuucaaggc

SEQ ID NO: 2570728 - RNA, 16 nt, Human
ugaggaugagcuggaa

SEQ ID NO: 2570729 - RNA, 18 nt, Human
ugaggaugcagagucagc

SEQ ID NO: 2570730 - RNA, 12 nt, Human
ugaggaugggaa

SEQ ID NO: 2570731 - RNA, 16 nt, Human
ugaggagucuugugug

SEQ ID NO: 2570732 - RNA, 15 nt, Human
ugaggagucuugugu

SEQ ID NO: 2570733 - RNA, 19 nt, Human
ugaggaggggcagguaaac

SEQ ID NO: 2570734 - RNA, 15 nt, Human
ugagcuuggccagaa

SEQ ID NO: 2570735 - RNA, 17 nt, Human
ugaggaggccuccaucu

SEQ ID NO: 2570736 - RNA, 20 nt, Human
ugagcuuggcagcugaacua

SEQ ID NO: 2570737 - RNA, 13 nt, Human
ugagcuuggccag

SEQ ID NO: 2570738 - RNA, 14 nt, Human
ugagcuuggccaga

SEQ ID NO: 2570739 - RNA, 16 nt, Human
ugagcuucucugugaa

SEQ ID NO: 2570740 - RNA, 19 nt, Human
ugagcuuggcagcugaacu

SEQ ID NO: 2570741 - RNA, 15 nt, Human
ugagcuucucuguga

SEQ ID NO: 2570742 - RNA, 16 nt, Human
ugagcuuagugaaauu

SEQ ID NO: 2570743 - RNA, 15 nt, Human
ugagcuuaucaugcu

SEQ ID NO: 2570744 - RNA, 23 nt, Human
ugagcuuaagaauuuugagcagg

SEQ ID NO: 2570745 - RNA, 11 nt, Human
ugagcuguuuu

SEQ ID NO: 2570746 - RNA, 15 nt, Human
ugagcuguugccuca

SEQ ID NO: 2570747 - RNA, 14 nt, Human
ugagcuguugccuc

SEQ ID NO: 2570748 - RNA, 15 nt, Human
ugagcugccauccag

SEQ ID NO: 2570749 - RNA, 20 nt, Human
ugagcugccuguaacuugag

SEQ ID NO: 2570750 - RNA, 11 nt, Human
ugagcugccuu

SEQ ID NO: 2570751 - RNA, 16 nt, Human
ugagcugccucugaga

SEQ ID NO: 2570752 - RNA, 16 nt, Human
ugagcugagcagggag

SEQ ID NO: 2570753 - RNA, 22 nt, Human
ugagccgagaucacgccacugc

SEQ ID NO: 2570754 - RNA, 23 nt, Human
ugagcagggcucagcggggacag

SEQ ID NO: 2570755 - RNA, 22 nt, Human
ugagcagggcucagcggggaca

SEQ ID NO: 2570756 - RNA, 20 nt, Human
ugagcagggcucagcgggga

SEQ ID NO: 2570757 - RNA, 21 nt, Human
ugagcuauuuccauuccagaa

SEQ ID NO: 2570758 - RNA, 19 nt, Human
ugagcuauuuccauuccag

SEQ ID NO: 2570759 - RNA, 14 nt, Human
ugagcuauguauua

SEQ ID NO: 2570760 - RNA, 15 nt, Human
ugagcuauuucaucu

SEQ ID NO: 2570761 - RNA, 15 nt, Human
ugagcuauguauuaa

SEQ ID NO: 2570762 - RNA, 16 nt, Human
ugagcuauugcuguuc

SEQ ID NO: 2570763 - RNA, 17 nt, Human
ugagccgcaucuucucc

SEQ ID NO: 2570764 - RNA, 20 nt, Human
ugagccgcaucuucuccauc

SEQ ID NO: 2570765 - RNA, 21 nt, Human
ugagccgcaucuucuccaucu

SEQ ID NO: 2570766 - RNA, 23 nt, Human
ugagccgcaucuucuccaucugg

SEQ ID NO: 2570767 - RNA, 23 nt, Human
ugagccgagaucacgccacugca

SEQ ID NO: 2570768 - RNA, 11 nt, Human
ugagcucagcc

SEQ ID NO: 2570769 - RNA, 12 nt, Human
ugagcucagccc

SEQ ID NO: 2570770 - RNA, 16 nt, Human
ugagcucagaccccca

SEQ ID NO: 2570771 - RNA, 17 nt, Human
ugagcucagacccccac

SEQ ID NO: 2570772 - RNA, 18 nt, Human
ugagcucagacccccacu

SEQ ID NO: 2570773 - RNA, 19 nt, Human
ugagcucagacccccacuc

SEQ ID NO: 2570774 - RNA, 11 nt, Human
ugagcucagga

SEQ ID NO: 2570775 - RNA, 19 nt, Human
ugagcucaggaguuugaga

SEQ ID NO: 2570776 - RNA, 20 nt, Human
ugagcugaaaugcugcauuu

SEQ ID NO: 2570777 - RNA, 18 nt, Human
ugagcugaaaugcugcau

SEQ ID NO: 2570778 - RNA, 17 nt, Human
ugagcugaaaugcugca

SEQ ID NO: 2570779 - RNA, 17 nt, Human
ugagcugagaucgugcc

SEQ ID NO: 2570780 - RNA, 14 nt, Human
ugagcugaggcagc

SEQ ID NO: 2570781 - RNA, 14 nt, Human
ugagcugagcaggg

SEQ ID NO: 2570782 - RNA, 19 nt, Human
ugagcugagaucgugccgu

SEQ ID NO: 2570783 - RNA, 13 nt, Human
ugagcugagcagg

SEQ ID NO: 2570784 - RNA, 20 nt, Human
ugagcucagcccuggugggc

SEQ ID NO: 2570785 - RNA, 20 nt, Human
ugagcucagacccccacucu

SEQ ID NO: 2570786 - RNA, 22 nt, Human
ugagcucagacccccacucuca

SEQ ID NO: 2570787 - RNA, 12 nt, Human
ugagcuccagac

SEQ ID NO: 2570788 - RNA, 13 nt, Human
ugagcuccagacc

SEQ ID NO: 2570789 - RNA, 14 nt, Human
ugagcuccagaccc

SEQ ID NO: 2570790 - RNA, 15 nt, Human
ugagcuccagacccc

SEQ ID NO: 2570791 - RNA, 16 nt, Human
ugagcuccagaccccc

SEQ ID NO: 2570792 - RNA, 17 nt, Human
ugagcuccagaccccca

SEQ ID NO: 2570793 - RNA, 14 nt, Human
ucugcagugccuug

SEQ ID NO: 2570794 - RNA, 20 nt, Human
ucugcagucacuucguggga

SEQ ID NO: 2570795 - RNA, 13 nt, Human
ucugcagugccuu

SEQ ID NO: 2570796 - RNA, 21 nt, Human
ucugcaguagucucugugcuu

SEQ ID NO: 2570797 - RNA, 20 nt, Human
ucugcaguagucucugugcu

SEQ ID NO: 2570798 - RNA, 19 nt, Human
ucugcaguagucucugugc

SEQ ID NO: 2570799 - RNA, 18 nt, Human
ucugcaguagucucugug

SEQ ID NO: 2570800 - RNA, 16 nt, Human
ucugcaguagucucug

SEQ ID NO: 2570801 - RNA, 15 nt, Human
ucugcagugccuugg

SEQ ID NO: 2570802 - RNA, 15 nt, Human
ucugcauauguugaa

SEQ ID NO: 2570803 - RNA, 16 nt, Human
ucugcauauguugaau

SEQ ID NO: 2570804 - RNA, 18 nt, Human
ucugcauauguugaauac

SEQ ID NO: 2570805 - RNA, 18 nt, Human
ucugccauauucuguugg

SEQ ID NO: 2570806 - RNA, 12 nt, Human
ucugcccaaccc

SEQ ID NO: 2570807 - RNA, 19 nt, Human
ucugcauauguugaauacu

SEQ ID NO: 2570808 - RNA, 21 nt, Human
ucugcauauguugaauacuuu

SEQ ID NO: 2570809 - RNA, 12 nt, Human
ucugcccacucc

SEQ ID NO: 2570810 - RNA, 23 nt, Human
ucugccauauucuguuggccagu

SEQ ID NO: 2570811 - RNA, 22 nt, Human
ucugccauauucuguuggccag

SEQ ID NO: 2570812 - RNA, 15 nt, Human
ucugccucccaucac

SEQ ID NO: 2570813 - RNA, 13 nt, Human
ucugccucccauc

SEQ ID NO: 2570814 - RNA, 12 nt, Human
ucugccucccau

SEQ ID NO: 2570815 - RNA, 16 nt, Human
ucugccucaaugugaa

SEQ ID NO: 2570816 - RNA, 14 nt, Human
ucugcccacucccu

SEQ ID NO: 2570817 - RNA, 13 nt, Human
ucugcccacuccc

SEQ ID NO: 2570818 - RNA, 18 nt, Human
ucugcccaauuggaggaa

SEQ ID NO: 2570819 - RNA, 19 nt, Human
ucugcccaaaaauaugguu

SEQ ID NO: 2570820 - RNA, 18 nt, Human
ucugcccacauuggaccc

SEQ ID NO: 2570821 - RNA, 16 nt, Human
ucugccugccagcugc

SEQ ID NO: 2570822 - RNA, 17 nt, Human
ucugccugccagcugca

SEQ ID NO: 2570823 - RNA, 12 nt, Human
ucugccugagcu

SEQ ID NO: 2570824 - RNA, 20 nt, Human
ucugccugaagucacacagu

SEQ ID NO: 2570825 - RNA, 15 nt, Human
ucugccucuucuggg

SEQ ID NO: 2570826 - RNA, 17 nt, Human
ucugccucuucugggag

SEQ ID NO: 2570827 - RNA, 18 nt, Human
ucugccucuucugggagg

SEQ ID NO: 2570828 - RNA, 19 nt, Human
ucugccucuucugggaggg

SEQ ID NO: 2570829 - RNA, 19 nt, Human
ucugccugaagucacacag

SEQ ID NO: 2570830 - RNA, 22 nt, Human
ucugccucugacacacagcucu

SEQ ID NO: 2570831 - RNA, 21 nt, Human
ucugccucugacacacagcuc

SEQ ID NO: 2570832 - RNA, 15 nt, Human
ucugccucugaggga

SEQ ID NO: 2570833 - RNA, 14 nt, Human
ucugccucuucugg

SEQ ID NO: 2570834 - RNA, 14 nt, Human
ucugccucugccug

SEQ ID NO: 2570835 - RNA, 16 nt, Human
ucugccucugccugca

SEQ ID NO: 2570836 - RNA, 23 nt, Human
ucugccucugacacacagcucug

SEQ ID NO: 2570837 - RNA, 21 nt, Human
ucugccucccaucacccgcua

SEQ ID NO: 2570838 - RNA, 20 nt, Human
ucugccucccaucacccgcu

SEQ ID NO: 2570839 - RNA, 17 nt, Human
ucugccucccaucaccc

SEQ ID NO: 2570840 - RNA, 16 nt, Human
ucugccucccaucacc

SEQ ID NO: 2570841 - RNA, 18 nt, Human
ucugccucugacacacag

SEQ ID NO: 2570842 - RNA, 15 nt, Human
ucugccucugacaca

SEQ ID NO: 2570843 - RNA, 12 nt, Human
ucugccucucaa

SEQ ID NO: 2570844 - RNA, 15 nt, Human
ucugccuccucuuca

SEQ ID NO: 2570845 - RNA, 15 nt, Human
ucugccucccucacc

SEQ ID NO: 2570846 - RNA, 21 nt, Human
ucugccucaaugugaaucaga

SEQ ID NO: 2570847 - RNA, 20 nt, Human
ucugccucacauagcuuaca

SEQ ID NO: 2570848 - RNA, 23 nt, Human
ucugacccaugcugcccugugag

SEQ ID NO: 2570849 - RNA, 22 nt, Human
ucugacccaugcugcccuguga

SEQ ID NO: 2570850 - RNA, 20 nt, Human
ucugacccaugcugcccugu

SEQ ID NO: 2570851 - RNA, 19 nt, Human
ucugacccaugcugcccug

SEQ ID NO: 2570852 - RNA, 24 nt, Human
ucucauaggaaaaguacauuuaau

SEQ ID NO: 2570853 - RNA, 15 nt, Human
ucucaucaacugaau

SEQ ID NO: 2570854 - RNA, 23 nt, Human
ucucauaggaaaaguacauuuaa

SEQ ID NO: 2570855 - RNA, 22 nt, Human
ucucauaggaaaaguacauuua

SEQ ID NO: 2570856 - RNA, 17 nt, Human
ucucaucaacugaauga

SEQ ID NO: 2570857 - RNA, 19 nt, Human
ucucaucacuccccuccaa

SEQ ID NO: 2570858 - RNA, 16 nt, Human
ucucaucacuccccuc

SEQ ID NO: 2570859 - RNA, 15 nt, Human
ucucaucacuccccu

SEQ ID NO: 2570860 - RNA, 21 nt, Human
ucucaucaguguccucuugcu

SEQ ID NO: 2570861 - RNA, 15 nt, Human
ucucaucaguguccu

SEQ ID NO: 2570862 - RNA, 13 nt, Human
ucucauccaucau

SEQ ID NO: 2570863 - RNA, 14 nt, Human
ucucauccaucauc

SEQ ID NO: 2570864 - RNA, 19 nt, Human
ucucaucccacgcacucca

SEQ ID NO: 2570865 - RNA, 10 nt, Human
ucucauccca

SEQ ID NO: 2570866 - RNA, 14 nt, Human
ucucauccccaggg

SEQ ID NO: 2570867 - RNA, 22 nt, Human
ucucauccccaggggucccagc

SEQ ID NO: 2570868 - RNA, 12 nt, Human
ucugagagcugu

SEQ ID NO: 2570869 - RNA, 15 nt, Human
ucucauccccagggg

SEQ ID NO: 2570870 - RNA, 18 nt, Human
ucugagaggacuuuucuu

SEQ ID NO: 2570871 - RNA, 24 nt, Human
ucugagaucaaaacgguuuuacug

SEQ ID NO: 2570872 - RNA, 21 nt, Human
ucugagcgccuccauccaagg

SEQ ID NO: 2570873 - RNA, 24 nt, Human
ucugagcccgggcugccugggcug

SEQ ID NO: 2570874 - RNA, 17 nt, Human
ucugagcccucaaagug

SEQ ID NO: 2570875 - RNA, 14 nt, Human
ucugagcgccucca

SEQ ID NO: 2570876 - RNA, 17 nt, Human
ucugagcuauuucaucu

SEQ ID NO: 2570877 - RNA, 20 nt, Human
ucugagcuauuucaucuauu

SEQ ID NO: 2570878 - RNA, 22 nt, Human
ucugagcuauuucaucuauuuu

SEQ ID NO: 2570879 - RNA, 21 nt, Human
ucugagcccgggcugccuggg

SEQ ID NO: 2570880 - RNA, 20 nt, Human
ucugagcccgggcugccugg

SEQ ID NO: 2570881 - RNA, 19 nt, Human
ucugagcccgggcugccug

SEQ ID NO: 2570882 - RNA, 18 nt, Human
ucugagcccgggcugccu

SEQ ID NO: 2570883 - RNA, 17 nt, Human
ucugagcccgggcugcc

SEQ ID NO: 2570884 - RNA, 16 nt, Human
ucugagcccgggcugc

SEQ ID NO: 2570885 - RNA, 15 nt, Human
ucugagcccgggcug

SEQ ID NO: 2570886 - RNA, 13 nt, Human
ucugagcccgggc

SEQ ID NO: 2570887 - RNA, 12 nt, Human
ucugagccaguu

SEQ ID NO: 2570888 - RNA, 22 nt, Human
ucugagccaguucaguaccugg

SEQ ID NO: 2570889 - RNA, 15 nt, Human
ucugagccccuggga

SEQ ID NO: 2570890 - RNA, 16 nt, Human
ucugagccccugggac

SEQ ID NO: 2570891 - RNA, 21 nt, Human
ucugaggaauccagacccggc

SEQ ID NO: 2570892 - RNA, 18 nt, Human
ucugaggaauccagaccc

SEQ ID NO: 2570893 - RNA, 16 nt, Human
ucugauugugauguga

SEQ ID NO: 2570894 - RNA, 18 nt, Human
ucugagcccucaaaguga

SEQ ID NO: 2570895 - RNA, 22 nt, Human
ucugaggaauccagacccggcu

SEQ ID NO: 2570896 - RNA, 23 nt, Human
ucugcaaaaugaggaauguauau

SEQ ID NO: 2570897 - RNA, 21 nt, Human
ucugcaaaaugaggaauguau

SEQ ID NO: 2570898 - RNA, 20 nt, Human
ucugcaaaaugaggaaugua

SEQ ID NO: 2570899 - RNA, 24 nt, Human
ucugcaaacaccaacauguuggga

SEQ ID NO: 2570900 - RNA, 22 nt, Human
ucugcaaaaugaggaauguaua

SEQ ID NO: 2570901 - RNA, 18 nt, Human
ucugcaaagaaugagaag

SEQ ID NO: 2570902 - RNA, 13 nt, Human
ucugauuucagga

SEQ ID NO: 2570903 - RNA, 20 nt, Human
ucugauuugucccuaugcau

SEQ ID NO: 2570904 - RNA, 14 nt, Human
ucugcaaaaauauu

SEQ ID NO: 2570905 - RNA, 19 nt, Human
ucugcaaaaauauuuauaa

SEQ ID NO: 2570906 - RNA, 20 nt, Human
ucugcaaaaauauuuauaaa

SEQ ID NO: 2570907 - RNA, 24 nt, Human
ucugcacccuggggccuggaccug

SEQ ID NO: 2570908 - RNA, 21 nt, Human
ucugcaaugggcacugggaug

SEQ ID NO: 2570909 - RNA, 19 nt, Human
ucugcaaugggcacuggga

SEQ ID NO: 2570910 - RNA, 16 nt, Human
ucugcaaugggcacug

SEQ ID NO: 2570911 - RNA, 23 nt, Human
ucugcaagucagaggauggccag

SEQ ID NO: 2570912 - RNA, 14 nt, Human
ucugcaaucuucuc

SEQ ID NO: 2570913 - RNA, 17 nt, Human
ucugcaaucuucucaga

SEQ ID NO: 2570914 - RNA, 17 nt, Human
ucugcaagucagaggau

SEQ ID NO: 2570915 - RNA, 16 nt, Human
ucugcaagucagagga

SEQ ID NO: 2570916 - RNA, 15 nt, Human
ucugcaagucagagg

SEQ ID NO: 2570917 - RNA, 14 nt, Human
ucugcaagucagag

SEQ ID NO: 2570918 - RNA, 13 nt, Human
ucugcaagucaga

SEQ ID NO: 2570919 - RNA, 12 nt, Human
ucugcaagucag

SEQ ID NO: 2570920 - RNA, 23 nt, Human
ucugcaagggcagaacacuaacc

SEQ ID NO: 2570921 - RNA, 15 nt, Human
ucugcaagccugcgu

SEQ ID NO: 2570922 - RNA, 17 nt, Human
ucugcaaggucuuuggu

SEQ ID NO: 2570923 - RNA, 14 nt, Human
ucugcaagccugcg

SEQ ID NO: 2570924 - RNA, 21 nt, Human
ucugcaagauucugaaacauu

SEQ ID NO: 2570925 - RNA, 20 nt, Human
ucugcaagcacaucugcauu

SEQ ID NO: 2570926 - RNA, 21 nt, Human
ucugcacuacugacauguggg

SEQ ID NO: 2570927 - RNA, 16 nt, Human
ucugcaguaaaucuuu

SEQ ID NO: 2570928 - RNA, 13 nt, Human
ucugcacuccccu

SEQ ID NO: 2570929 - RNA, 23 nt, Human
ucugcacuacuccucugcagugc

SEQ ID NO: 2570930 - RNA, 21 nt, Human
ucugcacuacuccucugcagu

SEQ ID NO: 2570931 - RNA, 20 nt, Human
ucugcacuacuccucugcag

SEQ ID NO: 2570932 - RNA, 19 nt, Human
ucugcacuacuccucugca

SEQ ID NO: 2570933 - RNA, 20 nt, Human
ucugcacuacugacaugugg

SEQ ID NO: 2570934 - RNA, 18 nt, Human
ucugcacuacugacaugu

SEQ ID NO: 2570935 - RNA, 18 nt, Human
ucugcacuacuccucugc

SEQ ID NO: 2570936 - RNA, 14 nt, Human
ucugcacuacuccu

SEQ ID NO: 2570937 - RNA, 12 nt, Human
ucugcacuacuc

SEQ ID NO: 2570938 - RNA, 23 nt, Human
ucugcacccuggggccuggaccu

SEQ ID NO: 2570939 - RNA, 18 nt, Human
ucugcaccguacugugga

SEQ ID NO: 2570940 - RNA, 18 nt, Human
ucuggugaccuuccaaga

SEQ ID NO: 2570941 - RNA, 23 nt, Human
ucuggugaccuuccaagagccug

SEQ ID NO: 2570942 - RNA, 16 nt, Human
ucuggugacuuuccuc

SEQ ID NO: 2570943 - RNA, 18 nt, Human
ucuggucucuaggcuggg

SEQ ID NO: 2570944 - RNA, 17 nt, Human
ucuggucucuaggcugg

SEQ ID NO: 2570945 - RNA, 16 nt, Human
ucuggucucuaggcug

SEQ ID NO: 2570946 - RNA, 21 nt, Human
ucuggucucuaggcuggggaa

SEQ ID NO: 2570947 - RNA, 19 nt, Human
ucuggucucuaggcugggg

SEQ ID NO: 2570948 - RNA, 17 nt, Human
ucuggugaagcucacuu

SEQ ID NO: 2570949 - RNA, 16 nt, Human
ucuggugaccuuccaa

SEQ ID NO: 2570950 - RNA, 14 nt, Human
ucuggucugggugc

SEQ ID NO: 2570951 - RNA, 16 nt, Human
ucuggugacaccagcc

SEQ ID NO: 2570952 - RNA, 17 nt, Human
ucuggugacaccagccu

SEQ ID NO: 2570953 - RNA, 18 nt, Human
ucuggugacaccagccuu

SEQ ID NO: 2570954 - RNA, 13 nt, Human
ucuguaaacugug

SEQ ID NO: 2570955 - RNA, 14 nt, Human
ucuguaaacugugu

SEQ ID NO: 2570956 - RNA, 15 nt, Human
ucuguaaacugugua

SEQ ID NO: 2570957 - RNA, 16 nt, Human
ucuguaaacuguguau

SEQ ID NO: 2570958 - RNA, 18 nt, Human
ucuguaaacucaaaacuu

SEQ ID NO: 2570959 - RNA, 15 nt, Human
ucuguaaacucaaaa

SEQ ID NO: 2570960 - RNA, 12 nt, Human
ucuguaaacugu

SEQ ID NO: 2570961 - RNA, 23 nt, Human
ucuguaaaaucuuucuuucuuag

SEQ ID NO: 2570962 - RNA, 22 nt, Human
ucuguaaaaucuuucuuucuua

SEQ ID NO: 2570963 - RNA, 19 nt, Human
ucuguaaacuguguauucc

SEQ ID NO: 2570964 - RNA, 22 nt, Human
ucuguaaacuguguauuccaag

SEQ ID NO: 2570965 - RNA, 22 nt, Human
ucuguaacucuaaaagauccuu

SEQ ID NO: 2570966 - RNA, 22 nt, Human
ucuggagcccacuguacuugcu

SEQ ID NO: 2570967 - RNA, 16 nt, Human
ucuggagcccacugua

SEQ ID NO: 2570968 - RNA, 12 nt, Human
ucuggagcccac

SEQ ID NO: 2570969 - RNA, 16 nt, Human
ucuggagccaagucca

SEQ ID NO: 2570970 - RNA, 20 nt, Human
ucuggagagguuauagguca

SEQ ID NO: 2570971 - RNA, 22 nt, Human
ucuggagagguuauaggucacu

SEQ ID NO: 2570972 - RNA, 22 nt, Human
ucuggcugccccaaccugcuga

SEQ ID NO: 2570973 - RNA, 21 nt, Human
ucuggcugccccaaccugcug

SEQ ID NO: 2570974 - RNA, 14 nt, Human
ucuggcugcagagc

SEQ ID NO: 2570975 - RNA, 15 nt, Human
ucuggcugcagagca

SEQ ID NO: 2570976 - RNA, 22 nt, Human
ucuggcugguuuggaaugcuuc

SEQ ID NO: 2570977 - RNA, 21 nt, Human
ucuggcuggcuaacuggaagc

SEQ ID NO: 2570978 - RNA, 22 nt, Human
ucuggcuuccagguaucuccag

SEQ ID NO: 2570979 - RNA, 15 nt, Human
ucuggcuuccaggua

SEQ ID NO: 2570980 - RNA, 13 nt, Human
ucuggcuuccagg

SEQ ID NO: 2570981 - RNA, 24 nt, Human
ucuggcuuccagguaucuccagga

SEQ ID NO: 2570982 - RNA, 23 nt, Human
ucuggcuuccagaaaaccccagc

SEQ ID NO: 2570983 - RNA, 17 nt, Human
ucuguaauuguguguga

SEQ ID NO: 2570984 - RNA, 14 nt, Human
ucuguacagagccc

SEQ ID NO: 2570985 - RNA, 13 nt, Human
ucuguacaaugaa

SEQ ID NO: 2570986 - RNA, 13 nt, Human
ucuguacacgugu

SEQ ID NO: 2570987 - RNA, 20 nt, Human
ucuguccuacucugugucag

SEQ ID NO: 2570988 - RNA, 15 nt, Human
ucuguacagagccca

SEQ ID NO: 2570989 - RNA, 17 nt, Human
ucuguacacguguccug

SEQ ID NO: 2570990 - RNA, 13 nt, Human
ucuguccucagcc

SEQ ID NO: 2570991 - RNA, 14 nt, Human
ucuguccucagccu

SEQ ID NO: 2570992 - RNA, 15 nt, Human
ucuguccucagccuu

SEQ ID NO: 2570993 - RNA, 19 nt, Human
ucuguccucagccuugcca

SEQ ID NO: 2570994 - RNA, 21 nt, Human
ucuguccucagccuugccaga

SEQ ID NO: 2570995 - RNA, 10 nt, Human
ucuguccuga

SEQ ID NO: 2570996 - RNA, 23 nt, Human
ucuguacaaugaacccccaugau

SEQ ID NO: 2570997 - RNA, 23 nt, Human
ucuguccucagccuugccagaga

SEQ ID NO: 2570998 - RNA, 17 nt, Human
ucugucgcccagucugg

SEQ ID NO: 2570999 - RNA, 12 nt, Human
ucuguccuggga

SEQ ID NO: 2571000 - RNA, 14 nt, Human
ucugucucagucca

SEQ ID NO: 2571001 - RNA, 21 nt, Human
ucugucucauccaucaucaug

SEQ ID NO: 2571002 - RNA, 13 nt, Human
ucugucucaucca

SEQ ID NO: 2571003 - RNA, 15 nt, Human
ucugucucauaugau

SEQ ID NO: 2571004 - RNA, 16 nt, Human
ucuguguacaaagaaa

SEQ ID NO: 2571005 - RNA, 19 nt, Human
ucugucuccuuaacacuga

SEQ ID NO: 2571006 - RNA, 17 nt, Human
ucugucucauccaucau

SEQ ID NO: 2571007 - RNA, 14 nt, Human
ucugucuccuuaac

SEQ ID NO: 2571008 - RNA, 15 nt, Human
ucugugucacuggcu

SEQ ID NO: 2571009 - RNA, 14 nt, Human
ucugugucacuggc

SEQ ID NO: 2571010 - RNA, 15 nt, Human
ucuguguacaaagaa

SEQ ID NO: 2571011 - RNA, 22 nt, Human
ucugugucacuggcugccucca

SEQ ID NO: 2571012 - RNA, 17 nt, Human
ucugugucacuggcugc

SEQ ID NO: 2571013 - RNA, 23 nt, Human
ucugugucacuggcugccuccac

SEQ ID NO: 2571014 - RNA, 13 nt, Human
ucugucuaggaau

SEQ ID NO: 2571015 - RNA, 21 nt, Human
ucugucucaaaaaauaaaaau

SEQ ID NO: 2571016 - RNA, 12 nt, Human
ucuguccugcug

SEQ ID NO: 2571017 - RNA, 16 nt, Human
ucugucgccuuagcau

SEQ ID NO: 2571018 - RNA, 19 nt, Human
ucugucgccuuagcauguu

SEQ ID NO: 2571019 - RNA, 18 nt, Human
ucugucgccuuagcaugu

SEQ ID NO: 2571020 - RNA, 17 nt, Human
ucugucgccuuagcaug

SEQ ID NO: 2571021 - RNA, 23 nt, Human
ucugucgccuuagcauguuugcu

SEQ ID NO: 2571022 - RNA, 22 nt, Human
ucugucgccuuagcauguuugc

SEQ ID NO: 2571023 - RNA, 20 nt, Human
ucugccugcccaggccccug

SEQ ID NO: 2571024 - RNA, 18 nt, Human
ucugccugcccaggcccc

SEQ ID NO: 2571025 - RNA, 18 nt, Human
ucugccugccagcugcac

SEQ ID NO: 2571026 - RNA, 21 nt, Human
ucugccugccagcugcacuga

SEQ ID NO: 2571027 - RNA, 17 nt, Human
ucugccugcccaggccc

SEQ ID NO: 2571028 - RNA, 20 nt, Human
ucugcucuccuuccuggagc

SEQ ID NO: 2571029 - RNA, 19 nt, Human
ucugcucuccuuccuggag

SEQ ID NO: 2571030 - RNA, 15 nt, Human
ucugcucuccuuccu

SEQ ID NO: 2571031 - RNA, 14 nt, Human
ucugcucuccuucc

SEQ ID NO: 2571032 - RNA, 22 nt, Human
ucugcucgggcccaggccaucu

SEQ ID NO: 2571033 - RNA, 18 nt, Human
ucugcucgggcccaggcc

SEQ ID NO: 2571034 - RNA, 17 nt, Human
ucugcucgggcccaggc

SEQ ID NO: 2571035 - RNA, 16 nt, Human
ucugcucgggcccagg

SEQ ID NO: 2571036 - RNA, 13 nt, Human
ucugcucuccuuc

SEQ ID NO: 2571037 - RNA, 12 nt, Human
ucugcucuccuu

SEQ ID NO: 2571038 - RNA, 22 nt, Human
ucugcuccuggagccuuugaau

SEQ ID NO: 2571039 - RNA, 22 nt, Human
ucugccugccagcugcacugau

SEQ ID NO: 2571040 - RNA, 16 nt, Human
ucugcucgccuuagca

SEQ ID NO: 2571041 - RNA, 14 nt, Human
ucugcucggccguc

SEQ ID NO: 2571042 - RNA, 15 nt, Human
ucugcucggccgucu

SEQ ID NO: 2571043 - RNA, 18 nt, Human
ucugcucggccgucuuca

SEQ ID NO: 2571044 - RNA, 16 nt, Human
ucugcucugcguguca

SEQ ID NO: 2571045 - RNA, 21 nt, Human
ucugcucugcgugucaccugu

SEQ ID NO: 2571046 - RNA, 14 nt, Human
ucugcucugcccuu

SEQ ID NO: 2571047 - RNA, 13 nt, Human
ucugcucugcccu

SEQ ID NO: 2571048 - RNA, 12 nt, Human
ucugcucugccc

SEQ ID NO: 2571049 - RNA, 20 nt, Human
ucugcucugaggcuuccaga

SEQ ID NO: 2571050 - RNA, 19 nt, Human
ucugcucugaggcuuccag

SEQ ID NO: 2571051 - RNA, 17 nt, Human
ucugcucuuucucugcc

SEQ ID NO: 2571052 - RNA, 16 nt, Human
ucugcucuuucucugc

SEQ ID NO: 2571053 - RNA, 15 nt, Human
ucugcucuuucucug

SEQ ID NO: 2571054 - RNA, 14 nt, Human
ucugcucuuucucu

SEQ ID NO: 2571055 - RNA, 19 nt, Human
ucugcucuuucucugccag

SEQ ID NO: 2571056 - RNA, 18 nt, Human
ucugcucuuucucugcca

SEQ ID NO: 2571057 - RNA, 13 nt, Human
ucugcugaaggaa

SEQ ID NO: 2571058 - RNA, 13 nt, Human
ucugcugcuggcu

SEQ ID NO: 2571059 - RNA, 11 nt, Human
ucugcugcugg

SEQ ID NO: 2571060 - RNA, 16 nt, Human
ucugcugaauuuucac

SEQ ID NO: 2571061 - RNA, 14 nt, Human
ucugcugaauuuuc

SEQ ID NO: 2571062 - RNA, 20 nt, Human
ucugcucuuucucugccagu

SEQ ID NO: 2571063 - RNA, 17 nt, Human
ucugcugaauuuucaca

SEQ ID NO: 2571064 - RNA, 13 nt, Human
ucugcugcccucc

SEQ ID NO: 2571065 - RNA, 14 nt, Human
ucugcugcccucca

SEQ ID NO: 2571066 - RNA, 15 nt, Human
ucugcugcccuccau

SEQ ID NO: 2571067 - RNA, 22 nt, Human
ucuggaauguaaucaauguuuc

SEQ ID NO: 2571068 - RNA, 18 nt, Human
ucuggaauguaaucaaug

SEQ ID NO: 2571069 - RNA, 16 nt, Human
ucuggaauguaaucaa

SEQ ID NO: 2571070 - RNA, 15 nt, Human
ucuggaauguaauca

SEQ ID NO: 2571071 - RNA, 22 nt, Human
ucugcugccgccccacccagau

SEQ ID NO: 2571072 - RNA, 19 nt, Human
ucugcuggaguuucaugua

SEQ ID NO: 2571073 - RNA, 14 nt, Human
ucuggaauuugaaa

SEQ ID NO: 2571074 - RNA, 18 nt, Human
ucuggacagccccacccu

SEQ ID NO: 2571075 - RNA, 19 nt, Human
ucuggacagccccacccug

SEQ ID NO: 2571076 - RNA, 21 nt, Human
ucuggacaagccaacuuguaa

SEQ ID NO: 2571077 - RNA, 12 nt, Human
ucuggacaagcc

SEQ ID NO: 2571078 - RNA, 15 nt, Human
ucugcugcuggcugg

SEQ ID NO: 2571079 - RNA, 14 nt, Human
ucugcugcuggcug

SEQ ID NO: 2571080 - RNA, 17 nt, Human
ucugcugcuggcugguu

SEQ ID NO: 2571081 - RNA, 18 nt, Human
ucugcugcugucccuccc

SEQ ID NO: 2571082 - RNA, 13 nt, Human
ucugcuggaguuu

SEQ ID NO: 2571083 - RNA, 21 nt, Human
ucugcugccgccccacccaga

SEQ ID NO: 2571084 - RNA, 18 nt, Human
ucugcugcccuccauccc

SEQ ID NO: 2571085 - RNA, 15 nt, Human
ucuggagaagcagug

SEQ ID NO: 2571086 - RNA, 22 nt, Human
ucuggagaagcagugagccgca

SEQ ID NO: 2571087 - RNA, 20 nt, Human
ucuggagagcuagaaccugg

SEQ ID NO: 2571088 - RNA, 23 nt, Human
ucuggagagcuagaaccuggagg

SEQ ID NO: 2571089 - RNA, 22 nt, Human
ucuggagagcuagaaccuggag

SEQ ID NO: 2571090 - RNA, 21 nt, Human
ucuggagagcuagaaccugga

SEQ ID NO: 2571091 - RNA, 16 nt, Human
ucuggagaagcaguga

SEQ ID NO: 2571092 - RNA, 11 nt, Human
ucuggagaagc

SEQ ID NO: 2571093 - RNA, 19 nt, Human
ucuggacuuggcaacagaa

SEQ ID NO: 2571094 - RNA, 20 nt, Human
ucuggacugaagccugcagg

SEQ ID NO: 2571095 - RNA, 14 nt, Human
ucuggacuggcuag

SEQ ID NO: 2571096 - RNA, 15 nt, Human
ucuggacuggcuaga

SEQ ID NO: 2571097 - RNA, 13 nt, Human
ucuggacugaagc

SEQ ID NO: 2571098 - RNA, 17 nt, Human
ucuggacugaagccugc

SEQ ID NO: 2571099 - RNA, 19 nt, Human
ucuggacugaagccugcag

SEQ ID NO: 2571100 - RNA, 19 nt, Human
ucuggacugccccagaaaa

SEQ ID NO: 2571101 - RNA, 21 nt, Human
ucuggacugaagccugcagga

SEQ ID NO: 2571102 - RNA, 22 nt, Human
ucuggacggcaggcucacugcc

SEQ ID NO: 2571103 - RNA, 21 nt, Human
ucuggacggcaggcucacugc

SEQ ID NO: 2571104 - RNA, 22 nt, Human
ucuggacuccucuguccaggca

SEQ ID NO: 2571105 - RNA, 18 nt, Human
ucuggacuccucugucca

SEQ ID NO: 2571106 - RNA, 16 nt, Human
ucuggacuccucuguc

SEQ ID NO: 2571107 - RNA, 23 nt, Human
ucuggacggcaggcucacugcca

SEQ ID NO: 2571108 - RNA, 15 nt, Human
ucuggacuccucugu

SEQ ID NO: 2571109 - RNA, 21 nt, Human
ucuggaccccaucugugaaua

SEQ ID NO: 2571110 - RNA, 20 nt, Human
ucuggacagccccacccugg

SEQ ID NO: 2571111 - RNA, 23 nt, Human
ucuggacaagccaacuuguaaau

SEQ ID NO: 2571112 - RNA, 23 nt, Human
ucuggaccccaucugugaauaag

SEQ ID NO: 2571113 - RNA, 19 nt, Human
ucuggacggcaggcucacu

SEQ ID NO: 2571114 - RNA, 17 nt, Human
ucuggacggcaggcuca

SEQ ID NO: 2571115 - RNA, 15 nt, Human
ucuggacggcaggcu

SEQ ID NO: 2571116 - RNA, 14 nt, Human
ucuggacggcaggc

SEQ ID NO: 2571117 - RNA, 20 nt, Human
ucuggaccuuguuguuguua

SEQ ID NO: 2571118 - RNA, 18 nt, Human
ugaaaaccacauuggaga

SEQ ID NO: 2571119 - RNA, 20 nt, Human
ugaaaacggagcugaacaau

SEQ ID NO: 2571120 - RNA, 23 nt, Human
ugaaaacccagagaggaaucaga

SEQ ID NO: 2571121 - RNA, 14 nt, Human
ugaaaacccagaga

SEQ ID NO: 2571122 - RNA, 15 nt, Human
ugaaaacccagagag

SEQ ID NO: 2571123 - RNA, 19 nt, Human
ugaaaagaaaaaugagccu

SEQ ID NO: 2571124 - RNA, 16 nt, Human
ugaaaacccagagagg

SEQ ID NO: 2571125 - RNA, 16 nt, Human
ugaaaacguuuuauug

SEQ ID NO: 2571126 - RNA, 17 nt, Human
ugaaaacguuuuauugu

SEQ ID NO: 2571127 - RNA, 18 nt, Human
ugaaaacguuuuauugug

SEQ ID NO: 2571128 - RNA, 15 nt, Human
ugaaaagaaaaauga

SEQ ID NO: 2571129 - RNA, 16 nt, Human
ugaaaauuauuuuaaa

SEQ ID NO: 2571130 - RNA, 15 nt, Human
ugaaaauuauuuuaa

SEQ ID NO: 2571131 - RNA, 16 nt, Human
ugaaaauuauuugaaa

SEQ ID NO: 2571132 - RNA, 20 nt, Human
ugaaaauuaggauuucauga

SEQ ID NO: 2571133 - RNA, 15 nt, Human
ugaaaauuauuugaa

SEQ ID NO: 2571134 - RNA, 20 nt, Human
ugaaaagaaaaaugagccug

SEQ ID NO: 2571135 - RNA, 22 nt, Human
ugaaaagaaaaaugagccuggc

SEQ ID NO: 2571136 - RNA, 23 nt, Human
ugaaacacucaguuguucaauaa

SEQ ID NO: 2571137 - RNA, 15 nt, Human
ugaaacacuuugcau

SEQ ID NO: 2571138 - RNA, 19 nt, Human
ugaaacaccuucucuggag

SEQ ID NO: 2571139 - RNA, 18 nt, Human
ugaaacaccuucucugga

SEQ ID NO: 2571140 - RNA, 16 nt, Human
ugaaacaccuucucug

SEQ ID NO: 2571141 - RNA, 17 nt, Human
ugaaaauuguauguuaa

SEQ ID NO: 2571142 - RNA, 12 nt, Human
ugaaaauuuuga

SEQ ID NO: 2571143 - RNA, 19 nt, Human
ugaaaauucaaaaaguguu

SEQ ID NO: 2571144 - RNA, 18 nt, Human
ugaaaauucaaaaagugu

SEQ ID NO: 2571145 - RNA, 23 nt, Human
ugaaaauucaaaaaguguuuauu

SEQ ID NO: 2571146 - RNA, 17 nt, Human
ugaaaauucaaaaagug

SEQ ID NO: 2571147 - RNA, 21 nt, Human
ugaaaauuauuuuaaacaaaa

SEQ ID NO: 2571148 - RNA, 19 nt, Human
ugaaaauuauuuuaaacaa

SEQ ID NO: 2571149 - RNA, 18 nt, Human
ugaaaauuauuuuaaaca

SEQ ID NO: 2571150 - RNA, 14 nt, Human
ugaaaauucagugg

SEQ ID NO: 2571151 - RNA, 21 nt, Human
ugaaaacacuguucucugccc

SEQ ID NO: 2571152 - RNA, 20 nt, Human
ugaaaacacuguucucugcc

SEQ ID NO: 2571153 - RNA, 16 nt, Human
ugaaaacacugugcac

SEQ ID NO: 2571154 - RNA, 18 nt, Human
ugaaaacacugugcacau

SEQ ID NO: 2571155 - RNA, 17 nt, Human
ugaaaacacuguucucu

SEQ ID NO: 2571156 - RNA, 23 nt, Human
ugaaaacacuguucucugcccuc

SEQ ID NO: 2571157 - RNA, 22 nt, Human
ugaaaacacuguucucugcccu

SEQ ID NO: 2571158 - RNA, 17 nt, Human
ugaaaacaucuggaagg

SEQ ID NO: 2571159 - RNA, 13 nt, Human
ugaaaacaucugg

SEQ ID NO: 2571160 - RNA, 19 nt, Human
ugaaaacaugguagaauug

SEQ ID NO: 2571161 - RNA, 23 nt, Human
ugaaaacaugguagaauuggaga

SEQ ID NO: 2571162 - RNA, 14 nt, Human
ugaaaacauguaau

SEQ ID NO: 2571163 - RNA, 18 nt, Human
ugaaaacagaaaacgguu

SEQ ID NO: 2571164 - RNA, 20 nt, Human
ucuuuuguucgcauggucac

SEQ ID NO: 2571165 - RNA, 23 nt, Human
ucuuuuuaaaguguuucuguuau

SEQ ID NO: 2571166 - RNA, 21 nt, Human
ugaaaacacauuuuucuuagg

SEQ ID NO: 2571167 - RNA, 15 nt, Human
ucuuuuuaauaaaaa

SEQ ID NO: 2571168 - RNA, 14 nt, Human
ucuuuuuaagcuua

SEQ ID NO: 2571169 - RNA, 21 nt, Human
ucuuuuuaagcuuauuuaauu

SEQ ID NO: 2571170 - RNA, 22 nt, Human
ucuuuuguauguaaaugugcau

SEQ ID NO: 2571171 - RNA, 20 nt, Human
ucuuuuguauguaaaugugc

SEQ ID NO: 2571172 - RNA, 17 nt, Human
ucuuuuguauguaaaug

SEQ ID NO: 2571173 - RNA, 15 nt, Human
ucuuuuguauguaaa

SEQ ID NO: 2571174 - RNA, 11 nt, Human
ucuuuuguaug

SEQ ID NO: 2571175 - RNA, 10 nt, Human
ucuuuuguau

SEQ ID NO: 2571176 - RNA, 14 nt, Human
ucuuuucuauuuuc

SEQ ID NO: 2571177 - RNA, 19 nt, Human
ucuuuucuacccuagccau

SEQ ID NO: 2571178 - RNA, 18 nt, Human
ucuuuucuacccuagcca

SEQ ID NO: 2571179 - RNA, 17 nt, Human
ucuuuucuacccuagcc

SEQ ID NO: 2571180 - RNA, 12 nt, Human
ucuuuucuaccc

SEQ ID NO: 2571181 - RNA, 22 nt, Human
ucuuuucgccguggcugcggca

SEQ ID NO: 2571182 - RNA, 19 nt, Human
ucuuuucccacuguuuaag

SEQ ID NO: 2571183 - RNA, 19 nt, Human
ucuuuucaucugggaaaga

SEQ ID NO: 2571184 - RNA, 22 nt, Human
ucuuuucaucugggaaagacau

SEQ ID NO: 2571185 - RNA, 15 nt, Human
ucuuuggacccugag

SEQ ID NO: 2571186 - RNA, 14 nt, Human
ucuuuggacccuga

SEQ ID NO: 2571187 - RNA, 22 nt, Human
ucuuuucacauucuuauaaaua

SEQ ID NO: 2571188 - RNA, 19 nt, Human
ucuuuucacauucuuauaa

SEQ ID NO: 2571189 - RNA, 18 nt, Human
ucuuuucacauucuuaua

SEQ ID NO: 2571190 - RNA, 17 nt, Human
ucuuuucacauucuuau

SEQ ID NO: 2571191 - RNA, 20 nt, Human
ucuuuucagaucauggcauc

SEQ ID NO: 2571192 - RNA, 18 nt, Human
ucuuuucaucugggaaag

SEQ ID NO: 2571193 - RNA, 16 nt, Human
ucuuuggacccugagg

SEQ ID NO: 2571194 - RNA, 16 nt, Human
ucuuugccuguucagu

SEQ ID NO: 2571195 - RNA, 15 nt, Human
ucuuugccuguucag

SEQ ID NO: 2571196 - RNA, 12 nt, Human
ucuuugccuguu

SEQ ID NO: 2571197 - RNA, 12 nt, Human
ucuuugccuggu

SEQ ID NO: 2571198 - RNA, 23 nt, Human
ucuuugccuguucaguuacagaa

SEQ ID NO: 2571199 - RNA, 17 nt, Human
ucuuugccuguucaguu

SEQ ID NO: 2571200 - RNA, 14 nt, Human
ucuuugccuugggc

SEQ ID NO: 2571201 - RNA, 20 nt, Human
ucuuugccuugggcugcucc

SEQ ID NO: 2571202 - RNA, 21 nt, Human
ucuuugccuugggcugcuccu

SEQ ID NO: 2571203 - RNA, 13 nt, Human
ucuuuggacccug

SEQ ID NO: 2571204 - RNA, 15 nt, Human
ucuuugcuugccucu

SEQ ID NO: 2571205 - RNA, 19 nt, Human
ucuuugcuucacuucuccc

SEQ ID NO: 2571206 - RNA, 22 nt, Human
ucuuuggacagaagcagcucuu

SEQ ID NO: 2571207 - RNA, 13 nt, Human
ucuuugcuugccu

SEQ ID NO: 2571208 - RNA, 23 nt, Human
ucuuugagugaagcugggagaac

SEQ ID NO: 2571209 - RNA, 17 nt, Human
ucuuugaauuuucugug

SEQ ID NO: 2571210 - RNA, 16 nt, Human
ucuuugaauuuucugu

SEQ ID NO: 2571211 - RNA, 13 nt, Human
ucuuugcagacag

SEQ ID NO: 2571212 - RNA, 23 nt, Human
ucuuugaccucaaccugugauga

SEQ ID NO: 2571213 - RNA, 17 nt, Human
ucuuugagauagaagaa

SEQ ID NO: 2571214 - RNA, 18 nt, Human
ucuuugagauagaagaac

SEQ ID NO: 2571215 - RNA, 22 nt, Human
ucuuugagauagaagaacugca

SEQ ID NO: 2571216 - RNA, 22 nt, Human
ucuuugccacccucaugcugug

SEQ ID NO: 2571217 - RNA, 21 nt, Human
ucuuugccacccucaugcugu

SEQ ID NO: 2571218 - RNA, 17 nt, Human
ucuuugcagacaggcaa

SEQ ID NO: 2571219 - RNA, 14 nt, Human
ucuuugcagacagg

SEQ ID NO: 2571220 - RNA, 18 nt, Human
ucuuucccauggggaggg

SEQ ID NO: 2571221 - RNA, 15 nt, Human
ucuuugaaugacaaa

SEQ ID NO: 2571222 - RNA, 14 nt, Human
ucuuugaaugcuuu

SEQ ID NO: 2571223 - RNA, 16 nt, Human
ucuuugaaugacaaag

SEQ ID NO: 2571224 - RNA, 13 nt, Human
ucuuucccucccu

SEQ ID NO: 2571225 - RNA, 23 nt, Human
ucuuucccucccuuccucuuucc

SEQ ID NO: 2571226 - RNA, 17 nt, Human
ucuuuccacagaagcuc

SEQ ID NO: 2571227 - RNA, 17 nt, Human
ucuuuccaaaguacacu

SEQ ID NO: 2571228 - RNA, 12 nt, Human
ucuuucccuccc

SEQ ID NO: 2571229 - RNA, 20 nt, Human
ucuugucucaaugcucauaa

SEQ ID NO: 2571230 - RNA, 18 nt, Human
ucuugucucaaugcucau

SEQ ID NO: 2571231 - RNA, 23 nt, Human
ucuugugaggaaagucauuggcu

SEQ ID NO: 2571232 - RNA, 13 nt, Human
ucuugugaggaaa

SEQ ID NO: 2571233 - RNA, 21 nt, Human
ucuugucucaaugcucauaac

SEQ ID NO: 2571234 - RNA, 13 nt, Human
ucuuguguguuua

SEQ ID NO: 2571235 - RNA, 23 nt, Human
ucuuuccaaaguacacuguuuca

SEQ ID NO: 2571236 - RNA, 21 nt, Human
ucuugugcuuuuccuauuugu

SEQ ID NO: 2571237 - RNA, 19 nt, Human
ucuuguggauguuuuaauu

SEQ ID NO: 2571238 - RNA, 23 nt, Human
ucuugugcuggauggagcccagg

SEQ ID NO: 2571239 - RNA, 22 nt, Human
ucuugugcuggauggagcccag

SEQ ID NO: 2571240 - RNA, 21 nt, Human
ucuugugugguuuggcccuuc

SEQ ID NO: 2571241 - RNA, 23 nt, Human
ucuuguggauguuuuaauuccau

SEQ ID NO: 2571242 - RNA, 13 nt, Human
ucuuauaauuuaa

SEQ ID NO: 2571243 - RNA, 14 nt, Human
ucuuauaauuuaaa

SEQ ID NO: 2571244 - RNA, 20 nt, Human
ucuuagguuggcaaaaaggc

SEQ ID NO: 2571245 - RNA, 23 nt, Human
ucuuagguuggcaaaaaggcagg

SEQ ID NO: 2571246 - RNA, 22 nt, Human
ucuuaggguuaugauuaaguaa

SEQ ID NO: 2571247 - RNA, 20 nt, Human
ucugugucagguggggcagc

SEQ ID NO: 2571248 - RNA, 17 nt, Human
ucugugucagguggggc

SEQ ID NO: 2571249 - RNA, 13 nt, Human
ucugugugaaaau

SEQ ID NO: 2571250 - RNA, 14 nt, Human
ucugugugcacaaa

SEQ ID NO: 2571251 - RNA, 21 nt, Human
ucugugugcacaaauauuuau

SEQ ID NO: 2571252 - RNA, 18 nt, Human
ucugugugaugaacuuuc

SEQ ID NO: 2571253 - RNA, 20 nt, Human
ucugugugaugaacuuucuc

SEQ ID NO: 2571254 - RNA, 22 nt, Human
ucugugugcaagugugugcaca

SEQ ID NO: 2571255 - RNA, 15 nt, Human
ucuuagauguauaua

SEQ ID NO: 2571256 - RNA, 22 nt, Human
ucugugugcaccuuaccaacuu

SEQ ID NO: 2571257 - RNA, 16 nt, Human
ucuuagcagcuuccag

SEQ ID NO: 2571258 - RNA, 16 nt, Human
ucuuagcauccugccu

SEQ ID NO: 2571259 - RNA, 19 nt, Human
ucugugugcaccuuaccaa

SEQ ID NO: 2571260 - RNA, 18 nt, Human
ucugugugcaccuuacca

SEQ ID NO: 2571261 - RNA, 13 nt, Human
ucugugugugugu

SEQ ID NO: 2571262 - RNA, 14 nt, Human
ucuuagauguauau

SEQ ID NO: 2571263 - RNA, 11 nt, Human
ucugugugugu

SEQ ID NO: 2571264 - RNA, 22 nt, Human
ucuuaucucagucaugcauaaa

SEQ ID NO: 2571265 - RNA, 20 nt, Human
ucuuaucucagucaugcaua

SEQ ID NO: 2571266 - RNA, 14 nt, Human
ucuuaucucaguca

SEQ ID NO: 2571267 - RNA, 20 nt, Human
ucuuaucauggucucaguca

SEQ ID NO: 2571268 - RNA, 12 nt, Human
ucuuaucucagu

SEQ ID NO: 2571269 - RNA, 21 nt, Human
ucuucagagacuccugcaggc

SEQ ID NO: 2571270 - RNA, 13 nt, Human
ucuucagagcuga

SEQ ID NO: 2571271 - RNA, 12 nt, Human
ucuucagagcug

SEQ ID NO: 2571272 - RNA, 16 nt, Human
ucuucagagcaggggu

SEQ ID NO: 2571273 - RNA, 15 nt, Human
ucuuaucuucugcaa

SEQ ID NO: 2571274 - RNA, 14 nt, Human
ucuucagaucucua

SEQ ID NO: 2571275 - RNA, 15 nt, Human
ucuuauauaugugaa

SEQ ID NO: 2571276 - RNA, 18 nt, Human
ucuuauauaugugaacau

SEQ ID NO: 2571277 - RNA, 18 nt, Human
ucuuagugccugagagua

SEQ ID NO: 2571278 - RNA, 14 nt, Human
ucuuagcuccccuc

SEQ ID NO: 2571279 - RNA, 13 nt, Human
ucuuagcuccccu

SEQ ID NO: 2571280 - RNA, 14 nt, Human
ucuuaguagauuuu

SEQ ID NO: 2571281 - RNA, 14 nt, Human
ucuuagugccugag

SEQ ID NO: 2571282 - RNA, 22 nt, Human
ucuuauccaacaucaacaucuu

SEQ ID NO: 2571283 - RNA, 23 nt, Human
ucuuaucaccacaguaaguuccu

SEQ ID NO: 2571284 - RNA, 16 nt, Human
ucuuaucaagcagcca

SEQ ID NO: 2571285 - RNA, 13 nt, Human
ucuuaucaagcag

SEQ ID NO: 2571286 - RNA, 14 nt, Human
ucuucagaggcccu

SEQ ID NO: 2571287 - RNA, 15 nt, Human
ucuucagaggcccuc

SEQ ID NO: 2571288 - RNA, 15 nt, Human
ucuucagaucucuaa

SEQ ID NO: 2571289 - RNA, 19 nt, Human
ucuucaguuaagccuuugg

SEQ ID NO: 2571290 - RNA, 20 nt, Human
ucuucaguuaagccuuugga

SEQ ID NO: 2571291 - RNA, 22 nt, Human
ucuucaguuaagccuuuggaaa

SEQ ID NO: 2571292 - RNA, 19 nt, Human
ucuucagauacaaacugca

SEQ ID NO: 2571293 - RNA, 16 nt, Human
ucuucauguuucagga

SEQ ID NO: 2571294 - RNA, 21 nt, Human
ucuucauuaagcccucuucca

SEQ ID NO: 2571295 - RNA, 20 nt, Human
ucuucauaacaauuuuagga

SEQ ID NO: 2571296 - RNA, 12 nt, Human
ucuucaguuuua

SEQ ID NO: 2571297 - RNA, 18 nt, Human
ucuucaguuuuaucuuua

SEQ ID NO: 2571298 - RNA, 19 nt, Human
ucuucaguuuuaucuuuaa

SEQ ID NO: 2571299 - RNA, 15 nt, Human
ucuucauuucauugu

SEQ ID NO: 2571300 - RNA, 14 nt, Human
ucuucauuucauug

SEQ ID NO: 2571301 - RNA, 22 nt, Human
ucuucauuaagcccucuuccau

SEQ ID NO: 2571302 - RNA, 22 nt, Human
ucuucauuaccucagugagaag

SEQ ID NO: 2571303 - RNA, 22 nt, Human
ucuucauuucauuguaugaugu

SEQ ID NO: 2571304 - RNA, 21 nt, Human
ucuucauuucauuguaugaug

SEQ ID NO: 2571305 - RNA, 17 nt, Human
ucuucauuucauuguau

SEQ ID NO: 2571306 - RNA, 16 nt, Human
ucuucauuucauugua

SEQ ID NO: 2571307 - RNA, 14 nt, Human
ucuuccaaagcaca

SEQ ID NO: 2571308 - RNA, 24 nt, Human
ucuucauuucauuguaugaugugu

SEQ ID NO: 2571309 - RNA, 19 nt, Human
ucuuguaauccgaaucucu

SEQ ID NO: 2571310 - RNA, 17 nt, Human
ucuugcucuguaaucuc

SEQ ID NO: 2571311 - RNA, 14 nt, Human
ucuugcucuguaau

SEQ ID NO: 2571312 - RNA, 13 nt, Human
ucuugcucuguaa

SEQ ID NO: 2571313 - RNA, 21 nt, Human
ucuugcccuucccugucccuc

SEQ ID NO: 2571314 - RNA, 20 nt, Human
ucuugcccuucccugucccu

SEQ ID NO: 2571315 - RNA, 18 nt, Human
ucuugcccuucccugucc

SEQ ID NO: 2571316 - RNA, 23 nt, Human
ucuuguaauuuaaacaggcccag

SEQ ID NO: 2571317 - RNA, 17 nt, Human
ucuuguacauguguagc

SEQ ID NO: 2571318 - RNA, 14 nt, Human
ucuuguacaugugu

SEQ ID NO: 2571319 - RNA, 23 nt, Human
ucuugcucugcugacagacacag

SEQ ID NO: 2571320 - RNA, 15 nt, Human
ucuugcucugcugac

SEQ ID NO: 2571321 - RNA, 24 nt, Human
ucuuguacauguguagccugugca

SEQ ID NO: 2571322 - RNA, 19 nt, Human
ucuuguacauguguagccu

SEQ ID NO: 2571323 - RNA, 16 nt, Human
ucuuguaguagucuca

SEQ ID NO: 2571324 - RNA, 14 nt, Human
ucuuguauuaagaa

SEQ ID NO: 2571325 - RNA, 16 nt, Human
ucuuguauuaaacucu

SEQ ID NO: 2571326 - RNA, 17 nt, Human
ucuugucucaaugcuca

SEQ ID NO: 2571327 - RNA, 15 nt, Human
ucuugucucaaugcu

SEQ ID NO: 2571328 - RNA, 14 nt, Human
ucuugucucaaugc

SEQ ID NO: 2571329 - RNA, 15 nt, Human
ucuuguauuaagaau

SEQ ID NO: 2571330 - RNA, 23 nt, Human
ucuuguccccucuugacccaucu

SEQ ID NO: 2571331 - RNA, 19 nt, Human
ucuuguauuaaacucuuca

SEQ ID NO: 2571332 - RNA, 13 nt, Human
ucuuguccuagcu

SEQ ID NO: 2571333 - RNA, 19 nt, Human
ucuugccaaauauaaauaa

SEQ ID NO: 2571334 - RNA, 22 nt, Human
ucuugccaaccuguaauaaaua

SEQ ID NO: 2571335 - RNA, 20 nt, Human
ucuugccaaccuguaauaaa

SEQ ID NO: 2571336 - RNA, 19 nt, Human
ucuugaaggaaaaugauac

SEQ ID NO: 2571337 - RNA, 23 nt, Human
ucuugcauggcaaggacugcagg

SEQ ID NO: 2571338 - RNA, 17 nt, Human
ucuugccacugccucuu

SEQ ID NO: 2571339 - RNA, 16 nt, Human
ucuugccacugccucu

SEQ ID NO: 2571340 - RNA, 23 nt, Human
ucuugccccaacccccagcaccc

SEQ ID NO: 2571341 - RNA, 21 nt, Human
ucuugccccaacccccagcac

SEQ ID NO: 2571342 - RNA, 20 nt, Human
ucuugccccaacccccagca

SEQ ID NO: 2571343 - RNA, 18 nt, Human
ucuugccccaacccccag

SEQ ID NO: 2571344 - RNA, 23 nt, Human
ucuugccaaccuguaauaaauau

SEQ ID NO: 2571345 - RNA, 14 nt, Human
ucuugcucugcuga

SEQ ID NO: 2571346 - RNA, 22 nt, Human
ucuugccccaacccccagcacc

SEQ ID NO: 2571347 - RNA, 12 nt, Human
ucuugcccccca

SEQ ID NO: 2571348 - RNA, 16 nt, Human
ucuugcccuucccugu

SEQ ID NO: 2571349 - RNA, 15 nt, Human
ucuugcccuucccug

SEQ ID NO: 2571350 - RNA, 13 nt, Human
ucuugcccuuccc

SEQ ID NO: 2571351 - RNA, 21 nt, Human
ucuugccccccaccccagccu

SEQ ID NO: 2571352 - RNA, 22 nt, Human
ucuugaagacuuuucuuucagc

SEQ ID NO: 2571353 - RNA, 13 nt, Human
ucuugaagacuuu

SEQ ID NO: 2571354 - RNA, 18 nt, Human
ucuugaacugagcuugga

SEQ ID NO: 2571355 - RNA, 21 nt, Human
ucuugaaauuaagaaggcaaa

SEQ ID NO: 2571356 - RNA, 23 nt, Human
ucuugaaaugaaaguauaacuga

SEQ ID NO: 2571357 - RNA, 15 nt, Human
ucuugcaugaggcua

SEQ ID NO: 2571358 - RNA, 20 nt, Human
ucuugaaauauaggaacuua

SEQ ID NO: 2571359 - RNA, 21 nt, Human
ucuugaaauauaggaacuuaa

SEQ ID NO: 2571360 - RNA, 22 nt, Human
ucuugaaauuaagaaggcaaaa

SEQ ID NO: 2571361 - RNA, 17 nt, Human
ucuugaacugagcuugg

SEQ ID NO: 2571362 - RNA, 14 nt, Human
ucuugaaauuaaga

SEQ ID NO: 2571363 - RNA, 20 nt, Human
ucuugaaauuaagaaggcaa

SEQ ID NO: 2571364 - RNA, 17 nt, Human
ucuucuuuuugcuguug

SEQ ID NO: 2571365 - RNA, 14 nt, Human
ucuugaaagcugug

SEQ ID NO: 2571366 - RNA, 12 nt, Human
ucuugaaaugaa

SEQ ID NO: 2571367 - RNA, 13 nt, Human
ucuugaaaugaaa

SEQ ID NO: 2571368 - RNA, 23 nt, Human
ucuuccuugaagaacugcaggcc

SEQ ID NO: 2571369 - RNA, 14 nt, Human
ucuuccuuuuauca

SEQ ID NO: 2571370 - RNA, 18 nt, Human
ucuuccuuggagggggga

SEQ ID NO: 2571371 - RNA, 15 nt, Human
ucuuccaaaggcaua

SEQ ID NO: 2571372 - RNA, 16 nt, Human
ucuucgggaagagagg

SEQ ID NO: 2571373 - RNA, 14 nt, Human
ucuucgggaagaga

SEQ ID NO: 2571374 - RNA, 13 nt, Human
ucuucgggaagag

SEQ ID NO: 2571375 - RNA, 22 nt, Human
ucuucgggaagagaggaguuca

SEQ ID NO: 2571376 - RNA, 18 nt, Human
ucuucgggaagagaggag

SEQ ID NO: 2571377 - RNA, 14 nt, Human
ucuucggaaaccuu

SEQ ID NO: 2571378 - RNA, 13 nt, Human
ucuucgaggugga

SEQ ID NO: 2571379 - RNA, 16 nt, Human
ucuucuuggucucagu

SEQ ID NO: 2571380 - RNA, 17 nt, Human
ucuucguacaguucuuc

SEQ ID NO: 2571381 - RNA, 15 nt, Human
ucuucguacaguucu

SEQ ID NO: 2571382 - RNA, 14 nt, Human
ucuucguacaguuc

SEQ ID NO: 2571383 - RNA, 19 nt, Human
ucuucggggaacuccugga

SEQ ID NO: 2571384 - RNA, 16 nt, Human
ucuucuuuuggcuucc

SEQ ID NO: 2571385 - RNA, 22 nt, Human
ucuucuuuugagcaacuuucuu

SEQ ID NO: 2571386 - RNA, 15 nt, Human
ucuucuuuugugaag

SEQ ID NO: 2571387 - RNA, 15 nt, Human
ucuucuuuuugcugu

SEQ ID NO: 2571388 - RNA, 18 nt, Human
ucuucuuuuggcuuccau

SEQ ID NO: 2571389 - RNA, 21 nt, Human
ucuucuuuuugaaaucagcau

SEQ ID NO: 2571390 - RNA, 23 nt, Human
ucuucuuuaggauugugaugguu

SEQ ID NO: 2571391 - RNA, 21 nt, Human
ucuucuuuuaaaccauuuucu

SEQ ID NO: 2571392 - RNA, 22 nt, Human
ucuucuuuuaaaccauuuucuu

SEQ ID NO: 2571393 - RNA, 19 nt, Human
ucuucuuuugagcaacuuu

SEQ ID NO: 2571394 - RNA, 14 nt, Human
ucagauacaaugua

SEQ ID NO: 2571395 - RNA, 22 nt, Human
ucagauaacuguuauuuauaau

SEQ ID NO: 2571396 - RNA, 14 nt, Human
uaucauuuaauaau

SEQ ID NO: 2571397 - RNA, 18 nt, Human
uaucauucauucuuagcu

SEQ ID NO: 2571398 - RNA, 22 nt, Human
uaucauucaaguguaaaauauu

SEQ ID NO: 2571399 - RNA, 15 nt, Human
uaucauuaaaguucu

SEQ ID NO: 2571400 - RNA, 13 nt, Human
uaucauucauucu

SEQ ID NO: 2571401 - RNA, 13 nt, Human
ucagauauuuaua

SEQ ID NO: 2571402 - RNA, 21 nt, Human
ucagauauuuauauuuuuauu

SEQ ID NO: 2571403 - RNA, 15 nt, Human
ucagcaccacccuag

SEQ ID NO: 2571404 - RNA, 23 nt, Human
ucagcaccacccuagucccuucc

SEQ ID NO: 2571405 - RNA, 12 nt, Human
ucagcaccaccc

SEQ ID NO: 2571406 - RNA, 13 nt, Human
ucagcaccacccu

SEQ ID NO: 2571407 - RNA, 14 nt, Human
ucagcaccacccua

SEQ ID NO: 2571408 - RNA, 19 nt, Human
ucagcacaaggccaucugg

SEQ ID NO: 2571409 - RNA, 19 nt, Human
ucagauccuuguuucaaac

SEQ ID NO: 2571410 - RNA, 18 nt, Human
ucagauccuuguuucaaa

SEQ ID NO: 2571411 - RNA, 17 nt, Human
ucagauccuuguuucaa

SEQ ID NO: 2571412 - RNA, 16 nt, Human
ucagauccuuguuuca

SEQ ID NO: 2571413 - RNA, 14 nt, Human
ucagauccagggac

SEQ ID NO: 2571414 - RNA, 15 nt, Human
ucagauccagggaca

SEQ ID NO: 2571415 - RNA, 16 nt, Human
ucagauccagggacag

SEQ ID NO: 2571416 - RNA, 20 nt, Human
ucagaucauuaucagccugu

SEQ ID NO: 2571417 - RNA, 21 nt, Human
ucagaucauuucaaaacucau

SEQ ID NO: 2571418 - RNA, 21 nt, Human
ucagauauuuuuucagaaaua

SEQ ID NO: 2571419 - RNA, 16 nt, Human
ucagaucacuacugca

SEQ ID NO: 2571420 - RNA, 15 nt, Human
ucagaucacuacugc

SEQ ID NO: 2571421 - RNA, 22 nt, Human
ucagauauuuuuucagaaauau

SEQ ID NO: 2571422 - RNA, 23 nt, Human
ucagauauuuuuucagaaauaug

SEQ ID NO: 2571423 - RNA, 16 nt, Human
ucagaucauggcaucc

SEQ ID NO: 2571424 - RNA, 13 nt, Human
ucagaucauggca

SEQ ID NO: 2571425 - RNA, 23 nt, Human
ucagaucaguguaccauuugccu

SEQ ID NO: 2571426 - RNA, 18 nt, Human
ucagaucacuacugcagu

SEQ ID NO: 2571427 - RNA, 17 nt, Human
ucagaucacuacugcag

SEQ ID NO: 2571428 - RNA, 13 nt, Human
ucagaucagugcu

SEQ ID NO: 2571429 - RNA, 18 nt, Human
ucagcauccuggcacccg

SEQ ID NO: 2571430 - RNA, 17 nt, Human
ucagcauccuggcaccc

SEQ ID NO: 2571431 - RNA, 16 nt, Human
ucagcauccuggcacc

SEQ ID NO: 2571432 - RNA, 15 nt, Human
ucagcauccuggcac

SEQ ID NO: 2571433 - RNA, 23 nt, Human
ucagcauauuuguauaguugcuu

SEQ ID NO: 2571434 - RNA, 22 nt, Human
ucagcauauuuguauaguugcu

SEQ ID NO: 2571435 - RNA, 13 nt, Human
ucagcauauuugu

SEQ ID NO: 2571436 - RNA, 17 nt, Human
ucagcauaccuuuauug

SEQ ID NO: 2571437 - RNA, 17 nt, Human
ucagccuccagccucug

SEQ ID NO: 2571438 - RNA, 16 nt, Human
ucagccuccagccucu

SEQ ID NO: 2571439 - RNA, 15 nt, Human
ucagccuccagccuc

SEQ ID NO: 2571440 - RNA, 14 nt, Human
ucagccuccagccu

SEQ ID NO: 2571441 - RNA, 23 nt, Human
ucagccuagccgaccucagccuu

SEQ ID NO: 2571442 - RNA, 18 nt, Human
ucagccuaggggucaggg

SEQ ID NO: 2571443 - RNA, 13 nt, Human
ucagccucccaaa

SEQ ID NO: 2571444 - RNA, 12 nt, Human
ucagccucccaa

SEQ ID NO: 2571445 - RNA, 17 nt, Human
ucagcacgauuucuguu

SEQ ID NO: 2571446 - RNA, 17 nt, Human
ucagcaccccuuccaug

SEQ ID NO: 2571447 - RNA, 15 nt, Human
ucagcaccccuucca

SEQ ID NO: 2571448 - RNA, 17 nt, Human
ucagcaggaagcaacga

SEQ ID NO: 2571449 - RNA, 20 nt, Human
ucagcaguaccuauaaagua

SEQ ID NO: 2571450 - RNA, 15 nt, Human
ucagcacgauuucug

SEQ ID NO: 2571451 - RNA, 16 nt, Human
ucagcacgauuucugu

SEQ ID NO: 2571452 - RNA, 22 nt, Human
ucagcaccuacaguguacaguc

SEQ ID NO: 2571453 - RNA, 21 nt, Human
ucagcaccuacaguguacagu

SEQ ID NO: 2571454 - RNA, 14 nt, Human
ucagcaccccuucc

SEQ ID NO: 2571455 - RNA, 13 nt, Human
ucagcaccccuuc

SEQ ID NO: 2571456 - RNA, 17 nt, Human
ucagcaccccugucucu

SEQ ID NO: 2571457 - RNA, 20 nt, Human
ucagcaccuacaguguacag

SEQ ID NO: 2571458 - RNA, 22 nt, Human
ucagcuccccucggagaagagc

SEQ ID NO: 2571459 - RNA, 21 nt, Human
ucagcuccccucggagaagag

SEQ ID NO: 2571460 - RNA, 14 nt, Human
ucagcuccuuccug

SEQ ID NO: 2571461 - RNA, 15 nt, Human
ucagcuccuuccugg

SEQ ID NO: 2571462 - RNA, 16 nt, Human
ucagcuccuuccugga

SEQ ID NO: 2571463 - RNA, 17 nt, Human
ucagcuccuuccuggag

SEQ ID NO: 2571464 - RNA, 22 nt, Human
ucagcuccagcucaccagcccc

SEQ ID NO: 2571465 - RNA, 21 nt, Human
ucagcuccagcucaccagccc

SEQ ID NO: 2571466 - RNA, 19 nt, Human
ucagccugagucuccugug

SEQ ID NO: 2571467 - RNA, 16 nt, Human
ucagccugagucuccu

SEQ ID NO: 2571468 - RNA, 15 nt, Human
ucagccugagucucc

SEQ ID NO: 2571469 - RNA, 15 nt, Human
ucagcuccagcucac

SEQ ID NO: 2571470 - RNA, 18 nt, Human
ucagcuccagcucaccag

SEQ ID NO: 2571471 - RNA, 20 nt, Human
ucagccucccgaauagcugg

SEQ ID NO: 2571472 - RNA, 12 nt, Human
ucagccucccga

SEQ ID NO: 2571473 - RNA, 19 nt, Human
ucagccuccagccucuguu

SEQ ID NO: 2571474 - RNA, 18 nt, Human
ucagccuccagccucugu

SEQ ID NO: 2571475 - RNA, 20 nt, Human
ucagccucccaaguagcugg

SEQ ID NO: 2571476 - RNA, 22 nt, Human
ucagccucccaaagugcuggga

SEQ ID NO: 2571477 - RNA, 21 nt, Human
ucagccucucucccagucuac

SEQ ID NO: 2571478 - RNA, 20 nt, Human
ucagccucucucccagucua

SEQ ID NO: 2571479 - RNA, 19 nt, Human
ucagccucucucccagucu

SEQ ID NO: 2571480 - RNA, 18 nt, Human
ucagccucucucccaguc

SEQ ID NO: 2571481 - RNA, 17 nt, Human
ucagccucucucccagu

SEQ ID NO: 2571482 - RNA, 16 nt, Human
ucagccucucucccag

SEQ ID NO: 2571483 - RNA, 10 nt, Human
ucagccugag

SEQ ID NO: 2571484 - RNA, 22 nt, Human
ucagccucuuaaagcugccugu

SEQ ID NO: 2571485 - RNA, 12 nt, Human
ucagccucuuaa

SEQ ID NO: 2571486 - RNA, 21 nt, Human
ucagccucuuaaagcugccug

SEQ ID NO: 2571487 - RNA, 16 nt, Human
ucagccugcuccagcu

SEQ ID NO: 2571488 - RNA, 11 nt, Human
ucagccugagu

SEQ ID NO: 2571489 - RNA, 20 nt, Human
ucagccugaggcugagacug

SEQ ID NO: 2571490 - RNA, 13 nt, Human
ucagccugaggcu

SEQ ID NO: 2571491 - RNA, 18 nt, Human
ucagccugaggcugagac

SEQ ID NO: 2571492 - RNA, 22 nt, Human
ucaggagaguagaacagauaau

SEQ ID NO: 2571493 - RNA, 13 nt, Human
ucaggagagcagc

SEQ ID NO: 2571494 - RNA, 20 nt, Human
ucaggagaggggcagaacag

SEQ ID NO: 2571495 - RNA, 20 nt, Human
ucaggagagaguugaaccua

SEQ ID NO: 2571496 - RNA, 15 nt, Human
ucaggagaggggcag

SEQ ID NO: 2571497 - RNA, 17 nt, Human
ucaggagaggggcagaa

SEQ ID NO: 2571498 - RNA, 18 nt, Human
ucaggagaggggcagaac

SEQ ID NO: 2571499 - RNA, 14 nt, Human
ucaggacuccucuc

SEQ ID NO: 2571500 - RNA, 20 nt, Human
ucaggacuuaacggcuccag

SEQ ID NO: 2571501 - RNA, 12 nt, Human
ucaggagaaaaa

SEQ ID NO: 2571502 - RNA, 15 nt, Human
ucaggacuuggucug

SEQ ID NO: 2571503 - RNA, 12 nt, Human
ucaggaggcuga

SEQ ID NO: 2571504 - RNA, 13 nt, Human
ucaggaggcugag

SEQ ID NO: 2571505 - RNA, 18 nt, Human
ucaggaggcugaggcaga

SEQ ID NO: 2571506 - RNA, 20 nt, Human
ucaggaggcugaggcagaag

SEQ ID NO: 2571507 - RNA, 22 nt, Human
ucaggaggcugaggcagaagaa

SEQ ID NO: 2571508 - RNA, 15 nt, Human
ucaggaggcugaggg

SEQ ID NO: 2571509 - RNA, 18 nt, Human
ucaggaggcugaggggag

SEQ ID NO: 2571510 - RNA, 13 nt, Human
ucaggagggauug

SEQ ID NO: 2571511 - RNA, 17 nt, Human
ucaggaggcaggaccuu

SEQ ID NO: 2571512 - RNA, 11 nt, Human
ucaggagcaca

SEQ ID NO: 2571513 - RNA, 23 nt, Human
ucaggaggaaggcuuacacccac

SEQ ID NO: 2571514 - RNA, 16 nt, Human
ucaggaggaaggcuua

SEQ ID NO: 2571515 - RNA, 16 nt, Human
ucagcugcugaaacaa

SEQ ID NO: 2571516 - RNA, 24 nt, Human
ucagcugccucacuuccuacaaga

SEQ ID NO: 2571517 - RNA, 15 nt, Human
ucagcugcuucuccc

SEQ ID NO: 2571518 - RNA, 12 nt, Human
ucagcugcuucu

SEQ ID NO: 2571519 - RNA, 15 nt, Human
ucagcugcuacuacu

SEQ ID NO: 2571520 - RNA, 12 nt, Human
ucagcugccuca

SEQ ID NO: 2571521 - RNA, 14 nt, Human
ucagcugccucacu

SEQ ID NO: 2571522 - RNA, 15 nt, Human
ucagcugccucacuu

SEQ ID NO: 2571523 - RNA, 14 nt, Human
ucaggacucagaag

SEQ ID NO: 2571524 - RNA, 21 nt, Human
ucaggacucagaagccucugg

SEQ ID NO: 2571525 - RNA, 14 nt, Human
ucaggaccuuuuga

SEQ ID NO: 2571526 - RNA, 23 nt, Human
ucaggaccugggaccuccccuga

SEQ ID NO: 2571527 - RNA, 19 nt, Human
ucaggacgagaaugagggu

SEQ ID NO: 2571528 - RNA, 21 nt, Human
ucaggaccugggaccuccccu

SEQ ID NO: 2571529 - RNA, 14 nt, Human
ucaggaccaggcaa

SEQ ID NO: 2571530 - RNA, 17 nt, Human
ucaggaccugggaccuc

SEQ ID NO: 2571531 - RNA, 20 nt, Human
ucaggaccaaagcuuucaug

SEQ ID NO: 2571532 - RNA, 15 nt, Human
ucaggacagaugcca

SEQ ID NO: 2571533 - RNA, 14 nt, Human
ucaggacagaugcc

SEQ ID NO: 2571534 - RNA, 21 nt, Human
ucagcuggcacugucucugcu

SEQ ID NO: 2571535 - RNA, 20 nt, Human
ucagcuguaagaagagacug

SEQ ID NO: 2571536 - RNA, 16 nt, Human
ucaggacccagaggaa

SEQ ID NO: 2571537 - RNA, 19 nt, Human
ucaggacccagaggaaggg

SEQ ID NO: 2571538 - RNA, 15 nt, Human
ucaggacccagagga

SEQ ID NO: 2571539 - RNA, 13 nt, Human
ucaggaccaggca

SEQ ID NO: 2571540 - RNA, 13 nt, Human
ucaggacacuaau

SEQ ID NO: 2571541 - RNA, 18 nt, Human
ucaguccuccccucacag

SEQ ID NO: 2571542 - RNA, 17 nt, Human
ucaguccuccccucaca

SEQ ID NO: 2571543 - RNA, 13 nt, Human
ucaguccuccccu

SEQ ID NO: 2571544 - RNA, 23 nt, Human
ucagucccuauguauuugcaguu

SEQ ID NO: 2571545 - RNA, 18 nt, Human
ucagucccuauguauuug

SEQ ID NO: 2571546 - RNA, 17 nt, Human
ucagucccuauguauuu

SEQ ID NO: 2571547 - RNA, 16 nt, Human
ucagucccuauguauu

SEQ ID NO: 2571548 - RNA, 13 nt, Human
ucagucccuaugu

SEQ ID NO: 2571549 - RNA, 23 nt, Human
ucaguccccucccaucugggagu

SEQ ID NO: 2571550 - RNA, 20 nt, Human
ucaguccccucccaucuggg

SEQ ID NO: 2571551 - RNA, 18 nt, Human
ucaguccccucccaucug

SEQ ID NO: 2571552 - RNA, 15 nt, Human
ucaguccccucccau

SEQ ID NO: 2571553 - RNA, 14 nt, Human
ucaguccccuccca

SEQ ID NO: 2571554 - RNA, 13 nt, Human
ucaguccccuccc

SEQ ID NO: 2571555 - RNA, 12 nt, Human
ucaguccccucc

SEQ ID NO: 2571556 - RNA, 21 nt, Human
ucaguccuccccucacagccu

SEQ ID NO: 2571557 - RNA, 19 nt, Human
ucaguccuccccucacagc

SEQ ID NO: 2571558 - RNA, 13 nt, Human
ucagucucugagc

SEQ ID NO: 2571559 - RNA, 15 nt, Human
ucagucucugagcag

SEQ ID NO: 2571560 - RNA, 17 nt, Human
ucagucucugagcagug

SEQ ID NO: 2571561 - RNA, 20 nt, Human
ucagucucugagcagugaau

SEQ ID NO: 2571562 - RNA, 19 nt, Human
ucagucugauucccaagcu

SEQ ID NO: 2571563 - RNA, 17 nt, Human
ucagucugauucccaag

SEQ ID NO: 2571564 - RNA, 18 nt, Human
ucagugugacugaucucu

SEQ ID NO: 2571565 - RNA, 19 nt, Human
ucagugugucuaaauuuga

SEQ ID NO: 2571566 - RNA, 14 nt, Human
ucagugugcccccc

SEQ ID NO: 2571567 - RNA, 13 nt, Human
ucagugugccccc

SEQ ID NO: 2571568 - RNA, 17 nt, Human
ucagucucugagggcuu

SEQ ID NO: 2571569 - RNA, 23 nt, Human
ucagucugauuaaagguggugcc

SEQ ID NO: 2571570 - RNA, 22 nt, Human
ucagugugccccccauccuggc

SEQ ID NO: 2571571 - RNA, 22 nt, Human
ucaguguuugggucaccccucc

SEQ ID NO: 2571572 - RNA, 21 nt, Human
ucaguguuaaaugugaugaau

SEQ ID NO: 2571573 - RNA, 14 nt, Human
ucaguguuauuagu

SEQ ID NO: 2571574 - RNA, 20 nt, Human
ucaguguucccuuuccuacu

SEQ ID NO: 2571575 - RNA, 15 nt, Human
ucaguguuaaaugug

SEQ ID NO: 2571576 - RNA, 17 nt, Human
ucaguguuaaaugugau

SEQ ID NO: 2571577 - RNA, 20 nt, Human
ucagugugccccccauccug

SEQ ID NO: 2571578 - RNA, 19 nt, Human
ucagugugccccccauccu

SEQ ID NO: 2571579 - RNA, 14 nt, Human
ucaguuacucagcc

SEQ ID NO: 2571580 - RNA, 15 nt, Human
ucaguucccuuggcc

SEQ ID NO: 2571581 - RNA, 16 nt, Human
ucaguucccuuggccu

SEQ ID NO: 2571582 - RNA, 17 nt, Human
ucaguucccuuggccuc

SEQ ID NO: 2571583 - RNA, 18 nt, Human
ucaguucccuuggccuca

SEQ ID NO: 2571584 - RNA, 19 nt, Human
ucaguucccuuggccucag

SEQ ID NO: 2571585 - RNA, 20 nt, Human
ucaguucccuuggccucaga

SEQ ID NO: 2571586 - RNA, 16 nt, Human
ucaguuccucuuugca

SEQ ID NO: 2571587 - RNA, 20 nt, Human
ucaguuccgauuucccaggc

SEQ ID NO: 2571588 - RNA, 22 nt, Human
ucaguucccuuggccucagaau

SEQ ID NO: 2571589 - RNA, 16 nt, Human
ucaguuaagccuuugg

SEQ ID NO: 2571590 - RNA, 17 nt, Human
ucaguuaagccuuugga

SEQ ID NO: 2571591 - RNA, 20 nt, Human
ucaguuacuaagaagaaaau

SEQ ID NO: 2571592 - RNA, 15 nt, Human
ucaguuacagaaagu

SEQ ID NO: 2571593 - RNA, 14 nt, Human
ucaguuacuaagaa

SEQ ID NO: 2571594 - RNA, 14 nt, Human
ucaguuacagaaag

SEQ ID NO: 2571595 - RNA, 13 nt, Human
ucaguuacagaaa

SEQ ID NO: 2571596 - RNA, 17 nt, Human
ucagguggggcagcuug

SEQ ID NO: 2571597 - RNA, 21 nt, Human
ucagguggggcagcuugaggg

SEQ ID NO: 2571598 - RNA, 16 nt, Human
ucagguggggcagcuu

SEQ ID NO: 2571599 - RNA, 15 nt, Human
ucagguggggcagcu

SEQ ID NO: 2571600 - RNA, 20 nt, Human
ucaggugcugccauccaggu

SEQ ID NO: 2571601 - RNA, 18 nt, Human
ucaggugcugccauccag

SEQ ID NO: 2571602 - RNA, 14 nt, Human
ucagguggggcagc

SEQ ID NO: 2571603 - RNA, 19 nt, Human
ucaggagucccaaggaaag

SEQ ID NO: 2571604 - RNA, 20 nt, Human
ucaggagucccaaggaaagc

SEQ ID NO: 2571605 - RNA, 11 nt, Human
ucagguggcca

SEQ ID NO: 2571606 - RNA, 21 nt, Human
ucagucauuagacuccuccuc

SEQ ID NO: 2571607 - RNA, 20 nt, Human
ucagucaugcauaaauaugc

SEQ ID NO: 2571608 - RNA, 17 nt, Human
ucagucaugcauaaaua

SEQ ID NO: 2571609 - RNA, 12 nt, Human
ucaguccaggau

SEQ ID NO: 2571610 - RNA, 17 nt, Human
ucagucccaucagagag

SEQ ID NO: 2571611 - RNA, 18 nt, Human
ucaguccccgugaaggag

SEQ ID NO: 2571612 - RNA, 18 nt, Human
ucaguccaugaagaugua

SEQ ID NO: 2571613 - RNA, 15 nt, Human
ucaguccauagcaga

SEQ ID NO: 2571614 - RNA, 20 nt, Human
ucagguggggucacucuggc

SEQ ID NO: 2571615 - RNA, 17 nt, Human
ucagguggggucacucu

SEQ ID NO: 2571616 - RNA, 16 nt, Human
ucagucaugcauaaau

SEQ ID NO: 2571617 - RNA, 15 nt, Human
ucagucaugcauaaa

SEQ ID NO: 2571618 - RNA, 14 nt, Human
ucagucaugcauaa

SEQ ID NO: 2571619 - RNA, 19 nt, Human
ucagucagugcaaauguca

SEQ ID NO: 2571620 - RNA, 17 nt, Human
ucaggugggcgugguca

SEQ ID NO: 2571621 - RNA, 21 nt, Human
ucagguggggucacucuggca

SEQ ID NO: 2571622 - RNA, 13 nt, Human
ucagguggccaug

SEQ ID NO: 2571623 - RNA, 17 nt, Human
ucaguucucuucacuca

SEQ ID NO: 2571624 - RNA, 20 nt, Human
ucaguucuagucucucuggg

SEQ ID NO: 2571625 - RNA, 23 nt, Human
ucauacucuagauuuuguuuugc

SEQ ID NO: 2571626 - RNA, 14 nt, Human
ucauacucuagauu

SEQ ID NO: 2571627 - RNA, 19 nt, Human
ucaguucuagucucucugg

SEQ ID NO: 2571628 - RNA, 14 nt, Human
ucaguucucuucac

SEQ ID NO: 2571629 - RNA, 21 nt, Human
ucaguuccucuuugcauggaa

SEQ ID NO: 2571630 - RNA, 19 nt, Human
ucaguuccucuuugcaugg

SEQ ID NO: 2571631 - RNA, 18 nt, Human
ucaguuccucuuugcaug

SEQ ID NO: 2571632 - RNA, 17 nt, Human
ucaguuccucuuugcau

SEQ ID NO: 2571633 - RNA, 20 nt, Human
ucaguuccugcccuuggccu

SEQ ID NO: 2571634 - RNA, 20 nt, Human
ucauacugugcuggagccac

SEQ ID NO: 2571635 - RNA, 18 nt, Human
ucauacugugcuggagcc

SEQ ID NO: 2571636 - RNA, 17 nt, Human
ucauacugugcuggagc

SEQ ID NO: 2571637 - RNA, 15 nt, Human
ucauacugaagaugc

SEQ ID NO: 2571638 - RNA, 13 nt, Human
ucauacugaagau

SEQ ID NO: 2571639 - RNA, 19 nt, Human
ucauacugugcuggagcca

SEQ ID NO: 2571640 - RNA, 16 nt, Human
ucauauuuugauuauu

SEQ ID NO: 2571641 - RNA, 14 nt, Human
ucauauuuugauua

SEQ ID NO: 2571642 - RNA, 12 nt, Human
ucauauuuugau

SEQ ID NO: 2571643 - RNA, 18 nt, Human
ucauauuuucuuucaaaa

SEQ ID NO: 2571644 - RNA, 15 nt, Human
ucauauuuuguauau

SEQ ID NO: 2571645 - RNA, 19 nt, Human
ucauauuuugauuauugua

SEQ ID NO: 2571646 - RNA, 22 nt, Human
ucauagaaauguaacuuuugua

SEQ ID NO: 2571647 - RNA, 13 nt, Human
ucauagaaaugua

SEQ ID NO: 2571648 - RNA, 15 nt, Human
ucaucaaggcacugc

SEQ ID NO: 2571649 - RNA, 19 nt, Human
ucaucaagacuggaaggug

SEQ ID NO: 2571650 - RNA, 16 nt, Human
ucaucaaggcacugcc

SEQ ID NO: 2571651 - RNA, 16 nt, Human
ucaucaguauugaagc

SEQ ID NO: 2571652 - RNA, 20 nt, Human
ucaucaguauugaagcauuu

SEQ ID NO: 2571653 - RNA, 21 nt, Human
ucaucaguauugaagcauuuu

SEQ ID NO: 2571654 - RNA, 15 nt, Human
ucaucaguggagcca

SEQ ID NO: 2571655 - RNA, 23 nt, Human
ucaucaguauugaagcauuuuau

SEQ ID NO: 2571656 - RNA, 15 nt, Human
ucaucaacugaauga

SEQ ID NO: 2571657 - RNA, 22 nt, Human
ucaucaacugaaugaggucagc

SEQ ID NO: 2571658 - RNA, 11 nt, Human
ucaucaagacu

SEQ ID NO: 2571659 - RNA, 23 nt, Human
ucaucaaauggaagacacauuga

SEQ ID NO: 2571660 - RNA, 19 nt, Human
ucaucaaauggaagacaca

SEQ ID NO: 2571661 - RNA, 23 nt, Human
ucauauuuuguauauaucugcuu

SEQ ID NO: 2571662 - RNA, 13 nt, Human
ucaucaacugaau

SEQ ID NO: 2571663 - RNA, 17 nt, Human
ucaucaacccuaaaaag

SEQ ID NO: 2571664 - RNA, 15 nt, Human
ucaucauacaugacu

SEQ ID NO: 2571665 - RNA, 14 nt, Human
ucaucauauuauac

SEQ ID NO: 2571666 - RNA, 17 nt, Human
ucaucauauuauacaga

SEQ ID NO: 2571667 - RNA, 13 nt, Human
ucaucauaaaaua

SEQ ID NO: 2571668 - RNA, 14 nt, Human
ucaucauaaaauaa

SEQ ID NO: 2571669 - RNA, 15 nt, Human
ucaucauaaaauaaa

SEQ ID NO: 2571670 - RNA, 19 nt, Human
ucaucauaaaauaaaguau

SEQ ID NO: 2571671 - RNA, 20 nt, Human
ucaucauucucugucucauc

SEQ ID NO: 2571672 - RNA, 19 nt, Human
ucaucauucucugucucau

SEQ ID NO: 2571673 - RNA, 20 nt, Human
ucaucauuguauauaugugu

SEQ ID NO: 2571674 - RNA, 22 nt, Human
ucaucauucucugucucaucca

SEQ ID NO: 2571675 - RNA, 19 nt, Human
ucaucauuguauauaugug

SEQ ID NO: 2571676 - RNA, 20 nt, Human
ucauggccuauuauauuaaa

SEQ ID NO: 2571677 - RNA, 18 nt, Human
ucauggccccucugaccu

SEQ ID NO: 2571678 - RNA, 14 nt, Human
ucauggccccucug

SEQ ID NO: 2571679 - RNA, 13 nt, Human
ucauggccccucu

SEQ ID NO: 2571680 - RNA, 22 nt, Human
ucauggcagaaggcaaacccau

SEQ ID NO: 2571681 - RNA, 23 nt, Human
ucauggagugacggucccacacu

SEQ ID NO: 2571682 - RNA, 20 nt, Human
ucauggagaagcagaaauac

SEQ ID NO: 2571683 - RNA, 14 nt, Human
ucauggacacuuug

SEQ ID NO: 2571684 - RNA, 20 nt, Human
ucauggauucauuacagcuu

SEQ ID NO: 2571685 - RNA, 23 nt, Human
ucauggaugggggaacucagauc

SEQ ID NO: 2571686 - RNA, 24 nt, Human
ucauggacuucugccagcauaaua

SEQ ID NO: 2571687 - RNA, 21 nt, Human
ucauggaauuggagcucgugg

SEQ ID NO: 2571688 - RNA, 17 nt, Human
ucauggacacuuugaaa

SEQ ID NO: 2571689 - RNA, 19 nt, Human
ucauggaauuggagcucgu

SEQ ID NO: 2571690 - RNA, 11 nt, Human
ucaugaaaauu

SEQ ID NO: 2571691 - RNA, 14 nt, Human
ucaucugcuggucc

SEQ ID NO: 2571692 - RNA, 13 nt, Human
ucaucugcugguc

SEQ ID NO: 2571693 - RNA, 21 nt, Human
ucaucugcucuccuuccugga

SEQ ID NO: 2571694 - RNA, 14 nt, Human
ucauccaccccauc

SEQ ID NO: 2571695 - RNA, 19 nt, Human
ucaucugcugguccguggg

SEQ ID NO: 2571696 - RNA, 12 nt, Human
ucaucuggaacc

SEQ ID NO: 2571697 - RNA, 18 nt, Human
ucaucuggaaccaucaga

SEQ ID NO: 2571698 - RNA, 17 nt, Human
ucauccacauuguuuua

SEQ ID NO: 2571699 - RNA, 16 nt, Human
ucauccacauuguuuu

SEQ ID NO: 2571700 - RNA, 15 nt, Human
ucauccacauuguuu

SEQ ID NO: 2571701 - RNA, 22 nt, Human
ucauccaaucuaaccacaucaa

SEQ ID NO: 2571702 - RNA, 22 nt, Human
ucauccacauuguuuuaaaaag

SEQ ID NO: 2571703 - RNA, 19 nt, Human
ucauccacauuguuuuaaa

SEQ ID NO: 2571704 - RNA, 12 nt, Human
ucauccacccca

SEQ ID NO: 2571705 - RNA, 15 nt, Human
ucauccaauccucac

SEQ ID NO: 2571706 - RNA, 18 nt, Human
ucauccaauccucacugg

SEQ ID NO: 2571707 - RNA, 19 nt, Human
ucauccaauccucacuggg

SEQ ID NO: 2571708 - RNA, 14 nt, Human
ucauccacauuguu

SEQ ID NO: 2571709 - RNA, 20 nt, Human
ucauccaauccucacugggu

SEQ ID NO: 2571710 - RNA, 22 nt, Human
ucauccaauccucacugggugg

SEQ ID NO: 2571711 - RNA, 14 nt, Human
ucaucugggaaaga

SEQ ID NO: 2571712 - RNA, 13 nt, Human
ucaucugggaaag

SEQ ID NO: 2571713 - RNA, 12 nt, Human
ucaucugggaaa

SEQ ID NO: 2571714 - RNA, 23 nt, Human
ucaucuggauaggagccugcugg

SEQ ID NO: 2571715 - RNA, 19 nt, Human
ucaucuggcaacaucuuua

SEQ ID NO: 2571716 - RNA, 23 nt, Human
ucaucuggcaacaucuuuauccg

SEQ ID NO: 2571717 - RNA, 22 nt, Human
ucaucuggauaggagccugcug

SEQ ID NO: 2571718 - RNA, 21 nt, Human
ucaucuggauaggagccugcu

SEQ ID NO: 2571719 - RNA, 13 nt, Human
ucaucuggaacca

SEQ ID NO: 2571720 - RNA, 13 nt, Human
ucaucuuucuuga

SEQ ID NO: 2571721 - RNA, 22 nt, Human
ucaucuuucuugaucaacaucu

SEQ ID NO: 2571722 - RNA, 16 nt, Human
ucaucugggaaagaca

SEQ ID NO: 2571723 - RNA, 14 nt, Human
ucccacucagucca

SEQ ID NO: 2571724 - RNA, 13 nt, Human
ucccacucacccc

SEQ ID NO: 2571725 - RNA, 15 nt, Human
ucccacuaucugggu

SEQ ID NO: 2571726 - RNA, 14 nt, Human
ucccacuaucuggg

SEQ ID NO: 2571727 - RNA, 20 nt, Human
ucccacuaucugggugcaug

SEQ ID NO: 2571728 - RNA, 17 nt, Human
ucccacucaagccaagc

SEQ ID NO: 2571729 - RNA, 20 nt, Human
ucccacgaauuugcugggga

SEQ ID NO: 2571730 - RNA, 18 nt, Human
ucccacgaauuugcuggg

SEQ ID NO: 2571731 - RNA, 15 nt, Human
ucccacgaauuugcu

SEQ ID NO: 2571732 - RNA, 20 nt, Human
ucccacgcacuccaugagca

SEQ ID NO: 2571733 - RNA, 14 nt, Human
ucccacgugggaga

SEQ ID NO: 2571734 - RNA, 18 nt, Human
ucccacgcuucucuuugg

SEQ ID NO: 2571735 - RNA, 21 nt, Human
ucccacgaauuugcuggggaa

SEQ ID NO: 2571736 - RNA, 20 nt, Human
ucccaccucucucacuccuu

SEQ ID NO: 2571737 - RNA, 21 nt, Human
ucccaccuuggcugcagggag

SEQ ID NO: 2571738 - RNA, 19 nt, Human
ucccaccuuggcugcaggg

SEQ ID NO: 2571739 - RNA, 18 nt, Human
ucccaccucucucacucc

SEQ ID NO: 2571740 - RNA, 17 nt, Human
ucccaccucucucacuc

SEQ ID NO: 2571741 - RNA, 23 nt, Human
ucccaccucccccucccccuucu

SEQ ID NO: 2571742 - RNA, 14 nt, Human
ucccaccucucuca

SEQ ID NO: 2571743 - RNA, 18 nt, Human
ucccaccucagccucccg

SEQ ID NO: 2571744 - RNA, 18 nt, Human
ucccaagaucugugcagc

SEQ ID NO: 2571745 - RNA, 16 nt, Human
ucccaccucagccucc

SEQ ID NO: 2571746 - RNA, 18 nt, Human
ucccaggcauuccccagg

SEQ ID NO: 2571747 - RNA, 17 nt, Human
ucccaggcauuccccag

SEQ ID NO: 2571748 - RNA, 15 nt, Human
ucccacuuccccucc

SEQ ID NO: 2571749 - RNA, 23 nt, Human
ucccacugccucagguuccuaug

SEQ ID NO: 2571750 - RNA, 17 nt, Human
ucccacuucccugacac

SEQ ID NO: 2571751 - RNA, 20 nt, Human
ucccacuuccccuccuaccc

SEQ ID NO: 2571752 - RNA, 16 nt, Human
ucccaggauguacaag

SEQ ID NO: 2571753 - RNA, 15 nt, Human
ucccacuugccccug

SEQ ID NO: 2571754 - RNA, 22 nt, Human
ucccacucuagggcaguggagu

SEQ ID NO: 2571755 - RNA, 17 nt, Human
ucccacucuagggcagu

SEQ ID NO: 2571756 - RNA, 23 nt, Human
ucccacucaccccggcagacgcc

SEQ ID NO: 2571757 - RNA, 15 nt, Human
ucccacucaccccgg

SEQ ID NO: 2571758 - RNA, 18 nt, Human
ucccacucaagccaagca

SEQ ID NO: 2571759 - RNA, 16 nt, Human
ucccacugcacccccu

SEQ ID NO: 2571760 - RNA, 13 nt, Human
ucccacugcaccc

SEQ ID NO: 2571761 - RNA, 20 nt, Human
ucccacugcacccccuccug

SEQ ID NO: 2571762 - RNA, 18 nt, Human
ucccacugcacccccucc

SEQ ID NO: 2571763 - RNA, 21 nt, Human
ucccacugcacccccuccugc

SEQ ID NO: 2571764 - RNA, 20 nt, Human
ucccacugccucagguuccu

SEQ ID NO: 2571765 - RNA, 18 nt, Human
ucccacugccucagguuc

SEQ ID NO: 2571766 - RNA, 16 nt, Human
ucccacugccucaggu

SEQ ID NO: 2571767 - RNA, 14 nt, Human
ucccacugccucag

SEQ ID NO: 2571768 - RNA, 22 nt, Human
ucccacugggguccagggagca

SEQ ID NO: 2571769 - RNA, 19 nt, Human
ucccaggcauuccccagga

SEQ ID NO: 2571770 - RNA, 18 nt, Human
ucccaggcugagccucag

SEQ ID NO: 2571771 - RNA, 19 nt, Human
ucccaggcugagccucagu

SEQ ID NO: 2571772 - RNA, 18 nt, Human
ucccaggcuucacccuga

SEQ ID NO: 2571773 - RNA, 15 nt, Human
ucccaggcuucaccc

SEQ ID NO: 2571774 - RNA, 16 nt, Human
ucccaggcuggggcug

SEQ ID NO: 2571775 - RNA, 15 nt, Human
ucccaggcuggggcu

SEQ ID NO: 2571776 - RNA, 18 nt, Human
ucccagggaagugcucug

SEQ ID NO: 2571777 - RNA, 22 nt, Human
ucccaggcuucacccugaaugg

SEQ ID NO: 2571778 - RNA, 16 nt, Human
ucccagggccagggcc

SEQ ID NO: 2571779 - RNA, 17 nt, Human
ucccagggccagggccc

SEQ ID NO: 2571780 - RNA, 20 nt, Human
ucccagggccagggcccugc

SEQ ID NO: 2571781 - RNA, 16 nt, Human
ucccaugagccucagc

SEQ ID NO: 2571782 - RNA, 15 nt, Human
ucccaugagccucag

SEQ ID NO: 2571783 - RNA, 23 nt, Human
ucccagggccagggcccugcaga

SEQ ID NO: 2571784 - RNA, 21 nt, Human
ucccagggccagggcccugca

SEQ ID NO: 2571785 - RNA, 22 nt, Human
ucccagggccagggcccugcag

SEQ ID NO: 2571786 - RNA, 20 nt, Human
ucccaugacccaggcugggc

SEQ ID NO: 2571787 - RNA, 16 nt, Human
ucccaugacccaggcu

SEQ ID NO: 2571788 - RNA, 15 nt, Human
ucccaugacccaggc

SEQ ID NO: 2571789 - RNA, 17 nt, Human
ucccaggggaccacacc

SEQ ID NO: 2571790 - RNA, 12 nt, Human
ucccaggggacc

SEQ ID NO: 2571791 - RNA, 13 nt, Human
uccauauggauuu

SEQ ID NO: 2571792 - RNA, 18 nt, Human
uccauauggauuuucuau

SEQ ID NO: 2571793 - RNA, 14 nt, Human
uccauauucaugua

SEQ ID NO: 2571794 - RNA, 19 nt, Human
uccaugaguuugcccuggu

SEQ ID NO: 2571795 - RNA, 14 nt, Human
uccaugaugcuggg

SEQ ID NO: 2571796 - RNA, 23 nt, Human
uccaugaguuuuuucucuugggc

SEQ ID NO: 2571797 - RNA, 19 nt, Human
uccauaugaccucaugcau

SEQ ID NO: 2571798 - RNA, 18 nt, Human
uccauaugaccucaugca

SEQ ID NO: 2571799 - RNA, 24 nt, Human
uccauaugaccucaugcaucucca

SEQ ID NO: 2571800 - RNA, 17 nt, Human
uccauaugaccucaugc

SEQ ID NO: 2571801 - RNA, 20 nt, Human
uccauauauuagcauuuagu

SEQ ID NO: 2571802 - RNA, 17 nt, Human
uccauauauuagcauuu

SEQ ID NO: 2571803 - RNA, 18 nt, Human
uccauauauuagcauuua

SEQ ID NO: 2571804 - RNA, 13 nt, Human
uccauauaaauau

SEQ ID NO: 2571805 - RNA, 12 nt, Human
uccauauaaaua

SEQ ID NO: 2571806 - RNA, 19 nt, Human
uccauauaaauauuagaaa

SEQ ID NO: 2571807 - RNA, 18 nt, Human
uccauaguaguaugauga

SEQ ID NO: 2571808 - RNA, 20 nt, Human
uccauagagagcaagacgcu

SEQ ID NO: 2571809 - RNA, 22 nt, Human
uccauagccuaaucccugggca

SEQ ID NO: 2571810 - RNA, 14 nt, Human
uccauacagcucua

SEQ ID NO: 2571811 - RNA, 13 nt, Human
uccauacagcucu

SEQ ID NO: 2571812 - RNA, 21 nt, Human
uccauagccuaaucccugggc

SEQ ID NO: 2571813 - RNA, 22 nt, Human
uccagggcuggacugaggccug

SEQ ID NO: 2571814 - RNA, 21 nt, Human
uccagggcuggacugaggccu

SEQ ID NO: 2571815 - RNA, 23 nt, Human
uccagggcuggacugaggccuga

SEQ ID NO: 2571816 - RNA, 13 nt, Human
uccagggcucuga

SEQ ID NO: 2571817 - RNA, 23 nt, Human
uccauaaucuggacuccucuguc

SEQ ID NO: 2571818 - RNA, 13 nt, Human
uccaggggccccu

SEQ ID NO: 2571819 - RNA, 17 nt, Human
uccaggggaugggaggu

SEQ ID NO: 2571820 - RNA, 19 nt, Human
uccagggcuggacugaggc

SEQ ID NO: 2571821 - RNA, 17 nt, Human
uccagggcuggacugag

SEQ ID NO: 2571822 - RNA, 14 nt, Human
uccagggcuggacu

SEQ ID NO: 2571823 - RNA, 14 nt, Human
uccagggcuaguga

SEQ ID NO: 2571824 - RNA, 20 nt, Human
uccagggcccugagcucggu

SEQ ID NO: 2571825 - RNA, 16 nt, Human
uccagggcccugagcu

SEQ ID NO: 2571826 - RNA, 17 nt, Human
uccagggcccugagcuc

SEQ ID NO: 2571827 - RNA, 12 nt, Human
uccauacauuug

SEQ ID NO: 2571828 - RNA, 17 nt, Human
uccauagagagcaagac

SEQ ID NO: 2571829 - RNA, 12 nt, Human
uccauaauuaug

SEQ ID NO: 2571830 - RNA, 17 nt, Human
uccauaauuaugacagu

SEQ ID NO: 2571831 - RNA, 19 nt, Human
uccauaauuaugacaguua

SEQ ID NO: 2571832 - RNA, 21 nt, Human
uccauaauuaugacaguuaua

SEQ ID NO: 2571833 - RNA, 20 nt, Human
uccauaauguauaaagaaca

SEQ ID NO: 2571834 - RNA, 16 nt, Human
uccauaaugcuacugu

SEQ ID NO: 2571835 - RNA, 18 nt, Human
uccauaaugcuacugucu

SEQ ID NO: 2571836 - RNA, 12 nt, Human
uccauaauguau

SEQ ID NO: 2571837 - RNA, 21 nt, Human
ucccaacucaccccagcccca

SEQ ID NO: 2571838 - RNA, 19 nt, Human
ucccaacucaccccagccc

SEQ ID NO: 2571839 - RNA, 14 nt, Human
ucccaacuuguaaa

SEQ ID NO: 2571840 - RNA, 15 nt, Human
ucccaacucuagcug

SEQ ID NO: 2571841 - RNA, 16 nt, Human
ucccaacucuagcugg

SEQ ID NO: 2571842 - RNA, 17 nt, Human
ucccaacucuagcuggg

SEQ ID NO: 2571843 - RNA, 23 nt, Human
ucccaacaggaggacaauucaug

SEQ ID NO: 2571844 - RNA, 14 nt, Human
ucccaacucuagcu

SEQ ID NO: 2571845 - RNA, 17 nt, Human
ucccaacuccuauaauu

SEQ ID NO: 2571846 - RNA, 18 nt, Human
ucccaacucaccccagcc

SEQ ID NO: 2571847 - RNA, 17 nt, Human
ucccaacucaccccagc

SEQ ID NO: 2571848 - RNA, 11 nt, Human
ucccaacaucg

SEQ ID NO: 2571849 - RNA, 22 nt, Human
ucccaacaggaggacaauucau

SEQ ID NO: 2571850 - RNA, 21 nt, Human
ucccaacaggaggacaauuca

SEQ ID NO: 2571851 - RNA, 20 nt, Human
ucccaacaggaggacaauuc

SEQ ID NO: 2571852 - RNA, 19 nt, Human
ucccaacaggaggacaauu

SEQ ID NO: 2571853 - RNA, 18 nt, Human
ucccaacaggaggacaau

SEQ ID NO: 2571854 - RNA, 11 nt, Human
ucccaacagga

SEQ ID NO: 2571855 - RNA, 16 nt, Human
uccaugcgcucagggc

SEQ ID NO: 2571856 - RNA, 15 nt, Human
uccaugcgcucaggg

SEQ ID NO: 2571857 - RNA, 18 nt, Human
uccaugcguguuucugac

SEQ ID NO: 2571858 - RNA, 19 nt, Human
uccaugcguguuucugacu

SEQ ID NO: 2571859 - RNA, 20 nt, Human
uccaugcguguuucugacuc

SEQ ID NO: 2571860 - RNA, 16 nt, Human
uccaugucgccucugc

SEQ ID NO: 2571861 - RNA, 12 nt, Human
uccaugauucua

SEQ ID NO: 2571862 - RNA, 15 nt, Human
uccaugaugcuggga

SEQ ID NO: 2571863 - RNA, 14 nt, Human
uccaugauggaaua

SEQ ID NO: 2571864 - RNA, 12 nt, Human
uccaugauggag

SEQ ID NO: 2571865 - RNA, 15 nt, Human
uccaugauggaguca

SEQ ID NO: 2571866 - RNA, 21 nt, Human
uccaugccugaggguggagac

SEQ ID NO: 2571867 - RNA, 16 nt, Human
uccaugccugagggug

SEQ ID NO: 2571868 - RNA, 15 nt, Human
uccaugccugagggu

SEQ ID NO: 2571869 - RNA, 14 nt, Human
uccaugccugaggg

SEQ ID NO: 2571870 - RNA, 13 nt, Human
uccaugccugagg

SEQ ID NO: 2571871 - RNA, 12 nt, Human
uccaugccugag

SEQ ID NO: 2571872 - RNA, 18 nt, Human
uccaugucgccucugcau

SEQ ID NO: 2571873 - RNA, 17 nt, Human
uccaugucgccucugca

SEQ ID NO: 2571874 - RNA, 14 nt, Human
uccaugucggccuc

SEQ ID NO: 2571875 - RNA, 19 nt, Human
uccaugucgccucugcauu

SEQ ID NO: 2571876 - RNA, 21 nt, Human
uccaugucggccucuaacccc

SEQ ID NO: 2571877 - RNA, 15 nt, Human
uccaugucggccucu

SEQ ID NO: 2571878 - RNA, 16 nt, Human
ucauguacaagaugaa

SEQ ID NO: 2571879 - RNA, 17 nt, Human
ucauguacaagaugaag

SEQ ID NO: 2571880 - RNA, 18 nt, Human
ucauguacaagaugaagg

SEQ ID NO: 2571881 - RNA, 14 nt, Human
ucauguacauuucu

SEQ ID NO: 2571882 - RNA, 17 nt, Human
ucaugggauagcacgug

SEQ ID NO: 2571883 - RNA, 23 nt, Human
ucaugggagggggcuugaagcca

SEQ ID NO: 2571884 - RNA, 18 nt, Human
ucauggcuuaauguuuau

SEQ ID NO: 2571885 - RNA, 15 nt, Human
ucauggcuuaauguu

SEQ ID NO: 2571886 - RNA, 14 nt, Human
ucauggcuuaaugu

SEQ ID NO: 2571887 - RNA, 22 nt, Human
ucauggcugugcccucuugaug

SEQ ID NO: 2571888 - RNA, 12 nt, Human
ucauguacauuu

SEQ ID NO: 2571889 - RNA, 17 nt, Human
ucauguaguaucaaaua

SEQ ID NO: 2571890 - RNA, 16 nt, Human
ucauguaguaucaaau

SEQ ID NO: 2571891 - RNA, 19 nt, Human
ucauguaucaucuggauag

SEQ ID NO: 2571892 - RNA, 18 nt, Human
ucauguaucaucuggaua

SEQ ID NO: 2571893 - RNA, 15 nt, Human
ucauguaucaucugg

SEQ ID NO: 2571894 - RNA, 19 nt, Human
ucauguaguaucaaauauu

SEQ ID NO: 2571895 - RNA, 16 nt, Human
uccaagaagcccagga

SEQ ID NO: 2571896 - RNA, 15 nt, Human
uccaagaagcccagg

SEQ ID NO: 2571897 - RNA, 14 nt, Human
uccaagaagcccag

SEQ ID NO: 2571898 - RNA, 20 nt, Human
ucauguaucaucuggauagg

SEQ ID NO: 2571899 - RNA, 16 nt, Human
ucaugucaacuucugg

SEQ ID NO: 2571900 - RNA, 22 nt, Human
uccaagcaggacauggacaagg

SEQ ID NO: 2571901 - RNA, 14 nt, Human
uccaagcaggacau

SEQ ID NO: 2571902 - RNA, 17 nt, Human
uccaagcaaaugugaau

SEQ ID NO: 2571903 - RNA, 19 nt, Human
uccaagaggguccuuuagu

SEQ ID NO: 2571904 - RNA, 15 nt, Human
uccaagcaaauguga

SEQ ID NO: 2571905 - RNA, 20 nt, Human
uccaagaccuucuccuucac

SEQ ID NO: 2571906 - RNA, 19 nt, Human
uccaagaagcccaggaaag

SEQ ID NO: 2571907 - RNA, 13 nt, Human
uccaagagccuga

SEQ ID NO: 2571908 - RNA, 14 nt, Human
uccaagagccugag

SEQ ID NO: 2571909 - RNA, 12 nt, Human
uccaagagcuga

SEQ ID NO: 2571910 - RNA, 20 nt, Human
uccacaccuggcacugcugu

SEQ ID NO: 2571911 - RNA, 19 nt, Human
uccacaccuggcacugcug

SEQ ID NO: 2571912 - RNA, 15 nt, Human
uccacaccuuuuauu

SEQ ID NO: 2571913 - RNA, 21 nt, Human
uccacaccuuuuauugacaca

SEQ ID NO: 2571914 - RNA, 18 nt, Human
uccacacccucucccagg

SEQ ID NO: 2571915 - RNA, 19 nt, Human
uccacacccucucccagga

SEQ ID NO: 2571916 - RNA, 20 nt, Human
uccacacccucucccaggac

SEQ ID NO: 2571917 - RNA, 21 nt, Human
uccacacccucucccaggacc

SEQ ID NO: 2571918 - RNA, 15 nt, Human
uccacacccccaccc

SEQ ID NO: 2571919 - RNA, 13 nt, Human
uccacacccccac

SEQ ID NO: 2571920 - RNA, 12 nt, Human
uccacaccccca

SEQ ID NO: 2571921 - RNA, 17 nt, Human
uccacaccaagcagcaa

SEQ ID NO: 2571922 - RNA, 19 nt, Human
uccacacacgcaggaacuc

SEQ ID NO: 2571923 - RNA, 21 nt, Human
uccacacacagcugggcugug

SEQ ID NO: 2571924 - RNA, 20 nt, Human
uccacacacagcugggcugu

SEQ ID NO: 2571925 - RNA, 15 nt, Human
uccacacacgcagga

SEQ ID NO: 2571926 - RNA, 14 nt, Human
uccacacacgcagg

SEQ ID NO: 2571927 - RNA, 19 nt, Human
uccacaagauucccagaga

SEQ ID NO: 2571928 - RNA, 20 nt, Human
uccacaagauucccagagac

SEQ ID NO: 2571929 - RNA, 21 nt, Human
uccacaagauucccagagaca

SEQ ID NO: 2571930 - RNA, 23 nt, Human
uccacacacagaggaagagcagg

SEQ ID NO: 2571931 - RNA, 23 nt, Human
uccacagcuuccccucucuccuc

SEQ ID NO: 2571932 - RNA, 14 nt, Human
uccacagcuaccuc

SEQ ID NO: 2571933 - RNA, 18 nt, Human
uccacagccugcaaguca

SEQ ID NO: 2571934 - RNA, 15 nt, Human
uccacagccugcaag

SEQ ID NO: 2571935 - RNA, 18 nt, Human
uccacagccgcagccucc

SEQ ID NO: 2571936 - RNA, 22 nt, Human
uccacagccaucccagccuugg

SEQ ID NO: 2571937 - RNA, 15 nt, Human
uccacagccauccca

SEQ ID NO: 2571938 - RNA, 14 nt, Human
uccacagccgcagc

SEQ ID NO: 2571939 - RNA, 16 nt, Human
uccacagccgcagccu

SEQ ID NO: 2571940 - RNA, 17 nt, Human
uccacagccgcagccuc

SEQ ID NO: 2571941 - RNA, 14 nt, Human
uccacagccauccc

SEQ ID NO: 2571942 - RNA, 22 nt, Human
uccacaccuggcacugcugugc

SEQ ID NO: 2571943 - RNA, 20 nt, Human
uccacagcaaccccaggcug

SEQ ID NO: 2571944 - RNA, 19 nt, Human
uccacagcaaccccaggcu

SEQ ID NO: 2571945 - RNA, 23 nt, Human
uccacacucaccucuaaaacagu

SEQ ID NO: 2571946 - RNA, 19 nt, Human
uccacaagagcccaggccu

SEQ ID NO: 2571947 - RNA, 20 nt, Human
uccacaagagcccaggccuc

SEQ ID NO: 2571948 - RNA, 21 nt, Human
uccacaagagcccaggccucc

SEQ ID NO: 2571949 - RNA, 23 nt, Human
uccaagcgaggucaacagagaag

SEQ ID NO: 2571950 - RNA, 21 nt, Human
uccaagcgaggucaacagaga

SEQ ID NO: 2571951 - RNA, 22 nt, Human
uccaagcgaggucaacagagaa

SEQ ID NO: 2571952 - RNA, 16 nt, Human
uccacaagauucccag

SEQ ID NO: 2571953 - RNA, 17 nt, Human
uccacaagauucccaga

SEQ ID NO: 2571954 - RNA, 18 nt, Human
uccacaagauucccagag

SEQ ID NO: 2571955 - RNA, 11 nt, Human
uccaagccugc

SEQ ID NO: 2571956 - RNA, 12 nt, Human
uccaagcccugg

SEQ ID NO: 2571957 - RNA, 23 nt, Human
uccaagccccaucuucuaaaugg

SEQ ID NO: 2571958 - RNA, 19 nt, Human
uccaagccccaucuucuaa

SEQ ID NO: 2571959 - RNA, 15 nt, Human
uccaagccccaucuu

SEQ ID NO: 2571960 - RNA, 23 nt, Human
uccaagcagccugagcaacucuu

SEQ ID NO: 2571961 - RNA, 22 nt, Human
uccaagcccaguucagcuuggg

SEQ ID NO: 2571962 - RNA, 15 nt, Human
uccaagccagcggga

SEQ ID NO: 2571963 - RNA, 15 nt, Human
uccagcuggccggga

SEQ ID NO: 2571964 - RNA, 21 nt, Human
uccagcuggccgggagccuga

SEQ ID NO: 2571965 - RNA, 22 nt, Human
uccagcuggccgggagccugau

SEQ ID NO: 2571966 - RNA, 19 nt, Human
uccagcugggcucugcaau

SEQ ID NO: 2571967 - RNA, 19 nt, Human
uccagcuggguuggaaaac

SEQ ID NO: 2571968 - RNA, 17 nt, Human
uccaggaaaugugcaca

SEQ ID NO: 2571969 - RNA, 20 nt, Human
uccaggaaggcggggcuuca

SEQ ID NO: 2571970 - RNA, 18 nt, Human
uccaggaaccacaccaca

SEQ ID NO: 2571971 - RNA, 23 nt, Human
uccaggaaacuccacaucugccu

SEQ ID NO: 2571972 - RNA, 21 nt, Human
uccagcuuuguucuucuuaaa

SEQ ID NO: 2571973 - RNA, 21 nt, Human
uccaggaaacuccacaucugc

SEQ ID NO: 2571974 - RNA, 20 nt, Human
uccaggacuauauuugggcc

SEQ ID NO: 2571975 - RNA, 23 nt, Human
uccaggacuauauuugggccugc

SEQ ID NO: 2571976 - RNA, 22 nt, Human
uccaggaaugccuccucccugg

SEQ ID NO: 2571977 - RNA, 16 nt, Human
uccaggagaaggccaa

SEQ ID NO: 2571978 - RNA, 20 nt, Human
uccaggagaaggccaauucc

SEQ ID NO: 2571979 - RNA, 23 nt, Human
uccaggagaaggccaauuccuau

SEQ ID NO: 2571980 - RNA, 17 nt, Human
uccagggcccccaucuc

SEQ ID NO: 2571981 - RNA, 13 nt, Human
uccagggcccuga

SEQ ID NO: 2571982 - RNA, 13 nt, Human
uccaggagaggag

SEQ ID NO: 2571983 - RNA, 22 nt, Human
uccagggccacgugccaggccc

SEQ ID NO: 2571984 - RNA, 23 nt, Human
uccagggccacgugccaggcccg

SEQ ID NO: 2571985 - RNA, 19 nt, Human
uccagcaauucuccugccu

SEQ ID NO: 2571986 - RNA, 20 nt, Human
uccagcaauucuccugccuc

SEQ ID NO: 2571987 - RNA, 19 nt, Human
uccagauuuacacugggag

SEQ ID NO: 2571988 - RNA, 18 nt, Human
uccagcaauucuccugcc

SEQ ID NO: 2571989 - RNA, 17 nt, Human
uccagauugacgacaag

SEQ ID NO: 2571990 - RNA, 18 nt, Human
uccagauguuuccagacu

SEQ ID NO: 2571991 - RNA, 19 nt, Human
uccagauguuuccagacuu

SEQ ID NO: 2571992 - RNA, 20 nt, Human
uccagauuuacacugggaga

SEQ ID NO: 2571993 - RNA, 18 nt, Human
uccagauuuacacuggga

SEQ ID NO: 2571994 - RNA, 16 nt, Human
uccagauuuacacugg

SEQ ID NO: 2571995 - RNA, 22 nt, Human
uccagauuuuuuacagcugccu

SEQ ID NO: 2571996 - RNA, 16 nt, Human
uccagaugcagggcag

SEQ ID NO: 2571997 - RNA, 17 nt, Human
uccagaugcagggcagu

SEQ ID NO: 2571998 - RNA, 18 nt, Human
uccagaugcagggcaguc

SEQ ID NO: 2571999 - RNA, 19 nt, Human
uccagaugcagggcaguca

SEQ ID NO: 2572000 - RNA, 21 nt, Human
uccagaugccuucuccagaca

SEQ ID NO: 2572001 - RNA, 21 nt, Human
uccacccugcucuccgaccag

SEQ ID NO: 2572002 - RNA, 13 nt, Human
uccacaggaagug

SEQ ID NO: 2572003 - RNA, 22 nt, Human
uccacccuggccgaguccaagc

SEQ ID NO: 2572004 - RNA, 12 nt, Human
uccacccuggaa

SEQ ID NO: 2572005 - RNA, 14 nt, Human
uccacccugcucuc

SEQ ID NO: 2572006 - RNA, 13 nt, Human
uccacccugcucu

SEQ ID NO: 2572007 - RNA, 22 nt, Human
uccacugugccaugugccaggu

SEQ ID NO: 2572008 - RNA, 12 nt, Human
uccacccugucc

SEQ ID NO: 2572009 - RNA, 14 nt, Human
uccacccugucccc

SEQ ID NO: 2572010 - RNA, 20 nt, Human
uccacuguguauagaaguag

SEQ ID NO: 2572011 - RNA, 12 nt, Human
uccacuguguau

SEQ ID NO: 2572012 - RNA, 15 nt, Human
uccacuuuaucuuga

SEQ ID NO: 2572013 - RNA, 23 nt, Human
uccacuuagaaauugcauuuccu

SEQ ID NO: 2572014 - RNA, 21 nt, Human
uccacuuagaaauugcauuuc

SEQ ID NO: 2572015 - RNA, 17 nt, Human
uccagagggcacucugc

SEQ ID NO: 2572016 - RNA, 15 nt, Human
uccagaugcagggca

SEQ ID NO: 2572017 - RNA, 20 nt, Human
uccagaggcuauuauuuuca

SEQ ID NO: 2572018 - RNA, 12 nt, Human
uccagagggcac

SEQ ID NO: 2572019 - RNA, 19 nt, Human
uccagagaguggcuccucc

SEQ ID NO: 2572020 - RNA, 22 nt, Human
uccagagaguggcuccucccgg

SEQ ID NO: 2572021 - RNA, 17 nt, Human
uccacuuuaucuugaau

SEQ ID NO: 2572022 - RNA, 14 nt, Human
uccacuuucuagcc

SEQ ID NO: 2572023 - RNA, 18 nt, Human
uccacuuucagugaaagc

SEQ ID NO: 2572024 - RNA, 23 nt, Human
ucccuaccgagucucuucuccac

SEQ ID NO: 2572025 - RNA, 22 nt, Human
ucccuaccgagucucuucucca

SEQ ID NO: 2572026 - RNA, 21 nt, Human
ucccuaccgagucucuucucc

SEQ ID NO: 2572027 - RNA, 19 nt, Human
ucccuaccgagucucuucu

SEQ ID NO: 2572028 - RNA, 18 nt, Human
ucccuaccaccuccccag

SEQ ID NO: 2572029 - RNA, 20 nt, Human
ucccuacccccuaagagcca

SEQ ID NO: 2572030 - RNA, 13 nt, Human
ucccuaccaccuc

SEQ ID NO: 2572031 - RNA, 19 nt, Human
ucccuacccccuaagagcc

SEQ ID NO: 2572032 - RNA, 19 nt, Human
ucccaugacccaggcuggg

SEQ ID NO: 2572033 - RNA, 15 nt, Human
ucccaugaucccugu

SEQ ID NO: 2572034 - RNA, 19 nt, Human
ucccaugaucccuguguug

SEQ ID NO: 2572035 - RNA, 16 nt, Human
ucccaugaucccugug

SEQ ID NO: 2572036 - RNA, 12 nt, Human
ucccaugaugua

SEQ ID NO: 2572037 - RNA, 22 nt, Human
ucccaugagccucagcauccug

SEQ ID NO: 2572038 - RNA, 17 nt, Human
ucccaugagccucagca

SEQ ID NO: 2572039 - RNA, 19 nt, Human
ucccuagaaacuuccaaau

SEQ ID NO: 2572040 - RNA, 17 nt, Human
ucccuacuuccugugac

SEQ ID NO: 2572041 - RNA, 18 nt, Human
ucccuagaaacuuccaaa

SEQ ID NO: 2572042 - RNA, 17 nt, Human
ucccuagaggguuccug

SEQ ID NO: 2572043 - RNA, 18 nt, Human
ucccuagaggguuccugu

SEQ ID NO: 2572044 - RNA, 23 nt, Human
ucccuagaucuuucuauuccaaa

SEQ ID NO: 2572045 - RNA, 16 nt, Human
ucccuagaucuuucua

SEQ ID NO: 2572046 - RNA, 19 nt, Human
ucccuagaggguuccugua

SEQ ID NO: 2572047 - RNA, 20 nt, Human
ucccuagaggguuccuguag

SEQ ID NO: 2572048 - RNA, 17 nt, Human
ucccuagccagcacuug

SEQ ID NO: 2572049 - RNA, 16 nt, Human
ucccuagccagcacuu

SEQ ID NO: 2572050 - RNA, 22 nt, Human
ucccuagccagcacuuguauau

SEQ ID NO: 2572051 - RNA, 20 nt, Human
ucccuagccagcacuuguau

SEQ ID NO: 2572052 - RNA, 18 nt, Human
ucccuagcugugaccucu

SEQ ID NO: 2572053 - RNA, 18 nt, Human
ucccucccuuccucuuuc

SEQ ID NO: 2572054 - RNA, 13 nt, Human
ucccucccuuggg

SEQ ID NO: 2572055 - RNA, 14 nt, Human
ucccucccuugggg

SEQ ID NO: 2572056 - RNA, 18 nt, Human
ucccuccgauccuuccuc

SEQ ID NO: 2572057 - RNA, 15 nt, Human
ucccuccgauccuuc

SEQ ID NO: 2572058 - RNA, 19 nt, Human
ucccuccgauccuuccucc

SEQ ID NO: 2572059 - RNA, 20 nt, Human
ucccuagcuuuagacccugg

SEQ ID NO: 2572060 - RNA, 19 nt, Human
ucccuagcuuuagacccug

SEQ ID NO: 2572061 - RNA, 22 nt, Human
ucccuagcuuuagacccugggu

SEQ ID NO: 2572062 - RNA, 15 nt, Human
ucccucccuuugaaa

SEQ ID NO: 2572063 - RNA, 18 nt, Human
ucccucuacugggagccu

SEQ ID NO: 2572064 - RNA, 22 nt, Human
ucccucuacugggagccuaccc

SEQ ID NO: 2572065 - RNA, 14 nt, Human
ucccuccgggaccu

SEQ ID NO: 2572066 - RNA, 15 nt, Human
ucccuccgggaccug

SEQ ID NO: 2572067 - RNA, 12 nt, Human
ucccuccucacc

SEQ ID NO: 2572068 - RNA, 14 nt, Human
ucccucuguuucuc

SEQ ID NO: 2572069 - RNA, 13 nt, Human
ucccucuguuucu

SEQ ID NO: 2572070 - RNA, 22 nt, Human
ucccugcaucugaccagcagcg

SEQ ID NO: 2572071 - RNA, 16 nt, Human
ucccugcaucugacca

SEQ ID NO: 2572072 - RNA, 18 nt, Human
ucccugcaucugaccagc

SEQ ID NO: 2572073 - RNA, 20 nt, Human
ucccugcaucugaccagcag

SEQ ID NO: 2572074 - RNA, 21 nt, Human
ucccugcaucugaccagcagc

SEQ ID NO: 2572075 - RNA, 16 nt, Human
ucccugccaauggacu

SEQ ID NO: 2572076 - RNA, 14 nt, Human
ucccugccaaugga

SEQ ID NO: 2572077 - RNA, 17 nt, Human
ucccucuggggcuguuc

SEQ ID NO: 2572078 - RNA, 20 nt, Human
ucccugcacuugcagacucu

SEQ ID NO: 2572079 - RNA, 13 nt, Human
ucccucuggggcu

SEQ ID NO: 2572080 - RNA, 18 nt, Human
ucccucugcuccuggagc

SEQ ID NO: 2572081 - RNA, 15 nt, Human
ucccucugcuccugg

SEQ ID NO: 2572082 - RNA, 20 nt, Human
ucccucugcuccuggagccu

SEQ ID NO: 2572083 - RNA, 16 nt, Human
ucccucuggcccugcc

SEQ ID NO: 2572084 - RNA, 17 nt, Human
ucccucuggcccugccu

SEQ ID NO: 2572085 - RNA, 18 nt, Human
ucccucuggcccugccuu

SEQ ID NO: 2572086 - RNA, 19 nt, Human
ucccucuggcccugccuuc

SEQ ID NO: 2572087 - RNA, 20 nt, Human
ucccucuggcccugccuucu

SEQ ID NO: 2572088 - RNA, 23 nt, Human
ucccucucucuucugcuccaccc

SEQ ID NO: 2572089 - RNA, 13 nt, Human
ucccucugaccug

SEQ ID NO: 2572090 - RNA, 17 nt, Human
ucccucugaccugcagg

SEQ ID NO: 2572091 - RNA, 16 nt, Human
ucccucugaggcugua

SEQ ID NO: 2572092 - RNA, 22 nt, Human
ucccucugagaauuccaaggag

SEQ ID NO: 2572093 - RNA, 21 nt, Human
ucccucugagaauuccaagga

SEQ ID NO: 2572094 - RNA, 18 nt, Human
ucccucugaccugcaggc

SEQ ID NO: 2572095 - RNA, 19 nt, Human
ucccucugaccugcaggcc

SEQ ID NO: 2572096 - RNA, 13 nt, Human
ucccucugcccca

SEQ ID NO: 2572097 - RNA, 11 nt, Human
ucccucugccu

SEQ ID NO: 2572098 - RNA, 19 nt, Human
ucccucugaggcuguagga

SEQ ID NO: 2572099 - RNA, 21 nt, Human
ucccucugccugaaccuucca

SEQ ID NO: 2572100 - RNA, 16 nt, Human
ucccucugccuguccc

SEQ ID NO: 2572101 - RNA, 18 nt, Human
ucccucugccugucccuc

SEQ ID NO: 2572102 - RNA, 20 nt, Human
ucccucugccugucccucuc

SEQ ID NO: 2572103 - RNA, 20 nt, Human
ucccucuccauaaccccacc

SEQ ID NO: 2572104 - RNA, 22 nt, Human
ucccucucaggcaugccugugu

SEQ ID NO: 2572105 - RNA, 23 nt, Human
ucccucucaggcaugccugugug

SEQ ID NO: 2572106 - RNA, 21 nt, Human
ucccucucucuucugcuccac

SEQ ID NO: 2572107 - RNA, 20 nt, Human
ucccucucucuucugcucca

SEQ ID NO: 2572108 - RNA, 23 nt, Human
ucccucuacugggagccuaccca

SEQ ID NO: 2572109 - RNA, 13 nt, Human
ucccuccucaccu

SEQ ID NO: 2572110 - RNA, 13 nt, Human
ucccucuauuuau

SEQ ID NO: 2572111 - RNA, 19 nt, Human
ucccucuauuuauguuugc

SEQ ID NO: 2572112 - RNA, 19 nt, Human
ucccucucaggcaugccug

SEQ ID NO: 2572113 - RNA, 20 nt, Human
ucccucucaggcaugccugu

SEQ ID NO: 2572114 - RNA, 20 nt, Human
ucccuggcugcccuggcccu

SEQ ID NO: 2572115 - RNA, 19 nt, Human
ucccuggcugcccuggccc

SEQ ID NO: 2572116 - RNA, 18 nt, Human
ucccuggcugcccuggcc

SEQ ID NO: 2572117 - RNA, 16 nt, Human
ucccuggcugcccugg

SEQ ID NO: 2572118 - RNA, 22 nt, Human
ucccuggcugcccuggcccuga

SEQ ID NO: 2572119 - RNA, 21 nt, Human
ucccuggcugcccuggcccug

SEQ ID NO: 2572120 - RNA, 23 nt, Human
ucccuggcugcccuggcccugag

SEQ ID NO: 2572121 - RNA, 15 nt, Human
ucccuggcucucaga

SEQ ID NO: 2572122 - RNA, 16 nt, Human
ucccuggcucucagaa

SEQ ID NO: 2572123 - RNA, 18 nt, Human
ucccuggcucucagaagg

SEQ ID NO: 2572124 - RNA, 15 nt, Human
ucccuggcugcccug

SEQ ID NO: 2572125 - RNA, 14 nt, Human
ucccuggcugcccu

SEQ ID NO: 2572126 - RNA, 19 nt, Human
ucccuggcucucagaaggu

SEQ ID NO: 2572127 - RNA, 20 nt, Human
ucccuggcucucagaaggua

SEQ ID NO: 2572128 - RNA, 18 nt, Human
ucccuggcuuguaacucc

SEQ ID NO: 2572129 - RNA, 19 nt, Human
ucccuggcuuguaacucca

SEQ ID NO: 2572130 - RNA, 21 nt, Human
ucccuggcuuguaacuccacc

SEQ ID NO: 2572131 - RNA, 11 nt, Human
ucccuggcuug

SEQ ID NO: 2572132 - RNA, 19 nt, Human
ucccugggaggaaauuuga

SEQ ID NO: 2572133 - RNA, 22 nt, Human
ucccuggcuuguaacuccacca

SEQ ID NO: 2572134 - RNA, 16 nt, Human
ucccugggcagaaagu

SEQ ID NO: 2572135 - RNA, 12 nt, Human
ucccugggcauu

SEQ ID NO: 2572136 - RNA, 17 nt, Human
ucccugggcauugcuuu

SEQ ID NO: 2572137 - RNA, 18 nt, Human
ucccugccccucccuuca

SEQ ID NO: 2572138 - RNA, 15 nt, Human
ucccuggccuuucau

SEQ ID NO: 2572139 - RNA, 24 nt, Human
ucccuggccuuucauauuuuagcu

SEQ ID NO: 2572140 - RNA, 16 nt, Human
ucccuggccuuucaua

SEQ ID NO: 2572141 - RNA, 14 nt, Human
ucccuggcucccau

SEQ ID NO: 2572142 - RNA, 16 nt, Human
ucccugccccccagcc

SEQ ID NO: 2572143 - RNA, 14 nt, Human
ucccugccccuccc

SEQ ID NO: 2572144 - RNA, 17 nt, Human
ucccugcauuucugagu

SEQ ID NO: 2572145 - RNA, 14 nt, Human
ucccugcauuucug

SEQ ID NO: 2572146 - RNA, 13 nt, Human
ucccugccagcuc

SEQ ID NO: 2572147 - RNA, 21 nt, Human
ucccuucccacuggaggcaug

SEQ ID NO: 2572148 - RNA, 17 nt, Human
ucccuucccaccucucu

SEQ ID NO: 2572149 - RNA, 16 nt, Human
ucccuucugucccuca

SEQ ID NO: 2572150 - RNA, 14 nt, Human
ucccuucugcuacu

SEQ ID NO: 2572151 - RNA, 15 nt, Human
ucccuucugcuacug

SEQ ID NO: 2572152 - RNA, 13 nt, Human
ucccuucugcuac

SEQ ID NO: 2572153 - RNA, 22 nt, Human
ucccuucccaugacccaggcug

SEQ ID NO: 2572154 - RNA, 23 nt, Human
ucccuucucuguagggaacucug

SEQ ID NO: 2572155 - RNA, 20 nt, Human
ucccugggcugugcuaccug

SEQ ID NO: 2572156 - RNA, 16 nt, Human
ucccuucccauaagcu

SEQ ID NO: 2572157 - RNA, 16 nt, Human
ucccuucccaccucuc

SEQ ID NO: 2572158 - RNA, 19 nt, Human
ucccugggcugugcuaccu

SEQ ID NO: 2572159 - RNA, 16 nt, Human
ucccugggcugugcua

SEQ ID NO: 2572160 - RNA, 15 nt, Human
ucccugggcugugcu

SEQ ID NO: 2572161 - RNA, 14 nt, Human
ucccuucccaccuc

SEQ ID NO: 2572162 - RNA, 18 nt, Human
ucccugggcauugcuuuc

SEQ ID NO: 2572163 - RNA, 23 nt, Human
uccgaaaaauccucuuccucuga

SEQ ID NO: 2572164 - RNA, 22 nt, Human
uccgaaaaauccucuuccucug

SEQ ID NO: 2572165 - RNA, 18 nt, Human
uccgaaaccaaagaagaa

SEQ ID NO: 2572166 - RNA, 19 nt, Human
uccgaaaccaaagaagaaa

SEQ ID NO: 2572167 - RNA, 13 nt, Human
ucccuugagaccu

SEQ ID NO: 2572168 - RNA, 16 nt, Human
ucccuugagaccucag

SEQ ID NO: 2572169 - RNA, 17 nt, Human
ucccuugagaccucagc

SEQ ID NO: 2572170 - RNA, 21 nt, Human
uccgaaagggacuuggaagcu

SEQ ID NO: 2572171 - RNA, 21 nt, Human
ucccuugaccaggccugggcc

SEQ ID NO: 2572172 - RNA, 17 nt, Human
ucccuugaccaggccug

SEQ ID NO: 2572173 - RNA, 17 nt, Human
ucccuugaaauuuuaaa

SEQ ID NO: 2572174 - RNA, 17 nt, Human
ucccuucuuuuucuucu

SEQ ID NO: 2572175 - RNA, 17 nt, Human
ucccuucugucccucac

SEQ ID NO: 2572176 - RNA, 22 nt, Human
ucccuucugucccucacagcac

SEQ ID NO: 2572177 - RNA, 13 nt, Human
ucccuucuugguu

SEQ ID NO: 2572178 - RNA, 20 nt, Human
ucccuucugcuacuggcaaa

SEQ ID NO: 2572179 - RNA, 22 nt, Human
uccgacuugaauuuucccacug

SEQ ID NO: 2572180 - RNA, 21 nt, Human
uccgacuugaauuuucccacu

SEQ ID NO: 2572181 - RNA, 15 nt, Human
uccgacugcuuugga

SEQ ID NO: 2572182 - RNA, 12 nt, Human
uccgacugcuuu

SEQ ID NO: 2572183 - RNA, 15 nt, Human
uccgaaccuccucug

SEQ ID NO: 2572184 - RNA, 17 nt, Human
uccgacucuucugagca

SEQ ID NO: 2572185 - RNA, 16 nt, Human
uccgaaccuccucugu

SEQ ID NO: 2572186 - RNA, 17 nt, Human
uccgaaccuccucugug

SEQ ID NO: 2572187 - RNA, 19 nt, Human
uccgaacacccucgaagcg

SEQ ID NO: 2572188 - RNA, 22 nt, Human
uccgaaagggacuuggaagcuc

SEQ ID NO: 2572189 - RNA, 21 nt, Human
uccgcccacaggaagccugca

SEQ ID NO: 2572190 - RNA, 18 nt, Human
uccgccagggcccacacc

SEQ ID NO: 2572191 - RNA, 13 nt, Human
uccgccagggccc

SEQ ID NO: 2572192 - RNA, 19 nt, Human
uccgccagggcccacaccc

SEQ ID NO: 2572193 - RNA, 19 nt, Human
uccgagccggggaguuucu

SEQ ID NO: 2572194 - RNA, 15 nt, Human
uccgagagggagaga

SEQ ID NO: 2572195 - RNA, 16 nt, Human
uccgagaggugggcca

SEQ ID NO: 2572196 - RNA, 14 nt, Human
uccgagagggagag

SEQ ID NO: 2572197 - RNA, 13 nt, Human
uccgagagggaga

SEQ ID NO: 2572198 - RNA, 17 nt, Human
uccgagagagcaccccu

SEQ ID NO: 2572199 - RNA, 24 nt, Human
uccgagccggggaguuucuuuccu

SEQ ID NO: 2572200 - RNA, 21 nt, Human
uccgagccggggaguuucuuu

SEQ ID NO: 2572201 - RNA, 12 nt, Human
uccgaggcaggg

SEQ ID NO: 2572202 - RNA, 13 nt, Human
uccgaggcagggu

SEQ ID NO: 2572203 - RNA, 14 nt, Human
uccgaggcaggguc

SEQ ID NO: 2572204 - RNA, 13 nt, Human
uccgcccugccac

SEQ ID NO: 2572205 - RNA, 15 nt, Human
uccgcccugccacuc

SEQ ID NO: 2572206 - RNA, 14 nt, Human
uccgcccugccacu

SEQ ID NO: 2572207 - RNA, 16 nt, Human
uccgcccugccacuca

SEQ ID NO: 2572208 - RNA, 12 nt, Human
uccgcccugcuc

SEQ ID NO: 2572209 - RNA, 22 nt, Human
uccgcccucaaaaugacagcca

SEQ ID NO: 2572210 - RNA, 21 nt, Human
uccgcuuucuacccagcgagc

SEQ ID NO: 2572211 - RNA, 19 nt, Human
uccgcccugcuccucccug

SEQ ID NO: 2572212 - RNA, 15 nt, Human
uccgcccugcuccuc

SEQ ID NO: 2572213 - RNA, 14 nt, Human
uccgcccugcuccu

SEQ ID NO: 2572214 - RNA, 17 nt, Human
uccgcccugcuccuccc

SEQ ID NO: 2572215 - RNA, 15 nt, Human
uccggaauccugucc

SEQ ID NO: 2572216 - RNA, 14 nt, Human
uccuccugggcccu

SEQ ID NO: 2572217 - RNA, 15 nt, Human
uccuccugggcccuc

SEQ ID NO: 2572218 - RNA, 16 nt, Human
uccuccugggcccucu

SEQ ID NO: 2572219 - RNA, 21 nt, Human
uccuccuuuucacaguucucu

SEQ ID NO: 2572220 - RNA, 13 nt, Human
uccuccuggacuc

SEQ ID NO: 2572221 - RNA, 13 nt, Human
uccuccuggcaga

SEQ ID NO: 2572222 - RNA, 17 nt, Human
uccuccugcccaccugu

SEQ ID NO: 2572223 - RNA, 11 nt, Human
uccuccuggaa

SEQ ID NO: 2572224 - RNA, 12 nt, Human
uccuccugcuca

SEQ ID NO: 2572225 - RNA, 12 nt, Human
uccuccugccca

SEQ ID NO: 2572226 - RNA, 16 nt, Human
uccuccugcccaccug

SEQ ID NO: 2572227 - RNA, 21 nt, Human
uccucuaggaggucucuaaga

SEQ ID NO: 2572228 - RNA, 23 nt, Human
uccucgcagagaggccaggugca

SEQ ID NO: 2572229 - RNA, 17 nt, Human
uccucuaggaggucucu

SEQ ID NO: 2572230 - RNA, 17 nt, Human
uccucgagggcagggac

SEQ ID NO: 2572231 - RNA, 13 nt, Human
uccucgcaagcug

SEQ ID NO: 2572232 - RNA, 14 nt, Human
uccucgcaagcugg

SEQ ID NO: 2572233 - RNA, 15 nt, Human
uccucgcaagcuggg

SEQ ID NO: 2572234 - RNA, 17 nt, Human
uccucgcagagaggcca

SEQ ID NO: 2572235 - RNA, 16 nt, Human
uccucgcagagaggcc

SEQ ID NO: 2572236 - RNA, 14 nt, Human
uccucgcagagagg

SEQ ID NO: 2572237 - RNA, 16 nt, Human
uccucgcaagcugggu

SEQ ID NO: 2572238 - RNA, 18 nt, Human
uccucucacuaaacuuua

SEQ ID NO: 2572239 - RNA, 17 nt, Human
uccucugcugcuggcug

SEQ ID NO: 2572240 - RNA, 20 nt, Human
uccucucaaccaccuuucag

SEQ ID NO: 2572241 - RNA, 21 nt, Human
uccucucaaccaccuuucaga

SEQ ID NO: 2572242 - RNA, 18 nt, Human
uccucucaaccaccuuuc

SEQ ID NO: 2572243 - RNA, 19 nt, Human
uccucuauugauguacagu

SEQ ID NO: 2572244 - RNA, 15 nt, Human
uccucuggccugugu

SEQ ID NO: 2572245 - RNA, 17 nt, Human
uccucuggauggcacca

SEQ ID NO: 2572246 - RNA, 14 nt, Human
uccucucagccccu

SEQ ID NO: 2572247 - RNA, 13 nt, Human
uccucuguacaga

SEQ ID NO: 2572248 - RNA, 23 nt, Human
uccucuggcuggcuaacuggaag

SEQ ID NO: 2572249 - RNA, 19 nt, Human
uccucuggauggcaccaga

SEQ ID NO: 2572250 - RNA, 9 nt, Human
uccucuggc

SEQ ID NO: 2572251 - RNA, 19 nt, Human
uccugaggcugggcucccu

SEQ ID NO: 2572252 - RNA, 17 nt, Human
uccugaggcugggcucc

SEQ ID NO: 2572253 - RNA, 16 nt, Human
uccugaggcugggcuc

SEQ ID NO: 2572254 - RNA, 15 nt, Human
uccugaggcugggcu

SEQ ID NO: 2572255 - RNA, 16 nt, Human
uccugaggcuccacuu

SEQ ID NO: 2572256 - RNA, 17 nt, Human
uccugaggcuccacuug

SEQ ID NO: 2572257 - RNA, 12 nt, Human
uccugaggcugg

SEQ ID NO: 2572258 - RNA, 13 nt, Human
uccucuguccagg

SEQ ID NO: 2572259 - RNA, 21 nt, Human
uccugaggcuccacuuggucu

SEQ ID NO: 2572260 - RNA, 17 nt, Human
uccugagccagauuuca

SEQ ID NO: 2572261 - RNA, 21 nt, Human
uccucugucagucacagccac

SEQ ID NO: 2572262 - RNA, 22 nt, Human
uccucugucagucacagccacc

SEQ ID NO: 2572263 - RNA, 17 nt, Human
uccucuguccaggcacu

SEQ ID NO: 2572264 - RNA, 23 nt, Human
uccucuguacagagcccacgccc

SEQ ID NO: 2572265 - RNA, 19 nt, Human
uccucuguacagagcccac

SEQ ID NO: 2572266 - RNA, 19 nt, Human
uccucugucagucacagcc

SEQ ID NO: 2572267 - RNA, 20 nt, Human
uccucugggcaggaccucag

SEQ ID NO: 2572268 - RNA, 19 nt, Human
uccugagccagauuucacu

SEQ ID NO: 2572269 - RNA, 18 nt, Human
uccugagccagauuucac

SEQ ID NO: 2572270 - RNA, 15 nt, Human
uccugaggcuccacu

SEQ ID NO: 2572271 - RNA, 17 nt, Human
uccuaguuccaccauca

SEQ ID NO: 2572272 - RNA, 14 nt, Human
uccuaguuccacca

SEQ ID NO: 2572273 - RNA, 14 nt, Human
uccuaagccuaaaa

SEQ ID NO: 2572274 - RNA, 18 nt, Human
uccuaagcuauucaguaa

SEQ ID NO: 2572275 - RNA, 19 nt, Human
uccuaagagugcugggcau

SEQ ID NO: 2572276 - RNA, 17 nt, Human
uccuaagagugcugggc

SEQ ID NO: 2572277 - RNA, 16 nt, Human
uccuaagcuauucagu

SEQ ID NO: 2572278 - RNA, 18 nt, Human
uccggacacuccuagaga

SEQ ID NO: 2572279 - RNA, 15 nt, Human
uccggacacuccuag

SEQ ID NO: 2572280 - RNA, 15 nt, Human
uccggagauguagca

SEQ ID NO: 2572281 - RNA, 21 nt, Human
uccggagugagaagcuuugcc

SEQ ID NO: 2572282 - RNA, 15 nt, Human
uccggaguagcuggg

SEQ ID NO: 2572283 - RNA, 22 nt, Human
uccggaauccuguccucagcuu

SEQ ID NO: 2572284 - RNA, 18 nt, Human
uccggaauccuguccuca

SEQ ID NO: 2572285 - RNA, 22 nt, Human
uccuaucagccugucucuucca

SEQ ID NO: 2572286 - RNA, 21 nt, Human
uccuaguuccaccaucaagcc

SEQ ID NO: 2572287 - RNA, 17 nt, Human
uccuaucuguguuuuga

SEQ ID NO: 2572288 - RNA, 14 nt, Human
uccuaucuguguuu

SEQ ID NO: 2572289 - RNA, 13 nt, Human
uccuaucuguguu

SEQ ID NO: 2572290 - RNA, 22 nt, Human
uccuauugugauuugacuguuu

SEQ ID NO: 2572291 - RNA, 20 nt, Human
uccuauugugauuugacugu

SEQ ID NO: 2572292 - RNA, 19 nt, Human
uccuauugugauuugacug

SEQ ID NO: 2572293 - RNA, 18 nt, Human
uccuauugugauuugacu

SEQ ID NO: 2572294 - RNA, 22 nt, Human
uccuauggcuggccacugcaca

SEQ ID NO: 2572295 - RNA, 20 nt, Human
uccuauggcuggccacugca

SEQ ID NO: 2572296 - RNA, 15 nt, Human
uccuauugugauuug

SEQ ID NO: 2572297 - RNA, 17 nt, Human
uccuauugucauuaaag

SEQ ID NO: 2572298 - RNA, 22 nt, Human
uccuccaggugcacaagcucca

SEQ ID NO: 2572299 - RNA, 20 nt, Human
uccuccaggugcacaagcuc

SEQ ID NO: 2572300 - RNA, 18 nt, Human
uccuccaggugcacaagc

SEQ ID NO: 2572301 - RNA, 14 nt, Human
uccuccaggugcac

SEQ ID NO: 2572302 - RNA, 13 nt, Human
uccuccaggugca

SEQ ID NO: 2572303 - RNA, 12 nt, Human
uccuccaggugc

SEQ ID NO: 2572304 - RNA, 20 nt, Human
uccucaaaacuucagacaua

SEQ ID NO: 2572305 - RNA, 15 nt, Human
uccuauuucuuauag

SEQ ID NO: 2572306 - RNA, 18 nt, Human
uccuauuuggggcuugca

SEQ ID NO: 2572307 - RNA, 18 nt, Human
uccuauuugccaugggcu

SEQ ID NO: 2572308 - RNA, 16 nt, Human
uccuauuugcacugua

SEQ ID NO: 2572309 - RNA, 16 nt, Human
uccuccucaccucaug

SEQ ID NO: 2572310 - RNA, 12 nt, Human
uccuccucaccu

SEQ ID NO: 2572311 - RNA, 22 nt, Human
uccuccuaccgaaaccuugccu

SEQ ID NO: 2572312 - RNA, 19 nt, Human
uccuccgugcuuccucagu

SEQ ID NO: 2572313 - RNA, 18 nt, Human
uccuccucaccucaugcc

SEQ ID NO: 2572314 - RNA, 20 nt, Human
uccuccugcagaccacgccc

SEQ ID NO: 2572315 - RNA, 15 nt, Human
uccuccugcagacca

SEQ ID NO: 2572316 - RNA, 12 nt, Human
uccuccugcaga

SEQ ID NO: 2572317 - RNA, 12 nt, Human
uccuccucagau

SEQ ID NO: 2572318 - RNA, 15 nt, Human
uccuccgaggccagu

SEQ ID NO: 2572319 - RNA, 18 nt, Human
uccuccgugcuuccucag

SEQ ID NO: 2572320 - RNA, 18 nt, Human
uccuccguccagccgcca

SEQ ID NO: 2572321 - RNA, 14 nt, Human
uccuccguccagcc

SEQ ID NO: 2572322 - RNA, 16 nt, Human
uccuccguccagccgc

SEQ ID NO: 2572323 - RNA, 19 nt, Human
uccucccuuuuuccuuguc

SEQ ID NO: 2572324 - RNA, 17 nt, Human
uccucccuuuuuccuug

SEQ ID NO: 2572325 - RNA, 22 nt, Human
uccuccagguuuuucaauuaaa

SEQ ID NO: 2572326 - RNA, 16 nt, Human
uccucccuuguucucu

SEQ ID NO: 2572327 - RNA, 23 nt, Human
uccuccagguuuuucaauuaaac

SEQ ID NO: 2572328 - RNA, 21 nt, Human
uccuccagguuuuucaauuaa

SEQ ID NO: 2572329 - RNA, 20 nt, Human
uccuccagguuuuucaauua

SEQ ID NO: 2572330 - RNA, 14 nt, Human
uccuccgaggccag

SEQ ID NO: 2572331 - RNA, 23 nt, Human
uccuccgagccggggaguuucuu

SEQ ID NO: 2572332 - RNA, 17 nt, Human
uccuccgucaccucaga

SEQ ID NO: 2572333 - RNA, 19 nt, Human
uccuccagguuuuucaauu

SEQ ID NO: 2572334 - RNA, 18 nt, Human
uccuccagguuuuucaau

SEQ ID NO: 2572335 - RNA, 17 nt, Human
uccuccagguuuuucaa

SEQ ID NO: 2572336 - RNA, 16 nt, Human
uccuccagguuuuuca

SEQ ID NO: 2572337 - RNA, 15 nt, Human
uccuccagguuuuuc

SEQ ID NO: 2572338 - RNA, 14 nt, Human
uccuccagguuuuu

SEQ ID NO: 2572339 - RNA, 13 nt, Human
uccuccagguuuu

SEQ ID NO: 2572340 - RNA, 12 nt, Human
uccuccagguuu

SEQ ID NO: 2572341 - RNA, 11 nt, Human
uccuccagguu

SEQ ID NO: 2572342 - RNA, 17 nt, Human
uccuauuuguuuucaug

SEQ ID NO: 2572343 - RNA, 16 nt, Human
uccuauuuguuuucau

SEQ ID NO: 2572344 - RNA, 14 nt, Human
uccuauuuguuuuc

SEQ ID NO: 2572345 - RNA, 15 nt, Human
ucggccuccauccug

SEQ ID NO: 2572346 - RNA, 16 nt, Human
ucggccuccauccuga

SEQ ID NO: 2572347 - RNA, 21 nt, Human
ucgucauguuggccaggcugg

SEQ ID NO: 2572348 - RNA, 22 nt, Human
ucggaggcuugucagagcuggg

SEQ ID NO: 2572349 - RNA, 14 nt, Human
ucggaggcuuggga

SEQ ID NO: 2572350 - RNA, 23 nt, Human
ucggaggcugcccccggcccccu

SEQ ID NO: 2572351 - RNA, 14 nt, Human
ucggaggcugcccc

SEQ ID NO: 2572352 - RNA, 12 nt, Human
ucggaggcccca

SEQ ID NO: 2572353 - RNA, 20 nt, Human
ucggaggccccaaaggaaaa

SEQ ID NO: 2572354 - RNA, 13 nt, Human
ucggaggaagccc

SEQ ID NO: 2572355 - RNA, 12 nt, Human
ucggaggaagcc

SEQ ID NO: 2572356 - RNA, 23 nt, Human
ucggagccucauccgaggcaggg

SEQ ID NO: 2572357 - RNA, 23 nt, Human
ucggagacagugaucuccauaug

SEQ ID NO: 2572358 - RNA, 22 nt, Human
ucggagccucauccgaggcagg

SEQ ID NO: 2572359 - RNA, 21 nt, Human
ucggaaaccuugguguaguug

SEQ ID NO: 2572360 - RNA, 21 nt, Human
ucggagacagugaucuccaua

SEQ ID NO: 2572361 - RNA, 23 nt, Human
ucgcuugugcagaaaacauuguu

SEQ ID NO: 2572362 - RNA, 19 nt, Human
ucgcuuuauuggcugagau

SEQ ID NO: 2572363 - RNA, 15 nt, Human
ucgcuuuugauaauc

SEQ ID NO: 2572364 - RNA, 23 nt, Human
ucgcccagucuggaaugcagugg

SEQ ID NO: 2572365 - RNA, 19 nt, Human
ucgcccagucuggaaugca

SEQ ID NO: 2572366 - RNA, 14 nt, Human
ucgcccagucugga

SEQ ID NO: 2572367 - RNA, 21 nt, Human
ucgccaccuggcauuccuucu

SEQ ID NO: 2572368 - RNA, 18 nt, Human
ucgccaccuggcauuccu

SEQ ID NO: 2572369 - RNA, 18 nt, Human
ucgccaccccuccuuccu

SEQ ID NO: 2572370 - RNA, 13 nt, Human
ucgcauuugucaa

SEQ ID NO: 2572371 - RNA, 15 nt, Human
ucgcauuugucaaug

SEQ ID NO: 2572372 - RNA, 15 nt, Human
ucggaaaacaugcua

SEQ ID NO: 2572373 - RNA, 18 nt, Human
ucggaaaacaugcuacac

SEQ ID NO: 2572374 - RNA, 21 nt, Human
ucgcuucuugccucugugcug

SEQ ID NO: 2572375 - RNA, 21 nt, Human
ucgcuugugcagaaaacauug

SEQ ID NO: 2572376 - RNA, 20 nt, Human
ucgcuugugcagaaaacauu

SEQ ID NO: 2572377 - RNA, 19 nt, Human
ucgcuucuugccucugugc

SEQ ID NO: 2572378 - RNA, 20 nt, Human
ucgauacugcgacuuucugc

SEQ ID NO: 2572379 - RNA, 19 nt, Human
ucgauacugcgacuuucug

SEQ ID NO: 2572380 - RNA, 23 nt, Human
ucgaugggggagucugaagcaga

SEQ ID NO: 2572381 - RNA, 14 nt, Human
ucgaugcaaugaac

SEQ ID NO: 2572382 - RNA, 23 nt, Human
ucgaugaagcccaauaaaccucu

SEQ ID NO: 2572383 - RNA, 23 nt, Human
ucgauacugcgacuuucugccug

SEQ ID NO: 2572384 - RNA, 22 nt, Human
ucgauacugcgacuuucugccu

SEQ ID NO: 2572385 - RNA, 19 nt, Human
ucgaugaagcccaauaaac

SEQ ID NO: 2572386 - RNA, 18 nt, Human
uccuuuucgcaggauucu

SEQ ID NO: 2572387 - RNA, 20 nt, Human
uccuuuguguuucuauugac

SEQ ID NO: 2572388 - RNA, 15 nt, Human
uccuuuguguuucua

SEQ ID NO: 2572389 - RNA, 23 nt, Human
uccuuuguauauuauuucuagga

SEQ ID NO: 2572390 - RNA, 22 nt, Human
uccuuuucgcaggauucuuccu

SEQ ID NO: 2572391 - RNA, 23 nt, Human
ucgcaucaaaagacaauucuuua

SEQ ID NO: 2572392 - RNA, 22 nt, Human
ucgcaucaaaagacaauucuuu

SEQ ID NO: 2572393 - RNA, 21 nt, Human
ucgcaucaaaagacaauucuu

SEQ ID NO: 2572394 - RNA, 19 nt, Human
ucgcauggucacacacuga

SEQ ID NO: 2572395 - RNA, 20 nt, Human
ucgcauggucacacacugau

SEQ ID NO: 2572396 - RNA, 20 nt, Human
ucgcaucaaaagacaauucu

SEQ ID NO: 2572397 - RNA, 17 nt, Human
ucgcaucaaaagacaau

SEQ ID NO: 2572398 - RNA, 15 nt, Human
ucgcaucaaaagaca

SEQ ID NO: 2572399 - RNA, 14 nt, Human
ucgcaucaaaagac

SEQ ID NO: 2572400 - RNA, 21 nt, Human
ucgcaggauucuuccucccuc

SEQ ID NO: 2572401 - RNA, 23 nt, Human
ucgcaggauucuuccucccuccc

SEQ ID NO: 2572402 - RNA, 16 nt, Human
ucgauguuauguaaaa

SEQ ID NO: 2572403 - RNA, 20 nt, Human
ucgauuauucccuguacaau

SEQ ID NO: 2572404 - RNA, 15 nt, Human
ucgauucauauugaa

SEQ ID NO: 2572405 - RNA, 20 nt, Human
uccuuucuuuuucuucuucc

SEQ ID NO: 2572406 - RNA, 17 nt, Human
ucgcaggauucuuccuc

SEQ ID NO: 2572407 - RNA, 21 nt, Human
uccuuaccagcagagcaccuu

SEQ ID NO: 2572408 - RNA, 20 nt, Human
uccuuaccagcagagcaccu

SEQ ID NO: 2572409 - RNA, 14 nt, Human
uccuuacccaucug

SEQ ID NO: 2572410 - RNA, 18 nt, Human
uccuuacccaucugcacc

SEQ ID NO: 2572411 - RNA, 14 nt, Human
uccuuaccucuucc

SEQ ID NO: 2572412 - RNA, 16 nt, Human
uccugucccaccaugc

SEQ ID NO: 2572413 - RNA, 17 nt, Human
uccuguccagcuccaac

SEQ ID NO: 2572414 - RNA, 19 nt, Human
uccugucccucauccauag

SEQ ID NO: 2572415 - RNA, 21 nt, Human
uccugucccuucucuuaauuu

SEQ ID NO: 2572416 - RNA, 18 nt, Human
uccugucccuucucuuaa

SEQ ID NO: 2572417 - RNA, 14 nt, Human
uccuguccagagag

SEQ ID NO: 2572418 - RNA, 16 nt, Human
uccugaggcuuuggau

SEQ ID NO: 2572419 - RNA, 17 nt, Human
uccugaggcuuuggauu

SEQ ID NO: 2572420 - RNA, 18 nt, Human
uccugaggcuuuggauuu

SEQ ID NO: 2572421 - RNA, 13 nt, Human
uccugaggcugag

SEQ ID NO: 2572422 - RNA, 15 nt, Human
uccugaggggcaucu

SEQ ID NO: 2572423 - RNA, 16 nt, Human
uccugaggggcaucug

SEQ ID NO: 2572424 - RNA, 19 nt, Human
uccugaggggcaucugccc

SEQ ID NO: 2572425 - RNA, 13 nt, Human
uccuguccagcuc

SEQ ID NO: 2572426 - RNA, 14 nt, Human
uccuguccagcucc

SEQ ID NO: 2572427 - RNA, 15 nt, Human
uccuguccagcucca

SEQ ID NO: 2572428 - RNA, 16 nt, Human
uccuguccagcuccaa

SEQ ID NO: 2572429 - RNA, 18 nt, Human
uccuguccaaccuaaccc

SEQ ID NO: 2572430 - RNA, 22 nt, Human
uccuguccacacccagcucagc

SEQ ID NO: 2572431 - RNA, 19 nt, Human
uccuguccacacccagcuc

SEQ ID NO: 2572432 - RNA, 17 nt, Human
uccuguccacacccagc

SEQ ID NO: 2572433 - RNA, 20 nt, Human
uccuguccaaccuaaccccu

SEQ ID NO: 2572434 - RNA, 14 nt, Human
uccuuaucaaagga

SEQ ID NO: 2572435 - RNA, 15 nt, Human
uccuuaucaaaggac

SEQ ID NO: 2572436 - RNA, 23 nt, Human
uccuuagcuuagaccucagccug

SEQ ID NO: 2572437 - RNA, 22 nt, Human
uccuuagguuuuuuuccuucug

SEQ ID NO: 2572438 - RNA, 15 nt, Human
uccuuagucuucuca

SEQ ID NO: 2572439 - RNA, 16 nt, Human
uccuuagucuucucau

SEQ ID NO: 2572440 - RNA, 17 nt, Human
uccuuagucuucucaua

SEQ ID NO: 2572441 - RNA, 20 nt, Human
uccuuaccuuuuuauuugca

SEQ ID NO: 2572442 - RNA, 15 nt, Human
uccuuaccuuuuuau

SEQ ID NO: 2572443 - RNA, 17 nt, Human
uccuuaccucuuccgga

SEQ ID NO: 2572444 - RNA, 23 nt, Human
uccuugaaaacacuguucucugc

SEQ ID NO: 2572445 - RNA, 22 nt, Human
uccuugaaaacacuguucucug

SEQ ID NO: 2572446 - RNA, 16 nt, Human
uccuucuuugauaaug

SEQ ID NO: 2572447 - RNA, 13 nt, Human
uccuucuuugaua

SEQ ID NO: 2572448 - RNA, 22 nt, Human
uccuucuuucuaguucagcugc

SEQ ID NO: 2572449 - RNA, 17 nt, Human
uccuuaucaaaggacac

SEQ ID NO: 2572450 - RNA, 18 nt, Human
uccuuagucuucucauag

SEQ ID NO: 2572451 - RNA, 22 nt, Human
uccuuagucuucucauagcauu

SEQ ID NO: 2572452 - RNA, 21 nt, Human
uccuuaucacugacacaaaaa

SEQ ID NO: 2572453 - RNA, 17 nt, Human
uccuugcaucaauuuuu

SEQ ID NO: 2572454 - RNA, 18 nt, Human
uccuugaagaacugcagg

SEQ ID NO: 2572455 - RNA, 20 nt, Human
uccuucuuugauaauguuaa

SEQ ID NO: 2572456 - RNA, 19 nt, Human
uccuucuuugauaauguua

SEQ ID NO: 2572457 - RNA, 22 nt, Human
uccuucuuugauaauguuaaau

SEQ ID NO: 2572458 - RNA, 14 nt, Human
uccuugcucugcac

SEQ ID NO: 2572459 - RNA, 21 nt, Human
uccuugcucucccucuucuca

SEQ ID NO: 2572460 - RNA, 20 nt, Human
uccuugcucucccucuucuc

SEQ ID NO: 2572461 - RNA, 19 nt, Human
uccuugcucucccucuucu

SEQ ID NO: 2572462 - RNA, 14 nt, Human
uccuugcucucccu

SEQ ID NO: 2572463 - RNA, 13 nt, Human
uccuugcucuccc

SEQ ID NO: 2572464 - RNA, 15 nt, Human
uccuugcuaugauga

SEQ ID NO: 2572465 - RNA, 19 nt, Human
uccuugaagaacugcaggc

SEQ ID NO: 2572466 - RNA, 16 nt, Human
uccuugccuccugugu

SEQ ID NO: 2572467 - RNA, 17 nt, Human
uccuugccuccugugua

SEQ ID NO: 2572468 - RNA, 14 nt, Human
uccuugcuacccag

SEQ ID NO: 2572469 - RNA, 18 nt, Human
uccuugccuccuguguaa

SEQ ID NO: 2572470 - RNA, 21 nt, Human
uccuuggugucgggcaugaca

SEQ ID NO: 2572471 - RNA, 18 nt, Human
uccuuggugucgggcaug

SEQ ID NO: 2572472 - RNA, 14 nt, Human
uccuugcucugcag

SEQ ID NO: 2572473 - RNA, 15 nt, Human
uccuugcucugcacc

SEQ ID NO: 2572474 - RNA, 17 nt, Human
uccuugcuguccuaggc

SEQ ID NO: 2572475 - RNA, 19 nt, Human
uccuugcuguccuaggcca

SEQ ID NO: 2572476 - RNA, 14 nt, Human
uccuuggugccugg

SEQ ID NO: 2572477 - RNA, 16 nt, Human
uccuugcucugcaggc

SEQ ID NO: 2572478 - RNA, 16 nt, Human
uccuuggggcaggcag

SEQ ID NO: 2572479 - RNA, 21 nt, Human
uccuugcuguccuaggccaca

SEQ ID NO: 2572480 - RNA, 22 nt, Human
uccuuggugucgggcaugacac

SEQ ID NO: 2572481 - RNA, 20 nt, Human
uccuuugaagaggaaaauga

SEQ ID NO: 2572482 - RNA, 20 nt, Human
uccuuugaauccucucucug

SEQ ID NO: 2572483 - RNA, 18 nt, Human
uccuuggugccuggccug

SEQ ID NO: 2572484 - RNA, 14 nt, Human
uccuuugaagagga

SEQ ID NO: 2572485 - RNA, 17 nt, Human
uccuuggggcaggcagu

SEQ ID NO: 2572486 - RNA, 20 nt, Human
uccuuugauaaaauaaauga

SEQ ID NO: 2572487 - RNA, 15 nt, Human
uccuuugaagaggaa

SEQ ID NO: 2572488 - RNA, 21 nt, Human
uccuuugaauccucucucugu

SEQ ID NO: 2572489 - RNA, 17 nt, Human
uccuuugcacugagggc

SEQ ID NO: 2572490 - RNA, 15 nt, Human
uccuuugcacugagg

SEQ ID NO: 2572491 - RNA, 14 nt, Human
uccuuugcacugag

SEQ ID NO: 2572492 - RNA, 22 nt, Human
uccuuugaucaguauaauuuuu

SEQ ID NO: 2572493 - RNA, 15 nt, Human
uccuuugcaggcuca

SEQ ID NO: 2572494 - RNA, 22 nt, Human
uccuuuggagcuuuuuucuuua

SEQ ID NO: 2572495 - RNA, 20 nt, Human
uccuuugcacugagggccac

SEQ ID NO: 2572496 - RNA, 13 nt, Human
uccuuugggaaag

SEQ ID NO: 2572497 - RNA, 22 nt, Human
uccuuugugaggaagccgcugg

SEQ ID NO: 2572498 - RNA, 18 nt, Human
uccuuugugaggaagccg

SEQ ID NO: 2572499 - RNA, 17 nt, Human
uccuuugugaggaagcc

SEQ ID NO: 2572500 - RNA, 19 nt, Human
uccuuuguauauuauuucu

SEQ ID NO: 2572501 - RNA, 11 nt, Human
uccuuuguaua

SEQ ID NO: 2572502 - RNA, 18 nt, Human
uccuuuguacuuugugcu

SEQ ID NO: 2572503 - RNA, 13 nt, Human
uccuuuguacuuu

SEQ ID NO: 2572504 - RNA, 20 nt, Human
ucucagauccuuguuucaaa

SEQ ID NO: 2572505 - RNA, 19 nt, Human
ucucaguuugugugucuua

SEQ ID NO: 2572506 - RNA, 18 nt, Human
ucucaguuugugugucuu

SEQ ID NO: 2572507 - RNA, 15 nt, Human
ucucaguuuucauaa

SEQ ID NO: 2572508 - RNA, 16 nt, Human
ucucaguuuucauaag

SEQ ID NO: 2572509 - RNA, 17 nt, Human
ucucaguuugugugucu

SEQ ID NO: 2572510 - RNA, 16 nt, Human
ucucaguuuguguguc

SEQ ID NO: 2572511 - RNA, 13 nt, Human
ucucaguuucacu

SEQ ID NO: 2572512 - RNA, 15 nt, Human
ucucacuguugccca

SEQ ID NO: 2572513 - RNA, 14 nt, Human
ucucacuguugccc

SEQ ID NO: 2572514 - RNA, 20 nt, Human
ucucacugugggaaggccag

SEQ ID NO: 2572515 - RNA, 17 nt, Human
ucucacuggaugcaaag

SEQ ID NO: 2572516 - RNA, 22 nt, Human
ucucacuguucccucugcuccu

SEQ ID NO: 2572517 - RNA, 21 nt, Human
ucucacuguucccucugcucc

SEQ ID NO: 2572518 - RNA, 18 nt, Human
ucucacuguucccucugc

SEQ ID NO: 2572519 - RNA, 17 nt, Human
ucucacuguucccucug

SEQ ID NO: 2572520 - RNA, 16 nt, Human
ucucacuguucccucu

SEQ ID NO: 2572521 - RNA, 21 nt, Human
ucucacugugggaaggccagc

SEQ ID NO: 2572522 - RNA, 14 nt, Human
ucucacuguucccu

SEQ ID NO: 2572523 - RNA, 22 nt, Human
ucucagauccuuguuucaaaca

SEQ ID NO: 2572524 - RNA, 19 nt, Human
ucucagauccuuguuucaa

SEQ ID NO: 2572525 - RNA, 18 nt, Human
ucucagauccuuguuuca

SEQ ID NO: 2572526 - RNA, 17 nt, Human
ucucagauccuuguuuc

SEQ ID NO: 2572527 - RNA, 16 nt, Human
ucucagauccuuguuu

SEQ ID NO: 2572528 - RNA, 14 nt, Human
ucucagauccuugu

SEQ ID NO: 2572529 - RNA, 20 nt, Human
ucucagauauuuauauuuuu

SEQ ID NO: 2572530 - RNA, 23 nt, Human
ucucagauauuuauauuuuuauu

SEQ ID NO: 2572531 - RNA, 17 nt, Human
ucucagacccuuuagcc

SEQ ID NO: 2572532 - RNA, 16 nt, Human
ucucagacugcaugua

SEQ ID NO: 2572533 - RNA, 21 nt, Human
ucucagacuuuggaaaaugca

SEQ ID NO: 2572534 - RNA, 20 nt, Human
ucucagagcuacuugggcca

SEQ ID NO: 2572535 - RNA, 19 nt, Human
ucucagagcuacuugggcc

SEQ ID NO: 2572536 - RNA, 22 nt, Human
ucucagacuuuggaaaaugcau

SEQ ID NO: 2572537 - RNA, 21 nt, Human
ucucagagcuacuugggccau

SEQ ID NO: 2572538 - RNA, 14 nt, Human
ucucagauauuuau

SEQ ID NO: 2572539 - RNA, 16 nt, Human
ucucagauauuuauau

SEQ ID NO: 2572540 - RNA, 13 nt, Human
ucucaaauuucua

SEQ ID NO: 2572541 - RNA, 20 nt, Human
ucuaucuugcucuguaaucu

SEQ ID NO: 2572542 - RNA, 19 nt, Human
ucuaucuugcucuguaauc

SEQ ID NO: 2572543 - RNA, 17 nt, Human
ucuaucuugcucuguaa

SEQ ID NO: 2572544 - RNA, 22 nt, Human
ucuaucuuugagcgcccacuag

SEQ ID NO: 2572545 - RNA, 14 nt, Human
ucucaaauuucuaa

SEQ ID NO: 2572546 - RNA, 16 nt, Human
ucucaaauuucuaaau

SEQ ID NO: 2572547 - RNA, 23 nt, Human
ucuaucauuuuuguacaguuugc

SEQ ID NO: 2572548 - RNA, 17 nt, Human
ucuauccacagagaguc

SEQ ID NO: 2572549 - RNA, 15 nt, Human
ucuauccacagagag

SEQ ID NO: 2572550 - RNA, 14 nt, Human
ucuauccacagaga

SEQ ID NO: 2572551 - RNA, 19 nt, Human
ucuaucauuuuuguacagu

SEQ ID NO: 2572552 - RNA, 14 nt, Human
ucuauccucuguaa

SEQ ID NO: 2572553 - RNA, 12 nt, Human
ucuaucucaucu

SEQ ID NO: 2572554 - RNA, 16 nt, Human
ucuauccuacaacaag

SEQ ID NO: 2572555 - RNA, 16 nt, Human
ucuaucuuauauaguu

SEQ ID NO: 2572556 - RNA, 21 nt, Human
ucucacacaugagcaucaggc

SEQ ID NO: 2572557 - RNA, 23 nt, Human
ucucacucugucgcccagucugg

SEQ ID NO: 2572558 - RNA, 22 nt, Human
ucucacugagaagauugugaau

SEQ ID NO: 2572559 - RNA, 21 nt, Human
ucucacugagaagauugugaa

SEQ ID NO: 2572560 - RNA, 20 nt, Human
ucucacugccaugccagcuu

SEQ ID NO: 2572561 - RNA, 12 nt, Human
ucucaauuucua

SEQ ID NO: 2572562 - RNA, 18 nt, Human
ucucaaauuucuaaaucu

SEQ ID NO: 2572563 - RNA, 16 nt, Human
ucucacacaugagcau

SEQ ID NO: 2572564 - RNA, 13 nt, Human
ucucaauuuuugg

SEQ ID NO: 2572565 - RNA, 22 nt, Human
ucucaauuuuugguugaauaaa

SEQ ID NO: 2572566 - RNA, 16 nt, Human
ucgucuuaacucacca

SEQ ID NO: 2572567 - RNA, 17 nt, Human
ucuaauauuaaaaauau

SEQ ID NO: 2572568 - RNA, 16 nt, Human
ucgucugacugugugu

SEQ ID NO: 2572569 - RNA, 15 nt, Human
ucgucugacugugug

SEQ ID NO: 2572570 - RNA, 18 nt, Human
ucgucuguuuauaaacau

SEQ ID NO: 2572571 - RNA, 21 nt, Human
ucgucuccagccccuucucag

SEQ ID NO: 2572572 - RNA, 16 nt, Human
ucgucgcacagucucu

SEQ ID NO: 2572573 - RNA, 19 nt, Human
ucgucggggggacagcucc

SEQ ID NO: 2572574 - RNA, 14 nt, Human
ucgucgcacagucu

SEQ ID NO: 2572575 - RNA, 18 nt, Human
ucguccucccccugccag

SEQ ID NO: 2572576 - RNA, 23 nt, Human
ucguccucccccugccagugccu

SEQ ID NO: 2572577 - RNA, 23 nt, Human
ucgucaucauuuuuccuucccuu

SEQ ID NO: 2572578 - RNA, 14 nt, Human
ucguccucccccug

SEQ ID NO: 2572579 - RNA, 16 nt, Human
ucguccucccccugcc

SEQ ID NO: 2572580 - RNA, 17 nt, Human
ucguccucccccugcca

SEQ ID NO: 2572581 - RNA, 13 nt, Human
ucguccucccccu

SEQ ID NO: 2572582 - RNA, 12 nt, Human
ucguccagggag

SEQ ID NO: 2572583 - RNA, 20 nt, Human
ucuaaugugguuauuucucu

SEQ ID NO: 2572584 - RNA, 19 nt, Human
ucuaaugugguuauuucuc

SEQ ID NO: 2572585 - RNA, 11 nt, Human
ucuaauguggu

SEQ ID NO: 2572586 - RNA, 17 nt, Human
ucuaaugucuucauuuc

SEQ ID NO: 2572587 - RNA, 15 nt, Human
ucuaaugucuucauu

SEQ ID NO: 2572588 - RNA, 14 nt, Human
ucuaaugucuucau

SEQ ID NO: 2572589 - RNA, 24 nt, Human
ucuaauguauuuuauuguaacaga

SEQ ID NO: 2572590 - RNA, 17 nt, Human
ucuaauguauuuuauug

SEQ ID NO: 2572591 - RNA, 20 nt, Human
ucuaauggguauuuaaacaa

SEQ ID NO: 2572592 - RNA, 15 nt, Human
ucuaauguauuuuau

SEQ ID NO: 2572593 - RNA, 20 nt, Human
ucuaaucuagauaucgacuu

SEQ ID NO: 2572594 - RNA, 19 nt, Human
ucuaaucuagauaucgacu

SEQ ID NO: 2572595 - RNA, 20 nt, Human
ucuaauauuuauugcuuuau

SEQ ID NO: 2572596 - RNA, 18 nt, Human
ucuaauauuaaaaauaug

SEQ ID NO: 2572597 - RNA, 22 nt, Human
ucuaauauuuauugcuuuauaa

SEQ ID NO: 2572598 - RNA, 15 nt, Human
ucuacuaauuccaca

SEQ ID NO: 2572599 - RNA, 14 nt, Human
ucuacuauuuaugu

SEQ ID NO: 2572600 - RNA, 16 nt, Human
ucuaauuuuggaugga

SEQ ID NO: 2572601 - RNA, 15 nt, Human
ucuaauuuuggaugg

SEQ ID NO: 2572602 - RNA, 20 nt, Human
ucuaauuucaaaaauauaac

SEQ ID NO: 2572603 - RNA, 15 nt, Human
ucuacuaaaaaugca

SEQ ID NO: 2572604 - RNA, 19 nt, Human
ucuacuaaaaauacaaaaa

SEQ ID NO: 2572605 - RNA, 15 nt, Human
ucuacuaaaaauaca

SEQ ID NO: 2572606 - RNA, 12 nt, Human
ucuacuaaaaau

SEQ ID NO: 2572607 - RNA, 22 nt, Human
ucuaauuucaaaaauauaacuu

SEQ ID NO: 2572608 - RNA, 19 nt, Human
ucuaauuucaaaaauauaa

SEQ ID NO: 2572609 - RNA, 23 nt, Human
ucuaauuuaucuugucucugggc

SEQ ID NO: 2572610 - RNA, 22 nt, Human
ucuaauuuaucuugucucuggg

SEQ ID NO: 2572611 - RNA, 22 nt, Human
ucuaauuggaagaaauuccugu

SEQ ID NO: 2572612 - RNA, 20 nt, Human
ucuaauuggaagaaauuccu

SEQ ID NO: 2572613 - RNA, 18 nt, Human
ucuacucuuaagccaucu

SEQ ID NO: 2572614 - RNA, 17 nt, Human
ucuacucuuaagccauc

SEQ ID NO: 2572615 - RNA, 16 nt, Human
ucuacucuuaagccau

SEQ ID NO: 2572616 - RNA, 18 nt, Human
ucuaggaggucucuaaga

SEQ ID NO: 2572617 - RNA, 18 nt, Human
ucuaggcaucccagggga

SEQ ID NO: 2572618 - RNA, 18 nt, Human
ucuacucuagggaaaaac

SEQ ID NO: 2572619 - RNA, 13 nt, Human
ucuacucucccau

SEQ ID NO: 2572620 - RNA, 21 nt, Human
ucuacucccaaguaugggguu

SEQ ID NO: 2572621 - RNA, 18 nt, Human
ucuacucucccauggcuu

SEQ ID NO: 2572622 - RNA, 20 nt, Human
ucuacucuccucaucucuaa

SEQ ID NO: 2572623 - RNA, 22 nt, Human
ucuacuccuaccucagccuaga

SEQ ID NO: 2572624 - RNA, 19 nt, Human
ucuacuccuuguaaagacu

SEQ ID NO: 2572625 - RNA, 21 nt, Human
ucuacucgaguuacagacaaa

SEQ ID NO: 2572626 - RNA, 20 nt, Human
ucuacucgaguuacagacaa

SEQ ID NO: 2572627 - RNA, 18 nt, Human
ucuacuaauuccacaccu

SEQ ID NO: 2572628 - RNA, 14 nt, Human
ucuacucagaaauu

SEQ ID NO: 2572629 - RNA, 21 nt, Human
ucuacucagaaauuuuuauuu

SEQ ID NO: 2572630 - RNA, 14 nt, Human
ucuacucauauaua

SEQ ID NO: 2572631 - RNA, 17 nt, Human
ucuacuccuaccucagc

SEQ ID NO: 2572632 - RNA, 19 nt, Human
ucuacuccuaccucagccu

SEQ ID NO: 2572633 - RNA, 18 nt, Human
ucuacucauuccccgggg

SEQ ID NO: 2572634 - RNA, 18 nt, Human
ucuacucauauauaucua

SEQ ID NO: 2572635 - RNA, 23 nt, Human
ucuauauguacuugucaaagaag

SEQ ID NO: 2572636 - RNA, 21 nt, Human
ucuauauguacuugucaaaga

SEQ ID NO: 2572637 - RNA, 20 nt, Human
ucuauauguacuugucaaag

SEQ ID NO: 2572638 - RNA, 18 nt, Human
ucuauauguacuugucaa

SEQ ID NO: 2572639 - RNA, 13 nt, Human
ucuauauguacuu

SEQ ID NO: 2572640 - RNA, 20 nt, Human
ucuagguuuaacucagauca

SEQ ID NO: 2572641 - RNA, 21 nt, Human
ucuauaugaauuuaaauauaa

SEQ ID NO: 2572642 - RNA, 19 nt, Human
ucuagguuuaacucagauc

SEQ ID NO: 2572643 - RNA, 17 nt, Human
ucuagguuuaacucaga

SEQ ID NO: 2572644 - RNA, 23 nt, Human
ucuagguucuaaaaauugugauc

SEQ ID NO: 2572645 - RNA, 20 nt, Human
ucuagguggcaaggcugugc

SEQ ID NO: 2572646 - RNA, 18 nt, Human
ucuagguggcaaggcugu

SEQ ID NO: 2572647 - RNA, 14 nt, Human
ucuagguucuaaaa

SEQ ID NO: 2572648 - RNA, 23 nt, Human
ucuaggugcccuuggaggccagc

SEQ ID NO: 2572649 - RNA, 17 nt, Human
ucuagguggcaaggcug

SEQ ID NO: 2572650 - RNA, 15 nt, Human
ucuagguaaauuaca

SEQ ID NO: 2572651 - RNA, 12 nt, Human
ucuaggcugggg

SEQ ID NO: 2572652 - RNA, 20 nt, Human
ucuagguaggggcccacuuc

SEQ ID NO: 2572653 - RNA, 17 nt, Human
ucuagguagugcccuau

SEQ ID NO: 2572654 - RNA, 12 nt, Human
ucuagggaaaaa

SEQ ID NO: 2572655 - RNA, 21 nt, Human
uggaauaaaauauuuuuuuca

SEQ ID NO: 2572656 - RNA, 19 nt, Human
uggaauaaaauacuauuuu

SEQ ID NO: 2572657 - RNA, 18 nt, Human
uggaauaaaauacuauuu

SEQ ID NO: 2572658 - RNA, 15 nt, Human
uggaauaaaauacua

SEQ ID NO: 2572659 - RNA, 15 nt, Human
uggaauaaguucaaa

SEQ ID NO: 2572660 - RNA, 17 nt, Human
uggaauaaggagaauga

SEQ ID NO: 2572661 - RNA, 22 nt, Human
uggaauaauccuaaacauauga

SEQ ID NO: 2572662 - RNA, 16 nt, Human
uggaauauauaaccag

SEQ ID NO: 2572663 - RNA, 13 nt, Human
uggaauaguuuuu

SEQ ID NO: 2572664 - RNA, 21 nt, Human
uggaauauaaggaaagcaaua

SEQ ID NO: 2572665 - RNA, 15 nt, Human
uggaauauauaacca

SEQ ID NO: 2572666 - RNA, 23 nt, Human
uggaauaguauccuccagguuuu

SEQ ID NO: 2572667 - RNA, 22 nt, Human
uggaauaguauccuccagguuu

SEQ ID NO: 2572668 - RNA, 13 nt, Human
uggaauauaaaga

SEQ ID NO: 2572669 - RNA, 14 nt, Human
uggaauauaaggaa

SEQ ID NO: 2572670 - RNA, 18 nt, Human
uggaauauaaggaaagca

SEQ ID NO: 2572671 - RNA, 13 nt, Human
uggaauaaaauac

SEQ ID NO: 2572672 - RNA, 14 nt, Human
uggaaguuuugcau

SEQ ID NO: 2572673 - RNA, 14 nt, Human
uggaauaacaugua

SEQ ID NO: 2572674 - RNA, 15 nt, Human
uggaauaacauguaa

SEQ ID NO: 2572675 - RNA, 19 nt, Human
uggaauaacauguaauuaa

SEQ ID NO: 2572676 - RNA, 16 nt, Human
uggaacucauuccugc

SEQ ID NO: 2572677 - RNA, 19 nt, Human
uggaacucauuccugccug

SEQ ID NO: 2572678 - RNA, 21 nt, Human
uggaacucauuccugccuguc

SEQ ID NO: 2572679 - RNA, 21 nt, Human
uggaacguuuuuccuguucuu

SEQ ID NO: 2572680 - RNA, 13 nt, Human
uggaaugcuugaa

SEQ ID NO: 2572681 - RNA, 20 nt, Human
uggaaugcuucuucucaggc

SEQ ID NO: 2572682 - RNA, 18 nt, Human
uggaaugcuucuucucag

SEQ ID NO: 2572683 - RNA, 24 nt, Human
uggaaugcuuccuagaaguuacug

SEQ ID NO: 2572684 - RNA, 17 nt, Human
uggaaugggcagcucau

SEQ ID NO: 2572685 - RNA, 22 nt, Human
uggaaugcuugaaaaaugugca

SEQ ID NO: 2572686 - RNA, 20 nt, Human
uggaaugaugggucaguugu

SEQ ID NO: 2572687 - RNA, 17 nt, Human
uggaaugcuuccuagaa

SEQ ID NO: 2572688 - RNA, 16 nt, Human
uggaaugcuuccuaga

SEQ ID NO: 2572689 - RNA, 16 nt, Human
uggaaugcuguguuaa

SEQ ID NO: 2572690 - RNA, 18 nt, Human
uggaaugaauuaaauaaa

SEQ ID NO: 2572691 - RNA, 17 nt, Human
uggaaugaauuaaauaa

SEQ ID NO: 2572692 - RNA, 17 nt, Human
uggacagaagcagcucu

SEQ ID NO: 2572693 - RNA, 18 nt, Human
uggacagaagcagcucuu

SEQ ID NO: 2572694 - RNA, 22 nt, Human
uggacagacagaggaugagcuc

SEQ ID NO: 2572695 - RNA, 16 nt, Human
uggacagacagaggau

SEQ ID NO: 2572696 - RNA, 15 nt, Human
uggacagaagcagcu

SEQ ID NO: 2572697 - RNA, 16 nt, Human
uggacagaagcagcuc

SEQ ID NO: 2572698 - RNA, 22 nt, Human
uggacacuuugaaauguguuuc

SEQ ID NO: 2572699 - RNA, 21 nt, Human
uggacacuuugaaauguguuu

SEQ ID NO: 2572700 - RNA, 18 nt, Human
uggaaugguuauaaaagu

SEQ ID NO: 2572701 - RNA, 17 nt, Human
uggaaugguuauaaaag

SEQ ID NO: 2572702 - RNA, 23 nt, Human
uggacacuuugaaauguguuucu

SEQ ID NO: 2572703 - RNA, 12 nt, Human
uggacagaagaa

SEQ ID NO: 2572704 - RNA, 18 nt, Human
uggacaugaagauucuuu

SEQ ID NO: 2572705 - RNA, 18 nt, Human
uggacauccucuucugcu

SEQ ID NO: 2572706 - RNA, 21 nt, Human
uggacaugaagauucuuuccc

SEQ ID NO: 2572707 - RNA, 22 nt, Human
uggacaugaagauucuuuccca

SEQ ID NO: 2572708 - RNA, 23 nt, Human
uggacauccuccucccacccggc

SEQ ID NO: 2572709 - RNA, 20 nt, Human
uggacauccuccucccaccc

SEQ ID NO: 2572710 - RNA, 12 nt, Human
uggacagcccca

SEQ ID NO: 2572711 - RNA, 18 nt, Human
uggacauccuccucccac

SEQ ID NO: 2572712 - RNA, 19 nt, Human
uggacaugcacagcuaaca

SEQ ID NO: 2572713 - RNA, 13 nt, Human
uggacaugcacag

SEQ ID NO: 2572714 - RNA, 18 nt, Human
uggacucaccucccccau

SEQ ID NO: 2572715 - RNA, 20 nt, Human
uggacucaccucccccaucu

SEQ ID NO: 2572716 - RNA, 23 nt, Human
uggacuaucugucugguggcccc

SEQ ID NO: 2572717 - RNA, 22 nt, Human
uggacuaucugucugguggccc

SEQ ID NO: 2572718 - RNA, 18 nt, Human
uggacuauuauaauuuaa

SEQ ID NO: 2572719 - RNA, 20 nt, Human
uggacuaucugucugguggc

SEQ ID NO: 2572720 - RNA, 17 nt, Human
uggacuaucugucuggu

SEQ ID NO: 2572721 - RNA, 15 nt, Human
uggacuaucugucug

SEQ ID NO: 2572722 - RNA, 14 nt, Human
uggacuaucugucu

SEQ ID NO: 2572723 - RNA, 16 nt, Human
uggacaugagauaaug

SEQ ID NO: 2572724 - RNA, 19 nt, Human
uggacauccucuucugcuu

SEQ ID NO: 2572725 - RNA, 24 nt, Human
uggacuacccacguucucacaccc

SEQ ID NO: 2572726 - RNA, 21 nt, Human
uggacuagagggaccucuccc

SEQ ID NO: 2572727 - RNA, 16 nt, Human
ugcuggagccugugua

SEQ ID NO: 2572728 - RNA, 15 nt, Human
ugcuggagccugugu

SEQ ID NO: 2572729 - RNA, 14 nt, Human
ugcuggagccugug

SEQ ID NO: 2572730 - RNA, 13 nt, Human
ugcuggagccugu

SEQ ID NO: 2572731 - RNA, 12 nt, Human
ugcuggagccug

SEQ ID NO: 2572732 - RNA, 11 nt, Human
ugcuggagccu

SEQ ID NO: 2572733 - RNA, 20 nt, Human
ugcuggagccacuaacuaga

SEQ ID NO: 2572734 - RNA, 19 nt, Human
ugcuggagccacuaacuag

SEQ ID NO: 2572735 - RNA, 19 nt, Human
ugcuggagccuguguaaca

SEQ ID NO: 2572736 - RNA, 17 nt, Human
ugcuggagccuguguaa

SEQ ID NO: 2572737 - RNA, 13 nt, Human
ugcuuuaauauca

SEQ ID NO: 2572738 - RNA, 15 nt, Human
ugcuuuaauaucauc

SEQ ID NO: 2572739 - RNA, 18 nt, Human
ugcuuuaauaucaucagu

SEQ ID NO: 2572740 - RNA, 20 nt, Human
ugcuuuaauaucaucaguau

SEQ ID NO: 2572741 - RNA, 19 nt, Human
ugcuuuaauuguuaagaua

SEQ ID NO: 2572742 - RNA, 22 nt, Human
ugcuggagaagagaggagagga

SEQ ID NO: 2572743 - RNA, 18 nt, Human
ugcuggagaagagaggag

SEQ ID NO: 2572744 - RNA, 13 nt, Human
ugcuggagaagag

SEQ ID NO: 2572745 - RNA, 20 nt, Human
ugcuggacggggacugggga

SEQ ID NO: 2572746 - RNA, 12 nt, Human
ugcuggagaggu

SEQ ID NO: 2572747 - RNA, 13 nt, Human
ugcuggagacucc

SEQ ID NO: 2572748 - RNA, 14 nt, Human
ugcuggagagguua

SEQ ID NO: 2572749 - RNA, 13 nt, Human
ugcuggagagguu

SEQ ID NO: 2572750 - RNA, 14 nt, Human
ugcuggagauguuu

SEQ ID NO: 2572751 - RNA, 18 nt, Human
ugcuggagccacuaacua

SEQ ID NO: 2572752 - RNA, 10 nt, Human
ugcuggagcc

SEQ ID NO: 2572753 - RNA, 21 nt, Human
ugcuggacggggacuggggau

SEQ ID NO: 2572754 - RNA, 14 nt, Human
ugcuggacugucau

SEQ ID NO: 2572755 - RNA, 15 nt, Human
ugcuggacugucaua

SEQ ID NO: 2572756 - RNA, 19 nt, Human
ugcuggacugucauagaaa

SEQ ID NO: 2572757 - RNA, 17 nt, Human
ugcuggaauucuaacaa

SEQ ID NO: 2572758 - RNA, 16 nt, Human
ugcuggacaguaucac

SEQ ID NO: 2572759 - RNA, 19 nt, Human
ugcuggacggcauuccugc

SEQ ID NO: 2572760 - RNA, 20 nt, Human
ugcuggacggcauuccugcu

SEQ ID NO: 2572761 - RNA, 14 nt, Human
ugcuuucugcucag

SEQ ID NO: 2572762 - RNA, 15 nt, Human
ugcuuucugcucagc

SEQ ID NO: 2572763 - RNA, 19 nt, Human
ugcuuucugcucagcuucu

SEQ ID NO: 2572764 - RNA, 20 nt, Human
ugcuuucugcucagcuucuc

SEQ ID NO: 2572765 - RNA, 12 nt, Human
ugcuuucugcuc

SEQ ID NO: 2572766 - RNA, 13 nt, Human
ugcuuucugcuca

SEQ ID NO: 2572767 - RNA, 14 nt, Human
ugcuuuacugucaa

SEQ ID NO: 2572768 - RNA, 23 nt, Human
ugcuuucuguugucauugcuguu

SEQ ID NO: 2572769 - RNA, 15 nt, Human
ugcuuucuuucguuu

SEQ ID NO: 2572770 - RNA, 22 nt, Human
ugcuuucuuucguuuguuuguu

SEQ ID NO: 2572771 - RNA, 20 nt, Human
uggaaaaauagccugccucu

SEQ ID NO: 2572772 - RNA, 12 nt, Human
uggaaaaauauu

SEQ ID NO: 2572773 - RNA, 18 nt, Human
ugcuuugacucaccuguu

SEQ ID NO: 2572774 - RNA, 13 nt, Human
uggaaaaauccag

SEQ ID NO: 2572775 - RNA, 18 nt, Human
uggaaaaaugagagaagg

SEQ ID NO: 2572776 - RNA, 18 nt, Human
uggaaaaauccagaaaga

SEQ ID NO: 2572777 - RNA, 19 nt, Human
uggaaaaauccagaaagaa

SEQ ID NO: 2572778 - RNA, 17 nt, Human
uggaaaaauagccugcc

SEQ ID NO: 2572779 - RNA, 22 nt, Human
ugcuuugaagcaguugugucag

SEQ ID NO: 2572780 - RNA, 19 nt, Human
ugcuuugaagcaguugugu

SEQ ID NO: 2572781 - RNA, 14 nt, Human
ugcuuugaagcagu

SEQ ID NO: 2572782 - RNA, 15 nt, Human
ugcuuugaagcaguu

SEQ ID NO: 2572783 - RNA, 20 nt, Human
uggaacauaaaauacaaugu

SEQ ID NO: 2572784 - RNA, 21 nt, Human
uggaacauaaaauacaauguu

SEQ ID NO: 2572785 - RNA, 20 nt, Human
uggaaagcaucaccucaggc

SEQ ID NO: 2572786 - RNA, 21 nt, Human
uggaaagcaucaccucaggcc

SEQ ID NO: 2572787 - RNA, 23 nt, Human
uggaacaucaucaaggcacugcc

SEQ ID NO: 2572788 - RNA, 21 nt, Human
uggaacaucaucaaggcacug

SEQ ID NO: 2572789 - RNA, 20 nt, Human
uggaaagaguaggaagacuu

SEQ ID NO: 2572790 - RNA, 14 nt, Human
uggaaagaguacuc

SEQ ID NO: 2572791 - RNA, 18 nt, Human
uggaaagauaacuaggaa

SEQ ID NO: 2572792 - RNA, 16 nt, Human
uggaaagaaucuaaua

SEQ ID NO: 2572793 - RNA, 23 nt, Human
uggaaagacagcuucucauccug

SEQ ID NO: 2572794 - RNA, 16 nt, Human
uggaaagcaucaccuc

SEQ ID NO: 2572795 - RNA, 19 nt, Human
uggaaagcaucaccucagg

SEQ ID NO: 2572796 - RNA, 23 nt, Human
uggaaagauaacuaggaaaucca

SEQ ID NO: 2572797 - RNA, 17 nt, Human
uggaaacagcucgacuu

SEQ ID NO: 2572798 - RNA, 17 nt, Human
uggaaaacaaggaaguc

SEQ ID NO: 2572799 - RNA, 23 nt, Human
uggaaacuucagcgguuuauaua

SEQ ID NO: 2572800 - RNA, 22 nt, Human
uggaaacagcucgacuuuaaaa

SEQ ID NO: 2572801 - RNA, 21 nt, Human
uggaaacuggaugaggucaua

SEQ ID NO: 2572802 - RNA, 21 nt, Human
uggaaagacuuuuccaacccu

SEQ ID NO: 2572803 - RNA, 21 nt, Human
uggaaacuguugccagagaug

SEQ ID NO: 2572804 - RNA, 14 nt, Human
uggaaacaggacca

SEQ ID NO: 2572805 - RNA, 17 nt, Human
uggaaacuguugccaga

SEQ ID NO: 2572806 - RNA, 19 nt, Human
uggaaagacagcuucucau

SEQ ID NO: 2572807 - RNA, 16 nt, Human
uggcaacagaucugga

SEQ ID NO: 2572808 - RNA, 17 nt, Human
uggcaacagaucuggaa

SEQ ID NO: 2572809 - RNA, 18 nt, Human
uggcaacagaucuggaac

SEQ ID NO: 2572810 - RNA, 20 nt, Human
uggcaacagaucuggaaccu

SEQ ID NO: 2572811 - RNA, 13 nt, Human
uggcaacagaucu

SEQ ID NO: 2572812 - RNA, 15 nt, Human
uggcaacagaucugg

SEQ ID NO: 2572813 - RNA, 14 nt, Human
uggcaacagaagug

SEQ ID NO: 2572814 - RNA, 15 nt, Human
uggcaacagaagcag

SEQ ID NO: 2572815 - RNA, 13 nt, Human
uggcaacagaagc

SEQ ID NO: 2572816 - RNA, 17 nt, Human
uggcaaaggaaggugga

SEQ ID NO: 2572817 - RNA, 22 nt, Human
uggcaaagggagcagaacugaa

SEQ ID NO: 2572818 - RNA, 21 nt, Human
uggcaaagggagcagaacuga

SEQ ID NO: 2572819 - RNA, 17 nt, Human
uggcaaauuaacuugag

SEQ ID NO: 2572820 - RNA, 12 nt, Human
uggcaacagaag

SEQ ID NO: 2572821 - RNA, 20 nt, Human
uggcaaauuaacuugaguuu

SEQ ID NO: 2572822 - RNA, 20 nt, Human
uggauuuucuauuguuacuc

SEQ ID NO: 2572823 - RNA, 19 nt, Human
uggauuuucuauuguuacu

SEQ ID NO: 2572824 - RNA, 22 nt, Human
uggauuuugguuuuguuccccu

SEQ ID NO: 2572825 - RNA, 17 nt, Human
uggauuuguuuaaaagg

SEQ ID NO: 2572826 - RNA, 16 nt, Human
uggauuuguuuaaaag

SEQ ID NO: 2572827 - RNA, 15 nt, Human
uggauuuguuuaaaa

SEQ ID NO: 2572828 - RNA, 13 nt, Human
uggauuugacauu

SEQ ID NO: 2572829 - RNA, 13 nt, Human
uggauuugaugcu

SEQ ID NO: 2572830 - RNA, 13 nt, Human
uggauuugaagca

SEQ ID NO: 2572831 - RNA, 14 nt, Human
uggauuugacauug

SEQ ID NO: 2572832 - RNA, 17 nt, Human
uggauuugccugugcca

SEQ ID NO: 2572833 - RNA, 18 nt, Human
uggauuugccugugccac

SEQ ID NO: 2572834 - RNA, 20 nt, Human
uggaucacagcugcuuucug

SEQ ID NO: 2572835 - RNA, 16 nt, Human
uggaucacagcugcuu

SEQ ID NO: 2572836 - RNA, 16 nt, Human
uggaucagaugaacuc

SEQ ID NO: 2572837 - RNA, 19 nt, Human
uggaucaguccuuugauca

SEQ ID NO: 2572838 - RNA, 15 nt, Human
uggaucuccaaggac

SEQ ID NO: 2572839 - RNA, 14 nt, Human
uggaucuccaagga

SEQ ID NO: 2572840 - RNA, 18 nt, Human
uggaucucauuggacccu

SEQ ID NO: 2572841 - RNA, 20 nt, Human
uggauccugaaauagaggcu

SEQ ID NO: 2572842 - RNA, 23 nt, Human
uggauccuagccuuauccucuga

SEQ ID NO: 2572843 - RNA, 13 nt, Human
uggauccuagccu

SEQ ID NO: 2572844 - RNA, 16 nt, Human
uggaucaguccuuuga

SEQ ID NO: 2572845 - RNA, 20 nt, Human
uggauuuaacagaaauguac

SEQ ID NO: 2572846 - RNA, 24 nt, Human
uggauuuaacagaaauguacagca

SEQ ID NO: 2572847 - RNA, 18 nt, Human
uggaucuccaaggaccag

SEQ ID NO: 2572848 - RNA, 14 nt, Human
uggauuuauaaaug

SEQ ID NO: 2572849 - RNA, 20 nt, Human
uggauuuauaaaugcuauuu

SEQ ID NO: 2572850 - RNA, 14 nt, Human
uggauuucagaaag

SEQ ID NO: 2572851 - RNA, 18 nt, Human
uggaggaaggaaacccag

SEQ ID NO: 2572852 - RNA, 12 nt, Human
uggaggaaggaa

SEQ ID NO: 2572853 - RNA, 20 nt, Human
uggaggaaggaaacccagcu

SEQ ID NO: 2572854 - RNA, 18 nt, Human
uggaggaagagggacaga

SEQ ID NO: 2572855 - RNA, 16 nt, Human
uggacucgccuguaau

SEQ ID NO: 2572856 - RNA, 15 nt, Human
uggacuccugcacac

SEQ ID NO: 2572857 - RNA, 14 nt, Human
uggacuccucuguc

SEQ ID NO: 2572858 - RNA, 15 nt, Human
uggacuccucugucc

SEQ ID NO: 2572859 - RNA, 15 nt, Human
uggacucucagucuc

SEQ ID NO: 2572860 - RNA, 20 nt, Human
uggacucucagucucugagc

SEQ ID NO: 2572861 - RNA, 17 nt, Human
uggacucuacacuguga

SEQ ID NO: 2572862 - RNA, 21 nt, Human
uggacucuacacugugaacuu

SEQ ID NO: 2572863 - RNA, 14 nt, Human
uggaggaaagcaac

SEQ ID NO: 2572864 - RNA, 13 nt, Human
uggacucugcaca

SEQ ID NO: 2572865 - RNA, 22 nt, Human
uggacucucagucucugagcag

SEQ ID NO: 2572866 - RNA, 15 nt, Human
uggaucacagcugcu

SEQ ID NO: 2572867 - RNA, 14 nt, Human
uggaucacagcugc

SEQ ID NO: 2572868 - RNA, 23 nt, Human
uggagggcuagaaccuggagagc

SEQ ID NO: 2572869 - RNA, 22 nt, Human
uggagggcuagaaccuggagag

SEQ ID NO: 2572870 - RNA, 22 nt, Human
uggagggcuagaaccuggagaa

SEQ ID NO: 2572871 - RNA, 21 nt, Human
uggagggcuagaaccuggaga

SEQ ID NO: 2572872 - RNA, 20 nt, Human
uggagggcuagaaccuggag

SEQ ID NO: 2572873 - RNA, 21 nt, Human
uggagggcgugggagcguggg

SEQ ID NO: 2572874 - RNA, 21 nt, Human
uggagggaaugaaccuggagg

SEQ ID NO: 2572875 - RNA, 20 nt, Human
uggagggaaugaaccuggag

SEQ ID NO: 2572876 - RNA, 11 nt, Human
uggagggaagc

SEQ ID NO: 2572877 - RNA, 22 nt, Human
uggagggacaaguggacucagg

SEQ ID NO: 2572878 - RNA, 22 nt, Human
uggaggcuuccugcguccuccu

SEQ ID NO: 2572879 - RNA, 19 nt, Human
uggagggaaugaaccugga

SEQ ID NO: 2572880 - RNA, 21 nt, Human
uggaggacuagaaccuggagg

SEQ ID NO: 2572881 - RNA, 20 nt, Human
uggaggacuagaaccuggag

SEQ ID NO: 2572882 - RNA, 19 nt, Human
uggaggacuagaaccugga

SEQ ID NO: 2572883 - RNA, 14 nt, Human
uggaggagaagaau

SEQ ID NO: 2572884 - RNA, 21 nt, Human
uggaggagaagaauuuucaga

SEQ ID NO: 2572885 - RNA, 15 nt, Human
uggaggagagaagaa

SEQ ID NO: 2572886 - RNA, 14 nt, Human
uggaggagaaggac

SEQ ID NO: 2572887 - RNA, 16 nt, Human
uggaggagcaaaggcu

SEQ ID NO: 2572888 - RNA, 14 nt, Human
uggaggagcaaagg

SEQ ID NO: 2572889 - RNA, 11 nt, Human
uggaggagcaa

SEQ ID NO: 2572890 - RNA, 13 nt, Human
uggaggagcagug

SEQ ID NO: 2572891 - RNA, 21 nt, Human
uggaggagcaaaggcugagaa

SEQ ID NO: 2572892 - RNA, 20 nt, Human
uggaggagcaaaggcugaga

SEQ ID NO: 2572893 - RNA, 18 nt, Human
uggaggagcaaaggcuga

SEQ ID NO: 2572894 - RNA, 21 nt, Human
uggaggagcagugcaggcaca

SEQ ID NO: 2572895 - RNA, 20 nt, Human
uggaggagcagugcaggcac

SEQ ID NO: 2572896 - RNA, 22 nt, Human
uggaggagcagugcaggcacag

SEQ ID NO: 2572897 - RNA, 20 nt, Human
uggaggcuuccugcguccuc

SEQ ID NO: 2572898 - RNA, 12 nt, Human
uggccacuaagc

SEQ ID NO: 2572899 - RNA, 13 nt, Human
uggccacucagcu

SEQ ID NO: 2572900 - RNA, 12 nt, Human
uggccacucagc

SEQ ID NO: 2572901 - RNA, 18 nt, Human
uggccacuaagcagagga

SEQ ID NO: 2572902 - RNA, 19 nt, Human
uggccacuaagcagaggag

SEQ ID NO: 2572903 - RNA, 17 nt, Human
uggccacuccagacccc

SEQ ID NO: 2572904 - RNA, 16 nt, Human
uggccaccuuuucagc

SEQ ID NO: 2572905 - RNA, 23 nt, Human
uggccaccugaggugggcccagg

SEQ ID NO: 2572906 - RNA, 22 nt, Human
uggccaccugaggugggcccag

SEQ ID NO: 2572907 - RNA, 21 nt, Human
uggccaccugaggugggccca

SEQ ID NO: 2572908 - RNA, 17 nt, Human
uggccaccuuuucagcg

SEQ ID NO: 2572909 - RNA, 20 nt, Human
uggccaccugaggugggccc

SEQ ID NO: 2572910 - RNA, 17 nt, Human
uggccaccugagguggg

SEQ ID NO: 2572911 - RNA, 21 nt, Human
uggcagugagugagccuggcu

SEQ ID NO: 2572912 - RNA, 21 nt, Human
uggccagaugcaccagcccuu

SEQ ID NO: 2572913 - RNA, 20 nt, Human
uggccagaugcaccagcccu

SEQ ID NO: 2572914 - RNA, 22 nt, Human
uggccacucagcuuccuaccca

SEQ ID NO: 2572915 - RNA, 15 nt, Human
uggccacucagcuuc

SEQ ID NO: 2572916 - RNA, 12 nt, Human
uggccagcagcu

SEQ ID NO: 2572917 - RNA, 13 nt, Human
uggccagcagcuu

SEQ ID NO: 2572918 - RNA, 21 nt, Human
uggccagccaacuuuugcaug

SEQ ID NO: 2572919 - RNA, 15 nt, Human
uggccagccccacag

SEQ ID NO: 2572920 - RNA, 13 nt, Human
uggccagccccac

SEQ ID NO: 2572921 - RNA, 12 nt, Human
uggccagcccca

SEQ ID NO: 2572922 - RNA, 14 nt, Human
uggccagcagcuug

SEQ ID NO: 2572923 - RNA, 23 nt, Human
uggccaggcagaucugugcccca

SEQ ID NO: 2572924 - RNA, 14 nt, Human
uggccaggauggag

SEQ ID NO: 2572925 - RNA, 12 nt, Human
uggccaggaugg

SEQ ID NO: 2572926 - RNA, 21 nt, Human
uggccaggcacccccuggaga

SEQ ID NO: 2572927 - RNA, 20 nt, Human
uggccaggcacccccuggag

SEQ ID NO: 2572928 - RNA, 12 nt, Human
uggccaggcaga

SEQ ID NO: 2572929 - RNA, 16 nt, Human
uggccaggcagaucug

SEQ ID NO: 2572930 - RNA, 17 nt, Human
uggccaggcagaucugu

SEQ ID NO: 2572931 - RNA, 19 nt, Human
uggccaggcagaucugugc

SEQ ID NO: 2572932 - RNA, 20 nt, Human
uggccaggcagaucugugcc

SEQ ID NO: 2572933 - RNA, 16 nt, Human
uggccagccccacagc

SEQ ID NO: 2572934 - RNA, 23 nt, Human
uggccaggagcucuucaggccuc

SEQ ID NO: 2572935 - RNA, 20 nt, Human
uggccaggagcucuucaggc

SEQ ID NO: 2572936 - RNA, 22 nt, Human
uggccaggagcucuucaggccu

SEQ ID NO: 2572937 - RNA, 17 nt, Human
uggccagccccacagcc

SEQ ID NO: 2572938 - RNA, 14 nt, Human
uggccaggagcucu

SEQ ID NO: 2572939 - RNA, 15 nt, Human
uggccaggagcucuu

SEQ ID NO: 2572940 - RNA, 16 nt, Human
uggccaggagcucuuc

SEQ ID NO: 2572941 - RNA, 23 nt, Human
uggcagugagugagccuggcucu

SEQ ID NO: 2572942 - RNA, 19 nt, Human
uggcagugagugagccugg

SEQ ID NO: 2572943 - RNA, 18 nt, Human
uggcagugagugagccug

SEQ ID NO: 2572944 - RNA, 17 nt, Human
uggcagugagugagccu

SEQ ID NO: 2572945 - RNA, 14 nt, Human
uggcagugagugag

SEQ ID NO: 2572946 - RNA, 22 nt, Human
uggcagucugaauuuuuaaaac

SEQ ID NO: 2572947 - RNA, 13 nt, Human
uggcagugggagc

SEQ ID NO: 2572948 - RNA, 20 nt, Human
uggccaccucucuccuuugc

SEQ ID NO: 2572949 - RNA, 19 nt, Human
uggcagucuauauguuugu

SEQ ID NO: 2572950 - RNA, 13 nt, Human
uggcagucuauau

SEQ ID NO: 2572951 - RNA, 16 nt, Human
uggcagucugaauuuu

SEQ ID NO: 2572952 - RNA, 18 nt, Human
uggcaguccuggaagcca

SEQ ID NO: 2572953 - RNA, 17 nt, Human
uggcagucacugaauuc

SEQ ID NO: 2572954 - RNA, 15 nt, Human
uggcaggugcagccc

SEQ ID NO: 2572955 - RNA, 22 nt, Human
uggcagguggaggugucaggcu

SEQ ID NO: 2572956 - RNA, 15 nt, Human
uggcagggcucagga

SEQ ID NO: 2572957 - RNA, 16 nt, Human
uggcagggugggaugg

SEQ ID NO: 2572958 - RNA, 17 nt, Human
uggcagggugggaugga

SEQ ID NO: 2572959 - RNA, 21 nt, Human
uggcagggguggcugccucau

SEQ ID NO: 2572960 - RNA, 23 nt, Human
uggcagggguggcugccucauuu

SEQ ID NO: 2572961 - RNA, 17 nt, Human
uggcagggcucaggauu

SEQ ID NO: 2572962 - RNA, 14 nt, Human
uggcagggcucagg

SEQ ID NO: 2572963 - RNA, 12 nt, Human
uggcagggcuca

SEQ ID NO: 2572964 - RNA, 18 nt, Human
uggcaggggacaggaguc

SEQ ID NO: 2572965 - RNA, 15 nt, Human
uggcaggggacagga

SEQ ID NO: 2572966 - RNA, 11 nt, Human
uggcagggcuc

SEQ ID NO: 2572967 - RNA, 19 nt, Human
uggcagggccuagcugcua

SEQ ID NO: 2572968 - RNA, 15 nt, Human
uggcagggccuagcu

SEQ ID NO: 2572969 - RNA, 14 nt, Human
uggcagggccuagc

SEQ ID NO: 2572970 - RNA, 19 nt, Human
uggcaggauggccuggcca

SEQ ID NO: 2572971 - RNA, 18 nt, Human
uggcaggauggccuggcc

SEQ ID NO: 2572972 - RNA, 22 nt, Human
uggcaggaugacccugcgaagg

SEQ ID NO: 2572973 - RNA, 21 nt, Human
uggcaacaguuagcuggagcu

SEQ ID NO: 2572974 - RNA, 22 nt, Human
uggcaacagaucuggaaccuca

SEQ ID NO: 2572975 - RNA, 21 nt, Human
uggcacccggccccugcuggu

SEQ ID NO: 2572976 - RNA, 22 nt, Human
uggcaccuucagacuuugcuuc

SEQ ID NO: 2572977 - RNA, 12 nt, Human
uggcaccuccua

SEQ ID NO: 2572978 - RNA, 20 nt, Human
uggcaccuaauccaggcaga

SEQ ID NO: 2572979 - RNA, 15 nt, Human
uggcaccgccuucuc

SEQ ID NO: 2572980 - RNA, 16 nt, Human
uggcaccgccuucucu

SEQ ID NO: 2572981 - RNA, 14 nt, Human
uggcacggugguac

SEQ ID NO: 2572982 - RNA, 19 nt, Human
uggcacgguggcucaggcc

SEQ ID NO: 2572983 - RNA, 20 nt, Human
uggcacgguggcucaggccu

SEQ ID NO: 2572984 - RNA, 13 nt, Human
uggcagcugcuuu

SEQ ID NO: 2572985 - RNA, 19 nt, Human
uggcaggaguuggaagugu

SEQ ID NO: 2572986 - RNA, 17 nt, Human
uggcaggaccaggacua

SEQ ID NO: 2572987 - RNA, 16 nt, Human
uggcaggaccaggacu

SEQ ID NO: 2572988 - RNA, 14 nt, Human
uggcaggaccagga

SEQ ID NO: 2572989 - RNA, 11 nt, Human
uggcaggacca

SEQ ID NO: 2572990 - RNA, 16 nt, Human
uggguaacuagggaag

SEQ ID NO: 2572991 - RNA, 14 nt, Human
ugggguuguguugu

SEQ ID NO: 2572992 - RNA, 19 nt, Human
ugggguugggauugggggc

SEQ ID NO: 2572993 - RNA, 21 nt, Human
ugggguuggcugggcccagaa

SEQ ID NO: 2572994 - RNA, 15 nt, Human
uggggguggaauaaa

SEQ ID NO: 2572995 - RNA, 15 nt, Human
ugggggugagggucc

SEQ ID NO: 2572996 - RNA, 14 nt, Human
ugggggugccagga

SEQ ID NO: 2572997 - RNA, 19 nt, Human
ugggguuuaucagaauucu

SEQ ID NO: 2572998 - RNA, 20 nt, Human
uggguggggggcuucauaca

SEQ ID NO: 2572999 - RNA, 21 nt, Human
uggguggggggcuucauacac

SEQ ID NO: 2573000 - RNA, 15 nt, Human
uggguaaaugcagcg

SEQ ID NO: 2573001 - RNA, 18 nt, Human
uggguggggggcuucaua

SEQ ID NO: 2573002 - RNA, 14 nt, Human
ugggugguggaucu

SEQ ID NO: 2573003 - RNA, 16 nt, Human
uggguggguggugggg

SEQ ID NO: 2573004 - RNA, 22 nt, Human
ugggugguacccucuggagggg

SEQ ID NO: 2573005 - RNA, 18 nt, Human
ugggugguacccucugga

SEQ ID NO: 2573006 - RNA, 14 nt, Human
ugggugguacccuc

SEQ ID NO: 2573007 - RNA, 15 nt, Human
ugggugggugguggg

SEQ ID NO: 2573008 - RNA, 14 nt, Human
uggguggguggugg

SEQ ID NO: 2573009 - RNA, 13 nt, Human
ugggugguacccu

SEQ ID NO: 2573010 - RNA, 12 nt, Human
uggguaaauuca

SEQ ID NO: 2573011 - RNA, 15 nt, Human
uggguggggugagga

SEQ ID NO: 2573012 - RNA, 20 nt, Human
uggguggggugaggaccacu

SEQ ID NO: 2573013 - RNA, 16 nt, Human
uggguucuacccaggu

SEQ ID NO: 2573014 - RNA, 15 nt, Human
uggguucuacccagg

SEQ ID NO: 2573015 - RNA, 22 nt, Human
uggguucuacccaggugcuagg

SEQ ID NO: 2573016 - RNA, 14 nt, Human
uggguucugccugc

SEQ ID NO: 2573017 - RNA, 14 nt, Human
uggguuaguggaug

SEQ ID NO: 2573018 - RNA, 16 nt, Human
uggguuagggaaaaca

SEQ ID NO: 2573019 - RNA, 18 nt, Human
uggguuagggaaaacauu

SEQ ID NO: 2573020 - RNA, 19 nt, Human
uggguuagggaaaacauuc

SEQ ID NO: 2573021 - RNA, 21 nt, Human
uggguuagggaaaacauucca

SEQ ID NO: 2573022 - RNA, 20 nt, Human
uggguguuccuggcaguuua

SEQ ID NO: 2573023 - RNA, 19 nt, Human
uggguguuccuggcaguuu

SEQ ID NO: 2573024 - RNA, 15 nt, Human
uggguguuccuggca

SEQ ID NO: 2573025 - RNA, 23 nt, Human
uggguguaacaggucuccucuua

SEQ ID NO: 2573026 - RNA, 18 nt, Human
uggguguguguagccaag

SEQ ID NO: 2573027 - RNA, 14 nt, Human
ugggugguggggag

SEQ ID NO: 2573028 - RNA, 15 nt, Human
ugggugguggaucug

SEQ ID NO: 2573029 - RNA, 22 nt, Human
uggguguaacaggucuccucuu

SEQ ID NO: 2573030 - RNA, 18 nt, Human
uggguuucuaaagcugcc

SEQ ID NO: 2573031 - RNA, 17 nt, Human
uggguuucuaaagcugc

SEQ ID NO: 2573032 - RNA, 19 nt, Human
uggguuuggaccccagcug

SEQ ID NO: 2573033 - RNA, 14 nt, Human
uggguuuggacccc

SEQ ID NO: 2573034 - RNA, 16 nt, Human
uggguuucuagcccau

SEQ ID NO: 2573035 - RNA, 17 nt, Human
uggguucugauauugcc

SEQ ID NO: 2573036 - RNA, 16 nt, Human
uggguucugccugcca

SEQ ID NO: 2573037 - RNA, 19 nt, Human
uggguucugccugccagcu

SEQ ID NO: 2573038 - RNA, 21 nt, Human
uggguuucuaaagcugccagc

SEQ ID NO: 2573039 - RNA, 16 nt, Human
ugguauagaaaugcug

SEQ ID NO: 2573040 - RNA, 14 nt, Human
ugguauagaaaugc

SEQ ID NO: 2573041 - RNA, 16 nt, Human
ugguauauccaaaagc

SEQ ID NO: 2573042 - RNA, 19 nt, Human
ugguauauccaaaagcuuu

SEQ ID NO: 2573043 - RNA, 22 nt, Human
ugguauagaaaugcugguuuuu

SEQ ID NO: 2573044 - RNA, 21 nt, Human
uggguuuggaccccagcuggg

SEQ ID NO: 2573045 - RNA, 20 nt, Human
uggguuuggaccccagcugg

SEQ ID NO: 2573046 - RNA, 13 nt, Human
ugguauagaaaug

SEQ ID NO: 2573047 - RNA, 22 nt, Human
ugguauccugugacauguaaca

SEQ ID NO: 2573048 - RNA, 15 nt, Human
ugguaucaagaaagu

SEQ ID NO: 2573049 - RNA, 22 nt, Human
ugguaucuagacccaucuucuu

SEQ ID NO: 2573050 - RNA, 22 nt, Human
ugguauauccaaaagcuuuuua

SEQ ID NO: 2573051 - RNA, 22 nt, Human
ugguaucuguucuuuaauuuau

SEQ ID NO: 2573052 - RNA, 19 nt, Human
ugguaucuguucuuuaauu

SEQ ID NO: 2573053 - RNA, 17 nt, Human
ugguaucuguucuuuaa

SEQ ID NO: 2573054 - RNA, 14 nt, Human
ugguaucuguucuu

SEQ ID NO: 2573055 - RNA, 18 nt, Human
ugguaugaucacggcuca

SEQ ID NO: 2573056 - RNA, 16 nt, Human
ugguaucuuaaagugu

SEQ ID NO: 2573057 - RNA, 18 nt, Human
ugguauuguauuuauuca

SEQ ID NO: 2573058 - RNA, 14 nt, Human
ugguauuguauuua

SEQ ID NO: 2573059 - RNA, 13 nt, Human
ugguauuguauuu

SEQ ID NO: 2573060 - RNA, 12 nt, Human
ugguauuguauu

SEQ ID NO: 2573061 - RNA, 23 nt, Human
ugguauuggcuagagguucaaag

SEQ ID NO: 2573062 - RNA, 15 nt, Human
ugguaugagcugagg

SEQ ID NO: 2573063 - RNA, 23 nt, Human
ugguaucuguucuuuaauuuauu

SEQ ID NO: 2573064 - RNA, 14 nt, Human
ugguaugagcugag

SEQ ID NO: 2573065 - RNA, 20 nt, Human
ugguauuacacuguauuugu

SEQ ID NO: 2573066 - RNA, 18 nt, Human
ugguauuacacuguauuu

SEQ ID NO: 2573067 - RNA, 16 nt, Human
ugguaugagcugaggg

SEQ ID NO: 2573068 - RNA, 19 nt, Human
ugguauucaggauuacaug

SEQ ID NO: 2573069 - RNA, 16 nt, Human
ugguauuccugccucc

SEQ ID NO: 2573070 - RNA, 18 nt, Human
ugggcuucacuguauaaa

SEQ ID NO: 2573071 - RNA, 17 nt, Human
ugggcuucaguggcagc

SEQ ID NO: 2573072 - RNA, 22 nt, Human
ugggcuuuuuuuuucucuuucu

SEQ ID NO: 2573073 - RNA, 14 nt, Human
ugggcuuguuuucu

SEQ ID NO: 2573074 - RNA, 23 nt, Human
ugggcuucacuguauaaauagga

SEQ ID NO: 2573075 - RNA, 17 nt, Human
ugggcuucacuguauaa

SEQ ID NO: 2573076 - RNA, 16 nt, Human
ugggcuucacuguaua

SEQ ID NO: 2573077 - RNA, 15 nt, Human
ugggcuucaguggca

SEQ ID NO: 2573078 - RNA, 19 nt, Human
ugggcugguggcucccgga

SEQ ID NO: 2573079 - RNA, 12 nt, Human
ugggcugugagu

SEQ ID NO: 2573080 - RNA, 14 nt, Human
ugggcuuagagcag

SEQ ID NO: 2573081 - RNA, 14 nt, Human
ugggcuuaagaaau

SEQ ID NO: 2573082 - RNA, 23 nt, Human
ugggcuguuggcacucacagacc

SEQ ID NO: 2573083 - RNA, 19 nt, Human
ugggcuguuggcacucaca

SEQ ID NO: 2573084 - RNA, 17 nt, Human
ugggcuguuggcacuca

SEQ ID NO: 2573085 - RNA, 12 nt, Human
ugggcugugcua

SEQ ID NO: 2573086 - RNA, 15 nt, Human
ugggcugugagugua

SEQ ID NO: 2573087 - RNA, 22 nt, Human
ugggcugugaguguaaguguga

SEQ ID NO: 2573088 - RNA, 23 nt, Human
ugggcuggguucuacccaggugc

SEQ ID NO: 2573089 - RNA, 17 nt, Human
ugggcuggugucaccug

SEQ ID NO: 2573090 - RNA, 16 nt, Human
ugggcuaguugggcuu

SEQ ID NO: 2573091 - RNA, 13 nt, Human
ugggcuacaagga

SEQ ID NO: 2573092 - RNA, 20 nt, Human
ugggcguggucacugcuguc

SEQ ID NO: 2573093 - RNA, 19 nt, Human
ugggcguggucacugcugu

SEQ ID NO: 2573094 - RNA, 17 nt, Human
ugggcuaauuaaauaaa

SEQ ID NO: 2573095 - RNA, 16 nt, Human
ugggcuacuuuguccu

SEQ ID NO: 2573096 - RNA, 16 nt, Human
ugggcagaggaaagca

SEQ ID NO: 2573097 - RNA, 21 nt, Human
ugggcagaucuaccccuuacu

SEQ ID NO: 2573098 - RNA, 16 nt, Human
ugggcagaucuacccc

SEQ ID NO: 2573099 - RNA, 15 nt, Human
ugggcagaucuaccc

SEQ ID NO: 2573100 - RNA, 15 nt, Human
ugggcagauuuucag

SEQ ID NO: 2573101 - RNA, 22 nt, Human
ugggcagaucuaccccuuacuu

SEQ ID NO: 2573102 - RNA, 17 nt, Human
ugggcagauuuucagca

SEQ ID NO: 2573103 - RNA, 20 nt, Human
ugggcgugagaccugccccu

SEQ ID NO: 2573104 - RNA, 22 nt, Human
ugggcuaagugauccucccacc

SEQ ID NO: 2573105 - RNA, 16 nt, Human
uggggaugugggaggg

SEQ ID NO: 2573106 - RNA, 15 nt, Human
uggggaugugggagg

SEQ ID NO: 2573107 - RNA, 14 nt, Human
uggggaugugggag

SEQ ID NO: 2573108 - RNA, 19 nt, Human
uggggaacaaggguggcau

SEQ ID NO: 2573109 - RNA, 22 nt, Human
uggggaaaggggucggcugacc

SEQ ID NO: 2573110 - RNA, 21 nt, Human
uggggaaaggggucggcugac

SEQ ID NO: 2573111 - RNA, 23 nt, Human
uggggaaaggggucggcugacca

SEQ ID NO: 2573112 - RNA, 15 nt, Human
uggggaacaagggug

SEQ ID NO: 2573113 - RNA, 21 nt, Human
ugggggaucacagccucugaa

SEQ ID NO: 2573114 - RNA, 20 nt, Human
uggggauugggccccugcca

SEQ ID NO: 2573115 - RNA, 20 nt, Human
ugggggaugacuagaggcag

SEQ ID NO: 2573116 - RNA, 23 nt, Human
uggggauugggugggcaggaaaa

SEQ ID NO: 2573117 - RNA, 20 nt, Human
ugggggaucacagccucuga

SEQ ID NO: 2573118 - RNA, 18 nt, Human
ugggggucuguguguuua

SEQ ID NO: 2573119 - RNA, 15 nt, Human
ugggggucugugugu

SEQ ID NO: 2573120 - RNA, 19 nt, Human
ugggggcugggcagaggaa

SEQ ID NO: 2573121 - RNA, 14 nt, Human
ugggggcuggccuc

SEQ ID NO: 2573122 - RNA, 21 nt, Human
ugggggcugcagcauguugcu

SEQ ID NO: 2573123 - RNA, 12 nt, Human
ugggggugcauu

SEQ ID NO: 2573124 - RNA, 15 nt, Human
ugggggugcauuuga

SEQ ID NO: 2573125 - RNA, 18 nt, Human
ugggggcugggcagagga

SEQ ID NO: 2573126 - RNA, 17 nt, Human
ugggggcugggcagagg

SEQ ID NO: 2573127 - RNA, 11 nt, Human
ugggggaugua

SEQ ID NO: 2573128 - RNA, 13 nt, Human
ugggggcaagaag

SEQ ID NO: 2573129 - RNA, 23 nt, Human
ugggggcaagaagaucacgcucc

SEQ ID NO: 2573130 - RNA, 13 nt, Human
ugggggcagaggg

SEQ ID NO: 2573131 - RNA, 14 nt, Human
ugggggcugcagca

SEQ ID NO: 2573132 - RNA, 16 nt, Human
ugggggcagagggcag

SEQ ID NO: 2573133 - RNA, 21 nt, Human
ugggggcggggugggaaagau

SEQ ID NO: 2573134 - RNA, 14 nt, Human
ugggaguacaaaag

SEQ ID NO: 2573135 - RNA, 22 nt, Human
ugggagcugccuguucagcucc

SEQ ID NO: 2573136 - RNA, 21 nt, Human
ugggagcugccuguucagcuc

SEQ ID NO: 2573137 - RNA, 17 nt, Human
ugggagcugccuguuca

SEQ ID NO: 2573138 - RNA, 21 nt, Human
ugggagugaggaugucugggc

SEQ ID NO: 2573139 - RNA, 15 nt, Human
ugggauccuccaggu

SEQ ID NO: 2573140 - RNA, 13 nt, Human
ugggaguccccuu

SEQ ID NO: 2573141 - RNA, 15 nt, Human
ugggagucaagugug

SEQ ID NO: 2573142 - RNA, 16 nt, Human
ugggagcugaggccac

SEQ ID NO: 2573143 - RNA, 15 nt, Human
ugggagugagcuggu

SEQ ID NO: 2573144 - RNA, 13 nt, Human
ugggauccuggag

SEQ ID NO: 2573145 - RNA, 18 nt, Human
ugggauccuccaggugca

SEQ ID NO: 2573146 - RNA, 18 nt, Human
ugggauuacaggcuccug

SEQ ID NO: 2573147 - RNA, 20 nt, Human
ugggaguccccuuuucuuuu

SEQ ID NO: 2573148 - RNA, 13 nt, Human
ugggaucugcccc

SEQ ID NO: 2573149 - RNA, 16 nt, Human
ugggauuacaggugug

SEQ ID NO: 2573150 - RNA, 20 nt, Human
ugggcagagcuggcucugag

SEQ ID NO: 2573151 - RNA, 18 nt, Human
ugggcagagcuggcucug

SEQ ID NO: 2573152 - RNA, 16 nt, Human
ugggcagagcuggcuc

SEQ ID NO: 2573153 - RNA, 15 nt, Human
ugggcagaggaaagc

SEQ ID NO: 2573154 - RNA, 18 nt, Human
ugggaucugccccucccu

SEQ ID NO: 2573155 - RNA, 16 nt, Human
ugggaucugccccucc

SEQ ID NO: 2573156 - RNA, 17 nt, Human
ugggauuacagguguga

SEQ ID NO: 2573157 - RNA, 21 nt, Human
ugggauuacagggaugagcca

SEQ ID NO: 2573158 - RNA, 17 nt, Human
ugggagaggugccagca

SEQ ID NO: 2573159 - RNA, 23 nt, Human
ugggagaggauuuuuuucugagc

SEQ ID NO: 2573160 - RNA, 20 nt, Human
ugggagaggauuuuuuucug

SEQ ID NO: 2573161 - RNA, 16 nt, Human
ugggacguggcucagc

SEQ ID NO: 2573162 - RNA, 23 nt, Human
ugggagauauauuuuuaagauaa

SEQ ID NO: 2573163 - RNA, 21 nt, Human
ugggagauauauuuuuaagau

SEQ ID NO: 2573164 - RNA, 22 nt, Human
ugggagaggugccagcaacuga

SEQ ID NO: 2573165 - RNA, 14 nt, Human
ugggagauguggaa

SEQ ID NO: 2573166 - RNA, 13 nt, Human
ugggagcaaaaga

SEQ ID NO: 2573167 - RNA, 14 nt, Human
ugggagcugccugu

SEQ ID NO: 2573168 - RNA, 13 nt, Human
ugggagcugccug

SEQ ID NO: 2573169 - RNA, 12 nt, Human
ugggagcugccu

SEQ ID NO: 2573170 - RNA, 20 nt, Human
ugggagcugaggccacacuc

SEQ ID NO: 2573171 - RNA, 22 nt, Human
ugggagcugaggccacacucag

SEQ ID NO: 2573172 - RNA, 23 nt, Human
ugggagauucaagggacccauga

SEQ ID NO: 2573173 - RNA, 19 nt, Human
ugggacaaaucaagcuuca

SEQ ID NO: 2573174 - RNA, 12 nt, Human
ugggacacccug

SEQ ID NO: 2573175 - RNA, 17 nt, Human
ugggaauugugugaugu

SEQ ID NO: 2573176 - RNA, 14 nt, Human
ugggaauuguguga

SEQ ID NO: 2573177 - RNA, 22 nt, Human
ugggaauguuugucucauccca

SEQ ID NO: 2573178 - RNA, 16 nt, Human
ugggaauguuugucuc

SEQ ID NO: 2573179 - RNA, 20 nt, Human
ugggaauguuacauuguuug

SEQ ID NO: 2573180 - RNA, 10 nt, Human
ugggaauguu

SEQ ID NO: 2573181 - RNA, 14 nt, Human
ugggacggugccca

SEQ ID NO: 2573182 - RNA, 23 nt, Human
ugggaccgccagauggggccucu

SEQ ID NO: 2573183 - RNA, 23 nt, Human
ugggacggugcccaagccagagg

SEQ ID NO: 2573184 - RNA, 15 nt, Human
ugggacguggcucag

SEQ ID NO: 2573185 - RNA, 23 nt, Human
ugggaccugccaggcaggggugg

SEQ ID NO: 2573186 - RNA, 19 nt, Human
ugggaccugccaggcaggg

SEQ ID NO: 2573187 - RNA, 18 nt, Human
ugggaccugccaggcagg

SEQ ID NO: 2573188 - RNA, 15 nt, Human
ugggaccuuuagugg

SEQ ID NO: 2573189 - RNA, 20 nt, Human
ugggaccugccaggcagggg

SEQ ID NO: 2573190 - RNA, 13 nt, Human
ugggacacccugu

SEQ ID NO: 2573191 - RNA, 19 nt, Human
ugggaccuaggggcgccgc

SEQ ID NO: 2573192 - RNA, 23 nt, Human
ugggaccucaguuuuaucauuuu

SEQ ID NO: 2573193 - RNA, 17 nt, Human
ugggaccugccaggcag

SEQ ID NO: 2573194 - RNA, 16 nt, Human
uggcuggaagggagga

SEQ ID NO: 2573195 - RNA, 21 nt, Human
uggcugggggccucagugcca

SEQ ID NO: 2573196 - RNA, 19 nt, Human
uggcuggaugaaauuuucu

SEQ ID NO: 2573197 - RNA, 23 nt, Human
uggcuggagacgggugggcggcu

SEQ ID NO: 2573198 - RNA, 16 nt, Human
uggcugguccagggcu

SEQ ID NO: 2573199 - RNA, 15 nt, Human
uggcugguccagggc

SEQ ID NO: 2573200 - RNA, 13 nt, Human
uggcugguccagg

SEQ ID NO: 2573201 - RNA, 22 nt, Human
uggcugguaacaguucauguuu

SEQ ID NO: 2573202 - RNA, 21 nt, Human
uggcuggaagauccugcgggu

SEQ ID NO: 2573203 - RNA, 20 nt, Human
uggcuggaagauccugcggg

SEQ ID NO: 2573204 - RNA, 15 nt, Human
uggcugcuuggccuu

SEQ ID NO: 2573205 - RNA, 13 nt, Human
uggcucuggagac

SEQ ID NO: 2573206 - RNA, 19 nt, Human
uggcuggaagauccugcgg

SEQ ID NO: 2573207 - RNA, 21 nt, Human
uggcugcuucaaggauccuga

SEQ ID NO: 2573208 - RNA, 16 nt, Human
uggcugcuucaaggau

SEQ ID NO: 2573209 - RNA, 11 nt, Human
uggcucugcug

SEQ ID NO: 2573210 - RNA, 12 nt, Human
uggcucugcugg

SEQ ID NO: 2573211 - RNA, 23 nt, Human
uggcucugcaaugggcacuggga

SEQ ID NO: 2573212 - RNA, 22 nt, Human
uggcucugaggugccuguccca

SEQ ID NO: 2573213 - RNA, 14 nt, Human
uggcucugcaaugg

SEQ ID NO: 2573214 - RNA, 22 nt, Human
uggccccacccugggcccuggg

SEQ ID NO: 2573215 - RNA, 20 nt, Human
uggcucuccaagugccagag

SEQ ID NO: 2573216 - RNA, 19 nt, Human
uggcucuccaagugccaga

SEQ ID NO: 2573217 - RNA, 15 nt, Human
uggcucuccaagugc

SEQ ID NO: 2573218 - RNA, 14 nt, Human
uggcucuccaagug

SEQ ID NO: 2573219 - RNA, 12 nt, Human
uggccccagcac

SEQ ID NO: 2573220 - RNA, 13 nt, Human
uggcucuccaagu

SEQ ID NO: 2573221 - RNA, 14 nt, Human
uggcucucuccagg

SEQ ID NO: 2573222 - RNA, 13 nt, Human
uggcucucuccag

SEQ ID NO: 2573223 - RNA, 23 nt, Human
uggcucuccaagugccagaggug

SEQ ID NO: 2573224 - RNA, 17 nt, Human
uggcucucccauuuccu

SEQ ID NO: 2573225 - RNA, 21 nt, Human
uggcucugaggugccuguccc

SEQ ID NO: 2573226 - RNA, 20 nt, Human
uggcucugaggugccugucc

SEQ ID NO: 2573227 - RNA, 19 nt, Human
uggcucugagcgccuccau

SEQ ID NO: 2573228 - RNA, 15 nt, Human
uggcucucuccagga

SEQ ID NO: 2573229 - RNA, 19 nt, Human
uggcucugaccgaaacagc

SEQ ID NO: 2573230 - RNA, 14 nt, Human
uggcccagggccca

SEQ ID NO: 2573231 - RNA, 15 nt, Human
uggcccagggcccag

SEQ ID NO: 2573232 - RNA, 19 nt, Human
uggcccauccccccucacc

SEQ ID NO: 2573233 - RNA, 16 nt, Human
uggcccagggcccaga

SEQ ID NO: 2573234 - RNA, 21 nt, Human
uggcccauccccccucaccag

SEQ ID NO: 2573235 - RNA, 20 nt, Human
uggcccauccccccucacca

SEQ ID NO: 2573236 - RNA, 22 nt, Human
uggcccauccccccucaccagg

SEQ ID NO: 2573237 - RNA, 18 nt, Human
uggccccacccugggccc

SEQ ID NO: 2573238 - RNA, 16 nt, Human
uggccccacccugggc

SEQ ID NO: 2573239 - RNA, 15 nt, Human
uggccccacccuggg

SEQ ID NO: 2573240 - RNA, 13 nt, Human
uggccccacccug

SEQ ID NO: 2573241 - RNA, 20 nt, Human
uggccccaagggcaaaauuc

SEQ ID NO: 2573242 - RNA, 16 nt, Human
uggcuuccuggcaaua

SEQ ID NO: 2573243 - RNA, 16 nt, Human
uggcuuccuuucuugg

SEQ ID NO: 2573244 - RNA, 15 nt, Human
uggcuuccuccugcg

SEQ ID NO: 2573245 - RNA, 21 nt, Human
uggcuuccuccucccuccugc

SEQ ID NO: 2573246 - RNA, 13 nt, Human
uggcuuccuccug

SEQ ID NO: 2573247 - RNA, 14 nt, Human
uggcuucuggagcc

SEQ ID NO: 2573248 - RNA, 22 nt, Human
uggcuucucauacguccaccau

SEQ ID NO: 2573249 - RNA, 21 nt, Human
uggcuucucauacguccacca

SEQ ID NO: 2573250 - RNA, 13 nt, Human
uggcuucucauac

SEQ ID NO: 2573251 - RNA, 14 nt, Human
uggcuuccuuucuu

SEQ ID NO: 2573252 - RNA, 14 nt, Human
uggcuucuccaggg

SEQ ID NO: 2573253 - RNA, 15 nt, Human
uggcuugagaaauau

SEQ ID NO: 2573254 - RNA, 20 nt, Human
uggcuugaagccaagucagc

SEQ ID NO: 2573255 - RNA, 18 nt, Human
uggcuucuucuuuaggau

SEQ ID NO: 2573256 - RNA, 14 nt, Human
uggcuuuugugcau

SEQ ID NO: 2573257 - RNA, 23 nt, Human
uggcuuucuccgacugcuaggga

SEQ ID NO: 2573258 - RNA, 17 nt, Human
uggcuuuggcuucuugg

SEQ ID NO: 2573259 - RNA, 21 nt, Human
uggcuuuauccucuuuagagu

SEQ ID NO: 2573260 - RNA, 15 nt, Human
uggcuuucagccucu

SEQ ID NO: 2573261 - RNA, 22 nt, Human
uggcuuucuccgacugcuaggg

SEQ ID NO: 2573262 - RNA, 20 nt, Human
uggcuuucucccacugaguu

SEQ ID NO: 2573263 - RNA, 21 nt, Human
uggcuuucccggacugcaagc

SEQ ID NO: 2573264 - RNA, 17 nt, Human
uggcuuucauuauuagu

SEQ ID NO: 2573265 - RNA, 12 nt, Human
uggcuuucccgg

SEQ ID NO: 2573266 - RNA, 21 nt, Human
uggcuugaguuuaaauuguaa

SEQ ID NO: 2573267 - RNA, 20 nt, Human
uggcuuuauccucuuuagag

SEQ ID NO: 2573268 - RNA, 16 nt, Human
uggcuuuauccucuuu

SEQ ID NO: 2573269 - RNA, 14 nt, Human
uggcuuuaaugaau

SEQ ID NO: 2573270 - RNA, 16 nt, Human
ugccccaucagugcuc

SEQ ID NO: 2573271 - RNA, 18 nt, Human
ugccccaucagugcuccc

SEQ ID NO: 2573272 - RNA, 20 nt, Human
ugccccaucagugcucccuc

SEQ ID NO: 2573273 - RNA, 21 nt, Human
ugccccaucagugcucccuca

SEQ ID NO: 2573274 - RNA, 23 nt, Human
ugccccucaacucuccuccagag

SEQ ID NO: 2573275 - RNA, 14 nt, Human
ugccccaggaccag

SEQ ID NO: 2573276 - RNA, 18 nt, Human
ugccccaggaccagcuca

SEQ ID NO: 2573277 - RNA, 19 nt, Human
ugccccaggaccagcucag

SEQ ID NO: 2573278 - RNA, 20 nt, Human
ugccccaggaccagcucagg

SEQ ID NO: 2573279 - RNA, 14 nt, Human
ugccccaggccuga

SEQ ID NO: 2573280 - RNA, 15 nt, Human
ugccccagggcuccc

SEQ ID NO: 2573281 - RNA, 17 nt, Human
ugccccuggcagccccu

SEQ ID NO: 2573282 - RNA, 22 nt, Human
ugccccucccccaacccccacc

SEQ ID NO: 2573283 - RNA, 23 nt, Human
ugccccucccccaacccccaccc

SEQ ID NO: 2573284 - RNA, 17 nt, Human
ugccccauccuccagca

SEQ ID NO: 2573285 - RNA, 18 nt, Human
ugccccauccuccagcag

SEQ ID NO: 2573286 - RNA, 19 nt, Human
ugccccucaacucuccucc

SEQ ID NO: 2573287 - RNA, 12 nt, Human
ugccccucccag

SEQ ID NO: 2573288 - RNA, 21 nt, Human
ugccccucccagaacacacuc

SEQ ID NO: 2573289 - RNA, 12 nt, Human
ugccccuccccc

SEQ ID NO: 2573290 - RNA, 17 nt, Human
ugccccucccccaaccc

SEQ ID NO: 2573291 - RNA, 21 nt, Human
ugccccucccccaacccccac

SEQ ID NO: 2573292 - RNA, 20 nt, Human
ugcccagucccccaacccca

SEQ ID NO: 2573293 - RNA, 18 nt, Human
ugcccagucccccaaccc

SEQ ID NO: 2573294 - RNA, 16 nt, Human
ugcccagucccccaac

SEQ ID NO: 2573295 - RNA, 14 nt, Human
ugcccaguccccca

SEQ ID NO: 2573296 - RNA, 20 nt, Human
ugcccagguuucuggucucu

SEQ ID NO: 2573297 - RNA, 21 nt, Human
ugcccagucgauaucucacuu

SEQ ID NO: 2573298 - RNA, 23 nt, Human
ugcccagucccccaaccccagcc

SEQ ID NO: 2573299 - RNA, 22 nt, Human
ugcccagucccccaaccccagc

SEQ ID NO: 2573300 - RNA, 23 nt, Human
ugcccaggggugcccccuccucu

SEQ ID NO: 2573301 - RNA, 22 nt, Human
ugcccaggggugcccccuccuc

SEQ ID NO: 2573302 - RNA, 21 nt, Human
ugcccaggggugcccccuccu

SEQ ID NO: 2573303 - RNA, 20 nt, Human
ugcccaggggugcccccucc

SEQ ID NO: 2573304 - RNA, 19 nt, Human
ugcccaggggugcccccuc

SEQ ID NO: 2573305 - RNA, 18 nt, Human
ugcccaggggugcccccu

SEQ ID NO: 2573306 - RNA, 16 nt, Human
ugcccaggggugcccc

SEQ ID NO: 2573307 - RNA, 15 nt, Human
ugcccaggggugccc

SEQ ID NO: 2573308 - RNA, 11 nt, Human
ugcccaggggu

SEQ ID NO: 2573309 - RNA, 20 nt, Human
ugcccaggggcccacaggga

SEQ ID NO: 2573310 - RNA, 17 nt, Human
ugcccaggggagcccuc

SEQ ID NO: 2573311 - RNA, 16 nt, Human
ugcccaggggagcccu

SEQ ID NO: 2573312 - RNA, 15 nt, Human
ugcccaggggagccc

SEQ ID NO: 2573313 - RNA, 14 nt, Human
ugcccaggggagcc

SEQ ID NO: 2573314 - RNA, 23 nt, Human
ugcccagggcucagccugguggg

SEQ ID NO: 2573315 - RNA, 18 nt, Human
ugcccaugggcacugcug

SEQ ID NO: 2573316 - RNA, 17 nt, Human
ugcccaugggcacugcu

SEQ ID NO: 2573317 - RNA, 16 nt, Human
ugcccaugggcacugc

SEQ ID NO: 2573318 - RNA, 15 nt, Human
ugcccaugggcacug

SEQ ID NO: 2573319 - RNA, 19 nt, Human
ugccccagcucuggcuucc

SEQ ID NO: 2573320 - RNA, 20 nt, Human
ugcccaugggcacugcuggg

SEQ ID NO: 2573321 - RNA, 13 nt, Human
ugccccaggacca

SEQ ID NO: 2573322 - RNA, 16 nt, Human
ugcccaugggagcugg

SEQ ID NO: 2573323 - RNA, 24 nt, Human
ugcccauggacaggcuggcuccag

SEQ ID NO: 2573324 - RNA, 15 nt, Human
ugcccaugccaccgc

SEQ ID NO: 2573325 - RNA, 17 nt, Human
ugcccaguuucagggcu

SEQ ID NO: 2573326 - RNA, 16 nt, Human
ugcccaguuucugccu

SEQ ID NO: 2573327 - RNA, 18 nt, Human
ugcccaguuucugccucu

SEQ ID NO: 2573328 - RNA, 17 nt, Human
ugcccaguuucugccuc

SEQ ID NO: 2573329 - RNA, 20 nt, Human
ugcccaucacaggguugggc

SEQ ID NO: 2573330 - RNA, 19 nt, Human
ugcccaguuucugccucug

SEQ ID NO: 2573331 - RNA, 23 nt, Human
ugcccaucacaggguugggccca

SEQ ID NO: 2573332 - RNA, 19 nt, Human
ugcccaucugggaaaauac

SEQ ID NO: 2573333 - RNA, 13 nt, Human
ugcccaucccugg

SEQ ID NO: 2573334 - RNA, 17 nt, Human
ugcccacccuccacucu

SEQ ID NO: 2573335 - RNA, 20 nt, Human
ugccauccagguucagcuug

SEQ ID NO: 2573336 - RNA, 21 nt, Human
ugccauccagguucagcuugu

SEQ ID NO: 2573337 - RNA, 13 nt, Human
ugcccaccuggcc

SEQ ID NO: 2573338 - RNA, 14 nt, Human
ugcccaccugccca

SEQ ID NO: 2573339 - RNA, 15 nt, Human
ugcccaccugcccau

SEQ ID NO: 2573340 - RNA, 17 nt, Human
ugcccaccugcccauca

SEQ ID NO: 2573341 - RNA, 19 nt, Human
ugcccaccugcccaucaca

SEQ ID NO: 2573342 - RNA, 15 nt, Human
ugcccacucccugca

SEQ ID NO: 2573343 - RNA, 14 nt, Human
ugcccacucccugc

SEQ ID NO: 2573344 - RNA, 16 nt, Human
ugcccacucccugcaa

SEQ ID NO: 2573345 - RNA, 11 nt, Human
ugcccaggcug

SEQ ID NO: 2573346 - RNA, 21 nt, Human
ugcccacccguggagauggga

SEQ ID NO: 2573347 - RNA, 20 nt, Human
ugcccagggcucagccuggu

SEQ ID NO: 2573348 - RNA, 21 nt, Human
ugcccagggcucagccuggug

SEQ ID NO: 2573349 - RNA, 13 nt, Human
ugcccaggcuggc

SEQ ID NO: 2573350 - RNA, 13 nt, Human
ugcccaggcugga

SEQ ID NO: 2573351 - RNA, 20 nt, Human
ugcccaggcuggagugcaau

SEQ ID NO: 2573352 - RNA, 18 nt, Human
ugcccaggcuggagugca

SEQ ID NO: 2573353 - RNA, 22 nt, Human
ugccacccugggcucugugggc

SEQ ID NO: 2573354 - RNA, 22 nt, Human
ugccacuacggaauaguuggcu

SEQ ID NO: 2573355 - RNA, 20 nt, Human
ugccacuaaauugacacuua

SEQ ID NO: 2573356 - RNA, 19 nt, Human
ugccacccuggggagaaag

SEQ ID NO: 2573357 - RNA, 21 nt, Human
ugccacccugggcucuguggg

SEQ ID NO: 2573358 - RNA, 20 nt, Human
ugccacccugggcucugugg

SEQ ID NO: 2573359 - RNA, 19 nt, Human
ugccacccugggcucugug

SEQ ID NO: 2573360 - RNA, 18 nt, Human
ugccacccugggcucugu

SEQ ID NO: 2573361 - RNA, 17 nt, Human
ugccacccugggcucug

SEQ ID NO: 2573362 - RNA, 15 nt, Human
ugccacccugggcuc

SEQ ID NO: 2573363 - RNA, 14 nt, Human
ugccacccugggcu

SEQ ID NO: 2573364 - RNA, 13 nt, Human
ugccacccugggc

SEQ ID NO: 2573365 - RNA, 14 nt, Human
ugccacccuaccug

SEQ ID NO: 2573366 - RNA, 16 nt, Human
ugccacccucaugcug

SEQ ID NO: 2573367 - RNA, 17 nt, Human
ugccacccucaugcugu

SEQ ID NO: 2573368 - RNA, 13 nt, Human
ugccacccuaccu

SEQ ID NO: 2573369 - RNA, 16 nt, Human
ugccaccagucacugu

SEQ ID NO: 2573370 - RNA, 23 nt, Human
ugccaccagagaccguccucacc

SEQ ID NO: 2573371 - RNA, 18 nt, Human
ugccaccaggccaccucc

SEQ ID NO: 2573372 - RNA, 17 nt, Human
ugccaccaggccaccuc

SEQ ID NO: 2573373 - RNA, 14 nt, Human
ugccaccaggccac

SEQ ID NO: 2573374 - RNA, 13 nt, Human
ugccacccaccuc

SEQ ID NO: 2573375 - RNA, 12 nt, Human
ugccacccuacc

SEQ ID NO: 2573376 - RNA, 12 nt, Human
ugccacccacca

SEQ ID NO: 2573377 - RNA, 17 nt, Human
ugccacccaccagggcg

SEQ ID NO: 2573378 - RNA, 19 nt, Human
ugccaccauccugcugcug

SEQ ID NO: 2573379 - RNA, 15 nt, Human
ugccaccauccugcu

SEQ ID NO: 2573380 - RNA, 18 nt, Human
ugccaccauggccagcca

SEQ ID NO: 2573381 - RNA, 22 nt, Human
ugccagguuuuuggucugaccc

SEQ ID NO: 2573382 - RNA, 19 nt, Human
ugccagguuuuuggucuga

SEQ ID NO: 2573383 - RNA, 18 nt, Human
ugccagguuuuuggucug

SEQ ID NO: 2573384 - RNA, 18 nt, Human
ugccaggcaggggugggg

SEQ ID NO: 2573385 - RNA, 17 nt, Human
ugccaggcagggguggg

SEQ ID NO: 2573386 - RNA, 16 nt, Human
ugccaggcaggggugg

SEQ ID NO: 2573387 - RNA, 15 nt, Human
ugccaggcaggggug

SEQ ID NO: 2573388 - RNA, 10 nt, Human
ugccaggcau

SEQ ID NO: 2573389 - RNA, 18 nt, Human
ugccaggauggaaugaug

SEQ ID NO: 2573390 - RNA, 12 nt, Human
ugccaggcaggg

SEQ ID NO: 2573391 - RNA, 20 nt, Human
ugccacucacacagccaggu

SEQ ID NO: 2573392 - RNA, 19 nt, Human
ugccacucacacagccagg

SEQ ID NO: 2573393 - RNA, 18 nt, Human
ugccacucacacagccag

SEQ ID NO: 2573394 - RNA, 16 nt, Human
ugccacucacacagcc

SEQ ID NO: 2573395 - RNA, 15 nt, Human
ugccacucacacagc

SEQ ID NO: 2573396 - RNA, 11 nt, Human
ugccacucaca

SEQ ID NO: 2573397 - RNA, 15 nt, Human
ugccacuagggcucu

SEQ ID NO: 2573398 - RNA, 19 nt, Human
ugccaaauauaaauaaaaa

SEQ ID NO: 2573399 - RNA, 22 nt, Human
ugccaaauauaaauaaaaauaa

SEQ ID NO: 2573400 - RNA, 14 nt, Human
ugcaucaagaugug

SEQ ID NO: 2573401 - RNA, 16 nt, Human
ugccaaauauguccug

SEQ ID NO: 2573402 - RNA, 16 nt, Human
ugccaaauaauaaaaa

SEQ ID NO: 2573403 - RNA, 19 nt, Human
ugcaucaagaugugacaug

SEQ ID NO: 2573404 - RNA, 13 nt, Human
ugccaccaggcca

SEQ ID NO: 2573405 - RNA, 22 nt, Human
ugccaccaggagaaccacuaca

SEQ ID NO: 2573406 - RNA, 14 nt, Human
ugccaccaggagaa

SEQ ID NO: 2573407 - RNA, 17 nt, Human
ugccaccaggagaacca

SEQ ID NO: 2573408 - RNA, 22 nt, Human
ugccaccagagaccguccucac

SEQ ID NO: 2573409 - RNA, 21 nt, Human
ugccaccagagaccguccuca

SEQ ID NO: 2573410 - RNA, 19 nt, Human
ugccaccagagaccguccu

SEQ ID NO: 2573411 - RNA, 18 nt, Human
ugccaccagagaccgucc

SEQ ID NO: 2573412 - RNA, 12 nt, Human
ugccaccaggag

SEQ ID NO: 2573413 - RNA, 13 nt, Human
ugccaccaggaga

SEQ ID NO: 2573414 - RNA, 17 nt, Human
ugccaaauauaaauaaa

SEQ ID NO: 2573415 - RNA, 18 nt, Human
ugccaaauauaaauaaaa

SEQ ID NO: 2573416 - RNA, 20 nt, Human
ugcauauuuauaaaaauaaa

SEQ ID NO: 2573417 - RNA, 18 nt, Human
ugcauauccugagccauc

SEQ ID NO: 2573418 - RNA, 16 nt, Human
ugcauauccugagcca

SEQ ID NO: 2573419 - RNA, 17 nt, Human
ugcauauccugagccau

SEQ ID NO: 2573420 - RNA, 13 nt, Human
ugcauauguugaa

SEQ ID NO: 2573421 - RNA, 15 nt, Human
ugcauauguaugacu

SEQ ID NO: 2573422 - RNA, 21 nt, Human
ugcauauuuauaaaaauaaaa

SEQ ID NO: 2573423 - RNA, 15 nt, Human
ugcauauguugaaua

SEQ ID NO: 2573424 - RNA, 17 nt, Human
ugcauauguugaauacu

SEQ ID NO: 2573425 - RNA, 12 nt, Human
ugcauauguaug

SEQ ID NO: 2573426 - RNA, 20 nt, Human
ugcauauuguauuacuagaa

SEQ ID NO: 2573427 - RNA, 23 nt, Human
ugcaccggcuggccuggccccuc

SEQ ID NO: 2573428 - RNA, 19 nt, Human
ugaguccccuguuuguuuc

SEQ ID NO: 2573429 - RNA, 15 nt, Human
ugcaccgggccacag

SEQ ID NO: 2573430 - RNA, 14 nt, Human
ugcaccgggccaca

SEQ ID NO: 2573431 - RNA, 20 nt, Human
ugaguccccuguuuguuucu

SEQ ID NO: 2573432 - RNA, 22 nt, Human
ugcaccgggccacagagaaagu

SEQ ID NO: 2573433 - RNA, 17 nt, Human
ugcaccgggccacagag

SEQ ID NO: 2573434 - RNA, 19 nt, Human
ugcacugcccauggacagg

SEQ ID NO: 2573435 - RNA, 21 nt, Human
ugcacugcccauggacaggcu

SEQ ID NO: 2573436 - RNA, 16 nt, Human
ugcacugaugcugccc

SEQ ID NO: 2573437 - RNA, 17 nt, Human
ugcacugaugcugcccc

SEQ ID NO: 2573438 - RNA, 21 nt, Human
ugcacugaugcugccccucau

SEQ ID NO: 2573439 - RNA, 22 nt, Human
ugcacugaugcugccccucauc

SEQ ID NO: 2573440 - RNA, 19 nt, Human
ugcacugagggccacacua

SEQ ID NO: 2573441 - RNA, 17 nt, Human
ugcacugagggccacac

SEQ ID NO: 2573442 - RNA, 16 nt, Human
ugcacugagggccaca

SEQ ID NO: 2573443 - RNA, 15 nt, Human
ugcacugagggccac

SEQ ID NO: 2573444 - RNA, 22 nt, Human
ugcacugauauaucaugaguga

SEQ ID NO: 2573445 - RNA, 14 nt, Human
ugcacugaugcugc

SEQ ID NO: 2573446 - RNA, 14 nt, Human
ugcacugagggcca

SEQ ID NO: 2573447 - RNA, 12 nt, Human
ugcacugagggc

SEQ ID NO: 2573448 - RNA, 17 nt, Human
ugcacugagcagagucu

SEQ ID NO: 2573449 - RNA, 15 nt, Human
ugcacugagcagagu

SEQ ID NO: 2573450 - RNA, 15 nt, Human
ugcacggcugcugag

SEQ ID NO: 2573451 - RNA, 14 nt, Human
ugcacggcugcuga

SEQ ID NO: 2573452 - RNA, 13 nt, Human
ugcacggcugcug

SEQ ID NO: 2573453 - RNA, 17 nt, Human
ugcacgcccauguguga

SEQ ID NO: 2573454 - RNA, 19 nt, Human
ugcacgcccaugugugagu

SEQ ID NO: 2573455 - RNA, 22 nt, Human
ugcacgcccaugugugagugug

SEQ ID NO: 2573456 - RNA, 15 nt, Human
ugcacgcccaugugu

SEQ ID NO: 2573457 - RNA, 22 nt, Human
ugcagagcagugggccuggcca

SEQ ID NO: 2573458 - RNA, 15 nt, Human
ugcagagcugaagau

SEQ ID NO: 2573459 - RNA, 21 nt, Human
ugcagagcaggaaacaugacu

SEQ ID NO: 2573460 - RNA, 15 nt, Human
ugcagaggccagagg

SEQ ID NO: 2573461 - RNA, 14 nt, Human
ugcagaggccagag

SEQ ID NO: 2573462 - RNA, 11 nt, Human
ugcagagcugc

SEQ ID NO: 2573463 - RNA, 17 nt, Human
ugcagaggccagaggcc

SEQ ID NO: 2573464 - RNA, 13 nt, Human
ugcagaggggcag

SEQ ID NO: 2573465 - RNA, 13 nt, Human
ugcagaggggaaa

SEQ ID NO: 2573466 - RNA, 20 nt, Human
ugcagcaauaaagcagcguu

SEQ ID NO: 2573467 - RNA, 23 nt, Human
ugcagcaauaaagcagcguuucu

SEQ ID NO: 2573468 - RNA, 17 nt, Human
ugcagcacucacacagg

SEQ ID NO: 2573469 - RNA, 20 nt, Human
ugcagcacucacacaggacc

SEQ ID NO: 2573470 - RNA, 13 nt, Human
ugcagcagaggca

SEQ ID NO: 2573471 - RNA, 16 nt, Human
ugcagcagaggcacug

SEQ ID NO: 2573472 - RNA, 18 nt, Human
ugcagcagcgguggccuc

SEQ ID NO: 2573473 - RNA, 20 nt, Human
ugcacuggggagcccgucuc

SEQ ID NO: 2573474 - RNA, 16 nt, Human
ugcacuggggagcccg

SEQ ID NO: 2573475 - RNA, 21 nt, Human
ugcacuugugauuauuuauua

SEQ ID NO: 2573476 - RNA, 15 nt, Human
ugcacuguaugcugg

SEQ ID NO: 2573477 - RNA, 16 nt, Human
ugcacuguaugcugga

SEQ ID NO: 2573478 - RNA, 21 nt, Human
ugcacuggaguccagucucuu

SEQ ID NO: 2573479 - RNA, 15 nt, Human
ugcacuggaguccag

SEQ ID NO: 2573480 - RNA, 18 nt, Human
ugcacuggaguccagucu

SEQ ID NO: 2573481 - RNA, 19 nt, Human
ugcacuggaguccagucuc

SEQ ID NO: 2573482 - RNA, 20 nt, Human
ugcacuggaguccagucucu

SEQ ID NO: 2573483 - RNA, 14 nt, Human
ugcacuuuguucug

SEQ ID NO: 2573484 - RNA, 12 nt, Human
ugcacuuuguuc

SEQ ID NO: 2573485 - RNA, 20 nt, Human
ugcacuuucuauccucugua

SEQ ID NO: 2573486 - RNA, 19 nt, Human
ugaggccugcccucaggga

SEQ ID NO: 2573487 - RNA, 14 nt, Human
ugcaggcagccagg

SEQ ID NO: 2573488 - RNA, 13 nt, Human
ugcaggcagccag

SEQ ID NO: 2573489 - RNA, 15 nt, Human
ugcaggcagccaggc

SEQ ID NO: 2573490 - RNA, 14 nt, Human
ugcaggcagacacg

SEQ ID NO: 2573491 - RNA, 13 nt, Human
ugcaggcagacac

SEQ ID NO: 2573492 - RNA, 12 nt, Human
ugcaggcagaca

SEQ ID NO: 2573493 - RNA, 23 nt, Human
ugcaggcacucaaugcagccaga

SEQ ID NO: 2573494 - RNA, 21 nt, Human
ugcaggcaccuuaguggcuuu

SEQ ID NO: 2573495 - RNA, 19 nt, Human
ugcaggcaccuuaguggcu

SEQ ID NO: 2573496 - RNA, 16 nt, Human
ugcaggcaccuuagug

SEQ ID NO: 2573497 - RNA, 23 nt, Human
ugcagcaugaccugugaccagca

SEQ ID NO: 2573498 - RNA, 15 nt, Human
ugcagcauaugagga

SEQ ID NO: 2573499 - RNA, 17 nt, Human
ugcagcauaugaggaug

SEQ ID NO: 2573500 - RNA, 20 nt, Human
ugcagcauaugaggaugcag

SEQ ID NO: 2573501 - RNA, 13 nt, Human
ugcagcaugaccu

SEQ ID NO: 2573502 - RNA, 17 nt, Human
ugcagcaugaccuguga

SEQ ID NO: 2573503 - RNA, 19 nt, Human
ugcagcaugaccugugacc

SEQ ID NO: 2573504 - RNA, 22 nt, Human
ugcagcaugaccugugaccagc

SEQ ID NO: 2573505 - RNA, 16 nt, Human
ugcagcagggaugccc

SEQ ID NO: 2573506 - RNA, 17 nt, Human
ugcagcagggaugcccu

SEQ ID NO: 2573507 - RNA, 18 nt, Human
ugcagcagggaugcccug

SEQ ID NO: 2573508 - RNA, 19 nt, Human
ugcagcagggaugcccugg

SEQ ID NO: 2573509 - RNA, 22 nt, Human
ugcagcagggaugcccuggagg

SEQ ID NO: 2573510 - RNA, 18 nt, Human
ugcagcagugagucucuu

SEQ ID NO: 2573511 - RNA, 22 nt, Human
ugcagcagugagucucuucaga

SEQ ID NO: 2573512 - RNA, 21 nt, Human
ugcagcaggaucuagaggggg

SEQ ID NO: 2573513 - RNA, 14 nt, Human
ugcagcagggaugc

SEQ ID NO: 2573514 - RNA, 20 nt, Human
ugcagcagcgguggccucuu

SEQ ID NO: 2573515 - RNA, 14 nt, Human
ugcagcagaggcac

SEQ ID NO: 2573516 - RNA, 20 nt, Human
ugcagugcucgcuguugcug

SEQ ID NO: 2573517 - RNA, 19 nt, Human
ugcagugcucgcuguugcu

SEQ ID NO: 2573518 - RNA, 23 nt, Human
ugcagugccuuggggaauuuccu

SEQ ID NO: 2573519 - RNA, 12 nt, Human
ugcagugccuug

SEQ ID NO: 2573520 - RNA, 17 nt, Human
ugcagugcucgcuguug

SEQ ID NO: 2573521 - RNA, 16 nt, Human
ugcagugcuuccaagg

SEQ ID NO: 2573522 - RNA, 19 nt, Human
ugcaggcccuggccucccc

SEQ ID NO: 2573523 - RNA, 17 nt, Human
ugcaggcccuggccucc

SEQ ID NO: 2573524 - RNA, 20 nt, Human
ugcagugauauggcagaaga

SEQ ID NO: 2573525 - RNA, 17 nt, Human
ugcagugauauggcaga

SEQ ID NO: 2573526 - RNA, 19 nt, Human
ugcaggccccgcuugucca

SEQ ID NO: 2573527 - RNA, 17 nt, Human
ugcagugccccuagcuu

SEQ ID NO: 2573528 - RNA, 16 nt, Human
ugcagugccccuagcu

SEQ ID NO: 2573529 - RNA, 22 nt, Human
ugcagugauauggcagaagaca

SEQ ID NO: 2573530 - RNA, 21 nt, Human
ugcagugauauggcagaagac

SEQ ID NO: 2573531 - RNA, 23 nt, Human
ugcagugauauggcagaagacac

SEQ ID NO: 2573532 - RNA, 16 nt, Human
ugcaggcccuggccuc

SEQ ID NO: 2573533 - RNA, 15 nt, Human
ugcaggcccuggccu

SEQ ID NO: 2573534 - RNA, 12 nt, Human
ugcaggcccugg

SEQ ID NO: 2573535 - RNA, 10 nt, Human
ugcaggcccc

SEQ ID NO: 2573536 - RNA, 21 nt, Human
ugcaggcaugcaugugcuugu

SEQ ID NO: 2573537 - RNA, 16 nt, Human
ugcaggcaucacagcu

SEQ ID NO: 2573538 - RNA, 20 nt, Human
ugcaggccaagagcagaggc

SEQ ID NO: 2573539 - RNA, 21 nt, Human
ugcaggccaagagcagaggca

SEQ ID NO: 2573540 - RNA, 15 nt, Human
ugcaggccaggccag

SEQ ID NO: 2573541 - RNA, 18 nt, Human
ugcaguucugaagaagau

SEQ ID NO: 2573542 - RNA, 17 nt, Human
ugcaguucugaagaaga

SEQ ID NO: 2573543 - RNA, 16 nt, Human
ugcaguucugaagaag

SEQ ID NO: 2573544 - RNA, 15 nt, Human
ugcaguucugaagaa

SEQ ID NO: 2573545 - RNA, 23 nt, Human
ugcagugcucgcuguugcugaau

SEQ ID NO: 2573546 - RNA, 22 nt, Human
ugcagugcucgcuguugcugaa

SEQ ID NO: 2573547 - RNA, 21 nt, Human
ugcagugcucgcuguugcuga

SEQ ID NO: 2573548 - RNA, 17 nt, Human
ugcaguggcucacgccu

SEQ ID NO: 2573549 - RNA, 22 nt, Human
ugcagugguaugaucacggcuc

SEQ ID NO: 2573550 - RNA, 22 nt, Human
ugcaguucugaagaagauggua

SEQ ID NO: 2573551 - RNA, 19 nt, Human
ugcaguucugaagaagaug

SEQ ID NO: 2573552 - RNA, 14 nt, Human
ugcaguugccaguc

SEQ ID NO: 2573553 - RNA, 13 nt, Human
ugcaguugccagu

SEQ ID NO: 2573554 - RNA, 17 nt, Human
ugcaguugacagcaggu

SEQ ID NO: 2573555 - RNA, 18 nt, Human
ugcauauaacuuauauug

SEQ ID NO: 2573556 - RNA, 16 nt, Human
ugcaguugacagcagg

SEQ ID NO: 2573557 - RNA, 14 nt, Human
ugcaguucugcagc

SEQ ID NO: 2573558 - RNA, 15 nt, Human
ugcaguugccaguca

SEQ ID NO: 2573559 - RNA, 22 nt, Human
ugcauauaacuuauauuguaag

SEQ ID NO: 2573560 - RNA, 20 nt, Human
ugcauauaacuuauauugua

SEQ ID NO: 2573561 - RNA, 21 nt, Human
ugcauauaacuuauauuguaa

SEQ ID NO: 2573562 - RNA, 13 nt, Human
ugcauauccugag

SEQ ID NO: 2573563 - RNA, 17 nt, Human
ugcauauauacauauau

SEQ ID NO: 2573564 - RNA, 15 nt, Human
ugcuccucuccaggc

SEQ ID NO: 2573565 - RNA, 14 nt, Human
ugcuccucuccagg

SEQ ID NO: 2573566 - RNA, 16 nt, Human
ugcuccucuccaggca

SEQ ID NO: 2573567 - RNA, 17 nt, Human
ugcuccuuguuccuaga

SEQ ID NO: 2573568 - RNA, 16 nt, Human
ugcuccuuguuccuag

SEQ ID NO: 2573569 - RNA, 17 nt, Human
ugcuccucuccccagca

SEQ ID NO: 2573570 - RNA, 18 nt, Human
ugcuccuuucuuguuuua

SEQ ID NO: 2573571 - RNA, 14 nt, Human
ugcucgccccagca

SEQ ID NO: 2573572 - RNA, 16 nt, Human
ugcucgccccagcagg

SEQ ID NO: 2573573 - RNA, 23 nt, Human
ugcuccuuguuccuagaguagag

SEQ ID NO: 2573574 - RNA, 17 nt, Human
ugcucgagacacaguga

SEQ ID NO: 2573575 - RNA, 23 nt, Human
ugcucgauuauucccuguacaau

SEQ ID NO: 2573576 - RNA, 20 nt, Human
ugcucuaugugcuuguaaaa

SEQ ID NO: 2573577 - RNA, 20 nt, Human
ugcucuaucuugcucuguaa

SEQ ID NO: 2573578 - RNA, 14 nt, Human
ugcucuaucuugcu

SEQ ID NO: 2573579 - RNA, 21 nt, Human
ugcucuaucuugcucuguaau

SEQ ID NO: 2573580 - RNA, 12 nt, Human
ugcucuauugua

SEQ ID NO: 2573581 - RNA, 21 nt, Human
ugcucuauuguagcauuucuu

SEQ ID NO: 2573582 - RNA, 14 nt, Human
ugcucgcuguugcu

SEQ ID NO: 2573583 - RNA, 13 nt, Human
ugcucgcuguugc

SEQ ID NO: 2573584 - RNA, 13 nt, Human
ugcucgcccugcg

SEQ ID NO: 2573585 - RNA, 14 nt, Human
ugcucgcccugcgg

SEQ ID NO: 2573586 - RNA, 17 nt, Human
ugcucgcuguugcugaa

SEQ ID NO: 2573587 - RNA, 15 nt, Human
ugcucgcuguugcug

SEQ ID NO: 2573588 - RNA, 18 nt, Human
ugcucgcuguugcugaau

SEQ ID NO: 2573589 - RNA, 21 nt, Human
ugcucuccucuugccacugcc

SEQ ID NO: 2573590 - RNA, 18 nt, Human
ugcucuccucuugccacu

SEQ ID NO: 2573591 - RNA, 14 nt, Human
ugcucuccucuugc

SEQ ID NO: 2573592 - RNA, 14 nt, Human
ugcucuccccugcc

SEQ ID NO: 2573593 - RNA, 16 nt, Human
ugcucuccucuugcca

SEQ ID NO: 2573594 - RNA, 17 nt, Human
ugcucuccaagcccagu

SEQ ID NO: 2573595 - RNA, 19 nt, Human
ugcucuccaagucucagug

SEQ ID NO: 2573596 - RNA, 18 nt, Human
ugcucuccaagucucagu

SEQ ID NO: 2573597 - RNA, 20 nt, Human
ugcucuccaagucucagugg

SEQ ID NO: 2573598 - RNA, 12 nt, Human
ugcucuccccug

SEQ ID NO: 2573599 - RNA, 13 nt, Human
ugcucuccccugc

SEQ ID NO: 2573600 - RNA, 17 nt, Human
ugcucuccuuccuggag

SEQ ID NO: 2573601 - RNA, 12 nt, Human
ugcucuccuucc

SEQ ID NO: 2573602 - RNA, 22 nt, Human
ugcucuccucuugccacugccu

SEQ ID NO: 2573603 - RNA, 17 nt, Human
ugcugaaacaacaaaua

SEQ ID NO: 2573604 - RNA, 23 nt, Human
ugcucuccuuccuggagcccaga

SEQ ID NO: 2573605 - RNA, 18 nt, Human
ugcucuccuuccuggagc

SEQ ID NO: 2573606 - RNA, 15 nt, Human
ugcucuccccugccc

SEQ ID NO: 2573607 - RNA, 15 nt, Human
ugcugaaacaggaga

SEQ ID NO: 2573608 - RNA, 16 nt, Human
ugcugaaaccaagggg

SEQ ID NO: 2573609 - RNA, 17 nt, Human
ugcugaaacaggagaga

SEQ ID NO: 2573610 - RNA, 17 nt, Human
ugcugaaauuuuauaug

SEQ ID NO: 2573611 - RNA, 20 nt, Human
ugcugaaagcccaaguaggg

SEQ ID NO: 2573612 - RNA, 15 nt, Human
ugcugaacaaaaaau

SEQ ID NO: 2573613 - RNA, 18 nt, Human
ugcugaacaaaaaauaaa

SEQ ID NO: 2573614 - RNA, 19 nt, Human
ugcuaagcauuccaacuau

SEQ ID NO: 2573615 - RNA, 15 nt, Human
ugcuaagcauuccaa

SEQ ID NO: 2573616 - RNA, 16 nt, Human
ugcuaagaugcucuau

SEQ ID NO: 2573617 - RNA, 15 nt, Human
ugcuaagccccagca

SEQ ID NO: 2573618 - RNA, 22 nt, Human
ugcucaagaagacauggagacu

SEQ ID NO: 2573619 - RNA, 15 nt, Human
ugcucaagaagacau

SEQ ID NO: 2573620 - RNA, 14 nt, Human
ugcucaagaagaca

SEQ ID NO: 2573621 - RNA, 21 nt, Human
ugcucaauaaaugauucuuag

SEQ ID NO: 2573622 - RNA, 14 nt, Human
ugcucacaccccau

SEQ ID NO: 2573623 - RNA, 18 nt, Human
ugcucaaugacucucugg

SEQ ID NO: 2573624 - RNA, 16 nt, Human
ugcucacauaucuguc

SEQ ID NO: 2573625 - RNA, 15 nt, Human
ugcucacauaucugu

SEQ ID NO: 2573626 - RNA, 17 nt, Human
ugcucagagcaguguuu

SEQ ID NO: 2573627 - RNA, 16 nt, Human
ugcucagaccagcucu

SEQ ID NO: 2573628 - RNA, 13 nt, Human
ugcucacagucuc

SEQ ID NO: 2573629 - RNA, 15 nt, Human
ugcucacaccccauu

SEQ ID NO: 2573630 - RNA, 17 nt, Human
ugcucagaccagcucuu

SEQ ID NO: 2573631 - RNA, 13 nt, Human
ugcuccucuccag

SEQ ID NO: 2573632 - RNA, 12 nt, Human
ugcuccucucca

SEQ ID NO: 2573633 - RNA, 11 nt, Human
ugcuccucucc

SEQ ID NO: 2573634 - RNA, 14 nt, Human
ugcucagucucccu

SEQ ID NO: 2573635 - RNA, 23 nt, Human
ugcuccuccuuggugccuggccu

SEQ ID NO: 2573636 - RNA, 19 nt, Human
ugcucagugucuggcugca

SEQ ID NO: 2573637 - RNA, 14 nt, Human
ugcuccucucccca

SEQ ID NO: 2573638 - RNA, 16 nt, Human
ugcucagucucccuuu

SEQ ID NO: 2573639 - RNA, 17 nt, Human
ugcucaguaauuugagg

SEQ ID NO: 2573640 - RNA, 16 nt, Human
ugcucagggucaauuu

SEQ ID NO: 2573641 - RNA, 20 nt, Human
ugcucagggucaauuucuuu

SEQ ID NO: 2573642 - RNA, 17 nt, Human
ugcucagcccugacugg

SEQ ID NO: 2573643 - RNA, 13 nt, Human
ugcucagcccuga

SEQ ID NO: 2573644 - RNA, 22 nt, Human
ugcucagcccugacuggugcua

SEQ ID NO: 2573645 - RNA, 13 nt, Human
ugcucagcccugg

SEQ ID NO: 2573646 - RNA, 12 nt, Human
ugcucagcccug

SEQ ID NO: 2573647 - RNA, 11 nt, Human
ugcucagcccu

SEQ ID NO: 2573648 - RNA, 12 nt, Human
ugcucagcagcu

SEQ ID NO: 2573649 - RNA, 20 nt, Human
ugcucagcccuggaggugcc

SEQ ID NO: 2573650 - RNA, 16 nt, Human
ugcucagcccuggagg

SEQ ID NO: 2573651 - RNA, 15 nt, Human
ugcucagcccuggag

SEQ ID NO: 2573652 - RNA, 14 nt, Human
ugcucagcccugga

SEQ ID NO: 2573653 - RNA, 23 nt, Human
ugcucagcccuggaggugccagc

SEQ ID NO: 2573654 - RNA, 21 nt, Human
ugcucagcccuggaggugcca

SEQ ID NO: 2573655 - RNA, 19 nt, Human
ugcucagggaaaagcagcu

SEQ ID NO: 2573656 - RNA, 14 nt, Human
ugcucagggcugac

SEQ ID NO: 2573657 - RNA, 19 nt, Human
ugcucaggggcguguggcu

SEQ ID NO: 2573658 - RNA, 21 nt, Human
ugcucagggaaaagcagcucu

SEQ ID NO: 2573659 - RNA, 22 nt, Human
ugcucagggaaaagcagcucuc

SEQ ID NO: 2573660 - RNA, 14 nt, Human
ugcugaacagugga

SEQ ID NO: 2573661 - RNA, 19 nt, Human
ugcugaacauugcauauaa

SEQ ID NO: 2573662 - RNA, 21 nt, Human
ugcugaacaccuuguggaagc

SEQ ID NO: 2573663 - RNA, 16 nt, Human
ugcugaacaccuugug

SEQ ID NO: 2573664 - RNA, 20 nt, Human
ugcugaacaaaaaauaaaaa

SEQ ID NO: 2573665 - RNA, 21 nt, Human
ugcugaacauugcauauaacu

SEQ ID NO: 2573666 - RNA, 14 nt, Human
ugcugaagcugccu

SEQ ID NO: 2573667 - RNA, 12 nt, Human
ugcugaaggcuc

SEQ ID NO: 2573668 - RNA, 23 nt, Human
ugcugaaggaauaaauugcuccu

SEQ ID NO: 2573669 - RNA, 21 nt, Human
ugcugaaggcucgagcaugcc

SEQ ID NO: 2573670 - RNA, 13 nt, Human
ugcugaaggcucg

SEQ ID NO: 2573671 - RNA, 23 nt, Human
ugcugacagacacaggcccggcu

SEQ ID NO: 2573672 - RNA, 22 nt, Human
ugcugacagacacaggcccggc

SEQ ID NO: 2573673 - RNA, 18 nt, Human
ugcugauuuggugaccaa

SEQ ID NO: 2573674 - RNA, 18 nt, Human
ugcugauggugcaaugac

SEQ ID NO: 2573675 - RNA, 14 nt, Human
ugcugcaaaccuga

SEQ ID NO: 2573676 - RNA, 20 nt, Human
ugcugcaaaccugaccccug

SEQ ID NO: 2573677 - RNA, 13 nt, Human
ugcugcaaggccu

SEQ ID NO: 2573678 - RNA, 13 nt, Human
ugcugcaaaccug

SEQ ID NO: 2573679 - RNA, 17 nt, Human
ugcugauggugcaauga

SEQ ID NO: 2573680 - RNA, 15 nt, Human
ugcugauggugcaau

SEQ ID NO: 2573681 - RNA, 13 nt, Human
ugcugauggugca

SEQ ID NO: 2573682 - RNA, 16 nt, Human
ugcugacagcugcucc

SEQ ID NO: 2573683 - RNA, 17 nt, Human
ugcugacagcugcuccu

SEQ ID NO: 2573684 - RNA, 18 nt, Human
ugcugacagcugcuccua

SEQ ID NO: 2573685 - RNA, 14 nt, Human
ugcugacagcugcu

SEQ ID NO: 2573686 - RNA, 15 nt, Human
ugcugacagcugcuc

SEQ ID NO: 2573687 - RNA, 15 nt, Human
ugcugacagcugacc

SEQ ID NO: 2573688 - RNA, 15 nt, Human
ugcugcuuuccccug

SEQ ID NO: 2573689 - RNA, 20 nt, Human
ugcugcuuagacauaacaaa

SEQ ID NO: 2573690 - RNA, 14 nt, Human
ugcugcuguguuuu

SEQ ID NO: 2573691 - RNA, 13 nt, Human
ugcugcugucccu

SEQ ID NO: 2573692 - RNA, 19 nt, Human
ugcugcuuuccccuguggg

SEQ ID NO: 2573693 - RNA, 18 nt, Human
ugcugcuuuccccugugg

SEQ ID NO: 2573694 - RNA, 17 nt, Human
ugcugcuuuccccugug

SEQ ID NO: 2573695 - RNA, 16 nt, Human
ugcugcuuuccccugu

SEQ ID NO: 2573696 - RNA, 23 nt, Human
ugcugcuuuccccuguggggauc

SEQ ID NO: 2573697 - RNA, 21 nt, Human
ugcugcuuuccccugugggga

SEQ ID NO: 2573698 - RNA, 16 nt, Human
ugcuggaauucuaaca

SEQ ID NO: 2573699 - RNA, 17 nt, Human
ugcuggaauaaguucaa

SEQ ID NO: 2573700 - RNA, 23 nt, Human
ugcugcuuuuugagguggcacuu

SEQ ID NO: 2573701 - RNA, 22 nt, Human
ugcugcuuuuugagguggcacu

SEQ ID NO: 2573702 - RNA, 17 nt, Human
ugcugcuuuuccuuggg

SEQ ID NO: 2573703 - RNA, 20 nt, Human
ugcugcuuuuugagguggca

SEQ ID NO: 2573704 - RNA, 20 nt, Human
ugcugcuuuuccuuggggca

SEQ ID NO: 2573705 - RNA, 15 nt, Human
ugcugcuacuuaauu

SEQ ID NO: 2573706 - RNA, 13 nt, Human
ugcugcuggacag

SEQ ID NO: 2573707 - RNA, 23 nt, Human
ugcugcuggacaguaucacuguc

SEQ ID NO: 2573708 - RNA, 13 nt, Human
ugcugcuggcugg

SEQ ID NO: 2573709 - RNA, 23 nt, Human
ugcugcuacccucccugcugucc

SEQ ID NO: 2573710 - RNA, 22 nt, Human
ugcugcuacccucccugcuguc

SEQ ID NO: 2573711 - RNA, 17 nt, Human
ugcugcugcugcgcccu

SEQ ID NO: 2573712 - RNA, 21 nt, Human
ugcugcuacccucccugcugu

SEQ ID NO: 2573713 - RNA, 20 nt, Human
ugcugcuacccucccugcug

SEQ ID NO: 2573714 - RNA, 19 nt, Human
ugcugcuacccucccugcu

SEQ ID NO: 2573715 - RNA, 18 nt, Human
ugcugcuacccucccugc

SEQ ID NO: 2573716 - RNA, 17 nt, Human
ugcugcuacccucccug

SEQ ID NO: 2573717 - RNA, 15 nt, Human
ugcugcuacccuccc

SEQ ID NO: 2573718 - RNA, 14 nt, Human
ugcugcuacccucc

SEQ ID NO: 2573719 - RNA, 21 nt, Human
ugcugcuaaucuucagggcac

SEQ ID NO: 2573720 - RNA, 22 nt, Human
ugcugcuaaucuucagggcacu

SEQ ID NO: 2573721 - RNA, 17 nt, Human
ugcugcuaaucuucagg

SEQ ID NO: 2573722 - RNA, 14 nt, Human
ugcugcgugccugu

SEQ ID NO: 2573723 - RNA, 20 nt, Human
ugcugccuucuggauucuug

SEQ ID NO: 2573724 - RNA, 16 nt, Human
ugcugcgcccuuaccu

SEQ ID NO: 2573725 - RNA, 17 nt, Human
ugcugcgcccugggcuc

SEQ ID NO: 2573726 - RNA, 20 nt, Human
ugcugcgcccuuaccuuccc

SEQ ID NO: 2573727 - RNA, 15 nt, Human
ugcugcgcccuuccc

SEQ ID NO: 2573728 - RNA, 18 nt, Human
ugcugcaccaacccagcc

SEQ ID NO: 2573729 - RNA, 17 nt, Human
ugcugcaccaacccagc

SEQ ID NO: 2573730 - RNA, 14 nt, Human
ugcugcaccaaccc

SEQ ID NO: 2573731 - RNA, 23 nt, Human
ugcugcaaggccuuucugugugu

SEQ ID NO: 2573732 - RNA, 20 nt, Human
ugcugcaaggccuuucugug

SEQ ID NO: 2573733 - RNA, 15 nt, Human
ugcugcaaggccuuu

SEQ ID NO: 2573734 - RNA, 18 nt, Human
ugcugcaguugccaguca

SEQ ID NO: 2573735 - RNA, 23 nt, Human
ugcugcaguugccagucaccccg

SEQ ID NO: 2573736 - RNA, 15 nt, Human
ugcugcaugccuggu

SEQ ID NO: 2573737 - RNA, 19 nt, Human
ugcugcaccaacccagccg

SEQ ID NO: 2573738 - RNA, 21 nt, Human
ugccugucugucucuccaucu

SEQ ID NO: 2573739 - RNA, 14 nt, Human
ugccugucugaagc

SEQ ID NO: 2573740 - RNA, 18 nt, Human
ugccugucugucucucca

SEQ ID NO: 2573741 - RNA, 14 nt, Human
ugccugugaacuga

SEQ ID NO: 2573742 - RNA, 22 nt, Human
ugccugucuccuuugcaggcuc

SEQ ID NO: 2573743 - RNA, 23 nt, Human
ugccugucuccuuugcaggcuca

SEQ ID NO: 2573744 - RNA, 11 nt, Human
ugccugucucc

SEQ ID NO: 2573745 - RNA, 15 nt, Human
ugccuguagcaguga

SEQ ID NO: 2573746 - RNA, 13 nt, Human
ugccuguaguuag

SEQ ID NO: 2573747 - RNA, 22 nt, Human
ugccuguacucgcuugugcaga

SEQ ID NO: 2573748 - RNA, 19 nt, Human
ugccuguacucgcuugugc

SEQ ID NO: 2573749 - RNA, 18 nt, Human
ugccuguagcccacucug

SEQ ID NO: 2573750 - RNA, 20 nt, Human
ugccuguagcccacucugcu

SEQ ID NO: 2573751 - RNA, 23 nt, Human
ugccuguagcccacucugcucgc

SEQ ID NO: 2573752 - RNA, 15 nt, Human
ugccuguaaacauag

SEQ ID NO: 2573753 - RNA, 13 nt, Human
ugccuguaaacau

SEQ ID NO: 2573754 - RNA, 19 nt, Human
ugccuguaaucccagcacu

SEQ ID NO: 2573755 - RNA, 11 nt, Human
ugccuguaauc

SEQ ID NO: 2573756 - RNA, 15 nt, Human
ugccuguaacuugag

SEQ ID NO: 2573757 - RNA, 18 nt, Human
ugccuguaaucacagcua

SEQ ID NO: 2573758 - RNA, 16 nt, Human
ugccugguggcagcug

SEQ ID NO: 2573759 - RNA, 15 nt, Human
ugccugguggcagcu

SEQ ID NO: 2573760 - RNA, 14 nt, Human
ugccugguggcagc

SEQ ID NO: 2573761 - RNA, 23 nt, Human
ugccugagggccccucugcccag

SEQ ID NO: 2573762 - RNA, 22 nt, Human
ugccugagggccccucugccca

SEQ ID NO: 2573763 - RNA, 21 nt, Human
ugccugagggccccucugccc

SEQ ID NO: 2573764 - RNA, 20 nt, Human
ugccugagggccccucugcc

SEQ ID NO: 2573765 - RNA, 19 nt, Human
ugccugagggccccucugc

SEQ ID NO: 2573766 - RNA, 17 nt, Human
ugccugagggccccucu

SEQ ID NO: 2573767 - RNA, 16 nt, Human
ugccugagggccccuc

SEQ ID NO: 2573768 - RNA, 15 nt, Human
ugccugagggccccu

SEQ ID NO: 2573769 - RNA, 15 nt, Human
ugccuggcggggugg

SEQ ID NO: 2573770 - RNA, 19 nt, Human
ugccugagggcgaggggag

SEQ ID NO: 2573771 - RNA, 14 nt, Human
ugccugagaggcag

SEQ ID NO: 2573772 - RNA, 13 nt, Human
ugccugagaggca

SEQ ID NO: 2573773 - RNA, 23 nt, Human
ugccugacccuacuucuuuugcu

SEQ ID NO: 2573774 - RNA, 18 nt, Human
ugccugacauuuggagug

SEQ ID NO: 2573775 - RNA, 18 nt, Human
ugccugagaggcaggcau

SEQ ID NO: 2573776 - RNA, 17 nt, Human
ugccugagaggcaggca

SEQ ID NO: 2573777 - RNA, 16 nt, Human
ugccugagaggcaggc

SEQ ID NO: 2573778 - RNA, 15 nt, Human
ugccugagaggcagg

SEQ ID NO: 2573779 - RNA, 14 nt, Human
ugccugagggcccc

SEQ ID NO: 2573780 - RNA, 19 nt, Human
ugccugagaggcaggcaua

SEQ ID NO: 2573781 - RNA, 11 nt, Human
ugccugagcuu

SEQ ID NO: 2573782 - RNA, 21 nt, Human
ugccugggaucccucauccuc

SEQ ID NO: 2573783 - RNA, 15 nt, Human
ugccuggcucagagc

SEQ ID NO: 2573784 - RNA, 13 nt, Human
ugccuggcucaga

SEQ ID NO: 2573785 - RNA, 11 nt, Human
ugccuggcuca

SEQ ID NO: 2573786 - RNA, 22 nt, Human
ugccuggcuucgcaaaauguuu

SEQ ID NO: 2573787 - RNA, 16 nt, Human
ugccuggcucagagcc

SEQ ID NO: 2573788 - RNA, 14 nt, Human
ugccugggaaugua

SEQ ID NO: 2573789 - RNA, 18 nt, Human
ugccugggcagaaggaag

SEQ ID NO: 2573790 - RNA, 15 nt, Human
ugccugggaauguau

SEQ ID NO: 2573791 - RNA, 16 nt, Human
ugccugggaauguauu

SEQ ID NO: 2573792 - RNA, 19 nt, Human
ugccuggugcacugugucu

SEQ ID NO: 2573793 - RNA, 22 nt, Human
ugccugggaguuuuguauucau

SEQ ID NO: 2573794 - RNA, 22 nt, Human
ugccugaacauccuuccuuccc

SEQ ID NO: 2573795 - RNA, 16 nt, Human
ugccugaaccuuccau

SEQ ID NO: 2573796 - RNA, 13 nt, Human
ugccugaagaaca

SEQ ID NO: 2573797 - RNA, 21 nt, Human
ugccugaacauccuuccuucc

SEQ ID NO: 2573798 - RNA, 20 nt, Human
ugccugaacauccuuccuuc

SEQ ID NO: 2573799 - RNA, 17 nt, Human
ugccugaacauccuucc

SEQ ID NO: 2573800 - RNA, 14 nt, Human
ugccugaacauccu

SEQ ID NO: 2573801 - RNA, 13 nt, Human
ugccugaacaucc

SEQ ID NO: 2573802 - RNA, 18 nt, Human
ugccucuuuccuguuguu

SEQ ID NO: 2573803 - RNA, 16 nt, Human
ugccucuucugggagg

SEQ ID NO: 2573804 - RNA, 19 nt, Human
ugccucuucugggagggca

SEQ ID NO: 2573805 - RNA, 20 nt, Human
ugccucuucugggagggcag

SEQ ID NO: 2573806 - RNA, 21 nt, Human
ugccucuucugggagggcagc

SEQ ID NO: 2573807 - RNA, 16 nt, Human
ugccucuucugugggu

SEQ ID NO: 2573808 - RNA, 13 nt, Human
ugccucuucuggg

SEQ ID NO: 2573809 - RNA, 15 nt, Human
ugccucuuucaucca

SEQ ID NO: 2573810 - RNA, 17 nt, Human
ugccucuuucauccacu

SEQ ID NO: 2573811 - RNA, 16 nt, Human
ugccucuuucauccac

SEQ ID NO: 2573812 - RNA, 14 nt, Human
ugccucuuuccugu

SEQ ID NO: 2573813 - RNA, 9 nt, Human
ugccucucu

SEQ ID NO: 2573814 - RNA, 20 nt, Human
ugccucuccuuuguauauua

SEQ ID NO: 2573815 - RNA, 15 nt, Human
ugccucuucugggag

SEQ ID NO: 2573816 - RNA, 17 nt, Human
ugccucuccuuuguaua

SEQ ID NO: 2573817 - RNA, 16 nt, Human
ugccucuccuuuguau

SEQ ID NO: 2573818 - RNA, 18 nt, Human
ugccucucccuggcccuc

SEQ ID NO: 2573819 - RNA, 21 nt, Human
ugccucucaucaacugaauga

SEQ ID NO: 2573820 - RNA, 18 nt, Human
ugccucucaucaacugaa

SEQ ID NO: 2573821 - RNA, 13 nt, Human
ugccccuggcugg

SEQ ID NO: 2573822 - RNA, 15 nt, Human
ugccccucccugcuu

SEQ ID NO: 2573823 - RNA, 17 nt, Human
ugccccucccugcuuca

SEQ ID NO: 2573824 - RNA, 18 nt, Human
ugccccuggcagccccug

SEQ ID NO: 2573825 - RNA, 23 nt, Human
ugccucgaaacacagaaaccuuu

SEQ ID NO: 2573826 - RNA, 21 nt, Human
ugccccuucccaucucuuccu

SEQ ID NO: 2573827 - RNA, 19 nt, Human
ugccccuucccaucucuuc

SEQ ID NO: 2573828 - RNA, 18 nt, Human
ugccccuguucucuucca

SEQ ID NO: 2573829 - RNA, 14 nt, Human
ugccccuggcucug

SEQ ID NO: 2573830 - RNA, 19 nt, Human
ugccucgaacuggcugcaa

SEQ ID NO: 2573831 - RNA, 18 nt, Human
ugccucgaacuggcugca

SEQ ID NO: 2573832 - RNA, 20 nt, Human
ugccucgaacuggcugcaaa

SEQ ID NO: 2573833 - RNA, 17 nt, Human
ugccugugaacugaacu

SEQ ID NO: 2573834 - RNA, 18 nt, Human
ugccugugaacugaacuc

SEQ ID NO: 2573835 - RNA, 21 nt, Human
ugccugugaacugaacucuga

SEQ ID NO: 2573836 - RNA, 14 nt, Human
ugccugugaggcag

SEQ ID NO: 2573837 - RNA, 18 nt, Human
ugccugucuguuacacug

SEQ ID NO: 2573838 - RNA, 16 nt, Human
ugccugugaggcaggg

SEQ ID NO: 2573839 - RNA, 20 nt, Human
ugccuucgucuuucccaugg

SEQ ID NO: 2573840 - RNA, 16 nt, Human
ugccuucuacuuuuaa

SEQ ID NO: 2573841 - RNA, 15 nt, Human
ugccuucuaaaggug

SEQ ID NO: 2573842 - RNA, 23 nt, Human
ugccuucgcuucuugccucugug

SEQ ID NO: 2573843 - RNA, 22 nt, Human
ugccuucgcuucuugccucugu

SEQ ID NO: 2573844 - RNA, 21 nt, Human
ugccuucgcuucuugccucug

SEQ ID NO: 2573845 - RNA, 20 nt, Human
ugccuucgcuucuugccucu

SEQ ID NO: 2573846 - RNA, 17 nt, Human
ugccuucuucacccagc

SEQ ID NO: 2573847 - RNA, 13 nt, Human
ugccuucuucacc

SEQ ID NO: 2573848 - RNA, 15 nt, Human
ugccuucucaacucc

SEQ ID NO: 2573849 - RNA, 22 nt, Human
ugccuucuucuuuuugcuguug

SEQ ID NO: 2573850 - RNA, 21 nt, Human
ugccuucuucuuuuugcuguu

SEQ ID NO: 2573851 - RNA, 20 nt, Human
ugccuucuucuuuuugcugu

SEQ ID NO: 2573852 - RNA, 16 nt, Human
ugccuucuuuugauua

SEQ ID NO: 2573853 - RNA, 14 nt, Human
ugccuucuucaccc

SEQ ID NO: 2573854 - RNA, 16 nt, Human
ugccuucuaaaggugu

SEQ ID NO: 2573855 - RNA, 16 nt, Human
ugccuucuucacccag

SEQ ID NO: 2573856 - RNA, 21 nt, Human
ugccuucuucggggaacuccu

SEQ ID NO: 2573857 - RNA, 19 nt, Human
ugccuucuucuuuuugcug

SEQ ID NO: 2573858 - RNA, 12 nt, Human
ugccuucuucuu

SEQ ID NO: 2573859 - RNA, 22 nt, Human
ugccuucuucggggaacuccug

SEQ ID NO: 2573860 - RNA, 23 nt, Human
ugccuucuucggggaacuccugg

SEQ ID NO: 2573861 - RNA, 21 nt, Human
ugcgaucuggguucacugcaa

SEQ ID NO: 2573862 - RNA, 20 nt, Human
ugcgaucuggguucacugca

SEQ ID NO: 2573863 - RNA, 19 nt, Human
ugcgaucuggguucacugc

SEQ ID NO: 2573864 - RNA, 15 nt, Human
ugcgaucuggguuca

SEQ ID NO: 2573865 - RNA, 23 nt, Human
ugccuugaauauccccucccagu

SEQ ID NO: 2573866 - RNA, 22 nt, Human
ugcgaguauguguuugugugug

SEQ ID NO: 2573867 - RNA, 15 nt, Human
ugccuugaagccacu

SEQ ID NO: 2573868 - RNA, 20 nt, Human
ugcgagugcucauuucagga

SEQ ID NO: 2573869 - RNA, 13 nt, Human
ugcgagugugugc

SEQ ID NO: 2573870 - RNA, 17 nt, Human
ugcgagugugugcaugu

SEQ ID NO: 2573871 - RNA, 19 nt, Human
ugccuugaaccacuucccu

SEQ ID NO: 2573872 - RNA, 17 nt, Human
ugccuugaaccacuucc

SEQ ID NO: 2573873 - RNA, 15 nt, Human
ugccuugaaccacuu

SEQ ID NO: 2573874 - RNA, 21 nt, Human
ugccuugaaccacuucccuca

SEQ ID NO: 2573875 - RNA, 14 nt, Human
ugccuugaagccac

SEQ ID NO: 2573876 - RNA, 14 nt, Human
ugcgaucuggguuc

SEQ ID NO: 2573877 - RNA, 22 nt, Human
ugcgagugugugcaugugugug

SEQ ID NO: 2573878 - RNA, 19 nt, Human
ugcgagugugugcaugugu

SEQ ID NO: 2573879 - RNA, 21 nt, Human
ugcgagugugugcaugugugu

SEQ ID NO: 2573880 - RNA, 22 nt, Human
ugcgugacaauaaaacauuaau

SEQ ID NO: 2573881 - RNA, 17 nt, Human
ugcgugacaauaaaaca

SEQ ID NO: 2573882 - RNA, 15 nt, Human
ugcgugacaauaaaa

SEQ ID NO: 2573883 - RNA, 14 nt, Human
ugcgugacaauaaa

SEQ ID NO: 2573884 - RNA, 22 nt, Human
ugcgugaaacacaccaggcugu

SEQ ID NO: 2573885 - RNA, 22 nt, Human
ugcguccuccucaccucaugcc

SEQ ID NO: 2573886 - RNA, 19 nt, Human
ugcguccuccucaccucau

SEQ ID NO: 2573887 - RNA, 16 nt, Human
ugcguccuccucaccu

SEQ ID NO: 2573888 - RNA, 14 nt, Human
ugcguccuccucac

SEQ ID NO: 2573889 - RNA, 15 nt, Human
ugcgucuggaggggc

SEQ ID NO: 2573890 - RNA, 23 nt, Human
ugcguccuccucaccucaugccc

SEQ ID NO: 2573891 - RNA, 23 nt, Human
ugcgucuggaggggccccugcuu

SEQ ID NO: 2573892 - RNA, 22 nt, Human
ugcgucuggaggggccccugcu

SEQ ID NO: 2573893 - RNA, 21 nt, Human
ugcgucuggaggggccccugc

SEQ ID NO: 2573894 - RNA, 20 nt, Human
ugcgucuggaggggccccug

SEQ ID NO: 2573895 - RNA, 14 nt, Human
ugcgugaaacacac

SEQ ID NO: 2573896 - RNA, 16 nt, Human
ugcgaucuucagagca

SEQ ID NO: 2573897 - RNA, 19 nt, Human
ugcguccacgagcuguuua

SEQ ID NO: 2573898 - RNA, 22 nt, Human
ugcgccuacaggagugagcacu

SEQ ID NO: 2573899 - RNA, 16 nt, Human
ugcgccuacaggagug

SEQ ID NO: 2573900 - RNA, 14 nt, Human
ugcgccuacaggag

SEQ ID NO: 2573901 - RNA, 21 nt, Human
ugcuaaauuuucaguagggcu

SEQ ID NO: 2573902 - RNA, 18 nt, Human
ugcuaaauguaacagucu

SEQ ID NO: 2573903 - RNA, 17 nt, Human
ugcuaaauguaacaguc

SEQ ID NO: 2573904 - RNA, 16 nt, Human
ugcuaaauguaacagu

SEQ ID NO: 2573905 - RNA, 15 nt, Human
ugcuaaauguaacag

SEQ ID NO: 2573906 - RNA, 20 nt, Human
ugcuaaauguaacagucuga

SEQ ID NO: 2573907 - RNA, 19 nt, Human
ugcuaaauguaacagucug

SEQ ID NO: 2573908 - RNA, 13 nt, Human
ugcuaagaugcuc

SEQ ID NO: 2573909 - RNA, 16 nt, Human
ugcuaacaucuaaaaa

SEQ ID NO: 2573910 - RNA, 22 nt, Human
ugcuaagacucaguggggaggg

SEQ ID NO: 2573911 - RNA, 13 nt, Human
ugcuaacaucuaa

SEQ ID NO: 2573912 - RNA, 15 nt, Human
ugcuaaauuuucagu

SEQ ID NO: 2573913 - RNA, 15 nt, Human
ugcuaaaugugaaug

SEQ ID NO: 2573914 - RNA, 20 nt, Human
ugcuaaauggucgcccagga

SEQ ID NO: 2573915 - RNA, 21 nt, Human
ugcuaaauggucgcccaggag

SEQ ID NO: 2573916 - RNA, 14 nt, Human
ugcuaaauguaaca

SEQ ID NO: 2573917 - RNA, 11 nt, Human
ugcuaaaugua

SEQ ID NO: 2573918 - RNA, 22 nt, Human
ugcuaaauggucgcccaggaga

SEQ ID NO: 2573919 - RNA, 23 nt, Human
ugcuaaauaaaauuuguugcaua

SEQ ID NO: 2573920 - RNA, 22 nt, Human
ugcuaaauaaaauuuguugcau

SEQ ID NO: 2573921 - RNA, 21 nt, Human
ugcuaaauaaaauuuguugca

SEQ ID NO: 2573922 - RNA, 17 nt, Human
ugcuaaauaaaauuugu

SEQ ID NO: 2573923 - RNA, 22 nt, Human
ugcuaaagaaaaagucauccaa

SEQ ID NO: 2573924 - RNA, 21 nt, Human
ugcuaaagaaaaagucaucca

SEQ ID NO: 2573925 - RNA, 16 nt, Human
uguacaaggacagccc

SEQ ID NO: 2573926 - RNA, 20 nt, Human
uguacaaggacagccccucc

SEQ ID NO: 2573927 - RNA, 16 nt, Human
uguacaagaugaagga

SEQ ID NO: 2573928 - RNA, 23 nt, Human
uguacaaggacagccccuccucc

SEQ ID NO: 2573929 - RNA, 16 nt, Human
uguaauguuacugauc

SEQ ID NO: 2573930 - RNA, 17 nt, Human
uguaauguuacugauca

SEQ ID NO: 2573931 - RNA, 19 nt, Human
uguaauguuacugaucaug

SEQ ID NO: 2573932 - RNA, 22 nt, Human
uguaauguuacugaucaugcau

SEQ ID NO: 2573933 - RNA, 17 nt, Human
uguaauuaaguacuaug

SEQ ID NO: 2573934 - RNA, 17 nt, Human
uguacagagcccacgcc

SEQ ID NO: 2573935 - RNA, 16 nt, Human
uguacagagcccacgc

SEQ ID NO: 2573936 - RNA, 18 nt, Human
uguacaaugacuuuauug

SEQ ID NO: 2573937 - RNA, 17 nt, Human
uguacaauauuuaaaau

SEQ ID NO: 2573938 - RNA, 14 nt, Human
uguacaauauuuaa

SEQ ID NO: 2573939 - RNA, 15 nt, Human
uguacaauauuuaaa

SEQ ID NO: 2573940 - RNA, 13 nt, Human
uguacagagccca

SEQ ID NO: 2573941 - RNA, 22 nt, Human
uguacaauugaacuuaaauaaa

SEQ ID NO: 2573942 - RNA, 23 nt, Human
uguacaauugaacuuaaauaaau

SEQ ID NO: 2573943 - RNA, 16 nt, Human
uguaccgcaaugugac

SEQ ID NO: 2573944 - RNA, 22 nt, Human
uguacaguuuguuuacacacgu

SEQ ID NO: 2573945 - RNA, 17 nt, Human
uguacaguuuguuuaca

SEQ ID NO: 2573946 - RNA, 16 nt, Human
uguacaguuuguuuac

SEQ ID NO: 2573947 - RNA, 14 nt, Human
uguacaguuuguuu

SEQ ID NO: 2573948 - RNA, 14 nt, Human
uguacaguucaguu

SEQ ID NO: 2573949 - RNA, 17 nt, Human
uguacaguuauuuaugc

SEQ ID NO: 2573950 - RNA, 13 nt, Human
uguacaguuuguu

SEQ ID NO: 2573951 - RNA, 16 nt, Human
uguacaguuugcugua

SEQ ID NO: 2573952 - RNA, 20 nt, Human
uguacaguucaguuccucuu

SEQ ID NO: 2573953 - RNA, 15 nt, Human
uguacaguuugcugu

SEQ ID NO: 2573954 - RNA, 13 nt, Human
uguacaguguucu

SEQ ID NO: 2573955 - RNA, 20 nt, Human
uguacaguguucuguuuaau

SEQ ID NO: 2573956 - RNA, 16 nt, Human
uguacaguguucuguu

SEQ ID NO: 2573957 - RNA, 17 nt, Human
uguacaguguguaaagu

SEQ ID NO: 2573958 - RNA, 11 nt, Human
uguacaguguu

SEQ ID NO: 2573959 - RNA, 19 nt, Human
uguacaguguguaaagugu

SEQ ID NO: 2573960 - RNA, 18 nt, Human
uguacagagcccacgccc

SEQ ID NO: 2573961 - RNA, 21 nt, Human
uguacagucuuguauuaaguu

SEQ ID NO: 2573962 - RNA, 17 nt, Human
uguacagucuuguauua

SEQ ID NO: 2573963 - RNA, 21 nt, Human
uguaaguuucaggugacaugu

SEQ ID NO: 2573964 - RNA, 20 nt, Human
uguaaguuucaggugacaug

SEQ ID NO: 2573965 - RNA, 19 nt, Human
uguaaguuucaggugacau

SEQ ID NO: 2573966 - RNA, 18 nt, Human
uguaaguuucaggugaca

SEQ ID NO: 2573967 - RNA, 16 nt, Human
uguaaguuucagguga

SEQ ID NO: 2573968 - RNA, 15 nt, Human
uguaaguuucaggug

SEQ ID NO: 2573969 - RNA, 23 nt, Human
uguaaguuucaggugacauguga

SEQ ID NO: 2573970 - RNA, 20 nt, Human
uguaauaaaaaguauauguu

SEQ ID NO: 2573971 - RNA, 17 nt, Human
uguaauaaacuuuaaua

SEQ ID NO: 2573972 - RNA, 16 nt, Human
uguaauagaaaacuga

SEQ ID NO: 2573973 - RNA, 20 nt, Human
uguaauagaaaacugaaaau

SEQ ID NO: 2573974 - RNA, 18 nt, Human
uguaauagaaaacugaaa

SEQ ID NO: 2573975 - RNA, 15 nt, Human
uguaauaaacuuuaa

SEQ ID NO: 2573976 - RNA, 13 nt, Human
uguaauaaacuuu

SEQ ID NO: 2573977 - RNA, 12 nt, Human
uguaauaaauau

SEQ ID NO: 2573978 - RNA, 21 nt, Human
uggucacagcggaggugugga

SEQ ID NO: 2573979 - RNA, 15 nt, Human
uggucacagcggagg

SEQ ID NO: 2573980 - RNA, 14 nt, Human
uguaaguuucaggu

SEQ ID NO: 2573981 - RNA, 18 nt, Human
uggucacagccuccucug

SEQ ID NO: 2573982 - RNA, 17 nt, Human
uggucacagccuccucu

SEQ ID NO: 2573983 - RNA, 16 nt, Human
uggucacagccuccuc

SEQ ID NO: 2573984 - RNA, 15 nt, Human
uggucacagccuccu

SEQ ID NO: 2573985 - RNA, 14 nt, Human
uggucacagccucc

SEQ ID NO: 2573986 - RNA, 13 nt, Human
uggucacagccuc

SEQ ID NO: 2573987 - RNA, 19 nt, Human
ugguauuguauuuauucaa

SEQ ID NO: 2573988 - RNA, 22 nt, Human
uggucaagauuuugaaugcuuc

SEQ ID NO: 2573989 - RNA, 22 nt, Human
uggucaauccgaaguaugaggg

SEQ ID NO: 2573990 - RNA, 14 nt, Human
uggucacacacuga

SEQ ID NO: 2573991 - RNA, 15 nt, Human
uggucacacacugau

SEQ ID NO: 2573992 - RNA, 16 nt, Human
uggucacacacugaug

SEQ ID NO: 2573993 - RNA, 21 nt, Human
uguaaucuugaauuguaacug

SEQ ID NO: 2573994 - RNA, 23 nt, Human
uguaaugucaccaccuucccagc

SEQ ID NO: 2573995 - RNA, 14 nt, Human
uguaauguuacuga

SEQ ID NO: 2573996 - RNA, 13 nt, Human
uguaauguuacug

SEQ ID NO: 2573997 - RNA, 19 nt, Human
uguaaucucguuucaaaaa

SEQ ID NO: 2573998 - RNA, 15 nt, Human
uguaaucuugaauug

SEQ ID NO: 2573999 - RNA, 17 nt, Human
uguaaucccagcuacuu

SEQ ID NO: 2574000 - RNA, 16 nt, Human
uguaaucguuaugugu

SEQ ID NO: 2574001 - RNA, 18 nt, Human
uguaaucguuaugugugu

SEQ ID NO: 2574002 - RNA, 19 nt, Human
uguaaucguuaugugugua

SEQ ID NO: 2574003 - RNA, 18 nt, Human
uguaaucucguuucaaaa

SEQ ID NO: 2574004 - RNA, 17 nt, Human
uguaaucucguuucaaa

SEQ ID NO: 2574005 - RNA, 16 nt, Human
uguaaucuauguauau

SEQ ID NO: 2574006 - RNA, 21 nt, Human
uguaaucguuauguguguaua

SEQ ID NO: 2574007 - RNA, 17 nt, Human
uguaauauaaagauguu

SEQ ID NO: 2574008 - RNA, 18 nt, Human
uguaaucaauaaacgauu

SEQ ID NO: 2574009 - RNA, 16 nt, Human
uguaaucaauaaacga

SEQ ID NO: 2574010 - RNA, 14 nt, Human
uguaaucaauguuu

SEQ ID NO: 2574011 - RNA, 15 nt, Human
uguaaucaauaaacg

SEQ ID NO: 2574012 - RNA, 14 nt, Human
uguaaucaauaaac

SEQ ID NO: 2574013 - RNA, 13 nt, Human
uguaaucaauaaa

SEQ ID NO: 2574014 - RNA, 14 nt, Human
uguaaucacagcua

SEQ ID NO: 2574015 - RNA, 20 nt, Human
uguaaucaauguuucuucua

SEQ ID NO: 2574016 - RNA, 20 nt, Human
uguaaucccagcuacucagg

SEQ ID NO: 2574017 - RNA, 21 nt, Human
uguaaucccagcuacucagga

SEQ ID NO: 2574018 - RNA, 16 nt, Human
uguaauccgaaucucu

SEQ ID NO: 2574019 - RNA, 22 nt, Human
uguaaucccagcuacuugggag

SEQ ID NO: 2574020 - RNA, 23 nt, Human
uguaaucccagcuacucaggagg

SEQ ID NO: 2574021 - RNA, 20 nt, Human
uguaaucccagcuacucggg

SEQ ID NO: 2574022 - RNA, 22 nt, Human
uguagaugaaaaagcauguaca

SEQ ID NO: 2574023 - RNA, 15 nt, Human
uguagauucugugga

SEQ ID NO: 2574024 - RNA, 23 nt, Human
uguagaugaaaaagcauguacag

SEQ ID NO: 2574025 - RNA, 21 nt, Human
uguagaugaaaaagcauguac

SEQ ID NO: 2574026 - RNA, 20 nt, Human
uguagaugaaaaagcaugua

SEQ ID NO: 2574027 - RNA, 19 nt, Human
uguagaugaaaaagcaugu

SEQ ID NO: 2574028 - RNA, 13 nt, Human
uguagaugaaaaa

SEQ ID NO: 2574029 - RNA, 11 nt, Human
uguagaugaaa

SEQ ID NO: 2574030 - RNA, 19 nt, Human
uguacuguucugugucuuu

SEQ ID NO: 2574031 - RNA, 16 nt, Human
uguacuguucuguguc

SEQ ID NO: 2574032 - RNA, 22 nt, Human
uguagauauugugaaguacaua

SEQ ID NO: 2574033 - RNA, 18 nt, Human
uguagaucagagcagcag

SEQ ID NO: 2574034 - RNA, 19 nt, Human
uguagauauugugaaguac

SEQ ID NO: 2574035 - RNA, 21 nt, Human
uguagauauugugaaguacau

SEQ ID NO: 2574036 - RNA, 17 nt, Human
uguagcauuucuugaug

SEQ ID NO: 2574037 - RNA, 16 nt, Human
uguagcaucuucugga

SEQ ID NO: 2574038 - RNA, 23 nt, Human
uguagcagugagaaaaagcuccu

SEQ ID NO: 2574039 - RNA, 18 nt, Human
uguagcauuucuugaugu

SEQ ID NO: 2574040 - RNA, 10 nt, Human
uguagccaag

SEQ ID NO: 2574041 - RNA, 15 nt, Human
uguagauuuauuuca

SEQ ID NO: 2574042 - RNA, 16 nt, Human
uguagauuuauuucau

SEQ ID NO: 2574043 - RNA, 11 nt, Human
uguagcaguga

SEQ ID NO: 2574044 - RNA, 22 nt, Human
uguaccuuuugaggagccccag

SEQ ID NO: 2574045 - RNA, 15 nt, Human
uguacgucugacagg

SEQ ID NO: 2574046 - RNA, 23 nt, Human
uguaccuuuuaacaccugaugug

SEQ ID NO: 2574047 - RNA, 22 nt, Human
uguaccuuuuaacaccugaugu

SEQ ID NO: 2574048 - RNA, 21 nt, Human
uguaccuuuugaggagcccca

SEQ ID NO: 2574049 - RNA, 14 nt, Human
uguaccucugccuc

SEQ ID NO: 2574050 - RNA, 15 nt, Human
uguaccuuuuaacac

SEQ ID NO: 2574051 - RNA, 19 nt, Human
uguacugcauaugaaagga

SEQ ID NO: 2574052 - RNA, 23 nt, Human
uguacuguucucuucuugaacac

SEQ ID NO: 2574053 - RNA, 15 nt, Human
uguacuguucugugu

SEQ ID NO: 2574054 - RNA, 16 nt, Human
uguacuguaguuuuuc

SEQ ID NO: 2574055 - RNA, 18 nt, Human
uguacuguaaagagaccu

SEQ ID NO: 2574056 - RNA, 13 nt, Human
uguacuggggguu

SEQ ID NO: 2574057 - RNA, 12 nt, Human
uguacuguaguu

SEQ ID NO: 2574058 - RNA, 12 nt, Human
uguacugggggu

SEQ ID NO: 2574059 - RNA, 19 nt, Human
uguagcccccuggccucug

SEQ ID NO: 2574060 - RNA, 20 nt, Human
uguagcccccuggccucugu

SEQ ID NO: 2574061 - RNA, 18 nt, Human
uguagccccucuccugga

SEQ ID NO: 2574062 - RNA, 20 nt, Human
uguagccugugcauguaugu

SEQ ID NO: 2574063 - RNA, 16 nt, Human
uguagccugugcaugu

SEQ ID NO: 2574064 - RNA, 23 nt, Human
uguagccuggauauuauucuugu

SEQ ID NO: 2574065 - RNA, 15 nt, Human
uguagccuuccucca

SEQ ID NO: 2574066 - RNA, 22 nt, Human
uguagccugugcauguaugucu

SEQ ID NO: 2574067 - RNA, 15 nt, Human
uguagccugugcaug

SEQ ID NO: 2574068 - RNA, 14 nt, Human
uguagccugugcau

SEQ ID NO: 2574069 - RNA, 13 nt, Human
uguagccugugca

SEQ ID NO: 2574070 - RNA, 22 nt, Human
uguagccucgccgucugugaau

SEQ ID NO: 2574071 - RNA, 16 nt, Human
uguagcccacacuuga

SEQ ID NO: 2574072 - RNA, 14 nt, Human
uguagcccacacuu

SEQ ID NO: 2574073 - RNA, 16 nt, Human
uguagccaugggacca

SEQ ID NO: 2574074 - RNA, 15 nt, Human
uguagccaugggacc

SEQ ID NO: 2574075 - RNA, 11 nt, Human
uguagccaugg

SEQ ID NO: 2574076 - RNA, 22 nt, Human
uguagccaugaccuuacauuuc

SEQ ID NO: 2574077 - RNA, 16 nt, Human
uguagcccccuggccu

SEQ ID NO: 2574078 - RNA, 17 nt, Human
uguagcccccuggccuc

SEQ ID NO: 2574079 - RNA, 18 nt, Human
uguagcccccuggccucu

SEQ ID NO: 2574080 - RNA, 16 nt, Human
uguagcccacucugcu

SEQ ID NO: 2574081 - RNA, 17 nt, Human
uguagcccacucugcuc

SEQ ID NO: 2574082 - RNA, 22 nt, Human
uguagcccacucugcucgccuu

SEQ ID NO: 2574083 - RNA, 22 nt, Human
uguaguguuggagaagaacuga

SEQ ID NO: 2574084 - RNA, 15 nt, Human
uguaguuaggaaaua

SEQ ID NO: 2574085 - RNA, 23 nt, Human
uguaguuaggaaauaaaaccuuu

SEQ ID NO: 2574086 - RNA, 13 nt, Human
uguaguuaaugau

SEQ ID NO: 2574087 - RNA, 12 nt, Human
uguaguuaggaa

SEQ ID NO: 2574088 - RNA, 13 nt, Human
uguaguuaggaaa

SEQ ID NO: 2574089 - RNA, 14 nt, Human
uguaguuaggaaau

SEQ ID NO: 2574090 - RNA, 14 nt, Human
uguagcugguuucc

SEQ ID NO: 2574091 - RNA, 16 nt, Human
uguagccuugcccgga

SEQ ID NO: 2574092 - RNA, 17 nt, Human
uguagccuugcccggau

SEQ ID NO: 2574093 - RNA, 21 nt, Human
uguagccuuccuccacauccu

SEQ ID NO: 2574094 - RNA, 18 nt, Human
uguccccaccgcagacag

SEQ ID NO: 2574095 - RNA, 23 nt, Human
ugucccacccccacccccagcuc

SEQ ID NO: 2574096 - RNA, 22 nt, Human
ugucccaccucuucucuuccug

SEQ ID NO: 2574097 - RNA, 21 nt, Human
ugucccaccucuucucuuccu

SEQ ID NO: 2574098 - RNA, 13 nt, Human
ugucccaccucuu

SEQ ID NO: 2574099 - RNA, 12 nt, Human
ugucccaccucu

SEQ ID NO: 2574100 - RNA, 22 nt, Human
ugucccacccccacccccagcu

SEQ ID NO: 2574101 - RNA, 18 nt, Human
ugucccacccccaccccc

SEQ ID NO: 2574102 - RNA, 17 nt, Human
ugucccacccccacccc

SEQ ID NO: 2574103 - RNA, 18 nt, Human
uguccaugcgcucagggc

SEQ ID NO: 2574104 - RNA, 13 nt, Human
ugucccaccagcu

SEQ ID NO: 2574105 - RNA, 22 nt, Human
uguccccaccgcagacaggacc

SEQ ID NO: 2574106 - RNA, 19 nt, Human
uguccccaccgcagacagg

SEQ ID NO: 2574107 - RNA, 17 nt, Human
ugucccccagcucuggu

SEQ ID NO: 2574108 - RNA, 16 nt, Human
ugucccccagcucugg

SEQ ID NO: 2574109 - RNA, 15 nt, Human
ugucccccagcucug

SEQ ID NO: 2574110 - RNA, 13 nt, Human
ugucccccagcuc

SEQ ID NO: 2574111 - RNA, 23 nt, Human
ugucccaccucuucucuuccugu

SEQ ID NO: 2574112 - RNA, 13 nt, Human
uguccccaccgca

SEQ ID NO: 2574113 - RNA, 19 nt, Human
uguccccaguuugcagaaa

SEQ ID NO: 2574114 - RNA, 17 nt, Human
uguccccgacccuugcc

SEQ ID NO: 2574115 - RNA, 20 nt, Human
uguccuacccacccuccuuu

SEQ ID NO: 2574116 - RNA, 16 nt, Human
uguccccgacccuugc

SEQ ID NO: 2574117 - RNA, 20 nt, Human
ugucccccuaauauuaggga

SEQ ID NO: 2574118 - RNA, 18 nt, Human
ugucccccucuguccagg

SEQ ID NO: 2574119 - RNA, 12 nt, Human
uguccucagccu

SEQ ID NO: 2574120 - RNA, 13 nt, Human
uguccucagccuu

SEQ ID NO: 2574121 - RNA, 16 nt, Human
uguccucagccuugcc

SEQ ID NO: 2574122 - RNA, 17 nt, Human
uguccuacucuguguca

SEQ ID NO: 2574123 - RNA, 12 nt, Human
uguccuacucug

SEQ ID NO: 2574124 - RNA, 17 nt, Human
uguccaguucccagaag

SEQ ID NO: 2574125 - RNA, 23 nt, Human
uguccagugcccauuccucaccu

SEQ ID NO: 2574126 - RNA, 18 nt, Human
uguccagugcccauuccu

SEQ ID NO: 2574127 - RNA, 17 nt, Human
uguccagugcccauucc

SEQ ID NO: 2574128 - RNA, 16 nt, Human
uguccagugcccauuc

SEQ ID NO: 2574129 - RNA, 15 nt, Human
uguccagugcccauu

SEQ ID NO: 2574130 - RNA, 14 nt, Human
uguccagugcccau

SEQ ID NO: 2574131 - RNA, 13 nt, Human
uguccagugccca

SEQ ID NO: 2574132 - RNA, 13 nt, Human
uguccagggcccu

SEQ ID NO: 2574133 - RNA, 23 nt, Human
uguccaguggguagguuggacug

SEQ ID NO: 2574134 - RNA, 16 nt, Human
ugucccaacuuguaaa

SEQ ID NO: 2574135 - RNA, 14 nt, Human
ugucauuucauuuc

SEQ ID NO: 2574136 - RNA, 16 nt, Human
ugucauuugagcaggg

SEQ ID NO: 2574137 - RNA, 19 nt, Human
ugucauuugagcagggcuc

SEQ ID NO: 2574138 - RNA, 16 nt, Human
ugucauuucauuuccu

SEQ ID NO: 2574139 - RNA, 17 nt, Human
ugucauuucauuuccua

SEQ ID NO: 2574140 - RNA, 17 nt, Human
uguccagggcccugagc

SEQ ID NO: 2574141 - RNA, 19 nt, Human
uguccagggcccugagcuc

SEQ ID NO: 2574142 - RNA, 23 nt, Human
ugucaugccccccucaaaccucc

SEQ ID NO: 2574143 - RNA, 17 nt, Human
ugucaugccccccucaa

SEQ ID NO: 2574144 - RNA, 16 nt, Human
ugucaugccccccuca

SEQ ID NO: 2574145 - RNA, 15 nt, Human
ugucaugccccccuc

SEQ ID NO: 2574146 - RNA, 14 nt, Human
ugucaugccccccu

SEQ ID NO: 2574147 - RNA, 21 nt, Human
ugucaugaauucuuaugcuua

SEQ ID NO: 2574148 - RNA, 19 nt, Human
ugucaugaauucuuaugcu

SEQ ID NO: 2574149 - RNA, 16 nt, Human
ugucaugaauucuuau

SEQ ID NO: 2574150 - RNA, 16 nt, Human
ugucaugaacauguuc

SEQ ID NO: 2574151 - RNA, 12 nt, Human
ugucaugaacau

SEQ ID NO: 2574152 - RNA, 23 nt, Human
ugucaucuuucuucuauuuuauu

SEQ ID NO: 2574153 - RNA, 13 nt, Human
ugucauuaaaaua

SEQ ID NO: 2574154 - RNA, 16 nt, Human
ugucauuuauauagau

SEQ ID NO: 2574155 - RNA, 18 nt, Human
ugucauuaaaauaaauaa

SEQ ID NO: 2574156 - RNA, 13 nt, Human
ugucaccugaaga

SEQ ID NO: 2574157 - RNA, 22 nt, Human
ugucaccguggaccuuccugcc

SEQ ID NO: 2574158 - RNA, 21 nt, Human
ugucaccguggaccuuccugc

SEQ ID NO: 2574159 - RNA, 20 nt, Human
ugucaccguggaccuuccug

SEQ ID NO: 2574160 - RNA, 19 nt, Human
ugucaccguggaccuuccu

SEQ ID NO: 2574161 - RNA, 16 nt, Human
ugucaccgugagcagc

SEQ ID NO: 2574162 - RNA, 22 nt, Human
ugucaccgugagcagcuuugga

SEQ ID NO: 2574163 - RNA, 18 nt, Human
ugucaccguggaccuucc

SEQ ID NO: 2574164 - RNA, 23 nt, Human
ugucaccgugagcagcuuuggaa

SEQ ID NO: 2574165 - RNA, 14 nt, Human
ugucaccugugcuu

SEQ ID NO: 2574166 - RNA, 13 nt, Human
ugucaucugugca

SEQ ID NO: 2574167 - RNA, 16 nt, Human
ugucacgauugucauc

SEQ ID NO: 2574168 - RNA, 22 nt, Human
uguauaaaagggacugagaaau

SEQ ID NO: 2574169 - RNA, 15 nt, Human
uguaugauucccagc

SEQ ID NO: 2574170 - RNA, 13 nt, Human
uguaugauguguu

SEQ ID NO: 2574171 - RNA, 22 nt, Human
uguaguugcaauagaacagaga

SEQ ID NO: 2574172 - RNA, 20 nt, Human
uguaguugaacugauaguua

SEQ ID NO: 2574173 - RNA, 14 nt, Human
uguaguugaacuga

SEQ ID NO: 2574174 - RNA, 20 nt, Human
uguaguugcguggacucugc

SEQ ID NO: 2574175 - RNA, 15 nt, Human
uguaguugcguggac

SEQ ID NO: 2574176 - RNA, 19 nt, Human
uguaguucuugucugauug

SEQ ID NO: 2574177 - RNA, 21 nt, Human
uguaguugcguggacucugca

SEQ ID NO: 2574178 - RNA, 22 nt, Human
uguaguuuuaucacauguaugu

SEQ ID NO: 2574179 - RNA, 19 nt, Human
uguaguuuaccucuuuaaa

SEQ ID NO: 2574180 - RNA, 17 nt, Human
uguauaaaaaaaauagu

SEQ ID NO: 2574181 - RNA, 13 nt, Human
uguauaaaaauag

SEQ ID NO: 2574182 - RNA, 20 nt, Human
uguaguuuuaucacauguau

SEQ ID NO: 2574183 - RNA, 19 nt, Human
uguaguuuuucuucaacau

SEQ ID NO: 2574184 - RNA, 13 nt, Human
uguauucucugag

SEQ ID NO: 2574185 - RNA, 22 nt, Human
uguauucucuccuguaccucuu

SEQ ID NO: 2574186 - RNA, 14 nt, Human
uguauucucugagc

SEQ ID NO: 2574187 - RNA, 19 nt, Human
uguauucucugagcugugc

SEQ ID NO: 2574188 - RNA, 20 nt, Human
uguauucucugagcugugca

SEQ ID NO: 2574189 - RNA, 21 nt, Human
uguauucucugagcugugcag

SEQ ID NO: 2574190 - RNA, 18 nt, Human
uguaugauguguugugau

SEQ ID NO: 2574191 - RNA, 16 nt, Human
uguauucuuaaauuca

SEQ ID NO: 2574192 - RNA, 18 nt, Human
uguauucuuugauguuaa

SEQ ID NO: 2574193 - RNA, 17 nt, Human
uguauucuuugauguua

SEQ ID NO: 2574194 - RNA, 16 nt, Human
uguauucuuugauguu

SEQ ID NO: 2574195 - RNA, 21 nt, Human
uguauucuuaaauucauuuua

SEQ ID NO: 2574196 - RNA, 21 nt, Human
uguauucuuugauguuaacac

SEQ ID NO: 2574197 - RNA, 19 nt, Human
uguauucuuugauguuaac

SEQ ID NO: 2574198 - RNA, 22 nt, Human
uguauucuuugauguuaacaca

SEQ ID NO: 2574199 - RNA, 21 nt, Human
uguauugugucuuuugcauga

SEQ ID NO: 2574200 - RNA, 19 nt, Human
uguauugugucuuuugcau

SEQ ID NO: 2574201 - RNA, 18 nt, Human
uguauugugucuuuugca

SEQ ID NO: 2574202 - RNA, 15 nt, Human
uguauuguucccagu

SEQ ID NO: 2574203 - RNA, 19 nt, Human
uguauuguucccagugaca

SEQ ID NO: 2574204 - RNA, 20 nt, Human
uguauugugucuuuugcaug

SEQ ID NO: 2574205 - RNA, 12 nt, Human
uguauuguuccc

SEQ ID NO: 2574206 - RNA, 13 nt, Human
uguauuguuccca

SEQ ID NO: 2574207 - RNA, 14 nt, Human
uguauuguucccag

SEQ ID NO: 2574208 - RNA, 23 nt, Human
uguauuuccccaacauguaauaa

SEQ ID NO: 2574209 - RNA, 18 nt, Human
uguauuuauuuuccuccc

SEQ ID NO: 2574210 - RNA, 19 nt, Human
uguauuuauuuuccucccc

SEQ ID NO: 2574211 - RNA, 20 nt, Human
uguauuuauuuuccucccca

SEQ ID NO: 2574212 - RNA, 15 nt, Human
uguauuuccagugca

SEQ ID NO: 2574213 - RNA, 22 nt, Human
uguauuuuccaagugugcauau

SEQ ID NO: 2574214 - RNA, 21 nt, Human
uguauuuuccaagugugcaua

SEQ ID NO: 2574215 - RNA, 20 nt, Human
uguauuuuccaagugugcau

SEQ ID NO: 2574216 - RNA, 18 nt, Human
uguauuuuccaagugugc

SEQ ID NO: 2574217 - RNA, 17 nt, Human
uguauuuuccaagugug

SEQ ID NO: 2574218 - RNA, 12 nt, Human
uguauuuuccaa

SEQ ID NO: 2574219 - RNA, 10 nt, Human
uguauuuucc

SEQ ID NO: 2574220 - RNA, 22 nt, Human
uguauuuuauuuagacaagaga

SEQ ID NO: 2574221 - RNA, 21 nt, Human
uguauuuuauuguaacagaca

SEQ ID NO: 2574222 - RNA, 14 nt, Human
uguauuuuauugua

SEQ ID NO: 2574223 - RNA, 13 nt, Human
uguauuuuauugu

SEQ ID NO: 2574224 - RNA, 19 nt, Human
uguauuuuauuuagacaag

SEQ ID NO: 2574225 - RNA, 18 nt, Human
uguauuuuauuuagacaa

SEQ ID NO: 2574226 - RNA, 20 nt, Human
uguauuuauuuaaaagauuc

SEQ ID NO: 2574227 - RNA, 18 nt, Human
uguauuuauuuaaaagau

SEQ ID NO: 2574228 - RNA, 16 nt, Human
uguauuuauuuaaaag

SEQ ID NO: 2574229 - RNA, 20 nt, Human
uguauuuauuuaguauuuau

SEQ ID NO: 2574230 - RNA, 23 nt, Human
uguauuuauuccauauucaugua

SEQ ID NO: 2574231 - RNA, 14 nt, Human
uguauuuauuccau

SEQ ID NO: 2574232 - RNA, 22 nt, Human
uguauuuauucaauaaaguauu

SEQ ID NO: 2574233 - RNA, 15 nt, Human
uguauuuauuuaaaa

SEQ ID NO: 2574234 - RNA, 19 nt, Human
uguauuuauucaauaaagu

SEQ ID NO: 2574235 - RNA, 17 nt, Human
uguauuuauucaauaaa

SEQ ID NO: 2574236 - RNA, 14 nt, Human
uguauuuauucaau

SEQ ID NO: 2574237 - RNA, 13 nt, Human
uguauuuauucaa

SEQ ID NO: 2574238 - RNA, 17 nt, Human
uguauuuaugugugagg

SEQ ID NO: 2574239 - RNA, 13 nt, Human
uguauuuaaauau

SEQ ID NO: 2574240 - RNA, 21 nt, Human
ugucaccaccuucccagcucu

SEQ ID NO: 2574241 - RNA, 23 nt, Human
ugucaccaccuucccagcucucc

SEQ ID NO: 2574242 - RNA, 22 nt, Human
ugucacccuuaggccagcacca

SEQ ID NO: 2574243 - RNA, 22 nt, Human
ugucacccuccaccucuucacc

SEQ ID NO: 2574244 - RNA, 18 nt, Human
ugucacccuccaccucuu

SEQ ID NO: 2574245 - RNA, 18 nt, Human
ugucaccggauccugggu

SEQ ID NO: 2574246 - RNA, 19 nt, Human
ugucaccggauccugggug

SEQ ID NO: 2574247 - RNA, 16 nt, Human
ugucaccaccuuccca

SEQ ID NO: 2574248 - RNA, 18 nt, Human
ugucaccaccuucccagc

SEQ ID NO: 2574249 - RNA, 19 nt, Human
ugucaccaccuucccagcu

SEQ ID NO: 2574250 - RNA, 13 nt, Human
ugucacaccagcc

SEQ ID NO: 2574251 - RNA, 15 nt, Human
ugucacacagggcag

SEQ ID NO: 2574252 - RNA, 14 nt, Human
uguauuuuguauug

SEQ ID NO: 2574253 - RNA, 15 nt, Human
ugucacaccagccau

SEQ ID NO: 2574254 - RNA, 14 nt, Human
ugucacaccagcca

SEQ ID NO: 2574255 - RNA, 12 nt, Human
ugucacaggcag

SEQ ID NO: 2574256 - RNA, 17 nt, Human
ugucacacacuuuggcu

SEQ ID NO: 2574257 - RNA, 23 nt, Human
uguauuuuccaagugugcauauu

SEQ ID NO: 2574258 - RNA, 16 nt, Human
uguauuuucuuucucu

SEQ ID NO: 2574259 - RNA, 16 nt, Human
ugucuguagagggccc

SEQ ID NO: 2574260 - RNA, 21 nt, Human
ugucuguacacguguccugua

SEQ ID NO: 2574261 - RNA, 20 nt, Human
ugucuguacacguguccugu

SEQ ID NO: 2574262 - RNA, 19 nt, Human
ugucuguacacguguccug

SEQ ID NO: 2574263 - RNA, 22 nt, Human
ugucugguuuuaacaauuuccu

SEQ ID NO: 2574264 - RNA, 15 nt, Human
ugucuguacacgugu

SEQ ID NO: 2574265 - RNA, 13 nt, Human
ugucuguacacgu

SEQ ID NO: 2574266 - RNA, 21 nt, Human
ugucuuuccacuccuccuagc

SEQ ID NO: 2574267 - RNA, 13 nt, Human
ugucuuuccuaga

SEQ ID NO: 2574268 - RNA, 23 nt, Human
ugucuguagagggcccugguguu

SEQ ID NO: 2574269 - RNA, 21 nt, Human
ugucuguagagggcccuggug

SEQ ID NO: 2574270 - RNA, 20 nt, Human
ugucuguagagggcccuggu

SEQ ID NO: 2574271 - RNA, 19 nt, Human
ugucuguagagggcccugg

SEQ ID NO: 2574272 - RNA, 17 nt, Human
ugucuguagcuccucaa

SEQ ID NO: 2574273 - RNA, 23 nt, Human
ugucuguagcuccucaacucacc

SEQ ID NO: 2574274 - RNA, 21 nt, Human
ugucuuuucuugcaugaggcu

SEQ ID NO: 2574275 - RNA, 16 nt, Human
ugucuuuggacccuga

SEQ ID NO: 2574276 - RNA, 14 nt, Human
ugucuuuggacccu

SEQ ID NO: 2574277 - RNA, 12 nt, Human
ugucuuucugag

SEQ ID NO: 2574278 - RNA, 21 nt, Human
ugucugucccgggguccugug

SEQ ID NO: 2574279 - RNA, 16 nt, Human
ugucugucccgggguc

SEQ ID NO: 2574280 - RNA, 15 nt, Human
ugucuuucugagcac

SEQ ID NO: 2574281 - RNA, 13 nt, Human
ugugaaggacccu

SEQ ID NO: 2574282 - RNA, 14 nt, Human
ugugaaggacccuu

SEQ ID NO: 2574283 - RNA, 17 nt, Human
ugugaaaaugugugugu

SEQ ID NO: 2574284 - RNA, 18 nt, Human
ugugaaaaugguccagga

SEQ ID NO: 2574285 - RNA, 22 nt, Human
ugugaaaaugguccaggagaag

SEQ ID NO: 2574286 - RNA, 16 nt, Human
ugugaaaaugugugug

SEQ ID NO: 2574287 - RNA, 14 nt, Human
ugugaaaauggguu

SEQ ID NO: 2574288 - RNA, 13 nt, Human
ugugaaaaugggu

SEQ ID NO: 2574289 - RNA, 17 nt, Human
ugugaaaaucaaauaca

SEQ ID NO: 2574290 - RNA, 20 nt, Human
ugucuuuuucuggacugaag

SEQ ID NO: 2574291 - RNA, 23 nt, Human
ugucuuuucuugcaugaggcuag

SEQ ID NO: 2574292 - RNA, 13 nt, Human
ugucuuuugaaua

SEQ ID NO: 2574293 - RNA, 23 nt, Human
ugugaaaagaaaaaugagccugg

SEQ ID NO: 2574294 - RNA, 12 nt, Human
ugucuuuugcau

SEQ ID NO: 2574295 - RNA, 14 nt, Human
ugucuuuugaauau

SEQ ID NO: 2574296 - RNA, 14 nt, Human
ugucuuuugcauga

SEQ ID NO: 2574297 - RNA, 17 nt, Human
ugucuuuuucuggacug

SEQ ID NO: 2574298 - RNA, 23 nt, Human
ugucuuuuucuggacugaagccu

SEQ ID NO: 2574299 - RNA, 16 nt, Human
ugucugguuuuaacaa

SEQ ID NO: 2574300 - RNA, 15 nt, Human
ugucuggccaggccu

SEQ ID NO: 2574301 - RNA, 15 nt, Human
ugucugguuuuaaca

SEQ ID NO: 2574302 - RNA, 19 nt, Human
ugucugcuuucuccauugu

SEQ ID NO: 2574303 - RNA, 19 nt, Human
ugucuggauucccaggaug

SEQ ID NO: 2574304 - RNA, 15 nt, Human
ugucuggauucccag

SEQ ID NO: 2574305 - RNA, 19 nt, Human
ugucugaaggacacuuccu

SEQ ID NO: 2574306 - RNA, 18 nt, Human
ugucugaaggacacuucc

SEQ ID NO: 2574307 - RNA, 17 nt, Human
ugucugaaggacacuuc

SEQ ID NO: 2574308 - RNA, 16 nt, Human
ugucugaagucacugc

SEQ ID NO: 2574309 - RNA, 18 nt, Human
ugucugaagucacugcac

SEQ ID NO: 2574310 - RNA, 17 nt, Human
ugucugaagucacugca

SEQ ID NO: 2574311 - RNA, 23 nt, Human
ugucugaaggacacuuccugccu

SEQ ID NO: 2574312 - RNA, 22 nt, Human
ugucugaaggacacuuccugcc

SEQ ID NO: 2574313 - RNA, 19 nt, Human
ugucugaagucacugcaca

SEQ ID NO: 2574314 - RNA, 15 nt, Human
uguccugaccacccu

SEQ ID NO: 2574315 - RNA, 14 nt, Human
uguccugaccaccc

SEQ ID NO: 2574316 - RNA, 12 nt, Human
uguccugaccac

SEQ ID NO: 2574317 - RNA, 19 nt, Human
uguccucucuggcugggga

SEQ ID NO: 2574318 - RNA, 12 nt, Human
uguccuccuggu

SEQ ID NO: 2574319 - RNA, 19 nt, Human
uguccucuucugcaucuug

SEQ ID NO: 2574320 - RNA, 21 nt, Human
uguccuccugguggguccagg

SEQ ID NO: 2574321 - RNA, 23 nt, Human
uguccucuugcucaaaaaucugu

SEQ ID NO: 2574322 - RNA, 15 nt, Human
uguccucuugcucaa

SEQ ID NO: 2574323 - RNA, 23 nt, Human
uguccucuucugcaucuugggga

SEQ ID NO: 2574324 - RNA, 17 nt, Human
uguccucagccuugcca

SEQ ID NO: 2574325 - RNA, 20 nt, Human
uguccucagccuugccagag

SEQ ID NO: 2574326 - RNA, 21 nt, Human
uguccucagccuugccagaga

SEQ ID NO: 2574327 - RNA, 22 nt, Human
uguccucagccuugccagagau

SEQ ID NO: 2574328 - RNA, 14 nt, Human
uguccucagcuucu

SEQ ID NO: 2574329 - RNA, 14 nt, Human
uguccucagguggc

SEQ ID NO: 2574330 - RNA, 21 nt, Human
uguccuccucggaucaccgag

SEQ ID NO: 2574331 - RNA, 11 nt, Human
uguccuccucg

SEQ ID NO: 2574332 - RNA, 10 nt, Human
uguccuccuc

SEQ ID NO: 2574333 - RNA, 19 nt, Human
uguccucagguggccaugc

SEQ ID NO: 2574334 - RNA, 18 nt, Human
uguccucagguggccaug

SEQ ID NO: 2574335 - RNA, 15 nt, Human
ugugaucagaccaua

SEQ ID NO: 2574336 - RNA, 20 nt, Human
ugugcacaauucuguuuuag

SEQ ID NO: 2574337 - RNA, 17 nt, Human
ugugcacaucugugucu

SEQ ID NO: 2574338 - RNA, 20 nt, Human
ugugcacaucugugucuugu

SEQ ID NO: 2574339 - RNA, 13 nt, Human
ugugcacaucucu

SEQ ID NO: 2574340 - RNA, 14 nt, Human
ugugcacaucucug

SEQ ID NO: 2574341 - RNA, 15 nt, Human
ugugcacaucucugc

SEQ ID NO: 2574342 - RNA, 19 nt, Human
ugugcacaucucugcuuga

SEQ ID NO: 2574343 - RNA, 19 nt, Human
ugugcacacacaccacaca

SEQ ID NO: 2574344 - RNA, 22 nt, Human
ugugcacacacaccacacauac

SEQ ID NO: 2574345 - RNA, 15 nt, Human
ugugauauauaagug

SEQ ID NO: 2574346 - RNA, 14 nt, Human
ugugauauauaagu

SEQ ID NO: 2574347 - RNA, 13 nt, Human
ugugauauauaag

SEQ ID NO: 2574348 - RNA, 19 nt, Human
ugugaguuuaccuuguaua

SEQ ID NO: 2574349 - RNA, 15 nt, Human
ugugauauggagccc

SEQ ID NO: 2574350 - RNA, 16 nt, Human
ugugauauauaagugu

SEQ ID NO: 2574351 - RNA, 14 nt, Human
ugugauauuaacag

SEQ ID NO: 2574352 - RNA, 16 nt, Human
ugugauauaagugugu

SEQ ID NO: 2574353 - RNA, 21 nt, Human
ugugaguuuaccuuguauacu

SEQ ID NO: 2574354 - RNA, 16 nt, Human
ugugaguuuaaagcaa

SEQ ID NO: 2574355 - RNA, 16 nt, Human
ugugaguguaagugug

SEQ ID NO: 2574356 - RNA, 20 nt, Human
ugugaguguaagugugagua

SEQ ID NO: 2574357 - RNA, 20 nt, Human
ugugaguguguccaagugug

SEQ ID NO: 2574358 - RNA, 23 nt, Human
ugugaguguguccaagugugugu

SEQ ID NO: 2574359 - RNA, 14 nt, Human
ugugagugugugca

SEQ ID NO: 2574360 - RNA, 21 nt, Human
ugugagucaccaagcccaguu

SEQ ID NO: 2574361 - RNA, 19 nt, Human
ugugagucaccaagcccag

SEQ ID NO: 2574362 - RNA, 17 nt, Human
ugugagucaccaagccc

SEQ ID NO: 2574363 - RNA, 15 nt, Human
ugugagucaccaagc

SEQ ID NO: 2574364 - RNA, 14 nt, Human
ugugaggccagggc

SEQ ID NO: 2574365 - RNA, 15 nt, Human
ugugaggccagggca

SEQ ID NO: 2574366 - RNA, 16 nt, Human
ugugaggccagggcag

SEQ ID NO: 2574367 - RNA, 17 nt, Human
ugugaggccagggcaga

SEQ ID NO: 2574368 - RNA, 18 nt, Human
ugugaggccuggccaggc

SEQ ID NO: 2574369 - RNA, 14 nt, Human
ugugaggccuggcc

SEQ ID NO: 2574370 - RNA, 22 nt, Human
ugugaggccccuggacaagcag

SEQ ID NO: 2574371 - RNA, 14 nt, Human
ugugaggccccugg

SEQ ID NO: 2574372 - RNA, 22 nt, Human
ugugaggccagggcagagugag

SEQ ID NO: 2574373 - RNA, 13 nt, Human
ugugaggccccug

SEQ ID NO: 2574374 - RNA, 23 nt, Human
ugugaggcccaugguugagaaau

SEQ ID NO: 2574375 - RNA, 18 nt, Human
ugugaggaagccgcuggg

SEQ ID NO: 2574376 - RNA, 13 nt, Human
ugugaggaagccg

SEQ ID NO: 2574377 - RNA, 15 nt, Human
ugugaccaaugucuu

SEQ ID NO: 2574378 - RNA, 12 nt, Human
ugugaggcaggg

SEQ ID NO: 2574379 - RNA, 13 nt, Human
ugugaccaaguua

SEQ ID NO: 2574380 - RNA, 13 nt, Human
ugugaggccaggg

SEQ ID NO: 2574381 - RNA, 13 nt, Human
ugugaggcagggg

SEQ ID NO: 2574382 - RNA, 18 nt, Human
ugugaggcaggggcggag

SEQ ID NO: 2574383 - RNA, 14 nt, Human
ugugaggagcugcu

SEQ ID NO: 2574384 - RNA, 17 nt, Human
ugugaggagcugcuggc

SEQ ID NO: 2574385 - RNA, 18 nt, Human
ugugaggagcugcuggcu

SEQ ID NO: 2574386 - RNA, 20 nt, Human
ugugaggagcugcuggcuug

SEQ ID NO: 2574387 - RNA, 20 nt, Human
ugugaggaagccgcuggggc

SEQ ID NO: 2574388 - RNA, 12 nt, Human
ugugaggaagcc

SEQ ID NO: 2574389 - RNA, 16 nt, Human
ugugaccaaugucuug

SEQ ID NO: 2574390 - RNA, 13 nt, Human
ugugaggagcugc

SEQ ID NO: 2574391 - RNA, 15 nt, Human
ugugaaguuagaauu

SEQ ID NO: 2574392 - RNA, 14 nt, Human
ugugaaguuagaau

SEQ ID NO: 2574393 - RNA, 13 nt, Human
ugugaaguuagaa

SEQ ID NO: 2574394 - RNA, 18 nt, Human
ugugaaguguuaauacua

SEQ ID NO: 2574395 - RNA, 18 nt, Human
ugugaagugaaugaaaca

SEQ ID NO: 2574396 - RNA, 23 nt, Human
ugugaaguccuucaccucacuga

SEQ ID NO: 2574397 - RNA, 16 nt, Human
ugugaaugggaaaaga

SEQ ID NO: 2574398 - RNA, 22 nt, Human
ugugaauggauuggauuauuua

SEQ ID NO: 2574399 - RNA, 21 nt, Human
ugugaauguugugauguauuc

SEQ ID NO: 2574400 - RNA, 19 nt, Human
ugugaauggauuggauuau

SEQ ID NO: 2574401 - RNA, 20 nt, Human
ugugaaguuagaauuccuuc

SEQ ID NO: 2574402 - RNA, 13 nt, Human
ugugaauucagau

SEQ ID NO: 2574403 - RNA, 20 nt, Human
ugugaauuagcucacuuggu

SEQ ID NO: 2574404 - RNA, 14 nt, Human
ugugaauucagauu

SEQ ID NO: 2574405 - RNA, 18 nt, Human
ugugacauuuauauauug

SEQ ID NO: 2574406 - RNA, 17 nt, Human
ugugacauuuauauauu

SEQ ID NO: 2574407 - RNA, 18 nt, Human
ugugaauugccugcagag

SEQ ID NO: 2574408 - RNA, 15 nt, Human
ugugacauguuuuau

SEQ ID NO: 2574409 - RNA, 18 nt, Human
ugugcuauacugcauacu

SEQ ID NO: 2574410 - RNA, 20 nt, Human
ugugcuauacugcauacuuu

SEQ ID NO: 2574411 - RNA, 21 nt, Human
ugugcuauacugcauacuuuu

SEQ ID NO: 2574412 - RNA, 13 nt, Human
ugugcuagaugug

SEQ ID NO: 2574413 - RNA, 15 nt, Human
ugugcuacuuugccu

SEQ ID NO: 2574414 - RNA, 13 nt, Human
ugugcuauacugc

SEQ ID NO: 2574415 - RNA, 16 nt, Human
ugugcuacuuugccuu

SEQ ID NO: 2574416 - RNA, 18 nt, Human
ugugcucaggacucagaa

SEQ ID NO: 2574417 - RNA, 20 nt, Human
ugugcucaaaauuugaagaa

SEQ ID NO: 2574418 - RNA, 16 nt, Human
ugugcucaaaauuuga

SEQ ID NO: 2574419 - RNA, 20 nt, Human
ugugcuagggaaacuucccg

SEQ ID NO: 2574420 - RNA, 14 nt, Human
ugugcuaugaauuu

SEQ ID NO: 2574421 - RNA, 15 nt, Human
ugugcuaugaauuuu

SEQ ID NO: 2574422 - RNA, 19 nt, Human
ugugcuaguaauuggaaag

SEQ ID NO: 2574423 - RNA, 19 nt, Human
ugugcgccuacaggaguga

SEQ ID NO: 2574424 - RNA, 16 nt, Human
ugugccuuuugccauc

SEQ ID NO: 2574425 - RNA, 18 nt, Human
ugugccuuuuauagcuau

SEQ ID NO: 2574426 - RNA, 16 nt, Human
ugugccuuuuauagcu

SEQ ID NO: 2574427 - RNA, 14 nt, Human
ugugcgccuacagg

SEQ ID NO: 2574428 - RNA, 16 nt, Human
ugugcucaggagcccu

SEQ ID NO: 2574429 - RNA, 15 nt, Human
ugugcucaggagccc

SEQ ID NO: 2574430 - RNA, 17 nt, Human
ugugcucaggagcccug

SEQ ID NO: 2574431 - RNA, 14 nt, Human
ugugcuuguuaacu

SEQ ID NO: 2574432 - RNA, 14 nt, Human
ugugcuuguuuaca

SEQ ID NO: 2574433 - RNA, 23 nt, Human
ugugcuuguuuacagcacuacuc

SEQ ID NO: 2574434 - RNA, 14 nt, Human
ugugcuuuagcuug

SEQ ID NO: 2574435 - RNA, 13 nt, Human
ugugcuuuaugcu

SEQ ID NO: 2574436 - RNA, 17 nt, Human
ugugcuuuaugcugaaa

SEQ ID NO: 2574437 - RNA, 18 nt, Human
ugugcuuuaugcugaaac

SEQ ID NO: 2574438 - RNA, 20 nt, Human
ugugcuuuaugcugaaacag

SEQ ID NO: 2574439 - RNA, 16 nt, Human
ugugcuuuccagcuca

SEQ ID NO: 2574440 - RNA, 15 nt, Human
ugugcuuuccagcuc

SEQ ID NO: 2574441 - RNA, 14 nt, Human
ugugcuuuccagcu

SEQ ID NO: 2574442 - RNA, 19 nt, Human
ugugcuuuaugcugaaaca

SEQ ID NO: 2574443 - RNA, 20 nt, Human
ugugcuuugacucaccuguu

SEQ ID NO: 2574444 - RNA, 17 nt, Human
ugugcuuucuauuguac

SEQ ID NO: 2574445 - RNA, 15 nt, Human
ugugcuuucuauugu

SEQ ID NO: 2574446 - RNA, 11 nt, Human
ugugcuuucua

SEQ ID NO: 2574447 - RNA, 22 nt, Human
ugugcuuucccugaacugggac

SEQ ID NO: 2574448 - RNA, 16 nt, Human
ugugcuuucccugaac

SEQ ID NO: 2574449 - RNA, 20 nt, Human
ugugcuuuccagcucacccc

SEQ ID NO: 2574450 - RNA, 18 nt, Human
ugugcuuuccagcucacc

SEQ ID NO: 2574451 - RNA, 19 nt, Human
uguggaaauuaagaagaaa

SEQ ID NO: 2574452 - RNA, 17 nt, Human
ugugcuuugcauuccua

SEQ ID NO: 2574453 - RNA, 20 nt, Human
ugugcacaucucugcuugag

SEQ ID NO: 2574454 - RNA, 13 nt, Human
ugugcacaucuuc

SEQ ID NO: 2574455 - RNA, 21 nt, Human
ugugcacaucugugucuuguu

SEQ ID NO: 2574456 - RNA, 14 nt, Human
ugugcacguacaca

SEQ ID NO: 2574457 - RNA, 19 nt, Human
ugugcacguggcauguggc

SEQ ID NO: 2574458 - RNA, 12 nt, Human
ugugcacuaagg

SEQ ID NO: 2574459 - RNA, 13 nt, Human
ugugcacugccca

SEQ ID NO: 2574460 - RNA, 16 nt, Human
ugugcacuaaggggcc

SEQ ID NO: 2574461 - RNA, 17 nt, Human
ugugcacuaaggggccc

SEQ ID NO: 2574462 - RNA, 14 nt, Human
ugugcacugucacu

SEQ ID NO: 2574463 - RNA, 21 nt, Human
ugugcacugcccauggacagg

SEQ ID NO: 2574464 - RNA, 17 nt, Human
ugugcacugucacuuug

SEQ ID NO: 2574465 - RNA, 23 nt, Human
ugugcacuaaggggcccggccag

SEQ ID NO: 2574466 - RNA, 16 nt, Human
ugugcauuaucuagau

SEQ ID NO: 2574467 - RNA, 19 nt, Human
ugugcauuaucuagauacu

SEQ ID NO: 2574468 - RNA, 14 nt, Human
ugugcauuaucuag

SEQ ID NO: 2574469 - RNA, 16 nt, Human
ugugcagaaaacauug

SEQ ID NO: 2574470 - RNA, 15 nt, Human
ugugcagaaaacauu

SEQ ID NO: 2574471 - RNA, 14 nt, Human
ugugcagaaaacau

SEQ ID NO: 2574472 - RNA, 21 nt, Human
ugugcacugucacuuugcucu

SEQ ID NO: 2574473 - RNA, 19 nt, Human
ugugcagaaaacauuguuc

SEQ ID NO: 2574474 - RNA, 17 nt, Human
ugugcagaaaacauugu

SEQ ID NO: 2574475 - RNA, 18 nt, Human
ugugcagacucaauaaaa

SEQ ID NO: 2574476 - RNA, 19 nt, Human
ugugcagacucaauaaaau

SEQ ID NO: 2574477 - RNA, 15 nt, Human
ugugccuuuuauagc

SEQ ID NO: 2574478 - RNA, 14 nt, Human
ugugcauugcugug

SEQ ID NO: 2574479 - RNA, 16 nt, Human
ugugccuucuuuugau

SEQ ID NO: 2574480 - RNA, 17 nt, Human
ugugccuuggugugcug

SEQ ID NO: 2574481 - RNA, 23 nt, Human
ugugccuucgucuuucccauggg

SEQ ID NO: 2574482 - RNA, 14 nt, Human
ugugccuucgucuu

SEQ ID NO: 2574483 - RNA, 20 nt, Human
ugugcauuaucuagauacug

SEQ ID NO: 2574484 - RNA, 21 nt, Human
ugugcauuaucuagauacugu

SEQ ID NO: 2574485 - RNA, 23 nt, Human
ugugcauuaucuagauacuguau

SEQ ID NO: 2574486 - RNA, 23 nt, Human
ugugcauucuuuuaaaagacaag

SEQ ID NO: 2574487 - RNA, 22 nt, Human
ugugcauucuuuuaaaagacaa

SEQ ID NO: 2574488 - RNA, 21 nt, Human
ugugcauucuuuuaaaagaca

SEQ ID NO: 2574489 - RNA, 14 nt, Human
ugugcaugugugug

SEQ ID NO: 2574490 - RNA, 22 nt, Human
ugugcagacucaauaaaaucau

SEQ ID NO: 2574491 - RNA, 15 nt, Human
ugugcaugugugugc

SEQ ID NO: 2574492 - RNA, 23 nt, Human
uguguagccugugcauguauguc

SEQ ID NO: 2574493 - RNA, 15 nt, Human
uguguacauaacuga

SEQ ID NO: 2574494 - RNA, 14 nt, Human
uguguagccugugc

SEQ ID NO: 2574495 - RNA, 16 nt, Human
uguguagccugugcau

SEQ ID NO: 2574496 - RNA, 15 nt, Human
uguguagccugugca

SEQ ID NO: 2574497 - RNA, 12 nt, Human
uguguagggcgg

SEQ ID NO: 2574498 - RNA, 14 nt, Human
uguguagcuuugcu

SEQ ID NO: 2574499 - RNA, 17 nt, Human
uguguagcuuugcucuu

SEQ ID NO: 2574500 - RNA, 19 nt, Human
uguguaauuuaaaauugug

SEQ ID NO: 2574501 - RNA, 22 nt, Human
uguguaauuuaaaauugugaug

SEQ ID NO: 2574502 - RNA, 23 nt, Human
uguguaauuuaaaauugugaugu

SEQ ID NO: 2574503 - RNA, 16 nt, Human
uguguaauuuuguucu

SEQ ID NO: 2574504 - RNA, 14 nt, Human
uguguacaaagaaa

SEQ ID NO: 2574505 - RNA, 19 nt, Human
uguguacaaagaaauaaca

SEQ ID NO: 2574506 - RNA, 21 nt, Human
uguguacagaauucugcuacc

SEQ ID NO: 2574507 - RNA, 18 nt, Human
uguguacagaugaaugau

SEQ ID NO: 2574508 - RNA, 22 nt, Human
uguguacacgggacugacgcaa

SEQ ID NO: 2574509 - RNA, 23 nt, Human
uguguacagaauucugcuaccuc

SEQ ID NO: 2574510 - RNA, 10 nt, Human
uguguacagg

SEQ ID NO: 2574511 - RNA, 21 nt, Human
uguguacagaugaaugauaaa

SEQ ID NO: 2574512 - RNA, 19 nt, Human
uguguacaguguguaaagu

SEQ ID NO: 2574513 - RNA, 19 nt, Human
ugugggauguucagcacug

SEQ ID NO: 2574514 - RNA, 13 nt, Human
ugugggagggagc

SEQ ID NO: 2574515 - RNA, 22 nt, Human
ugugggauguucagcacugucc

SEQ ID NO: 2574516 - RNA, 21 nt, Human
ugugggagggagcagacagga

SEQ ID NO: 2574517 - RNA, 16 nt, Human
ugugggcaggaaguga

SEQ ID NO: 2574518 - RNA, 20 nt, Human
ugugggcgugagaccugccc

SEQ ID NO: 2574519 - RNA, 21 nt, Human
ugugggcgugagaccugcccc

SEQ ID NO: 2574520 - RNA, 19 nt, Human
ugugggccucaaggacuug

SEQ ID NO: 2574521 - RNA, 21 nt, Human
ugugggccucaaggacuugaa

SEQ ID NO: 2574522 - RNA, 21 nt, Human
uguguaauagaaaacugaaaa

SEQ ID NO: 2574523 - RNA, 15 nt, Human
uguguaaucaauaaa

SEQ ID NO: 2574524 - RNA, 22 nt, Human
ugugggcgugagaccugccccu

SEQ ID NO: 2574525 - RNA, 22 nt, Human
ugugggcuaguugggcuuccuc

SEQ ID NO: 2574526 - RNA, 11 nt, Human
uguguaauuua

SEQ ID NO: 2574527 - RNA, 18 nt, Human
uguguaauuuaaaauugu

SEQ ID NO: 2574528 - RNA, 23 nt, Human
uguguaaucauuucuugggcccu

SEQ ID NO: 2574529 - RNA, 20 nt, Human
uguguaaucaauaaacgauu

SEQ ID NO: 2574530 - RNA, 19 nt, Human
uguguaaucaauaaacgau

SEQ ID NO: 2574531 - RNA, 21 nt, Human
uguguaaucauuucuugggcc

SEQ ID NO: 2574532 - RNA, 22 nt, Human
uguguaaucauuucuugggccc

SEQ ID NO: 2574533 - RNA, 19 nt, Human
uguggaccacugcaugagc

SEQ ID NO: 2574534 - RNA, 17 nt, Human
uguggaccacugcauga

SEQ ID NO: 2574535 - RNA, 19 nt, Human
uguggacacagcucuucuc

SEQ ID NO: 2574536 - RNA, 16 nt, Human
uguggacuaaaagaua

SEQ ID NO: 2574537 - RNA, 15 nt, Human
uguggacuaaaagau

SEQ ID NO: 2574538 - RNA, 18 nt, Human
uguggccguuaucuggaa

SEQ ID NO: 2574539 - RNA, 10 nt, Human
uguggccuca

SEQ ID NO: 2574540 - RNA, 11 nt, Human
uguggccucag

SEQ ID NO: 2574541 - RNA, 18 nt, Human
uguggaaucuggagugag

SEQ ID NO: 2574542 - RNA, 17 nt, Human
uguggaaucuggaguga

SEQ ID NO: 2574543 - RNA, 15 nt, Human
uguggaagugugggu

SEQ ID NO: 2574544 - RNA, 18 nt, Human
uguggacacagcucuucu

SEQ ID NO: 2574545 - RNA, 14 nt, Human
uguggaagcaaaaa

SEQ ID NO: 2574546 - RNA, 14 nt, Human
uguggaagggacua

SEQ ID NO: 2574547 - RNA, 15 nt, Human
uguggaagggacuag

SEQ ID NO: 2574548 - RNA, 18 nt, Human
uguggaagggacuaggag

SEQ ID NO: 2574549 - RNA, 23 nt, Human
uguggcgcagcauauucaggaag

SEQ ID NO: 2574550 - RNA, 17 nt, Human
uguggccuguggccugu

SEQ ID NO: 2574551 - RNA, 18 nt, Human
uguggcgccgucuccagg

SEQ ID NO: 2574552 - RNA, 20 nt, Human
uguggccuuccauuuauaug

SEQ ID NO: 2574553 - RNA, 16 nt, Human
uguggccuguggccug

SEQ ID NO: 2574554 - RNA, 15 nt, Human
uguggccuguggccu

SEQ ID NO: 2574555 - RNA, 13 nt, Human
uguggccuguggc

SEQ ID NO: 2574556 - RNA, 16 nt, Human
uguggccugggccucc

SEQ ID NO: 2574557 - RNA, 17 nt, Human
uguggccugcacaguga

SEQ ID NO: 2574558 - RNA, 15 nt, Human
uguggccugggccuc

SEQ ID NO: 2574559 - RNA, 11 nt, Human
uguggccugca

SEQ ID NO: 2574560 - RNA, 13 nt, Human
uguggccucagaa

SEQ ID NO: 2574561 - RNA, 14 nt, Human
ugugggagugugua

SEQ ID NO: 2574562 - RNA, 15 nt, Human
ugugggaguguguaa

SEQ ID NO: 2574563 - RNA, 13 nt, Human
ugugggagcagcg

SEQ ID NO: 2574564 - RNA, 13 nt, Human
uguggcuccccuc

SEQ ID NO: 2574565 - RNA, 22 nt, Human
uguggcucacgugagagugucu

SEQ ID NO: 2574566 - RNA, 16 nt, Human
uguggcucacgugugu

SEQ ID NO: 2574567 - RNA, 10 nt, Human
uguggcucac

SEQ ID NO: 2574568 - RNA, 23 nt, Human
uguggcgccgucuccaggggcug

SEQ ID NO: 2574569 - RNA, 19 nt, Human
uguggcgccgucuccaggg

SEQ ID NO: 2574570 - RNA, 13 nt, Human
uguggcggugccu

SEQ ID NO: 2574571 - RNA, 17 nt, Human
uuaaaugucuaauguau

SEQ ID NO: 2574572 - RNA, 14 nt, Human
uuaaaugucuaaug

SEQ ID NO: 2574573 - RNA, 18 nt, Human
uuaaaugucuucuguauu

SEQ ID NO: 2574574 - RNA, 22 nt, Human
uuaaaugucuaauguauuuuau

SEQ ID NO: 2574575 - RNA, 19 nt, Human
uuaaaugucuaauguauuu

SEQ ID NO: 2574576 - RNA, 18 nt, Human
uuaaaugucuaauguauu

SEQ ID NO: 2574577 - RNA, 13 nt, Human
uuaaaugcccagc

SEQ ID NO: 2574578 - RNA, 12 nt, Human
uuaacuuuuaua

SEQ ID NO: 2574579 - RNA, 13 nt, Human
uuaacuuuuauaa

SEQ ID NO: 2574580 - RNA, 15 nt, Human
uuaacuugaguuuua

SEQ ID NO: 2574581 - RNA, 16 nt, Human
uuaacuuuaagacuga

SEQ ID NO: 2574582 - RNA, 22 nt, Human
uuaagauuuuucucaaaguuuu

SEQ ID NO: 2574583 - RNA, 20 nt, Human
uuaagauuuuucucaaaguu

SEQ ID NO: 2574584 - RNA, 17 nt, Human
uuaagauuuuucucaaa

SEQ ID NO: 2574585 - RNA, 16 nt, Human
uuaagauuuuucucaa

SEQ ID NO: 2574586 - RNA, 15 nt, Human
uuaagauuuuucuca

SEQ ID NO: 2574587 - RNA, 14 nt, Human
uuaagauuuuucuc

SEQ ID NO: 2574588 - RNA, 16 nt, Human
uuaagauaauuauaau

SEQ ID NO: 2574589 - RNA, 14 nt, Human
uuaagauaauuaua

SEQ ID NO: 2574590 - RNA, 21 nt, Human
uuaagauaauaguuuacaugu

SEQ ID NO: 2574591 - RNA, 14 nt, Human
uuaagauaugaugu

SEQ ID NO: 2574592 - RNA, 14 nt, Human
uuaagauggauucu

SEQ ID NO: 2574593 - RNA, 17 nt, Human
uuaagauggauucucag

SEQ ID NO: 2574594 - RNA, 18 nt, Human
uuaagauggauucucaga

SEQ ID NO: 2574595 - RNA, 21 nt, Human
uuaagauggauucucagauau

SEQ ID NO: 2574596 - RNA, 22 nt, Human
uuaagauggauucucagauauu

SEQ ID NO: 2574597 - RNA, 23 nt, Human
uuaagauggauucucagauauuu

SEQ ID NO: 2574598 - RNA, 19 nt, Human
uuaagauaauaauauaugu

SEQ ID NO: 2574599 - RNA, 21 nt, Human
uuaagagugggggagagcagg

SEQ ID NO: 2574600 - RNA, 12 nt, Human
uuaagagugaaa

SEQ ID NO: 2574601 - RNA, 20 nt, Human
uuaagaguagcaaguucuag

SEQ ID NO: 2574602 - RNA, 12 nt, Human
uuaagaguaaaa

SEQ ID NO: 2574603 - RNA, 14 nt, Human
uuaacuuuuauaaa

SEQ ID NO: 2574604 - RNA, 23 nt, Human
uuaacuuuaucacauuauuugca

SEQ ID NO: 2574605 - RNA, 18 nt, Human
uuaacuuuaucacauuau

SEQ ID NO: 2574606 - RNA, 16 nt, Human
uuaacuuuaaguuuca

SEQ ID NO: 2574607 - RNA, 18 nt, Human
uuaagccaucuugguaaa

SEQ ID NO: 2574608 - RNA, 21 nt, Human
uuaagccacuuaaaauguuca

SEQ ID NO: 2574609 - RNA, 13 nt, Human
uuaagcccugagg

SEQ ID NO: 2574610 - RNA, 16 nt, Human
uuaagccaucuuggua

SEQ ID NO: 2574611 - RNA, 19 nt, Human
uuaagccucauauuuaaag

SEQ ID NO: 2574612 - RNA, 23 nt, Human
uuaauaauaaauucccuggccuu

SEQ ID NO: 2574613 - RNA, 14 nt, Human
uuaauaauaaauuc

SEQ ID NO: 2574614 - RNA, 15 nt, Human
uuaauaaguuucacu

SEQ ID NO: 2574615 - RNA, 21 nt, Human
uuaauaacauuaccuuacugu

SEQ ID NO: 2574616 - RNA, 20 nt, Human
uuaauaacauuaccuuacug

SEQ ID NO: 2574617 - RNA, 17 nt, Human
uuaauaacauuaccuua

SEQ ID NO: 2574618 - RNA, 16 nt, Human
uuaauaacauuaccuu

SEQ ID NO: 2574619 - RNA, 15 nt, Human
uuaauaacauuaccu

SEQ ID NO: 2574620 - RNA, 13 nt, Human
uuaauaacauuac

SEQ ID NO: 2574621 - RNA, 14 nt, Human
uuaagcacuacaua

SEQ ID NO: 2574622 - RNA, 21 nt, Human
uuaagauuuuucucaaaguuu

SEQ ID NO: 2574623 - RNA, 15 nt, Human
uuaagcagaagcauu

SEQ ID NO: 2574624 - RNA, 22 nt, Human
uuaagcacuacauaaacugacu

SEQ ID NO: 2574625 - RNA, 20 nt, Human
uuaagcacuacauaaacuga

SEQ ID NO: 2574626 - RNA, 17 nt, Human
uuaagcacuacauaaac

SEQ ID NO: 2574627 - RNA, 16 nt, Human
uuaagcagaagcauua

SEQ ID NO: 2574628 - RNA, 13 nt, Human
uuaagcauuacca

SEQ ID NO: 2574629 - RNA, 18 nt, Human
uuaagcauuaccacucag

SEQ ID NO: 2574630 - RNA, 12 nt, Human
uuaagcauuguu

SEQ ID NO: 2574631 - RNA, 14 nt, Human
uuaagcauuguuug

SEQ ID NO: 2574632 - RNA, 19 nt, Human
uuaagcauuguuugcuuau

SEQ ID NO: 2574633 - RNA, 22 nt, Human
uuaagcauuguuugcuuauugu

SEQ ID NO: 2574634 - RNA, 23 nt, Human
uuaagcauuguuugcuuauuguu

SEQ ID NO: 2574635 - RNA, 20 nt, Human
uuaagcauuggguggguaaa

SEQ ID NO: 2574636 - RNA, 11 nt, Human
uuaauauuaaa

SEQ ID NO: 2574637 - RNA, 19 nt, Human
uuaauagaauauaauuauc

SEQ ID NO: 2574638 - RNA, 21 nt, Human
uuaauaauauacuuguggacu

SEQ ID NO: 2574639 - RNA, 24 nt, Human
uuaauaaucagcaagaauuugauc

SEQ ID NO: 2574640 - RNA, 18 nt, Human
uuaauaauauacuugugg

SEQ ID NO: 2574641 - RNA, 16 nt, Human
uuaauaauauacuugu

SEQ ID NO: 2574642 - RNA, 14 nt, Human
uuaauaauauacuu

SEQ ID NO: 2574643 - RNA, 17 nt, Human
uuaauaaguuucacuga

SEQ ID NO: 2574644 - RNA, 21 nt, Human
uuaauacucauccuuguauaa

SEQ ID NO: 2574645 - RNA, 20 nt, Human
uuaauacucauccuuguaua

SEQ ID NO: 2574646 - RNA, 22 nt, Human
uuaauacucauccuuguauaaa

SEQ ID NO: 2574647 - RNA, 15 nt, Human
uuaauaccacagcuu

SEQ ID NO: 2574648 - RNA, 15 nt, Human
uuaauacuaccuuga

SEQ ID NO: 2574649 - RNA, 17 nt, Human
uuaauacuaccuugaaa

SEQ ID NO: 2574650 - RNA, 19 nt, Human
uuaauacuauaaauaauau

SEQ ID NO: 2574651 - RNA, 20 nt, Human
uuacauuuguauaaaauaau

SEQ ID NO: 2574652 - RNA, 16 nt, Human
uuacauuguucaauua

SEQ ID NO: 2574653 - RNA, 16 nt, Human
uuacauuuccaaauga

SEQ ID NO: 2574654 - RNA, 17 nt, Human
uuacauuuccaaaugaa

SEQ ID NO: 2574655 - RNA, 12 nt, Human
uuacauuuuuaa

SEQ ID NO: 2574656 - RNA, 17 nt, Human
uuacauuuuuaagugcu

SEQ ID NO: 2574657 - RNA, 21 nt, Human
uuacagaaaguggugcucagu

SEQ ID NO: 2574658 - RNA, 20 nt, Human
uuacagaacacgcuuucaca

SEQ ID NO: 2574659 - RNA, 19 nt, Human
uuacauuauuaucaacaau

SEQ ID NO: 2574660 - RNA, 13 nt, Human
uuacauucaguug

SEQ ID NO: 2574661 - RNA, 13 nt, Human
uuacauucugaau

SEQ ID NO: 2574662 - RNA, 13 nt, Human
uuacauuguaaau

SEQ ID NO: 2574663 - RNA, 12 nt, Human
uuacauuguaaa

SEQ ID NO: 2574664 - RNA, 17 nt, Human
uuacauuguuugucugu

SEQ ID NO: 2574665 - RNA, 15 nt, Human
uuacauugucauuua

SEQ ID NO: 2574666 - RNA, 13 nt, Human
uuacauuguucaa

SEQ ID NO: 2574667 - RNA, 22 nt, Human
uuacagaaaguggugcucaguu

SEQ ID NO: 2574668 - RNA, 19 nt, Human
uuacagaaaguggugcuca

SEQ ID NO: 2574669 - RNA, 14 nt, Human
uuacagaaaguggu

SEQ ID NO: 2574670 - RNA, 15 nt, Human
uuacacuuacuguug

SEQ ID NO: 2574671 - RNA, 14 nt, Human
uuacacuuacuguu

SEQ ID NO: 2574672 - RNA, 23 nt, Human
uuacacuuuaugccggaugugcu

SEQ ID NO: 2574673 - RNA, 13 nt, Human
uuacacuuuaugc

SEQ ID NO: 2574674 - RNA, 20 nt, Human
uuacacuuuaugcacaaaau

SEQ ID NO: 2574675 - RNA, 15 nt, Human
uuacacucuuuguaa

SEQ ID NO: 2574676 - RNA, 22 nt, Human
uuacacuggaggagagaagaau

SEQ ID NO: 2574677 - RNA, 21 nt, Human
uuacacuggaggagagaagaa

SEQ ID NO: 2574678 - RNA, 13 nt, Human
uuacacugggaga

SEQ ID NO: 2574679 - RNA, 17 nt, Human
uuacacuguauuuguau

SEQ ID NO: 2574680 - RNA, 14 nt, Human
uuacacuguauuug

SEQ ID NO: 2574681 - RNA, 14 nt, Human
uuacacucuuugua

SEQ ID NO: 2574682 - RNA, 21 nt, Human
uuacaccagccucgucuucau

SEQ ID NO: 2574683 - RNA, 23 nt, Human
uuacacguggaggaaugcucccc

SEQ ID NO: 2574684 - RNA, 23 nt, Human
uuacacauuuuucagauauaaaa

SEQ ID NO: 2574685 - RNA, 17 nt, Human
uuacacauuuuucagau

SEQ ID NO: 2574686 - RNA, 22 nt, Human
uuacaacugccucgaaacacag

SEQ ID NO: 2574687 - RNA, 23 nt, Human
uuacaacugccucgaaacacaga

SEQ ID NO: 2574688 - RNA, 23 nt, Human
uuacacacgugcaauuuguuugu

SEQ ID NO: 2574689 - RNA, 19 nt, Human
uuacacacgugcaauuugu

SEQ ID NO: 2574690 - RNA, 17 nt, Human
uuacaagaaaaaaugaa

SEQ ID NO: 2574691 - RNA, 18 nt, Human
uuacacaucucagacccu

SEQ ID NO: 2574692 - RNA, 17 nt, Human
uuacacaucuucaacag

SEQ ID NO: 2574693 - RNA, 15 nt, Human
uuacacauuuuucag

SEQ ID NO: 2574694 - RNA, 14 nt, Human
uuaauuagugcuaa

SEQ ID NO: 2574695 - RNA, 13 nt, Human
uuaauuagugcua

SEQ ID NO: 2574696 - RNA, 16 nt, Human
uuaauuaccaaccugu

SEQ ID NO: 2574697 - RNA, 19 nt, Human
uuaauuagccagugaaaaa

SEQ ID NO: 2574698 - RNA, 19 nt, Human
uuaauuagggguugcuaag

SEQ ID NO: 2574699 - RNA, 20 nt, Human
uuaauuagggguugcuaaga

SEQ ID NO: 2574700 - RNA, 17 nt, Human
uuacaacagauuuguga

SEQ ID NO: 2574701 - RNA, 16 nt, Human
uuacaacagauuugug

SEQ ID NO: 2574702 - RNA, 15 nt, Human
uuacaacagauuugu

SEQ ID NO: 2574703 - RNA, 13 nt, Human
uuacaacagauuu

SEQ ID NO: 2574704 - RNA, 19 nt, Human
uuacaacagauuugugaac

SEQ ID NO: 2574705 - RNA, 18 nt, Human
uuacaacagauuugugaa

SEQ ID NO: 2574706 - RNA, 21 nt, Human
uuacaacagauuugugaacuc

SEQ ID NO: 2574707 - RNA, 14 nt, Human
uuaaugacacuugu

SEQ ID NO: 2574708 - RNA, 19 nt, Human
uuaaugacacuugucccca

SEQ ID NO: 2574709 - RNA, 23 nt, Human
uuaaugacacuuguccccaaauc

SEQ ID NO: 2574710 - RNA, 23 nt, Human
uuaaugaaguuugaauguuaaau

SEQ ID NO: 2574711 - RNA, 22 nt, Human
uuaaugaaguuugaauguuaaa

SEQ ID NO: 2574712 - RNA, 18 nt, Human
uuaaugaaguuugaaugu

SEQ ID NO: 2574713 - RNA, 15 nt, Human
uuaaugaaguuugaa

SEQ ID NO: 2574714 - RNA, 17 nt, Human
uuaaugaaguuugaaug

SEQ ID NO: 2574715 - RNA, 16 nt, Human
uuaaugaaguuugaau

SEQ ID NO: 2574716 - RNA, 22 nt, Human
uuaauuaaaacacaacaucuuu

SEQ ID NO: 2574717 - RNA, 16 nt, Human
uuaaugauaaguaaau

SEQ ID NO: 2574718 - RNA, 19 nt, Human
uuaaugacagagccagugg

SEQ ID NO: 2574719 - RNA, 14 nt, Human
uuaauuaaaugcuc

SEQ ID NO: 2574720 - RNA, 13 nt, Human
uuaauuaaaugca

SEQ ID NO: 2574721 - RNA, 20 nt, Human
uuaauuaaugaaauaucugu

SEQ ID NO: 2574722 - RNA, 16 nt, Human
uuaaaucugugaugau

SEQ ID NO: 2574723 - RNA, 15 nt, Human
uuaaaucugugauga

SEQ ID NO: 2574724 - RNA, 14 nt, Human
uuaaaucugugaug

SEQ ID NO: 2574725 - RNA, 21 nt, Human
uuaaaucuaugaaguauauaa

SEQ ID NO: 2574726 - RNA, 16 nt, Human
uuaaaucuaugaagua

SEQ ID NO: 2574727 - RNA, 16 nt, Human
uuaaaucucauugcuu

SEQ ID NO: 2574728 - RNA, 18 nt, Human
uuaaauauuucaagacau

SEQ ID NO: 2574729 - RNA, 20 nt, Human
uuaaaucccauucauaacuu

SEQ ID NO: 2574730 - RNA, 23 nt, Human
uuaaaugaaauuguaaaaccugu

SEQ ID NO: 2574731 - RNA, 14 nt, Human
uuaaaugaaauugu

SEQ ID NO: 2574732 - RNA, 15 nt, Human
uuaaaugaaagcaug

SEQ ID NO: 2574733 - RNA, 16 nt, Human
uuaaaugcccagcccc

SEQ ID NO: 2574734 - RNA, 15 nt, Human
uuaaaugcccagccc

SEQ ID NO: 2574735 - RNA, 14 nt, Human
uuaaaugcccagcc

SEQ ID NO: 2574736 - RNA, 11 nt, Human
uuaaaugcacc

SEQ ID NO: 2574737 - RNA, 12 nt, Human
uuaaaugagaag

SEQ ID NO: 2574738 - RNA, 23 nt, Human
uuaaaugagaaggaauuugaguu

SEQ ID NO: 2574739 - RNA, 18 nt, Human
uuaaagcagugcuucuca

SEQ ID NO: 2574740 - RNA, 22 nt, Human
uuaaagcagagggacuuuguau

SEQ ID NO: 2574741 - RNA, 15 nt, Human
uuaaagcauuuacuu

SEQ ID NO: 2574742 - RNA, 17 nt, Human
uuaaagcauuuacuuug

SEQ ID NO: 2574743 - RNA, 20 nt, Human
uuaaagcauuuacuuugaau

SEQ ID NO: 2574744 - RNA, 21 nt, Human
uuaaagcagagggacuuugua

SEQ ID NO: 2574745 - RNA, 15 nt, Human
uuaaagaaaacccac

SEQ ID NO: 2574746 - RNA, 22 nt, Human
uuaaauaucaguagaaacucua

SEQ ID NO: 2574747 - RNA, 22 nt, Human
uuaaauauuucaagacauuaaa

SEQ ID NO: 2574748 - RNA, 15 nt, Human
uuaaauauuucaaga

SEQ ID NO: 2574749 - RNA, 13 nt, Human
uuaaagccuccuc

SEQ ID NO: 2574750 - RNA, 21 nt, Human
uuaaauauguuagcaaagagu

SEQ ID NO: 2574751 - RNA, 17 nt, Human
uuaaauauuuacauaug

SEQ ID NO: 2574752 - RNA, 18 nt, Human
uuaaauauuuacauauga

SEQ ID NO: 2574753 - RNA, 14 nt, Human
uuaaauauuuacau

SEQ ID NO: 2574754 - RNA, 21 nt, Human
uuaaaaaaaacaaaaagaaca

SEQ ID NO: 2574755 - RNA, 19 nt, Human
uuaaaaaaaacaaaaagaa

SEQ ID NO: 2574756 - RNA, 19 nt, Human
uuaaaacugaagucugaaa

SEQ ID NO: 2574757 - RNA, 18 nt, Human
uuaaaacugaagucugaa

SEQ ID NO: 2574758 - RNA, 17 nt, Human
uuaaaacugaagucuga

SEQ ID NO: 2574759 - RNA, 16 nt, Human
uuaaaacugaagucug

SEQ ID NO: 2574760 - RNA, 22 nt, Human
uuaaaaaaaacaaaaagaacaa

SEQ ID NO: 2574761 - RNA, 14 nt, Human
uuaaaacugaaguc

SEQ ID NO: 2574762 - RNA, 18 nt, Human
uuaaaaaaaacaaaaaga

SEQ ID NO: 2574763 - RNA, 15 nt, Human
uuaaaaaaaacaaaa

SEQ ID NO: 2574764 - RNA, 14 nt, Human
uuaaaaaaaacaaa

SEQ ID NO: 2574765 - RNA, 19 nt, Human
uguuuuuguauuuuuaaug

SEQ ID NO: 2574766 - RNA, 16 nt, Human
uuaaaaaaaaaggcau

SEQ ID NO: 2574767 - RNA, 18 nt, Human
uuaaaaaaaaagaucugu

SEQ ID NO: 2574768 - RNA, 14 nt, Human
uuaaaacccaagug

SEQ ID NO: 2574769 - RNA, 20 nt, Human
uuaaaauaaaaauucugaau

SEQ ID NO: 2574770 - RNA, 22 nt, Human
uuaaaaguuucaaugugauucu

SEQ ID NO: 2574771 - RNA, 19 nt, Human
uuaaaaguuucaaugugau

SEQ ID NO: 2574772 - RNA, 16 nt, Human
uuaaaauaaaaauucu

SEQ ID NO: 2574773 - RNA, 12 nt, Human
uuaaaauaauau

SEQ ID NO: 2574774 - RNA, 20 nt, Human
uuaaaauaagcacugugcua

SEQ ID NO: 2574775 - RNA, 15 nt, Human
uuaaaauaacuagug

SEQ ID NO: 2574776 - RNA, 15 nt, Human
uuaaaacuuguaauu

SEQ ID NO: 2574777 - RNA, 21 nt, Human
uuaaaacugaagucugaaauu

SEQ ID NO: 2574778 - RNA, 20 nt, Human
uuaaaacugaagucugaaau

SEQ ID NO: 2574779 - RNA, 17 nt, Human
uuaaaaguuucaaugug

SEQ ID NO: 2574780 - RNA, 16 nt, Human
uuaaaaguuucaaugu

SEQ ID NO: 2574781 - RNA, 17 nt, Human
uuaaaaguugaauuuuu

SEQ ID NO: 2574782 - RNA, 14 nt, Human
uuaaaacuuuaauc

SEQ ID NO: 2574783 - RNA, 22 nt, Human
uuaaacuaggagaaccaaaucu

SEQ ID NO: 2574784 - RNA, 22 nt, Human
uuaaacuagcauaucugccuuu

SEQ ID NO: 2574785 - RNA, 21 nt, Human
uuaaacuagcauaucugccuu

SEQ ID NO: 2574786 - RNA, 14 nt, Human
uuaaacucagggac

SEQ ID NO: 2574787 - RNA, 13 nt, Human
uuaaacucaggga

SEQ ID NO: 2574788 - RNA, 23 nt, Human
uuaaacuagcauaucugccuuua

SEQ ID NO: 2574789 - RNA, 22 nt, Human
uuaaacuuaaucuaaauggaac

SEQ ID NO: 2574790 - RNA, 15 nt, Human
uuaaacuucucugaa

SEQ ID NO: 2574791 - RNA, 14 nt, Human
uuaaacuucucuga

SEQ ID NO: 2574792 - RNA, 18 nt, Human
uuaaacuucucugaaggg

SEQ ID NO: 2574793 - RNA, 17 nt, Human
uuaaacuucucugaagg

SEQ ID NO: 2574794 - RNA, 20 nt, Human
uuaaacuucucugaagggag

SEQ ID NO: 2574795 - RNA, 16 nt, Human
uuaaacguaugcaugu

SEQ ID NO: 2574796 - RNA, 23 nt, Human
uuaaacggauuauuuuuucagac

SEQ ID NO: 2574797 - RNA, 22 nt, Human
uuaaacggauuauuuuuucaga

SEQ ID NO: 2574798 - RNA, 18 nt, Human
uuaaaauacacacucaaa

SEQ ID NO: 2574799 - RNA, 19 nt, Human
uuaaacuagcauaucugcc

SEQ ID NO: 2574800 - RNA, 17 nt, Human
uuaaacuagcauaucug

SEQ ID NO: 2574801 - RNA, 20 nt, Human
uuaaacguaugcaugugaag

SEQ ID NO: 2574802 - RNA, 18 nt, Human
uuaaacguaugcauguga

SEQ ID NO: 2574803 - RNA, 14 nt, Human
uuaaacgugcagac

SEQ ID NO: 2574804 - RNA, 20 nt, Human
uuaaacuaaggcccucuuga

SEQ ID NO: 2574805 - RNA, 13 nt, Human
uuaaaaaaaaaga

SEQ ID NO: 2574806 - RNA, 22 nt, Human
uuaaaaaaaaaccugagcccca

SEQ ID NO: 2574807 - RNA, 15 nt, Human
uguuuuuguaaagug

SEQ ID NO: 2574808 - RNA, 12 nt, Human
uguuuuuguaaa

SEQ ID NO: 2574809 - RNA, 12 nt, Human
uguuuuucuggg

SEQ ID NO: 2574810 - RNA, 16 nt, Human
uguuuuugaaggcaga

SEQ ID NO: 2574811 - RNA, 18 nt, Human
uguuuuugaaggcagaaa

SEQ ID NO: 2574812 - RNA, 20 nt, Human
uguuuuugaaggcagaaagc

SEQ ID NO: 2574813 - RNA, 16 nt, Human
uguuuuugcacauguu

SEQ ID NO: 2574814 - RNA, 13 nt, Human
uguuuuugaaaua

SEQ ID NO: 2574815 - RNA, 16 nt, Human
uguuuuuaaaaaucau

SEQ ID NO: 2574816 - RNA, 22 nt, Human
uguuuuuacccauauccccucu

SEQ ID NO: 2574817 - RNA, 13 nt, Human
uguuuuuacccau

SEQ ID NO: 2574818 - RNA, 22 nt, Human
uguuuuuaagcuguuuccauag

SEQ ID NO: 2574819 - RNA, 20 nt, Human
uguuuuuaagcuguuuccau

SEQ ID NO: 2574820 - RNA, 17 nt, Human
uguuuuuaagcuguuuc

SEQ ID NO: 2574821 - RNA, 15 nt, Human
uguuuuuaagcuguu

SEQ ID NO: 2574822 - RNA, 22 nt, Human
uguuuuaaggaugcuuguacau

SEQ ID NO: 2574823 - RNA, 23 nt, Human
uguuuuaaggaugcuuguacaua

SEQ ID NO: 2574824 - RNA, 13 nt, Human
uguuuuaacaaaa

SEQ ID NO: 2574825 - RNA, 14 nt, Human
uguuuuaacaaaaa

SEQ ID NO: 2574826 - RNA, 19 nt, Human
uguuuuaaggaugcuugua

SEQ ID NO: 2574827 - RNA, 17 nt, Human
uguuuuaagaggcaggg

SEQ ID NO: 2574828 - RNA, 22 nt, Human
uguuuuaauuuaaacaccuccu

SEQ ID NO: 2574829 - RNA, 16 nt, Human
uguuuuaauuccauga

SEQ ID NO: 2574830 - RNA, 14 nt, Human
uguuuuaauuccau

SEQ ID NO: 2574831 - RNA, 23 nt, Human
uguuuuaauuuaaacaccuccuc

SEQ ID NO: 2574832 - RNA, 17 nt, Human
uguuuuuaaaaaucaua

SEQ ID NO: 2574833 - RNA, 20 nt, Human
uguuuuuaaaaaucauaaac

SEQ ID NO: 2574834 - RNA, 19 nt, Human
uguuuuuaaaaguuucaau

SEQ ID NO: 2574835 - RNA, 14 nt, Human
uguuuuuaagcugu

SEQ ID NO: 2574836 - RNA, 12 nt, Human
uguuuuuaacuc

SEQ ID NO: 2574837 - RNA, 14 nt, Human
uguuucugucagga

SEQ ID NO: 2574838 - RNA, 12 nt, Human
uguuuguguauu

SEQ ID NO: 2574839 - RNA, 15 nt, Human
uguuuguggccucag

SEQ ID NO: 2574840 - RNA, 13 nt, Human
uguuuguggccuc

SEQ ID NO: 2574841 - RNA, 14 nt, Human
uguuuguggccuca

SEQ ID NO: 2574842 - RNA, 13 nt, Human
uguuugugcuucu

SEQ ID NO: 2574843 - RNA, 12 nt, Human
uguuugugcuuc

SEQ ID NO: 2574844 - RNA, 15 nt, Human
uguuugugcuguggu

SEQ ID NO: 2574845 - RNA, 15 nt, Human
uguuugugcuucuaa

SEQ ID NO: 2574846 - RNA, 14 nt, Human
uguuugugcuucua

SEQ ID NO: 2574847 - RNA, 12 nt, Human
uguuuguggccu

SEQ ID NO: 2574848 - RNA, 16 nt, Human
uguuuuaagaggcagg

SEQ ID NO: 2574849 - RNA, 11 nt, Human
uguuuuaacaa

SEQ ID NO: 2574850 - RNA, 22 nt, Human
uguuuuaaauuuauuucaaaaa

SEQ ID NO: 2574851 - RNA, 15 nt, Human
uguuuguucaucugu

SEQ ID NO: 2574852 - RNA, 12 nt, Human
uguuuguuaugg

SEQ ID NO: 2574853 - RNA, 14 nt, Human
uguuuguguauuua

SEQ ID NO: 2574854 - RNA, 19 nt, Human
uguuugugcuucuaauauu

SEQ ID NO: 2574855 - RNA, 14 nt, Human
uguuugugugagag

SEQ ID NO: 2574856 - RNA, 13 nt, Human
uguuugugugugu

SEQ ID NO: 2574857 - RNA, 11 nt, Human
uguuugugugu

SEQ ID NO: 2574858 - RNA, 13 nt, Human
uguuuacuaggga

SEQ ID NO: 2574859 - RNA, 19 nt, Human
uguuuacuagggaucccuc

SEQ ID NO: 2574860 - RNA, 19 nt, Human
uguuuacuuaaagauuuau

SEQ ID NO: 2574861 - RNA, 18 nt, Human
uguuuacuuaaagauuua

SEQ ID NO: 2574862 - RNA, 17 nt, Human
uguuuacuuaaagauuu

SEQ ID NO: 2574863 - RNA, 16 nt, Human
uguuuacuuaaagauu

SEQ ID NO: 2574864 - RNA, 15 nt, Human
uguuuacuuaaagau

SEQ ID NO: 2574865 - RNA, 12 nt, Human
uguuuacugaaa

SEQ ID NO: 2574866 - RNA, 19 nt, Human
uguuuccauauuuuauagg

SEQ ID NO: 2574867 - RNA, 14 nt, Human
uguuucccauaauu

SEQ ID NO: 2574868 - RNA, 22 nt, Human
uguuucccauaauuuucuucau

SEQ ID NO: 2574869 - RNA, 23 nt, Human
uguuuacuuaaagauuuaucaaa

SEQ ID NO: 2574870 - RNA, 14 nt, Human
uguuuccucuaguu

SEQ ID NO: 2574871 - RNA, 20 nt, Human
uguuucccuuucacuggcau

SEQ ID NO: 2574872 - RNA, 23 nt, Human
uguuuccuagcacacacuuuugg

SEQ ID NO: 2574873 - RNA, 11 nt, Human
uguuuccugag

SEQ ID NO: 2574874 - RNA, 15 nt, Human
uguuuccuggcacug

SEQ ID NO: 2574875 - RNA, 21 nt, Human
uguuucugcaguagucucugu

SEQ ID NO: 2574876 - RNA, 22 nt, Human
uguuucugcaguagucucugug

SEQ ID NO: 2574877 - RNA, 12 nt, Human
uguuucugcagu

SEQ ID NO: 2574878 - RNA, 12 nt, Human
uguuucugacuc

SEQ ID NO: 2574879 - RNA, 19 nt, Human
uguuucugacucugagcua

SEQ ID NO: 2574880 - RNA, 16 nt, Human
uguuuccugcaggcca

SEQ ID NO: 2574881 - RNA, 23 nt, Human
uguguggguggauauaaauauau

SEQ ID NO: 2574882 - RNA, 21 nt, Human
uguguggguggauauaaauau

SEQ ID NO: 2574883 - RNA, 20 nt, Human
uguguggguggauauaaaua

SEQ ID NO: 2574884 - RNA, 16 nt, Human
ugugugggagugugua

SEQ ID NO: 2574885 - RNA, 13 nt, Human
ugugugggucuau

SEQ ID NO: 2574886 - RNA, 16 nt, Human
ugugugugaaugaaca

SEQ ID NO: 2574887 - RNA, 20 nt, Human
ugugugugaaugaacacucu

SEQ ID NO: 2574888 - RNA, 17 nt, Human
ugugugugaaaaugugu

SEQ ID NO: 2574889 - RNA, 16 nt, Human
ugugugucuuaauuau

SEQ ID NO: 2574890 - RNA, 22 nt, Human
uguguggguggauauaaauaua

SEQ ID NO: 2574891 - RNA, 22 nt, Human
ugugugucuaggcaggaccugu

SEQ ID NO: 2574892 - RNA, 16 nt, Human
uguguuuauugucaaa

SEQ ID NO: 2574893 - RNA, 15 nt, Human
uguguuucaaguuca

SEQ ID NO: 2574894 - RNA, 19 nt, Human
ugugugugcuuauguauga

SEQ ID NO: 2574895 - RNA, 20 nt, Human
ugugugugcuuauguaugag

SEQ ID NO: 2574896 - RNA, 19 nt, Human
uguguuuugcaagccagau

SEQ ID NO: 2574897 - RNA, 13 nt, Human
uguguuuugcaag

SEQ ID NO: 2574898 - RNA, 15 nt, Human
uguguuucuguauaa

SEQ ID NO: 2574899 - RNA, 20 nt, Human
uguguuucuaugugacaauu

SEQ ID NO: 2574900 - RNA, 13 nt, Human
uguguuucacuuu

SEQ ID NO: 2574901 - RNA, 12 nt, Human
uguguuuccaca

SEQ ID NO: 2574902 - RNA, 11 nt, Human
uguguuuccuu

SEQ ID NO: 2574903 - RNA, 15 nt, Human
uguguuuuucauaaa

SEQ ID NO: 2574904 - RNA, 15 nt, Human
uguguuuuuaauaaa

SEQ ID NO: 2574905 - RNA, 18 nt, Human
uguguuuuucauaaagca

SEQ ID NO: 2574906 - RNA, 20 nt, Human
uguguuuuuaauaaagacag

SEQ ID NO: 2574907 - RNA, 19 nt, Human
uguguuuuuauuguuaacu

SEQ ID NO: 2574908 - RNA, 14 nt, Human
uguguuuuuauugu

SEQ ID NO: 2574909 - RNA, 11 nt, Human
uguguaugugg

SEQ ID NO: 2574910 - RNA, 12 nt, Human
uguguauguggg

SEQ ID NO: 2574911 - RNA, 21 nt, Human
uguguaucguaaccagccaga

SEQ ID NO: 2574912 - RNA, 24 nt, Human
uguguauccauuaucauguguaau

SEQ ID NO: 2574913 - RNA, 23 nt, Human
uguguauccauuaucauguguaa

SEQ ID NO: 2574914 - RNA, 22 nt, Human
uguguauccauuaucaugugua

SEQ ID NO: 2574915 - RNA, 18 nt, Human
uguguaugcgugugugug

SEQ ID NO: 2574916 - RNA, 14 nt, Human
uguguaugggcaaa

SEQ ID NO: 2574917 - RNA, 22 nt, Human
ugugugaaagguacuucaaauc

SEQ ID NO: 2574918 - RNA, 21 nt, Human
ugugugaaagguacuucaaau

SEQ ID NO: 2574919 - RNA, 17 nt, Human
ugugugaugaacuuucu

SEQ ID NO: 2574920 - RNA, 16 nt, Human
ugugugaugaacuuuc

SEQ ID NO: 2574921 - RNA, 14 nt, Human
uguguaugugcgug

SEQ ID NO: 2574922 - RNA, 20 nt, Human
ugugugaaauaccagugugg

SEQ ID NO: 2574923 - RNA, 19 nt, Human
uguguaugugcgugugugc

SEQ ID NO: 2574924 - RNA, 23 nt, Human
ugugugaagaucacguuccuucc

SEQ ID NO: 2574925 - RNA, 13 nt, Human
ugugugcucucca

SEQ ID NO: 2574926 - RNA, 15 nt, Human
ugugugcuuauguau

SEQ ID NO: 2574927 - RNA, 22 nt, Human
ugugugcaccuuaccaacuuuc

SEQ ID NO: 2574928 - RNA, 17 nt, Human
ugugugcaccuuaccaa

SEQ ID NO: 2574929 - RNA, 22 nt, Human
ugugugcaacaggguauggacu

SEQ ID NO: 2574930 - RNA, 23 nt, Human
ugugugcaccuuaccaacuuucu

SEQ ID NO: 2574931 - RNA, 14 nt, Human
ugugugaugugcau

SEQ ID NO: 2574932 - RNA, 16 nt, Human
ugugugauugaaucug

SEQ ID NO: 2574933 - RNA, 15 nt, Human
ugugugauugacagc

SEQ ID NO: 2574934 - RNA, 18 nt, Human
ugugugauugacagcuuu

SEQ ID NO: 2574935 - RNA, 19 nt, Human
ugugugauugacagcuuug

SEQ ID NO: 2574936 - RNA, 21 nt, Human
ugugugauugacagcuuugcu

SEQ ID NO: 2574937 - RNA, 19 nt, Human
ugugugcacguacacacac

SEQ ID NO: 2574938 - RNA, 14 nt, Human
ugugugggagugug

SEQ ID NO: 2574939 - RNA, 15 nt, Human
ugugugggagugugu

SEQ ID NO: 2574940 - RNA, 11 nt, Human
uguguggccug

SEQ ID NO: 2574941 - RNA, 18 nt, Human
ugugugcucuucuucuuu

SEQ ID NO: 2574942 - RNA, 17 nt, Human
uguguggacucaagucc

SEQ ID NO: 2574943 - RNA, 19 nt, Human
uguguggacugugaugcca

SEQ ID NO: 2574944 - RNA, 16 nt, Human
uguguggacugugaug

SEQ ID NO: 2574945 - RNA, 21 nt, Human
uguuaaaagaugaaaauauuu

SEQ ID NO: 2574946 - RNA, 12 nt, Human
uguuaaaauaac

SEQ ID NO: 2574947 - RNA, 21 nt, Human
uguguuuuugcuaucacacag

SEQ ID NO: 2574948 - RNA, 13 nt, Human
uguguuuuugaaa

SEQ ID NO: 2574949 - RNA, 21 nt, Human
uguuacccaguaacucaucug

SEQ ID NO: 2574950 - RNA, 23 nt, Human
uguuaaaauguauucuuaaauuc

SEQ ID NO: 2574951 - RNA, 15 nt, Human
uguuaaaauguauuc

SEQ ID NO: 2574952 - RNA, 14 nt, Human
uguuaaaauaacua

SEQ ID NO: 2574953 - RNA, 16 nt, Human
uguuaccugaaaacac

SEQ ID NO: 2574954 - RNA, 22 nt, Human
uguuaccugaaaacacugugca

SEQ ID NO: 2574955 - RNA, 16 nt, Human
uguuaccuacuuugac

SEQ ID NO: 2574956 - RNA, 15 nt, Human
uguuaccugaaaaca

SEQ ID NO: 2574957 - RNA, 18 nt, Human
uguuacccuccuguaaau

SEQ ID NO: 2574958 - RNA, 20 nt, Human
uguuaccuaauuagagcaga

SEQ ID NO: 2574959 - RNA, 14 nt, Human
uguuacuaacuaaa

SEQ ID NO: 2574960 - RNA, 13 nt, Human
uguuacuaacuaa

SEQ ID NO: 2574961 - RNA, 17 nt, Human
uguuacuaaagaaaaua

SEQ ID NO: 2574962 - RNA, 21 nt, Human
uguuaccugaucaaugacaga

SEQ ID NO: 2574963 - RNA, 23 nt, Human
uguuaccugaaaacacugugcac

SEQ ID NO: 2574964 - RNA, 14 nt, Human
uguuacuaaguuuu

SEQ ID NO: 2574965 - RNA, 16 nt, Human
uguuacuaucugcuuu

SEQ ID NO: 2574966 - RNA, 18 nt, Human
uguuacuaacuaaacucu

SEQ ID NO: 2574967 - RNA, 17 nt, Human
uguuacuaacuaaacuc

SEQ ID NO: 2574968 - RNA, 15 nt, Human
uguuacuaucugcuu

SEQ ID NO: 2574969 - RNA, 17 nt, Human
uguuacucugguucuuu

SEQ ID NO: 2574970 - RNA, 15 nt, Human
uguuacucugguucu

SEQ ID NO: 2574971 - RNA, 13 nt, Human
uguuacucugguu

SEQ ID NO: 2574972 - RNA, 20 nt, Human
uguuacucugguucuuuguu

SEQ ID NO: 2574973 - RNA, 14 nt, Human
uguuacuguaauuc

SEQ ID NO: 2574974 - RNA, 14 nt, Human
uguuagcagacagg

SEQ ID NO: 2574975 - RNA, 12 nt, Human
uguuacuguaau

SEQ ID NO: 2574976 - RNA, 14 nt, Human
uguuacugaucaug

SEQ ID NO: 2574977 - RNA, 15 nt, Human
uguuacugaccagca

SEQ ID NO: 2574978 - RNA, 13 nt, Human
uguuacugaucau

SEQ ID NO: 2574979 - RNA, 20 nt, Human
uguuacugaucaugcauugu

SEQ ID NO: 2574980 - RNA, 16 nt, Human
uguuaggaaaauuuca

SEQ ID NO: 2574981 - RNA, 14 nt, Human
uguuagcuguuauu

SEQ ID NO: 2574982 - RNA, 17 nt, Human
uguuagccccauaauuu

SEQ ID NO: 2574983 - RNA, 17 nt, Human
uguucauaaauaaaguu

SEQ ID NO: 2574984 - RNA, 18 nt, Human
uguucagcuccagcucac

SEQ ID NO: 2574985 - RNA, 15 nt, Human
uguucauagcccagu

SEQ ID NO: 2574986 - RNA, 14 nt, Human
uguucauagcccag

SEQ ID NO: 2574987 - RNA, 18 nt, Human
uguucauagacccucuca

SEQ ID NO: 2574988 - RNA, 12 nt, Human
uguucauacauu

SEQ ID NO: 2574989 - RNA, 22 nt, Human
uguucagcuccagcucaccagc

SEQ ID NO: 2574990 - RNA, 21 nt, Human
uguucagcuccagcucaccag

SEQ ID NO: 2574991 - RNA, 17 nt, Human
uguucagcacugucccu

SEQ ID NO: 2574992 - RNA, 15 nt, Human
uguucagcacugucc

SEQ ID NO: 2574993 - RNA, 18 nt, Human
uguucagcacugucccuu

SEQ ID NO: 2574994 - RNA, 18 nt, Human
uguucagauugcuuugau

SEQ ID NO: 2574995 - RNA, 20 nt, Human
uguucagcuccagcucacca

SEQ ID NO: 2574996 - RNA, 19 nt, Human
uguuaguaugaggcauuug

SEQ ID NO: 2574997 - RNA, 20 nt, Human
uguuaguaugaggcauuugu

SEQ ID NO: 2574998 - RNA, 17 nt, Human
uguuaguaugaggcauu

SEQ ID NO: 2574999 - RNA, 21 nt, Human
uguuaggccuggcacaguguc

SEQ ID NO: 2575000 - RNA, 20 nt, Human
uguuaggccuggcacagugu

SEQ ID NO: 2575001 - RNA, 16 nt, Human
uguuaggccuggcaca

SEQ ID NO: 2575002 - RNA, 13 nt, Human
uguuaguaacaug

SEQ ID NO: 2575003 - RNA, 16 nt, Human
uguucacuuuuccucc

SEQ ID NO: 2575004 - RNA, 19 nt, Human
uguucacuuuuccucccuc

SEQ ID NO: 2575005 - RNA, 15 nt, Human
uguuagucauuugcu

SEQ ID NO: 2575006 - RNA, 17 nt, Human
uguucacuuuugacaaa

SEQ ID NO: 2575007 - RNA, 13 nt, Human
uguucacuguccc

SEQ ID NO: 2575008 - RNA, 18 nt, Human
uguucagaagguugcucu

SEQ ID NO: 2575009 - RNA, 14 nt, Human
uguucagcacuguc

SEQ ID NO: 2575010 - RNA, 13 nt, Human
uguucagcacugu

SEQ ID NO: 2575011 - RNA, 22 nt, Human
uguucagaagguugcucuagau

SEQ ID NO: 2575012 - RNA, 17 nt, Human
uguucagauugcuuuga

SEQ ID NO: 2575013 - RNA, 20 nt, Human
uguugacaugggacauuugc

SEQ ID NO: 2575014 - RNA, 16 nt, Human
uguugacaguucugaa

SEQ ID NO: 2575015 - RNA, 17 nt, Human
uguugacaguucauaug

SEQ ID NO: 2575016 - RNA, 16 nt, Human
uguugacacaggucuu

SEQ ID NO: 2575017 - RNA, 15 nt, Human
uguugaagccuuugu

SEQ ID NO: 2575018 - RNA, 13 nt, Human
uguugaauacuuu

SEQ ID NO: 2575019 - RNA, 18 nt, Human
uguugaauacuuuuuaca

SEQ ID NO: 2575020 - RNA, 22 nt, Human
uguugaaugcccacaggcaaau

SEQ ID NO: 2575021 - RNA, 22 nt, Human
uguugacuuauuuucucugugu

SEQ ID NO: 2575022 - RNA, 21 nt, Human
uguugacuuauuuucucugug

SEQ ID NO: 2575023 - RNA, 20 nt, Human
uguugacuuauuuucucugu

SEQ ID NO: 2575024 - RNA, 13 nt, Human
uguugacuuauuu

SEQ ID NO: 2575025 - RNA, 22 nt, Human
uguugagaaucccaaauuugau

SEQ ID NO: 2575026 - RNA, 18 nt, Human
uguugacgaagucucuuu

SEQ ID NO: 2575027 - RNA, 16 nt, Human
uguugacgaagucucu

SEQ ID NO: 2575028 - RNA, 19 nt, Human
uguugacauccaagcuucc

SEQ ID NO: 2575029 - RNA, 17 nt, Human
uguugacauccaagcuu

SEQ ID NO: 2575030 - RNA, 14 nt, Human
uguugacaugugcu

SEQ ID NO: 2575031 - RNA, 20 nt, Human
uguucuggcucuuccaggcu

SEQ ID NO: 2575032 - RNA, 17 nt, Human
uguucuggcucuuccag

SEQ ID NO: 2575033 - RNA, 21 nt, Human
uguucuggcucuuccaggcug

SEQ ID NO: 2575034 - RNA, 15 nt, Human
uguucugcuuuccuc

SEQ ID NO: 2575035 - RNA, 23 nt, Human
uguucuuucuggcuaugcauuug

SEQ ID NO: 2575036 - RNA, 13 nt, Human
uguucuuugggga

SEQ ID NO: 2575037 - RNA, 13 nt, Human
uguucuggcccuc

SEQ ID NO: 2575038 - RNA, 15 nt, Human
uguucuggcccucac

SEQ ID NO: 2575039 - RNA, 16 nt, Human
uguucuuuugucccag

SEQ ID NO: 2575040 - RNA, 23 nt, Human
uguugaaaaaaaaguuucagaga

SEQ ID NO: 2575041 - RNA, 17 nt, Human
uguucuuuuuauugaau

SEQ ID NO: 2575042 - RNA, 14 nt, Human
uguucuuuuuauug

SEQ ID NO: 2575043 - RNA, 15 nt, Human
uguucucucuucucc

SEQ ID NO: 2575044 - RNA, 16 nt, Human
uguucucucuucucca

SEQ ID NO: 2575045 - RNA, 15 nt, Human
uguucucucccaggg

SEQ ID NO: 2575046 - RNA, 20 nt, Human
uguucucuaucauuuaauaa

SEQ ID NO: 2575047 - RNA, 18 nt, Human
uguucucuaucauuuaau

SEQ ID NO: 2575048 - RNA, 15 nt, Human
uguucucuaucauuu

SEQ ID NO: 2575049 - RNA, 21 nt, Human
uguucuccuuuuccucucucc

SEQ ID NO: 2575050 - RNA, 21 nt, Human
uguucaucuguaacucuaaaa

SEQ ID NO: 2575051 - RNA, 15 nt, Human
uguucaucuguaacu

SEQ ID NO: 2575052 - RNA, 14 nt, Human
uguucaucuguaac

SEQ ID NO: 2575053 - RNA, 19 nt, Human
uguucaucccaugauguag

SEQ ID NO: 2575054 - RNA, 11 nt, Human
uguucauccca

SEQ ID NO: 2575055 - RNA, 20 nt, Human
uguucauagcccaguagacc

SEQ ID NO: 2575056 - RNA, 19 nt, Human
uguucauagcccaguagac

SEQ ID NO: 2575057 - RNA, 23 nt, Human
uguucauagcccaguagaccuug

SEQ ID NO: 2575058 - RNA, 19 nt, Human
uguucaucauccuaagcua

SEQ ID NO: 2575059 - RNA, 16 nt, Human
uguucucugcccucca

SEQ ID NO: 2575060 - RNA, 15 nt, Human
uguucucugcccucc

SEQ ID NO: 2575061 - RNA, 14 nt, Human
uguucucugcccuc

SEQ ID NO: 2575062 - RNA, 13 nt, Human
uguucucugcccu

SEQ ID NO: 2575063 - RNA, 16 nt, Human
uguucuggcucuucca

SEQ ID NO: 2575064 - RNA, 13 nt, Human
uguucuggcucuu

SEQ ID NO: 2575065 - RNA, 12 nt, Human
uguucuggcucu

SEQ ID NO: 2575066 - RNA, 17 nt, Human
uguuggagaagaacuga

SEQ ID NO: 2575067 - RNA, 16 nt, Human
uguuggagaagaacug

SEQ ID NO: 2575068 - RNA, 21 nt, Human
uguuggaaaagaauacagaaa

SEQ ID NO: 2575069 - RNA, 15 nt, Human
uguugauugcuaaau

SEQ ID NO: 2575070 - RNA, 14 nt, Human
uguugauugcuaaa

SEQ ID NO: 2575071 - RNA, 12 nt, Human
uguuggaaugaa

SEQ ID NO: 2575072 - RNA, 14 nt, Human
uguuggagaagaac

SEQ ID NO: 2575073 - RNA, 16 nt, Human
uguugaugcuuucguc

SEQ ID NO: 2575074 - RNA, 12 nt, Human
uguugaucccaa

SEQ ID NO: 2575075 - RNA, 16 nt, Human
uguugaucccaagaca

SEQ ID NO: 2575076 - RNA, 13 nt, Human
uguugauugcuaa

SEQ ID NO: 2575077 - RNA, 12 nt, Human
uguugauugcua

SEQ ID NO: 2575078 - RNA, 20 nt, Human
uguugauugcaggaauaagg

SEQ ID NO: 2575079 - RNA, 11 nt, Human
uguugauuauu

SEQ ID NO: 2575080 - RNA, 16 nt, Human
uguugauuauuagcca

SEQ ID NO: 2575081 - RNA, 16 nt, Human
uguuggccaggcuggu

SEQ ID NO: 2575082 - RNA, 15 nt, Human
uguuggccaggcugg

SEQ ID NO: 2575083 - RNA, 14 nt, Human
uguuggcagccucu

SEQ ID NO: 2575084 - RNA, 12 nt, Human
uguuggcaggcu

SEQ ID NO: 2575085 - RNA, 14 nt, Human
uguuggcagcauaa

SEQ ID NO: 2575086 - RNA, 15 nt, Human
uguuggccaaagcca

SEQ ID NO: 2575087 - RNA, 20 nt, Human
uguuggagaagaacugaaau

SEQ ID NO: 2575088 - RNA, 19 nt, Human
uguuggagaagaacugaaa

SEQ ID NO: 2575089 - RNA, 22 nt, Human
uguuggcacucacagaccugga

SEQ ID NO: 2575090 - RNA, 21 nt, Human
uguuggcacucacagaccugg

SEQ ID NO: 2575091 - RNA, 23 nt, Human
uguuggcacucacagaccuggag

SEQ ID NO: 2575092 - RNA, 15 nt, Human
uguuggcacucacag

SEQ ID NO: 2575093 - RNA, 19 nt, Human
uguuggcacauccuaugca

SEQ ID NO: 2575094 - RNA, 18 nt, Human
uguuggcacaugccugua

SEQ ID NO: 2575095 - RNA, 13 nt, Human
uguuggacccgcu

SEQ ID NO: 2575096 - RNA, 19 nt, Human
uguuggacccgcucuggac

SEQ ID NO: 2575097 - RNA, 18 nt, Human
uguuggacccgcucugga

SEQ ID NO: 2575098 - RNA, 18 nt, Human
uguuggcacauccuaugc

SEQ ID NO: 2575099 - RNA, 20 nt, Human
uguuggauuuuugucuugug

SEQ ID NO: 2575100 - RNA, 17 nt, Human
uguuuaaaaucauuucu

SEQ ID NO: 2575101 - RNA, 18 nt, Human
uguuuaaaaucauuucug

SEQ ID NO: 2575102 - RNA, 19 nt, Human
uguuggcugggggccucag

SEQ ID NO: 2575103 - RNA, 19 nt, Human
uguugggacugcuaaauaa

SEQ ID NO: 2575104 - RNA, 14 nt, Human
uguugggacugcua

SEQ ID NO: 2575105 - RNA, 19 nt, Human
uguugggaaacuuggcucg

SEQ ID NO: 2575106 - RNA, 22 nt, Human
uguuggcugggaacucaccugg

SEQ ID NO: 2575107 - RNA, 21 nt, Human
uguuggcagugagugagccug

SEQ ID NO: 2575108 - RNA, 21 nt, Human
uguuggcaggcuggccagucc

SEQ ID NO: 2575109 - RNA, 18 nt, Human
uguuggcaggcuggccag

SEQ ID NO: 2575110 - RNA, 15 nt, Human
uguuggcgagaggag

SEQ ID NO: 2575111 - RNA, 20 nt, Human
uguuggccuccggccucccc

SEQ ID NO: 2575112 - RNA, 20 nt, Human
uguuggcgagaggaggggcc

SEQ ID NO: 2575113 - RNA, 17 nt, Human
uguuggccuccggccuc

SEQ ID NO: 2575114 - RNA, 16 nt, Human
uguuggccuccggccu

SEQ ID NO: 2575115 - RNA, 15 nt, Human
uguuggccucugcaa

SEQ ID NO: 2575116 - RNA, 17 nt, Human
uguuggcugggggccuc

SEQ ID NO: 2575117 - RNA, 23 nt, Human
uguuggcguggggccuuugucag

SEQ ID NO: 2575118 - RNA, 15 nt, Human
uguuggcuaaugaag

SEQ ID NO: 2575119 - RNA, 19 nt, Human
uguuuaacuuaaucaauua

SEQ ID NO: 2575120 - RNA, 11 nt, Human
uguuuaaauau

SEQ ID NO: 2575121 - RNA, 22 nt, Human
uguuuaaauaaaguaucaugca

SEQ ID NO: 2575122 - RNA, 20 nt, Human
uguuuaaauaaaguaucaug

SEQ ID NO: 2575123 - RNA, 17 nt, Human
uguuuaaauaaaguauc

SEQ ID NO: 2575124 - RNA, 15 nt, Human
uguuuaaauaaagua

SEQ ID NO: 2575125 - RNA, 14 nt, Human
uguuuaaauaaagu

SEQ ID NO: 2575126 - RNA, 12 nt, Human
uguuuaagagac

SEQ ID NO: 2575127 - RNA, 21 nt, Human
uguuuaaagagagguuauaga

SEQ ID NO: 2575128 - RNA, 17 nt, Human
uguuuaaagagagguua

SEQ ID NO: 2575129 - RNA, 12 nt, Human
uguuuaaagaga

SEQ ID NO: 2575130 - RNA, 12 nt, Human
uguuuaaauaaa

SEQ ID NO: 2575131 - RNA, 14 nt, Human
uguuuacaucaguu

SEQ ID NO: 2575132 - RNA, 12 nt, Human
uguuuacauauc

SEQ ID NO: 2575133 - RNA, 21 nt, Human
uguuuacaucaguuuuaacga

SEQ ID NO: 2575134 - RNA, 12 nt, Human
uguuuacagugu

SEQ ID NO: 2575135 - RNA, 16 nt, Human
uguuuaauauugagaa

SEQ ID NO: 2575136 - RNA, 23 nt, Human
uguuuaauacucauccuuguaua

SEQ ID NO: 2575137 - RNA, 20 nt, Human
uguuuaauauugagaaagaa

SEQ ID NO: 2575138 - RNA, 14 nt, Human
uguuuaagaugggc

SEQ ID NO: 2575139 - RNA, 21 nt, Human
uguuuaaguguuguaaauauu

SEQ ID NO: 2575140 - RNA, 20 nt, Human
uguuuaacuuaaucaauuaa

SEQ ID NO: 2575141 - RNA, 13 nt, Human
agugauuaccagg

SEQ ID NO: 2575142 - RNA, 16 nt, Human
agugauguaccaugaa

SEQ ID NO: 2575143 - RNA, 19 nt, Human
agugaugucacuagggcag

SEQ ID NO: 2575144 - RNA, 20 nt, Human
agugauggguuaguggaugg

SEQ ID NO: 2575145 - RNA, 22 nt, Human
agugauccucccaccucagccu

SEQ ID NO: 2575146 - RNA, 20 nt, Human
agugauccucccaccucagc

SEQ ID NO: 2575147 - RNA, 19 nt, Human
agugauccucccaccucag

SEQ ID NO: 2575148 - RNA, 13 nt, Human
agugcuaagugug

SEQ ID NO: 2575149 - RNA, 20 nt, Human
agugcuaaaaaugggacuuc

SEQ ID NO: 2575150 - RNA, 16 nt, Human
agugcuaaaaauggga

SEQ ID NO: 2575151 - RNA, 14 nt, Human
agugcuaaaaaugg

SEQ ID NO: 2575152 - RNA, 22 nt, Human
agugcguguguagaguuaagaa

SEQ ID NO: 2575153 - RNA, 18 nt, Human
agugcguguguagaguua

SEQ ID NO: 2575154 - RNA, 16 nt, Human
agugcguguguagagu

SEQ ID NO: 2575155 - RNA, 13 nt, Human
agugcguguguag

SEQ ID NO: 2575156 - RNA, 15 nt, Human
agugcguccacgagc

SEQ ID NO: 2575157 - RNA, 14 nt, Human
agugcgugcucagu

SEQ ID NO: 2575158 - RNA, 15 nt, Human
agugcgaguaugugu

SEQ ID NO: 2575159 - RNA, 14 nt, Human
agugcgaguaugug

SEQ ID NO: 2575160 - RNA, 17 nt, Human
agugcgaguauguguuu

SEQ ID NO: 2575161 - RNA, 17 nt, Human
agugcgauucuggauaa

SEQ ID NO: 2575162 - RNA, 22 nt, Human
agugccuuggggaauuuccucu

SEQ ID NO: 2575163 - RNA, 21 nt, Human
agugccuuggggaauuuccuc

SEQ ID NO: 2575164 - RNA, 19 nt, Human
agugccuuccuguuuuuca

SEQ ID NO: 2575165 - RNA, 16 nt, Human
agugccuucuaaaggu

SEQ ID NO: 2575166 - RNA, 16 nt, Human
agugccuuccauaauu

SEQ ID NO: 2575167 - RNA, 20 nt, Human
agugccuucaauaaauggua

SEQ ID NO: 2575168 - RNA, 18 nt, Human
agugccuucaauaaaugg

SEQ ID NO: 2575169 - RNA, 13 nt, Human
agugccuuccaua

SEQ ID NO: 2575170 - RNA, 15 nt, Human
agugccuuccauaau

SEQ ID NO: 2575171 - RNA, 22 nt, Human
agugccuuauggaacacucuga

SEQ ID NO: 2575172 - RNA, 21 nt, Human
agugccuuauggaacacucug

SEQ ID NO: 2575173 - RNA, 20 nt, Human
agugccuuauggaacacucu

SEQ ID NO: 2575174 - RNA, 19 nt, Human
agugccuuauggaacacuc

SEQ ID NO: 2575175 - RNA, 18 nt, Human
agugccuuauggaacacu

SEQ ID NO: 2575176 - RNA, 20 nt, Human
agugauucuccugccucagc

SEQ ID NO: 2575177 - RNA, 18 nt, Human
agugauucuccugccuca

SEQ ID NO: 2575178 - RNA, 19 nt, Human
agugauucuccugccucag

SEQ ID NO: 2575179 - RNA, 19 nt, Human
agugacagaggcagcccca

SEQ ID NO: 2575180 - RNA, 16 nt, Human
agugacagaggcagcc

SEQ ID NO: 2575181 - RNA, 19 nt, Human
agugacagaguucacuaua

SEQ ID NO: 2575182 - RNA, 14 nt, Human
agugaaugcuggga

SEQ ID NO: 2575183 - RNA, 15 nt, Human
agugacagaguucac

SEQ ID NO: 2575184 - RNA, 16 nt, Human
agugaaugauucagug

SEQ ID NO: 2575185 - RNA, 17 nt, Human
agugaaugauucagugu

SEQ ID NO: 2575186 - RNA, 18 nt, Human
agugaaugcucaaguuuu

SEQ ID NO: 2575187 - RNA, 19 nt, Human
agugaaugauucaguguua

SEQ ID NO: 2575188 - RNA, 14 nt, Human
agugacagaggcag

SEQ ID NO: 2575189 - RNA, 13 nt, Human
agugaaugaaaca

SEQ ID NO: 2575190 - RNA, 13 nt, Human
agugaaugauuca

SEQ ID NO: 2575191 - RNA, 23 nt, Human
agugaaucuaaaagcuuuugcuu

SEQ ID NO: 2575192 - RNA, 17 nt, Human
agugaauaaaugucuug

SEQ ID NO: 2575193 - RNA, 14 nt, Human
agugaauaaauguc

SEQ ID NO: 2575194 - RNA, 14 nt, Human
aguaucaugcauuc

SEQ ID NO: 2575195 - RNA, 19 nt, Human
aguaucaugcccugugcaa

SEQ ID NO: 2575196 - RNA, 12 nt, Human
aguaucaugcau

SEQ ID NO: 2575197 - RNA, 11 nt, Human
aguaucaugca

SEQ ID NO: 2575198 - RNA, 15 nt, Human
aguaucaugcccugu

SEQ ID NO: 2575199 - RNA, 18 nt, Human
aguaucaggucucccacg

SEQ ID NO: 2575200 - RNA, 13 nt, Human
aguaucaugaagc

SEQ ID NO: 2575201 - RNA, 15 nt, Human
aguaucaggucuccc

SEQ ID NO: 2575202 - RNA, 15 nt, Human
aguaucaggccugcc

SEQ ID NO: 2575203 - RNA, 19 nt, Human
aguaucaauccuuguucag

SEQ ID NO: 2575204 - RNA, 13 nt, Human
aguaucacugucu

SEQ ID NO: 2575205 - RNA, 17 nt, Human
aguaucacugucuuucc

SEQ ID NO: 2575206 - RNA, 22 nt, Human
aguaucacugucuuuccuagau

SEQ ID NO: 2575207 - RNA, 23 nt, Human
aguaucaaauauuagaugugauu

SEQ ID NO: 2575208 - RNA, 22 nt, Human
aguaucaaauauuagaugugau

SEQ ID NO: 2575209 - RNA, 21 nt, Human
aguaucaaauauuagauguga

SEQ ID NO: 2575210 - RNA, 19 nt, Human
aguaucaaauauuagaugu

SEQ ID NO: 2575211 - RNA, 15 nt, Human
aguaucaaauauuag

SEQ ID NO: 2575212 - RNA, 18 nt, Human
aguauauuuucuuuuccu

SEQ ID NO: 2575213 - RNA, 19 nt, Human
aguauauuuucuuuuccuc

SEQ ID NO: 2575214 - RNA, 21 nt, Human
agucgaauuaauagcuuuuau

SEQ ID NO: 2575215 - RNA, 18 nt, Human
agucgaauuaauagcuuu

SEQ ID NO: 2575216 - RNA, 21 nt, Human
aguccuuuuuuuccaucuuua

SEQ ID NO: 2575217 - RNA, 16 nt, Human
aguccuuuuuuuccau

SEQ ID NO: 2575218 - RNA, 17 nt, Human
aguccuuuauguggaaa

SEQ ID NO: 2575219 - RNA, 16 nt, Human
agucgaggacagggag

SEQ ID NO: 2575220 - RNA, 18 nt, Human
aguccuugcuuggcugcu

SEQ ID NO: 2575221 - RNA, 13 nt, Human
aguccuugcuugg

SEQ ID NO: 2575222 - RNA, 14 nt, Human
aguccuuuaugugg

SEQ ID NO: 2575223 - RNA, 18 nt, Human
aguccuuaaacagggcau

SEQ ID NO: 2575224 - RNA, 17 nt, Human
aguccuuaaacagggca

SEQ ID NO: 2575225 - RNA, 16 nt, Human
aguccugugaauuucu

SEQ ID NO: 2575226 - RNA, 12 nt, Human
aguccuugcuug

SEQ ID NO: 2575227 - RNA, 18 nt, Human
aguccuugcaagaaucag

SEQ ID NO: 2575228 - RNA, 15 nt, Human
aguccuugcaagaau

SEQ ID NO: 2575229 - RNA, 23 nt, Human
agucugcaacuuuaagcagcucu

SEQ ID NO: 2575230 - RNA, 22 nt, Human
agucugcaaaaugaggaaugua

SEQ ID NO: 2575231 - RNA, 13 nt, Human
agucugcaaaaug

SEQ ID NO: 2575232 - RNA, 18 nt, Human
agucuggaaugcaguggu

SEQ ID NO: 2575233 - RNA, 19 nt, Human
agucgauagagcuguauua

SEQ ID NO: 2575234 - RNA, 20 nt, Human
agucugauucccaagcucug

SEQ ID NO: 2575235 - RNA, 22 nt, Human
agucugauucccaagcucugcu

SEQ ID NO: 2575236 - RNA, 21 nt, Human
agucugauucccaagcucugc

SEQ ID NO: 2575237 - RNA, 18 nt, Human
agucuggcccuuccuuuu

SEQ ID NO: 2575238 - RNA, 15 nt, Human
agucuggccaacauc

SEQ ID NO: 2575239 - RNA, 17 nt, Human
agucuggaucugggacc

SEQ ID NO: 2575240 - RNA, 13 nt, Human
agucuggaggggc

SEQ ID NO: 2575241 - RNA, 15 nt, Human
agucuggaucuggga

SEQ ID NO: 2575242 - RNA, 23 nt, Human
agucugcacaugcagcugcaccc

SEQ ID NO: 2575243 - RNA, 15 nt, Human
agucugcaagauucu

SEQ ID NO: 2575244 - RNA, 22 nt, Human
agucuggaggggcauggccagc

SEQ ID NO: 2575245 - RNA, 13 nt, Human
agugaauaaaugu

SEQ ID NO: 2575246 - RNA, 18 nt, Human
agucugugagauucauuc

SEQ ID NO: 2575247 - RNA, 18 nt, Human
agucugucucugucaugg

SEQ ID NO: 2575248 - RNA, 15 nt, Human
agucugucucuguca

SEQ ID NO: 2575249 - RNA, 14 nt, Human
agucugucucuguc

SEQ ID NO: 2575250 - RNA, 17 nt, Human
agucugucucaaaagaa

SEQ ID NO: 2575251 - RNA, 16 nt, Human
agucugggcugccggg

SEQ ID NO: 2575252 - RNA, 14 nt, Human
agucugggcugccg

SEQ ID NO: 2575253 - RNA, 17 nt, Human
agucuggcugagcccug

SEQ ID NO: 2575254 - RNA, 15 nt, Human
agucuggugaagcuc

SEQ ID NO: 2575255 - RNA, 17 nt, Human
agucuggugggaggacg

SEQ ID NO: 2575256 - RNA, 20 nt, Human
agucugguuucuagacuugu

SEQ ID NO: 2575257 - RNA, 13 nt, Human
agucugucaugaa

SEQ ID NO: 2575258 - RNA, 15 nt, Human
agucugguuucuaga

SEQ ID NO: 2575259 - RNA, 23 nt, Human
agucugucaugaacauguuccug

SEQ ID NO: 2575260 - RNA, 13 nt, Human
agucauuuaauaa

SEQ ID NO: 2575261 - RNA, 18 nt, Human
aguccuuaccagcagagc

SEQ ID NO: 2575262 - RNA, 16 nt, Human
aguccuuaccagcaga

SEQ ID NO: 2575263 - RNA, 23 nt, Human
aguccugugaauuucuucacugu

SEQ ID NO: 2575264 - RNA, 14 nt, Human
aguccugugaauuu

SEQ ID NO: 2575265 - RNA, 13 nt, Human
aguccugugaauu

SEQ ID NO: 2575266 - RNA, 21 nt, Human
aguccugugaaugccacugcc

SEQ ID NO: 2575267 - RNA, 20 nt, Human
aguccucuggguaggaauca

SEQ ID NO: 2575268 - RNA, 22 nt, Human
aguccugugaaugccacugccu

SEQ ID NO: 2575269 - RNA, 14 nt, Human
aguccucuuuucug

SEQ ID NO: 2575270 - RNA, 22 nt, Human
aguccuccccucacagccucug

SEQ ID NO: 2575271 - RNA, 21 nt, Human
aguccuccccucacagccucu

SEQ ID NO: 2575272 - RNA, 20 nt, Human
aguccuccccucacagccuc

SEQ ID NO: 2575273 - RNA, 22 nt, Human
agucauuugcugagcauguacu

SEQ ID NO: 2575274 - RNA, 19 nt, Human
agucauuugcugagcaugu

SEQ ID NO: 2575275 - RNA, 21 nt, Human
agucauuuuaacuuuaucaca

SEQ ID NO: 2575276 - RNA, 19 nt, Human
agucauuuuaacuuuauca

SEQ ID NO: 2575277 - RNA, 15 nt, Human
aguccucguagccau

SEQ ID NO: 2575278 - RNA, 17 nt, Human
aguccucguagccaucu

SEQ ID NO: 2575279 - RNA, 13 nt, Human
aguccucuccacc

SEQ ID NO: 2575280 - RNA, 23 nt, Human
aguccuccccucacagccucuga

SEQ ID NO: 2575281 - RNA, 21 nt, Human
aguccucguagccaucucucu

SEQ ID NO: 2575282 - RNA, 19 nt, Human
aguccucuccaccuagugg

SEQ ID NO: 2575283 - RNA, 14 nt, Human
aguccucuccaccu

SEQ ID NO: 2575284 - RNA, 12 nt, Human
aguccucugaau

SEQ ID NO: 2575285 - RNA, 22 nt, Human
aguccucuggauggcaccagag

SEQ ID NO: 2575286 - RNA, 21 nt, Human
aguccucuccaccuaguggcu

SEQ ID NO: 2575287 - RNA, 14 nt, Human
aguccucugaauga

SEQ ID NO: 2575288 - RNA, 22 nt, Human
aggggccagaggaacuguccag

SEQ ID NO: 2575289 - RNA, 17 nt, Human
aggggccagaggcucgu

SEQ ID NO: 2575290 - RNA, 12 nt, Human
aggggccagagg

SEQ ID NO: 2575291 - RNA, 13 nt, Human
aggggccagaggc

SEQ ID NO: 2575292 - RNA, 14 nt, Human
aggggccagaggcu

SEQ ID NO: 2575293 - RNA, 15 nt, Human
aggggccagaggcuc

SEQ ID NO: 2575294 - RNA, 23 nt, Human
aggggcauguauuggccuggagg

SEQ ID NO: 2575295 - RNA, 22 nt, Human
aggggcauguauuggccuggag

SEQ ID NO: 2575296 - RNA, 21 nt, Human
aggggcauguauuggccugga

SEQ ID NO: 2575297 - RNA, 20 nt, Human
aggggcauguauuggccugg

SEQ ID NO: 2575298 - RNA, 16 nt, Human
aguaaaauugccauau

SEQ ID NO: 2575299 - RNA, 14 nt, Human
aguaaaauugccau

SEQ ID NO: 2575300 - RNA, 21 nt, Human
aguaaaauugccauauugcac

SEQ ID NO: 2575301 - RNA, 20 nt, Human
aguaaaauugccauauugca

SEQ ID NO: 2575302 - RNA, 19 nt, Human
aguaaaauugccauauugc

SEQ ID NO: 2575303 - RNA, 17 nt, Human
aguaaaauugccauauu

SEQ ID NO: 2575304 - RNA, 23 nt, Human
aguaaaauugccauauugcacau

SEQ ID NO: 2575305 - RNA, 22 nt, Human
aguaaaauugccauauugcaca

SEQ ID NO: 2575306 - RNA, 13 nt, Human
aguaaagaaauga

SEQ ID NO: 2575307 - RNA, 15 nt, Human
aguaaagaaaugaca

SEQ ID NO: 2575308 - RNA, 12 nt, Human
aguaaagaaauu

SEQ ID NO: 2575309 - RNA, 14 nt, Human
aguaaacuauuuau

SEQ ID NO: 2575310 - RNA, 16 nt, Human
aguaaacuauuuaucu

SEQ ID NO: 2575311 - RNA, 19 nt, Human
aguauauaaugguuucaaa

SEQ ID NO: 2575312 - RNA, 17 nt, Human
aguacugcucuuguuuc

SEQ ID NO: 2575313 - RNA, 21 nt, Human
aguacuucuccacccugcucu

SEQ ID NO: 2575314 - RNA, 19 nt, Human
aguacuucuccacccugcu

SEQ ID NO: 2575315 - RNA, 20 nt, Human
aguacuucuccacccugcuc

SEQ ID NO: 2575316 - RNA, 17 nt, Human
aguauauuauguauuua

SEQ ID NO: 2575317 - RNA, 15 nt, Human
aguauauuauguauu

SEQ ID NO: 2575318 - RNA, 14 nt, Human
aguauauuauguau

SEQ ID NO: 2575319 - RNA, 14 nt, Human
aguauauuuauagu

SEQ ID NO: 2575320 - RNA, 18 nt, Human
aguauauuuauagucaca

SEQ ID NO: 2575321 - RNA, 13 nt, Human
aguauauuuucuu

SEQ ID NO: 2575322 - RNA, 22 nt, Human
aguauauugauccagaaagaaa

SEQ ID NO: 2575323 - RNA, 18 nt, Human
aguauaucuggacaagcc

SEQ ID NO: 2575324 - RNA, 16 nt, Human
aguauaucuggacaag

SEQ ID NO: 2575325 - RNA, 15 nt, Human
aguauaucuggacaa

SEQ ID NO: 2575326 - RNA, 13 nt, Human
aguauaucuggac

SEQ ID NO: 2575327 - RNA, 22 nt, Human
aguauaucuggacaagccaacu

SEQ ID NO: 2575328 - RNA, 14 nt, Human
aguaccuggaggag

SEQ ID NO: 2575329 - RNA, 13 nt, Human
aguaccuggagga

SEQ ID NO: 2575330 - RNA, 12 nt, Human
aguaccuggagg

SEQ ID NO: 2575331 - RNA, 15 nt, Human
aguaccuggaggagg

SEQ ID NO: 2575332 - RNA, 13 nt, Human
aguacucauacau

SEQ ID NO: 2575333 - RNA, 13 nt, Human
aguaccuuuguca

SEQ ID NO: 2575334 - RNA, 14 nt, Human
aguaccuuugucac

SEQ ID NO: 2575335 - RNA, 15 nt, Human
aguaccuuugucaca

SEQ ID NO: 2575336 - RNA, 15 nt, Human
aguacuggagaaaau

SEQ ID NO: 2575337 - RNA, 15 nt, Human
aguacuggcauggua

SEQ ID NO: 2575338 - RNA, 20 nt, Human
aguacuccugcaaaauuuua

SEQ ID NO: 2575339 - RNA, 21 nt, Human
aguacuccugcaaaauuuuau

SEQ ID NO: 2575340 - RNA, 15 nt, Human
aguacguuauuguug

SEQ ID NO: 2575341 - RNA, 13 nt, Human
aguacguuauugu

SEQ ID NO: 2575342 - RNA, 18 nt, Human
aguacgugcuaacaggcu

SEQ ID NO: 2575343 - RNA, 16 nt, Human
aguacuccugcaaaau

SEQ ID NO: 2575344 - RNA, 18 nt, Human
aguacuccugcaaaauuu

SEQ ID NO: 2575345 - RNA, 19 nt, Human
aguacuccugcaaaauuuu

SEQ ID NO: 2575346 - RNA, 18 nt, Human
aguaacgcgucuuccuga

SEQ ID NO: 2575347 - RNA, 17 nt, Human
aguaacgcgucuuccug

SEQ ID NO: 2575348 - RNA, 21 nt, Human
aguaaccuuuugcaccugcuc

SEQ ID NO: 2575349 - RNA, 12 nt, Human
aguaaccugggu

SEQ ID NO: 2575350 - RNA, 16 nt, Human
aguaacgcgucuuccu

SEQ ID NO: 2575351 - RNA, 22 nt, Human
aguaacgcgucuuccugagugg

SEQ ID NO: 2575352 - RNA, 19 nt, Human
aguaacgcgucuuccugag

SEQ ID NO: 2575353 - RNA, 14 nt, Human
aguaacuuaaguua

SEQ ID NO: 2575354 - RNA, 23 nt, Human
aguaaccuuuugcaccugcucuc

SEQ ID NO: 2575355 - RNA, 19 nt, Human
aguaacugccaucaagaug

SEQ ID NO: 2575356 - RNA, 14 nt, Human
aguaacucaucugu

SEQ ID NO: 2575357 - RNA, 14 nt, Human
aguaacugacaacu

SEQ ID NO: 2575358 - RNA, 13 nt, Human
aguaagaaaagug

SEQ ID NO: 2575359 - RNA, 19 nt, Human
aguaacuuuauguguaaau

SEQ ID NO: 2575360 - RNA, 20 nt, Human
aguaacuuuauguguaaaua

SEQ ID NO: 2575361 - RNA, 14 nt, Human
aguaccugaaaagu

SEQ ID NO: 2575362 - RNA, 17 nt, Human
aguaccugaaaaaaugc

SEQ ID NO: 2575363 - RNA, 15 nt, Human
aguaccugaaaagua

SEQ ID NO: 2575364 - RNA, 17 nt, Human
aguaacuuuauguguaa

SEQ ID NO: 2575365 - RNA, 16 nt, Human
aguaacuuuaugugua

SEQ ID NO: 2575366 - RNA, 14 nt, Human
aguaacuuuaugug

SEQ ID NO: 2575367 - RNA, 18 nt, Human
aguaacuuggcuuucauu

SEQ ID NO: 2575368 - RNA, 15 nt, Human
aguaacuuggcuuuc

SEQ ID NO: 2575369 - RNA, 14 nt, Human
aguaacuuggcuuu

SEQ ID NO: 2575370 - RNA, 17 nt, Human
aguaacuucuuauggaa

SEQ ID NO: 2575371 - RNA, 19 nt, Human
aguaacuucuuauggaauu

SEQ ID NO: 2575372 - RNA, 17 nt, Human
aguaacuuacuuaggug

SEQ ID NO: 2575373 - RNA, 14 nt, Human
aguaaagcuaaaau

SEQ ID NO: 2575374 - RNA, 18 nt, Human
aguaaagccguuguuuac

SEQ ID NO: 2575375 - RNA, 17 nt, Human
aguaaagccguuguuua

SEQ ID NO: 2575376 - RNA, 19 nt, Human
aguaaaggaguaagaaccu

SEQ ID NO: 2575377 - RNA, 17 nt, Human
aguaaagcuaaaaugau

SEQ ID NO: 2575378 - RNA, 13 nt, Human
aguaaagaaauuu

SEQ ID NO: 2575379 - RNA, 20 nt, Human
aguaaagaaauuuaaaagac

SEQ ID NO: 2575380 - RNA, 18 nt, Human
aguaaagugauaauuucu

SEQ ID NO: 2575381 - RNA, 19 nt, Human
aguaaagugauaauuucug

SEQ ID NO: 2575382 - RNA, 15 nt, Human
aguaaauaaauuguu

SEQ ID NO: 2575383 - RNA, 14 nt, Human
aguaaauaaauugu

SEQ ID NO: 2575384 - RNA, 18 nt, Human
aguaaauaaauuguuuga

SEQ ID NO: 2575385 - RNA, 16 nt, Human
aguaaauaaauuguuu

SEQ ID NO: 2575386 - RNA, 19 nt, Human
aguaaauaaauuguuugac

SEQ ID NO: 2575387 - RNA, 18 nt, Human
aguaaaugggggugcauu

SEQ ID NO: 2575388 - RNA, 19 nt, Human
aguaaaugggggugcauuu

SEQ ID NO: 2575389 - RNA, 20 nt, Human
aguaaaugggggugcauuug

SEQ ID NO: 2575390 - RNA, 21 nt, Human
aguaaaugggggugcauuuga

SEQ ID NO: 2575391 - RNA, 20 nt, Human
aguuguucaauaauaaauau

SEQ ID NO: 2575392 - RNA, 22 nt, Human
aguuguuagugugucuuagugu

SEQ ID NO: 2575393 - RNA, 17 nt, Human
aguuguuagugugucuu

SEQ ID NO: 2575394 - RNA, 19 nt, Human
aguugaaugacaacagaag

SEQ ID NO: 2575395 - RNA, 16 nt, Human
aguugaagcuaagauu

SEQ ID NO: 2575396 - RNA, 20 nt, Human
aguuaauuacauccucaugc

SEQ ID NO: 2575397 - RNA, 21 nt, Human
aguuaacgggugaauaauaaa

SEQ ID NO: 2575398 - RNA, 17 nt, Human
aguuaacgggugaauaa

SEQ ID NO: 2575399 - RNA, 13 nt, Human
aguuaacggguga

SEQ ID NO: 2575400 - RNA, 20 nt, Human
aguuaacaccuuuaaagugu

SEQ ID NO: 2575401 - RNA, 12 nt, Human
aguuaacagaga

SEQ ID NO: 2575402 - RNA, 17 nt, Human
aguuaacaaugauauau

SEQ ID NO: 2575403 - RNA, 16 nt, Human
aguuaacaaugauaua

SEQ ID NO: 2575404 - RNA, 13 nt, Human
aguuaacaaugau

SEQ ID NO: 2575405 - RNA, 14 nt, Human
aguuaaauuucugg

SEQ ID NO: 2575406 - RNA, 21 nt, Human
aguuaaauagaguauaugcac

SEQ ID NO: 2575407 - RNA, 15 nt, Human
aguguuuucugggau

SEQ ID NO: 2575408 - RNA, 23 nt, Human
aguuaaauagaguauaugcacuu

SEQ ID NO: 2575409 - RNA, 20 nt, Human
aguguuuuaagauaaauuau

SEQ ID NO: 2575410 - RNA, 18 nt, Human
aguguuuuggaauaaaau

SEQ ID NO: 2575411 - RNA, 13 nt, Human
aguguuuucuggg

SEQ ID NO: 2575412 - RNA, 17 nt, Human
agugcucauuucaggau

SEQ ID NO: 2575413 - RNA, 11 nt, Human
agugcucccuc

SEQ ID NO: 2575414 - RNA, 14 nt, Human
agugcucccucaca

SEQ ID NO: 2575415 - RNA, 17 nt, Human
agugcucccucacaugu

SEQ ID NO: 2575416 - RNA, 15 nt, Human
aguggcauggcucca

SEQ ID NO: 2575417 - RNA, 18 nt, Human
aguggcauggcuccaguc

SEQ ID NO: 2575418 - RNA, 20 nt, Human
aguggcauuggcagcaggug

SEQ ID NO: 2575419 - RNA, 18 nt, Human
aguggcauuggcagcagg

SEQ ID NO: 2575420 - RNA, 16 nt, Human
aguggcauuggcagca

SEQ ID NO: 2575421 - RNA, 15 nt, Human
aguguuucuguuauu

SEQ ID NO: 2575422 - RNA, 16 nt, Human
aguggcccccacagaa

SEQ ID NO: 2575423 - RNA, 21 nt, Human
aguguuucuguuauuaacaaa

SEQ ID NO: 2575424 - RNA, 21 nt, Human
aguguuuggguauauucauuu

SEQ ID NO: 2575425 - RNA, 14 nt, Human
aguggccacucagc

SEQ ID NO: 2575426 - RNA, 14 nt, Human
aguggccacuaagc

SEQ ID NO: 2575427 - RNA, 19 nt, Human
aguggccacuaagcagagg

SEQ ID NO: 2575428 - RNA, 20 nt, Human
aguggccacuaagcagagga

SEQ ID NO: 2575429 - RNA, 22 nt, Human
aguggccacuaagcagaggagg

SEQ ID NO: 2575430 - RNA, 21 nt, Human
aguuccacugagcuccaugug

SEQ ID NO: 2575431 - RNA, 15 nt, Human
aguuccacugagcuc

SEQ ID NO: 2575432 - RNA, 14 nt, Human
aguuccacugagcu

SEQ ID NO: 2575433 - RNA, 19 nt, Human
aguucuuugggccagacau

SEQ ID NO: 2575434 - RNA, 22 nt, Human
aguuccaugaagaccacaucca

SEQ ID NO: 2575435 - RNA, 19 nt, Human
aguucuuuguucauagccc

SEQ ID NO: 2575436 - RNA, 21 nt, Human
aguucuuugggccagacaugc

SEQ ID NO: 2575437 - RNA, 17 nt, Human
aguugaaaaacagcuga

SEQ ID NO: 2575438 - RNA, 17 nt, Human
aguugaagacagagcua

SEQ ID NO: 2575439 - RNA, 16 nt, Human
aguugaagacagagcu

SEQ ID NO: 2575440 - RNA, 22 nt, Human
aguucuuuguucauagcccagu

SEQ ID NO: 2575441 - RNA, 21 nt, Human
aguucuuuguucauagcccag

SEQ ID NO: 2575442 - RNA, 14 nt, Human
aguugaaaagacuc

SEQ ID NO: 2575443 - RNA, 18 nt, Human
aguugaaaaacagcugag

SEQ ID NO: 2575444 - RNA, 21 nt, Human
aguuccaccaucaagccacca

SEQ ID NO: 2575445 - RNA, 18 nt, Human
aguuccaccaucaagcca

SEQ ID NO: 2575446 - RNA, 17 nt, Human
aguucauccauucuauu

SEQ ID NO: 2575447 - RNA, 16 nt, Human
aguucauccaauccuc

SEQ ID NO: 2575448 - RNA, 18 nt, Human
aguucauccaauccucac

SEQ ID NO: 2575449 - RNA, 20 nt, Human
aguucauccaauccucacug

SEQ ID NO: 2575450 - RNA, 22 nt, Human
aguucauccaauccucacuggg

SEQ ID NO: 2575451 - RNA, 22 nt, Human
aguucauauguaccauguacau

SEQ ID NO: 2575452 - RNA, 18 nt, Human
aguucauauguaccaugu

SEQ ID NO: 2575453 - RNA, 20 nt, Human
aguucauauuccauauuuau

SEQ ID NO: 2575454 - RNA, 19 nt, Human
aguucauauuccauauuua

SEQ ID NO: 2575455 - RNA, 20 nt, Human
aguucauagggucucuucag

SEQ ID NO: 2575456 - RNA, 21 nt, Human
aguuacaacuuccuaauuuua

SEQ ID NO: 2575457 - RNA, 14 nt, Human
aguucauacccugu

SEQ ID NO: 2575458 - RNA, 19 nt, Human
aguuacacauuuuucagau

SEQ ID NO: 2575459 - RNA, 16 nt, Human
aguuacacauuuuuca

SEQ ID NO: 2575460 - RNA, 20 nt, Human
aguuacaaauugcuugaaag

SEQ ID NO: 2575461 - RNA, 13 nt, Human
aguuacacauuuu

SEQ ID NO: 2575462 - RNA, 17 nt, Human
aguuucugggaccucag

SEQ ID NO: 2575463 - RNA, 17 nt, Human
aguuucuguccugcugg

SEQ ID NO: 2575464 - RNA, 16 nt, Human
aguuucuggcccuggc

SEQ ID NO: 2575465 - RNA, 14 nt, Human
aguuucuuagcuuu

SEQ ID NO: 2575466 - RNA, 23 nt, Human
aguuucuguucuguggaaagugu

SEQ ID NO: 2575467 - RNA, 22 nt, Human
aguuucuguucuguggaaagug

SEQ ID NO: 2575468 - RNA, 21 nt, Human
aguuucuguucuguggaaagu

SEQ ID NO: 2575469 - RNA, 19 nt, Human
aguuucuguucuguggaaa

SEQ ID NO: 2575470 - RNA, 18 nt, Human
aguuucuguucuguggaa

SEQ ID NO: 2575471 - RNA, 17 nt, Human
aguuucuguucugugga

SEQ ID NO: 2575472 - RNA, 16 nt, Human
aguuucuguucugugg

SEQ ID NO: 2575473 - RNA, 15 nt, Human
aguuucuguucugug

SEQ ID NO: 2575474 - RNA, 13 nt, Human
aguuucuguucug

SEQ ID NO: 2575475 - RNA, 14 nt, Human
aguuugauuaaauu

SEQ ID NO: 2575476 - RNA, 17 nt, Human
aguuugauauuaaagga

SEQ ID NO: 2575477 - RNA, 16 nt, Human
aguuugagcugccuuc

SEQ ID NO: 2575478 - RNA, 15 nt, Human
aguuucuuagcuuuu

SEQ ID NO: 2575479 - RNA, 23 nt, Human
aguuugagcugccuucccuagcu

SEQ ID NO: 2575480 - RNA, 14 nt, Human
aguuugaggcugca

SEQ ID NO: 2575481 - RNA, 17 nt, Human
aguuugaggcugcagcg

SEQ ID NO: 2575482 - RNA, 13 nt, Human
aguuugccagaag

SEQ ID NO: 2575483 - RNA, 12 nt, Human
aguuugcccugg

SEQ ID NO: 2575484 - RNA, 21 nt, Human
aguuugcccugguuucacugg

SEQ ID NO: 2575485 - RNA, 20 nt, Human
aguuugcauuccugauauga

SEQ ID NO: 2575486 - RNA, 15 nt, Human
aguuugcauuccuga

SEQ ID NO: 2575487 - RNA, 22 nt, Human
aguuugcagaaaagcaccugcc

SEQ ID NO: 2575488 - RNA, 23 nt, Human
aguuugcagaaaagcaccugccg

SEQ ID NO: 2575489 - RNA, 11 nt, Human
aguuugcaguu

SEQ ID NO: 2575490 - RNA, 13 nt, Human
aguuugcagaaaa

SEQ ID NO: 2575491 - RNA, 14 nt, Human
aguuugcagaaaag

SEQ ID NO: 2575492 - RNA, 20 nt, Human
aguuugcagaaaagcaccug

SEQ ID NO: 2575493 - RNA, 21 nt, Human
aguuugcagaaaagcaccugc

SEQ ID NO: 2575494 - RNA, 16 nt, Human
auaaaagacagugaaa

SEQ ID NO: 2575495 - RNA, 15 nt, Human
auaaaagacagugaa

SEQ ID NO: 2575496 - RNA, 12 nt, Human
auaaaaauguuu

SEQ ID NO: 2575497 - RNA, 14 nt, Human
auaaaaauucugaa

SEQ ID NO: 2575498 - RNA, 15 nt, Human
auaaaaauucugaau

SEQ ID NO: 2575499 - RNA, 12 nt, Human
auaaaacaggua

SEQ ID NO: 2575500 - RNA, 18 nt, Human
auaaaacaggucaauaca

SEQ ID NO: 2575501 - RNA, 16 nt, Human
auaaaacaggucaaua

SEQ ID NO: 2575502 - RNA, 23 nt, Human
auaaaaauauuguguugugaaug

SEQ ID NO: 2575503 - RNA, 18 nt, Human
auaaaaagaucacuuucu

SEQ ID NO: 2575504 - RNA, 12 nt, Human
auaaaaauggau

SEQ ID NO: 2575505 - RNA, 18 nt, Human
auaaaaaauggugccuga

SEQ ID NO: 2575506 - RNA, 12 nt, Human
auaaaaaauggu

SEQ ID NO: 2575507 - RNA, 12 nt, Human
auaaaaaaugga

SEQ ID NO: 2575508 - RNA, 11 nt, Human
auaaaaaaugg

SEQ ID NO: 2575509 - RNA, 12 nt, Human
auaaaaacaaau

SEQ ID NO: 2575510 - RNA, 14 nt, Human
auaaaaagaucacu

SEQ ID NO: 2575511 - RNA, 20 nt, Human
auaaaaagacauucuuccaa

SEQ ID NO: 2575512 - RNA, 18 nt, Human
auaaaaacuaaauuguaa

SEQ ID NO: 2575513 - RNA, 22 nt, Human
auaaaaagaaaagauaaagaug

SEQ ID NO: 2575514 - RNA, 16 nt, Human
auaaaaacuaaauugu

SEQ ID NO: 2575515 - RNA, 12 nt, Human
auaaaaacuaaa

SEQ ID NO: 2575516 - RNA, 17 nt, Human
auaaaaaccaagaagau

SEQ ID NO: 2575517 - RNA, 21 nt, Human
auaaaaaauaaucuauuucua

SEQ ID NO: 2575518 - RNA, 17 nt, Human
auaaaaaaaagaaaaaa

SEQ ID NO: 2575519 - RNA, 18 nt, Human
auaaaaaaaagaaaaaag

SEQ ID NO: 2575520 - RNA, 23 nt, Human
aguuugcuagcagaaaucuagaa

SEQ ID NO: 2575521 - RNA, 19 nt, Human
auaaaaaaacaaucauuug

SEQ ID NO: 2575522 - RNA, 15 nt, Human
auaaaaaaaauaguu

SEQ ID NO: 2575523 - RNA, 17 nt, Human
auaaaaaaacaaucauu

SEQ ID NO: 2575524 - RNA, 14 nt, Human
auaaaaaaaauagu

SEQ ID NO: 2575525 - RNA, 13 nt, Human
auaaaaaaaagaa

SEQ ID NO: 2575526 - RNA, 14 nt, Human
auaaagaugaucua

SEQ ID NO: 2575527 - RNA, 11 nt, Human
auaaagaugau

SEQ ID NO: 2575528 - RNA, 19 nt, Human
auaaagaugaucuacucag

SEQ ID NO: 2575529 - RNA, 18 nt, Human
auaaagaucgcccccacc

SEQ ID NO: 2575530 - RNA, 13 nt, Human
auaaagaguuaga

SEQ ID NO: 2575531 - RNA, 21 nt, Human
auaaagagagaaaaacaaauu

SEQ ID NO: 2575532 - RNA, 21 nt, Human
auaaagaugagugagcaugcc

SEQ ID NO: 2575533 - RNA, 19 nt, Human
auaaagaucauguaaaagu

SEQ ID NO: 2575534 - RNA, 15 nt, Human
auaaagagagaaaaa

SEQ ID NO: 2575535 - RNA, 14 nt, Human
auaaagaccacuuu

SEQ ID NO: 2575536 - RNA, 14 nt, Human
auaaaacauuaaga

SEQ ID NO: 2575537 - RNA, 17 nt, Human
auaaaacauuaagaaaa

SEQ ID NO: 2575538 - RNA, 10 nt, Human
auaaaagaug

SEQ ID NO: 2575539 - RNA, 11 nt, Human
auaaagacagg

SEQ ID NO: 2575540 - RNA, 20 nt, Human
auaagugcuguauaaaauca

SEQ ID NO: 2575541 - RNA, 19 nt, Human
auaagugcuguauaaaauc

SEQ ID NO: 2575542 - RNA, 18 nt, Human
auaagugcuguauaaaau

SEQ ID NO: 2575543 - RNA, 17 nt, Human
auaagugcuguauaaaa

SEQ ID NO: 2575544 - RNA, 22 nt, Human
auaagugcuguauaaaaucagc

SEQ ID NO: 2575545 - RNA, 18 nt, Human
auaaguggaggcacuuua

SEQ ID NO: 2575546 - RNA, 19 nt, Human
auaaguaagaaaauauuuu

SEQ ID NO: 2575547 - RNA, 19 nt, Human
auaaguggaggcacuuuag

SEQ ID NO: 2575548 - RNA, 20 nt, Human
auaaguggaggcacuuuagg

SEQ ID NO: 2575549 - RNA, 12 nt, Human
auaauguuaaau

SEQ ID NO: 2575550 - RNA, 11 nt, Human
auaauguuaaa

SEQ ID NO: 2575551 - RNA, 10 nt, Human
auaauguuaa

SEQ ID NO: 2575552 - RNA, 12 nt, Human
auaaugugaagu

SEQ ID NO: 2575553 - RNA, 16 nt, Human
auaaugugaaguguua

SEQ ID NO: 2575554 - RNA, 16 nt, Human
auaagugcuguauaaa

SEQ ID NO: 2575555 - RNA, 15 nt, Human
auaagugcuguauaa

SEQ ID NO: 2575556 - RNA, 14 nt, Human
auaagugcuguaua

SEQ ID NO: 2575557 - RNA, 13 nt, Human
auaagugcuguau

SEQ ID NO: 2575558 - RNA, 18 nt, Human
auaaguaagaaaauauuu

SEQ ID NO: 2575559 - RNA, 17 nt, Human
auaaguaagaaaauauu

SEQ ID NO: 2575560 - RNA, 15 nt, Human
auaaguaagaaaaua

SEQ ID NO: 2575561 - RNA, 14 nt, Human
auaaguaagaaaau

SEQ ID NO: 2575562 - RNA, 17 nt, Human
auaaguaauucaagaaa

SEQ ID NO: 2575563 - RNA, 13 nt, Human
auaaguaaguuug

SEQ ID NO: 2575564 - RNA, 13 nt, Human
auaaguacugugu

SEQ ID NO: 2575565 - RNA, 16 nt, Human
auaaguacuguguaca

SEQ ID NO: 2575566 - RNA, 22 nt, Human
auacacauaauuaaagugucca

SEQ ID NO: 2575567 - RNA, 12 nt, Human
auacacauaauu

SEQ ID NO: 2575568 - RNA, 10 nt, Human
auacacauaa

SEQ ID NO: 2575569 - RNA, 14 nt, Human
auacacaggauccu

SEQ ID NO: 2575570 - RNA, 15 nt, Human
auacaccacuacauu

SEQ ID NO: 2575571 - RNA, 23 nt, Human
auacaaugcugugcccuaaagug

SEQ ID NO: 2575572 - RNA, 18 nt, Human
auacaauguauuuauuua

SEQ ID NO: 2575573 - RNA, 21 nt, Human
auacaauguauuuauuuaaaa

SEQ ID NO: 2575574 - RNA, 20 nt, Human
auacaauguauuuauuuaaa

SEQ ID NO: 2575575 - RNA, 15 nt, Human
auacaauucuacauu

SEQ ID NO: 2575576 - RNA, 22 nt, Human
auaauguuaaauuuguaaguuu

SEQ ID NO: 2575577 - RNA, 19 nt, Human
auaauguuaaauuuguaag

SEQ ID NO: 2575578 - RNA, 18 nt, Human
auaauguuaaauuuguaa

SEQ ID NO: 2575579 - RNA, 16 nt, Human
auaauguuaaauuugu

SEQ ID NO: 2575580 - RNA, 23 nt, Human
auaauguuaaauuuguaaguuuc

SEQ ID NO: 2575581 - RNA, 12 nt, Human
auaauguuaaca

SEQ ID NO: 2575582 - RNA, 15 nt, Human
auaagcucagaaucc

SEQ ID NO: 2575583 - RNA, 15 nt, Human
auaaguaaaugcuag

SEQ ID NO: 2575584 - RNA, 13 nt, Human
auaaguaagaaaa

SEQ ID NO: 2575585 - RNA, 12 nt, Human
auaaguaagaaa

SEQ ID NO: 2575586 - RNA, 23 nt, Human
auaagguuucguuucuguauaca

SEQ ID NO: 2575587 - RNA, 20 nt, Human
auaagguuucguuucuguau

SEQ ID NO: 2575588 - RNA, 19 nt, Human
auaagguuucguuucugua

SEQ ID NO: 2575589 - RNA, 17 nt, Human
auaagguuuaaaaagau

SEQ ID NO: 2575590 - RNA, 16 nt, Human
auaagcucagaaucca

SEQ ID NO: 2575591 - RNA, 18 nt, Human
auaagcggcguaaguuua

SEQ ID NO: 2575592 - RNA, 13 nt, Human
auaagcuaaagag

SEQ ID NO: 2575593 - RNA, 16 nt, Human
auaagcuaaagaggcu

SEQ ID NO: 2575594 - RNA, 17 nt, Human
auaagcuaaagaggcug

SEQ ID NO: 2575595 - RNA, 21 nt, Human
auaagcuaacaccagacagac

SEQ ID NO: 2575596 - RNA, 16 nt, Human
auacaccaauugauuu

SEQ ID NO: 2575597 - RNA, 23 nt, Human
auacacauaauuaaaguguccau

SEQ ID NO: 2575598 - RNA, 21 nt, Human
auacaccaccucacuccuguu

SEQ ID NO: 2575599 - RNA, 20 nt, Human
auacaccaccucacuccugu

SEQ ID NO: 2575600 - RNA, 17 nt, Human
auacaccacuacauucu

SEQ ID NO: 2575601 - RNA, 18 nt, Human
auacaccgggccuggaga

SEQ ID NO: 2575602 - RNA, 14 nt, Human
auacaccgggccug

SEQ ID NO: 2575603 - RNA, 17 nt, Human
auacaccagcauuccuu

SEQ ID NO: 2575604 - RNA, 18 nt, Human
auacaccagcauuccuuu

SEQ ID NO: 2575605 - RNA, 19 nt, Human
auacaccagagauaauaug

SEQ ID NO: 2575606 - RNA, 22 nt, Human
auacacuauuugugagcaaagg

SEQ ID NO: 2575607 - RNA, 21 nt, Human
auacacuaugaagauguuuca

SEQ ID NO: 2575608 - RNA, 17 nt, Human
auacacgagguaugagg

SEQ ID NO: 2575609 - RNA, 19 nt, Human
auacacuaauuccuuucua

SEQ ID NO: 2575610 - RNA, 21 nt, Human
auacacugaaguuaacagaga

SEQ ID NO: 2575611 - RNA, 18 nt, Human
auacuugaagggccagag

SEQ ID NO: 2575612 - RNA, 19 nt, Human
auacuugaagggccagagc

SEQ ID NO: 2575613 - RNA, 20 nt, Human
auacuugaagggccagagcc

SEQ ID NO: 2575614 - RNA, 21 nt, Human
auacuugaagggccagagcca

SEQ ID NO: 2575615 - RNA, 16 nt, Human
auacuugaagggccag

SEQ ID NO: 2575616 - RNA, 17 nt, Human
auacuugaagggccaga

SEQ ID NO: 2575617 - RNA, 16 nt, Human
auacuuuugcccuuug

SEQ ID NO: 2575618 - RNA, 19 nt, Human
auacuuuuuaaauguaaag

SEQ ID NO: 2575619 - RNA, 13 nt, Human
auacuuuuuacaa

SEQ ID NO: 2575620 - RNA, 20 nt, Human
auacuuuuuacaauuaaaaa

SEQ ID NO: 2575621 - RNA, 19 nt, Human
auacuuuuuucuuauuuaa

SEQ ID NO: 2575622 - RNA, 19 nt, Human
auagcaaauguuuugacau

SEQ ID NO: 2575623 - RNA, 22 nt, Human
auagcaaagcgacguuagucgu

SEQ ID NO: 2575624 - RNA, 16 nt, Human
auagcaacacucuaua

SEQ ID NO: 2575625 - RNA, 15 nt, Human
auacuuuuuuucaca

SEQ ID NO: 2575626 - RNA, 14 nt, Human
auacuuuuuuucac

SEQ ID NO: 2575627 - RNA, 21 nt, Human
auacuuuuuuuucuuuaaaaa

SEQ ID NO: 2575628 - RNA, 16 nt, Human
auagaaaaacccugcc

SEQ ID NO: 2575629 - RNA, 17 nt, Human
auagaaaacugaaaauc

SEQ ID NO: 2575630 - RNA, 17 nt, Human
auacugugcuggagcca

SEQ ID NO: 2575631 - RNA, 20 nt, Human
auacugugcuggagccacua

SEQ ID NO: 2575632 - RNA, 16 nt, Human
auacugugcuggagcc

SEQ ID NO: 2575633 - RNA, 21 nt, Human
auacugucgguuuuuuuuaaa

SEQ ID NO: 2575634 - RNA, 19 nt, Human
auacuugaaaauuaacaug

SEQ ID NO: 2575635 - RNA, 20 nt, Human
auacuguuugagguuuuuaa

SEQ ID NO: 2575636 - RNA, 21 nt, Human
auacuuaaauggaaaaaauga

SEQ ID NO: 2575637 - RNA, 12 nt, Human
auacuguuugag

SEQ ID NO: 2575638 - RNA, 16 nt, Human
auacuguuugagguuu

SEQ ID NO: 2575639 - RNA, 15 nt, Human
auacuguugugcgca

SEQ ID NO: 2575640 - RNA, 19 nt, Human
auacuguauuuuguauugu

SEQ ID NO: 2575641 - RNA, 17 nt, Human
auacugucucuuucaug

SEQ ID NO: 2575642 - RNA, 17 nt, Human
augaggcuugcugagag

SEQ ID NO: 2575643 - RNA, 15 nt, Human
augaggcuugcugag

SEQ ID NO: 2575644 - RNA, 18 nt, Human
augaggcuugcugagagg

SEQ ID NO: 2575645 - RNA, 23 nt, Human
aucuaggaagacuuuggaaagag

SEQ ID NO: 2575646 - RNA, 11 nt, Human
aucuaggauuu

SEQ ID NO: 2575647 - RNA, 19 nt, Human
aucuaggauuuuaagggaa

SEQ ID NO: 2575648 - RNA, 21 nt, Human
augaauacuguauuuuguauu

SEQ ID NO: 2575649 - RNA, 20 nt, Human
augaauacaaacaauggaaa

SEQ ID NO: 2575650 - RNA, 22 nt, Human
augaauaauuucccaauuagga

SEQ ID NO: 2575651 - RNA, 21 nt, Human
augaauacagggcaugcauuu

SEQ ID NO: 2575652 - RNA, 17 nt, Human
augaauaaagacaccua

SEQ ID NO: 2575653 - RNA, 23 nt, Human
augaaguuuuuuuuauacaggau

SEQ ID NO: 2575654 - RNA, 15 nt, Human
augaagcuuguguau

SEQ ID NO: 2575655 - RNA, 23 nt, Human
augaagcucaccuguugcuuaca

SEQ ID NO: 2575656 - RNA, 15 nt, Human
augaauaauuuccca

SEQ ID NO: 2575657 - RNA, 14 nt, Human
augaaguaauaugc

SEQ ID NO: 2575658 - RNA, 21 nt, Human
augaaguaauaugcacacauu

SEQ ID NO: 2575659 - RNA, 23 nt, Human
augaaguaauaugcacacauuuu

SEQ ID NO: 2575660 - RNA, 13 nt, Human
augaaguacucau

SEQ ID NO: 2575661 - RNA, 13 nt, Human
augaagcuugugu

SEQ ID NO: 2575662 - RNA, 15 nt, Human
augaagcuaccucaa

SEQ ID NO: 2575663 - RNA, 14 nt, Human
augaaagaaaggcc

SEQ ID NO: 2575664 - RNA, 23 nt, Human
augaagcauuuacuuuguguuca

SEQ ID NO: 2575665 - RNA, 16 nt, Human
augaagccuuagccag

SEQ ID NO: 2575666 - RNA, 14 nt, Human
augaagcuaccuca

SEQ ID NO: 2575667 - RNA, 12 nt, Human
augaagcccaag

SEQ ID NO: 2575668 - RNA, 15 nt, Human
augaagcccaaguga

SEQ ID NO: 2575669 - RNA, 17 nt, Human
augaagcccaagugaaa

SEQ ID NO: 2575670 - RNA, 16 nt, Human
augaagcccaauaaac

SEQ ID NO: 2575671 - RNA, 23 nt, Human
augaaaccuuauuuuuucccaaa

SEQ ID NO: 2575672 - RNA, 13 nt, Human
augaaacuuggau

SEQ ID NO: 2575673 - RNA, 22 nt, Human
augaaaccuuauuuuuucccaa

SEQ ID NO: 2575674 - RNA, 12 nt, Human
augaaagacugu

SEQ ID NO: 2575675 - RNA, 23 nt, Human
augaggccacugcugcuucucca

SEQ ID NO: 2575676 - RNA, 13 nt, Human
augaccuuacauu

SEQ ID NO: 2575677 - RNA, 13 nt, Human
augaggcuugcug

SEQ ID NO: 2575678 - RNA, 23 nt, Human
augaggccucuuggaccucugcu

SEQ ID NO: 2575679 - RNA, 22 nt, Human
augaggccucuuggaccucugc

SEQ ID NO: 2575680 - RNA, 21 nt, Human
augaggccucuuggaccucug

SEQ ID NO: 2575681 - RNA, 22 nt, Human
augaggcugcuuuccaaagcca

SEQ ID NO: 2575682 - RNA, 15 nt, Human
augaggccgcuagag

SEQ ID NO: 2575683 - RNA, 21 nt, Human
augaggccgcuagaggccuga

SEQ ID NO: 2575684 - RNA, 15 nt, Human
augaggccucuugga

SEQ ID NO: 2575685 - RNA, 18 nt, Human
augaggccucaguggacu

SEQ ID NO: 2575686 - RNA, 20 nt, Human
augagcuuuauguaauaaug

SEQ ID NO: 2575687 - RNA, 22 nt, Human
augagcuuuauguaauaaugug

SEQ ID NO: 2575688 - RNA, 18 nt, Human
augagcuuuauguaauaa

SEQ ID NO: 2575689 - RNA, 13 nt, Human
augagcuggaagg

SEQ ID NO: 2575690 - RNA, 12 nt, Human
augagcugaggg

SEQ ID NO: 2575691 - RNA, 13 nt, Human
augagcugagggg

SEQ ID NO: 2575692 - RNA, 16 nt, Human
augagcucuucauguu

SEQ ID NO: 2575693 - RNA, 21 nt, Human
augagcuggaaggagugagag

SEQ ID NO: 2575694 - RNA, 19 nt, Human
augagccucagcauccugg

SEQ ID NO: 2575695 - RNA, 21 nt, Human
augagccucagcauccuggca

SEQ ID NO: 2575696 - RNA, 11 nt, Human
augagccuggc

SEQ ID NO: 2575697 - RNA, 12 nt, Human
augagccuggca

SEQ ID NO: 2575698 - RNA, 18 nt, Human
augaccuuucaauaggaa

SEQ ID NO: 2575699 - RNA, 14 nt, Human
augaccuuacauuu

SEQ ID NO: 2575700 - RNA, 15 nt, Human
augaccuuucaauag

SEQ ID NO: 2575701 - RNA, 13 nt, Human
augaccuuucaau

SEQ ID NO: 2575702 - RNA, 16 nt, Human
augaccuuacauuucc

SEQ ID NO: 2575703 - RNA, 18 nt, Human
augaccuucuaggaagcu

SEQ ID NO: 2575704 - RNA, 17 nt, Human
augaccuucuaggaagc

SEQ ID NO: 2575705 - RNA, 13 nt, Human
augcauacacaca

SEQ ID NO: 2575706 - RNA, 14 nt, Human
augcauacacacac

SEQ ID NO: 2575707 - RNA, 15 nt, Human
augcauacacacaca

SEQ ID NO: 2575708 - RNA, 17 nt, Human
augcauacacacacaca

SEQ ID NO: 2575709 - RNA, 11 nt, Human
augcauacaca

SEQ ID NO: 2575710 - RNA, 12 nt, Human
augcauacacac

SEQ ID NO: 2575711 - RNA, 10 nt, Human
augcauacac

SEQ ID NO: 2575712 - RNA, 14 nt, Human
augcauaaaugcau

SEQ ID NO: 2575713 - RNA, 13 nt, Human
augcauauuguau

SEQ ID NO: 2575714 - RNA, 21 nt, Human
augcauacuucaaaaguauuu

SEQ ID NO: 2575715 - RNA, 22 nt, Human
augcauacuucaaaaguauuuu

SEQ ID NO: 2575716 - RNA, 16 nt, Human
augcauauuguauuac

SEQ ID NO: 2575717 - RNA, 15 nt, Human
augcauauuguauua

SEQ ID NO: 2575718 - RNA, 24 nt, Human
augcauauuauuuuauguugcaua

SEQ ID NO: 2575719 - RNA, 20 nt, Human
augcauacuucaaaaguauu

SEQ ID NO: 2575720 - RNA, 18 nt, Human
augcauacuucaaaagua

SEQ ID NO: 2575721 - RNA, 17 nt, Human
augcauacuucaaaagu

SEQ ID NO: 2575722 - RNA, 16 nt, Human
augcauacuucaaaag

SEQ ID NO: 2575723 - RNA, 20 nt, Human
augcauauuauuuuauguug

SEQ ID NO: 2575724 - RNA, 22 nt, Human
augcauacacacacacacacag

SEQ ID NO: 2575725 - RNA, 23 nt, Human
augcauacacacacacacacagc

SEQ ID NO: 2575726 - RNA, 15 nt, Human
augcauacuucaaaa

SEQ ID NO: 2575727 - RNA, 19 nt, Human
augcauccuuugcacuguc

SEQ ID NO: 2575728 - RNA, 14 nt, Human
augcaucuagauua

SEQ ID NO: 2575729 - RNA, 23 nt, Human
augcauccauuccucagggacag

SEQ ID NO: 2575730 - RNA, 14 nt, Human
augcauccauuccu

SEQ ID NO: 2575731 - RNA, 17 nt, Human
augcauccauuccucag

SEQ ID NO: 2575732 - RNA, 18 nt, Human
augcauccauuccucagg

SEQ ID NO: 2575733 - RNA, 22 nt, Human
augcauccauuccucagggaca

SEQ ID NO: 2575734 - RNA, 18 nt, Human
augcaucauucuuguuaa

SEQ ID NO: 2575735 - RNA, 17 nt, Human
augcauggugccccagg

SEQ ID NO: 2575736 - RNA, 18 nt, Human
augcauggugccccagga

SEQ ID NO: 2575737 - RNA, 19 nt, Human
augcauggugccccaggac

SEQ ID NO: 2575738 - RNA, 20 nt, Human
augcauggugccccaggacc

SEQ ID NO: 2575739 - RNA, 23 nt, Human
augcauggagggcugcccuguac

SEQ ID NO: 2575740 - RNA, 16 nt, Human
augcauggaaauuccc

SEQ ID NO: 2575741 - RNA, 16 nt, Human
augcauggugccccag

SEQ ID NO: 2575742 - RNA, 19 nt, Human
augcauggugcaguugaca

SEQ ID NO: 2575743 - RNA, 21 nt, Human
augccugguggcagcugcggu

SEQ ID NO: 2575744 - RNA, 23 nt, Human
augccuguacucgcuugugcaga

SEQ ID NO: 2575745 - RNA, 21 nt, Human
augccuguacucgcuugugca

SEQ ID NO: 2575746 - RNA, 16 nt, Human
augccuguccagccug

SEQ ID NO: 2575747 - RNA, 18 nt, Human
augccugguggcagcugc

SEQ ID NO: 2575748 - RNA, 19 nt, Human
augccugguggcagcugcg

SEQ ID NO: 2575749 - RNA, 14 nt, Human
augccugguggcag

SEQ ID NO: 2575750 - RNA, 13 nt, Human
augccugguggca

SEQ ID NO: 2575751 - RNA, 23 nt, Human
augcauggugcaguugacagcag

SEQ ID NO: 2575752 - RNA, 21 nt, Human
augcauggugccccaggacca

SEQ ID NO: 2575753 - RNA, 22 nt, Human
augcauggugccccaggaccag

SEQ ID NO: 2575754 - RNA, 16 nt, Human
augcauguccuguaaa

SEQ ID NO: 2575755 - RNA, 12 nt, Human
augccugguggc

SEQ ID NO: 2575756 - RNA, 11 nt, Human
augccuggugg

SEQ ID NO: 2575757 - RNA, 22 nt, Human
augcuucuucagagacuccugc

SEQ ID NO: 2575758 - RNA, 14 nt, Human
augcucuucugugg

SEQ ID NO: 2575759 - RNA, 21 nt, Human
augcuuuaggauguacaguua

SEQ ID NO: 2575760 - RNA, 20 nt, Human
augcuucuucagagacuccu

SEQ ID NO: 2575761 - RNA, 17 nt, Human
augcuucuucagagacu

SEQ ID NO: 2575762 - RNA, 14 nt, Human
augcuucuucagag

SEQ ID NO: 2575763 - RNA, 18 nt, Human
augcucugcauguuacau

SEQ ID NO: 2575764 - RNA, 19 nt, Human
augcucugcauguuacaua

SEQ ID NO: 2575765 - RNA, 16 nt, Human
augcucuuagaaaauu

SEQ ID NO: 2575766 - RNA, 13 nt, Human
augcucuucugug

SEQ ID NO: 2575767 - RNA, 23 nt, Human
augcucugugcgaggguuacuau

SEQ ID NO: 2575768 - RNA, 11 nt, Human
auggagccagc

SEQ ID NO: 2575769 - RNA, 23 nt, Human
auggagagcuggagccuggugcc

SEQ ID NO: 2575770 - RNA, 20 nt, Human
auggagauucaguuuucauu

SEQ ID NO: 2575771 - RNA, 22 nt, Human
auggagugacggucccacacug

SEQ ID NO: 2575772 - RNA, 11 nt, Human
auggagugacg

SEQ ID NO: 2575773 - RNA, 15 nt, Human
auggagccagcuccc

SEQ ID NO: 2575774 - RNA, 18 nt, Human
auggagccagcucccucu

SEQ ID NO: 2575775 - RNA, 13 nt, Human
auggagagcugga

SEQ ID NO: 2575776 - RNA, 19 nt, Human
auggagauucaguuuucau

SEQ ID NO: 2575777 - RNA, 23 nt, Human
auggagauagccccacaggaggu

SEQ ID NO: 2575778 - RNA, 20 nt, Human
auggagagcuagaacccggc

SEQ ID NO: 2575779 - RNA, 13 nt, Human
auggagagagggg

SEQ ID NO: 2575780 - RNA, 14 nt, Human
auggagagagggga

SEQ ID NO: 2575781 - RNA, 15 nt, Human
auggagagaggggaa

SEQ ID NO: 2575782 - RNA, 17 nt, Human
auggagagaggggaaua

SEQ ID NO: 2575783 - RNA, 21 nt, Human
augcuuugaaguacaauugug

SEQ ID NO: 2575784 - RNA, 18 nt, Human
auggagagaaaacagacc

SEQ ID NO: 2575785 - RNA, 16 nt, Human
augcuuugaucccuuc

SEQ ID NO: 2575786 - RNA, 21 nt, Human
augcuuucagauuaaaauugu

SEQ ID NO: 2575787 - RNA, 15 nt, Human
augcuuuccaaaacc

SEQ ID NO: 2575788 - RNA, 23 nt, Human
auggcuuccuggcaauagucaaa

SEQ ID NO: 2575789 - RNA, 14 nt, Human
auggcuucuaacaa

SEQ ID NO: 2575790 - RNA, 17 nt, Human
auggcuuccuccucccu

SEQ ID NO: 2575791 - RNA, 18 nt, Human
auggcuugccacagcucu

SEQ ID NO: 2575792 - RNA, 14 nt, Human
augggaaaagagau

SEQ ID NO: 2575793 - RNA, 19 nt, Human
auggaguggcaauauagaa

SEQ ID NO: 2575794 - RNA, 16 nt, Human
auggaguguacaagua

SEQ ID NO: 2575795 - RNA, 19 nt, Human
auggcuuccuccucccucc

SEQ ID NO: 2575796 - RNA, 21 nt, Human
auggaguuaacgggugaauaa

SEQ ID NO: 2575797 - RNA, 17 nt, Human
auggaguuaacggguga

SEQ ID NO: 2575798 - RNA, 15 nt, Human
auggaguucuugugc

SEQ ID NO: 2575799 - RNA, 18 nt, Human
auggaguguguauuguuc

SEQ ID NO: 2575800 - RNA, 21 nt, Human
auggaguguguauuguuccca

SEQ ID NO: 2575801 - RNA, 13 nt, Human
auggagagaaaac

SEQ ID NO: 2575802 - RNA, 14 nt, Human
augggaaagcauug

SEQ ID NO: 2575803 - RNA, 20 nt, Human
augggaaagcauuguaaaug

SEQ ID NO: 2575804 - RNA, 18 nt, Human
augggaaagccaccucuc

SEQ ID NO: 2575805 - RNA, 17 nt, Human
augggaaagccaccucu

SEQ ID NO: 2575806 - RNA, 23 nt, Human
augggaaagccaccucucccuca

SEQ ID NO: 2575807 - RNA, 13 nt, Human
augggaaaguauu

SEQ ID NO: 2575808 - RNA, 17 nt, Human
augggaaugagguggga

SEQ ID NO: 2575809 - RNA, 21 nt, Human
augggaaaguauucuguacuc

SEQ ID NO: 2575810 - RNA, 20 nt, Human
augggacauuugcucaugga

SEQ ID NO: 2575811 - RNA, 15 nt, Human
augggacagggagga

SEQ ID NO: 2575812 - RNA, 14 nt, Human
augggaauugugug

SEQ ID NO: 2575813 - RNA, 18 nt, Human
augggaaugaggugggag

SEQ ID NO: 2575814 - RNA, 15 nt, Human
augggaauuguguga

SEQ ID NO: 2575815 - RNA, 14 nt, Human
aucaaaagaaagaa

SEQ ID NO: 2575816 - RNA, 21 nt, Human
aucaaaacuuucuuuucugga

SEQ ID NO: 2575817 - RNA, 15 nt, Human
aucaaaacuuucuuu

SEQ ID NO: 2575818 - RNA, 16 nt, Human
aucaaaaauauuccau

SEQ ID NO: 2575819 - RNA, 15 nt, Human
auauuuuuuuguaga

SEQ ID NO: 2575820 - RNA, 18 nt, Human
auauuuuuuucuuuucuu

SEQ ID NO: 2575821 - RNA, 23 nt, Human
aucaaaagacaauucuuuauaca

SEQ ID NO: 2575822 - RNA, 21 nt, Human
aucaaaagacaauucuuuaua

SEQ ID NO: 2575823 - RNA, 24 nt, Human
aucaaaagguuaauaaaguaauua

SEQ ID NO: 2575824 - RNA, 22 nt, Human
aucaaacccggcgguccccucc

SEQ ID NO: 2575825 - RNA, 19 nt, Human
aucaaaagacaauucuuua

SEQ ID NO: 2575826 - RNA, 18 nt, Human
aucaaaagacaauucuuu

SEQ ID NO: 2575827 - RNA, 17 nt, Human
aucaaaagacaauucuu

SEQ ID NO: 2575828 - RNA, 16 nt, Human
aucaaaagacaauucu

SEQ ID NO: 2575829 - RNA, 15 nt, Human
aucaaaagacaauuc

SEQ ID NO: 2575830 - RNA, 14 nt, Human
aucaaaagacaauu

SEQ ID NO: 2575831 - RNA, 13 nt, Human
aucaaaagacaau

SEQ ID NO: 2575832 - RNA, 21 nt, Human
aucaaaaccuuucaaauauca

SEQ ID NO: 2575833 - RNA, 20 nt, Human
aucaaaagguuaauaaagua

SEQ ID NO: 2575834 - RNA, 18 nt, Human
aucaaagagagaaaauaa

SEQ ID NO: 2575835 - RNA, 12 nt, Human
aucaaaggacac

SEQ ID NO: 2575836 - RNA, 17 nt, Human
aucaaacugaagccaga

SEQ ID NO: 2575837 - RNA, 21 nt, Human
aucaaaggaaaauaguaaugu

SEQ ID NO: 2575838 - RNA, 19 nt, Human
aucaaagagguuuuaaaaa

SEQ ID NO: 2575839 - RNA, 14 nt, Human
aucaaacugaagcc

SEQ ID NO: 2575840 - RNA, 15 nt, Human
aucaaacugaagcca

SEQ ID NO: 2575841 - RNA, 16 nt, Human
aucaaacugaagccag

SEQ ID NO: 2575842 - RNA, 14 nt, Human
auagcacagacccu

SEQ ID NO: 2575843 - RNA, 19 nt, Human
auagcaagacacaucccua

SEQ ID NO: 2575844 - RNA, 17 nt, Human
auagcaagauugcuuaa

SEQ ID NO: 2575845 - RNA, 13 nt, Human
auagcaagugaau

SEQ ID NO: 2575846 - RNA, 19 nt, Human
auagcaagugaauuuuucu

SEQ ID NO: 2575847 - RNA, 22 nt, Human
auagcaagugaauuuuucucua

SEQ ID NO: 2575848 - RNA, 23 nt, Human
auagcaaauguuuugacaugaaa

SEQ ID NO: 2575849 - RNA, 22 nt, Human
auagcaauccauguuaguuuuu

SEQ ID NO: 2575850 - RNA, 22 nt, Human
aucuaggaagacuuuggaaaga

SEQ ID NO: 2575851 - RNA, 20 nt, Human
auccccauccuccagcuucu

SEQ ID NO: 2575852 - RNA, 15 nt, Human
auccccauccuccag

SEQ ID NO: 2575853 - RNA, 19 nt, Human
auccagggcucugaccagu

SEQ ID NO: 2575854 - RNA, 21 nt, Human
auccccaguaaaauugccaua

SEQ ID NO: 2575855 - RNA, 15 nt, Human
auccccaguaaaauu

SEQ ID NO: 2575856 - RNA, 18 nt, Human
auccagggaugccaucug

SEQ ID NO: 2575857 - RNA, 17 nt, Human
auccccccaucuugcuu

SEQ ID NO: 2575858 - RNA, 15 nt, Human
auccccccaucuugc

SEQ ID NO: 2575859 - RNA, 12 nt, Human
aucccccagccu

SEQ ID NO: 2575860 - RNA, 12 nt, Human
aucccccagacu

SEQ ID NO: 2575861 - RNA, 13 nt, Human
aucccccugcccu

SEQ ID NO: 2575862 - RNA, 12 nt, Human
aucccccugccc

SEQ ID NO: 2575863 - RNA, 14 nt, Human
auccccccucacca

SEQ ID NO: 2575864 - RNA, 17 nt, Human
auccccauccuccagcu

SEQ ID NO: 2575865 - RNA, 20 nt, Human
auccccccaucuugcuuccc

SEQ ID NO: 2575866 - RNA, 19 nt, Human
aucccccccaccucucccu

SEQ ID NO: 2575867 - RNA, 12 nt, Human
auccuugaagau

SEQ ID NO: 2575868 - RNA, 13 nt, Human
auccuucugccuu

SEQ ID NO: 2575869 - RNA, 11 nt, Human
auccuucugcc

SEQ ID NO: 2575870 - RNA, 22 nt, Human
auccuucuaguuucccacaaua

SEQ ID NO: 2575871 - RNA, 19 nt, Human
auccuucuaguuucccaca

SEQ ID NO: 2575872 - RNA, 17 nt, Human
auccuucuaguuuccca

SEQ ID NO: 2575873 - RNA, 13 nt, Human
auccuucuaguuu

SEQ ID NO: 2575874 - RNA, 12 nt, Human
auccuucuaguu

SEQ ID NO: 2575875 - RNA, 22 nt, Human
auccuuccuucccacccaucgc

SEQ ID NO: 2575876 - RNA, 16 nt, Human
auccuuccuucccacc

SEQ ID NO: 2575877 - RNA, 14 nt, Human
auccuuccuuccca

SEQ ID NO: 2575878 - RNA, 13 nt, Human
auccuuccuccca

SEQ ID NO: 2575879 - RNA, 11 nt, Human
auccuuccucc

SEQ ID NO: 2575880 - RNA, 18 nt, Human
aucccccuugccacccca

SEQ ID NO: 2575881 - RNA, 14 nt, Human
aucccccuugccac

SEQ ID NO: 2575882 - RNA, 15 nt, Human
aucccccugcccucg

SEQ ID NO: 2575883 - RNA, 14 nt, Human
aucccccugcccuc

SEQ ID NO: 2575884 - RNA, 17 nt, Human
auccuuccucacaccag

SEQ ID NO: 2575885 - RNA, 18 nt, Human
aucgaaucuacuaauucc

SEQ ID NO: 2575886 - RNA, 20 nt, Human
aucgaaucuacuaauuccac

SEQ ID NO: 2575887 - RNA, 14 nt, Human
aucgaccugccucg

SEQ ID NO: 2575888 - RNA, 21 nt, Human
aucgacuuguuuuugcacaug

SEQ ID NO: 2575889 - RNA, 23 nt, Human
aucgaaauaacaauguuaaggaa

SEQ ID NO: 2575890 - RNA, 19 nt, Human
aucgaaauaacaauguuaa

SEQ ID NO: 2575891 - RNA, 18 nt, Human
aucgaaauaacaauguua

SEQ ID NO: 2575892 - RNA, 17 nt, Human
aucgaaauaacaauguu

SEQ ID NO: 2575893 - RNA, 13 nt, Human
aucgaaauaacaa

SEQ ID NO: 2575894 - RNA, 22 nt, Human
aucgaaauaacaauguuaagga

SEQ ID NO: 2575895 - RNA, 20 nt, Human
aucgaaauaacaauguuaag

SEQ ID NO: 2575896 - RNA, 15 nt, Human
aucgaaccguuuuga

SEQ ID NO: 2575897 - RNA, 18 nt, Human
auccuuuuucuuuauaaa

SEQ ID NO: 2575898 - RNA, 12 nt, Human
auccagggacag

SEQ ID NO: 2575899 - RNA, 13 nt, Human
auccagggacaga

SEQ ID NO: 2575900 - RNA, 14 nt, Human
auccagggacagag

SEQ ID NO: 2575901 - RNA, 16 nt, Human
auccagggacagaggc

SEQ ID NO: 2575902 - RNA, 19 nt, Human
auccagggacagaggcccc

SEQ ID NO: 2575903 - RNA, 20 nt, Human
auccagggacagaggcccca

SEQ ID NO: 2575904 - RNA, 21 nt, Human
auccagggacagaggccccag

SEQ ID NO: 2575905 - RNA, 17 nt, Human
auccagccuggggucug

SEQ ID NO: 2575906 - RNA, 22 nt, Human
auccaggcagauccaggacuau

SEQ ID NO: 2575907 - RNA, 19 nt, Human
auccaggcagauccaggac

SEQ ID NO: 2575908 - RNA, 24 nt, Human
auccaggcagucgggggcuggccu

SEQ ID NO: 2575909 - RNA, 21 nt, Human
auccagccucuccccugauua

SEQ ID NO: 2575910 - RNA, 17 nt, Human
auccagccucuccccug

SEQ ID NO: 2575911 - RNA, 16 nt, Human
auccagccucuccccu

SEQ ID NO: 2575912 - RNA, 12 nt, Human
auccagccuggg

SEQ ID NO: 2575913 - RNA, 21 nt, Human
auccagcccugaguuccuagc

SEQ ID NO: 2575914 - RNA, 14 nt, Human
auccagccucuccc

SEQ ID NO: 2575915 - RNA, 19 nt, Human
auccagccggaggccagag

SEQ ID NO: 2575916 - RNA, 20 nt, Human
auccagaucauuccucagaa

SEQ ID NO: 2575917 - RNA, 12 nt, Human
auccacuuugca

SEQ ID NO: 2575918 - RNA, 22 nt, Human
auccagaguuuagaggaaaaaa

SEQ ID NO: 2575919 - RNA, 20 nt, Human
auccagauacacccaaagua

SEQ ID NO: 2575920 - RNA, 21 nt, Human
auccacugugccaugugccag

SEQ ID NO: 2575921 - RNA, 22 nt, Human
auccacucuacccucccacccc

SEQ ID NO: 2575922 - RNA, 23 nt, Human
auccacucuacccucccaccccc

SEQ ID NO: 2575923 - RNA, 23 nt, Human
auccacuuuaucuugaauaaugu

SEQ ID NO: 2575924 - RNA, 19 nt, Human
auccacucugccugcuuac

SEQ ID NO: 2575925 - RNA, 18 nt, Human
aucauccuuuccagcaug

SEQ ID NO: 2575926 - RNA, 13 nt, Human
aucauccuuucca

SEQ ID NO: 2575927 - RNA, 14 nt, Human
aucaucccagcugc

SEQ ID NO: 2575928 - RNA, 11 nt, Human
aucaaauacuu

SEQ ID NO: 2575929 - RNA, 12 nt, Human
aucauccuacug

SEQ ID NO: 2575930 - RNA, 21 nt, Human
aucaugaauuaguuuuauaug

SEQ ID NO: 2575931 - RNA, 20 nt, Human
aucaugacaaagacugagua

SEQ ID NO: 2575932 - RNA, 18 nt, Human
aucaaaguaggcaggacc

SEQ ID NO: 2575933 - RNA, 14 nt, Human
aucauccagaaguu

SEQ ID NO: 2575934 - RNA, 15 nt, Human
aucauccuaagcuau

SEQ ID NO: 2575935 - RNA, 20 nt, Human
aucauggaaugguuauaaaa

SEQ ID NO: 2575936 - RNA, 19 nt, Human
aucauggaaugguuauaaa

SEQ ID NO: 2575937 - RNA, 12 nt, Human
aucaugcccugu

SEQ ID NO: 2575938 - RNA, 22 nt, Human
aucaugcauuguugaggugguc

SEQ ID NO: 2575939 - RNA, 12 nt, Human
aucaugcauugu

SEQ ID NO: 2575940 - RNA, 13 nt, Human
aucaugcauuguu

SEQ ID NO: 2575941 - RNA, 14 nt, Human
aucaugcauuguug

SEQ ID NO: 2575942 - RNA, 21 nt, Human
aucaugcauuguugagguggu

SEQ ID NO: 2575943 - RNA, 21 nt, Human
aucaugcauguccuguaaagg

SEQ ID NO: 2575944 - RNA, 22 nt, Human
aucaugcaucuuacugaaggua

SEQ ID NO: 2575945 - RNA, 19 nt, Human
aucaugcaaaugcuguauu

SEQ ID NO: 2575946 - RNA, 16 nt, Human
aucauccuuuccagca

SEQ ID NO: 2575947 - RNA, 16 nt, Human
aucaucuauaaagaag

SEQ ID NO: 2575948 - RNA, 13 nt, Human
aucaugacauguu

SEQ ID NO: 2575949 - RNA, 23 nt, Human
aucaugagugaauaaaugucuug

SEQ ID NO: 2575950 - RNA, 18 nt, Human
aucaugacauguuauaua

SEQ ID NO: 2575951 - RNA, 16 nt, Human
aucaugacauguuaua

SEQ ID NO: 2575952 - RNA, 20 nt, Human
agauauaagugcuguauaaa

SEQ ID NO: 2575953 - RNA, 18 nt, Human
agauauaagugcuguaua

SEQ ID NO: 2575954 - RNA, 17 nt, Human
agauauaagugcuguau

SEQ ID NO: 2575955 - RNA, 16 nt, Human
agauauaagugcugua

SEQ ID NO: 2575956 - RNA, 22 nt, Human
agauauaagugcuguauaaaau

SEQ ID NO: 2575957 - RNA, 21 nt, Human
agauauaagugcuguauaaaa

SEQ ID NO: 2575958 - RNA, 23 nt, Human
agauauaagugcuguauaaaauc

SEQ ID NO: 2575959 - RNA, 13 nt, Human
agauauauaucau

SEQ ID NO: 2575960 - RNA, 17 nt, Human
agauaucugagggagga

SEQ ID NO: 2575961 - RNA, 21 nt, Human
agauaucugagggaggaggcc

SEQ ID NO: 2575962 - RNA, 17 nt, Human
agauaucuugaaaugaa

SEQ ID NO: 2575963 - RNA, 18 nt, Human
agauaugaacauauuguu

SEQ ID NO: 2575964 - RNA, 15 nt, Human
agauaugaguuguuu

SEQ ID NO: 2575965 - RNA, 16 nt, Human
agauaugauauguaaa

SEQ ID NO: 2575966 - RNA, 17 nt, Human
agauaugauauguaaac

SEQ ID NO: 2575967 - RNA, 20 nt, Human
agagggguacauuucccugu

SEQ ID NO: 2575968 - RNA, 23 nt, Human
agaggggguggccucccaacuca

SEQ ID NO: 2575969 - RNA, 22 nt, Human
agagggucuggagaagcaguga

SEQ ID NO: 2575970 - RNA, 12 nt, Human
agaguggccugg

SEQ ID NO: 2575971 - RNA, 13 nt, Human
agaguggccuggc

SEQ ID NO: 2575972 - RNA, 14 nt, Human
agaguggccuggcc

SEQ ID NO: 2575973 - RNA, 15 nt, Human
agaguggccuggcca

SEQ ID NO: 2575974 - RNA, 16 nt, Human
agaguggccuggccag

SEQ ID NO: 2575975 - RNA, 16 nt, Human
agagggguggagacug

SEQ ID NO: 2575976 - RNA, 19 nt, Human
agagggguacauuucccug

SEQ ID NO: 2575977 - RNA, 19 nt, Human
agagggguggagacugcuu

SEQ ID NO: 2575978 - RNA, 22 nt, Human
agagggugacaagauagagagc

SEQ ID NO: 2575979 - RNA, 18 nt, Human
agagggucuggagaagca

SEQ ID NO: 2575980 - RNA, 20 nt, Human
agagggucugaggaauccag

SEQ ID NO: 2575981 - RNA, 14 nt, Human
agaguggcuccucc

SEQ ID NO: 2575982 - RNA, 13 nt, Human
agaguggcuccuc

SEQ ID NO: 2575983 - RNA, 12 nt, Human
agaguggcuccu

SEQ ID NO: 2575984 - RNA, 17 nt, Human
agaguggccuggccagg

SEQ ID NO: 2575985 - RNA, 19 nt, Human
agaguggccuggccaggag

SEQ ID NO: 2575986 - RNA, 20 nt, Human
agagugggggagagcaggcu

SEQ ID NO: 2575987 - RNA, 18 nt, Human
agagugggggagagcagg

SEQ ID NO: 2575988 - RNA, 22 nt, Human
agaguggccuggccaggagcuc

SEQ ID NO: 2575989 - RNA, 19 nt, Human
agagugggguagguuggga

SEQ ID NO: 2575990 - RNA, 22 nt, Human
agagugggggagagcaggcugg

SEQ ID NO: 2575991 - RNA, 16 nt, Human
agaguggguuucacaa

SEQ ID NO: 2575992 - RNA, 15 nt, Human
agaguugaagacaga

SEQ ID NO: 2575993 - RNA, 14 nt, Human
agaguugaagacag

SEQ ID NO: 2575994 - RNA, 13 nt, Human
agauagaauuucc

SEQ ID NO: 2575995 - RNA, 16 nt, Human
agauagaauuuccaau

SEQ ID NO: 2575996 - RNA, 14 nt, Human
agauagagagcuau

SEQ ID NO: 2575997 - RNA, 13 nt, Human
agaguugagcucu

SEQ ID NO: 2575998 - RNA, 13 nt, Human
agauagaagaacu

SEQ ID NO: 2575999 - RNA, 14 nt, Human
agauagaagaacug

SEQ ID NO: 2576000 - RNA, 15 nt, Human
agauagaagaacugc

SEQ ID NO: 2576001 - RNA, 16 nt, Human
agauagaagaacugca

SEQ ID NO: 2576002 - RNA, 22 nt, Human
agaguguagaagcauuccuucu

SEQ ID NO: 2576003 - RNA, 12 nt, Human
agaguugaaccu

SEQ ID NO: 2576004 - RNA, 13 nt, Human
agaguugaaccua

SEQ ID NO: 2576005 - RNA, 13 nt, Human
agaguugaagaca

SEQ ID NO: 2576006 - RNA, 18 nt, Human
agaguguagaucagagca

SEQ ID NO: 2576007 - RNA, 18 nt, Human
agaguguagaagcauucc

SEQ ID NO: 2576008 - RNA, 17 nt, Human
agaguguagaagcauuc

SEQ ID NO: 2576009 - RNA, 16 nt, Human
agaguguagaagcauu

SEQ ID NO: 2576010 - RNA, 15 nt, Human
agaguguagaagcau

SEQ ID NO: 2576011 - RNA, 14 nt, Human
agaguguagaagca

SEQ ID NO: 2576012 - RNA, 13 nt, Human
agaguguagaagc

SEQ ID NO: 2576013 - RNA, 12 nt, Human
agaguguagaag

SEQ ID NO: 2576014 - RNA, 18 nt, Human
agagugguauuugcagac

SEQ ID NO: 2576015 - RNA, 15 nt, Human
agagugguauuugca

SEQ ID NO: 2576016 - RNA, 18 nt, Human
agaguggucuuucuggag

SEQ ID NO: 2576017 - RNA, 19 nt, Human
agauagccccacaggaggu

SEQ ID NO: 2576018 - RNA, 20 nt, Human
agauagccaaggccaaagga

SEQ ID NO: 2576019 - RNA, 20 nt, Human
agauagauaggucagugcaa

SEQ ID NO: 2576020 - RNA, 13 nt, Human
agauaggcucugc

SEQ ID NO: 2576021 - RNA, 14 nt, Human
agauaggcucugca

SEQ ID NO: 2576022 - RNA, 16 nt, Human
agauaggcucugcaca

SEQ ID NO: 2576023 - RNA, 15 nt, Human
agauauaagugcugu

SEQ ID NO: 2576024 - RNA, 13 nt, Human
agauauaagugcu

SEQ ID NO: 2576025 - RNA, 20 nt, Human
agauauaacuauugcccagg

SEQ ID NO: 2576026 - RNA, 17 nt, Human
agauauaaauggcuggu

SEQ ID NO: 2576027 - RNA, 15 nt, Human
agauauaaauggcug

SEQ ID NO: 2576028 - RNA, 23 nt, Human
agauaguuuugccagaacaguuu

SEQ ID NO: 2576029 - RNA, 21 nt, Human
agauaggcucugcacagaugg

SEQ ID NO: 2576030 - RNA, 22 nt, Human
agauaggcucugcacagaugga

SEQ ID NO: 2576031 - RNA, 15 nt, Human
agauauaaaagacug

SEQ ID NO: 2576032 - RNA, 13 nt, Human
agcaaacucugcu

SEQ ID NO: 2576033 - RNA, 23 nt, Human
agcaaaaugugaaugggaaaaga

SEQ ID NO: 2576034 - RNA, 15 nt, Human
agcaaaaugugaaug

SEQ ID NO: 2576035 - RNA, 14 nt, Human
agcaaaaugugaau

SEQ ID NO: 2576036 - RNA, 23 nt, Human
agcaaaauugauguguuuauuua

SEQ ID NO: 2576037 - RNA, 23 nt, Human
agcaaaauuuuuucucuaggaaa

SEQ ID NO: 2576038 - RNA, 15 nt, Human
agcaaacucugcugu

SEQ ID NO: 2576039 - RNA, 14 nt, Human
agcaaacucugcug

SEQ ID NO: 2576040 - RNA, 13 nt, Human
agcaaacucuuuu

SEQ ID NO: 2576041 - RNA, 17 nt, Human
agcaaacucuuuuccca

SEQ ID NO: 2576042 - RNA, 13 nt, Human
agcaaacuuggaa

SEQ ID NO: 2576043 - RNA, 16 nt, Human
agcaaagagugggcug

SEQ ID NO: 2576044 - RNA, 12 nt, Human
agcaaagagugg

SEQ ID NO: 2576045 - RNA, 17 nt, Human
agcaaagaucaaaauaa

SEQ ID NO: 2576046 - RNA, 15 nt, Human
agcaaagaucaaaau

SEQ ID NO: 2576047 - RNA, 14 nt, Human
agcaaagaucaaaa

SEQ ID NO: 2576048 - RNA, 13 nt, Human
agcaaagaucaaa

SEQ ID NO: 2576049 - RNA, 12 nt, Human
agcaaagaucaa

SEQ ID NO: 2576050 - RNA, 22 nt, Human
agcaaagagugggcugcaucug

SEQ ID NO: 2576051 - RNA, 20 nt, Human
agcaaagauaucucaucucu

SEQ ID NO: 2576052 - RNA, 15 nt, Human
agcaaagcaccagcu

SEQ ID NO: 2576053 - RNA, 22 nt, Human
agcaaagcaccagcuucuccag

SEQ ID NO: 2576054 - RNA, 20 nt, Human
agcaaagucuaaaguuuaca

SEQ ID NO: 2576055 - RNA, 15 nt, Human
agcaaagucuaaagu

SEQ ID NO: 2576056 - RNA, 14 nt, Human
agcaaagucuaaag

SEQ ID NO: 2576057 - RNA, 19 nt, Human
agcaaaggcugagaacacu

SEQ ID NO: 2576058 - RNA, 23 nt, Human
agcaaaggaguagaaagacagag

SEQ ID NO: 2576059 - RNA, 19 nt, Human
agcaaagccccaugcugga

SEQ ID NO: 2576060 - RNA, 11 nt, Human
agcaaauacau

SEQ ID NO: 2576061 - RNA, 23 nt, Human
agcaaagucuaaaguuuacagua

SEQ ID NO: 2576062 - RNA, 22 nt, Human
agcaaagucuaaaguuuacagu

SEQ ID NO: 2576063 - RNA, 19 nt, Human
agcaaauaaacuaggaaau

SEQ ID NO: 2576064 - RNA, 16 nt, Human
agcaaauuaauuggca

SEQ ID NO: 2576065 - RNA, 15 nt, Human
agcaaauuaauuggc

SEQ ID NO: 2576066 - RNA, 18 nt, Human
agcaaauguuucugcagu

SEQ ID NO: 2576067 - RNA, 17 nt, Human
agcaaauguuucugcag

SEQ ID NO: 2576068 - RNA, 16 nt, Human
agcaaauguuucugca

SEQ ID NO: 2576069 - RNA, 14 nt, Human
agcaaauguuucug

SEQ ID NO: 2576070 - RNA, 13 nt, Human
agcaaauguuucu

SEQ ID NO: 2576071 - RNA, 19 nt, Human
agcaaauucuguuuuucua

SEQ ID NO: 2576072 - RNA, 16 nt, Human
agcaaaucagaaacuu

SEQ ID NO: 2576073 - RNA, 17 nt, Human
agcaaauguuaugcaua

SEQ ID NO: 2576074 - RNA, 20 nt, Human
agcaaaucagaaacuuguga

SEQ ID NO: 2576075 - RNA, 12 nt, Human
agcaaauuuggg

SEQ ID NO: 2576076 - RNA, 11 nt, Human
agcaaauugau

SEQ ID NO: 2576077 - RNA, 22 nt, Human
agcaaauuaauuggcagcagau

SEQ ID NO: 2576078 - RNA, 21 nt, Human
agcaaauuaauuggcagcaga

SEQ ID NO: 2576079 - RNA, 19 nt, Human
agcaaauuaauuggcagca

SEQ ID NO: 2576080 - RNA, 13 nt, Human
agcaaacuaagcc

SEQ ID NO: 2576081 - RNA, 19 nt, Human
agcaaaauugauguguuua

SEQ ID NO: 2576082 - RNA, 13 nt, Human
agcaaaauugaug

SEQ ID NO: 2576083 - RNA, 14 nt, Human
agcaaaaucauuuu

SEQ ID NO: 2576084 - RNA, 14 nt, Human
agauugcugaaauu

SEQ ID NO: 2576085 - RNA, 15 nt, Human
agcaaaaucauuuua

SEQ ID NO: 2576086 - RNA, 13 nt, Human
agauugcauguga

SEQ ID NO: 2576087 - RNA, 15 nt, Human
agauugcaugugacu

SEQ ID NO: 2576088 - RNA, 16 nt, Human
agauugcaugugacuc

SEQ ID NO: 2576089 - RNA, 18 nt, Human
agauugcaugugacucug

SEQ ID NO: 2576090 - RNA, 19 nt, Human
agauugcaugugacucuga

SEQ ID NO: 2576091 - RNA, 23 nt, Human
agauugcaugugacucugaagcu

SEQ ID NO: 2576092 - RNA, 13 nt, Human
agauugcugaaau

SEQ ID NO: 2576093 - RNA, 22 nt, Human
agauugcaugugacucugaagc

SEQ ID NO: 2576094 - RNA, 21 nt, Human
agauugcgccauugcacucca

SEQ ID NO: 2576095 - RNA, 19 nt, Human
agauugcaacaggcugggc

SEQ ID NO: 2576096 - RNA, 17 nt, Human
agauugcaacaggcugg

SEQ ID NO: 2576097 - RNA, 16 nt, Human
agauugcaccacugca

SEQ ID NO: 2576098 - RNA, 16 nt, Human
agauucuuuccugagg

SEQ ID NO: 2576099 - RNA, 15 nt, Human
agauucuuuccugag

SEQ ID NO: 2576100 - RNA, 17 nt, Human
agauugacgacaagugc

SEQ ID NO: 2576101 - RNA, 18 nt, Human
agauucuuuccugaggcu

SEQ ID NO: 2576102 - RNA, 19 nt, Human
agauugagaaggagagaaa

SEQ ID NO: 2576103 - RNA, 18 nt, Human
agauugagaaggagagaa

SEQ ID NO: 2576104 - RNA, 17 nt, Human
agauugagaaggagaga

SEQ ID NO: 2576105 - RNA, 16 nt, Human
agauugagaaggagag

SEQ ID NO: 2576106 - RNA, 15 nt, Human
agauugacgacaagu

SEQ ID NO: 2576107 - RNA, 15 nt, Human
agauugagaaggaga

SEQ ID NO: 2576108 - RNA, 18 nt, Human
agauugagagaagagaca

SEQ ID NO: 2576109 - RNA, 19 nt, Human
agauugagagaagagacaa

SEQ ID NO: 2576110 - RNA, 22 nt, Human
agauugagaaguuuuguacaga

SEQ ID NO: 2576111 - RNA, 17 nt, Human
agauugagauguguuca

SEQ ID NO: 2576112 - RNA, 16 nt, Human
agauugcaacaggcug

SEQ ID NO: 2576113 - RNA, 22 nt, Human
agauugaggccugcccucaggg

SEQ ID NO: 2576114 - RNA, 19 nt, Human
agauugaggccugcccuca

SEQ ID NO: 2576115 - RNA, 13 nt, Human
agauugaggccug

SEQ ID NO: 2576116 - RNA, 18 nt, Human
agaugaaucaaugggaaa

SEQ ID NO: 2576117 - RNA, 13 nt, Human
agaugaaucaaug

SEQ ID NO: 2576118 - RNA, 23 nt, Human
agaucugacaugauuccuuccug

SEQ ID NO: 2576119 - RNA, 16 nt, Human
agaugaaugccgugga

SEQ ID NO: 2576120 - RNA, 18 nt, Human
agaugacaucugucuagg

SEQ ID NO: 2576121 - RNA, 22 nt, Human
agaugacauugcuaagaugcuc

SEQ ID NO: 2576122 - RNA, 21 nt, Human
agaugacauugcuaagaugcu

SEQ ID NO: 2576123 - RNA, 15 nt, Human
agaugacauugcuaa

SEQ ID NO: 2576124 - RNA, 11 nt, Human
agaugacaaaa

SEQ ID NO: 2576125 - RNA, 20 nt, Human
agauggcugugccucugccu

SEQ ID NO: 2576126 - RNA, 19 nt, Human
agauggcugugccucugcc

SEQ ID NO: 2576127 - RNA, 18 nt, Human
agauggcugugccucugc

SEQ ID NO: 2576128 - RNA, 17 nt, Human
agauggcugugccucug

SEQ ID NO: 2576129 - RNA, 19 nt, Human
agauggggucuguaaaauc

SEQ ID NO: 2576130 - RNA, 18 nt, Human
agauggggucuguaaaau

SEQ ID NO: 2576131 - RNA, 16 nt, Human
agauggggucuguaaa

SEQ ID NO: 2576132 - RNA, 22 nt, Human
agauggcugugccucugccugu

SEQ ID NO: 2576133 - RNA, 21 nt, Human
agauggcugugccucugccug

SEQ ID NO: 2576134 - RNA, 14 nt, Human
agauucuuuccuga

SEQ ID NO: 2576135 - RNA, 12 nt, Human
agauucuuuccc

SEQ ID NO: 2576136 - RNA, 19 nt, Human
agauucuacauauucuuua

SEQ ID NO: 2576137 - RNA, 23 nt, Human
agaugggucuggcugagcugaac

SEQ ID NO: 2576138 - RNA, 22 nt, Human
agaugggugcuuggaggaagga

SEQ ID NO: 2576139 - RNA, 20 nt, Human
agaugggugcuuggaggaag

SEQ ID NO: 2576140 - RNA, 22 nt, Human
agaugggucuggcugagcugaa

SEQ ID NO: 2576141 - RNA, 21 nt, Human
agaugggucuggcugagcuga

SEQ ID NO: 2576142 - RNA, 19 nt, Human
agaugggucuggcugagcu

SEQ ID NO: 2576143 - RNA, 17 nt, Human
agaugggucuggcugag

SEQ ID NO: 2576144 - RNA, 21 nt, Human
agaucugcagggggugugucu

SEQ ID NO: 2576145 - RNA, 21 nt, Human
agaucugacaugauuccuucc

SEQ ID NO: 2576146 - RNA, 23 nt, Human
agaucucugcuuuggaaaucaca

SEQ ID NO: 2576147 - RNA, 18 nt, Human
agaucucugcuuuggaaa

SEQ ID NO: 2576148 - RNA, 18 nt, Human
agcacugauuucacaaca

SEQ ID NO: 2576149 - RNA, 17 nt, Human
agcacugauuucacaac

SEQ ID NO: 2576150 - RNA, 13 nt, Human
agcacugauuuca

SEQ ID NO: 2576151 - RNA, 21 nt, Human
agcacugaggaagaacggggc

SEQ ID NO: 2576152 - RNA, 16 nt, Human
agcagccuggacccug

SEQ ID NO: 2576153 - RNA, 19 nt, Human
agcacugacuucuaaguaa

SEQ ID NO: 2576154 - RNA, 14 nt, Human
agcacugaggaaga

SEQ ID NO: 2576155 - RNA, 11 nt, Human
agcacugagga

SEQ ID NO: 2576156 - RNA, 10 nt, Human
agcacugagg

SEQ ID NO: 2576157 - RNA, 16 nt, Human
agcacugagcaaagca

SEQ ID NO: 2576158 - RNA, 21 nt, Human
agcacuacauaaacugacuuu

SEQ ID NO: 2576159 - RNA, 17 nt, Human
agcacuacauaaacuga

SEQ ID NO: 2576160 - RNA, 16 nt, Human
agcacuacauaaacug

SEQ ID NO: 2576161 - RNA, 16 nt, Human
agcacucacacaggac

SEQ ID NO: 2576162 - RNA, 14 nt, Human
agcacuauacagau

SEQ ID NO: 2576163 - RNA, 14 nt, Human
agcacucacacagg

SEQ ID NO: 2576164 - RNA, 17 nt, Human
agcacugacuucuaagu

SEQ ID NO: 2576165 - RNA, 20 nt, Human
agcacucccaagucuacaga

SEQ ID NO: 2576166 - RNA, 19 nt, Human
agcacucccaagucuacag

SEQ ID NO: 2576167 - RNA, 14 nt, Human
agcacucccaaguc

SEQ ID NO: 2576168 - RNA, 13 nt, Human
agcacucccaagu

SEQ ID NO: 2576169 - RNA, 21 nt, Human
agcacuccucgguacucccau

SEQ ID NO: 2576170 - RNA, 16 nt, Human
agcagugcaugcuguc

SEQ ID NO: 2576171 - RNA, 13 nt, Human
agcagugcaugcu

SEQ ID NO: 2576172 - RNA, 16 nt, Human
agcagccuuuaaugca

SEQ ID NO: 2576173 - RNA, 18 nt, Human
agcagccuuuaaugcauc

SEQ ID NO: 2576174 - RNA, 11 nt, Human
agcagcuacca

SEQ ID NO: 2576175 - RNA, 17 nt, Human
agcagcuaucucucagu

SEQ ID NO: 2576176 - RNA, 19 nt, Human
agcagcuaucucucaguga

SEQ ID NO: 2576177 - RNA, 15 nt, Human
agcagcucaaaggca

SEQ ID NO: 2576178 - RNA, 16 nt, Human
agcagcucaaaggcac

SEQ ID NO: 2576179 - RNA, 19 nt, Human
agcagcucaaaggcacagu

SEQ ID NO: 2576180 - RNA, 12 nt, Human
agcagcucaggc

SEQ ID NO: 2576181 - RNA, 13 nt, Human
agcagcucaggca

SEQ ID NO: 2576182 - RNA, 14 nt, Human
agcagcucaggcac

SEQ ID NO: 2576183 - RNA, 23 nt, Human
agcagccugagcaacucuugauu

SEQ ID NO: 2576184 - RNA, 20 nt, Human
agcagccuggacccugugga

SEQ ID NO: 2576185 - RNA, 19 nt, Human
agcagcguuucuaugacac

SEQ ID NO: 2576186 - RNA, 18 nt, Human
agcagcguuucuaugaca

SEQ ID NO: 2576187 - RNA, 13 nt, Human
agcagccuguggc

SEQ ID NO: 2576188 - RNA, 14 nt, Human
agcagccuguggca

SEQ ID NO: 2576189 - RNA, 21 nt, Human
agcaguggcugguccagggcu

SEQ ID NO: 2576190 - RNA, 19 nt, Human
agcaguggcugguccaggg

SEQ ID NO: 2576191 - RNA, 18 nt, Human
agcaguggcugguccagg

SEQ ID NO: 2576192 - RNA, 17 nt, Human
agcaguggcugguccag

SEQ ID NO: 2576193 - RNA, 16 nt, Human
agcaguggcuggucca

SEQ ID NO: 2576194 - RNA, 13 nt, Human
agcaguggcuggu

SEQ ID NO: 2576195 - RNA, 12 nt, Human
agcaguggcugg

SEQ ID NO: 2576196 - RNA, 11 nt, Human
agcaguggcug

SEQ ID NO: 2576197 - RNA, 22 nt, Human
agcaguggcugguccagggcua

SEQ ID NO: 2576198 - RNA, 14 nt, Human
agcagugggccugg

SEQ ID NO: 2576199 - RNA, 19 nt, Human
agcaguggacaccaggagu

SEQ ID NO: 2576200 - RNA, 14 nt, Human
agcagugcuucuca

SEQ ID NO: 2576201 - RNA, 15 nt, Human
agcagugcaggcaca

SEQ ID NO: 2576202 - RNA, 13 nt, Human
agcagugcaggca

SEQ ID NO: 2576203 - RNA, 12 nt, Human
agcaguggacac

SEQ ID NO: 2576204 - RNA, 15 nt, Human
agcaguggacaccag

SEQ ID NO: 2576205 - RNA, 17 nt, Human
agcagugcaugcugucc

SEQ ID NO: 2576206 - RNA, 20 nt, Human
agcagcucaaaggcacagug

SEQ ID NO: 2576207 - RNA, 21 nt, Human
agcagcucaggcacacuucuu

SEQ ID NO: 2576208 - RNA, 23 nt, Human
agcagugccuuccauaauuauga

SEQ ID NO: 2576209 - RNA, 15 nt, Human
agcaauuccaaccuu

SEQ ID NO: 2576210 - RNA, 14 nt, Human
agcaauuccaaccu

SEQ ID NO: 2576211 - RNA, 15 nt, Human
agcaauucuccugcc

SEQ ID NO: 2576212 - RNA, 17 nt, Human
agcaauucuccugccuc

SEQ ID NO: 2576213 - RNA, 18 nt, Human
agcaauucuccugccuca

SEQ ID NO: 2576214 - RNA, 19 nt, Human
agcaauucuccugccucag

SEQ ID NO: 2576215 - RNA, 20 nt, Human
agcaauucuccugccucagc

SEQ ID NO: 2576216 - RNA, 20 nt, Human
agcaauuuauacaauaucau

SEQ ID NO: 2576217 - RNA, 23 nt, Human
agcaauuuaauauuuugcacagu

SEQ ID NO: 2576218 - RNA, 21 nt, Human
agcaauuuuccuugaagccga

SEQ ID NO: 2576219 - RNA, 20 nt, Human
agcaauuuuccuugaagccg

SEQ ID NO: 2576220 - RNA, 19 nt, Human
agcaauuuuccuugaagcc

SEQ ID NO: 2576221 - RNA, 18 nt, Human
agcaauuuuccuugaagc

SEQ ID NO: 2576222 - RNA, 17 nt, Human
agcaauuuuccuugaag

SEQ ID NO: 2576223 - RNA, 16 nt, Human
agcaauuuuccuugaa

SEQ ID NO: 2576224 - RNA, 15 nt, Human
agcaauuuuccuuga

SEQ ID NO: 2576225 - RNA, 14 nt, Human
agcaauuuuccuug

SEQ ID NO: 2576226 - RNA, 13 nt, Human
agcaauuuuccuu

SEQ ID NO: 2576227 - RNA, 12 nt, Human
agcaauuuuccu

SEQ ID NO: 2576228 - RNA, 24 nt, Human
agcaauuuaauauuuugcacaguu

SEQ ID NO: 2576229 - RNA, 21 nt, Human
agcaauuucgccguugaagag

SEQ ID NO: 2576230 - RNA, 22 nt, Human
agcaauuucgccguugaagagg

SEQ ID NO: 2576231 - RNA, 21 nt, Human
agcacagacccugcccugugg

SEQ ID NO: 2576232 - RNA, 15 nt, Human
agcacagagaagaca

SEQ ID NO: 2576233 - RNA, 14 nt, Human
agcaauuuucgaac

SEQ ID NO: 2576234 - RNA, 12 nt, Human
agcacagagagg

SEQ ID NO: 2576235 - RNA, 17 nt, Human
agcacuacucugugcca

SEQ ID NO: 2576236 - RNA, 20 nt, Human
agcacuaaggugugcucuga

SEQ ID NO: 2576237 - RNA, 17 nt, Human
agcacagagaagacaaa

SEQ ID NO: 2576238 - RNA, 23 nt, Human
agcacagagagggggccaccucc

SEQ ID NO: 2576239 - RNA, 21 nt, Human
agcacagagagggggccaccu

SEQ ID NO: 2576240 - RNA, 20 nt, Human
agcacagagagggggccacc

SEQ ID NO: 2576241 - RNA, 19 nt, Human
agcacagagagggggccac

SEQ ID NO: 2576242 - RNA, 16 nt, Human
agcaucuaugugagac

SEQ ID NO: 2576243 - RNA, 15 nt, Human
agcaucuaucucauc

SEQ ID NO: 2576244 - RNA, 20 nt, Human
agcaucucagccuaccauga

SEQ ID NO: 2576245 - RNA, 14 nt, Human
agcaucucaugagu

SEQ ID NO: 2576246 - RNA, 13 nt, Human
agcaucggaggga

SEQ ID NO: 2576247 - RNA, 17 nt, Human
agccaacuauggccugu

SEQ ID NO: 2576248 - RNA, 21 nt, Human
agccaacgacaaagccaaacu

SEQ ID NO: 2576249 - RNA, 19 nt, Human
agccaacuuggcuuucccg

SEQ ID NO: 2576250 - RNA, 14 nt, Human
agccaacuuggcuu

SEQ ID NO: 2576251 - RNA, 21 nt, Human
agccaacugcugcuuuuugag

SEQ ID NO: 2576252 - RNA, 14 nt, Human
agccaacugcugcu

SEQ ID NO: 2576253 - RNA, 13 nt, Human
agccaacugcugc

SEQ ID NO: 2576254 - RNA, 12 nt, Human
agccaacuccau

SEQ ID NO: 2576255 - RNA, 19 nt, Human
agccaacuuguaaauacac

SEQ ID NO: 2576256 - RNA, 18 nt, Human
agccaacuuguaaauaca

SEQ ID NO: 2576257 - RNA, 15 nt, Human
agccaacuuguaaau

SEQ ID NO: 2576258 - RNA, 20 nt, Human
agccaacuuggcuuucccgg

SEQ ID NO: 2576259 - RNA, 20 nt, Human
agccaacuuguaaauacacc

SEQ ID NO: 2576260 - RNA, 15 nt, Human
agccaacuuuugcau

SEQ ID NO: 2576261 - RNA, 13 nt, Human
agcaucugcuaau

SEQ ID NO: 2576262 - RNA, 19 nt, Human
agcaucucuugaggccagg

SEQ ID NO: 2576263 - RNA, 22 nt, Human
agcaucucuugaggccaggagu

SEQ ID NO: 2576264 - RNA, 13 nt, Human
agcaucucccagu

SEQ ID NO: 2576265 - RNA, 20 nt, Human
agcaucucccucacugaaac

SEQ ID NO: 2576266 - RNA, 22 nt, Human
agcaucucccucacugaaacca

SEQ ID NO: 2576267 - RNA, 17 nt, Human
agcaucucuugaggcca

SEQ ID NO: 2576268 - RNA, 22 nt, Human
agccagauuucacucuccuugg

SEQ ID NO: 2576269 - RNA, 20 nt, Human
agccagauuucacucuccuu

SEQ ID NO: 2576270 - RNA, 17 nt, Human
agccagauuucacucuc

SEQ ID NO: 2576271 - RNA, 14 nt, Human
agccagauuucacu

SEQ ID NO: 2576272 - RNA, 21 nt, Human
agccaagggaaccuguguccg

SEQ ID NO: 2576273 - RNA, 20 nt, Human
agccaagggaaccugugucc

SEQ ID NO: 2576274 - RNA, 19 nt, Human
agccaagggaaccuguguc

SEQ ID NO: 2576275 - RNA, 17 nt, Human
agccaagggaaccugug

SEQ ID NO: 2576276 - RNA, 14 nt, Human
agccaagaggcugc

SEQ ID NO: 2576277 - RNA, 16 nt, Human
agccaagggaaccugu

SEQ ID NO: 2576278 - RNA, 15 nt, Human
agccaagaggcugca

SEQ ID NO: 2576279 - RNA, 18 nt, Human
agccaaggguucagagac

SEQ ID NO: 2576280 - RNA, 15 nt, Human
agccaagggccucuu

SEQ ID NO: 2576281 - RNA, 22 nt, Human
agccaaggguucagagacucag

SEQ ID NO: 2576282 - RNA, 19 nt, Human
agccaaggugggcugagcc

SEQ ID NO: 2576283 - RNA, 20 nt, Human
agccaaggugggcugagccc

SEQ ID NO: 2576284 - RNA, 22 nt, Human
agccauuuguuggggcaguggu

SEQ ID NO: 2576285 - RNA, 18 nt, Human
agccauuuguuggggcag

SEQ ID NO: 2576286 - RNA, 17 nt, Human
agccauuuguuggggca

SEQ ID NO: 2576287 - RNA, 22 nt, Human
agccaagguuuuauaaggcuga

SEQ ID NO: 2576288 - RNA, 16 nt, Human
agccauuuugugaaug

SEQ ID NO: 2576289 - RNA, 15 nt, Human
agccauuuugugaau

SEQ ID NO: 2576290 - RNA, 14 nt, Human
agccauuuugugaa

SEQ ID NO: 2576291 - RNA, 20 nt, Human
agccauuuuggggggccccc

SEQ ID NO: 2576292 - RNA, 19 nt, Human
agccauuuugugaauggau

SEQ ID NO: 2576293 - RNA, 17 nt, Human
agccauuuugugaaugg

SEQ ID NO: 2576294 - RNA, 17 nt, Human
agcccaaaccaccagaa

SEQ ID NO: 2576295 - RNA, 19 nt, Human
agcccaaaccaccagaagc

SEQ ID NO: 2576296 - RNA, 20 nt, Human
agcccaaaccaccagaagcc

SEQ ID NO: 2576297 - RNA, 22 nt, Human
agcccaaaccaccagaagccca

SEQ ID NO: 2576298 - RNA, 21 nt, Human
agccagcaggcucucaggcca

SEQ ID NO: 2576299 - RNA, 22 nt, Human
agccagcaggcucucaggccag

SEQ ID NO: 2576300 - RNA, 23 nt, Human
agccagcaggcucucaggccagc

SEQ ID NO: 2576301 - RNA, 22 nt, Human
agccaaggugggcugagcccug

SEQ ID NO: 2576302 - RNA, 23 nt, Human
agccaaggugggcugagcccugg

SEQ ID NO: 2576303 - RNA, 19 nt, Human
agcccacgcccccacuggu

SEQ ID NO: 2576304 - RNA, 18 nt, Human
agcccacgcccccacugg

SEQ ID NO: 2576305 - RNA, 17 nt, Human
agcccacgcccccacug

SEQ ID NO: 2576306 - RNA, 21 nt, Human
agcccacccuccugucuuccc

SEQ ID NO: 2576307 - RNA, 23 nt, Human
agcccacccuccugucuucccag

SEQ ID NO: 2576308 - RNA, 19 nt, Human
agcccacccuccugucuuc

SEQ ID NO: 2576309 - RNA, 18 nt, Human
agcccacccuccugucuu

SEQ ID NO: 2576310 - RNA, 17 nt, Human
agcccacccuccugucu

SEQ ID NO: 2576311 - RNA, 16 nt, Human
agcccacccuccuguc

SEQ ID NO: 2576312 - RNA, 13 nt, Human
agcccaccuuggc

SEQ ID NO: 2576313 - RNA, 23 nt, Human
agcccaccccucaacaccucugc

SEQ ID NO: 2576314 - RNA, 13 nt, Human
agcccaaagaagg

SEQ ID NO: 2576315 - RNA, 15 nt, Human
agcccacccuccugu

SEQ ID NO: 2576316 - RNA, 14 nt, Human
agcccacccuccug

SEQ ID NO: 2576317 - RNA, 13 nt, Human
agcccacccuccu

SEQ ID NO: 2576318 - RNA, 20 nt, Human
agaagucaugaagcccaagu

SEQ ID NO: 2576319 - RNA, 14 nt, Human
agaagucacacagu

SEQ ID NO: 2576320 - RNA, 22 nt, Human
agaauccuggcccucuguguug

SEQ ID NO: 2576321 - RNA, 20 nt, Human
agaauccuggcccucugugu

SEQ ID NO: 2576322 - RNA, 21 nt, Human
agaauccuaggcuccacccca

SEQ ID NO: 2576323 - RNA, 15 nt, Human
agaagucuuagacuu

SEQ ID NO: 2576324 - RNA, 17 nt, Human
agaagucuuagauguau

SEQ ID NO: 2576325 - RNA, 19 nt, Human
agaagucuuagauguauau

SEQ ID NO: 2576326 - RNA, 17 nt, Human
agaagucaaaguaaaac

SEQ ID NO: 2576327 - RNA, 23 nt, Human
agaagggcuagaaccuggagagc

SEQ ID NO: 2576328 - RNA, 21 nt, Human
agaagggcuagaaccuggaga

SEQ ID NO: 2576329 - RNA, 14 nt, Human
agaagggcuagaac

SEQ ID NO: 2576330 - RNA, 13 nt, Human
agaagggcuagaa

SEQ ID NO: 2576331 - RNA, 21 nt, Human
agaagggcuagaaccuggagg

SEQ ID NO: 2576332 - RNA, 21 nt, Human
agaagggauggauuccaaccc

SEQ ID NO: 2576333 - RNA, 19 nt, Human
agaagggccaguccugccu

SEQ ID NO: 2576334 - RNA, 20 nt, Human
agaagggccaguccugccug

SEQ ID NO: 2576335 - RNA, 14 nt, Human
agaagggagaagaa

SEQ ID NO: 2576336 - RNA, 19 nt, Human
agaagaugaauacaaacaa

SEQ ID NO: 2576337 - RNA, 14 nt, Human
agaagaugaauaca

SEQ ID NO: 2576338 - RNA, 16 nt, Human
agaagaugaucagacc

SEQ ID NO: 2576339 - RNA, 13 nt, Human
agaagaugaauac

SEQ ID NO: 2576340 - RNA, 18 nt, Human
agaagaugaaugagcaaa

SEQ ID NO: 2576341 - RNA, 11 nt, Human
agaagggaggc

SEQ ID NO: 2576342 - RNA, 14 nt, Human
agaagggagaagga

SEQ ID NO: 2576343 - RNA, 15 nt, Human
agaagggagaagaaa

SEQ ID NO: 2576344 - RNA, 17 nt, Human
agaagaugaucagaccu

SEQ ID NO: 2576345 - RNA, 13 nt, Human
agaagggagaagg

SEQ ID NO: 2576346 - RNA, 16 nt, Human
agaagggagaagaaag

SEQ ID NO: 2576347 - RNA, 20 nt, Human
agaagagcuguucacagcca

SEQ ID NO: 2576348 - RNA, 16 nt, Human
agaagauccuacccca

SEQ ID NO: 2576349 - RNA, 18 nt, Human
agaagauccuaaaacaaa

SEQ ID NO: 2576350 - RNA, 17 nt, Human
agaagauccuaaaacaa

SEQ ID NO: 2576351 - RNA, 14 nt, Human
agaagauccccuca

SEQ ID NO: 2576352 - RNA, 13 nt, Human
agaagauccccuc

SEQ ID NO: 2576353 - RNA, 23 nt, Human
agaagaucacgcuccccgccugu

SEQ ID NO: 2576354 - RNA, 19 nt, Human
agaagaucacgcuccccgc

SEQ ID NO: 2576355 - RNA, 22 nt, Human
agaagauauuagucuuggggca

SEQ ID NO: 2576356 - RNA, 20 nt, Human
agaagagccggagccuccag

SEQ ID NO: 2576357 - RNA, 23 nt, Human
agaagagaaugcacaaacagagg

SEQ ID NO: 2576358 - RNA, 15 nt, Human
agaagagaaugcaca

SEQ ID NO: 2576359 - RNA, 13 nt, Human
agaagagcuguuc

SEQ ID NO: 2576360 - RNA, 22 nt, Human
agaagagaauauuagcuuuacu

SEQ ID NO: 2576361 - RNA, 21 nt, Human
agaagacugcauuauauuuau

SEQ ID NO: 2576362 - RNA, 18 nt, Human
agaaccaguuucaggugu

SEQ ID NO: 2576363 - RNA, 22 nt, Human
agaaccaucccuauuuuguauu

SEQ ID NO: 2576364 - RNA, 16 nt, Human
agaaccagucccccca

SEQ ID NO: 2576365 - RNA, 19 nt, Human
agaaccaguccccccaccc

SEQ ID NO: 2576366 - RNA, 20 nt, Human
agaaccaguccccccacccu

SEQ ID NO: 2576367 - RNA, 20 nt, Human
agaaccaggcaacuugggaa

SEQ ID NO: 2576368 - RNA, 13 nt, Human
agaaccacuauga

SEQ ID NO: 2576369 - RNA, 16 nt, Human
agaaccaaaucuggaa

SEQ ID NO: 2576370 - RNA, 13 nt, Human
agaaccaaaucug

SEQ ID NO: 2576371 - RNA, 18 nt, Human
agaaccaaaucuggaagc

SEQ ID NO: 2576372 - RNA, 16 nt, Human
agaaccaagaagggcu

SEQ ID NO: 2576373 - RNA, 17 nt, Human
agaaccaggcaacuugg

SEQ ID NO: 2576374 - RNA, 21 nt, Human
agaaccaaaaagaggcuaugu

SEQ ID NO: 2576375 - RNA, 20 nt, Human
agaaccaaaaguuuuccuga

SEQ ID NO: 2576376 - RNA, 18 nt, Human
agaaccaaaaguuuuccu

SEQ ID NO: 2576377 - RNA, 16 nt, Human
agaacauuuuaauuca

SEQ ID NO: 2576378 - RNA, 13 nt, Human
agaacauuuuaau

SEQ ID NO: 2576379 - RNA, 18 nt, Human
agaaugcucuuuacuuca

SEQ ID NO: 2576380 - RNA, 12 nt, Human
agaaugaggcug

SEQ ID NO: 2576381 - RNA, 13 nt, Human
agaaugaggcugc

SEQ ID NO: 2576382 - RNA, 14 nt, Human
agaaugaggcugcu

SEQ ID NO: 2576383 - RNA, 20 nt, Human
agaaugaggcugcuuuccaa

SEQ ID NO: 2576384 - RNA, 23 nt, Human
agaaugcacaaacagaggccgcc

SEQ ID NO: 2576385 - RNA, 17 nt, Human
agaaugaggaggaagga

SEQ ID NO: 2576386 - RNA, 16 nt, Human
agaaugagggccaaga

SEQ ID NO: 2576387 - RNA, 16 nt, Human
agaaugaaagggccca

SEQ ID NO: 2576388 - RNA, 21 nt, Human
agaaugaaagaguaaaggaaa

SEQ ID NO: 2576389 - RNA, 21 nt, Human
agaaugagccuacgcugaaga

SEQ ID NO: 2576390 - RNA, 15 nt, Human
agaaugaaagcuccu

SEQ ID NO: 2576391 - RNA, 12 nt, Human
agaaugagccuc

SEQ ID NO: 2576392 - RNA, 13 nt, Human
agaaugaggagga

SEQ ID NO: 2576393 - RNA, 16 nt, Human
agaaugaggaggaagg

SEQ ID NO: 2576394 - RNA, 19 nt, Human
agaaucuuuauugagaaag

SEQ ID NO: 2576395 - RNA, 18 nt, Human
agaaucuuuauugagaaa

SEQ ID NO: 2576396 - RNA, 17 nt, Human
agaaucuuuauugagaa

SEQ ID NO: 2576397 - RNA, 16 nt, Human
agaaucuuuauugaga

SEQ ID NO: 2576398 - RNA, 23 nt, Human
agaaucuuuagagaaguauacau

SEQ ID NO: 2576399 - RNA, 14 nt, Human
agaaucuuuagaga

SEQ ID NO: 2576400 - RNA, 19 nt, Human
agaaugaaagaguaaagga

SEQ ID NO: 2576401 - RNA, 12 nt, Human
agaaugaaagag

SEQ ID NO: 2576402 - RNA, 17 nt, Human
agaaugaaaauuguaug

SEQ ID NO: 2576403 - RNA, 16 nt, Human
agaaugaaaacucauu

SEQ ID NO: 2576404 - RNA, 24 nt, Human
agaaucuuuauugagaaagagcac

SEQ ID NO: 2576405 - RNA, 21 nt, Human
agaaucuuuauugagaaagag

SEQ ID NO: 2576406 - RNA, 17 nt, Human
agaaucucaaauaacua

SEQ ID NO: 2576407 - RNA, 16 nt, Human
agaaucuaaagccagu

SEQ ID NO: 2576408 - RNA, 17 nt, Human
agaaucuacccaaagga

SEQ ID NO: 2576409 - RNA, 15 nt, Human
agaaucuaaagccag

SEQ ID NO: 2576410 - RNA, 19 nt, Human
agaaucuguuucccagcag

SEQ ID NO: 2576411 - RNA, 16 nt, Human
agaaucuggagagcua

SEQ ID NO: 2576412 - RNA, 13 nt, Human
agaaucuggagag

SEQ ID NO: 2576413 - RNA, 18 nt, Human
agaaucuauauuuaacaa

SEQ ID NO: 2576414 - RNA, 19 nt, Human
agaaucuacccaaaggaua

SEQ ID NO: 2576415 - RNA, 15 nt, Human
agaacaaugugcuau

SEQ ID NO: 2576416 - RNA, 21 nt, Human
agaacaauauugacuuugucu

SEQ ID NO: 2576417 - RNA, 20 nt, Human
agaacaauauugacuuuguc

SEQ ID NO: 2576418 - RNA, 21 nt, Human
agaacacagaaagccuaucaa

SEQ ID NO: 2576419 - RNA, 19 nt, Human
agaacacagaaagccuauc

SEQ ID NO: 2576420 - RNA, 16 nt, Human
agaacacaaggucauu

SEQ ID NO: 2576421 - RNA, 20 nt, Human
agaacaaagugagacagucc

SEQ ID NO: 2576422 - RNA, 17 nt, Human
agaacaaccaaaaucuu

SEQ ID NO: 2576423 - RNA, 17 nt, Human
agaacaagguaguuuuu

SEQ ID NO: 2576424 - RNA, 19 nt, Human
agaacaagguaguuuuuac

SEQ ID NO: 2576425 - RNA, 19 nt, Human
agaacaauauugacuuugu

SEQ ID NO: 2576426 - RNA, 17 nt, Human
agaacaauauugacuuu

SEQ ID NO: 2576427 - RNA, 14 nt, Human
agaacacuaaccug

SEQ ID NO: 2576428 - RNA, 13 nt, Human
agaacacuaaccu

SEQ ID NO: 2576429 - RNA, 12 nt, Human
agaacacuaacc

SEQ ID NO: 2576430 - RNA, 14 nt, Human
agaacacgcuuuca

SEQ ID NO: 2576431 - RNA, 15 nt, Human
agaacacccucuaaa

SEQ ID NO: 2576432 - RNA, 21 nt, Human
agaacacagccgauucaccug

SEQ ID NO: 2576433 - RNA, 19 nt, Human
agaacagauaaucagugug

SEQ ID NO: 2576434 - RNA, 14 nt, Human
agaacacugugaaa

SEQ ID NO: 2576435 - RNA, 17 nt, Human
agaacaucccuccuggg

SEQ ID NO: 2576436 - RNA, 13 nt, Human
agaacaucccucc

SEQ ID NO: 2576437 - RNA, 14 nt, Human
agaacauggacuug

SEQ ID NO: 2576438 - RNA, 20 nt, Human
agaacaucuguauacccucu

SEQ ID NO: 2576439 - RNA, 18 nt, Human
agaacaucccugccagcu

SEQ ID NO: 2576440 - RNA, 19 nt, Human
agaacaucccugccagcuc

SEQ ID NO: 2576441 - RNA, 20 nt, Human
agaacaucauuagaacaaag

SEQ ID NO: 2576442 - RNA, 18 nt, Human
agaacaucauuagaacaa

SEQ ID NO: 2576443 - RNA, 16 nt, Human
agaacaucauuagaac

SEQ ID NO: 2576444 - RNA, 15 nt, Human
agaacaucauuagaa

SEQ ID NO: 2576445 - RNA, 15 nt, Human
agaacauccaaggag

SEQ ID NO: 2576446 - RNA, 18 nt, Human
agaacauccaaggagaaa

SEQ ID NO: 2576447 - RNA, 16 nt, Human
agaacaucccugccag

SEQ ID NO: 2576448 - RNA, 17 nt, Human
agaacaucccugccagc

SEQ ID NO: 2576449 - RNA, 18 nt, Human
agaaccaaaaagaggcua

SEQ ID NO: 2576450 - RNA, 17 nt, Human
agaaccaaaaagaggcu

SEQ ID NO: 2576451 - RNA, 22 nt, Human
agaacaugugagagguuugacu

SEQ ID NO: 2576452 - RNA, 13 nt, Human
agaacaugugaga

SEQ ID NO: 2576453 - RNA, 16 nt, Human
agaacauggacuugua

SEQ ID NO: 2576454 - RNA, 18 nt, Human
agaacaucuguccuguga

SEQ ID NO: 2576455 - RNA, 19 nt, Human
agaacauggacuuguauau

SEQ ID NO: 2576456 - RNA, 17 nt, Human
agaacacugugaaaaca

SEQ ID NO: 2576457 - RNA, 23 nt, Human
agaacagcaggguagucugguuu

SEQ ID NO: 2576458 - RNA, 13 nt, Human
agaacagcagagg

SEQ ID NO: 2576459 - RNA, 18 nt, Human
agaacagccgcuccuguc

SEQ ID NO: 2576460 - RNA, 19 nt, Human
agaacagccgcuccugucu

SEQ ID NO: 2576461 - RNA, 20 nt, Human
agaacagccgcuccugucug

SEQ ID NO: 2576462 - RNA, 18 nt, Human
agaacagcuucagguuau

SEQ ID NO: 2576463 - RNA, 16 nt, Human
agaacagcuucagguu

SEQ ID NO: 2576464 - RNA, 14 nt, Human
agaacagcuucagg

SEQ ID NO: 2576465 - RNA, 13 nt, Human
agaacagcuucag

SEQ ID NO: 2576466 - RNA, 22 nt, Human
agaacagcuucagguuaucgaa

SEQ ID NO: 2576467 - RNA, 16 nt, Human
agaacaggcaagugaa

SEQ ID NO: 2576468 - RNA, 12 nt, Human
agaacagcuuca

SEQ ID NO: 2576469 - RNA, 18 nt, Human
agaacagcagagguucuu

SEQ ID NO: 2576470 - RNA, 22 nt, Human
agaacagccgcuccugucugcc

SEQ ID NO: 2576471 - RNA, 23 nt, Human
agaacagccgcuccugucugcca

SEQ ID NO: 2576472 - RNA, 22 nt, Human
agaacagugauuaccagggacu

SEQ ID NO: 2576473 - RNA, 13 nt, Human
agaacaguaaaca

SEQ ID NO: 2576474 - RNA, 17 nt, Human
agaacaguuuguacaga

SEQ ID NO: 2576475 - RNA, 15 nt, Human
agaacaguuuguaca

SEQ ID NO: 2576476 - RNA, 14 nt, Human
agaacaguaaacau

SEQ ID NO: 2576477 - RNA, 21 nt, Human
agaacagugcuugccacagag

SEQ ID NO: 2576478 - RNA, 14 nt, Human
agaacaucauuaga

SEQ ID NO: 2576479 - RNA, 11 nt, Human
agaacauagaa

SEQ ID NO: 2576480 - RNA, 16 nt, Human
agacucuuuggacacu

SEQ ID NO: 2576481 - RNA, 20 nt, Human
agagaagugacagggaagcu

SEQ ID NO: 2576482 - RNA, 18 nt, Human
agagaagugacagggaag

SEQ ID NO: 2576483 - RNA, 17 nt, Human
agagaagugacagggaa

SEQ ID NO: 2576484 - RNA, 15 nt, Human
agagaagugacaggg

SEQ ID NO: 2576485 - RNA, 14 nt, Human
agagaagugacagg

SEQ ID NO: 2576486 - RNA, 14 nt, Human
agagaagugccccu

SEQ ID NO: 2576487 - RNA, 15 nt, Human
agagaagugccccug

SEQ ID NO: 2576488 - RNA, 17 nt, Human
agagaagugccccugcu

SEQ ID NO: 2576489 - RNA, 18 nt, Human
agagaagugccccugcug

SEQ ID NO: 2576490 - RNA, 19 nt, Human
agagagaugggagcuccuc

SEQ ID NO: 2576491 - RNA, 18 nt, Human
agagagaugggagcuccu

SEQ ID NO: 2576492 - RNA, 17 nt, Human
agagagaugggagcucc

SEQ ID NO: 2576493 - RNA, 21 nt, Human
agagagaucaaauggaaagga

SEQ ID NO: 2576494 - RNA, 13 nt, Human
agagaauauuuua

SEQ ID NO: 2576495 - RNA, 15 nt, Human
agagaaucaacauuu

SEQ ID NO: 2576496 - RNA, 12 nt, Human
agagaaucaaca

SEQ ID NO: 2576497 - RNA, 22 nt, Human
agagaauauuagcuuuacuguu

SEQ ID NO: 2576498 - RNA, 14 nt, Human
agagaaauaugaag

SEQ ID NO: 2576499 - RNA, 14 nt, Human
agagaaauauggaa

SEQ ID NO: 2576500 - RNA, 16 nt, Human
agagaaguauuauaaa

SEQ ID NO: 2576501 - RNA, 18 nt, Human
agagaaguauacauaagu

SEQ ID NO: 2576502 - RNA, 22 nt, Human
agagaaccucacgcaccuccca

SEQ ID NO: 2576503 - RNA, 17 nt, Human
agagaaccgagcaaaga

SEQ ID NO: 2576504 - RNA, 15 nt, Human
agagaaccgagcaaa

SEQ ID NO: 2576505 - RNA, 21 nt, Human
agagaaccgagcaaagaucaa

SEQ ID NO: 2576506 - RNA, 20 nt, Human
agagaaccgagcaaagauca

SEQ ID NO: 2576507 - RNA, 20 nt, Human
agagaaccucacgcaccucc

SEQ ID NO: 2576508 - RNA, 18 nt, Human
agagaaacaauaaagaga

SEQ ID NO: 2576509 - RNA, 14 nt, Human
agagaaagaagaga

SEQ ID NO: 2576510 - RNA, 24 nt, Human
agagaaagugggugagaugcugga

SEQ ID NO: 2576511 - RNA, 19 nt, Human
agagaaagugauuucuaga

SEQ ID NO: 2576512 - RNA, 18 nt, Human
agagaaagugauuucuag

SEQ ID NO: 2576513 - RNA, 16 nt, Human
agagaaagaaaaugaa

SEQ ID NO: 2576514 - RNA, 15 nt, Human
agagaaagaaaauga

SEQ ID NO: 2576515 - RNA, 21 nt, Human
agacucuuuuuguaccuggug

SEQ ID NO: 2576516 - RNA, 15 nt, Human
agacucuuugcauau

SEQ ID NO: 2576517 - RNA, 22 nt, Human
agacucuuuuuguaccugguga

SEQ ID NO: 2576518 - RNA, 17 nt, Human
agacugaacauguacac

SEQ ID NO: 2576519 - RNA, 23 nt, Human
agacucuuuuuguaccuggugac

SEQ ID NO: 2576520 - RNA, 18 nt, Human
agacugaacuuaccguga

SEQ ID NO: 2576521 - RNA, 12 nt, Human
agacugaccaau

SEQ ID NO: 2576522 - RNA, 20 nt, Human
agagaaaauaaaaaguuaaa

SEQ ID NO: 2576523 - RNA, 19 nt, Human
agagaaaauaaaaaguuaa

SEQ ID NO: 2576524 - RNA, 18 nt, Human
agagaaaauaaaaaguua

SEQ ID NO: 2576525 - RNA, 19 nt, Human
agagccugcaggugcugcu

SEQ ID NO: 2576526 - RNA, 18 nt, Human
agagccugcaggugcugc

SEQ ID NO: 2576527 - RNA, 17 nt, Human
agagccugcaggugcug

SEQ ID NO: 2576528 - RNA, 17 nt, Human
agagccugccuggagcg

SEQ ID NO: 2576529 - RNA, 16 nt, Human
agagccugccuggagc

SEQ ID NO: 2576530 - RNA, 15 nt, Human
agagccugccuggag

SEQ ID NO: 2576531 - RNA, 13 nt, Human
agagccugcuccc

SEQ ID NO: 2576532 - RNA, 15 nt, Human
agagccugcuccccc

SEQ ID NO: 2576533 - RNA, 16 nt, Human
agagccugcuccccca

SEQ ID NO: 2576534 - RNA, 18 nt, Human
agagccugcucccccacc

SEQ ID NO: 2576535 - RNA, 11 nt, Human
agagccugcug

SEQ ID NO: 2576536 - RNA, 19 nt, Human
agagccugcucccccaccc

SEQ ID NO: 2576537 - RNA, 20 nt, Human
agagccugcucccccacccc

SEQ ID NO: 2576538 - RNA, 12 nt, Human
agagccugcugc

SEQ ID NO: 2576539 - RNA, 13 nt, Human
agagccugaggga

SEQ ID NO: 2576540 - RNA, 14 nt, Human
agagccugagggau

SEQ ID NO: 2576541 - RNA, 11 nt, Human
agagccugagg

SEQ ID NO: 2576542 - RNA, 14 nt, Human
agagcccagcucca

SEQ ID NO: 2576543 - RNA, 12 nt, Human
agagcccagcuc

SEQ ID NO: 2576544 - RNA, 13 nt, Human
agagcccagcucc

SEQ ID NO: 2576545 - RNA, 17 nt, Human
agagcccacgcccccac

SEQ ID NO: 2576546 - RNA, 20 nt, Human
agagcccagagguaacagaa

SEQ ID NO: 2576547 - RNA, 16 nt, Human
agagcccagagguaac

SEQ ID NO: 2576548 - RNA, 14 nt, Human
agagcccagaggua

SEQ ID NO: 2576549 - RNA, 24 nt, Human
agagcccagagguaacagaacagc

SEQ ID NO: 2576550 - RNA, 22 nt, Human
agagcccagagguaacagaaca

SEQ ID NO: 2576551 - RNA, 21 nt, Human
agagcccagcagggccucaaa

SEQ ID NO: 2576552 - RNA, 14 nt, Human
agagcccagccauu

SEQ ID NO: 2576553 - RNA, 19 nt, Human
agagagcaagacgcugugc

SEQ ID NO: 2576554 - RNA, 11 nt, Human
agagagcaaga

SEQ ID NO: 2576555 - RNA, 23 nt, Human
agagagcaagacgcugugcugcc

SEQ ID NO: 2576556 - RNA, 14 nt, Human
agagagauguuuug

SEQ ID NO: 2576557 - RNA, 17 nt, Human
agagaggagaggagaga

SEQ ID NO: 2576558 - RNA, 13 nt, Human
agagaggagucag

SEQ ID NO: 2576559 - RNA, 20 nt, Human
agagaggagucagagagaau

SEQ ID NO: 2576560 - RNA, 18 nt, Human
agagcccacgcccccacu

SEQ ID NO: 2576561 - RNA, 17 nt, Human
agagaggaguucaauga

SEQ ID NO: 2576562 - RNA, 15 nt, Human
agagaggaguucaau

SEQ ID NO: 2576563 - RNA, 14 nt, Human
agagaggaguucaa

SEQ ID NO: 2576564 - RNA, 13 nt, Human
agagaggaguuca

SEQ ID NO: 2576565 - RNA, 21 nt, Human
agagaggaguucaaugaucua

SEQ ID NO: 2576566 - RNA, 18 nt, Human
agagaggaguucaaugau

SEQ ID NO: 2576567 - RNA, 13 nt, Human
agagaggcagaga

SEQ ID NO: 2576568 - RNA, 16 nt, Human
agagaggcagagagcg

SEQ ID NO: 2576569 - RNA, 15 nt, Human
agagaggcagagagc

SEQ ID NO: 2576570 - RNA, 14 nt, Human
agagaggcagagag

SEQ ID NO: 2576571 - RNA, 16 nt, Human
agacaaaaacagccuc

SEQ ID NO: 2576572 - RNA, 15 nt, Human
agaauuuugagcagg

SEQ ID NO: 2576573 - RNA, 20 nt, Human
agaauuuucagaccccagcg

SEQ ID NO: 2576574 - RNA, 21 nt, Human
agaauuuucagaccccagcgg

SEQ ID NO: 2576575 - RNA, 19 nt, Human
agacaaggaaaaaauaaca

SEQ ID NO: 2576576 - RNA, 14 nt, Human
agacaagcaacagg

SEQ ID NO: 2576577 - RNA, 17 nt, Human
agacaaaaacagccuca

SEQ ID NO: 2576578 - RNA, 22 nt, Human
agacaaaaacagccucacagaa

SEQ ID NO: 2576579 - RNA, 17 nt, Human
agacaagccuggccuac

SEQ ID NO: 2576580 - RNA, 13 nt, Human
agacaagcugcaa

SEQ ID NO: 2576581 - RNA, 16 nt, Human
agacaagguagcccug

SEQ ID NO: 2576582 - RNA, 23 nt, Human
agacaaugacuuacuguacauga

SEQ ID NO: 2576583 - RNA, 20 nt, Human
agacaaugugaaaagaaaaa

SEQ ID NO: 2576584 - RNA, 18 nt, Human
agacaauucuuuauacaa

SEQ ID NO: 2576585 - RNA, 14 nt, Human
agacaauucuuuau

SEQ ID NO: 2576586 - RNA, 22 nt, Human
agacaauucuuuauacaacagu

SEQ ID NO: 2576587 - RNA, 13 nt, Human
agacaauucuuua

SEQ ID NO: 2576588 - RNA, 19 nt, Human
agacgcugugcugcccugc

SEQ ID NO: 2576589 - RNA, 18 nt, Human
agacgcugugcugcccug

SEQ ID NO: 2576590 - RNA, 23 nt, Human
agacgaggcccucgggcccagcc

SEQ ID NO: 2576591 - RNA, 22 nt, Human
agacgaggcccucgggcccagc

SEQ ID NO: 2576592 - RNA, 20 nt, Human
agacgaggcccucgggccca

SEQ ID NO: 2576593 - RNA, 17 nt, Human
agacgaggcccucgggc

SEQ ID NO: 2576594 - RNA, 13 nt, Human
agacgaggcccuc

SEQ ID NO: 2576595 - RNA, 15 nt, Human
agacgagaggacgag

SEQ ID NO: 2576596 - RNA, 21 nt, Human
agacgacaaggaaaggcaaau

SEQ ID NO: 2576597 - RNA, 17 nt, Human
agacgcugugcugcccu

SEQ ID NO: 2576598 - RNA, 23 nt, Human
agacuagaauucuagugcugcug

SEQ ID NO: 2576599 - RNA, 22 nt, Human
agacuagaauucuagugcugcu

SEQ ID NO: 2576600 - RNA, 20 nt, Human
agacgcugugcugcccugcc

SEQ ID NO: 2576601 - RNA, 16 nt, Human
agacuagauugccuuu

SEQ ID NO: 2576602 - RNA, 19 nt, Human
agacuagauugccuuuguu

SEQ ID NO: 2576603 - RNA, 22 nt, Human
agacuaguuuuuauuccuugug

SEQ ID NO: 2576604 - RNA, 15 nt, Human
agacuaucagcccaa

SEQ ID NO: 2576605 - RNA, 17 nt, Human
agacuauauuguacaca

SEQ ID NO: 2576606 - RNA, 23 nt, Human
agacagcccgggcucugccuccc

SEQ ID NO: 2576607 - RNA, 22 nt, Human
agacagcccgggcucugccucc

SEQ ID NO: 2576608 - RNA, 14 nt, Human
agacaauuuauuau

SEQ ID NO: 2576609 - RNA, 21 nt, Human
agacagcccgggcucugccuc

SEQ ID NO: 2576610 - RNA, 24 nt, Human
agaccacgcccguccugccugugg

SEQ ID NO: 2576611 - RNA, 23 nt, Human
agaccacgcccguccugccugug

SEQ ID NO: 2576612 - RNA, 21 nt, Human
agaccacgcccguccugccug

SEQ ID NO: 2576613 - RNA, 20 nt, Human
agaccacgcccguccugccu

SEQ ID NO: 2576614 - RNA, 16 nt, Human
agaccaccccgccugc

SEQ ID NO: 2576615 - RNA, 19 nt, Human
agaccacgcccguccugcc

SEQ ID NO: 2576616 - RNA, 14 nt, Human
agaccaccccgccu

SEQ ID NO: 2576617 - RNA, 20 nt, Human
agacagccuguaucuugggg

SEQ ID NO: 2576618 - RNA, 11 nt, Human
agacagccugu

SEQ ID NO: 2576619 - RNA, 13 nt, Human
agacagcccucca

SEQ ID NO: 2576620 - RNA, 23 nt, Human
agaccaucccugaaggccccgcc

SEQ ID NO: 2576621 - RNA, 14 nt, Human
agaccacguuucua

SEQ ID NO: 2576622 - RNA, 17 nt, Human
agaccaugcagagcgcc

SEQ ID NO: 2576623 - RNA, 16 nt, Human
agaccaugcagagcgc

SEQ ID NO: 2576624 - RNA, 18 nt, Human
agacgaaacauuuguucu

SEQ ID NO: 2576625 - RNA, 17 nt, Human
agaccuuuucaacuugg

SEQ ID NO: 2576626 - RNA, 12 nt, Human
agaccuuuucaa

SEQ ID NO: 2576627 - RNA, 22 nt, Human
agaccuuguucacacucucaca

SEQ ID NO: 2576628 - RNA, 20 nt, Human
agaccuuugaggauaucaaa

SEQ ID NO: 2576629 - RNA, 21 nt, Human
agaccuuguucacacucucac

SEQ ID NO: 2576630 - RNA, 16 nt, Human
aggcagaaaauugcac

SEQ ID NO: 2576631 - RNA, 20 nt, Human
aggcacuuuagggcuguaaa

SEQ ID NO: 2576632 - RNA, 14 nt, Human
aggcagaaagcaaa

SEQ ID NO: 2576633 - RNA, 16 nt, Human
aggcagaaagcaaaau

SEQ ID NO: 2576634 - RNA, 19 nt, Human
aggcagaaagcaaaauuau

SEQ ID NO: 2576635 - RNA, 22 nt, Human
aggcacuuuagggcuguaaaau

SEQ ID NO: 2576636 - RNA, 20 nt, Human
aggcagagguugcagugagc

SEQ ID NO: 2576637 - RNA, 13 nt, Human
aggcagauacagg

SEQ ID NO: 2576638 - RNA, 22 nt, Human
aggcagaacucaucuagguaaa

SEQ ID NO: 2576639 - RNA, 21 nt, Human
aggcagaagaauugaacccag

SEQ ID NO: 2576640 - RNA, 15 nt, Human
aggcagaagaauuga

SEQ ID NO: 2576641 - RNA, 16 nt, Human
aggcagccaggccaca

SEQ ID NO: 2576642 - RNA, 15 nt, Human
aggcagccaggccac

SEQ ID NO: 2576643 - RNA, 14 nt, Human
aggcagccaggcca

SEQ ID NO: 2576644 - RNA, 15 nt, Human
aggcagauccaggac

SEQ ID NO: 2576645 - RNA, 16 nt, Human
aggcagauccaggacu

SEQ ID NO: 2576646 - RNA, 11 nt, Human
aggcagaucca

SEQ ID NO: 2576647 - RNA, 23 nt, Human
aggccaggcccucugcccacucc

SEQ ID NO: 2576648 - RNA, 19 nt, Human
aggccaggcccucugccca

SEQ ID NO: 2576649 - RNA, 18 nt, Human
aggccaggcccucugccc

SEQ ID NO: 2576650 - RNA, 17 nt, Human
aggccaggcccucugcc

SEQ ID NO: 2576651 - RNA, 16 nt, Human
aggccaggcccucugc

SEQ ID NO: 2576652 - RNA, 16 nt, Human
aggccagcugcuuggg

SEQ ID NO: 2576653 - RNA, 14 nt, Human
aggccagcugcuug

SEQ ID NO: 2576654 - RNA, 13 nt, Human
aggccagcugcuu

SEQ ID NO: 2576655 - RNA, 23 nt, Human
aggccaugggcacuguggguaga

SEQ ID NO: 2576656 - RNA, 19 nt, Human
aggccagggggccaguccc

SEQ ID NO: 2576657 - RNA, 23 nt, Human
aggccagggggccagucccugag

SEQ ID NO: 2576658 - RNA, 12 nt, Human
aggccaggccgg

SEQ ID NO: 2576659 - RNA, 18 nt, Human
aggcauugcacagggaga

SEQ ID NO: 2576660 - RNA, 11 nt, Human
aggccaggcuc

SEQ ID NO: 2576661 - RNA, 13 nt, Human
aggccagggcaga

SEQ ID NO: 2576662 - RNA, 15 nt, Human
aggccagggcagagu

SEQ ID NO: 2576663 - RNA, 12 nt, Human
aggccaggcucc

SEQ ID NO: 2576664 - RNA, 17 nt, Human
aggccaggcuccuuccu

SEQ ID NO: 2576665 - RNA, 22 nt, Human
aggccaggcuccuuccugucuu

SEQ ID NO: 2576666 - RNA, 17 nt, Human
aggcccucugcccacuc

SEQ ID NO: 2576667 - RNA, 17 nt, Human
aggccaugggccuccug

SEQ ID NO: 2576668 - RNA, 16 nt, Human
aggccaugggccuccu

SEQ ID NO: 2576669 - RNA, 14 nt, Human
aggccaugggccuc

SEQ ID NO: 2576670 - RNA, 22 nt, Human
aggcauguucucugaggacacu

SEQ ID NO: 2576671 - RNA, 20 nt, Human
aggcauguucucugaggaca

SEQ ID NO: 2576672 - RNA, 21 nt, Human
aggcauuccccaggaggccag

SEQ ID NO: 2576673 - RNA, 22 nt, Human
aggcauuaaauuuuagcaaaga

SEQ ID NO: 2576674 - RNA, 14 nt, Human
aggcauuaaauuuu

SEQ ID NO: 2576675 - RNA, 15 nt, Human
aggcaugccugugug

SEQ ID NO: 2576676 - RNA, 23 nt, Human
aggcauuccccaggaggccagcc

SEQ ID NO: 2576677 - RNA, 22 nt, Human
aggcauuccccaggaggccagc

SEQ ID NO: 2576678 - RNA, 12 nt, Human
aggccagcugcu

SEQ ID NO: 2576679 - RNA, 13 nt, Human
aggcauuccagcu

SEQ ID NO: 2576680 - RNA, 12 nt, Human
aggcauucaagu

SEQ ID NO: 2576681 - RNA, 24 nt, Human
aggcauuccagcuccuccgugcuu

SEQ ID NO: 2576682 - RNA, 13 nt, Human
aggcauucucuga

SEQ ID NO: 2576683 - RNA, 17 nt, Human
aggcaucgcaauguaag

SEQ ID NO: 2576684 - RNA, 11 nt, Human
aggcaugaagg

SEQ ID NO: 2576685 - RNA, 14 nt, Human
aggcaucugcaccc

SEQ ID NO: 2576686 - RNA, 15 nt, Human
aggcaugagggauca

SEQ ID NO: 2576687 - RNA, 23 nt, Human
aggcaugagggaucacagggccc

SEQ ID NO: 2576688 - RNA, 19 nt, Human
aggcaucugugggcauggu

SEQ ID NO: 2576689 - RNA, 24 nt, Human
aggcaugugaugagaggaaaucac

SEQ ID NO: 2576690 - RNA, 23 nt, Human
aggcaugugaugagaggaaauca

SEQ ID NO: 2576691 - RNA, 12 nt, Human
aggcauguucuc

SEQ ID NO: 2576692 - RNA, 20 nt, Human
aggcaugagggaucacaggg

SEQ ID NO: 2576693 - RNA, 22 nt, Human
aggcaugagggaucacagggcc

SEQ ID NO: 2576694 - RNA, 13 nt, Human
aggcaugccugug

SEQ ID NO: 2576695 - RNA, 14 nt, Human
aggcaugccugugu

SEQ ID NO: 2576696 - RNA, 22 nt, Human
aggcaugugccacccacccaac

SEQ ID NO: 2576697 - RNA, 21 nt, Human
aggaugugauauauaagugua

SEQ ID NO: 2576698 - RNA, 18 nt, Human
aggaugugauauauaagu

SEQ ID NO: 2576699 - RNA, 20 nt, Human
aggaugugauuguggaaugg

SEQ ID NO: 2576700 - RNA, 15 nt, Human
aggaugugugcaugu

SEQ ID NO: 2576701 - RNA, 21 nt, Human
aggaugugggggaagaccugg

SEQ ID NO: 2576702 - RNA, 16 nt, Human
aggaugugugcaugug

SEQ ID NO: 2576703 - RNA, 14 nt, Human
aggaugugugcaug

SEQ ID NO: 2576704 - RNA, 19 nt, Human
aggaugggggcuggccucu

SEQ ID NO: 2576705 - RNA, 17 nt, Human
aggaugggaaggaggga

SEQ ID NO: 2576706 - RNA, 11 nt, Human
aggaugggcuc

SEQ ID NO: 2576707 - RNA, 12 nt, Human
aggaugggaagg

SEQ ID NO: 2576708 - RNA, 17 nt, Human
aggauggccuggccagg

SEQ ID NO: 2576709 - RNA, 16 nt, Human
aggauggccuggccag

SEQ ID NO: 2576710 - RNA, 13 nt, Human
aggauggccuggc

SEQ ID NO: 2576711 - RNA, 20 nt, Human
aggauggccagugucugucc

SEQ ID NO: 2576712 - RNA, 23 nt, Human
aggauggccuggccagggccugg

SEQ ID NO: 2576713 - RNA, 22 nt, Human
aggauggccuggccagggccug

SEQ ID NO: 2576714 - RNA, 18 nt, Human
aggauggcuuugaaugcg

SEQ ID NO: 2576715 - RNA, 14 nt, Human
aggaugugauauau

SEQ ID NO: 2576716 - RNA, 13 nt, Human
aggaugucugggc

SEQ ID NO: 2576717 - RNA, 19 nt, Human
aggaugucacucagaugga

SEQ ID NO: 2576718 - RNA, 22 nt, Human
aggaugggucugguuugcagag

SEQ ID NO: 2576719 - RNA, 14 nt, Human
aggaggucucuaag

SEQ ID NO: 2576720 - RNA, 18 nt, Human
aggaggguuagggagggg

SEQ ID NO: 2576721 - RNA, 14 nt, Human
aggagggcagcaga

SEQ ID NO: 2576722 - RNA, 20 nt, Human
aggagggcccuaccugauug

SEQ ID NO: 2576723 - RNA, 18 nt, Human
aggagggucaggaaggau

SEQ ID NO: 2576724 - RNA, 17 nt, Human
aggagggcgugacucac

SEQ ID NO: 2576725 - RNA, 22 nt, Human
aggagggcgugacucacccaag

SEQ ID NO: 2576726 - RNA, 20 nt, Human
aggagggcaagggccaugcu

SEQ ID NO: 2576727 - RNA, 16 nt, Human
aggagggcaagggcca

SEQ ID NO: 2576728 - RNA, 19 nt, Human
aggagggaugcugccugag

SEQ ID NO: 2576729 - RNA, 15 nt, Human
aggagggagggggcu

SEQ ID NO: 2576730 - RNA, 16 nt, Human
aggagagccagcccuc

SEQ ID NO: 2576731 - RNA, 23 nt, Human
aggagggagguauucgugcagca

SEQ ID NO: 2576732 - RNA, 14 nt, Human
aggagagccagccc

SEQ ID NO: 2576733 - RNA, 15 nt, Human
aggagagccagcccu

SEQ ID NO: 2576734 - RNA, 12 nt, Human
aggagagccugc

SEQ ID NO: 2576735 - RNA, 13 nt, Human
aggagagccugcu

SEQ ID NO: 2576736 - RNA, 14 nt, Human
aggagagccugcug

SEQ ID NO: 2576737 - RNA, 15 nt, Human
aggagagccugcugc

SEQ ID NO: 2576738 - RNA, 16 nt, Human
aggagagccugcugca

SEQ ID NO: 2576739 - RNA, 18 nt, Human
aggagagccugcugcaug

SEQ ID NO: 2576740 - RNA, 13 nt, Human
aggaaguagagga

SEQ ID NO: 2576741 - RNA, 19 nt, Human
aggaaguacuggagaaaau

SEQ ID NO: 2576742 - RNA, 18 nt, Human
aggagacaguucaagaaa

SEQ ID NO: 2576743 - RNA, 14 nt, Human
aggagaccaaggcg

SEQ ID NO: 2576744 - RNA, 18 nt, Human
aggaagguuuucuccacu

SEQ ID NO: 2576745 - RNA, 14 nt, Human
aggaagguuuucuc

SEQ ID NO: 2576746 - RNA, 14 nt, Human
aggagagaguugaa

SEQ ID NO: 2576747 - RNA, 12 nt, Human
aggagagcagcg

SEQ ID NO: 2576748 - RNA, 11 nt, Human
aggagagcagc

SEQ ID NO: 2576749 - RNA, 12 nt, Human
aggagagccaga

SEQ ID NO: 2576750 - RNA, 23 nt, Human
aggagagccagagaagugacagg

SEQ ID NO: 2576751 - RNA, 21 nt, Human
aggagagccagagaagugaca

SEQ ID NO: 2576752 - RNA, 15 nt, Human
aggagagccagagaa

SEQ ID NO: 2576753 - RNA, 14 nt, Human
aggagagccagaga

SEQ ID NO: 2576754 - RNA, 16 nt, Human
aggagagcccuucauu

SEQ ID NO: 2576755 - RNA, 13 nt, Human
aggagacucaccu

SEQ ID NO: 2576756 - RNA, 14 nt, Human
aggagacucaccuc

SEQ ID NO: 2576757 - RNA, 15 nt, Human
aggagacucaccucu

SEQ ID NO: 2576758 - RNA, 16 nt, Human
aggagacucaccucug

SEQ ID NO: 2576759 - RNA, 17 nt, Human
aggagacucaccucugc

SEQ ID NO: 2576760 - RNA, 18 nt, Human
aggagacucaccucugcc

SEQ ID NO: 2576761 - RNA, 19 nt, Human
aggagacucaccucugccu

SEQ ID NO: 2576762 - RNA, 21 nt, Human
aggagacucaccucugccuca

SEQ ID NO: 2576763 - RNA, 21 nt, Human
aggagaccuggcacuggaugc

SEQ ID NO: 2576764 - RNA, 11 nt, Human
aggagacucac

SEQ ID NO: 2576765 - RNA, 17 nt, Human
aggagaccaaggcggga

SEQ ID NO: 2576766 - RNA, 14 nt, Human
aggagacccacagg

SEQ ID NO: 2576767 - RNA, 20 nt, Human
aggaguaaucuguguacaaa

SEQ ID NO: 2576768 - RNA, 23 nt, Human
aggagguuuggggucugccacca

SEQ ID NO: 2576769 - RNA, 14 nt, Human
aggagguuuggaug

SEQ ID NO: 2576770 - RNA, 18 nt, Human
aggagguuuaggucaaga

SEQ ID NO: 2576771 - RNA, 24 nt, Human
aggagucugcacaugcagcugcac

SEQ ID NO: 2576772 - RNA, 18 nt, Human
aggaguacaggugaagca

SEQ ID NO: 2576773 - RNA, 21 nt, Human
aggaguaaucuguguacaaag

SEQ ID NO: 2576774 - RNA, 12 nt, Human
aggagugagcac

SEQ ID NO: 2576775 - RNA, 15 nt, Human
aggaggugccaacag

SEQ ID NO: 2576776 - RNA, 14 nt, Human
aggaggugagggau

SEQ ID NO: 2576777 - RNA, 13 nt, Human
aggaggugaggga

SEQ ID NO: 2576778 - RNA, 15 nt, Human
aggaggucucuaaga

SEQ ID NO: 2576779 - RNA, 20 nt, Human
aggagguggaggcugcagug

SEQ ID NO: 2576780 - RNA, 16 nt, Human
aggaggugccaacagu

SEQ ID NO: 2576781 - RNA, 20 nt, Human
aggagguggagguugcagug

SEQ ID NO: 2576782 - RNA, 14 nt, Human
aggagguggcagcc

SEQ ID NO: 2576783 - RNA, 17 nt, Human
aggagguggcagcccug

SEQ ID NO: 2576784 - RNA, 18 nt, Human
aggagguggcagcccugu

SEQ ID NO: 2576785 - RNA, 20 nt, Human
aggagguggcagcccuguag

SEQ ID NO: 2576786 - RNA, 21 nt, Human
aggagguggcagcccuguagg

SEQ ID NO: 2576787 - RNA, 23 nt, Human
aggagguggcagcccuguaggga

SEQ ID NO: 2576788 - RNA, 22 nt, Human
aggagugaggaaggcaggaaga

SEQ ID NO: 2576789 - RNA, 12 nt, Human
aggagugaggaa

SEQ ID NO: 2576790 - RNA, 21 nt, Human
aggagugagaucauuuucuua

SEQ ID NO: 2576791 - RNA, 14 nt, Human
aggagugagaucau

SEQ ID NO: 2576792 - RNA, 17 nt, Human
aggagugagaggggaca

SEQ ID NO: 2576793 - RNA, 23 nt, Human
aggagugaaaccuuuagggcagc

SEQ ID NO: 2576794 - RNA, 22 nt, Human
aggagugaaaccuuuagggcag

SEQ ID NO: 2576795 - RNA, 14 nt, Human
aggagugagcacua

SEQ ID NO: 2576796 - RNA, 19 nt, Human
aggaguuccuaaccagccu

SEQ ID NO: 2576797 - RNA, 20 nt, Human
aggaguuccuugaucuguau

SEQ ID NO: 2576798 - RNA, 16 nt, Human
aggaguucgagaccag

SEQ ID NO: 2576799 - RNA, 21 nt, Human
aggaguucgagaccagccugg

SEQ ID NO: 2576800 - RNA, 19 nt, Human
aggaguucaaugaucuagg

SEQ ID NO: 2576801 - RNA, 18 nt, Human
aggaguggaggaggccug

SEQ ID NO: 2576802 - RNA, 18 nt, Human
aggaguucaaugaucuag

SEQ ID NO: 2576803 - RNA, 23 nt, Human
aggaguucagggucauagcaugc

SEQ ID NO: 2576804 - RNA, 19 nt, Human
aggauggccagugucuguc

SEQ ID NO: 2576805 - RNA, 18 nt, Human
aggauggccagugucugu

SEQ ID NO: 2576806 - RNA, 16 nt, Human
aggauggccagugucu

SEQ ID NO: 2576807 - RNA, 19 nt, Human
aggauggaggggugguccu

SEQ ID NO: 2576808 - RNA, 15 nt, Human
aggauggccaguguc

SEQ ID NO: 2576809 - RNA, 19 nt, Human
aggaguuucgagguagagu

SEQ ID NO: 2576810 - RNA, 12 nt, Human
aggauggagggg

SEQ ID NO: 2576811 - RNA, 21 nt, Human
aggaguugcuguuuguuugac

SEQ ID NO: 2576812 - RNA, 14 nt, Human
aggaguugcuguuu

SEQ ID NO: 2576813 - RNA, 18 nt, Human
aggaguuucguuuucaaa

SEQ ID NO: 2576814 - RNA, 22 nt, Human
aggaguucgagaccagccuggc

SEQ ID NO: 2576815 - RNA, 16 nt, Human
aggaguucgaggcugc

SEQ ID NO: 2576816 - RNA, 17 nt, Human
aggaguucgaggcugca

SEQ ID NO: 2576817 - RNA, 14 nt, Human
agggacugagaaau

SEQ ID NO: 2576818 - RNA, 13 nt, Human
agggacugagaaa

SEQ ID NO: 2576819 - RNA, 15 nt, Human
agggacugagaaauu

SEQ ID NO: 2576820 - RNA, 22 nt, Human
agggacucugaagccucuggga

SEQ ID NO: 2576821 - RNA, 14 nt, Human
agggacugaagcca

SEQ ID NO: 2576822 - RNA, 17 nt, Human
agggacugagaaauuua

SEQ ID NO: 2576823 - RNA, 18 nt, Human
agggauggcggguggggg

SEQ ID NO: 2576824 - RNA, 19 nt, Human
agggauggccguuggccac

SEQ ID NO: 2576825 - RNA, 15 nt, Human
agggauggccguugg

SEQ ID NO: 2576826 - RNA, 17 nt, Human
agggauggauuccaacc

SEQ ID NO: 2576827 - RNA, 16 nt, Human
agggauggauuccaac

SEQ ID NO: 2576828 - RNA, 18 nt, Human
agggauggacugaugcuu

SEQ ID NO: 2576829 - RNA, 20 nt, Human
agggauuagggagagaagau

SEQ ID NO: 2576830 - RNA, 13 nt, Human
agggauggcgggu

SEQ ID NO: 2576831 - RNA, 19 nt, Human
agggauucaggcugcuugg

SEQ ID NO: 2576832 - RNA, 16 nt, Human
agggauucaggcugcu

SEQ ID NO: 2576833 - RNA, 18 nt, Human
agggauucaggcugcuug

SEQ ID NO: 2576834 - RNA, 18 nt, Human
agggauucacaucugcau

SEQ ID NO: 2576835 - RNA, 13 nt, Human
agggauggugccc

SEQ ID NO: 2576836 - RNA, 14 nt, Human
agggauucaggcug

SEQ ID NO: 2576837 - RNA, 15 nt, Human
agggauucaggcugc

SEQ ID NO: 2576838 - RNA, 15 nt, Human
agggaugcauggaga

SEQ ID NO: 2576839 - RNA, 18 nt, Human
agggaugaugccacacca

SEQ ID NO: 2576840 - RNA, 16 nt, Human
agggaugaugccacac

SEQ ID NO: 2576841 - RNA, 19 nt, Human
agggaugaggugcugggag

SEQ ID NO: 2576842 - RNA, 23 nt, Human
agggaugaggugcugggagggau

SEQ ID NO: 2576843 - RNA, 15 nt, Human
agggaugcccuggag

SEQ ID NO: 2576844 - RNA, 17 nt, Human
agggaugcccuggaggu

SEQ ID NO: 2576845 - RNA, 19 nt, Human
agggaugcccuggaggugg

SEQ ID NO: 2576846 - RNA, 20 nt, Human
agggaugcccuggagguggc

SEQ ID NO: 2576847 - RNA, 18 nt, Human
agggaugccaucuguggg

SEQ ID NO: 2576848 - RNA, 17 nt, Human
agggauggacugaugcu

SEQ ID NO: 2576849 - RNA, 13 nt, Human
agggauggacuga

SEQ ID NO: 2576850 - RNA, 21 nt, Human
agggaugcccuggagguggcu

SEQ ID NO: 2576851 - RNA, 15 nt, Human
agggauggaaaagga

SEQ ID NO: 2576852 - RNA, 22 nt, Human
agggauggaaaaggaagacuag

SEQ ID NO: 2576853 - RNA, 16 nt, Human
agggaugcugccugag

SEQ ID NO: 2576854 - RNA, 17 nt, Human
agggaugcugccugagu

SEQ ID NO: 2576855 - RNA, 18 nt, Human
agggaugcugccugaguc

SEQ ID NO: 2576856 - RNA, 19 nt, Human
agggaugcugccugaguca

SEQ ID NO: 2576857 - RNA, 19 nt, Human
agggaugagcauggagcug

SEQ ID NO: 2576858 - RNA, 18 nt, Human
agggaugaaggccucccu

SEQ ID NO: 2576859 - RNA, 22 nt, Human
agggaugacuaaaauauuuauu

SEQ ID NO: 2576860 - RNA, 21 nt, Human
agggaugagcauggagcuggc

SEQ ID NO: 2576861 - RNA, 20 nt, Human
agggaugagcauggagcugg

SEQ ID NO: 2576862 - RNA, 16 nt, Human
agggaugaggugcugg

SEQ ID NO: 2576863 - RNA, 17 nt, Human
agggaugaggugcuggg

SEQ ID NO: 2576864 - RNA, 17 nt, Human
agggaugaaagagaagg

SEQ ID NO: 2576865 - RNA, 22 nt, Human
agggaucuugcauucccagugg

SEQ ID NO: 2576866 - RNA, 15 nt, Human
agggaugacuaaaau

SEQ ID NO: 2576867 - RNA, 20 nt, Human
agggaucuugcauucccagu

SEQ ID NO: 2576868 - RNA, 19 nt, Human
agggaucuugcauucccag

SEQ ID NO: 2576869 - RNA, 22 nt, Human
agggaucugguccuacccaucc

SEQ ID NO: 2576870 - RNA, 22 nt, Human
agggaucccucaucugucccuc

SEQ ID NO: 2576871 - RNA, 18 nt, Human
agggcuagaaccuggcag

SEQ ID NO: 2576872 - RNA, 23 nt, Human
agggcuagaaccuggaggggcua

SEQ ID NO: 2576873 - RNA, 21 nt, Human
agggcuagaaccuggaggggc

SEQ ID NO: 2576874 - RNA, 22 nt, Human
agggcuagaaccuggagggcug

SEQ ID NO: 2576875 - RNA, 22 nt, Human
agggcuagaaccuggagggcua

SEQ ID NO: 2576876 - RNA, 18 nt, Human
agggcuagaaccuggagg

SEQ ID NO: 2576877 - RNA, 20 nt, Human
agggcuagaaccuggagagc

SEQ ID NO: 2576878 - RNA, 19 nt, Human
agggcuagaaccuggagag

SEQ ID NO: 2576879 - RNA, 19 nt, Human
agggcuagaaccuggagaa

SEQ ID NO: 2576880 - RNA, 18 nt, Human
agggcuagaaccuggaga

SEQ ID NO: 2576881 - RNA, 17 nt, Human
agggcuagaaccuggag

SEQ ID NO: 2576882 - RNA, 22 nt, Human
agggcuagaaccuggaagggcu

SEQ ID NO: 2576883 - RNA, 19 nt, Human
agggcuagaaccuggaagg

SEQ ID NO: 2576884 - RNA, 18 nt, Human
agggcuagaaccuggaag

SEQ ID NO: 2576885 - RNA, 17 nt, Human
agggcuagaaccuggaa

SEQ ID NO: 2576886 - RNA, 16 nt, Human
agggcuagaaccugga

SEQ ID NO: 2576887 - RNA, 17 nt, Human
agggcuacccugagcug

SEQ ID NO: 2576888 - RNA, 18 nt, Human
agggcuacccugagcuga

SEQ ID NO: 2576889 - RNA, 20 nt, Human
agggcuacccugagcugagg

SEQ ID NO: 2576890 - RNA, 21 nt, Human
agggcuacccugagcugaggc

SEQ ID NO: 2576891 - RNA, 22 nt, Human
agggcuagaaccuagaagggcu

SEQ ID NO: 2576892 - RNA, 21 nt, Human
agggcuagaaccuagaagggc

SEQ ID NO: 2576893 - RNA, 17 nt, Human
agggcuagaaccuagaa

SEQ ID NO: 2576894 - RNA, 21 nt, Human
agggcuacugcagcuuuacau

SEQ ID NO: 2576895 - RNA, 22 nt, Human
agggcuacccugagcugaggca

SEQ ID NO: 2576896 - RNA, 23 nt, Human
agggcuacccugagcugaggcag

SEQ ID NO: 2576897 - RNA, 24 nt, Human
agggcuagugacuugugucccaug

SEQ ID NO: 2576898 - RNA, 22 nt, Human
agggcuagugacuuguguccca

SEQ ID NO: 2576899 - RNA, 19 nt, Human
agggcuauagcucaggacc

SEQ ID NO: 2576900 - RNA, 18 nt, Human
agggcuagaaucuggaga

SEQ ID NO: 2576901 - RNA, 18 nt, Human
agggcuagaacuggagag

SEQ ID NO: 2576902 - RNA, 17 nt, Human
agggcuagaacuggaga

SEQ ID NO: 2576903 - RNA, 22 nt, Human
agggcuagaaccuguagagcua

SEQ ID NO: 2576904 - RNA, 16 nt, Human
agggcuagcaucccug

SEQ ID NO: 2576905 - RNA, 20 nt, Human
agggcuagaaucuggagagc

SEQ ID NO: 2576906 - RNA, 16 nt, Human
aggggcaucugccccu

SEQ ID NO: 2576907 - RNA, 17 nt, Human
aggggcaucugccccuc

SEQ ID NO: 2576908 - RNA, 19 nt, Human
aggggcaucugccccuccc

SEQ ID NO: 2576909 - RNA, 20 nt, Human
aggggcaucugccccucccc

SEQ ID NO: 2576910 - RNA, 21 nt, Human
aggggcaucugccccuccccc

SEQ ID NO: 2576911 - RNA, 22 nt, Human
aggggcaucugccccuccccca

SEQ ID NO: 2576912 - RNA, 18 nt, Human
aggggcauggccagcagc

SEQ ID NO: 2576913 - RNA, 19 nt, Human
aggggcauguauuggccug

SEQ ID NO: 2576914 - RNA, 18 nt, Human
agggccuggcucaggugg

SEQ ID NO: 2576915 - RNA, 12 nt, Human
agggauuugagg

SEQ ID NO: 2576916 - RNA, 16 nt, Human
agggauugcugccacu

SEQ ID NO: 2576917 - RNA, 15 nt, Human
agggcuacccugagc

SEQ ID NO: 2576918 - RNA, 19 nt, Human
agggcuacccucccccagg

SEQ ID NO: 2576919 - RNA, 14 nt, Human
agggcuaagagcua

SEQ ID NO: 2576920 - RNA, 21 nt, Human
agggcuaagagcuagcgcugc

SEQ ID NO: 2576921 - RNA, 22 nt, Human
agggcuaagagcuagcgcugcc

SEQ ID NO: 2576922 - RNA, 23 nt, Human
agggcuaagagcuagcgcugccg

SEQ ID NO: 2576923 - RNA, 14 nt, Human
agggcgugggagcg

SEQ ID NO: 2576924 - RNA, 13 nt, Human
agggcguggaggg

SEQ ID NO: 2576925 - RNA, 13 nt, Human
agggcuaagagcu

SEQ ID NO: 2576926 - RNA, 17 nt, Human
agggcgugacucaccca

SEQ ID NO: 2576927 - RNA, 19 nt, Human
agggcgugacucacccaag

SEQ ID NO: 2576928 - RNA, 19 nt, Human
agggcguggaaaggggcag

SEQ ID NO: 2576929 - RNA, 14 nt, Human
agggccuggcucag

SEQ ID NO: 2576930 - RNA, 13 nt, Human
agggccuggcuca

SEQ ID NO: 2576931 - RNA, 22 nt, Human
agggauuuggggcucagagugg

SEQ ID NO: 2576932 - RNA, 20 nt, Human
agggauucugguuccagggu

SEQ ID NO: 2576933 - RNA, 20 nt, Human
aggcccucugcccacucccu

SEQ ID NO: 2576934 - RNA, 19 nt, Human
aggcccucugcccacuccc

SEQ ID NO: 2576935 - RNA, 20 nt, Human
aggccagggucacugaaggc

SEQ ID NO: 2576936 - RNA, 23 nt, Human
aggccagggcuauagcucaggac

SEQ ID NO: 2576937 - RNA, 12 nt, Human
aggccaggguca

SEQ ID NO: 2576938 - RNA, 13 nt, Human
aggcugagccuca

SEQ ID NO: 2576939 - RNA, 19 nt, Human
aggcucuucuccccagagu

SEQ ID NO: 2576940 - RNA, 14 nt, Human
aggcugaggaaagg

SEQ ID NO: 2576941 - RNA, 11 nt, Human
aggcugagccu

SEQ ID NO: 2576942 - RNA, 13 nt, Human
aggcucuucuccu

SEQ ID NO: 2576943 - RNA, 11 nt, Human
aggcugaggac

SEQ ID NO: 2576944 - RNA, 15 nt, Human
aggcugaggaaaggc

SEQ ID NO: 2576945 - RNA, 18 nt, Human
aggcugaggaaaggccag

SEQ ID NO: 2576946 - RNA, 19 nt, Human
aggcugaggaaaggccagc

SEQ ID NO: 2576947 - RNA, 20 nt, Human
aggcugaggaaaggccagcu

SEQ ID NO: 2576948 - RNA, 13 nt, Human
aggcugaggacuu

SEQ ID NO: 2576949 - RNA, 18 nt, Human
aggcugaggcaagagaau

SEQ ID NO: 2576950 - RNA, 22 nt, Human
aggcugaggaaaggccagcugg

SEQ ID NO: 2576951 - RNA, 11 nt, Human
aggcugaggca

SEQ ID NO: 2576952 - RNA, 17 nt, Human
aggcuagcuucugcuuu

SEQ ID NO: 2576953 - RNA, 15 nt, Human
aggcuagcuucugcu

SEQ ID NO: 2576954 - RNA, 18 nt, Human
aggcuagcuucugcuuuu

SEQ ID NO: 2576955 - RNA, 13 nt, Human
aggcucugugcug

SEQ ID NO: 2576956 - RNA, 22 nt, Human
aggcucuggagcccacuguacu

SEQ ID NO: 2576957 - RNA, 22 nt, Human
aggcucuuagcagcuuccagau

SEQ ID NO: 2576958 - RNA, 19 nt, Human
aggcucuuagcagcuucca

SEQ ID NO: 2576959 - RNA, 18 nt, Human
aggcucuucuccccagag

SEQ ID NO: 2576960 - RNA, 17 nt, Human
aggcucuucuccccaga

SEQ ID NO: 2576961 - RNA, 16 nt, Human
aggcucuucuccccag

SEQ ID NO: 2576962 - RNA, 18 nt, Human
aggcucugugcugacccu

SEQ ID NO: 2576963 - RNA, 17 nt, Human
aggcucugugcugaccc

SEQ ID NO: 2576964 - RNA, 16 nt, Human
aggcucugugcugacc

SEQ ID NO: 2576965 - RNA, 22 nt, Human
aggcucugugcugacccuccug

SEQ ID NO: 2576966 - RNA, 21 nt, Human
aggcucugugcugacccuccu

SEQ ID NO: 2576967 - RNA, 23 nt, Human
aggcuguaucccaugagccucag

SEQ ID NO: 2576968 - RNA, 14 nt, Human
aggcugaggcagaa

SEQ ID NO: 2576969 - RNA, 21 nt, Human
aggcugcagucagucaugaug

SEQ ID NO: 2576970 - RNA, 17 nt, Human
aggcugcagugagccga

SEQ ID NO: 2576971 - RNA, 19 nt, Human
aggcugcagugagccgaga

SEQ ID NO: 2576972 - RNA, 12 nt, Human
aggcugucaauu

SEQ ID NO: 2576973 - RNA, 20 nt, Human
aggcuguucccauguagccc

SEQ ID NO: 2576974 - RNA, 19 nt, Human
aggcugucaauuacaggaa

SEQ ID NO: 2576975 - RNA, 17 nt, Human
aggcugccaaggccaga

SEQ ID NO: 2576976 - RNA, 24 nt, Human
aggcuguaucccaugagccucagc

SEQ ID NO: 2576977 - RNA, 17 nt, Human
agggacaggauaagagg

SEQ ID NO: 2576978 - RNA, 13 nt, Human
agggacauauuca

SEQ ID NO: 2576979 - RNA, 19 nt, Human
agggacauguuuugauaaa

SEQ ID NO: 2576980 - RNA, 15 nt, Human
agggacauauucauu

SEQ ID NO: 2576981 - RNA, 23 nt, Human
agggacauauucauuuggaaaua

SEQ ID NO: 2576982 - RNA, 24 nt, Human
agggacauguuuugauaaaguagu

SEQ ID NO: 2576983 - RNA, 22 nt, Human
agggacauguuuugauaaagua

SEQ ID NO: 2576984 - RNA, 20 nt, Human
agggacauguuuugauaaag

SEQ ID NO: 2576985 - RNA, 16 nt, Human
agggaccaacugggcc

SEQ ID NO: 2576986 - RNA, 17 nt, Human
agggaccaacugggccc

SEQ ID NO: 2576987 - RNA, 19 nt, Human
agggaccaacugggcccaa

SEQ ID NO: 2576988 - RNA, 14 nt, Human
agggaccaaggacc

SEQ ID NO: 2576989 - RNA, 18 nt, Human
agggaccaaggaccccuc

SEQ ID NO: 2576990 - RNA, 20 nt, Human
agggacucugaagccucugg

SEQ ID NO: 2576991 - RNA, 21 nt, Human
agggacucugaagccucuggg

SEQ ID NO: 2576992 - RNA, 19 nt, Human
agggaccaaggaccccuca

SEQ ID NO: 2576993 - RNA, 18 nt, Human
aggcuuaauaccugggug

SEQ ID NO: 2576994 - RNA, 14 nt, Human
aggcuuacacccac

SEQ ID NO: 2576995 - RNA, 18 nt, Human
agcuaaacggauuccaaa

SEQ ID NO: 2576996 - RNA, 17 nt, Human
agcuaaacggauuccaa

SEQ ID NO: 2576997 - RNA, 18 nt, Human
agcuaaauuacaauuguc

SEQ ID NO: 2576998 - RNA, 13 nt, Human
agcuaaauccuuu

SEQ ID NO: 2576999 - RNA, 13 nt, Human
agcuaaagaggcu

SEQ ID NO: 2577000 - RNA, 15 nt, Human
agcuaaagaggcuga

SEQ ID NO: 2577001 - RNA, 21 nt, Human
agcuaaagaggcugaaagagg

SEQ ID NO: 2577002 - RNA, 16 nt, Human
agcuaaagcccaaccu

SEQ ID NO: 2577003 - RNA, 19 nt, Human
agcuaacauggaaguacua

SEQ ID NO: 2577004 - RNA, 19 nt, Human
agcuaacacacagcuccca

SEQ ID NO: 2577005 - RNA, 18 nt, Human
agcuaacacacagcuccc

SEQ ID NO: 2577006 - RNA, 17 nt, Human
agcuaacacacagcucc

SEQ ID NO: 2577007 - RNA, 16 nt, Human
agcuaacacacagcuc

SEQ ID NO: 2577008 - RNA, 16 nt, Human
agcuaacacuggcccc

SEQ ID NO: 2577009 - RNA, 17 nt, Human
agcuaacacuggccccu

SEQ ID NO: 2577010 - RNA, 18 nt, Human
agcuaacacuggccccua

SEQ ID NO: 2577011 - RNA, 19 nt, Human
agcuaacacuggccccuag

SEQ ID NO: 2577012 - RNA, 17 nt, Human
agcuaacauuuuaaaua

SEQ ID NO: 2577013 - RNA, 20 nt, Human
agcuaacauggaaguacuau

SEQ ID NO: 2577014 - RNA, 12 nt, Human
agcuaagaaccu

SEQ ID NO: 2577015 - RNA, 13 nt, Human
agcuaagaaccug

SEQ ID NO: 2577016 - RNA, 19 nt, Human
agcuaagaaauaaaacugu

SEQ ID NO: 2577017 - RNA, 15 nt, Human
agcuaagaaauaaaa

SEQ ID NO: 2577018 - RNA, 13 nt, Human
agcuaagaaauaa

SEQ ID NO: 2577019 - RNA, 14 nt, Human
agcuaagaaaagau

SEQ ID NO: 2577020 - RNA, 23 nt, Human
agcuaacauuuuaaauaaaagaa

SEQ ID NO: 2577021 - RNA, 20 nt, Human
agcuaacauuuuaaauaaaa

SEQ ID NO: 2577022 - RNA, 18 nt, Human
agcuaacauuuuaaauaa

SEQ ID NO: 2577023 - RNA, 22 nt, Human
agcuaacauuuuaaauaaaaga

SEQ ID NO: 2577024 - RNA, 23 nt, Human
agcuaacccccuucuacugagcc

SEQ ID NO: 2577025 - RNA, 20 nt, Human
agcgaaugcuaggucucgga

SEQ ID NO: 2577026 - RNA, 16 nt, Human
agcgaacuugacaauu

SEQ ID NO: 2577027 - RNA, 12 nt, Human
agcgaagggagu

SEQ ID NO: 2577028 - RNA, 13 nt, Human
agcgaauuuuaaa

SEQ ID NO: 2577029 - RNA, 15 nt, Human
agcgaauuuuaaaag

SEQ ID NO: 2577030 - RNA, 16 nt, Human
agcgaauuuuaaaaga

SEQ ID NO: 2577031 - RNA, 13 nt, Human
agcgacagugaga

SEQ ID NO: 2577032 - RNA, 15 nt, Human
agcgacagugagacu

SEQ ID NO: 2577033 - RNA, 15 nt, Human
agcgacaaagaugau

SEQ ID NO: 2577034 - RNA, 14 nt, Human
agcgacaaagauga

SEQ ID NO: 2577035 - RNA, 15 nt, Human
agcgauucuucugcu

SEQ ID NO: 2577036 - RNA, 19 nt, Human
agcgauucuucugcuucag

SEQ ID NO: 2577037 - RNA, 17 nt, Human
agcgauucuucugcuuc

SEQ ID NO: 2577038 - RNA, 12 nt, Human
agcuacaaaugc

SEQ ID NO: 2577039 - RNA, 15 nt, Human
agcuaaugggacacu

SEQ ID NO: 2577040 - RNA, 14 nt, Human
agcuaaugggacac

SEQ ID NO: 2577041 - RNA, 13 nt, Human
agcuaaugggaca

SEQ ID NO: 2577042 - RNA, 17 nt, Human
agcuaaucuguagggcu

SEQ ID NO: 2577043 - RNA, 13 nt, Human
agcuaaucuguag

SEQ ID NO: 2577044 - RNA, 19 nt, Human
agcuaagugaaaaggucau

SEQ ID NO: 2577045 - RNA, 20 nt, Human
agcuaaucuguagggcugga

SEQ ID NO: 2577046 - RNA, 19 nt, Human
agcuaaucuguagggcugg

SEQ ID NO: 2577047 - RNA, 23 nt, Human
agcuaaucuguagggcuggaccu

SEQ ID NO: 2577048 - RNA, 17 nt, Human
agcuaagcuaggaauga

SEQ ID NO: 2577049 - RNA, 17 nt, Human
agcuaagaaccuggaac

SEQ ID NO: 2577050 - RNA, 14 nt, Human
agcuaagaaccugg

SEQ ID NO: 2577051 - RNA, 16 nt, Human
agcuaagaaccuggaa

SEQ ID NO: 2577052 - RNA, 18 nt, Human
agcuaagcuaggaaugaa

SEQ ID NO: 2577053 - RNA, 16 nt, Human
agcuaaggacauuucc

SEQ ID NO: 2577054 - RNA, 19 nt, Human
agcuaaggacauuucccag

SEQ ID NO: 2577055 - RNA, 21 nt, Human
agcucaccagccccagugccc

SEQ ID NO: 2577056 - RNA, 14 nt, Human
agcucaccagcccc

SEQ ID NO: 2577057 - RNA, 13 nt, Human
agcucaccagccc

SEQ ID NO: 2577058 - RNA, 13 nt, Human
agcuacaaaugca

SEQ ID NO: 2577059 - RNA, 21 nt, Human
agcucacaauaaaaauggcuc

SEQ ID NO: 2577060 - RNA, 20 nt, Human
agcucacaguuccucgcccu

SEQ ID NO: 2577061 - RNA, 16 nt, Human
agcucacacaugagau

SEQ ID NO: 2577062 - RNA, 22 nt, Human
agcuacaccuuucuccuuugua

SEQ ID NO: 2577063 - RNA, 21 nt, Human
agcuacaccuuucuccuuugu

SEQ ID NO: 2577064 - RNA, 18 nt, Human
agccuggcacagggcagu

SEQ ID NO: 2577065 - RNA, 17 nt, Human
agccuggcacagggcag

SEQ ID NO: 2577066 - RNA, 11 nt, Human
agccuggaggc

SEQ ID NO: 2577067 - RNA, 23 nt, Human
agccuggaggccgggugcucagg

SEQ ID NO: 2577068 - RNA, 12 nt, Human
agccuggccaga

SEQ ID NO: 2577069 - RNA, 13 nt, Human
agccuggccagac

SEQ ID NO: 2577070 - RNA, 20 nt, Human
agccuggcacagggcagugg

SEQ ID NO: 2577071 - RNA, 14 nt, Human
agccuggccaacau

SEQ ID NO: 2577072 - RNA, 14 nt, Human
agccuggagaagcu

SEQ ID NO: 2577073 - RNA, 13 nt, Human
agccuggagaagc

SEQ ID NO: 2577074 - RNA, 11 nt, Human
agccuggagaa

SEQ ID NO: 2577075 - RNA, 18 nt, Human
agccuggacccccagcuu

SEQ ID NO: 2577076 - RNA, 17 nt, Human
agccuggacccccagcu

SEQ ID NO: 2577077 - RNA, 16 nt, Human
agccuggacccccagc

SEQ ID NO: 2577078 - RNA, 21 nt, Human
agccuggaacaucaucaaggc

SEQ ID NO: 2577079 - RNA, 20 nt, Human
agccuggaacaucaucaagg

SEQ ID NO: 2577080 - RNA, 19 nt, Human
agccuggaacaucaucaag

SEQ ID NO: 2577081 - RNA, 15 nt, Human
agccuggacccccag

SEQ ID NO: 2577082 - RNA, 14 nt, Human
agccugcuuuuuaa

SEQ ID NO: 2577083 - RNA, 14 nt, Human
agccuggacccugu

SEQ ID NO: 2577084 - RNA, 17 nt, Human
agccugcugccugcuuu

SEQ ID NO: 2577085 - RNA, 11 nt, Human
agccugcugca

SEQ ID NO: 2577086 - RNA, 23 nt, Human
agccugcuggucacagccuccuc

SEQ ID NO: 2577087 - RNA, 22 nt, Human
agccugcuggucacagccuccu

SEQ ID NO: 2577088 - RNA, 21 nt, Human
agccugcuggucacagccucc

SEQ ID NO: 2577089 - RNA, 20 nt, Human
agccugcuggucacagccuc

SEQ ID NO: 2577090 - RNA, 18 nt, Human
agccugcuggcacccacc

SEQ ID NO: 2577091 - RNA, 11 nt, Human
agccugcuggc

SEQ ID NO: 2577092 - RNA, 17 nt, Human
agccugcuggcacccac

SEQ ID NO: 2577093 - RNA, 10 nt, Human
agccugcugg

SEQ ID NO: 2577094 - RNA, 12 nt, Human
agccugcugcau

SEQ ID NO: 2577095 - RNA, 17 nt, Human
agccuggcccagcuccc

SEQ ID NO: 2577096 - RNA, 16 nt, Human
agccuggcccagcucc

SEQ ID NO: 2577097 - RNA, 15 nt, Human
agccuggcccagcuc

SEQ ID NO: 2577098 - RNA, 14 nt, Human
agccuggcccagcu

SEQ ID NO: 2577099 - RNA, 18 nt, Human
agccuggcccagcucccc

SEQ ID NO: 2577100 - RNA, 16 nt, Human
agccuggccccauggu

SEQ ID NO: 2577101 - RNA, 17 nt, Human
agccuggccccaugguc

SEQ ID NO: 2577102 - RNA, 13 nt, Human
agccuggcccagc

SEQ ID NO: 2577103 - RNA, 12 nt, Human
agccuggcccag

SEQ ID NO: 2577104 - RNA, 17 nt, Human
agccuggccagccuaca

SEQ ID NO: 2577105 - RNA, 21 nt, Human
agccuggccagacacaggccc

SEQ ID NO: 2577106 - RNA, 22 nt, Human
agccuggccagacacaggcccu

SEQ ID NO: 2577107 - RNA, 14 nt, Human
agccuggccagaca

SEQ ID NO: 2577108 - RNA, 15 nt, Human
agccuggccagacac

SEQ ID NO: 2577109 - RNA, 16 nt, Human
agccuggccagacaca

SEQ ID NO: 2577110 - RNA, 18 nt, Human
agccuggccagacacagg

SEQ ID NO: 2577111 - RNA, 15 nt, Human
agccugggcaacaga

SEQ ID NO: 2577112 - RNA, 17 nt, Human
agccugggcaacagagc

SEQ ID NO: 2577113 - RNA, 18 nt, Human
agccugggcaacagagca

SEQ ID NO: 2577114 - RNA, 20 nt, Human
agccugggaggucaaggcug

SEQ ID NO: 2577115 - RNA, 18 nt, Human
agccugggcaaugugaua

SEQ ID NO: 2577116 - RNA, 20 nt, Human
agccugggcaacagagcaag

SEQ ID NO: 2577117 - RNA, 17 nt, Human
agccugggcagcauagc

SEQ ID NO: 2577118 - RNA, 20 nt, Human
agccugggcagcauagcaag

SEQ ID NO: 2577119 - RNA, 15 nt, Human
agccugggcagccag

SEQ ID NO: 2577120 - RNA, 16 nt, Human
agccuuuuucuaggcc

SEQ ID NO: 2577121 - RNA, 11 nt, Human
agccuuugaau

SEQ ID NO: 2577122 - RNA, 15 nt, Human
agccuuugccucccc

SEQ ID NO: 2577123 - RNA, 21 nt, Human
agccuuugaauaaaaaugcac

SEQ ID NO: 2577124 - RNA, 16 nt, Human
agccuuugccuccccg

SEQ ID NO: 2577125 - RNA, 18 nt, Human
agcgaaccaauauuugua

SEQ ID NO: 2577126 - RNA, 12 nt, Human
agcgaaacuccg

SEQ ID NO: 2577127 - RNA, 15 nt, Human
agccuuuaaugcauc

SEQ ID NO: 2577128 - RNA, 14 nt, Human
agccuuuaaugcau

SEQ ID NO: 2577129 - RNA, 23 nt, Human
agccuugugucuacagagaaccu

SEQ ID NO: 2577130 - RNA, 13 nt, Human
agccuuuaaugca

SEQ ID NO: 2577131 - RNA, 20 nt, Human
agccuugugucuacagagaa

SEQ ID NO: 2577132 - RNA, 17 nt, Human
agccugggcagccaggc

SEQ ID NO: 2577133 - RNA, 18 nt, Human
agccugggcagccaggcu

SEQ ID NO: 2577134 - RNA, 17 nt, Human
agccuugugucuacaga

SEQ ID NO: 2577135 - RNA, 14 nt, Human
agccuuuccauaag

SEQ ID NO: 2577136 - RNA, 22 nt, Human
agccuuuccauaaggaauguag

SEQ ID NO: 2577137 - RNA, 16 nt, Human
agccuuucucccaggc

SEQ ID NO: 2577138 - RNA, 23 nt, Human
agccuuuccauaaggaauguagc

SEQ ID NO: 2577139 - RNA, 15 nt, Human
agccuuucuuuugga

SEQ ID NO: 2577140 - RNA, 23 nt, Human
agcucaccagccccagugcccac

SEQ ID NO: 2577141 - RNA, 22 nt, Human
agcucaccagccccagugccca

SEQ ID NO: 2577142 - RNA, 17 nt, Human
agcucacccaauaaaca

SEQ ID NO: 2577143 - RNA, 21 nt, Human
agcucacaguuccucgcccug

SEQ ID NO: 2577144 - RNA, 23 nt, Human
agcucacaguuccucgcccuggg

SEQ ID NO: 2577145 - RNA, 20 nt, Human
agcuccucgagggcagggac

SEQ ID NO: 2577146 - RNA, 17 nt, Human
agcuccucgagggcagg

SEQ ID NO: 2577147 - RNA, 16 nt, Human
agcuccucuccccagc

SEQ ID NO: 2577148 - RNA, 17 nt, Human
agcuccucuccccagcc

SEQ ID NO: 2577149 - RNA, 18 nt, Human
agcuccucuccccagccc

SEQ ID NO: 2577150 - RNA, 19 nt, Human
agcuccucuccccagccca

SEQ ID NO: 2577151 - RNA, 20 nt, Human
agcuccucuccccagcccag

SEQ ID NO: 2577152 - RNA, 21 nt, Human
agcuccucuccccagcccaga

SEQ ID NO: 2577153 - RNA, 22 nt, Human
agcuccucuccccagcccagag

SEQ ID NO: 2577154 - RNA, 23 nt, Human
agcuccucuccccagcccagaga

SEQ ID NO: 2577155 - RNA, 18 nt, Human
agcuccucuccuggagga

SEQ ID NO: 2577156 - RNA, 17 nt, Human
agcuccucuccuggagg

SEQ ID NO: 2577157 - RNA, 16 nt, Human
agcuccucuccuggag

SEQ ID NO: 2577158 - RNA, 15 nt, Human
agcuccucuccugga

SEQ ID NO: 2577159 - RNA, 14 nt, Human
agcuccucuccugg

SEQ ID NO: 2577160 - RNA, 13 nt, Human
agcuccucuccug

SEQ ID NO: 2577161 - RNA, 24 nt, Human
agcuccucuccccagcccagagac

SEQ ID NO: 2577162 - RNA, 17 nt, Human
agcucuugugaggaaag

SEQ ID NO: 2577163 - RNA, 16 nt, Human
agcucuugugaggaaa

SEQ ID NO: 2577164 - RNA, 13 nt, Human
agcucuugugagg

SEQ ID NO: 2577165 - RNA, 12 nt, Human
agcucuugugag

SEQ ID NO: 2577166 - RNA, 21 nt, Human
agcucuugugaggaaagucau

SEQ ID NO: 2577167 - RNA, 12 nt, Human
agcucuuuccuc

SEQ ID NO: 2577168 - RNA, 23 nt, Human
agcucuugcuaaucagugucuca

SEQ ID NO: 2577169 - RNA, 13 nt, Human
agcucuuuccucc

SEQ ID NO: 2577170 - RNA, 15 nt, Human
agcucuuuccuccuu

SEQ ID NO: 2577171 - RNA, 17 nt, Human
agcucuuuccuccuucc

SEQ ID NO: 2577172 - RNA, 13 nt, Human
agcucuugcuaau

SEQ ID NO: 2577173 - RNA, 22 nt, Human
agcucuugcccuucccuguccc

SEQ ID NO: 2577174 - RNA, 21 nt, Human
agcucuugcccuucccugucc

SEQ ID NO: 2577175 - RNA, 19 nt, Human
agcucuugcccuucccugu

SEQ ID NO: 2577176 - RNA, 12 nt, Human
agcuccucuggg

SEQ ID NO: 2577177 - RNA, 14 nt, Human
agcuccucugggca

SEQ ID NO: 2577178 - RNA, 18 nt, Human
agcucuugcccuucccug

SEQ ID NO: 2577179 - RNA, 16 nt, Human
agcucuugcccuuccc

SEQ ID NO: 2577180 - RNA, 21 nt, Human
agcucuugcuaaucagugucu

SEQ ID NO: 2577181 - RNA, 20 nt, Human
agcucuugcuaaucaguguc

SEQ ID NO: 2577182 - RNA, 19 nt, Human
agcucuugcuaaucagugu

SEQ ID NO: 2577183 - RNA, 15 nt, Human
agcucuugcuaauca

SEQ ID NO: 2577184 - RNA, 16 nt, Human
agcucuuggcuccacu

SEQ ID NO: 2577185 - RNA, 15 nt, Human
agcugacuuuucugu

SEQ ID NO: 2577186 - RNA, 21 nt, Human
agcugacuuuucuguccgagc

SEQ ID NO: 2577187 - RNA, 22 nt, Human
agcugaccucuguuguccuccc

SEQ ID NO: 2577188 - RNA, 21 nt, Human
agcugaccucuguuguccucc

SEQ ID NO: 2577189 - RNA, 22 nt, Human
agcucuuuccuccuuccaugga

SEQ ID NO: 2577190 - RNA, 23 nt, Human
agcucuuuccuccuuccauggaa

SEQ ID NO: 2577191 - RNA, 22 nt, Human
agcucuuuggcagucuauaugu

SEQ ID NO: 2577192 - RNA, 17 nt, Human
agcugaccucuguuguc

SEQ ID NO: 2577193 - RNA, 19 nt, Human
agcugacgaacuuccaugg

SEQ ID NO: 2577194 - RNA, 14 nt, Human
agcugcugaaacaa

SEQ ID NO: 2577195 - RNA, 15 nt, Human
agcugcugaaacaac

SEQ ID NO: 2577196 - RNA, 16 nt, Human
agcugcugaaacaaca

SEQ ID NO: 2577197 - RNA, 20 nt, Human
agcugcugaaacaacaaaua

SEQ ID NO: 2577198 - RNA, 14 nt, Human
agcugccuucccua

SEQ ID NO: 2577199 - RNA, 13 nt, Human
agcugccuucccu

SEQ ID NO: 2577200 - RNA, 12 nt, Human
agcugccuuccc

SEQ ID NO: 2577201 - RNA, 10 nt, Human
agcugccuuc

SEQ ID NO: 2577202 - RNA, 19 nt, Human
agcugccuucccuagcuuu

SEQ ID NO: 2577203 - RNA, 18 nt, Human
agcugccuucccuagcuu

SEQ ID NO: 2577204 - RNA, 17 nt, Human
agcugccuucccuagcu

SEQ ID NO: 2577205 - RNA, 16 nt, Human
agcugccuucccuagc

SEQ ID NO: 2577206 - RNA, 14 nt, Human
agcugccuuggcuc

SEQ ID NO: 2577207 - RNA, 16 nt, Human
agcugccuuggcucag

SEQ ID NO: 2577208 - RNA, 17 nt, Human
agcugccuuggcucaga

SEQ ID NO: 2577209 - RNA, 19 nt, Human
agcugccuuggcucagaca

SEQ ID NO: 2577210 - RNA, 20 nt, Human
agcugccuuggcucagacau

SEQ ID NO: 2577211 - RNA, 17 nt, Human
agcugcgcuugcuuuuc

SEQ ID NO: 2577212 - RNA, 22 nt, Human
agcugccuugagccuuaaaacc

SEQ ID NO: 2577213 - RNA, 15 nt, Human
agcuggucccacuca

SEQ ID NO: 2577214 - RNA, 22 nt, Human
agcugguaguuaguagcauguu

SEQ ID NO: 2577215 - RNA, 19 nt, Human
agcugguaguuaguagcau

SEQ ID NO: 2577216 - RNA, 21 nt, Human
agcugguaguuaguagcaugu

SEQ ID NO: 2577217 - RNA, 14 nt, Human
agcuggguuggaaa

SEQ ID NO: 2577218 - RNA, 16 nt, Human
agcuggguuggaaaac

SEQ ID NO: 2577219 - RNA, 20 nt, Human
agcuggguuggaaaacagua

SEQ ID NO: 2577220 - RNA, 18 nt, Human
agcugcgcuugcuuuucu

SEQ ID NO: 2577221 - RNA, 20 nt, Human
agcugguaaucuugcucugc

SEQ ID NO: 2577222 - RNA, 15 nt, Human
agcugguaguuagua

SEQ ID NO: 2577223 - RNA, 15 nt, Human
agcugguuagaaaug

SEQ ID NO: 2577224 - RNA, 18 nt, Human
agcuggugucugauuguu

SEQ ID NO: 2577225 - RNA, 16 nt, Human
agcuggugguuucacg

SEQ ID NO: 2577226 - RNA, 14 nt, Human
agcuggugguuuca

SEQ ID NO: 2577227 - RNA, 12 nt, Human
agcuggugguuu

SEQ ID NO: 2577228 - RNA, 13 nt, Human
agcuggugggaag

SEQ ID NO: 2577229 - RNA, 15 nt, Human
agcuggugggaagcg

SEQ ID NO: 2577230 - RNA, 21 nt, Human
agcuggugguaucugaguuga

SEQ ID NO: 2577231 - RNA, 18 nt, Human
agcuguaugauucccagc

SEQ ID NO: 2577232 - RNA, 17 nt, Human
agcuguaugauucccag

SEQ ID NO: 2577233 - RNA, 19 nt, Human
agcuguauugaaucaugua

SEQ ID NO: 2577234 - RNA, 17 nt, Human
agcugguuagaaaugca

SEQ ID NO: 2577235 - RNA, 11 nt, Human
agcuguauuga

SEQ ID NO: 2577236 - RNA, 16 nt, Human
agcuguauugaaucau

SEQ ID NO: 2577237 - RNA, 15 nt, Human
agcuguauugaauca

SEQ ID NO: 2577238 - RNA, 15 nt, Human
aggaaguacuggaga

SEQ ID NO: 2577239 - RNA, 11 nt, Human
aggaaguacug

SEQ ID NO: 2577240 - RNA, 14 nt, Human
aggaaggugguggg

SEQ ID NO: 2577241 - RNA, 14 nt, Human
aggaagguucuggu

SEQ ID NO: 2577242 - RNA, 16 nt, Human
aggaagguucuggugu

SEQ ID NO: 2577243 - RNA, 21 nt, Human
aggaagguucuggugugaacu

SEQ ID NO: 2577244 - RNA, 16 nt, Human
aggaagguggauggcc

SEQ ID NO: 2577245 - RNA, 15 nt, Human
aggaagguggauggc

SEQ ID NO: 2577246 - RNA, 22 nt, Human
aggaagaacggggcucuucuca

SEQ ID NO: 2577247 - RNA, 18 nt, Human
aggaagaacggggcucuu

SEQ ID NO: 2577248 - RNA, 12 nt, Human
aggaagaacggg

SEQ ID NO: 2577249 - RNA, 21 nt, Human
aggaagaacacccucuaaaug

SEQ ID NO: 2577250 - RNA, 20 nt, Human
aggaagaagcuuaggcaggg

SEQ ID NO: 2577251 - RNA, 15 nt, Human
aggaagaauuuuaaa

SEQ ID NO: 2577252 - RNA, 18 nt, Human
aggaagaagcuuaggcag

SEQ ID NO: 2577253 - RNA, 17 nt, Human
aggaagaagcuuaggca

SEQ ID NO: 2577254 - RNA, 16 nt, Human
aggaagaagcuuaggc

SEQ ID NO: 2577255 - RNA, 14 nt, Human
aggaagguagaaau

SEQ ID NO: 2577256 - RNA, 20 nt, Human
aggaagaauuuuaaaaauga

SEQ ID NO: 2577257 - RNA, 17 nt, Human
aggaagaauuuuaaaaa

SEQ ID NO: 2577258 - RNA, 23 nt, Human
aggaagaauuuuaaaaaugaauc

SEQ ID NO: 2577259 - RNA, 12 nt, Human
aggaacacuccu

SEQ ID NO: 2577260 - RNA, 23 nt, Human
aggaacaaggcaaggcugucaau

SEQ ID NO: 2577261 - RNA, 23 nt, Human
aggaaaaccaagccguggcuucc

SEQ ID NO: 2577262 - RNA, 22 nt, Human
aggaaaaccaagccguggcuuc

SEQ ID NO: 2577263 - RNA, 21 nt, Human
aggaaaaccaagccguggcuu

SEQ ID NO: 2577264 - RNA, 20 nt, Human
aggaaaaccaagccguggcu

SEQ ID NO: 2577265 - RNA, 15 nt, Human
aggaacacuccuuca

SEQ ID NO: 2577266 - RNA, 13 nt, Human
aggaacagaagga

SEQ ID NO: 2577267 - RNA, 14 nt, Human
aggaacagaaggau

SEQ ID NO: 2577268 - RNA, 21 nt, Human
aggaacagaaggaugaaugag

SEQ ID NO: 2577269 - RNA, 21 nt, Human
aggaacagcuaugggagcccc

SEQ ID NO: 2577270 - RNA, 23 nt, Human
aggaacuuaaauaaugugaaacu

SEQ ID NO: 2577271 - RNA, 16 nt, Human
aggaacauaugaaaau

SEQ ID NO: 2577272 - RNA, 23 nt, Human
aggaacacccgacuccucaaaag

SEQ ID NO: 2577273 - RNA, 14 nt, Human
aggaacuuccaggu

SEQ ID NO: 2577274 - RNA, 15 nt, Human
aggaagaaaucacag

SEQ ID NO: 2577275 - RNA, 13 nt, Human
aggaagaaaucac

SEQ ID NO: 2577276 - RNA, 21 nt, Human
agcuuugugacuguauauaaa

SEQ ID NO: 2577277 - RNA, 12 nt, Human
agcuuuguucuu

SEQ ID NO: 2577278 - RNA, 18 nt, Human
agcuuuguucuucuuaaa

SEQ ID NO: 2577279 - RNA, 19 nt, Human
agcuuuguuucaaccaagu

SEQ ID NO: 2577280 - RNA, 22 nt, Human
agcuuuguuuguugucagcuga

SEQ ID NO: 2577281 - RNA, 21 nt, Human
agcuuuguuuguugucagcug

SEQ ID NO: 2577282 - RNA, 17 nt, Human
agcuuuuugucuuuucu

SEQ ID NO: 2577283 - RNA, 14 nt, Human
agcuuuuuucuuua

SEQ ID NO: 2577284 - RNA, 21 nt, Human
agcuuuuuuccuuaauccagc

SEQ ID NO: 2577285 - RNA, 18 nt, Human
agcuuuuuuacacaaaug

SEQ ID NO: 2577286 - RNA, 21 nt, Human
aggaaaaaaaucguccaggga

SEQ ID NO: 2577287 - RNA, 18 nt, Human
aggaaaaaauaacaauga

SEQ ID NO: 2577288 - RNA, 19 nt, Human
aggaaaaauguguaauuuu

SEQ ID NO: 2577289 - RNA, 15 nt, Human
aggaaaaauguguaa

SEQ ID NO: 2577290 - RNA, 13 nt, Human
aggaaaaacaggu

SEQ ID NO: 2577291 - RNA, 19 nt, Human
aggaaaaccaagccguggc

SEQ ID NO: 2577292 - RNA, 19 nt, Human
aggaaaaacacaagcaaaa

SEQ ID NO: 2577293 - RNA, 17 nt, Human
aggaaaaacacaagcaa

SEQ ID NO: 2577294 - RNA, 23 nt, Human
aggaaaaaauguuggauuuauaa

SEQ ID NO: 2577295 - RNA, 14 nt, Human
aggaaaaaaaugac

SEQ ID NO: 2577296 - RNA, 15 nt, Human
aggaaaaaaaugacu

SEQ ID NO: 2577297 - RNA, 22 nt, Human
aggaaaaaaaucguccagggag

SEQ ID NO: 2577298 - RNA, 14 nt, Human
acugauuuuuguga

SEQ ID NO: 2577299 - RNA, 19 nt, Human
acugauuuuuguaagacaa

SEQ ID NO: 2577300 - RNA, 18 nt, Human
acugauuuuuguaagaca

SEQ ID NO: 2577301 - RNA, 15 nt, Human
acugauuuuuguaag

SEQ ID NO: 2577302 - RNA, 15 nt, Human
acugauuuuugugau

SEQ ID NO: 2577303 - RNA, 23 nt, Human
acugaauuauaagaggcugauaa

SEQ ID NO: 2577304 - RNA, 19 nt, Human
acugaauuauaagaggcug

SEQ ID NO: 2577305 - RNA, 12 nt, Human
acugaauuucuu

SEQ ID NO: 2577306 - RNA, 13 nt, Human
acugaauuaauca

SEQ ID NO: 2577307 - RNA, 21 nt, Human
acugaauuaaucaucuauaaa

SEQ ID NO: 2577308 - RNA, 22 nt, Human
acugaauuaaugacagagccag

SEQ ID NO: 2577309 - RNA, 19 nt, Human
acucuaccagacuguguau

SEQ ID NO: 2577310 - RNA, 17 nt, Human
acucuacccauauuaca

SEQ ID NO: 2577311 - RNA, 19 nt, Human
acucuacccauauuacaga

SEQ ID NO: 2577312 - RNA, 13 nt, Human
acucuacccuccc

SEQ ID NO: 2577313 - RNA, 15 nt, Human
acucuacccucccac

SEQ ID NO: 2577314 - RNA, 16 nt, Human
acucuacccucccacc

SEQ ID NO: 2577315 - RNA, 18 nt, Human
acucuacccucccacccc

SEQ ID NO: 2577316 - RNA, 19 nt, Human
acucuacccucccaccccc

SEQ ID NO: 2577317 - RNA, 12 nt, Human
acugaaugaggu

SEQ ID NO: 2577318 - RNA, 20 nt, Human
acugaaugaggucagcaugu

SEQ ID NO: 2577319 - RNA, 23 nt, Human
acugaaugaaacccccacacaca

SEQ ID NO: 2577320 - RNA, 19 nt, Human
acugaauguuuauuccuug

SEQ ID NO: 2577321 - RNA, 16 nt, Human
acugaaugcucugugc

SEQ ID NO: 2577322 - RNA, 21 nt, Human
acugaaugccucaaugugacc

SEQ ID NO: 2577323 - RNA, 22 nt, Human
acugaaugcuucugacuucaua

SEQ ID NO: 2577324 - RNA, 18 nt, Human
acugacauuguuggccaa

SEQ ID NO: 2577325 - RNA, 17 nt, Human
acugacauuguuggcca

SEQ ID NO: 2577326 - RNA, 20 nt, Human
acugacaccuuugcaggcau

SEQ ID NO: 2577327 - RNA, 17 nt, Human
acugacaccuuugcagg

SEQ ID NO: 2577328 - RNA, 18 nt, Human
acugacauguggggccag

SEQ ID NO: 2577329 - RNA, 12 nt, Human
acugacaugugg

SEQ ID NO: 2577330 - RNA, 21 nt, Human
acugacaggcagccuggacau

SEQ ID NO: 2577331 - RNA, 18 nt, Human
acugacagccucccaccc

SEQ ID NO: 2577332 - RNA, 23 nt, Human
acugacacaaaaaguagauuaag

SEQ ID NO: 2577333 - RNA, 22 nt, Human
acugacacccauguuucucugg

SEQ ID NO: 2577334 - RNA, 21 nt, Human
acugacacccauguuucucug

SEQ ID NO: 2577335 - RNA, 16 nt, Human
acugacacccauguuu

SEQ ID NO: 2577336 - RNA, 23 nt, Human
acugaauuucuuuugccguuauu

SEQ ID NO: 2577337 - RNA, 17 nt, Human
acugaauuguccccagu

SEQ ID NO: 2577338 - RNA, 14 nt, Human
acugauuacugccu

SEQ ID NO: 2577339 - RNA, 22 nt, Human
acugauguuacaucacaguguu

SEQ ID NO: 2577340 - RNA, 21 nt, Human
acugauguuacaucacagugu

SEQ ID NO: 2577341 - RNA, 23 nt, Human
acugaugggcaacccccagccug

SEQ ID NO: 2577342 - RNA, 17 nt, Human
acugaucaugcauuguu

SEQ ID NO: 2577343 - RNA, 20 nt, Human
acugauguaugaggaauuuc

SEQ ID NO: 2577344 - RNA, 19 nt, Human
acugauaugggucuugaua

SEQ ID NO: 2577345 - RNA, 20 nt, Human
acugacaggcagccuggaca

SEQ ID NO: 2577346 - RNA, 22 nt, Human
acugacauguggggccagguca

SEQ ID NO: 2577347 - RNA, 17 nt, Human
acugauauauuuuacaa

SEQ ID NO: 2577348 - RNA, 16 nt, Human
acugauccagcccuga

SEQ ID NO: 2577349 - RNA, 17 nt, Human
acugauccagcccugag

SEQ ID NO: 2577350 - RNA, 15 nt, Human
acugaucaugcauug

SEQ ID NO: 2577351 - RNA, 16 nt, Human
acugaucaugcauugu

SEQ ID NO: 2577352 - RNA, 18 nt, Human
acugaucaugcauuguug

SEQ ID NO: 2577353 - RNA, 15 nt, Human
acugaucacaaaaac

SEQ ID NO: 2577354 - RNA, 20 nt, Human
acugauuuuuuuuuccuuca

SEQ ID NO: 2577355 - RNA, 19 nt, Human
acugauuuuuuuuuccuuc

SEQ ID NO: 2577356 - RNA, 18 nt, Human
acugauuuuuuuuuccuu

SEQ ID NO: 2577357 - RNA, 17 nt, Human
acugauuuuuuuuuccu

SEQ ID NO: 2577358 - RNA, 16 nt, Human
acugauuuuuuuuucc

SEQ ID NO: 2577359 - RNA, 14 nt, Human
acugauuuuuguaa

SEQ ID NO: 2577360 - RNA, 22 nt, Human
acugauuuuguuauuuuuauau

SEQ ID NO: 2577361 - RNA, 16 nt, Human
acugauuuggagauau

SEQ ID NO: 2577362 - RNA, 14 nt, Human
acugauuuccuuug

SEQ ID NO: 2577363 - RNA, 13 nt, Human
acugauuuccuuu

SEQ ID NO: 2577364 - RNA, 19 nt, Human
acucguuaauuuguagugu

SEQ ID NO: 2577365 - RNA, 14 nt, Human
acucguuaauuugu

SEQ ID NO: 2577366 - RNA, 19 nt, Human
acucuaaaagguucaggga

SEQ ID NO: 2577367 - RNA, 18 nt, Human
acucuaaaagguucaggg

SEQ ID NO: 2577368 - RNA, 16 nt, Human
acucuaaaagguucag

SEQ ID NO: 2577369 - RNA, 15 nt, Human
acucuaaaagguuca

SEQ ID NO: 2577370 - RNA, 21 nt, Human
acucuaaaagauccuuuuuaa

SEQ ID NO: 2577371 - RNA, 15 nt, Human
acucuaaaagauccu

SEQ ID NO: 2577372 - RNA, 14 nt, Human
acucuaaaagaucc

SEQ ID NO: 2577373 - RNA, 12 nt, Human
acucuaaaagau

SEQ ID NO: 2577374 - RNA, 19 nt, Human
acucuacauaauuuagagu

SEQ ID NO: 2577375 - RNA, 13 nt, Human
acucuacauaauu

SEQ ID NO: 2577376 - RNA, 14 nt, Human
acucuaccagacug

SEQ ID NO: 2577377 - RNA, 16 nt, Human
acucuacacugugaac

SEQ ID NO: 2577378 - RNA, 15 nt, Human
acucuacagaggcca

SEQ ID NO: 2577379 - RNA, 21 nt, Human
acuccguuggccacuccgaga

SEQ ID NO: 2577380 - RNA, 18 nt, Human
acuccguuggccacuccg

SEQ ID NO: 2577381 - RNA, 16 nt, Human
acuccgucucaaggaa

SEQ ID NO: 2577382 - RNA, 17 nt, Human
acuccguuggccacucc

SEQ ID NO: 2577383 - RNA, 15 nt, Human
acuccguuggccacu

SEQ ID NO: 2577384 - RNA, 22 nt, Human
acuccggguuugagauggacac

SEQ ID NO: 2577385 - RNA, 15 nt, Human
acuccgucucaagga

SEQ ID NO: 2577386 - RNA, 21 nt, Human
acuccggugugccugcagccc

SEQ ID NO: 2577387 - RNA, 19 nt, Human
acuccggugugccugcagc

SEQ ID NO: 2577388 - RNA, 20 nt, Human
acuccggugugccugcagcc

SEQ ID NO: 2577389 - RNA, 17 nt, Human
acuccggggagcgcccg

SEQ ID NO: 2577390 - RNA, 15 nt, Human
acuccggugugccug

SEQ ID NO: 2577391 - RNA, 16 nt, Human
acuccggugugccugc

SEQ ID NO: 2577392 - RNA, 23 nt, Human
acuccggccugaugacagagcga

SEQ ID NO: 2577393 - RNA, 19 nt, Human
acuccggccugaugacaga

SEQ ID NO: 2577394 - RNA, 15 nt, Human
acuccggcccuccua

SEQ ID NO: 2577395 - RNA, 18 nt, Human
acuccggagugagaagcu

SEQ ID NO: 2577396 - RNA, 14 nt, Human
acuccggcccuccu

SEQ ID NO: 2577397 - RNA, 16 nt, Human
acucccacacccaaga

SEQ ID NO: 2577398 - RNA, 19 nt, Human
acucccaagucuacagagu

SEQ ID NO: 2577399 - RNA, 23 nt, Human
acucccaaguaugggguucaaga

SEQ ID NO: 2577400 - RNA, 14 nt, Human
acucccaaguaugg

SEQ ID NO: 2577401 - RNA, 15 nt, Human
acucccaagcuggac

SEQ ID NO: 2577402 - RNA, 13 nt, Human
acuccaugagcac

SEQ ID NO: 2577403 - RNA, 17 nt, Human
acuccaugagaagccgu

SEQ ID NO: 2577404 - RNA, 21 nt, Human
acuccaugcuuagucacugcc

SEQ ID NO: 2577405 - RNA, 17 nt, Human
acuccaugagcacccca

SEQ ID NO: 2577406 - RNA, 22 nt, Human
acucccaucugugaaaggaaag

SEQ ID NO: 2577407 - RNA, 16 nt, Human
acucccacuucccuga

SEQ ID NO: 2577408 - RNA, 14 nt, Human
acucccacuucccu

SEQ ID NO: 2577409 - RNA, 20 nt, Human
acucccacuucccugacacu

SEQ ID NO: 2577410 - RNA, 17 nt, Human
acucccacuucccugac

SEQ ID NO: 2577411 - RNA, 17 nt, Human
acucccagacacccacc

SEQ ID NO: 2577412 - RNA, 13 nt, Human
acucccauuccug

SEQ ID NO: 2577413 - RNA, 16 nt, Human
acucccauuccugaag

SEQ ID NO: 2577414 - RNA, 20 nt, Human
acucccauuccugaagaacc

SEQ ID NO: 2577415 - RNA, 13 nt, Human
acucccaggcagc

SEQ ID NO: 2577416 - RNA, 22 nt, Human
acucccaguccaaauguccucc

SEQ ID NO: 2577417 - RNA, 21 nt, Human
acucccucgucgagcuggaug

SEQ ID NO: 2577418 - RNA, 18 nt, Human
acucccugccccccagcc

SEQ ID NO: 2577419 - RNA, 17 nt, Human
acucccuggcucucaga

SEQ ID NO: 2577420 - RNA, 13 nt, Human
acucccuucccau

SEQ ID NO: 2577421 - RNA, 18 nt, Human
acucccuggcucucagaa

SEQ ID NO: 2577422 - RNA, 15 nt, Human
acucccuucuaccug

SEQ ID NO: 2577423 - RNA, 23 nt, Human
acucccuucccaugacccaggcu

SEQ ID NO: 2577424 - RNA, 21 nt, Human
acucccuucccaugacccagg

SEQ ID NO: 2577425 - RNA, 15 nt, Human
acucccuucccauaa

SEQ ID NO: 2577426 - RNA, 22 nt, Human
acucccauuccugaagaaccag

SEQ ID NO: 2577427 - RNA, 15 nt, Human
acucccuccucaccu

SEQ ID NO: 2577428 - RNA, 13 nt, Human
acucccuccucac

SEQ ID NO: 2577429 - RNA, 16 nt, Human
acucccuccucaccuc

SEQ ID NO: 2577430 - RNA, 19 nt, Human
acucccuccucaccucugg

SEQ ID NO: 2577431 - RNA, 20 nt, Human
acucccuccucaccucugga

SEQ ID NO: 2577432 - RNA, 22 nt, Human
acucccuccucaccucuggacu

SEQ ID NO: 2577433 - RNA, 20 nt, Human
acucccuucuaccugccacu

SEQ ID NO: 2577434 - RNA, 19 nt, Human
acucccuucuaccugccac

SEQ ID NO: 2577435 - RNA, 18 nt, Human
acucccuucuaccugcca

SEQ ID NO: 2577436 - RNA, 17 nt, Human
acucccuucuaccugcc

SEQ ID NO: 2577437 - RNA, 23 nt, Human
acuccgagaggugggccagucug

SEQ ID NO: 2577438 - RNA, 22 nt, Human
acuccgagaggugggccagucu

SEQ ID NO: 2577439 - RNA, 14 nt, Human
acucccuuucaaca

SEQ ID NO: 2577440 - RNA, 14 nt, Human
acuccggagacagg

SEQ ID NO: 2577441 - RNA, 22 nt, Human
acuccgcuggagguggggccug

SEQ ID NO: 2577442 - RNA, 14 nt, Human
acuccgcuggaggu

SEQ ID NO: 2577443 - RNA, 23 nt, Human
acuccggagugagaagcuuugcc

SEQ ID NO: 2577444 - RNA, 16 nt, Human
acuccggagacagggu

SEQ ID NO: 2577445 - RNA, 15 nt, Human
acuccggagacaggg

SEQ ID NO: 2577446 - RNA, 13 nt, Human
acuccggcccucc

SEQ ID NO: 2577447 - RNA, 18 nt, Human
acugugcccugguggaga

SEQ ID NO: 2577448 - RNA, 17 nt, Human
acugugcccugguggag

SEQ ID NO: 2577449 - RNA, 15 nt, Human
acugugcccuggugg

SEQ ID NO: 2577450 - RNA, 14 nt, Human
acugugcccuggug

SEQ ID NO: 2577451 - RNA, 13 nt, Human
acugugcccuggu

SEQ ID NO: 2577452 - RNA, 12 nt, Human
acugugcccugg

SEQ ID NO: 2577453 - RNA, 21 nt, Human
acugucuuuuuuucccuacca

SEQ ID NO: 2577454 - RNA, 18 nt, Human
acugugccaugugccagg

SEQ ID NO: 2577455 - RNA, 17 nt, Human
acugugccaugugccag

SEQ ID NO: 2577456 - RNA, 23 nt, Human
acugucuuuuuucuaaaguaaaa

SEQ ID NO: 2577457 - RNA, 22 nt, Human
acugucuuuuuucuaaaguaaa

SEQ ID NO: 2577458 - RNA, 16 nt, Human
acugugccaugugcca

SEQ ID NO: 2577459 - RNA, 14 nt, Human
acugucuuuccuag

SEQ ID NO: 2577460 - RNA, 22 nt, Human
acuguaacugugucaugauuca

SEQ ID NO: 2577461 - RNA, 16 nt, Human
acugugaagagaacca

SEQ ID NO: 2577462 - RNA, 18 nt, Human
acuguaaagaaagagaga

SEQ ID NO: 2577463 - RNA, 19 nt, Human
acuguaaagaaagagagaa

SEQ ID NO: 2577464 - RNA, 20 nt, Human
acuguaaagaaagagagaaa

SEQ ID NO: 2577465 - RNA, 21 nt, Human
acuguaaagaaagagagaaaa

SEQ ID NO: 2577466 - RNA, 22 nt, Human
acuguaaagaaagagagaaaau

SEQ ID NO: 2577467 - RNA, 23 nt, Human
acuguaaagaaagagagaaaaua

SEQ ID NO: 2577468 - RNA, 18 nt, Human
acuguaaauaaaaagaaa

SEQ ID NO: 2577469 - RNA, 13 nt, Human
acuguaacacuuu

SEQ ID NO: 2577470 - RNA, 10 nt, Human
acuguaacac

SEQ ID NO: 2577471 - RNA, 20 nt, Human
acuguaacacuuuacaaugu

SEQ ID NO: 2577472 - RNA, 23 nt, Human
acuguaaagagaccuaccucagg

SEQ ID NO: 2577473 - RNA, 17 nt, Human
acuguaaagagaccuac

SEQ ID NO: 2577474 - RNA, 16 nt, Human
acugucuuuuuucuaa

SEQ ID NO: 2577475 - RNA, 13 nt, Human
acuguaaagaaag

SEQ ID NO: 2577476 - RNA, 14 nt, Human
acuguaaagaaaga

SEQ ID NO: 2577477 - RNA, 15 nt, Human
acuguaaagaaagag

SEQ ID NO: 2577478 - RNA, 16 nt, Human
acuguaaagaaagaga

SEQ ID NO: 2577479 - RNA, 23 nt, Human
acuggugcuauaggcuggagaag

SEQ ID NO: 2577480 - RNA, 16 nt, Human
acuguaaaaugaaauu

SEQ ID NO: 2577481 - RNA, 17 nt, Human
acuguaaaauaauaacu

SEQ ID NO: 2577482 - RNA, 12 nt, Human
acugguggcccg

SEQ ID NO: 2577483 - RNA, 21 nt, Human
acuggugacugcgaucuucag

SEQ ID NO: 2577484 - RNA, 12 nt, Human
acuggugacugc

SEQ ID NO: 2577485 - RNA, 14 nt, Human
acuggugagcagac

SEQ ID NO: 2577486 - RNA, 16 nt, Human
acuggugagcagacug

SEQ ID NO: 2577487 - RNA, 14 nt, Human
acuggaguggagca

SEQ ID NO: 2577488 - RNA, 18 nt, Human
acuggagugcagggagga

SEQ ID NO: 2577489 - RNA, 17 nt, Human
acuggaguggagcauug

SEQ ID NO: 2577490 - RNA, 16 nt, Human
acuggagguugaagcc

SEQ ID NO: 2577491 - RNA, 23 nt, Human
acuggaggucacauucaggaaga

SEQ ID NO: 2577492 - RNA, 21 nt, Human
acuggaggucacauucaggaa

SEQ ID NO: 2577493 - RNA, 20 nt, Human
acuggaggucacauucagga

SEQ ID NO: 2577494 - RNA, 19 nt, Human
acuggaggucacauucagg

SEQ ID NO: 2577495 - RNA, 14 nt, Human
acuggaggucacau

SEQ ID NO: 2577496 - RNA, 21 nt, Human
acuggaggggacgcugguaga

SEQ ID NO: 2577497 - RNA, 22 nt, Human
acuggaggggacgcugguagag

SEQ ID NO: 2577498 - RNA, 18 nt, Human
acuggagguugaagccaa

SEQ ID NO: 2577499 - RNA, 17 nt, Human
acuggagguugaagcca

SEQ ID NO: 2577500 - RNA, 19 nt, Human
acuggagguugaagccaag

SEQ ID NO: 2577501 - RNA, 12 nt, Human
acuggaguccag

SEQ ID NO: 2577502 - RNA, 17 nt, Human
acuggagugcagggagg

SEQ ID NO: 2577503 - RNA, 13 nt, Human
acuggagugcagg

SEQ ID NO: 2577504 - RNA, 17 nt, Human
acuggaguccagucucu

SEQ ID NO: 2577505 - RNA, 15 nt, Human
acuggaaaggggaga

SEQ ID NO: 2577506 - RNA, 17 nt, Human
acuggaaaggggagagc

SEQ ID NO: 2577507 - RNA, 16 nt, Human
acugccuacugcaucg

SEQ ID NO: 2577508 - RNA, 14 nt, Human
acugccuacugcau

SEQ ID NO: 2577509 - RNA, 15 nt, Human
acugccuauuuuaau

SEQ ID NO: 2577510 - RNA, 23 nt, Human
acuggaaaggggagagccugcug

SEQ ID NO: 2577511 - RNA, 22 nt, Human
acuggaaaggggagagccugcu

SEQ ID NO: 2577512 - RNA, 21 nt, Human
acuggaaaggggagagccugc

SEQ ID NO: 2577513 - RNA, 20 nt, Human
acuggaaaggggagagccug

SEQ ID NO: 2577514 - RNA, 12 nt, Human
acuggaacucuc

SEQ ID NO: 2577515 - RNA, 20 nt, Human
acuggaggagagaagaauga

SEQ ID NO: 2577516 - RNA, 18 nt, Human
acuggaggagagaagaau

SEQ ID NO: 2577517 - RNA, 17 nt, Human
acuggaggagagaagaa

SEQ ID NO: 2577518 - RNA, 16 nt, Human
acuggagcccaggagu

SEQ ID NO: 2577519 - RNA, 16 nt, Human
acuggaggagagaaga

SEQ ID NO: 2577520 - RNA, 16 nt, Human
acuggaaccagggaga

SEQ ID NO: 2577521 - RNA, 15 nt, Human
acuggaaccagggag

SEQ ID NO: 2577522 - RNA, 11 nt, Human
acuggagcccc

SEQ ID NO: 2577523 - RNA, 14 nt, Human
acugccaugccagc

SEQ ID NO: 2577524 - RNA, 21 nt, Human
acugccauggaggcacacagc

SEQ ID NO: 2577525 - RNA, 18 nt, Human
acugccauggaggcacac

SEQ ID NO: 2577526 - RNA, 15 nt, Human
acugccuaagcccuc

SEQ ID NO: 2577527 - RNA, 14 nt, Human
acugccuaagcccu

SEQ ID NO: 2577528 - RNA, 19 nt, Human
acugccgaccgaggcugga

SEQ ID NO: 2577529 - RNA, 18 nt, Human
acugccgaccgaggcugg

SEQ ID NO: 2577530 - RNA, 22 nt, Human
acugccgcaagucugcagcccg

SEQ ID NO: 2577531 - RNA, 22 nt, Human
acugccgaccgaggcuggagcu

SEQ ID NO: 2577532 - RNA, 23 nt, Human
acugccgaccgaggcuggagcug

SEQ ID NO: 2577533 - RNA, 19 nt, Human
acugcccaggccugccugu

SEQ ID NO: 2577534 - RNA, 14 nt, Human
acugcccacccccu

SEQ ID NO: 2577535 - RNA, 13 nt, Human
acugcccaccccc

SEQ ID NO: 2577536 - RNA, 19 nt, Human
acugcccaaagugcuucca

SEQ ID NO: 2577537 - RNA, 14 nt, Human
acugcccaaagugc

SEQ ID NO: 2577538 - RNA, 16 nt, Human
acugcccacccccuca

SEQ ID NO: 2577539 - RNA, 15 nt, Human
acugcccacccccuc

SEQ ID NO: 2577540 - RNA, 17 nt, Human
acugcccacccccucaa

SEQ ID NO: 2577541 - RNA, 15 nt, Human
acuguuucaaacuuu

SEQ ID NO: 2577542 - RNA, 18 nt, Human
acuguuucaaacuuuacu

SEQ ID NO: 2577543 - RNA, 19 nt, Human
acuguuucaaacuuuacua

SEQ ID NO: 2577544 - RNA, 12 nt, Human
acuguuucucug

SEQ ID NO: 2577545 - RNA, 13 nt, Human
acuguuuuuaccc

SEQ ID NO: 2577546 - RNA, 14 nt, Human
acuguuuuuuccug

SEQ ID NO: 2577547 - RNA, 23 nt, Human
acuguuuuuacccauauccccuc

SEQ ID NO: 2577548 - RNA, 21 nt, Human
acuguuuuuacccauaucccc

SEQ ID NO: 2577549 - RNA, 17 nt, Human
acuguuuuuacccauau

SEQ ID NO: 2577550 - RNA, 16 nt, Human
acuguuuuuacccaua

SEQ ID NO: 2577551 - RNA, 15 nt, Human
acuguuuuuacccau

SEQ ID NO: 2577552 - RNA, 14 nt, Human
acuguuuuuaccca

SEQ ID NO: 2577553 - RNA, 23 nt, Human
acuguuuuucagggagguggcug

SEQ ID NO: 2577554 - RNA, 18 nt, Human
acuucaaauccuugaaga

SEQ ID NO: 2577555 - RNA, 17 nt, Human
acuucaaauccuugaag

SEQ ID NO: 2577556 - RNA, 22 nt, Human
acuuaaaaaugguuuaaauggu

SEQ ID NO: 2577557 - RNA, 18 nt, Human
acuuaaaaauguaaauau

SEQ ID NO: 2577558 - RNA, 17 nt, Human
acuuaaaaauguaaaua

SEQ ID NO: 2577559 - RNA, 16 nt, Human
acuuaaaaauguaaau

SEQ ID NO: 2577560 - RNA, 14 nt, Human
acuuaaaaauguaa

SEQ ID NO: 2577561 - RNA, 23 nt, Human
acuuaaaaauguaaauauucuau

SEQ ID NO: 2577562 - RNA, 19 nt, Human
acuuaaaaauguaaauauu

SEQ ID NO: 2577563 - RNA, 17 nt, Human
acuguuuuuuccugagc

SEQ ID NO: 2577564 - RNA, 18 nt, Human
acuguuuuuuccugagcu

SEQ ID NO: 2577565 - RNA, 19 nt, Human
acuguuuuuuccugagcuu

SEQ ID NO: 2577566 - RNA, 13 nt, Human
acuuaaaaaaaug

SEQ ID NO: 2577567 - RNA, 14 nt, Human
acuuaaaaaaauga

SEQ ID NO: 2577568 - RNA, 15 nt, Human
acuuaaaaaaaugac

SEQ ID NO: 2577569 - RNA, 16 nt, Human
acuuaaaaaaaugaca

SEQ ID NO: 2577570 - RNA, 17 nt, Human
acuuaaaaaaaugacag

SEQ ID NO: 2577571 - RNA, 22 nt, Human
acuuaaaaaaaugacagauguu

SEQ ID NO: 2577572 - RNA, 13 nt, Human
acuuaaaaaacuu

SEQ ID NO: 2577573 - RNA, 23 nt, Human
acuuaaaaaacuuguaaaugcug

SEQ ID NO: 2577574 - RNA, 14 nt, Human
acuuaaaaaauguc

SEQ ID NO: 2577575 - RNA, 17 nt, Human
acuuguauauuuguaca

SEQ ID NO: 2577576 - RNA, 16 nt, Human
acuuguauauuuguac

SEQ ID NO: 2577577 - RNA, 14 nt, Human
acuuguacaaaaua

SEQ ID NO: 2577578 - RNA, 18 nt, Human
acuuguacaaaauaaaca

SEQ ID NO: 2577579 - RNA, 20 nt, Human
acuuguacaaaauaaacaaa

SEQ ID NO: 2577580 - RNA, 18 nt, Human
acuuguaauuuuuuuaau

SEQ ID NO: 2577581 - RNA, 14 nt, Human
acuuggucaccagc

SEQ ID NO: 2577582 - RNA, 17 nt, Human
acuuguagggaugccuu

SEQ ID NO: 2577583 - RNA, 15 nt, Human
acuuguauauuugua

SEQ ID NO: 2577584 - RNA, 14 nt, Human
acuuguauauuugu

SEQ ID NO: 2577585 - RNA, 14 nt, Human
acuugaaaauuaac

SEQ ID NO: 2577586 - RNA, 12 nt, Human
acuugaaaauua

SEQ ID NO: 2577587 - RNA, 20 nt, Human
acuucuuuugcucuuagcug

SEQ ID NO: 2577588 - RNA, 13 nt, Human
acuuggucuguga

SEQ ID NO: 2577589 - RNA, 15 nt, Human
acuugggucuucccu

SEQ ID NO: 2577590 - RNA, 23 nt, Human
acuuggggggcugaggugggagg

SEQ ID NO: 2577591 - RNA, 20 nt, Human
acuucuugaaggugcugacg

SEQ ID NO: 2577592 - RNA, 17 nt, Human
acuucagagagcuggua

SEQ ID NO: 2577593 - RNA, 18 nt, Human
acuucagagagcugguag

SEQ ID NO: 2577594 - RNA, 20 nt, Human
acuucagagagcugguaguu

SEQ ID NO: 2577595 - RNA, 21 nt, Human
acuucagacauagaauuaaca

SEQ ID NO: 2577596 - RNA, 13 nt, Human
acuucagacugaa

SEQ ID NO: 2577597 - RNA, 19 nt, Human
acuucagacugaacaugua

SEQ ID NO: 2577598 - RNA, 15 nt, Human
acuucagagagcugg

SEQ ID NO: 2577599 - RNA, 16 nt, Human
acuucagagagcuggu

SEQ ID NO: 2577600 - RNA, 16 nt, Human
acuucaaacugagauc

SEQ ID NO: 2577601 - RNA, 22 nt, Human
acuucuuggcuuggugaggaaa

SEQ ID NO: 2577602 - RNA, 22 nt, Human
accuuggcaccagacacccagg

SEQ ID NO: 2577603 - RNA, 19 nt, Human
accuuggacauccuccucc

SEQ ID NO: 2577604 - RNA, 18 nt, Human
accuuggacauccuccuc

SEQ ID NO: 2577605 - RNA, 19 nt, Human
accuugcuuugauggaaua

SEQ ID NO: 2577606 - RNA, 14 nt, Human
accuuggcaccaga

SEQ ID NO: 2577607 - RNA, 16 nt, Human
accuuggcaccagaca

SEQ ID NO: 2577608 - RNA, 17 nt, Human
accuuggcaccagacac

SEQ ID NO: 2577609 - RNA, 18 nt, Human
accuuggcaccagacacc

SEQ ID NO: 2577610 - RNA, 23 nt, Human
accucugccugaagucacacagu

SEQ ID NO: 2577611 - RNA, 20 nt, Human
accucugccugaagucacac

SEQ ID NO: 2577612 - RNA, 12 nt, Human
accucugccuga

SEQ ID NO: 2577613 - RNA, 20 nt, Human
accucugccucagaaaacaa

SEQ ID NO: 2577614 - RNA, 19 nt, Human
accugccaggaagccagca

SEQ ID NO: 2577615 - RNA, 17 nt, Human
accucuguucaguguaa

SEQ ID NO: 2577616 - RNA, 18 nt, Human
accucuguucaguguaaa

SEQ ID NO: 2577617 - RNA, 19 nt, Human
accucuguucaguguaaau

SEQ ID NO: 2577618 - RNA, 22 nt, Human
accucuguucaguguaaauagu

SEQ ID NO: 2577619 - RNA, 12 nt, Human
accucugugugc

SEQ ID NO: 2577620 - RNA, 11 nt, Human
accucugugug

SEQ ID NO: 2577621 - RNA, 14 nt, Human
accucuguucagug

SEQ ID NO: 2577622 - RNA, 15 nt, Human
accucuguucagugu

SEQ ID NO: 2577623 - RNA, 15 nt, Human
accucugugugcucc

SEQ ID NO: 2577624 - RNA, 19 nt, Human
accucugugaccucaggca

SEQ ID NO: 2577625 - RNA, 18 nt, Human
accucugugaccucaggc

SEQ ID NO: 2577626 - RNA, 17 nt, Human
accucugugaccucagg

SEQ ID NO: 2577627 - RNA, 16 nt, Human
accucugugaccucag

SEQ ID NO: 2577628 - RNA, 15 nt, Human
accucugugaccuca

SEQ ID NO: 2577629 - RNA, 14 nt, Human
accucugugaccuc

SEQ ID NO: 2577630 - RNA, 22 nt, Human
accucugucuuggcuuucaugu

SEQ ID NO: 2577631 - RNA, 19 nt, Human
accucugucuuggcuuuca

SEQ ID NO: 2577632 - RNA, 22 nt, Human
accugccaggaagccagcaggc

SEQ ID NO: 2577633 - RNA, 21 nt, Human
accugccaggaagccagcagg

SEQ ID NO: 2577634 - RNA, 23 nt, Human
accugccaggaagccagcaggcu

SEQ ID NO: 2577635 - RNA, 18 nt, Human
accugcccccuucuccca

SEQ ID NO: 2577636 - RNA, 13 nt, Human
accugccaggcag

SEQ ID NO: 2577637 - RNA, 16 nt, Human
accucuguuguccucc

SEQ ID NO: 2577638 - RNA, 14 nt, Human
accucuguuguccu

SEQ ID NO: 2577639 - RNA, 19 nt, Human
accugcccccuucucccac

SEQ ID NO: 2577640 - RNA, 20 nt, Human
accugcccccuucucccaca

SEQ ID NO: 2577641 - RNA, 22 nt, Human
accugcccccuucucccacacu

SEQ ID NO: 2577642 - RNA, 23 nt, Human
accugcccccuucucccacacug

SEQ ID NO: 2577643 - RNA, 15 nt, Human
accugccccucaacu

SEQ ID NO: 2577644 - RNA, 12 nt, Human
accugccccuca

SEQ ID NO: 2577645 - RNA, 20 nt, Human
accugccccucaacucuccu

SEQ ID NO: 2577646 - RNA, 16 nt, Human
accugccccgcccagc

SEQ ID NO: 2577647 - RNA, 17 nt, Human
accugccccgcccagcu

SEQ ID NO: 2577648 - RNA, 15 nt, Human
accuguaacuuuugu

SEQ ID NO: 2577649 - RNA, 23 nt, Human
accugccccgcccagcugcaccu

SEQ ID NO: 2577650 - RNA, 17 nt, Human
accuguaacuuuuguaa

SEQ ID NO: 2577651 - RNA, 19 nt, Human
accugugcuucgggcccuu

SEQ ID NO: 2577652 - RNA, 22 nt, Human
accugugcuucgggcccuuccc

SEQ ID NO: 2577653 - RNA, 15 nt, Human
accugugccucggcu

SEQ ID NO: 2577654 - RNA, 16 nt, Human
accugugccucggcuu

SEQ ID NO: 2577655 - RNA, 23 nt, Human
accugugcuucgggcccuuccca

SEQ ID NO: 2577656 - RNA, 19 nt, Human
accugugaugaggggagga

SEQ ID NO: 2577657 - RNA, 17 nt, Human
accuguggccaaguucu

SEQ ID NO: 2577658 - RNA, 18 nt, Human
accuguaauaaauaugag

SEQ ID NO: 2577659 - RNA, 17 nt, Human
accuguaauaaauauga

SEQ ID NO: 2577660 - RNA, 16 nt, Human
accuguaauaaauaug

SEQ ID NO: 2577661 - RNA, 15 nt, Human
accuguaauaaauau

SEQ ID NO: 2577662 - RNA, 13 nt, Human
accuguaauaaau

SEQ ID NO: 2577663 - RNA, 20 nt, Human
accuguaacuuuuguaaaua

SEQ ID NO: 2577664 - RNA, 23 nt, Human
accuguaauaaauaugagugcca

SEQ ID NO: 2577665 - RNA, 21 nt, Human
accuguaauaaauaugagugc

SEQ ID NO: 2577666 - RNA, 11 nt, Human
accuguaauca

SEQ ID NO: 2577667 - RNA, 15 nt, Human
accuguaaucccagc

SEQ ID NO: 2577668 - RNA, 14 nt, Human
accuguaaucccag

SEQ ID NO: 2577669 - RNA, 18 nt, Human
accugugaguuuaaagca

SEQ ID NO: 2577670 - RNA, 14 nt, Human
accugugccucggc

SEQ ID NO: 2577671 - RNA, 19 nt, Human
accugugaguuuaaagcaa

SEQ ID NO: 2577672 - RNA, 19 nt, Human
accuguaaucccagcuacu

SEQ ID NO: 2577673 - RNA, 16 nt, Human
accuguaaucccagca

SEQ ID NO: 2577674 - RNA, 19 nt, Human
accuguaaucccagcacuu

SEQ ID NO: 2577675 - RNA, 14 nt, Human
acguggagagcugg

SEQ ID NO: 2577676 - RNA, 17 nt, Human
acguggacguuuuuaau

SEQ ID NO: 2577677 - RNA, 15 nt, Human
acguggagagcuggu

SEQ ID NO: 2577678 - RNA, 16 nt, Human
acguggagagcuggug

SEQ ID NO: 2577679 - RNA, 18 nt, Human
acguggagagcuggugcc

SEQ ID NO: 2577680 - RNA, 19 nt, Human
acguggagagcuggugccc

SEQ ID NO: 2577681 - RNA, 22 nt, Human
acgugccuuuugcaccccuccc

SEQ ID NO: 2577682 - RNA, 21 nt, Human
acgugccuuuugcaccccucc

SEQ ID NO: 2577683 - RNA, 20 nt, Human
acgugccuuuugcaccccuc

SEQ ID NO: 2577684 - RNA, 13 nt, Human
acgugccaggccc

SEQ ID NO: 2577685 - RNA, 14 nt, Human
acgugccaggcccg

SEQ ID NO: 2577686 - RNA, 18 nt, Human
acgugccaggcccggggc

SEQ ID NO: 2577687 - RNA, 19 nt, Human
acgugccaggcccggggcu

SEQ ID NO: 2577688 - RNA, 19 nt, Human
acgugccuuuugcaccccu

SEQ ID NO: 2577689 - RNA, 17 nt, Human
acgugccuuuugcaccc

SEQ ID NO: 2577690 - RNA, 15 nt, Human
acgugccuuuugcac

SEQ ID NO: 2577691 - RNA, 21 nt, Human
acgugccaggcccggggcugg

SEQ ID NO: 2577692 - RNA, 23 nt, Human
acuaaugccuuacucuucuugaa

SEQ ID NO: 2577693 - RNA, 24 nt, Human
acuaaugccuuacucuucuugaaa

SEQ ID NO: 2577694 - RNA, 19 nt, Human
acuaaugccuuacucuucu

SEQ ID NO: 2577695 - RNA, 18 nt, Human
acuaauggggcggugaga

SEQ ID NO: 2577696 - RNA, 23 nt, Human
acgcagcccugcuuugggcugcc

SEQ ID NO: 2577697 - RNA, 22 nt, Human
acgcagcccugcuuugggcugc

SEQ ID NO: 2577698 - RNA, 24 nt, Human
acgcagcccuagagccugccugga

SEQ ID NO: 2577699 - RNA, 23 nt, Human
acgcagcccuagagccugccugg

SEQ ID NO: 2577700 - RNA, 22 nt, Human
acgcagcccuagagccugccug

SEQ ID NO: 2577701 - RNA, 21 nt, Human
acgcagcccuagagccugccu

SEQ ID NO: 2577702 - RNA, 12 nt, Human
acgcagcccugc

SEQ ID NO: 2577703 - RNA, 14 nt, Human
acgcaccugccuca

SEQ ID NO: 2577704 - RNA, 15 nt, Human
acgcaccugccucag

SEQ ID NO: 2577705 - RNA, 13 nt, Human
acgcaccucccau

SEQ ID NO: 2577706 - RNA, 15 nt, Human
acgcaccucccaucc

SEQ ID NO: 2577707 - RNA, 14 nt, Human
acgcagcccuagag

SEQ ID NO: 2577708 - RNA, 20 nt, Human
acgcagcccuagagccugcc

SEQ ID NO: 2577709 - RNA, 19 nt, Human
acgcagcccuagagccugc

SEQ ID NO: 2577710 - RNA, 18 nt, Human
acgcagcccuagagccug

SEQ ID NO: 2577711 - RNA, 19 nt, Human
acgcaccucccauccuaau

SEQ ID NO: 2577712 - RNA, 19 nt, Human
acgcugugcugcccugccc

SEQ ID NO: 2577713 - RNA, 22 nt, Human
acgcugugcugcccugcccacc

SEQ ID NO: 2577714 - RNA, 13 nt, Human
acgcuucugaaug

SEQ ID NO: 2577715 - RNA, 12 nt, Human
acgcuucugaau

SEQ ID NO: 2577716 - RNA, 22 nt, Human
acgcuucugaaugcugcuacuu

SEQ ID NO: 2577717 - RNA, 18 nt, Human
acgcuucugaaugcugcu

SEQ ID NO: 2577718 - RNA, 18 nt, Human
acgcuugcguaugucugu

SEQ ID NO: 2577719 - RNA, 17 nt, Human
acgcaggaacucccagc

SEQ ID NO: 2577720 - RNA, 16 nt, Human
acgcaggaacucccag

SEQ ID NO: 2577721 - RNA, 15 nt, Human
acgcugugggcaggu

SEQ ID NO: 2577722 - RNA, 21 nt, Human
acgcuuaaaggugucuuccuc

SEQ ID NO: 2577723 - RNA, 14 nt, Human
acgcugugggcagg

SEQ ID NO: 2577724 - RNA, 23 nt, Human
acgucuuccuucugccugagcuu

SEQ ID NO: 2577725 - RNA, 15 nt, Human
acgcuugcucauuuu

SEQ ID NO: 2577726 - RNA, 12 nt, Human
acgucuucuaaa

SEQ ID NO: 2577727 - RNA, 22 nt, Human
acgugcauugugcuucuuucuu

SEQ ID NO: 2577728 - RNA, 13 nt, Human
acgucugugccau

SEQ ID NO: 2577729 - RNA, 12 nt, Human
acgucugugcca

SEQ ID NO: 2577730 - RNA, 20 nt, Human
acgcuugcguaugucuguua

SEQ ID NO: 2577731 - RNA, 13 nt, Human
acgcuucuucuuu

SEQ ID NO: 2577732 - RNA, 19 nt, Human
acggaauaguuggcuagga

SEQ ID NO: 2577733 - RNA, 17 nt, Human
acggacacucaaaagcu

SEQ ID NO: 2577734 - RNA, 16 nt, Human
acggacacccccucgc

SEQ ID NO: 2577735 - RNA, 15 nt, Human
acggacacccccucg

SEQ ID NO: 2577736 - RNA, 20 nt, Human
acgauuucuguuuagauaau

SEQ ID NO: 2577737 - RNA, 23 nt, Human
acgauuucuguuuagauaauaca

SEQ ID NO: 2577738 - RNA, 19 nt, Human
acgauuucuguuuagauaa

SEQ ID NO: 2577739 - RNA, 17 nt, Human
acgcacagccaaggacu

SEQ ID NO: 2577740 - RNA, 15 nt, Human
acgcacagccaagga

SEQ ID NO: 2577741 - RNA, 14 nt, Human
acgcaccacaucuc

SEQ ID NO: 2577742 - RNA, 22 nt, Human
acgcacacguacuuaaaugaaa

SEQ ID NO: 2577743 - RNA, 21 nt, Human
acgcacacacacacacaggag

SEQ ID NO: 2577744 - RNA, 14 nt, Human
acgcacacacacaa

SEQ ID NO: 2577745 - RNA, 18 nt, Human
acgcacacacacacacag

SEQ ID NO: 2577746 - RNA, 19 nt, Human
acgcacacacacacacagg

SEQ ID NO: 2577747 - RNA, 20 nt, Human
acgcacacacacacacagga

SEQ ID NO: 2577748 - RNA, 21 nt, Human
acgcaaagggcugaaagccau

SEQ ID NO: 2577749 - RNA, 13 nt, Human
acgcacacacaca

SEQ ID NO: 2577750 - RNA, 12 nt, Human
acgcacacacac

SEQ ID NO: 2577751 - RNA, 17 nt, Human
acgcaaagggcugaaag

SEQ ID NO: 2577752 - RNA, 12 nt, Human
acccucaugcug

SEQ ID NO: 2577753 - RNA, 23 nt, Human
acccucaucaccaacgucugugc

SEQ ID NO: 2577754 - RNA, 18 nt, Human
acccuggcacccagggug

SEQ ID NO: 2577755 - RNA, 15 nt, Human
acccuggcauuaugu

SEQ ID NO: 2577756 - RNA, 23 nt, Human
acccuggcacuauaauguaagcu

SEQ ID NO: 2577757 - RNA, 13 nt, Human
acccuggagccca

SEQ ID NO: 2577758 - RNA, 16 nt, Human
acccuggaucaguccu

SEQ ID NO: 2577759 - RNA, 13 nt, Human
acccucaugcugu

SEQ ID NO: 2577760 - RNA, 15 nt, Human
acccucaggacaaug

SEQ ID NO: 2577761 - RNA, 22 nt, Human
acccucagcaccccuuccaugu

SEQ ID NO: 2577762 - RNA, 19 nt, Human
acccucagcaccccuucca

SEQ ID NO: 2577763 - RNA, 18 nt, Human
acccucagcaccccuucc

SEQ ID NO: 2577764 - RNA, 17 nt, Human
acccucagcaccccuuc

SEQ ID NO: 2577765 - RNA, 16 nt, Human
acccucagcaccccuu

SEQ ID NO: 2577766 - RNA, 14 nt, Human
acccucagcacccc

SEQ ID NO: 2577767 - RNA, 18 nt, Human
acccucagagccaccccu

SEQ ID NO: 2577768 - RNA, 13 nt, Human
acccucaggcagg

SEQ ID NO: 2577769 - RNA, 14 nt, Human
acccucaggcaggu

SEQ ID NO: 2577770 - RNA, 13 nt, Human
acccucaucacca

SEQ ID NO: 2577771 - RNA, 19 nt, Human
acccucaggcauaggccug

SEQ ID NO: 2577772 - RNA, 20 nt, Human
acccucaggcauaggccugg

SEQ ID NO: 2577773 - RNA, 22 nt, Human
acccucaggcauaggccugggu

SEQ ID NO: 2577774 - RNA, 23 nt, Human
acccucaggcauaggccugggug

SEQ ID NO: 2577775 - RNA, 15 nt, Human
acccucaggcaggug

SEQ ID NO: 2577776 - RNA, 16 nt, Human
acccucaggcaggugg

SEQ ID NO: 2577777 - RNA, 16 nt, Human
acccugugauggggcc

SEQ ID NO: 2577778 - RNA, 23 nt, Human
acccugucuguagagggcccugg

SEQ ID NO: 2577779 - RNA, 22 nt, Human
acccugucuguagagggcccug

SEQ ID NO: 2577780 - RNA, 14 nt, Human
acccugucucuacu

SEQ ID NO: 2577781 - RNA, 22 nt, Human
acccugucccccagcucuggug

SEQ ID NO: 2577782 - RNA, 21 nt, Human
acccugucucuuaaagaaaaa

SEQ ID NO: 2577783 - RNA, 21 nt, Human
acccugucucuacuaaaaaua

SEQ ID NO: 2577784 - RNA, 19 nt, Human
acccugucccccagcucug

SEQ ID NO: 2577785 - RNA, 16 nt, Human
acccugucccccagcu

SEQ ID NO: 2577786 - RNA, 14 nt, Human
acccugucccccag

SEQ ID NO: 2577787 - RNA, 21 nt, Human
acccugucccccagcucuggu

SEQ ID NO: 2577788 - RNA, 20 nt, Human
acccugucccccagcucugg

SEQ ID NO: 2577789 - RNA, 11 nt, Human
acccugucucu

SEQ ID NO: 2577790 - RNA, 20 nt, Human
acccugggugggcucugugc

SEQ ID NO: 2577791 - RNA, 19 nt, Human
acccugggugggcucugug

SEQ ID NO: 2577792 - RNA, 18 nt, Human
acccugggugggcucugu

SEQ ID NO: 2577793 - RNA, 22 nt, Human
acccuggggccuggaccugccu

SEQ ID NO: 2577794 - RNA, 18 nt, Human
acccuggugguugcuguu

SEQ ID NO: 2577795 - RNA, 19 nt, Human
acccuggugguugcuguuu

SEQ ID NO: 2577796 - RNA, 15 nt, Human
acccuggugggccaa

SEQ ID NO: 2577797 - RNA, 17 nt, Human
acccuggugguugcugu

SEQ ID NO: 2577798 - RNA, 19 nt, Human
acccuguccaaacugccua

SEQ ID NO: 2577799 - RNA, 20 nt, Human
acccuguauauagcccagcc

SEQ ID NO: 2577800 - RNA, 22 nt, Human
acccuguacuguucugugucuu

SEQ ID NO: 2577801 - RNA, 20 nt, Human
acccuguacuguucuguguc

SEQ ID NO: 2577802 - RNA, 18 nt, Human
acccuguauauagcccag

SEQ ID NO: 2577803 - RNA, 15 nt, Human
acccuguauauagcc

SEQ ID NO: 2577804 - RNA, 20 nt, Human
acccugggcucugugggcug

SEQ ID NO: 2577805 - RNA, 13 nt, Human
acccuggggccug

SEQ ID NO: 2577806 - RNA, 19 nt, Human
acccuggggccuggaccug

SEQ ID NO: 2577807 - RNA, 18 nt, Human
acccuggggccuggaccu

SEQ ID NO: 2577808 - RNA, 17 nt, Human
acccuggggccuggacc

SEQ ID NO: 2577809 - RNA, 16 nt, Human
acccuggggagaaagu

SEQ ID NO: 2577810 - RNA, 19 nt, Human
acccugggcucugugggcu

SEQ ID NO: 2577811 - RNA, 18 nt, Human
acccugggcucugugggc

SEQ ID NO: 2577812 - RNA, 17 nt, Human
acccugggcucuguggg

SEQ ID NO: 2577813 - RNA, 21 nt, Human
acccugggcucugggagcagc

SEQ ID NO: 2577814 - RNA, 20 nt, Human
acccugggcucugggagcag

SEQ ID NO: 2577815 - RNA, 19 nt, Human
acccugggcucugggagca

SEQ ID NO: 2577816 - RNA, 20 nt, Human
acccugggcccugggcugga

SEQ ID NO: 2577817 - RNA, 18 nt, Human
acccugggcccugggcug

SEQ ID NO: 2577818 - RNA, 22 nt, Human
acccugggcccugggcuggaau

SEQ ID NO: 2577819 - RNA, 18 nt, Human
acccuggccgaguccaag

SEQ ID NO: 2577820 - RNA, 21 nt, Human
acccuggccgaguccaagcug

SEQ ID NO: 2577821 - RNA, 19 nt, Human
acccuggccgcccccugcc

SEQ ID NO: 2577822 - RNA, 17 nt, Human
acccuggccgcccccug

SEQ ID NO: 2577823 - RNA, 16 nt, Human
acccuggccgcccccu

SEQ ID NO: 2577824 - RNA, 22 nt, Human
acccuggccgaguccaagcugg

SEQ ID NO: 2577825 - RNA, 17 nt, Human
acccugggcccugggcu

SEQ ID NO: 2577826 - RNA, 15 nt, Human
acccugggcccuggg

SEQ ID NO: 2577827 - RNA, 14 nt, Human
acccugggcccugg

SEQ ID NO: 2577828 - RNA, 12 nt, Human
acccugggaccu

SEQ ID NO: 2577829 - RNA, 23 nt, Human
acccugggaccuaggggcgccgc

SEQ ID NO: 2577830 - RNA, 22 nt, Human
acccuggccgcccccugccccc

SEQ ID NO: 2577831 - RNA, 23 nt, Human
acccuauauuuugcauaguacca

SEQ ID NO: 2577832 - RNA, 21 nt, Human
acccuaguucuaccucaggca

SEQ ID NO: 2577833 - RNA, 16 nt, Human
acccuaguuucccuga

SEQ ID NO: 2577834 - RNA, 15 nt, Human
acccuaguucuaccu

SEQ ID NO: 2577835 - RNA, 22 nt, Human
acccuagucccuuccccucccu

SEQ ID NO: 2577836 - RNA, 13 nt, Human
acccuauugcugc

SEQ ID NO: 2577837 - RNA, 17 nt, Human
acccuauauguaguaua

SEQ ID NO: 2577838 - RNA, 15 nt, Human
acccucacacuggga

SEQ ID NO: 2577839 - RNA, 21 nt, Human
acccucaaccucuucuggcuc

SEQ ID NO: 2577840 - RNA, 21 nt, Human
acccucagaaacacuggggcu

SEQ ID NO: 2577841 - RNA, 18 nt, Human
acccucagaaacacuggg

SEQ ID NO: 2577842 - RNA, 11 nt, Human
acccucagagc

SEQ ID NO: 2577843 - RNA, 14 nt, Human
acccuauugcugcu

SEQ ID NO: 2577844 - RNA, 19 nt, Human
acccuauugcugcuugagg

SEQ ID NO: 2577845 - RNA, 22 nt, Human
acccguucugcuggccuggauc

SEQ ID NO: 2577846 - RNA, 20 nt, Human
acccguucugcuggccugga

SEQ ID NO: 2577847 - RNA, 18 nt, Human
acccguucugcuggccug

SEQ ID NO: 2577848 - RNA, 13 nt, Human
acccguucaacuu

SEQ ID NO: 2577849 - RNA, 21 nt, Human
acccguucaacuuuuccuuug

SEQ ID NO: 2577850 - RNA, 16 nt, Human
acccguucacauuuuu

SEQ ID NO: 2577851 - RNA, 16 nt, Human
acccuaaaucuugacu

SEQ ID NO: 2577852 - RNA, 23 nt, Human
acccguucugcuggccuggaucu

SEQ ID NO: 2577853 - RNA, 19 nt, Human
acccuaaaaagcagagcuu

SEQ ID NO: 2577854 - RNA, 19 nt, Human
acccuagccauuccuggua

SEQ ID NO: 2577855 - RNA, 17 nt, Human
acccuagccauuccugg

SEQ ID NO: 2577856 - RNA, 16 nt, Human
acccuagccauuccug

SEQ ID NO: 2577857 - RNA, 23 nt, Human
acccuagccauuccugguaccca

SEQ ID NO: 2577858 - RNA, 18 nt, Human
acccuacuucuuuugcuc

SEQ ID NO: 2577859 - RNA, 14 nt, Human
acccuacuucuuuu

SEQ ID NO: 2577860 - RNA, 13 nt, Human
acccuaccuguuc

SEQ ID NO: 2577861 - RNA, 15 nt, Human
acccuaccccaccac

SEQ ID NO: 2577862 - RNA, 16 nt, Human
acccuaccugugccug

SEQ ID NO: 2577863 - RNA, 17 nt, Human
acccuaccugugccuga

SEQ ID NO: 2577864 - RNA, 13 nt, Human
acccuaccugugc

SEQ ID NO: 2577865 - RNA, 16 nt, Human
acccuaagccuccuuu

SEQ ID NO: 2577866 - RNA, 14 nt, Human
acccuaccccacca

SEQ ID NO: 2577867 - RNA, 16 nt, Human
acccuaagacuccucg

SEQ ID NO: 2577868 - RNA, 22 nt, Human
acccuaaggucauuaccacagg

SEQ ID NO: 2577869 - RNA, 21 nt, Human
accucaggugauccacccacc

SEQ ID NO: 2577870 - RNA, 20 nt, Human
accucaggugauccacccac

SEQ ID NO: 2577871 - RNA, 11 nt, Human
accucaggccu

SEQ ID NO: 2577872 - RNA, 17 nt, Human
accucaggcagcucaag

SEQ ID NO: 2577873 - RNA, 16 nt, Human
accucaggcagcucaa

SEQ ID NO: 2577874 - RNA, 12 nt, Human
accucaggcagg

SEQ ID NO: 2577875 - RNA, 15 nt, Human
accucaggcaggaag

SEQ ID NO: 2577876 - RNA, 23 nt, Human
accucaugcccacccccugcccu

SEQ ID NO: 2577877 - RNA, 20 nt, Human
accucaugcccacccccugc

SEQ ID NO: 2577878 - RNA, 16 nt, Human
accucaugcccacccc

SEQ ID NO: 2577879 - RNA, 13 nt, Human
accucaugcccac

SEQ ID NO: 2577880 - RNA, 21 nt, Human
accucaugcaucuccaccugc

SEQ ID NO: 2577881 - RNA, 20 nt, Human
accucaugcaucuccaccug

SEQ ID NO: 2577882 - RNA, 19 nt, Human
accucaugcaucuccaccu

SEQ ID NO: 2577883 - RNA, 18 nt, Human
accucaugcaucuccacc

SEQ ID NO: 2577884 - RNA, 16 nt, Human
accucaugcaucucca

SEQ ID NO: 2577885 - RNA, 18 nt, Human
accucagucaguauuguu

SEQ ID NO: 2577886 - RNA, 17 nt, Human
accucagucaguauugu

SEQ ID NO: 2577887 - RNA, 22 nt, Human
accucagucaguauuguuuugg

SEQ ID NO: 2577888 - RNA, 15 nt, Human
accucaucuucuuca

SEQ ID NO: 2577889 - RNA, 19 nt, Human
accucagguugcugguugc

SEQ ID NO: 2577890 - RNA, 17 nt, Human
accucagguugcugguu

SEQ ID NO: 2577891 - RNA, 16 nt, Human
accucagguugcuggu

SEQ ID NO: 2577892 - RNA, 15 nt, Human
accucagguugcugg

SEQ ID NO: 2577893 - RNA, 15 nt, Human
accucagucaguauu

SEQ ID NO: 2577894 - RNA, 13 nt, Human
accucaggccagg

SEQ ID NO: 2577895 - RNA, 20 nt, Human
accucaggccaggugcagug

SEQ ID NO: 2577896 - RNA, 14 nt, Human
accucagguugcug

SEQ ID NO: 2577897 - RNA, 23 nt, Human
accucaggcacuagccuuuggcu

SEQ ID NO: 2577898 - RNA, 21 nt, Human
accucaggccaggugcagugg

SEQ ID NO: 2577899 - RNA, 14 nt, Human
accucagccuggcc

SEQ ID NO: 2577900 - RNA, 15 nt, Human
accucagccuggcca

SEQ ID NO: 2577901 - RNA, 16 nt, Human
accucagccuggccag

SEQ ID NO: 2577902 - RNA, 17 nt, Human
accucagccuggccaga

SEQ ID NO: 2577903 - RNA, 19 nt, Human
accucagccuggccagaca

SEQ ID NO: 2577904 - RNA, 20 nt, Human
accucagccuggccagacac

SEQ ID NO: 2577905 - RNA, 21 nt, Human
accucagccuggccagacaca

SEQ ID NO: 2577906 - RNA, 13 nt, Human
accucagccuggc

SEQ ID NO: 2577907 - RNA, 18 nt, Human
accguggaggaggaaggc

SEQ ID NO: 2577908 - RNA, 15 nt, Human
accucagccuccugu

SEQ ID NO: 2577909 - RNA, 22 nt, Human
accguggaggaggaaggcaaga

SEQ ID NO: 2577910 - RNA, 15 nt, Human
accguggaggaggaa

SEQ ID NO: 2577911 - RNA, 18 nt, Human
accguggaccuuccugcc

SEQ ID NO: 2577912 - RNA, 11 nt, Human
accucagccug

SEQ ID NO: 2577913 - RNA, 15 nt, Human
accucagcugcuucu

SEQ ID NO: 2577914 - RNA, 23 nt, Human
accucagcucugggagaggauuu

SEQ ID NO: 2577915 - RNA, 22 nt, Human
accucagcucugggagaggauu

SEQ ID NO: 2577916 - RNA, 18 nt, Human
accucagcucugggagag

SEQ ID NO: 2577917 - RNA, 17 nt, Human
accucagcucugggaga

SEQ ID NO: 2577918 - RNA, 15 nt, Human
accucagcucuggga

SEQ ID NO: 2577919 - RNA, 14 nt, Human
accucagcucuggg

SEQ ID NO: 2577920 - RNA, 19 nt, Human
accucaggcacuagccuuu

SEQ ID NO: 2577921 - RNA, 18 nt, Human
accucaggcacuagccuu

SEQ ID NO: 2577922 - RNA, 17 nt, Human
accucaggcacuagccu

SEQ ID NO: 2577923 - RNA, 13 nt, Human
accucagcugcuu

SEQ ID NO: 2577924 - RNA, 15 nt, Human
accucaggcagcuca

SEQ ID NO: 2577925 - RNA, 12 nt, Human
accucaggcagc

SEQ ID NO: 2577926 - RNA, 12 nt, Human
accucagccugu

SEQ ID NO: 2577927 - RNA, 16 nt, Human
accucagccugugcug

SEQ ID NO: 2577928 - RNA, 17 nt, Human
accucagccugugcugc

SEQ ID NO: 2577929 - RNA, 18 nt, Human
accucagccugugcugcc

SEQ ID NO: 2577930 - RNA, 19 nt, Human
accucagccugugcugccc

SEQ ID NO: 2577931 - RNA, 20 nt, Human
accucagccuuccccuugcc

SEQ ID NO: 2577932 - RNA, 12 nt, Human
accucagcucug

SEQ ID NO: 2577933 - RNA, 14 nt, Human
accucagccuugga

SEQ ID NO: 2577934 - RNA, 21 nt, Human
acccugugauggggcccugcc

SEQ ID NO: 2577935 - RNA, 20 nt, Human
acccugugauggggcccugc

SEQ ID NO: 2577936 - RNA, 19 nt, Human
acccugugauggggcccug

SEQ ID NO: 2577937 - RNA, 17 nt, Human
acccugugauggggccc

SEQ ID NO: 2577938 - RNA, 16 nt, Human
accgggcacucagaag

SEQ ID NO: 2577939 - RNA, 20 nt, Human
accgggccacagagaaagua

SEQ ID NO: 2577940 - RNA, 14 nt, Human
accgggcacucaga

SEQ ID NO: 2577941 - RNA, 12 nt, Human
accgggcacuca

SEQ ID NO: 2577942 - RNA, 11 nt, Human
accucagccuc

SEQ ID NO: 2577943 - RNA, 12 nt, Human
accucagccucc

SEQ ID NO: 2577944 - RNA, 23 nt, Human
accgugaggccagagacacaagc

SEQ ID NO: 2577945 - RNA, 19 nt, Human
accgugccuggccacgccc

SEQ ID NO: 2577946 - RNA, 17 nt, Human
accguggaccuuccugc

SEQ ID NO: 2577947 - RNA, 22 nt, Human
accggggagcccccgccccgcc

SEQ ID NO: 2577948 - RNA, 21 nt, Human
acccugugacauggugccuga

SEQ ID NO: 2577949 - RNA, 19 nt, Human
acccugugacauggugccu

SEQ ID NO: 2577950 - RNA, 19 nt, Human
accggcuuuaccaaaccgc

SEQ ID NO: 2577951 - RNA, 16 nt, Human
accgggccgcuagaug

SEQ ID NO: 2577952 - RNA, 22 nt, Human
accgggccaguaucuauauaug

SEQ ID NO: 2577953 - RNA, 21 nt, Human
accgggcugggagcucugcag

SEQ ID NO: 2577954 - RNA, 18 nt, Human
accgugaggccagagaca

SEQ ID NO: 2577955 - RNA, 23 nt, Human
accgggcugggagcucugcagag

SEQ ID NO: 2577956 - RNA, 14 nt, Human
accuccacagcuuc

SEQ ID NO: 2577957 - RNA, 19 nt, Human
accuccaaaacuccugccc

SEQ ID NO: 2577958 - RNA, 17 nt, Human
accucauugacaagaac

SEQ ID NO: 2577959 - RNA, 22 nt, Human
accucaugcccacccccugccc

SEQ ID NO: 2577960 - RNA, 21 nt, Human
accucaugcccacccccugcc

SEQ ID NO: 2577961 - RNA, 21 nt, Human
accuccaaaacuccugccccu

SEQ ID NO: 2577962 - RNA, 20 nt, Human
accuccaaaacuccugcccc

SEQ ID NO: 2577963 - RNA, 11 nt, Human
accuccacagc

SEQ ID NO: 2577964 - RNA, 12 nt, Human
accuccacagcu

SEQ ID NO: 2577965 - RNA, 13 nt, Human
accuccacagcuu

SEQ ID NO: 2577966 - RNA, 19 nt, Human
acagcugagagacuuuuaa

SEQ ID NO: 2577967 - RNA, 16 nt, Human
acagcugagagacuuu

SEQ ID NO: 2577968 - RNA, 15 nt, Human
acagcugagagacuu

SEQ ID NO: 2577969 - RNA, 16 nt, Human
acagcugaauuaucua

SEQ ID NO: 2577970 - RNA, 20 nt, Human
acagcucuucuccaggcugu

SEQ ID NO: 2577971 - RNA, 19 nt, Human
acagcucuucuccaggcug

SEQ ID NO: 2577972 - RNA, 17 nt, Human
acaggcaaugcuggcug

SEQ ID NO: 2577973 - RNA, 14 nt, Human
acaggcacccacca

SEQ ID NO: 2577974 - RNA, 16 nt, Human
acaggcaaugcuggcu

SEQ ID NO: 2577975 - RNA, 15 nt, Human
acaggcaaugcuggc

SEQ ID NO: 2577976 - RNA, 22 nt, Human
acaggaugguucccuugaugaa

SEQ ID NO: 2577977 - RNA, 24 nt, Human
acaggaugguucccuugaugaaga

SEQ ID NO: 2577978 - RNA, 18 nt, Human
acagcugagcacauucug

SEQ ID NO: 2577979 - RNA, 22 nt, Human
acagcugagagacuuuuaauca

SEQ ID NO: 2577980 - RNA, 15 nt, Human
acaggauuagacagu

SEQ ID NO: 2577981 - RNA, 23 nt, Human
acagugcugucugaucugugcuu

SEQ ID NO: 2577982 - RNA, 22 nt, Human
acagugcugucugaucugugcu

SEQ ID NO: 2577983 - RNA, 14 nt, Human
acagugcugucuga

SEQ ID NO: 2577984 - RNA, 24 nt, Human
acagugaugcugugcuaugaauuu

SEQ ID NO: 2577985 - RNA, 11 nt, Human
acagugccugc

SEQ ID NO: 2577986 - RNA, 22 nt, Human
acagugaucuccauauguuaca

SEQ ID NO: 2577987 - RNA, 13 nt, Human
acagugccugcug

SEQ ID NO: 2577988 - RNA, 14 nt, Human
acagugccugcuga

SEQ ID NO: 2577989 - RNA, 14 nt, Human
acagugccugggaa

SEQ ID NO: 2577990 - RNA, 16 nt, Human
acagugcuaaaaaugg

SEQ ID NO: 2577991 - RNA, 14 nt, Human
acagugcuaaaaau

SEQ ID NO: 2577992 - RNA, 21 nt, Human
acagugccuucaauaaauggu

SEQ ID NO: 2577993 - RNA, 20 nt, Human
acagugccuucaauaaaugg

SEQ ID NO: 2577994 - RNA, 18 nt, Human
acagugccugggaaugua

SEQ ID NO: 2577995 - RNA, 20 nt, Human
acagugccugggaauguauu

SEQ ID NO: 2577996 - RNA, 17 nt, Human
acagugccuucaauaaa

SEQ ID NO: 2577997 - RNA, 21 nt, Human
acagugccugggaauguauua

SEQ ID NO: 2577998 - RNA, 14 nt, Human
acagugcuucagcc

SEQ ID NO: 2577999 - RNA, 15 nt, Human
acagugcuucagccu

SEQ ID NO: 2578000 - RNA, 17 nt, Human
acagugcuucagccuga

SEQ ID NO: 2578001 - RNA, 18 nt, Human
acagugcuucagccugag

SEQ ID NO: 2578002 - RNA, 20 nt, Human
acagugcuucagccugaggc

SEQ ID NO: 2578003 - RNA, 21 nt, Human
acagugcuucagccugaggcu

SEQ ID NO: 2578004 - RNA, 21 nt, Human
acagugcuugccacagagcgg

SEQ ID NO: 2578005 - RNA, 20 nt, Human
acagugcuugccacagagcg

SEQ ID NO: 2578006 - RNA, 22 nt, Human
acagugcuucagccugaggcug

SEQ ID NO: 2578007 - RNA, 17 nt, Human
acaguggauugcauuuc

SEQ ID NO: 2578008 - RNA, 18 nt, Human
acaguggaauauaaggaa

SEQ ID NO: 2578009 - RNA, 18 nt, Human
acagugcaucucagccca

SEQ ID NO: 2578010 - RNA, 17 nt, Human
acagugcaucucagccc

SEQ ID NO: 2578011 - RNA, 15 nt, Human
acagugcaucucagc

SEQ ID NO: 2578012 - RNA, 15 nt, Human
acagugaucuccaua

SEQ ID NO: 2578013 - RNA, 18 nt, Human
acagugaucuccauaugu

SEQ ID NO: 2578014 - RNA, 19 nt, Human
acagugaucuccauauguu

SEQ ID NO: 2578015 - RNA, 21 nt, Human
acagugaucuccauauguuac

SEQ ID NO: 2578016 - RNA, 19 nt, Human
acagugauuaccagggacu

SEQ ID NO: 2578017 - RNA, 13 nt, Human
acagugcaucuca

SEQ ID NO: 2578018 - RNA, 23 nt, Human
acaggcacccaccaucaugucug

SEQ ID NO: 2578019 - RNA, 14 nt, Human
acaggcaccgagaa

SEQ ID NO: 2578020 - RNA, 17 nt, Human
acaggcaccgagaaugu

SEQ ID NO: 2578021 - RNA, 20 nt, Human
acaggcaccgagaauguugu

SEQ ID NO: 2578022 - RNA, 21 nt, Human
acaggcaccgagaauguugua

SEQ ID NO: 2578023 - RNA, 14 nt, Human
acagugaucuccau

SEQ ID NO: 2578024 - RNA, 17 nt, Human
acagugggagccagggc

SEQ ID NO: 2578025 - RNA, 16 nt, Human
acagugggagccaggg

SEQ ID NO: 2578026 - RNA, 15 nt, Human
acagugggagccagg

SEQ ID NO: 2578027 - RNA, 14 nt, Human
acagugggagccag

SEQ ID NO: 2578028 - RNA, 15 nt, Human
acagugggaaauauu

SEQ ID NO: 2578029 - RNA, 13 nt, Human
acagugggagcca

SEQ ID NO: 2578030 - RNA, 14 nt, Human
acagugggaaauau

SEQ ID NO: 2578031 - RNA, 12 nt, Human
acagugggaaau

SEQ ID NO: 2578032 - RNA, 21 nt, Human
acaguggcucacgccuguaau

SEQ ID NO: 2578033 - RNA, 19 nt, Human
acauuuguauaaaauaauu

SEQ ID NO: 2578034 - RNA, 16 nt, Human
acauuuguauaaaaua

SEQ ID NO: 2578035 - RNA, 16 nt, Human
acauuugcucauggaa

SEQ ID NO: 2578036 - RNA, 15 nt, Human
acauuugcucaugga

SEQ ID NO: 2578037 - RNA, 21 nt, Human
acauuuguauaaaauaauuuu

SEQ ID NO: 2578038 - RNA, 15 nt, Human
acauuugccuugcug

SEQ ID NO: 2578039 - RNA, 14 nt, Human
acauuugccuugcu

SEQ ID NO: 2578040 - RNA, 17 nt, Human
accaacccuguuuccug

SEQ ID NO: 2578041 - RNA, 16 nt, Human
accaacccuguuuccu

SEQ ID NO: 2578042 - RNA, 14 nt, Human
accaacccuguuuc

SEQ ID NO: 2578043 - RNA, 17 nt, Human
accaacgucugugccau

SEQ ID NO: 2578044 - RNA, 14 nt, Human
accaacgucugugc

SEQ ID NO: 2578045 - RNA, 19 nt, Human
acauuucuuugugcuuugg

SEQ ID NO: 2578046 - RNA, 13 nt, Human
acauuugccuugc

SEQ ID NO: 2578047 - RNA, 23 nt, Human
acauuucuuagacuacauuuaga

SEQ ID NO: 2578048 - RNA, 16 nt, Human
accacgcuggaccuug

SEQ ID NO: 2578049 - RNA, 14 nt, Human
accacgcuggaccu

SEQ ID NO: 2578050 - RNA, 18 nt, Human
accacgcuggaccuugaa

SEQ ID NO: 2578051 - RNA, 18 nt, Human
accaccccgccugcccuc

SEQ ID NO: 2578052 - RNA, 16 nt, Human
accacgcuggggucug

SEQ ID NO: 2578053 - RNA, 14 nt, Human
accaccccccacuc

SEQ ID NO: 2578054 - RNA, 20 nt, Human
accaccccagcugcuccccu

SEQ ID NO: 2578055 - RNA, 22 nt, Human
accaccccagcugcuccccucc

SEQ ID NO: 2578056 - RNA, 13 nt, Human
accacguuucuaa

SEQ ID NO: 2578057 - RNA, 14 nt, Human
accacguuucuaaa

SEQ ID NO: 2578058 - RNA, 14 nt, Human
accacguccagcug

SEQ ID NO: 2578059 - RNA, 22 nt, Human
accacggccacuggccaucucc

SEQ ID NO: 2578060 - RNA, 18 nt, Human
accacggccacuggccau

SEQ ID NO: 2578061 - RNA, 17 nt, Human
accacgucugucuucac

SEQ ID NO: 2578062 - RNA, 14 nt, Human
accacggccacugg

SEQ ID NO: 2578063 - RNA, 21 nt, Human
accacggacguuuccaucagg

SEQ ID NO: 2578064 - RNA, 20 nt, Human
accacggacguuuccaucag

SEQ ID NO: 2578065 - RNA, 15 nt, Human
accaccccccacucu

SEQ ID NO: 2578066 - RNA, 14 nt, Human
accacggaaaagag

SEQ ID NO: 2578067 - RNA, 18 nt, Human
accacggaaaagagcgca

SEQ ID NO: 2578068 - RNA, 18 nt, Human
accaagccguggcuuccc

SEQ ID NO: 2578069 - RNA, 17 nt, Human
accaagccguggcuucc

SEQ ID NO: 2578070 - RNA, 16 nt, Human
accaagccguggcuuc

SEQ ID NO: 2578071 - RNA, 15 nt, Human
accaagccguggcuu

SEQ ID NO: 2578072 - RNA, 21 nt, Human
accaacgucugugccauuuug

SEQ ID NO: 2578073 - RNA, 14 nt, Human
accaagccguggcu

SEQ ID NO: 2578074 - RNA, 13 nt, Human
accaaccugacca

SEQ ID NO: 2578075 - RNA, 18 nt, Human
accaagccuggucagccc

SEQ ID NO: 2578076 - RNA, 13 nt, Human
accaccagaagcc

SEQ ID NO: 2578077 - RNA, 15 nt, Human
accaccagaagccca

SEQ ID NO: 2578078 - RNA, 16 nt, Human
accaccagaagcccag

SEQ ID NO: 2578079 - RNA, 17 nt, Human
accaccagaagcccaga

SEQ ID NO: 2578080 - RNA, 19 nt, Human
accaacccuguuuccugag

SEQ ID NO: 2578081 - RNA, 23 nt, Human
accacccacucuccucugccuca

SEQ ID NO: 2578082 - RNA, 19 nt, Human
accaccccagcugcucccc

SEQ ID NO: 2578083 - RNA, 16 nt, Human
accagagcugccaccu

SEQ ID NO: 2578084 - RNA, 14 nt, Human
accagagcugccac

SEQ ID NO: 2578085 - RNA, 13 nt, Human
accagagcugcca

SEQ ID NO: 2578086 - RNA, 12 nt, Human
accagagcugcc

SEQ ID NO: 2578087 - RNA, 23 nt, Human
accacgugcuacccccaugcugg

SEQ ID NO: 2578088 - RNA, 18 nt, Human
accacgucugucuucaca

SEQ ID NO: 2578089 - RNA, 22 nt, Human
acauguuuugauaaaguaguaa

SEQ ID NO: 2578090 - RNA, 23 nt, Human
acauguuuugauaaaguaguaaa

SEQ ID NO: 2578091 - RNA, 18 nt, Human
acauguguagccugugca

SEQ ID NO: 2578092 - RNA, 17 nt, Human
acauguguagccugugc

SEQ ID NO: 2578093 - RNA, 20 nt, Human
acauguguuaaguauuuuca

SEQ ID NO: 2578094 - RNA, 20 nt, Human
acauguguagccugugcaug

SEQ ID NO: 2578095 - RNA, 17 nt, Human
acauguguuggcagccu

SEQ ID NO: 2578096 - RNA, 17 nt, Human
acauguuuuagacaaau

SEQ ID NO: 2578097 - RNA, 20 nt, Human
acauguuuuagacaaauacu

SEQ ID NO: 2578098 - RNA, 21 nt, Human
acauguguuuuaauuccaaua

SEQ ID NO: 2578099 - RNA, 12 nt, Human
acauguguuuua

SEQ ID NO: 2578100 - RNA, 22 nt, Human
acauguuuuagacaaauacuca

SEQ ID NO: 2578101 - RNA, 21 nt, Human
acauguuuuagacaaauacuc

SEQ ID NO: 2578102 - RNA, 23 nt, Human
acauguuuuagacaaauacucau

SEQ ID NO: 2578103 - RNA, 21 nt, Human
acauguuuugauaaaguagua

SEQ ID NO: 2578104 - RNA, 20 nt, Human
acauguuuugauaaaguagu

SEQ ID NO: 2578105 - RNA, 18 nt, Human
acauguuuugauaaagua

SEQ ID NO: 2578106 - RNA, 17 nt, Human
acauguuuugauaaagu

SEQ ID NO: 2578107 - RNA, 15 nt, Human
acauguuuugauaaa

SEQ ID NO: 2578108 - RNA, 13 nt, Human
acauguuuugaua

SEQ ID NO: 2578109 - RNA, 19 nt, Human
acauguuuuucuucucccu

SEQ ID NO: 2578110 - RNA, 15 nt, Human
acauccaaagcagac

SEQ ID NO: 2578111 - RNA, 16 nt, Human
acauccaaagcagaca

SEQ ID NO: 2578112 - RNA, 17 nt, Human
acauccaaagcagacag

SEQ ID NO: 2578113 - RNA, 18 nt, Human
acauccaaagcagacagc

SEQ ID NO: 2578114 - RNA, 21 nt, Human
acauccaaaauaguuaagaca

SEQ ID NO: 2578115 - RNA, 21 nt, Human
acauacaccuaugucauuuca

SEQ ID NO: 2578116 - RNA, 23 nt, Human
acauaaucuucugccuucucaug

SEQ ID NO: 2578117 - RNA, 14 nt, Human
acauaagaccauaa

SEQ ID NO: 2578118 - RNA, 22 nt, Human
acauaacguuuuuccuuuaaaa

SEQ ID NO: 2578119 - RNA, 16 nt, Human
acauacaauuccaaac

SEQ ID NO: 2578120 - RNA, 16 nt, Human
acauacacacauaugu

SEQ ID NO: 2578121 - RNA, 13 nt, Human
acauacaccagca

SEQ ID NO: 2578122 - RNA, 14 nt, Human
acauacaccagcau

SEQ ID NO: 2578123 - RNA, 15 nt, Human
acauacaccagcauu

SEQ ID NO: 2578124 - RNA, 20 nt, Human
acauacaggaagguagaaau

SEQ ID NO: 2578125 - RNA, 19 nt, Human
acauaaguuuaggauaaaa

SEQ ID NO: 2578126 - RNA, 21 nt, Human
acauaaguaauucaagaaaac

SEQ ID NO: 2578127 - RNA, 20 nt, Human
acauaaguauuuaauucaug

SEQ ID NO: 2578128 - RNA, 23 nt, Human
acauaacguuuuuccuuuaaaaa

SEQ ID NO: 2578129 - RNA, 12 nt, Human
acauaacugaaa

SEQ ID NO: 2578130 - RNA, 20 nt, Human
acauaacugaaaaugugcua

SEQ ID NO: 2578131 - RNA, 20 nt, Human
acauaaguaauucaagaaaa

SEQ ID NO: 2578132 - RNA, 21 nt, Human
acauaacguuuuuccuuuaaa

SEQ ID NO: 2578133 - RNA, 20 nt, Human
acauaacguuuuuccuuuaa

SEQ ID NO: 2578134 - RNA, 18 nt, Human
acauaacguuuuuccuuu

SEQ ID NO: 2578135 - RNA, 16 nt, Human
acauaacguuuuuccu

SEQ ID NO: 2578136 - RNA, 15 nt, Human
acauaacguuuuucc

SEQ ID NO: 2578137 - RNA, 14 nt, Human
acauaacguuuuuc

SEQ ID NO: 2578138 - RNA, 18 nt, Human
acaugcagcccaugccca

SEQ ID NO: 2578139 - RNA, 15 nt, Human
acaugcagcccaugc

SEQ ID NO: 2578140 - RNA, 17 nt, Human
acaugcagcccaugccc

SEQ ID NO: 2578141 - RNA, 20 nt, Human
acaugccucucucaggccaa

SEQ ID NO: 2578142 - RNA, 21 nt, Human
acaugccugccccaaacaaau

SEQ ID NO: 2578143 - RNA, 15 nt, Human
acaugccugccccaa

SEQ ID NO: 2578144 - RNA, 22 nt, Human
acaugcgggcugggcagcuguu

SEQ ID NO: 2578145 - RNA, 21 nt, Human
acaugcgggcugggcagcugu

SEQ ID NO: 2578146 - RNA, 19 nt, Human
acaugcgggcugggcagcu

SEQ ID NO: 2578147 - RNA, 17 nt, Human
acaugcgggcugggcag

SEQ ID NO: 2578148 - RNA, 17 nt, Human
acaugcggagaacaaau

SEQ ID NO: 2578149 - RNA, 22 nt, Human
acaugccugccccaaacaaaua

SEQ ID NO: 2578150 - RNA, 16 nt, Human
acaugcgggcugggca

SEQ ID NO: 2578151 - RNA, 14 nt, Human
acaugcgggcuggg

SEQ ID NO: 2578152 - RNA, 23 nt, Human
acaugcggagaacaaaugugaag

SEQ ID NO: 2578153 - RNA, 17 nt, Human
acaugcgguagccagca

SEQ ID NO: 2578154 - RNA, 19 nt, Human
acaugugccgaaugugcag

SEQ ID NO: 2578155 - RNA, 17 nt, Human
acaugugccgaaugugc

SEQ ID NO: 2578156 - RNA, 22 nt, Human
acaugugccagggcaaugauga

SEQ ID NO: 2578157 - RNA, 18 nt, Human
acauguggggccagguca

SEQ ID NO: 2578158 - RNA, 16 nt, Human
acauguggggccaggu

SEQ ID NO: 2578159 - RNA, 18 nt, Human
acauguggaaagugaauu

SEQ ID NO: 2578160 - RNA, 20 nt, Human
acaugugccgaaugugcagg

SEQ ID NO: 2578161 - RNA, 19 nt, Human
acauguggaaagugaauuu

SEQ ID NO: 2578162 - RNA, 16 nt, Human
acaugugugcgugugc

SEQ ID NO: 2578163 - RNA, 15 nt, Human
acauguggugggaca

SEQ ID NO: 2578164 - RNA, 23 nt, Human
acauguggugggacagggaccca

SEQ ID NO: 2578165 - RNA, 16 nt, Human
acaugugguuuauaga

SEQ ID NO: 2578166 - RNA, 13 nt, Human
acaugugguuuau

SEQ ID NO: 2578167 - RNA, 15 nt, Human
acaucccugccagcu

SEQ ID NO: 2578168 - RNA, 18 nt, Human
acaucccgggacgcagca

SEQ ID NO: 2578169 - RNA, 23 nt, Human
acaucccuacaaaaaauuagaaa

SEQ ID NO: 2578170 - RNA, 16 nt, Human
acaucccugccagcuc

SEQ ID NO: 2578171 - RNA, 17 nt, Human
acaucccugccagcucu

SEQ ID NO: 2578172 - RNA, 19 nt, Human
acauccaaagcagacagcu

SEQ ID NO: 2578173 - RNA, 18 nt, Human
acaucccauguaacagaa

SEQ ID NO: 2578174 - RNA, 16 nt, Human
acaucccauguaacag

SEQ ID NO: 2578175 - RNA, 20 nt, Human
acaucccauguaacagaaag

SEQ ID NO: 2578176 - RNA, 16 nt, Human
acaucccauugcccug

SEQ ID NO: 2578177 - RNA, 17 nt, Human
acaucccauugcccugg

SEQ ID NO: 2578178 - RNA, 18 nt, Human
acaucccauugcccuggu

SEQ ID NO: 2578179 - RNA, 14 nt, Human
acauccccacccuu

SEQ ID NO: 2578180 - RNA, 18 nt, Human
acauccccccgccaaaag

SEQ ID NO: 2578181 - RNA, 13 nt, Human
acaugcacgugug

SEQ ID NO: 2578182 - RNA, 18 nt, Human
acaugcacuuggcugcau

SEQ ID NO: 2578183 - RNA, 22 nt, Human
acaugcacuuggcugcauaaau

SEQ ID NO: 2578184 - RNA, 18 nt, Human
acaugcacucagcucuug

SEQ ID NO: 2578185 - RNA, 17 nt, Human
acaugcacuaugaggaa

SEQ ID NO: 2578186 - RNA, 16 nt, Human
acaugcacuaugagga

SEQ ID NO: 2578187 - RNA, 17 nt, Human
acaugcacucagcucuu

SEQ ID NO: 2578188 - RNA, 13 nt, Human
aauuuccucuauu

SEQ ID NO: 2578189 - RNA, 11 nt, Human
aauuguaauag

SEQ ID NO: 2578190 - RNA, 15 nt, Human
aauuguauagagaua

SEQ ID NO: 2578191 - RNA, 13 nt, Human
aauuguauagaga

SEQ ID NO: 2578192 - RNA, 19 nt, Human
aauuguauaacagguuauu

SEQ ID NO: 2578193 - RNA, 18 nt, Human
aauuguauaacagguuau

SEQ ID NO: 2578194 - RNA, 17 nt, Human
aauuguauaacagguua

SEQ ID NO: 2578195 - RNA, 16 nt, Human
aauuguauaacagguu

SEQ ID NO: 2578196 - RNA, 15 nt, Human
aauuguauaacaggu

SEQ ID NO: 2578197 - RNA, 22 nt, Human
aauuucauaccuaucaucuuaa

SEQ ID NO: 2578198 - RNA, 14 nt, Human
aauuguacauauuu

SEQ ID NO: 2578199 - RNA, 21 nt, Human
aauuguacauauuuguggaau

SEQ ID NO: 2578200 - RNA, 15 nt, Human
aauuguacauauuug

SEQ ID NO: 2578201 - RNA, 14 nt, Human
aauuguauaacagg

SEQ ID NO: 2578202 - RNA, 13 nt, Human
aauuguauaacag

SEQ ID NO: 2578203 - RNA, 18 nt, Human
aauuguaggggugugugu

SEQ ID NO: 2578204 - RNA, 22 nt, Human
aauuuccccaacagugugaagu

SEQ ID NO: 2578205 - RNA, 21 nt, Human
aauuuccccaacagugugaag

SEQ ID NO: 2578206 - RNA, 20 nt, Human
aauuuccccaacagugugaa

SEQ ID NO: 2578207 - RNA, 19 nt, Human
aauuuccccaacaguguga

SEQ ID NO: 2578208 - RNA, 18 nt, Human
aauuuccccaacagugug

SEQ ID NO: 2578209 - RNA, 17 nt, Human
aauuuccccaacagugu

SEQ ID NO: 2578210 - RNA, 15 nt, Human
aauuuccccaacagu

SEQ ID NO: 2578211 - RNA, 14 nt, Human
aauuuccccaacag

SEQ ID NO: 2578212 - RNA, 16 nt, Human
aauuucccaggacccu

SEQ ID NO: 2578213 - RNA, 17 nt, Human
aauuucccaggacccug

SEQ ID NO: 2578214 - RNA, 21 nt, Human
aauuucccaggacccugaagg

SEQ ID NO: 2578215 - RNA, 22 nt, Human
aauuucccaggacccugaaggg

SEQ ID NO: 2578216 - RNA, 22 nt, Human
aauuucccacaccguguaaacc

SEQ ID NO: 2578217 - RNA, 12 nt, Human
aauuucccagga

SEQ ID NO: 2578218 - RNA, 14 nt, Human
aauuucccaggacc

SEQ ID NO: 2578219 - RNA, 15 nt, Human
aauuucccaggaccc

SEQ ID NO: 2578220 - RNA, 15 nt, Human
aauuuccagagaaga

SEQ ID NO: 2578221 - RNA, 15 nt, Human
aauuuccaguaccuu

SEQ ID NO: 2578222 - RNA, 17 nt, Human
aauuuccaguaccuuug

SEQ ID NO: 2578223 - RNA, 20 nt, Human
aauuuccaguaccuuuguca

SEQ ID NO: 2578224 - RNA, 24 nt, Human
aauuuccagugagcuuaucaugcu

SEQ ID NO: 2578225 - RNA, 19 nt, Human
aauuucccaauuaggaagu

SEQ ID NO: 2578226 - RNA, 17 nt, Human
aauuucccaaagcagug

SEQ ID NO: 2578227 - RNA, 15 nt, Human
aauuucccaaagcag

SEQ ID NO: 2578228 - RNA, 18 nt, Human
aauuucauaugcuguaua

SEQ ID NO: 2578229 - RNA, 16 nt, Human
aauuucauaugcugua

SEQ ID NO: 2578230 - RNA, 21 nt, Human
aauuuccacaaaaucugucca

SEQ ID NO: 2578231 - RNA, 11 nt, Human
aauuuccagag

SEQ ID NO: 2578232 - RNA, 19 nt, Human
aauucugucacucaccacu

SEQ ID NO: 2578233 - RNA, 22 nt, Human
aauucuguacugauuuuuguaa

SEQ ID NO: 2578234 - RNA, 21 nt, Human
aauucuguacauagccuauau

SEQ ID NO: 2578235 - RNA, 20 nt, Human
aauucuguacauagccuaua

SEQ ID NO: 2578236 - RNA, 21 nt, Human
aauucuguuuuagguuaaaaa

SEQ ID NO: 2578237 - RNA, 12 nt, Human
aauucuguuuua

SEQ ID NO: 2578238 - RNA, 16 nt, Human
aauucuguuucuugag

SEQ ID NO: 2578239 - RNA, 12 nt, Human
aauucuguuucu

SEQ ID NO: 2578240 - RNA, 13 nt, Human
aauucuguuucuu

SEQ ID NO: 2578241 - RNA, 10 nt, Human
aauucugaau

SEQ ID NO: 2578242 - RNA, 21 nt, Human
aauucugagaaaacuucuuuu

SEQ ID NO: 2578243 - RNA, 20 nt, Human
aauucugcaauguuuuccuu

SEQ ID NO: 2578244 - RNA, 19 nt, Human
aauucugcaauguuuuccu

SEQ ID NO: 2578245 - RNA, 19 nt, Human
aauucuguacauagccuau

SEQ ID NO: 2578246 - RNA, 17 nt, Human
aauucuguacauagccu

SEQ ID NO: 2578247 - RNA, 12 nt, Human
aauucuguacau

SEQ ID NO: 2578248 - RNA, 12 nt, Human
aauucuguaaau

SEQ ID NO: 2578249 - RNA, 19 nt, Human
aauucugcuaccucacugg

SEQ ID NO: 2578250 - RNA, 15 nt, Human
aauucugcuaccuca

SEQ ID NO: 2578251 - RNA, 16 nt, Human
aauucugcuaccucac

SEQ ID NO: 2578252 - RNA, 11 nt, Human
aauuggcagca

SEQ ID NO: 2578253 - RNA, 22 nt, Human
aauuggcagcagauuuuaggaa

SEQ ID NO: 2578254 - RNA, 14 nt, Human
aauuggcagcagau

SEQ ID NO: 2578255 - RNA, 18 nt, Human
aauuggcauguguauguu

SEQ ID NO: 2578256 - RNA, 21 nt, Human
aauugggagcuugggaaugga

SEQ ID NO: 2578257 - RNA, 22 nt, Human
aauuguaaggaaugauuaauua

SEQ ID NO: 2578258 - RNA, 14 nt, Human
aauucuguuuuucu

SEQ ID NO: 2578259 - RNA, 18 nt, Human
aauucuguuuuucuaggc

SEQ ID NO: 2578260 - RNA, 16 nt, Human
aauuggaggaaagcaa

SEQ ID NO: 2578261 - RNA, 14 nt, Human
aauucuuaaaauau

SEQ ID NO: 2578262 - RNA, 15 nt, Human
aauucuccugccuca

SEQ ID NO: 2578263 - RNA, 16 nt, Human
aauucuccugccucag

SEQ ID NO: 2578264 - RNA, 13 nt, Human
aauucuccuggag

SEQ ID NO: 2578265 - RNA, 12 nt, Human
aauucuccugga

SEQ ID NO: 2578266 - RNA, 15 nt, Human
aauucuccuggaggu

SEQ ID NO: 2578267 - RNA, 14 nt, Human
aauucuccugccuc

SEQ ID NO: 2578268 - RNA, 21 nt, Human
aauucucauuugucacacacu

SEQ ID NO: 2578269 - RNA, 15 nt, Human
aauucucuaguuuga

SEQ ID NO: 2578270 - RNA, 17 nt, Human
aauucucuaguuugauu

SEQ ID NO: 2578271 - RNA, 14 nt, Human
aauucucuuucaaa

SEQ ID NO: 2578272 - RNA, 15 nt, Human
aauucucuuauccaa

SEQ ID NO: 2578273 - RNA, 21 nt, Human
aauucucaugugauccuuuua

SEQ ID NO: 2578274 - RNA, 20 nt, Human
aauucucaugugauccuuuu

SEQ ID NO: 2578275 - RNA, 19 nt, Human
aauucucaugugauccuuu

SEQ ID NO: 2578276 - RNA, 16 nt, Human
aauucucaugugaucc

SEQ ID NO: 2578277 - RNA, 13 nt, Human
aauucucauguga

SEQ ID NO: 2578278 - RNA, 22 nt, Human
aauucucaaccuaccaccccuu

SEQ ID NO: 2578279 - RNA, 17 nt, Human
aauucucaaccuaccac

SEQ ID NO: 2578280 - RNA, 14 nt, Human
aauucuauuugcug

SEQ ID NO: 2578281 - RNA, 19 nt, Human
aauucucagaaucucaaau

SEQ ID NO: 2578282 - RNA, 22 nt, Human
aauucuauaaggccauaaaaca

SEQ ID NO: 2578283 - RNA, 21 nt, Human
aauucuagugcugcugaagau

SEQ ID NO: 2578284 - RNA, 18 nt, Human
aauucuagugcugcugaa

SEQ ID NO: 2578285 - RNA, 16 nt, Human
aauucuauaaggccau

SEQ ID NO: 2578286 - RNA, 17 nt, Human
aauucuagugcugcuga

SEQ ID NO: 2578287 - RNA, 16 nt, Human
aauucuagugcugcug

SEQ ID NO: 2578288 - RNA, 12 nt, Human
aauucuagugcu

SEQ ID NO: 2578289 - RNA, 23 nt, Human
aauucuaggcaucccaggggacc

SEQ ID NO: 2578290 - RNA, 22 nt, Human
aauucuagcuuugagcuuaaga

SEQ ID NO: 2578291 - RNA, 15 nt, Human
aauucuacauuguca

SEQ ID NO: 2578292 - RNA, 14 nt, Human
aauucuacuuugag

SEQ ID NO: 2578293 - RNA, 23 nt, Human
aauucgaaccaggaaauggaacc

SEQ ID NO: 2578294 - RNA, 13 nt, Human
aauucuaaaugaa

SEQ ID NO: 2578295 - RNA, 19 nt, Human
aauucuaaaugaauguuua

SEQ ID NO: 2578296 - RNA, 14 nt, Human
aauucuaacuuuuu

SEQ ID NO: 2578297 - RNA, 19 nt, Human
aauuauagaugggaaugaa

SEQ ID NO: 2578298 - RNA, 15 nt, Human
aauuauagaugggaa

SEQ ID NO: 2578299 - RNA, 19 nt, Human
aauuauacccccugcaaag

SEQ ID NO: 2578300 - RNA, 20 nt, Human
aauuauacuggagaagucuu

SEQ ID NO: 2578301 - RNA, 22 nt, Human
aauuauagugauguaaucuuga

SEQ ID NO: 2578302 - RNA, 21 nt, Human
aauuauauagguugugcaaau

SEQ ID NO: 2578303 - RNA, 20 nt, Human
aauuauauagguugugcaaa

SEQ ID NO: 2578304 - RNA, 22 nt, Human
aauuauaucaguccucuuucaa

SEQ ID NO: 2578305 - RNA, 18 nt, Human
aauuauguauguuuacau

SEQ ID NO: 2578306 - RNA, 16 nt, Human
aauuauguauguuuac

SEQ ID NO: 2578307 - RNA, 15 nt, Human
aauuauguauguuua

SEQ ID NO: 2578308 - RNA, 19 nt, Human
aauuaugccuuuuuugauc

SEQ ID NO: 2578309 - RNA, 13 nt, Human
aauuaugacaguu

SEQ ID NO: 2578310 - RNA, 17 nt, Human
aauuaugccuuuuuuga

SEQ ID NO: 2578311 - RNA, 22 nt, Human
aauuaucuauacauaucuuuau

SEQ ID NO: 2578312 - RNA, 12 nt, Human
aauuaugacagu

SEQ ID NO: 2578313 - RNA, 15 nt, Human
aauuaugacaguuau

SEQ ID NO: 2578314 - RNA, 21 nt, Human
aauuccuguagcaucuucugg

SEQ ID NO: 2578315 - RNA, 21 nt, Human
aauuauguauguuuacauauc

SEQ ID NO: 2578316 - RNA, 17 nt, Human
aauuccucuuugcuuug

SEQ ID NO: 2578317 - RNA, 18 nt, Human
aauuccucuuugcuuugc

SEQ ID NO: 2578318 - RNA, 19 nt, Human
aauuccucuuugcuuugcu

SEQ ID NO: 2578319 - RNA, 11 nt, Human
aauuccugggc

SEQ ID NO: 2578320 - RNA, 15 nt, Human
aauucggugugcacc

SEQ ID NO: 2578321 - RNA, 18 nt, Human
aauucgcugcaaccuguu

SEQ ID NO: 2578322 - RNA, 14 nt, Human
aauucgaccugauu

SEQ ID NO: 2578323 - RNA, 15 nt, Human
aauucgaaccaggaa

SEQ ID NO: 2578324 - RNA, 19 nt, Human
aauuccuuuucuaacucuc

SEQ ID NO: 2578325 - RNA, 13 nt, Human
aauuccuuagcuu

SEQ ID NO: 2578326 - RNA, 23 nt, Human
aauuccuuagcuuagaccucagc

SEQ ID NO: 2578327 - RNA, 16 nt, Human
aauuccuucaggguga

SEQ ID NO: 2578328 - RNA, 17 nt, Human
aauuccuguagcaucuu

SEQ ID NO: 2578329 - RNA, 23 nt, Human
aauuccuucagggugaugccagg

SEQ ID NO: 2578330 - RNA, 21 nt, Human
aauuccuuggcaugccuucca

SEQ ID NO: 2578331 - RNA, 19 nt, Human
aauuaugaguuauuuuuau

SEQ ID NO: 2578332 - RNA, 15 nt, Human
aauuauccagaguuu

SEQ ID NO: 2578333 - RNA, 15 nt, Human
aauuaucggaagcag

SEQ ID NO: 2578334 - RNA, 17 nt, Human
aauuaucggaagcagug

SEQ ID NO: 2578335 - RNA, 20 nt, Human
aauuaucggaagcagugccu

SEQ ID NO: 2578336 - RNA, 21 nt, Human
aauuaucggaagcagugccuu

SEQ ID NO: 2578337 - RNA, 17 nt, Human
aauuaucgggaacagug

SEQ ID NO: 2578338 - RNA, 19 nt, Human
aauuaucgggaacaguguu

SEQ ID NO: 2578339 - RNA, 20 nt, Human
aauuaucgggaacaguguuu

SEQ ID NO: 2578340 - RNA, 23 nt, Human
aauuaucgggaacaguguuuccc

SEQ ID NO: 2578341 - RNA, 14 nt, Human
aauuaucuauacau

SEQ ID NO: 2578342 - RNA, 16 nt, Human
aauuaucuauacauau

SEQ ID NO: 2578343 - RNA, 18 nt, Human
acaaacaauggaaacuga

SEQ ID NO: 2578344 - RNA, 15 nt, Human
acaaacaccucccag

SEQ ID NO: 2578345 - RNA, 20 nt, Human
acaaacaauggaaacugaau

SEQ ID NO: 2578346 - RNA, 19 nt, Human
acaaacaugugguuaaugc

SEQ ID NO: 2578347 - RNA, 13 nt, Human
acaaacagcucag

SEQ ID NO: 2578348 - RNA, 19 nt, Human
acaaacauauuuguuaaau

SEQ ID NO: 2578349 - RNA, 14 nt, Human
acaaacaucacucu

SEQ ID NO: 2578350 - RNA, 22 nt, Human
acaaacauauuuguuaaauauu

SEQ ID NO: 2578351 - RNA, 16 nt, Human
acaacauuaaaacaau

SEQ ID NO: 2578352 - RNA, 22 nt, Human
acaacauguauaauauuuuuaa

SEQ ID NO: 2578353 - RNA, 14 nt, Human
acaacauguauaau

SEQ ID NO: 2578354 - RNA, 14 nt, Human
acaaccauuccaga

SEQ ID NO: 2578355 - RNA, 15 nt, Human
acaaccacuggucug

SEQ ID NO: 2578356 - RNA, 17 nt, Human
acaaccacucauucaaa

SEQ ID NO: 2578357 - RNA, 15 nt, Human
acaaccaccgcuccc

SEQ ID NO: 2578358 - RNA, 19 nt, Human
acaaccaccgcuccccagc

SEQ ID NO: 2578359 - RNA, 21 nt, Human
acaaccaccuaaucaggcuga

SEQ ID NO: 2578360 - RNA, 20 nt, Human
acaaccaccgcuccccagcc

SEQ ID NO: 2578361 - RNA, 18 nt, Human
acaaccaagcucucugca

SEQ ID NO: 2578362 - RNA, 13 nt, Human
acaaacuguaaau

SEQ ID NO: 2578363 - RNA, 20 nt, Human
acaaacucaccaucugugca

SEQ ID NO: 2578364 - RNA, 22 nt, Human
acaaacucucugaaccccuccc

SEQ ID NO: 2578365 - RNA, 22 nt, Human
acaaacuauuucuuauauaugu

SEQ ID NO: 2578366 - RNA, 16 nt, Human
acaaacuacauguaau

SEQ ID NO: 2578367 - RNA, 14 nt, Human
acaaacaugacccu

SEQ ID NO: 2578368 - RNA, 15 nt, Human
acaaacucucugaac

SEQ ID NO: 2578369 - RNA, 18 nt, Human
acaagggagagaccucau

SEQ ID NO: 2578370 - RNA, 19 nt, Human
acaaggcaaggcugucaau

SEQ ID NO: 2578371 - RNA, 17 nt, Human
acaaggcaaggcuguca

SEQ ID NO: 2578372 - RNA, 16 nt, Human
acaaggcaaggcuguc

SEQ ID NO: 2578373 - RNA, 14 nt, Human
acaacugaguccuu

SEQ ID NO: 2578374 - RNA, 13 nt, Human
acaacugaguccu

SEQ ID NO: 2578375 - RNA, 12 nt, Human
acaacugagucc

SEQ ID NO: 2578376 - RNA, 19 nt, Human
acaacugaguccuuaaaca

SEQ ID NO: 2578377 - RNA, 21 nt, Human
acaacugccucgaaacacaga

SEQ ID NO: 2578378 - RNA, 20 nt, Human
acaacuccuagggccacuga

SEQ ID NO: 2578379 - RNA, 20 nt, Human
acaacuggaauaguuuuuuu

SEQ ID NO: 2578380 - RNA, 19 nt, Human
acaacuggaauaguuuuuu

SEQ ID NO: 2578381 - RNA, 22 nt, Human
acaacugccucgaaacacagaa

SEQ ID NO: 2578382 - RNA, 14 nt, Human
acaacuuaaauaau

SEQ ID NO: 2578383 - RNA, 13 nt, Human
acaacuuaaguug

SEQ ID NO: 2578384 - RNA, 15 nt, Human
acaacuuaaauaaua

SEQ ID NO: 2578385 - RNA, 20 nt, Human
acaagguucccucugagaau

SEQ ID NO: 2578386 - RNA, 19 nt, Human
acaagguucccucugagaa

SEQ ID NO: 2578387 - RNA, 22 nt, Human
acaagguucuucccuuuuacau

SEQ ID NO: 2578388 - RNA, 13 nt, Human
acaagguucuucc

SEQ ID NO: 2578389 - RNA, 23 nt, Human
acaagguccucugucagucacag

SEQ ID NO: 2578390 - RNA, 18 nt, Human
acaaggguggcaucccag

SEQ ID NO: 2578391 - RNA, 22 nt, Human
acaagguagcccuggccagagg

SEQ ID NO: 2578392 - RNA, 17 nt, Human
acaagguccaagauacc

SEQ ID NO: 2578393 - RNA, 14 nt, Human
acaagguaguuuuu

SEQ ID NO: 2578394 - RNA, 21 nt, Human
acaagguaccccuuucuggcu

SEQ ID NO: 2578395 - RNA, 19 nt, Human
acaagggucuagggagaga

SEQ ID NO: 2578396 - RNA, 20 nt, Human
acaagggucuagggagagac

SEQ ID NO: 2578397 - RNA, 16 nt, Human
acaagguaguuuuuac

SEQ ID NO: 2578398 - RNA, 22 nt, Human
acaacuuaaguugguccuuuac

SEQ ID NO: 2578399 - RNA, 19 nt, Human
acaagggagagaccucauc

SEQ ID NO: 2578400 - RNA, 17 nt, Human
acaagggucuagggaga

SEQ ID NO: 2578401 - RNA, 18 nt, Human
acaagggucuagggagag

SEQ ID NO: 2578402 - RNA, 20 nt, Human
acaaguguauaucagaaaag

SEQ ID NO: 2578403 - RNA, 19 nt, Human
acaaguguauaucagaaaa

SEQ ID NO: 2578404 - RNA, 18 nt, Human
acaaguguauaucagaaa

SEQ ID NO: 2578405 - RNA, 15 nt, Human
acaaguuaaauaaau

SEQ ID NO: 2578406 - RNA, 14 nt, Human
acaagugcugaaca

SEQ ID NO: 2578407 - RNA, 13 nt, Human
acaagugcuggca

SEQ ID NO: 2578408 - RNA, 12 nt, Human
acaagugcuggc

SEQ ID NO: 2578409 - RNA, 15 nt, Human
acaaguggacucagg

SEQ ID NO: 2578410 - RNA, 18 nt, Human
acaaguggacucagggca

SEQ ID NO: 2578411 - RNA, 19 nt, Human
acaaguggacucagggcag

SEQ ID NO: 2578412 - RNA, 13 nt, Human
acaagugguggua

SEQ ID NO: 2578413 - RNA, 19 nt, Human
acacagccacacacacaga

SEQ ID NO: 2578414 - RNA, 20 nt, Human
acacagccacacacacagaa

SEQ ID NO: 2578415 - RNA, 21 nt, Human
acacagccacacacacagaaa

SEQ ID NO: 2578416 - RNA, 22 nt, Human
acacagccacacacacagaaaa

SEQ ID NO: 2578417 - RNA, 23 nt, Human
acacagccacacacacagaaaau

SEQ ID NO: 2578418 - RNA, 19 nt, Human
acacagccgauucaccuga

SEQ ID NO: 2578419 - RNA, 20 nt, Human
acacagccaggugccuugga

SEQ ID NO: 2578420 - RNA, 23 nt, Human
acacagccgauucaccugagcag

SEQ ID NO: 2578421 - RNA, 16 nt, Human
acacagcucuucucca

SEQ ID NO: 2578422 - RNA, 14 nt, Human
acacagcucuucuc

SEQ ID NO: 2578423 - RNA, 13 nt, Human
acacagccacaca

SEQ ID NO: 2578424 - RNA, 14 nt, Human
acacagccacacac

SEQ ID NO: 2578425 - RNA, 15 nt, Human
acacagccacacaca

SEQ ID NO: 2578426 - RNA, 18 nt, Human
acacagccacacacacag

SEQ ID NO: 2578427 - RNA, 11 nt, Human
acacagccaca

SEQ ID NO: 2578428 - RNA, 12 nt, Human
acacagccacac

SEQ ID NO: 2578429 - RNA, 21 nt, Human
acacagaaaauauacuguaaa

SEQ ID NO: 2578430 - RNA, 22 nt, Human
acacagaaaauauacuguaaag

SEQ ID NO: 2578431 - RNA, 23 nt, Human
acacagaaaauauacuguaaaga

SEQ ID NO: 2578432 - RNA, 18 nt, Human
acacagaaaauguugaga

SEQ ID NO: 2578433 - RNA, 19 nt, Human
acacagaaaauguugagaa

SEQ ID NO: 2578434 - RNA, 22 nt, Human
acacagcagcuucaccagagca

SEQ ID NO: 2578435 - RNA, 14 nt, Human
acacagcaugugua

SEQ ID NO: 2578436 - RNA, 15 nt, Human
acacagcauguguau

SEQ ID NO: 2578437 - RNA, 13 nt, Human
acacagaaaauau

SEQ ID NO: 2578438 - RNA, 14 nt, Human
acacagaaaauaua

SEQ ID NO: 2578439 - RNA, 15 nt, Human
acacagaaaauauac

SEQ ID NO: 2578440 - RNA, 16 nt, Human
acacagaaaauauacu

SEQ ID NO: 2578441 - RNA, 17 nt, Human
acacagaaaauauacug

SEQ ID NO: 2578442 - RNA, 18 nt, Human
acacagaaaauauacugu

SEQ ID NO: 2578443 - RNA, 19 nt, Human
acacagaaaauauacugua

SEQ ID NO: 2578444 - RNA, 20 nt, Human
acacagaaaauauacuguaa

SEQ ID NO: 2578445 - RNA, 11 nt, Human
acacagaaaau

SEQ ID NO: 2578446 - RNA, 12 nt, Human
acacagaaaaua

SEQ ID NO: 2578447 - RNA, 19 nt, Human
acacacuuuuuaagaaaua

SEQ ID NO: 2578448 - RNA, 14 nt, Human
acacacuuuuuaag

SEQ ID NO: 2578449 - RNA, 15 nt, Human
acaccaauauucaua

SEQ ID NO: 2578450 - RNA, 13 nt, Human
acaccagagccca

SEQ ID NO: 2578451 - RNA, 23 nt, Human
acaccagagcccaccuuggcuca

SEQ ID NO: 2578452 - RNA, 18 nt, Human
acaccagagcccaccuug

SEQ ID NO: 2578453 - RNA, 22 nt, Human
acaccaagcugugccacccugg

SEQ ID NO: 2578454 - RNA, 21 nt, Human
acaccaagcugugccacccug

SEQ ID NO: 2578455 - RNA, 20 nt, Human
acaccaagcugugccacccu

SEQ ID NO: 2578456 - RNA, 18 nt, Human
acaccaagcugugccacc

SEQ ID NO: 2578457 - RNA, 17 nt, Human
acaccaagcugugccac

SEQ ID NO: 2578458 - RNA, 16 nt, Human
acaccaagcugugcca

SEQ ID NO: 2578459 - RNA, 16 nt, Human
acaccaagcagcaaca

SEQ ID NO: 2578460 - RNA, 13 nt, Human
acaccaagcagca

SEQ ID NO: 2578461 - RNA, 18 nt, Human
acaccaagcacagcagcc

SEQ ID NO: 2578462 - RNA, 19 nt, Human
acaccaagcacagcagccu

SEQ ID NO: 2578463 - RNA, 20 nt, Human
acaccaagcacagcagccug

SEQ ID NO: 2578464 - RNA, 21 nt, Human
acaccaagcacagcagccugg

SEQ ID NO: 2578465 - RNA, 14 nt, Human
acaccaagcacagc

SEQ ID NO: 2578466 - RNA, 16 nt, Human
acaccaagcacagcag

SEQ ID NO: 2578467 - RNA, 18 nt, Human
acacagcucuucuccagg

SEQ ID NO: 2578468 - RNA, 12 nt, Human
acacguguccug

SEQ ID NO: 2578469 - RNA, 20 nt, Human
acacguggaggaaugcuccc

SEQ ID NO: 2578470 - RNA, 21 nt, Human
acacguggaggaaugcucccc

SEQ ID NO: 2578471 - RNA, 22 nt, Human
acacguggaggaaugcuccccc

SEQ ID NO: 2578472 - RNA, 24 nt, Human
acacguggaggaaugcucccccau

SEQ ID NO: 2578473 - RNA, 22 nt, Human
acacgccugcaaacgcugccug

SEQ ID NO: 2578474 - RNA, 20 nt, Human
acacgcacgcacacacacaa

SEQ ID NO: 2578475 - RNA, 23 nt, Human
acacguacuuaaaugaaagcaug

SEQ ID NO: 2578476 - RNA, 14 nt, Human
acacguccacccca

SEQ ID NO: 2578477 - RNA, 13 nt, Human
acacgugagaauc

SEQ ID NO: 2578478 - RNA, 17 nt, Human
acacgucugacccucuc

SEQ ID NO: 2578479 - RNA, 19 nt, Human
acacgucugacccucucca

SEQ ID NO: 2578480 - RNA, 21 nt, Human
acacgugagaaucccuggcaa

SEQ ID NO: 2578481 - RNA, 16 nt, Human
acacgugagaaucccu

SEQ ID NO: 2578482 - RNA, 23 nt, Human
acacgugcaauuuguuugugcuu

SEQ ID NO: 2578483 - RNA, 17 nt, Human
acacguggaggaaugcu

SEQ ID NO: 2578484 - RNA, 14 nt, Human
acacgcaccugccu

SEQ ID NO: 2578485 - RNA, 16 nt, Human
acacgcaccugccuca

SEQ ID NO: 2578486 - RNA, 14 nt, Human
acacgcacgcacac

SEQ ID NO: 2578487 - RNA, 13 nt, Human
acacgcacgcaca

SEQ ID NO: 2578488 - RNA, 17 nt, Human
acacgcaccugccucag

SEQ ID NO: 2578489 - RNA, 13 nt, Human
acacgcaccugcc

SEQ ID NO: 2578490 - RNA, 12 nt, Human
acaccagccagg

SEQ ID NO: 2578491 - RNA, 19 nt, Human
acaccagcauuccuuuuga

SEQ ID NO: 2578492 - RNA, 14 nt, Human
acaccagcauuccu

SEQ ID NO: 2578493 - RNA, 16 nt, Human
acaccagcauuccuuu

SEQ ID NO: 2578494 - RNA, 19 nt, Human
acacgccuuguucuuggcc

SEQ ID NO: 2578495 - RNA, 18 nt, Human
acacgcacgcacacacac

SEQ ID NO: 2578496 - RNA, 17 nt, Human
acacgcacgcacacaca

SEQ ID NO: 2578497 - RNA, 16 nt, Human
acacgcacgcacacac

SEQ ID NO: 2578498 - RNA, 15 nt, Human
acacgcacgcacaca

SEQ ID NO: 2578499 - RNA, 19 nt, Human
acacgcaggaacucccagc

SEQ ID NO: 2578500 - RNA, 18 nt, Human
aauaaagaguuagaauga

SEQ ID NO: 2578501 - RNA, 15 nt, Human
aauaaagaguuagaa

SEQ ID NO: 2578502 - RNA, 14 nt, Human
aauaaagaucaugu

SEQ ID NO: 2578503 - RNA, 19 nt, Human
aauaaagaucauguaaaag

SEQ ID NO: 2578504 - RNA, 15 nt, Human
aauaaagcaauuuuc

SEQ ID NO: 2578505 - RNA, 13 nt, Human
aauaaagcaauuu

SEQ ID NO: 2578506 - RNA, 12 nt, Human
aauaaagcaauu

SEQ ID NO: 2578507 - RNA, 20 nt, Human
aauaaagaucauguaaaagu

SEQ ID NO: 2578508 - RNA, 13 nt, Human
aauaaagaaauug

SEQ ID NO: 2578509 - RNA, 12 nt, Human
aauaaagacagg

SEQ ID NO: 2578510 - RNA, 11 nt, Human
aauaaagacag

SEQ ID NO: 2578511 - RNA, 17 nt, Human
aauaaugugaaacugga

SEQ ID NO: 2578512 - RNA, 22 nt, Human
aauaaugugaaacuggauuaaa

SEQ ID NO: 2578513 - RNA, 14 nt, Human
aauaaagcagcguu

SEQ ID NO: 2578514 - RNA, 22 nt, Human
aauaaagcaauuuuccuugaag

SEQ ID NO: 2578515 - RNA, 18 nt, Human
aauaaagcaauuuuccuu

SEQ ID NO: 2578516 - RNA, 17 nt, Human
aauaaagcaauuuuccu

SEQ ID NO: 2578517 - RNA, 16 nt, Human
aauaaagcaauuuucc

SEQ ID NO: 2578518 - RNA, 24 nt, Human
aauaaagcaauuuuccuugaagcc

SEQ ID NO: 2578519 - RNA, 23 nt, Human
aauaaagcaauuuuccuugaagc

SEQ ID NO: 2578520 - RNA, 11 nt, Human
aauaaagcccu

SEQ ID NO: 2578521 - RNA, 19 nt, Human
aauaauguuaacauggaca

SEQ ID NO: 2578522 - RNA, 15 nt, Human
aauaaugugaaucau

SEQ ID NO: 2578523 - RNA, 12 nt, Human
aauaaacuuuuu

SEQ ID NO: 2578524 - RNA, 20 nt, Human
aauaaacuuuuuuuugagaa

SEQ ID NO: 2578525 - RNA, 17 nt, Human
aauaaacuuuuuuuuga

SEQ ID NO: 2578526 - RNA, 22 nt, Human
aauaaacuuagaauaaaauugu

SEQ ID NO: 2578527 - RNA, 13 nt, Human
aauaaacuuuaau

SEQ ID NO: 2578528 - RNA, 19 nt, Human
aauaaacacucuugaaaaa

SEQ ID NO: 2578529 - RNA, 13 nt, Human
aauaaacacugug

SEQ ID NO: 2578530 - RNA, 12 nt, Human
aauaaacacugu

SEQ ID NO: 2578531 - RNA, 12 nt, Human
aauaaacaggag

SEQ ID NO: 2578532 - RNA, 13 nt, Human
aauaaacauccuu

SEQ ID NO: 2578533 - RNA, 23 nt, Human
aauaaacauccuucaagaacucu

SEQ ID NO: 2578534 - RNA, 16 nt, Human
aauaaacacucuugaa

SEQ ID NO: 2578535 - RNA, 11 nt, Human
aauaaacacuc

SEQ ID NO: 2578536 - RNA, 23 nt, Human
aaguuuaaggaauaugggagaaa

SEQ ID NO: 2578537 - RNA, 10 nt, Human
aauaaacacu

SEQ ID NO: 2578538 - RNA, 17 nt, Human
aaguuguuugucaucuu

SEQ ID NO: 2578539 - RNA, 22 nt, Human
aaguuguuugagaaauuaagua

SEQ ID NO: 2578540 - RNA, 21 nt, Human
aaguuguuugagaaauuaagu

SEQ ID NO: 2578541 - RNA, 15 nt, Human
aaguuguuugagaaa

SEQ ID NO: 2578542 - RNA, 14 nt, Human
aaguuuaaggaaua

SEQ ID NO: 2578543 - RNA, 15 nt, Human
aaguuuaaggaauau

SEQ ID NO: 2578544 - RNA, 13 nt, Human
aaguuguuugcau

SEQ ID NO: 2578545 - RNA, 17 nt, Human
aaguuuaaagcucgaaa

SEQ ID NO: 2578546 - RNA, 23 nt, Human
aaguugguccuuuacacucaggc

SEQ ID NO: 2578547 - RNA, 12 nt, Human
aagugcugggau

SEQ ID NO: 2578548 - RNA, 17 nt, Human
aaguggacucagggcag

SEQ ID NO: 2578549 - RNA, 22 nt, Human
aaguggaccuuaggccuuccuc

SEQ ID NO: 2578550 - RNA, 20 nt, Human
aaguggaccaggacaggacc

SEQ ID NO: 2578551 - RNA, 20 nt, Human
aaguggacuggccccugggu

SEQ ID NO: 2578552 - RNA, 16 nt, Human
aaguggaggcacuuua

SEQ ID NO: 2578553 - RNA, 18 nt, Human
aaguggacuggccccugg

SEQ ID NO: 2578554 - RNA, 23 nt, Human
aaguggacucuuugguggcuuug

SEQ ID NO: 2578555 - RNA, 20 nt, Human
aaguggaccuugagaccaca

SEQ ID NO: 2578556 - RNA, 23 nt, Human
aaguugaauugaggggauuaaua

SEQ ID NO: 2578557 - RNA, 18 nt, Human
aaguugaagcuaagauuu

SEQ ID NO: 2578558 - RNA, 21 nt, Human
aaguugaauggccugccuuga

SEQ ID NO: 2578559 - RNA, 14 nt, Human
aaguggcugcugac

SEQ ID NO: 2578560 - RNA, 20 nt, Human
aaguugaaagaguccuauuu

SEQ ID NO: 2578561 - RNA, 17 nt, Human
aaguugaaauuaaccau

SEQ ID NO: 2578562 - RNA, 12 nt, Human
aaguggcugcug

SEQ ID NO: 2578563 - RNA, 17 nt, Human
aaguugaagcuaagauu

SEQ ID NO: 2578564 - RNA, 14 nt, Human
aaguggccucuuug

SEQ ID NO: 2578565 - RNA, 17 nt, Human
aaguggccucuuugucu

SEQ ID NO: 2578566 - RNA, 22 nt, Human
aaguggccucuuugucuaaaac

SEQ ID NO: 2578567 - RNA, 13 nt, Human
aaguggccucuuu

SEQ ID NO: 2578568 - RNA, 22 nt, Human
aagugcugcauuuaaaagauac

SEQ ID NO: 2578569 - RNA, 23 nt, Human
aagugcuggcaaccacuaagaau

SEQ ID NO: 2578570 - RNA, 21 nt, Human
aagugcuggcaccaccaggca

SEQ ID NO: 2578571 - RNA, 22 nt, Human
aagugcuggcaaccacuaagaa

SEQ ID NO: 2578572 - RNA, 23 nt, Human
aaucaccgaaaacguggcugcuu

SEQ ID NO: 2578573 - RNA, 16 nt, Human
aaucacgcuuuccuga

SEQ ID NO: 2578574 - RNA, 21 nt, Human
aaucaccgaaaacguggcugc

SEQ ID NO: 2578575 - RNA, 22 nt, Human
aaucaaugcuauaacuauguug

SEQ ID NO: 2578576 - RNA, 17 nt, Human
aaucaaugucacuuaaa

SEQ ID NO: 2578577 - RNA, 22 nt, Human
aauauuaaugccuuuaaaguau

SEQ ID NO: 2578578 - RNA, 15 nt, Human
aauauuaaugccuuu

SEQ ID NO: 2578579 - RNA, 21 nt, Human
aauauuuuuuuguagaugaaa

SEQ ID NO: 2578580 - RNA, 17 nt, Human
aauauuuuuuuguagau

SEQ ID NO: 2578581 - RNA, 18 nt, Human
aauauuuuuucuuuucua

SEQ ID NO: 2578582 - RNA, 10 nt, Human
aaucaaaacu

SEQ ID NO: 2578583 - RNA, 18 nt, Human
aaucaaaacucuccuaca

SEQ ID NO: 2578584 - RNA, 16 nt, Human
aaucaaagcaaugcau

SEQ ID NO: 2578585 - RNA, 16 nt, Human
aaucaaagacauggaa

SEQ ID NO: 2578586 - RNA, 20 nt, Human
aaucaaaauaacgccccaga

SEQ ID NO: 2578587 - RNA, 13 nt, Human
aaucaaaauaugu

SEQ ID NO: 2578588 - RNA, 19 nt, Human
aaucaauacacuaguuguu

SEQ ID NO: 2578589 - RNA, 20 nt, Human
aaucaauacacuaguuguuu

SEQ ID NO: 2578590 - RNA, 18 nt, Human
aaucaauacacuaguugu

SEQ ID NO: 2578591 - RNA, 14 nt, Human
aaucaauacacuag

SEQ ID NO: 2578592 - RNA, 12 nt, Human
aaucaauaauau

SEQ ID NO: 2578593 - RNA, 16 nt, Human
aaucaauaaacgauuu

SEQ ID NO: 2578594 - RNA, 22 nt, Human
aaucaaagcaaugcauuuugga

SEQ ID NO: 2578595 - RNA, 18 nt, Human
aaucaaagcaaugcauuu

SEQ ID NO: 2578596 - RNA, 23 nt, Human
aaucaaguuggcuucuaaucaaa

SEQ ID NO: 2578597 - RNA, 13 nt, Human
aaucaauaaacga

SEQ ID NO: 2578598 - RNA, 17 nt, Human
aauauauaaauauauau

SEQ ID NO: 2578599 - RNA, 13 nt, Human
aauauauaaauau

SEQ ID NO: 2578600 - RNA, 11 nt, Human
aauauauaaau

SEQ ID NO: 2578601 - RNA, 21 nt, Human
aauauauaaaaagaaaagaua

SEQ ID NO: 2578602 - RNA, 19 nt, Human
aauauauauaaauauauau

SEQ ID NO: 2578603 - RNA, 15 nt, Human
aauauauauaaauaa

SEQ ID NO: 2578604 - RNA, 13 nt, Human
aauauauauaaau

SEQ ID NO: 2578605 - RNA, 15 nt, Human
aauauauauaaaccu

SEQ ID NO: 2578606 - RNA, 14 nt, Human
aauauauauaaacc

SEQ ID NO: 2578607 - RNA, 13 nt, Human
aauauauauaaac

SEQ ID NO: 2578608 - RNA, 12 nt, Human
aauauauauaaa

SEQ ID NO: 2578609 - RNA, 14 nt, Human
aauauauaaauaua

SEQ ID NO: 2578610 - RNA, 23 nt, Human
aauauguggaguucaucuugaau

SEQ ID NO: 2578611 - RNA, 13 nt, Human
aauauguccuggg

SEQ ID NO: 2578612 - RNA, 14 nt, Human
aauauauauauccu

SEQ ID NO: 2578613 - RNA, 21 nt, Human
aauauauauauauauaaaaua

SEQ ID NO: 2578614 - RNA, 19 nt, Human
aauauauauauauauaaaa

SEQ ID NO: 2578615 - RNA, 18 nt, Human
aauauauauauauauaaa

SEQ ID NO: 2578616 - RNA, 16 nt, Human
aauauauauaaauaaa

SEQ ID NO: 2578617 - RNA, 22 nt, Human
aauauauauauauauaaaauaa

SEQ ID NO: 2578618 - RNA, 12 nt, Human
aauauguccugg

SEQ ID NO: 2578619 - RNA, 21 nt, Human
aauauguuaaccucaguguca

SEQ ID NO: 2578620 - RNA, 16 nt, Human
aauauguuagcaaaga

SEQ ID NO: 2578621 - RNA, 22 nt, Human
aauauguuaaccucagugucau

SEQ ID NO: 2578622 - RNA, 20 nt, Human
aauauguucuuuaaaaauau

SEQ ID NO: 2578623 - RNA, 19 nt, Human
aauauuaaauacagacacu

SEQ ID NO: 2578624 - RNA, 17 nt, Human
aauauuaaauacagaca

SEQ ID NO: 2578625 - RNA, 16 nt, Human
aauauuaaauacagac

SEQ ID NO: 2578626 - RNA, 14 nt, Human
aauauuaaauacag

SEQ ID NO: 2578627 - RNA, 13 nt, Human
aauauuaaauaca

SEQ ID NO: 2578628 - RNA, 22 nt, Human
aauauguugaugaaaaauagca

SEQ ID NO: 2578629 - RNA, 22 nt, Human
aauauuaaauacagacacuaag

SEQ ID NO: 2578630 - RNA, 20 nt, Human
aauauuaaauacagacacua

SEQ ID NO: 2578631 - RNA, 13 nt, Human
aauauuaaaucug

SEQ ID NO: 2578632 - RNA, 21 nt, Human
aauauuaaaucugcuggaguu

SEQ ID NO: 2578633 - RNA, 13 nt, Human
aauauuaagaaag

SEQ ID NO: 2578634 - RNA, 22 nt, Human
aaucucaccccaucccacaccc

SEQ ID NO: 2578635 - RNA, 22 nt, Human
aaucucagagguagggcugcca

SEQ ID NO: 2578636 - RNA, 23 nt, Human
aaucucagagguagggcugccac

SEQ ID NO: 2578637 - RNA, 22 nt, Human
aaucucagcaaugauuacucuu

SEQ ID NO: 2578638 - RNA, 16 nt, Human
aaucucaauauuucag

SEQ ID NO: 2578639 - RNA, 17 nt, Human
aaucucaauucuucccu

SEQ ID NO: 2578640 - RNA, 13 nt, Human
aaucucaccccau

SEQ ID NO: 2578641 - RNA, 13 nt, Human
aaucugacccagu

SEQ ID NO: 2578642 - RNA, 14 nt, Human
aaucugacccagug

SEQ ID NO: 2578643 - RNA, 15 nt, Human
aaucugacccagugc

SEQ ID NO: 2578644 - RNA, 17 nt, Human
aaucugacccagugccc

SEQ ID NO: 2578645 - RNA, 12 nt, Human
aaucugacccag

SEQ ID NO: 2578646 - RNA, 17 nt, Human
aaucugaggccuccucu

SEQ ID NO: 2578647 - RNA, 19 nt, Human
aaucugauuggacauuuuc

SEQ ID NO: 2578648 - RNA, 18 nt, Human
aaucugauuggacauuuu

SEQ ID NO: 2578649 - RNA, 17 nt, Human
aaucugauggcuucucc

SEQ ID NO: 2578650 - RNA, 16 nt, Human
aaugaagcuuguguau

SEQ ID NO: 2578651 - RNA, 15 nt, Human
aaugaagcuugugua

SEQ ID NO: 2578652 - RNA, 14 nt, Human
aaugaagcuugugu

SEQ ID NO: 2578653 - RNA, 12 nt, Human
aaugaagcuugu

SEQ ID NO: 2578654 - RNA, 22 nt, Human
aaugaagcagcuuuaaacaaau

SEQ ID NO: 2578655 - RNA, 19 nt, Human
aaugaagcagcuuuaaaca

SEQ ID NO: 2578656 - RNA, 15 nt, Human
aaugaagccuuagcc

SEQ ID NO: 2578657 - RNA, 22 nt, Human
aaugaagcuuguguauccauua

SEQ ID NO: 2578658 - RNA, 19 nt, Human
aaugaagcuuguguaucca

SEQ ID NO: 2578659 - RNA, 17 nt, Human
aaugaagcuuguguauc

SEQ ID NO: 2578660 - RNA, 18 nt, Human
aaugaaguuugaauguua

SEQ ID NO: 2578661 - RNA, 17 nt, Human
aaugaaguuugaauguu

SEQ ID NO: 2578662 - RNA, 14 nt, Human
aaugaagcaaugcu

SEQ ID NO: 2578663 - RNA, 17 nt, Human
aaugaaagcaugucuca

SEQ ID NO: 2578664 - RNA, 15 nt, Human
aaugaaagcaugugg

SEQ ID NO: 2578665 - RNA, 17 nt, Human
aaugaagcagcuuuaaa

SEQ ID NO: 2578666 - RNA, 15 nt, Human
aaugaagcagcuuua

SEQ ID NO: 2578667 - RNA, 19 nt, Human
aaugaaagaguaaaggaaa

SEQ ID NO: 2578668 - RNA, 21 nt, Human
aaugaaagacuguacaaagua

SEQ ID NO: 2578669 - RNA, 18 nt, Human
aaugaaagacuguacaaa

SEQ ID NO: 2578670 - RNA, 20 nt, Human
aaugaaagacuguacaaagu

SEQ ID NO: 2578671 - RNA, 20 nt, Human
aaugaauacuuuauaaagga

SEQ ID NO: 2578672 - RNA, 22 nt, Human
aaugaaguuugaauguuaaaua

SEQ ID NO: 2578673 - RNA, 21 nt, Human
aaugaaguuugaauguuaaau

SEQ ID NO: 2578674 - RNA, 20 nt, Human
aaugaaguuugaauguuaaa

SEQ ID NO: 2578675 - RNA, 19 nt, Human
aaugaaguuugaauguuaa

SEQ ID NO: 2578676 - RNA, 15 nt, Human
aaugaauaauaauua

SEQ ID NO: 2578677 - RNA, 16 nt, Human
aaugaauaauuuccca

SEQ ID NO: 2578678 - RNA, 21 nt, Human
aaugaauaauaauuauccaga

SEQ ID NO: 2578679 - RNA, 20 nt, Human
aaugauguauguugaagccu

SEQ ID NO: 2578680 - RNA, 18 nt, Human
aaugauggcaauuuugua

SEQ ID NO: 2578681 - RNA, 19 nt, Human
aaugauggcaauuuuguaa

SEQ ID NO: 2578682 - RNA, 20 nt, Human
aaugaugccaugaggaacaa

SEQ ID NO: 2578683 - RNA, 14 nt, Human
aaugauggcaauuu

SEQ ID NO: 2578684 - RNA, 17 nt, Human
aaugauggcaauuuugu

SEQ ID NO: 2578685 - RNA, 22 nt, Human
aaugauggacccaaugcacaca

SEQ ID NO: 2578686 - RNA, 15 nt, Human
aaugauggacccaau

SEQ ID NO: 2578687 - RNA, 22 nt, Human
aagccagugacuccaggagagg

SEQ ID NO: 2578688 - RNA, 17 nt, Human
aagccagugcggcaggu

SEQ ID NO: 2578689 - RNA, 18 nt, Human
aagccagugacuccagga

SEQ ID NO: 2578690 - RNA, 17 nt, Human
aagccagugacuccagg

SEQ ID NO: 2578691 - RNA, 21 nt, Human
aagccaggagcaaauguuucu
